United States Patent 11,078,247 (RNA ENCODING A THERAPEUTIC PROTEIN) - sequence listing, part 16

SEQ ID NO: 29340 - RNA, 1236 nt, Artificial Sequence
  derived and/or modified sequence opt1 from DPEP1__Homo_sapiens__NP_001121613
auguggagcggcugguggcuguggccccucguggccgucugcaccgccgacuucuuccgcgacgaggcggagcggaucaugcgcgacuccccggugaucgacgggcacaacgaccugcccuggcagcugcucgacauguucaacaaccggcugcaggacgagcgcgccaaccugaccacgcucgccggcacccacaccaacauccccaagcugcgggccggguucgugggcgggcaguucuggagcgucuacacccccugcgacacgcagaacaaggacgccgugcgccggacccuggagcagauggacgugguccaccgcaugugccggauguacccggagaccuuccucuacgugaccuccagcgcgggcauccgccaggccuuccgggagggcaagguggccucccugaucggggucgagggcgggcacagcaucgacuccagccugggcgugcuccgcgcccuguaccagcuggggaugcgguaccucacgcugacccacuccugcaacacccccugggcggacaacuggcugguggacaccggcgacagcgagccccagucccagggccucagccccuucgggcagcgcgucgugaaggagcugaaccggcugggcgugcucaucgaccuggcccacgucuccguggccacgaugaaggccacccugcagcucagccgcgccccggugaucuucucccacagcuccgcguacagcgucugcgccucccggcgcaacgugcccgacgacgugcugcggcuggucaagcagaccgacagccucgugauggugaacuucuacaacaacuacaucagcugcaccaacaaggccaaccugucccaggucgccgaccaccuggaccacaucaaggagguggccggggcgcgcgccgucggcuucggcggggacuucgacggcgugccccgggugcccgaggggcucgaggacgucagcaaguacccggaccugaucgccgagcugcuccgccgcaacuggacggaggccgaggugaagggcgcccuggcggacaaccugcuccggguguucgaggccgucgagcaggccuccaaccugacccaggcccccgaggaggagcccaucccccuggaccagcucgggggcagcugccgcacccacuacggcuacuccagcggggccuccagccugcaccggcacuggggccugcuccuggcgucccuggccccgcucgugcugugccugagccuccuguga

SEQ ID NO: 29341 - RNA, 1461 nt, Artificial Sequence
  derived and/or modified sequence opt1 from DPEP2__Homo_sapiens__NP_071750
augcagcccagcggccuggaggggccgggcaccuucgggcgcuggccccuccugucccugcuccugcugcuccugcugcuccagcccgugaccugcgccuacacgacccccggcccgccccgggcccugaccacccugggggcgccccgcgcccacacgaugcccggcaccuacgccccgagcaccacccucuccagccccuccacgcagggccugcaggagcaggcccgggcccugaugcgcgacuucccccucgucgacgggcacaacgaccugccccuggugcuccgccagguguaccagaagggccugcaggacgucaaccugcggaacuucagcuacgggcagaccucccucgaccggcugcgcgacggccuggugggggcgcaguucuggagcgccuacgugccgugccagacccaggaccgggacgcccuccgccugacccuggagcagaucgaccucauccggcgcaugugcgccuccuacagcgagcuggagcuggucacguccgcgaaggcccucaacgacacccagaagcuggccugccugaucggcguggagggcgggcacagccucgacaacucccugagcauccugcggaccuucuacaugcucggcgugcgcuaccugacccugacgcacacgugcaacacccccugggccgaguccagcgccaaggggguccacuccuucuacaacaacaucagcggccucaccgacuucggcgagaaggugguggcggagaugaaccggcuggggaugauggucgaccugucccacgugagcgacgccguggcccgccgggcccucgaggucagccaggcccccgugaucuucucccacagcgcggcccgcggcgugugcaacuccgcccggaacguccccgacgacauccugcagcugcucaagaagaacgggggcguggugauggucagccuguccaugggggugauccagugcaacccgagcgccaacguguccaccgucgccgaccacuucgaccacaucaaggcggugaucggcagcaaguucaucggcaucgggggcgacuacgacggggccggcaaguucccccaggggcuggaggacgucuccaccuaccccgugcucaucgaggagcugcugagccgcggcugguccgaggaggagcugcagggcgugcuccgggggaaccugcugcgcgucuuccgccagguggagaaggugcaggaggagaacaaguggcagagcccccucgaggacaaguucccggacgagcagcuguccagcuccugccacagcgaccugucccggcuccgccagcggcagagccugaccuccggccaggagcugaccgagauccccauccacuggacggccaagcuccccgccaaguggagcgucagcgaguccagcccccacauggccccggugcuggcgguggucgccaccuuccccgugcugauccucuggcuguga

SEQ ID NO: 29342 - RNA, 1542 nt, Artificial Sequence
  derived and/or modified sequence opt1 from DPEP3__Homo_sapiens__NP_071752
augauccgcacgccccugagcgccuccgcccaccggcuccugcugccgggcagccgcgggcggccgccccgcaacaugcagcccaccggccgggaggggucccgcgcgcucagccggcgcuaccugcggcgccugcuccugcugcuccugcugcuccugcugcggcagcccgugacccgcgccgagaccacccccggcgcgccccgggcccucuccacccuggggagccccucccuguucacgaccccgggcguccccagcgcccucaccacccccggccugacgacccccgggaccccgaagacccuggaccuccgcggccgggcccaggcccugaugcgcuccuucccccugguggacgggcacaacgaccucccccaggugcugcggcagcgcuacaagaacguccugcaggacgugaaccuccggaacuucagccacggccagacgucccuggaccgccugcgggacgggcucgugggcgcccaguucuggagcgccuccgucagcugccagucccaggaccagaccgcggugcgccuggcccuggagcagaucgaccucauccaccgcaugugcgccagcuacuccgagcuggagcuggugaccagcgccgagggccucaacuccagccagaagcuggccugccugaucggggucgagggcgggcacagccucgacuccagccuguccgugcugcggagcuucuacgugcucggcguccgcuaccugacccugacguucacgugcuccacccccugggcggagagcuccaccaaguuccggcaccacauguacaccaacgugagcggccucaccuccuucggggagaagguggucgaggagcugaaccgccugggcaugaugaucgaccucagcuacgccuccgacacccugauccggcgcgugcuggaggugagccaggccccggucaucuucucccacagcgccgcccgggcggugugcgacaaccugcucaacgugcccgacgacauccugcagcugcucaagaagaacgggggcaucgucauggugacccuguccaugggggugcugcagugcaaccuccuggccaacgucagcacgguggccgaccacuucgaccacauccgcgccgucaucggcuccgaguucaucggcaucgggggcaacuacgacgggaccggccgguucccccaggggcuggaggacgugagcaccuaccccgugcucaucgaggagcugcugucccgcagcuggagcgaggaggagcuccagggcguccugcggggcaaccugcuccgcguguuccgccagguggagaagguccgggaggagucccgggcccagagcccgguggaggcggaguuccccuacgggcagcuguccaccagcugccacucccaccuggugccccagaacggccaccaggccacgcaccucgaggucaccaagcagcccaccaaccgcgugccguggcggagcuccaacgccagccccuaccuggugcccgggcuggucgccgccgcgaccauccccacguucacccaguggcucugcuga

SEQ ID NO: 29343 - RNA, 1245 nt, Artificial Sequence
  derived and/or modified sequence opt1 from DPF1__Homo_sapiens__NP_001128627
augggcgggcugagcgcccgccccaccgccggccggaccgaccccgcggggacgugcuggggccaggaccccggguccaagauggccaccgugauccccggcccccucagccugggcgaggacuucuaccgcgaggccaucgagcacugccgguccuacaacgcccgccugugcgccgagcggagccuccgccugccguuccuggacucccagaccggggucgcgcagaacaacugcuacaucuggauggagaagacccaccggggccccgggcucgcccccggccagaucuacacguaccccgcccgcugcuggcggaagaagcgccggcugaacauccuggaggacccgcgccuccggcccugcgaguacaagaucgacugcgaggcgccccugaagaaggagggcgggcugcccgagggcccggugcucgaggcccugcugugcgccgagaccggggagaagaagaucgagcucaaggaggaggagaccaucauggacugccagaagcagcagcugcuggaguucccccacgaccucgagguggaggaccuggaggacgacaucccccgccggaagaaccgcgccaagggcaaggccuacgggaucggcggccugcggaagcgccaggacaccgccagccucgaggaccgggacaagcccuacgucugcgacaucugcgggaagcgcuacaagaaccggccgggccuguccuaccacuacacgcacacccaccuggcggaggaggagggggaggagaacgccgagcgccacgcccuccccuuccaccgcaagaacaaccacaagcaguucuacaaggagcuggccugggugcccgaggcccagcggaagcacaccgcgaagaaggcccccgacggcaccgugaucccgaacggguacugcgacuucugccugggcggcagcaagaagacggggugccccgaggaccucaucuccugcgccgacugcggccgcagcgggcaccccuccugccugcaguucaccgucaacaugaccgccgccgugcggaccuaccgcuggcagugcaucgagugcaagagcugcucccugugcggcacgagcgagaacgacgaccagcuccuguucugcgacgacugcgaccggggguaccacauguacugccuguccccgcccauggcggagccgcccgagggcagcugguccugccaccucugccugcgccaccugaaggagaaggccagcgccuacaucacccucaccuga

SEQ ID NO: 29344 - RNA, 1137 nt, Artificial Sequence
  derived and/or modified sequence opt1 from DPF3__Homo_sapiens__NP_001267471
auggccaccgugauccacaacccccugaaggcccucggcgaccaguucuacaaggaggcgaucgagcacugccgcagcuacaacucccggcugugcgccgagcgcagcguccggcugcccuuccucgacucccagaccgggguggcccagaacaacugcuacaucuggauggagaagcgccaccggggccccgggcuggcccccggccagcuguacacguaccccgcccgcugcuggcggaagaagcgccggcuccacccgcccgaggaccccaagcugcgccugcucgagaucaagcccgagguggagcugccgcugaagaaggacggguucaccagcgaguccaccacccucgaggcgcugcugcggggcgagggcgucgagaagaagguggacgcccgcgaggaggagagcauccaggagauccagcgggugcucgagaacgacgagaacgucgaggaggggaacgaggaggaggaccuggaggaggacauccccaagcgcaagaaccggacgcgcggccgggcccgcggguccgccggcgggcggcgccggcacgacgcggccagccaggaggaccacgacaagcccuacgugugcgacaucugcggcaagcgcuacaagaaccgccccggccuguccuaccacuacgcccacacccaccucgccagcgaggagggggacgaggcccaggaccaggagacccgguccccgcccaaccaccgcaacgagaaccaccggccccagaagggccccgacgggaccgugaucccgaacaacuacugcgacuucugccugggcggcagcaacaugaacaagaaguccgggcgccccgaggagcuggucagcugcgcggacugcggccgguccgggcaccccacgugccuccaguucacccugaacaugaccgaggccgugaagaccuacaaguggcagugcaucgagugcaagagcugcauccugugcggcacguccgagaacgacgaccagcuccuguucugcgacgacugcgaccgcggguaccacauguacugccugaacccgcccguggccgagccgcccgagggcagcugguccugccaccucugcugggagcugcugaaggagaaggccagcgccuucggcugccaggcguga

SEQ ID NO: 29345 - RNA, 1332 nt, Artificial Sequence
  derived and/or modified sequence opt1 from DPH1__Homo_sapiens__NP_001374
augcgccgccaggugauggccgcccuggucgugagcggcgccgccgagcagggcgggcgggacgggcccggccgggggcgcgccccgcggggccgcguggccaaccagaucccgcccgagauccucaagaacccccagcugcaggccgcgauccggguccugcccuccaacuacaacuucgagauccccaagaccaucuggcgcauccagcaggcccaggccaagaagguggcccuccagaugcccgagggccugcuccuguucgcgugcaccaucguggacauccuggagcgguucacggaggccgaggucauggugaugggggacgugaccuacggcgccugcugcgucgacgacuucaccgcccgcgcccugggggcggacuuccucgugcacuacggccacagcugccugauccccauggacaccuccgcccaggacuuccgggugcuguacgucuucguggacauccgcaucgacacgacccaccuccuggacagccugcggcucaccuucccgcccgccaccgcccuggcccugguguccacgauccaguucgucagcacccuccaggcggccgcccaggagcugaaggccgaguaccgcguguccgugccccagugcaagccccugagcccgggggagauccucggcugcaccagcccccggcuguccaaggaggucgaggccgugguguaccugggcgacgggcgcuuccaccucgaguccgucaugaucgcgaaccccaacgugcccgccuaccgguacgacccguacagcaaggugcugucccgcgagcacuacgaccaccagcggaugcaggccgcccgccaggaggccaucgcgaccgcccggagcgccaaguccuggggccugauccucgggacgcugggccgccagggcagccccaagauccuggagcaccucgagucccgccugcgggcccuggggcucagcuucguccgccugcugcucuccgagaucuuccccagcaagcugagccugcuccccgagguggacgucuggguccagguggcgugcccgcggcuguccaucgacuggggcaccgccuuccccaagccccugcucacccccuacgaggccgccguggcccugcgcgacaucagcuggcagcagccguaccccauggacuucuacgcgggguccagccugggccccuggaccgugaaccacgggcaggaccggcgcccccacgccccgggccggcccgcccgcggcaaggugcaggagggguccgcccggcccccgagcgccgucgcgugcgaggacugcuccugccgcgacgagaagguggcgccccucgcccccuga

SEQ ID NO: 29346 - RNA, 174 nt, Artificial Sequence
  derived and/or modified sequence opt1 from DPH3__Homo_sapiens__NP_001040899
auggccguguuccacgacgaggucgagaucgaggacuuccaguacgacgaggacagcgagaccuacuucuaccccugcccgugcggcgacaacuucuccaucaccaaggaccaguucgugugcggggagacggugcccgcccccagcgcgaacaaggagcuggucaagugcuga

SEQ ID NO: 29347 - RNA, 498 nt, Artificial Sequence
  derived and/or modified sequence opt1 from DPH6__Homo_sapiens__NP_001135444
augcgcguggccgcccugaucagcggcgggaaggacuccugcuacaacaugaugcagugcaucgcggccggccaccagaucgucgcccucgccaaccugcggcccgccgagaaccagguggggagcgacgagcuggacuccuacauguaccagaccgugggccaccacgcgaucgaccucuacgccgaggccauggcccugccccuguaccgccggaccauccgcgggcggagccucgacacgcgccaggucuacaccaagugcgagggcgacgagguggaggaccuguacgagcugcucaagcuggugaagggcaucacccggaugacccugcucgcggaguacgacgcccugaaccugcaggacuuccacaugcaccucaaggucgggucccaggccaucguguaccgcacgcccaacgagcugugcacccacagcaaguucgacaagcacaccuucccgcccuucaucuccgagaucgccaagugcgagguguga

SEQ ID NO: 29348 - RNA, 1359 nt, Artificial Sequence
  derived and/or modified sequence opt1 from DPH7__Homo_sapiens__NP_620133
augaugggcugcuucgcccugcagaccguggacaccgagcucacggccgacagcgucgaguggugcccccugcaggggugccgccaccuccucgcgugcggcaccuaccagcugcggcgcccggaggaccggcccgccgggccccagaacaagggcgggauggaggugaaggagccccaggugcgccugggccggcuguuccuguacuccuucaacgacaacaacagcauccacccgcuggucgaggugcagcgcaaggacaccuccgccauccucgacaugaaguggugccacauccccguggccggccacgcccugcuggggcucgcggacgccagcggcuccauccagcugcugcggcucgucgagagcgagaagucccacgugcuggagccccugagcucccucgcccuggaggagcagugccuggcccucagccuggacugguccaccgggaagacgggccgcgcgggggaccagccccugaagaucaucagcuccgacagcaccggccagcuccaccuccugauggugaacgagacccggccgcgccugcagaaggucgccuccuggcaggcccaccaguucgaggccuggaucgccgcguucaacuacuggcaccccgagaucguguacagcggcggggacgacggccugcugcgggggugggacacccgcgugcccggcaaguuccucuucacguccaagcggcacaccaugggcgucugcagcauccaguccagcccccaccgcgagcacauccuggccaccgggagcuacgacgagcacauccugcucugggacacccggaacaugaagcagccgcuggccgacacgcccgugcagggcgggguguggcgcaucaaguggcaccccuuccaccaccaccuccugcuggccgccugcaugcacuccggcuucaagauccugaacugccagaaggcgauggaggagcggcaggaggccaccguccucaccagccacacccugcccgacucccugguguacggggccgacuggagcuggcuccuguuccgcucccugcagcgggccccgagcugguccuuccccagcaaccucggcacgaagaccgccgaccugaagggcgcguccgagcugcccacccccugccacgagugccgcgaggacaacgacggggagggccacgcccggccgcagagcgggaugaagccccucaccgagggcaugcgcaagaacgggacguggcugcaggccaccgccgccaccacccgcgacugcggcgugaaccccgaggaggcggacuccgccuucagccugcuggccacgugcuccuucuacgaccacgcccuccaccugugggagugggagggcaacuga

SEQ ID NO: 29349 - RNA, 783 nt, Artificial Sequence
  derived and/or modified sequence opt1 from DPM1__Homo_sapiens__NP_003850
auggccagccuggaggugucccgcagcccccggcgcucccggcgcgagcucgagguccggagcccgcgccagaacaaguacuccgugcugcugcccaccuacaacgagcgggagaaccucccccugaucguguggcugcucgucaagagcuucuccgagagcggcaucaacuacgagaucaucaucaucgacgacgggucccccgacggcacccgcgacguggccgagcagcuggagaagaucuacgggagcgaccggauccugcuccgcccgcgggagaagaagcugggccuggggacggcguacauccacggcaugaagcacgccaccggcaacuacaucaucaucauggacgccgaccucucccaccaccccaaguucauccccgaguucauccgcaagcagaaggaggggaacuucgacaucgugagcggcacccgguacaaggggaacggcggggucuacggcugggaccugaagcgcaagaucaucucccggggcgccaacuuccugacccagauccuccugcgccccggggccagcgaccugacgggcuccuuccggcucuaccgcaaggaggugcuggagaagcugaucgagaagugcgugagcaagggguacgucuuccagauggagaugaucgugcgggcgcgccagcucaacuacaccaucggcgaggugccgaucuccuucgucgaccggguguacggcgagagcaagcucgggggcaacgagaucguguccuuccugaaggggcugcugacccuguucgccaccacguga

SEQ ID NO: 29350 - RNA, 255 nt, Artificial Sequence
  derived and/or modified sequence opt1 from DPM2__Homo_sapiens__NP_003854
auggccaccggcaccgaccagguggucgggcugggccucguggccgugagccugaucaucuucacguacuacaccgcgugggucauccugcuccccuucaucgacucccagcacgugauccacaaguacuuccugccgcgcgccuacgccguggccaucccccuggccgcggggcuccugcugcuccuguucgucggccuguucaucagcuacgugaugcucaagaccaagcgggugaccaagaaggcccaguga

SEQ ID NO: 29351 - RNA, 369 nt, Artificial Sequence
  derived and/or modified sequence opt1 from DPM3__Homo_sapiens__NP_061846
augcugagcgugggcgggcuccgccugucccugguccgguucagcuuccuccugcugcgcggcgcccuccugcccucccuggccgugaccaugaccaagcucgcgcaguggcugugggggcuggccauccucggcagcacguggguggcccugaccaccggggcccugggccucgagcugccgcuguccugccaggagguccucuggccccugcccgccuaccugcucgugagcgcgggcugcuacgcccuggggaccgugggcuaccgggucgccacguuccacgacugcgaggacgccgcgcgcgagcugcagucccagauccaggaggcccgggccgaccucgcccgccgggggcugcgcuucuga

SEQ ID NO: 29352 - RNA, 2403 nt, Artificial Sequence
  derived and/or modified sequence opt1 from DPP10__Homo_sapiens__NP_001171505
augaccgccgccaagcaggagccccagccgacccccggcgcgcgcgccagccaggcccagcccgccgaccaggagcugggguccaacagcccgccccagcggaacuggaagggcaucgccaucgcgcuccuggugauccuggucgugugcucccucaucacgaugagcgugauccugcugacccccgacgagcucaccaacuccagcgagacccgccugucccuggaggaccucuuccggaaggacuucguccugcacgaccccgaggcccgcuggaucaacgacacggacgugguguacaagagcgagaacgggcacgucaucaagcugaacaucgagaccaacgccaccacccuccugcuggagaacacgaccuucgugaccuucaaggccucccggcacagcgugucccccgaccucaaguacguccugcuggcguacgacgugaagcagaucuuccacuacagcuacaccgccuccuacgugaucuacaacauccacacgcgcgaggucugggagcucaacccgcccgagguggaggacagcgugcugcaguacgccgccuggggcguccaggggcagcagcugaucuacaucuucgagaacaacaucuacuaccagcccgacaucaaguccagcucccuccggcugaccagcuccggcaaggaggagaucaucuucaacggcaucgccgacuggcuguacgaggaggagcuccugcacagccacaucgcgcacugguggagccccgacggggagcgccuggccuuccucaugaucaacgacucccuggugccgaccauggugaucccccgguucaccggcgcccuguaccccaaggggaagcaguaccccuacccgaaggccggccaggucaaccccacgaucaagcucuacguggugaaccuguacgggcccacccacacccuggagcucaugcccccggacagcuucaagucccgcgaguacuacaucaccauggucaagugggugagcaacacgaagaccgugguccgguggcugaaccgcgcccagaacaucuccauccugaccgugugcgagaccacgaccggcgcgugcagcaagaaguacgagaugaccuccgacaccuggcucagccagcagaacgaggagcccgucuucucccgggacggcagcaaguucuucaugacggugcccgugaagcagggcgggcgcggggaguuccaccacaucgccauguuccugauccaguccaagagcgagcagaucaccguccggcaccugaccuccggcaacugggaggugaucaagauccucgccuacgacgagaccacgcagaagaucuacuuccugagcaccgaguccagcccccgcggccggcagcuguacuccgccagcaccgaggggcuccugaaccgccagugcaucuccugcaacuucaugaaggagcagugcaccuacuucgacgccagcuucagcccgaugaaccagcacuuccuccuguucugcgagggcccccgggugcccgucgugucccugcacagcacggacaaccccgcgaaguacuucauccuggaguccaacagcaugcucaaggaggccauccugaagaagaagaucgggaagccggagaucaagauccugcacaucgacgacuacgagcugccccuccagcugucccugcccaaggacuucauggaccgcaaccaguacgcccuccugcugaucauggacgaggagccgggcgggcagcucgugaccgacaaguuccacaucgacugggacagcguccugaucgacauggacaacgugaucguggcccgguucgacggccgcggcuccggguuccagggccugaagauccuccaggagauccaccgccggcuggggagcgucgaggugaaggaccagaucaccgccgugaaguuccugcucaagcugcccuacaucgacuccaagcgccugagcaucuucggcaagggguacggcggcuacaucgcguccaugauccucaagagcgacgagaagcuguucaagugcggguccgucguggcccccaucaccgaccugaagcucuacgccagcgccuucuccgagcgguaccugggcaugcccagcaaggaggaguccaccuaccaggcggccagcgugcugcacaacguccacgggcucaaggaggagaacauccugaucauccacggcacggccgacaccaaggugcacuuccagcacagcgccgagcugaucaagcaccucaucaaggccggggugaacuacaccaugcaggucuacccggacgagggccacaacguguccgagaaguccaaguaccaccuguacagcaccauccugaaguucuucagcgacugccucaaggaggagaucuccgugcugccccaggagcccgaggaggacgaguga

SEQ ID NO: 29353 - RNA, 2124 nt, Artificial Sequence
  derived and/or modified sequence opt1 from DPP3__Homo_sapiens__NP_001243599
auggccgacacccaguacauccugcccaacgacaucggcgugagcucccucgacugccgcgaggccuuccggcugcugagcccgaccgagcgccucuacgcguaccaccugucccgggccgccugguacgggggccuggccguccuccugcagacgagccccgaggcccccuacaucuacgcgcugcucucccgccuguuccgggcccaggaccccgaccagcugcgccagcacgcccucgccgaggggcugaccgaggaggaguaccaggagaagcuggagcgggugauccucggcagcgaggcggcccagcagcacccggaggaggugcgcgggcuguggcagaccugcggcgagcugauguucucccucgagccccggcugcgccaccugggccucgggaaggagggcaucaccacguacuucagcgggaacugcaccauggaggacgccaagcuggcccaggacuuccuggacucccagaaccucagcgccuacaacacccggcuguucaaggaggucgacggcgaggggaagcccuacuacgaggugcgccuggcguccgugcucggcagcgagcccucccuggacagcgaggucaccuccaagcucaagagcuacgaguuccggggcuccccguuccaggugacgcgcggggacuacgcccccauccugcagaagguggucgagcagcuggagaaggccaaggccuacgccgcgaacagccaccagggccagaugcuggcccaguacaucgaguccuucacccaggggagcaucgaggcccacaagcggggcagccgcuucuggauccaggacaagggccccaucguggaguccuacaucggguucaucgagagcuaccgggaccccuucggcucccgcggggaguucgagggcuucguggccgucgugaacaaggccaugagcgcgaaguucgagcggcucguggccuccgccgagcagcugcugaaggagcucccguggccgcccaccuucgagaaggacaaguuccugacccccgacuucacgagccuggacguccucaccuucgccggguccggcauccccgccggcaucaacauccccaacuacgacgaccugcgccagaccgagggguucaagaacgugagccugggcaacgugcucgcggucgccuacgccacccagcgggagaagcugacguuccuggaggaggacgacaaggaccucuacauccuguggaaggggcccuccuucgacguccaggugggccugcacgagcuccuggggcacggcagcggcaagcuguucgugcaggacgagaagggggccuucaacuucgaccaggagaccgugaucaaccccgagaccggcgagcagauccaguccugguaccgcagcggggagaccugggacuccaaguucagcacgaucgcguccagcuacgaggagugccgcgccgaguccgugggccuguaccucugccugcacccgcagguccuggagaucuucggguucgagggcgccgacgccgaggacgugaucuacgucaacuggcucaacauggugcgggccggccugcuggcgcucgaguucuacacccccgaggccuucaacuggcgccaggcccacaugcaggcccgguucgugauccugcgcguccugcucgaggccggggagggccuggugaccaucacccccacgaccgggagcgacggccggcccgacgcgcgcgugcggcuggaccgcuccaagauccggagcgucggcaagccggcccucgagcgcuuccugcggcgccugcagguccucaagagcaccggggacguggccggcgggcgggcccuguacgagggcuacgccaccgugacggacgcgccgcccgagugcuuccugacccuccgcgacaccgugcugcugcggaaggagucccgcaagcucaucgugcagcccaacacccggcuggaggggagcgacguccagcugcucgaguacgaggccuccgccgccggccugauccgcagcuucuccgagcgguuccccgaggacggccccgagcuggaggagauccucacgcagcuggcgaccgccgacgcccgcuucuggaaggggcccagcgaggccccguccggccaggccuga

SEQ ID NO: 29354 - RNA, 2301 nt, Artificial Sequence
  derived and/or modified sequence opt1 from DPP4__Homo_sapiens__NP_001926
augaagacccccuggaaggugcugcucggccugcugggggccgccgcgcucgucaccaucaucacggugccggugguccugcugaacaagggcaccgacgacgccaccgccgacagccgcaagaccuacacgcucaccgacuaccugaagaacaccuaccggcugaagcucuacucccugcgcuggaucagcgaccacgaguaccuguacaagcaggagaacaacauccucguguucaacgccgaguacgggaacuccagcguguuccuggagaacuccaccuucgacgaguucggccacagcaucaacgacuacuccaucagccccgacgggcaguucauccugcucgaguacaacuacgucaagcaguggcggcacuccuacacggccagcuacgacaucuacgaccugaacaagcgccagcugaucaccgaggagcggauccccaacaacacccagugggugaccuggucccccgugggccacaagcucgcguacgucuggaacaacgacaucuacgugaagaucgagccgaaccugcccagcuaccgcaucacguggaccggcaaggaggacaucaucuacaacgggaucaccgacuggguguacgaggaggaggucuucuccgccuacagcgcccugugguggucccccaacggcaccuuccucgccuacgcgcaguucaacgacacggaggugccccugaucgaguacagcuucuacuccgacgagagccugcaguacccgaagaccgugcggguccccuaccccaaggccggggccgugaaccccaccgugaaguucuucgucgugaacaccgacucccucagcagcgugacgaacgccaccuccauccagaucaccgccccggcgagcaugcugaucggcgaccacuaccugugcgacgucaccugggccacgcaggagcgcaucucccuccaguggcugcggcgcauccagaacuacagcgugauggacaucugcgacuacgacgaguccagcgggcgguggaacugccugguggcccgccagcacaucgagauguccaccaccggcugggucggccgguuccgccccagcgagccccacuucacccucgacgggaacuccuucuacaagaucaucagcaacgaggagggcuaccggcacaucugcuacuuccagaucgacaagaaggacugcacguucaucaccaaggggaccugggaggugaucggcaucgaggcccugaccuccgacuaccuguacuacaucagcaacgaguacaagggcaugcccgggggccgcaaccucuacaagauccagcuguccgacuacacgaaggugaccugccugagcugcgagcucaacccggagcggugccaguacuacuccgugagcuucuccaaggaggccaaguacuaccagcugcgcugcagcgggcccggccugccccucuacacccugcacuccagcgugaacgacaaggggcugcggguccucgaggacaacagcgcgcuggacaagaugcugcagaacgugcagaugcccuccaagaagcucgacuucaucauccugaacgagaccaaguucugguaccagaugauccugccgccccacuucgacaagagcaagaaguacccccuccugcuggacguguacgccggccccugcucccagaaggccgacacggucuuccgccugaacugggccaccuaccucgccagcaccgagaacaucaucguggcguccuucgacggccgggggagcggcuaccagggggacaagaucaugcacgccaucaaccgccgccugggcaccuucgagguggaggaccagaucgaggccgcccggcaguucuccaagaugggguucgucgacaacaagcgcaucgccaucuggggcuggagcuacggcggguacgugaccuccauggugcugggcagcggguccggcgucuucaagugcgggaucgcgguggccccggugagccggugggaguacuacgacuccgucuacacggagcgcuacaugggccuccccacccccgaggacaaccuggaccacuaccggaacagcaccgugaugucccgcgccgagaacuucaagcaggucgaguaccugcucauccacggcaccgccgacgacaacguccacuuccagcagagcgcgcagaucuccaaggcccugguggacgugggggucgacuuccaggccaugugguacacggacgaggaccacggcaucgccagcagcaccgcccaccagcacaucuacacccacaugucccacuucaucaagcagugcuucagccugcccuga

SEQ ID NO: 29355 - RNA, 2406 nt, Artificial Sequence
  derived and/or modified sequence opt1 from DPP6__Homo_sapiens__NP_001034439
augaaggagaaggccaugaucaagaccgccaagaugcagggcaacgugauggagcuggucgggagcaacccgccccagcgcaacuggaagggcaucgcgaucgcccuccuggugauccuggugaucugcucccucaucgucaccagcgugauccugcugacgcccgccgaggacaacucccucagccagaagaagaaggugaccgucgaggaccuguucuccgaggacuucaagauccacgaccccgaggccaaguggaucagcgacaccgaguucaucuaccgggagcagaaggggaccgugcgccuguggaacguggagacgaacaccuccaccguccucaucgagggcaagaagaucgagagccugcgggccauccgcuacgagaucucccccgaccgggaguacgcgcuguucagcuacaacguggagccgaucuaccagcacuccuacaccggguacuacgugcucagcaagaucccccacggcgacccccagucccuggacccgcccgaggucagcaacgccaagcugcaguacgccggcugggggcccaagggccagcagcucaucuucaucuucgagaacaacaucuacuacugcgcccacguggggaagcaggcgauccgcguggucuccacgggcaaggagggggugaucuacaacggccugagcgacuggcuguacgaggaggagauccucaagacccacaucgcccacugguggucccccgacggcacccggcuggccuacgccgccaucaacgacagccgcgugcccaucauggagcugccgaccuacacgggguccaucuaccccaccgucaagcccuaccacuaccccaaggcgggcagcgagaacccgagcaucucccuccacgugaucgggcugaacggccccacccacgaccuggagaugaugccgcccgacgacccccggaugcgcgaguacuacaucaccauggugaagugggccacgagcaccaaggucgccgugaccuggcucaaccgggcccagaacguguccauccugacccugugcgacgccacgaccggcgucugcaccaagaagcacgaggacgagagcgaggcguggcuccaccgccagaacgaggagcccguguucuccaaggacgggcggaaguucuucuucauccgcgccaucccccagggcgggcggggcaaguucuaccacaucaccgucagcuccagccagcccaacuccagcaacgacaacauccaguccaucacgagcggggacugggacgugaccaagauccuggccuacgacgagaagggcaacaagaucuacuuccuguccaccgaggaccucccgcgccggcgccagcuguacagcgccaacaccgugggcaacuucaaccggcagugccuguccugcgaccucgucgagaacugcacguacuucagcgccuccuucagccacuccauggacuucuuccugcugaagugcgaggggcccggcgugcccauggugaccguccacaacaccaccgacaagaagaagauguucgaccucgagacgaacgagcacgugaagaaggcgaucaacgaccgccagaugcccaagguggaguaccgggacaucgagaucgacgacuacaaccugccgaugcagauccugaagcccgccaccuucaccgacaccacgcacuacccccuccugcuggucguggacgggaccccgggcagccagagcguggccgagaaguucgaggucuccugggagaccgugauggugagcucccacggggccgucguggugaagugcgacggccgcggcagcggguuccagggcaccaagcuccugcacgagguccgccggcgccuggggcuccuggaggagaaggaccagauggaggccgugcggaccaugcugaaggagcaguacaucgaccgcacgcggguggcggucuucggcaaggacuacgggggcuaccucuccaccuacauccugcccgccaagggcgagaaccaggggcagaccuucacgugcggcagcgcccugucccccaucaccgacuucaagcuguacgccagcgcguucuccgagcgcuaccucgggcugcacggccuggacaaccgggccuacgagaugaccaagguggcccaccgcgugagcgcccucgaggagcagcaguuccugaucauccaccccaccgccgacgagaagauccacuuccagcacaccgcggagcugaucacgcagcucauccggggcaaggccaacuacucccugcagaucuacccggacgagagccacuacuucaccuccagcucccugaagcagcaccucuaccgcagcaucaucaacuucuucgucgagugcuuccggauccaggacaagcugcugaccgugaccgccaaggaggacgaggaggaggacuga

SEQ ID NO: 29356 - RNA, 1479 nt, Artificial Sequence
  derived and/or modified sequence opt1 from DPP7__Homo_sapiens__NP_037511
augggcagcgcccccugggccccggugcugcuccuggcgcuggggcuccgcggccugcaggccggggcccggcgcgcccccgaccccggcuuccaggagcgguucuuccagcagcgccuggaccacuucaacuucgagcgguucgggaacaagaccuucccccagcgcuuccucgucuccgaccgguucugggugcgcggcgagggcccgaucuucuucuacaccgggaacgagggcgacgugugggccuucgcgaacaacagcgccuucgucgccgagcuggccgcggagcgcggggcccugcucguguucgccgagcaccgguacuacggcaagucccugcccuucggggcccagagcacgcagcggggccacaccgagcugcucaccguggagcaggcccuggcggacuucgccgagcugcuccgcgcccugcggcgcgaccugggcgcccaggacgcccccgcgaucgccuucgggggcuccuacgggggcaugcucagcgccuaccugcggaugaaguacccccaccuggucgccggcgcccucgcggccuccgccccggugcuggccguggccgggcugggcgacagcaaccaguucuuccgcgacgucaccgcggacuucgaggggcagucccccaagugcacgcagggcgugcgggaggccuuccgccagaucaaggaccucuuccugcagggggccuacgacaccgugcggugggaguucgggaccugccagccccugagcgacgagaaggaccucacccagcuguucauguucgcccgcaacgcguucacgguccuggccaugauggacuaccccuacccgaccgacuuccucggcccccugcccgccaaccccgugaagguggggugcgaccggcugcucuccgaggcccagcgcaucaccggccugcgcgcccuggcggggcucgucuacaacgccagcggcuccgagcacugcuacgacaucuaccggcuguaccacagcugcgccgacccgaccgggugcggcacgggccccgacgcccgcgccugggacuaccaggcgugcaccgagaucaaccugaccuucgccuccaacaacgugaccgacauguuccccgaccuccccuucacggacgagcugcggcagcgcuacugccuggacaccuggggcguguggccgcggcccgacuggcuccugaccagcuucuggggcggggaccugcgcgccgccuccaacaucaucuucagcaacggcaaccucgaccccugggccgggggcggcauccggcgcaaccuguccgcgagcgucaucgccgugaccauccagggcggggcccaccaccuggaccuccgggccagccaccccgaggacccggcguccguggucgaggcccgcaagcuggaggccacgaucaucggggagugggugaaggccgcccggcgcgagcagcagcccgcgcugcggggcggcccccgccugagccucuga

SEQ ID NO: 29357 - RNA, 2349 nt, Artificial Sequence
  derived and/or modified sequence opt1 from DPP8__Homo_sapiens__NP_060213
auggccgccgcgauggagaccgagcagcugggcguggagaucuucgagaccgccgacugcgaggagaacaucgagagccaggaccgccccaagcucgagccguucuacgucgagcgguacuccuggagccagcugaagaagcugcucgccgacacgcgcaaguaccacggguacaugauggccaaggcgccccacgacuucauguucgugaagcggaacgaccccgacggcccccacuccgaccgcaucuacuaccuggccaugagcggggagaaccgggagaacacccuguucuacuccgagaucccgaagaccaucaaccgcgccgccgugcucaugcugagcuggaagccccugcucgaccuguuccaggccacccuggacuacggcauguacucccgggaggaggagcuccugcgcgagcggaagcgcaucgggacggucggcaucgcgagcuacgacuaccaccagggcuccgggaccuuccuguuccaggccggcagcgggaucuaccacgugaaggacggcgggccccagggcuucacccagcagccccuccggccgaaccugguggagaccuccugccccaacauccgcauggaccccaagcugugccccgccgacccggacuggaucgccuucauccacagcaacgacaucuggaucuccaacaucgucacgcgggaggagcgccggcucaccuacgugcacaacgagcuggccaacauggaggaggacgcgcgcagcgccggcguggccaccuucguccugcaggaggaguucgaccgguacuccggguacugguggugccccaaggccgagaccacgcccagcggcgggaagauccuccgcauccuguacgaggagaacgacgaguccgagguggagaucauccacgugaccagccccaugcuggagacccggcgcgccgacuccuuccgguacccgaagaccggcacggcgaaccccaaggucaccuucaagaugagcgagaucaugaucgacgccgagggccgcaucaucgacgugaucgacaaggagcucauccagcccuucgagauccuguucgaggggguggaguacaucgcccgcgccggcuggacccccgaggggaaguacgccuggagcauccugcucgaccggucccagacccgccugcagaucguccugaucagcccggagcuguucauccccguggaggacgacgugauggagcggcagcgccucaucgaguccguccccgacagcgugacgccccugaucaucuacgaggagaccaccgacaucuggaucaacauccacgacaucuuccacguguucccgcagucccacgaggaggagaucgaguucaucuucgcgagcgagugcaagaccggcuuccggcaccucuacaagaucacguccauccugaaggagagcaaguacaagcgcuccagcgggggccugcccgcccccuccgacuucaagugccccaucaaggaggagaucgccaucaccagcggcgagugggagguccucgggcggcacggcuccaacauccagguggacgaggugcgccggcuggucuacuucgaggggaccaaggacagcccgcuggagcaccaccucuacguggucuccuacgugaaccccggcgaggugacccgccugacggaccggggguacagccacuccugcugcaucagccagcacugcgacuucuucaucuccaaguacagcaaccagaagaacccccacugcgucagccuguacaagcucuccagcccggaggacgaccccacgugcaagaccaaggaguucugggccaccauccuggacuccgccggcccccugcccgacuacaccccgcccgagaucuucagcuucgaguccaccaccggcuucacccucuacgggaugcuguacaagccccacgaccugcagcccggcaagaaguacccgacgguccucuucaucuacgggggcccccagguggcgaucgccggggcccccgugacccuguggaucuucuacgacaccggcuacaccgagcgcuacaugggccaccccgaccagaacgagcagggguacuaccugggcagcguggccaugcaggcggagaaguucccguccgagcccaaccggcugcuccugcugcacggguuccucgacgagaacgugcacuucgcccacaccagcauccugcuguccuuccucguccgcgccggcaagcccuacgaccugcagaucuacccccaggagcggcacagcauccgcgugccggaguccggcgagcacuacgagcugcaccuccugcacuaccugcaggagaaccucgggagccggaucgccgcccugaaggugaucuga

SEQ ID NO: 29358 - RNA, 2679 nt, Artificial Sequence
  derived and/or modified sequence opt1 from DPP9__Homo_sapiens__XP_005259730
augcgcaaggugaagaagcugcggcucgacaaggagaacaccggcagcuggcgcuccuucagccugaacuccgagggggccgagcggauggccaccacgggcacccccaccgcggaccgcggggacgccgccgccaccgacgacccggccgcgcgguuccagguccagaagcacagcugggacggccugcgcuccaucauccacgggagccggaaguacuccggccucaucgugaacaaggcgccccacgacuuccaguucgugcagaagacggacgagagcggcccccacucccaccgccuguacuaccuggggaugcccuacggcagccgggagaacucccuccuguacagcgagaucccgaagaagguccgcaaggaggcccugcuccugcuguccuggaagcagaugcucgaccacuuccaggccacgccccaccacgggguguacagccgggaggaggagcugcugcgcgagcggaagcgccucggcguguucgggaucaccuccuacgacuuccacagcgaguccggccuguuccuguuccaggccagcaacucccucuuccacugccgggacggcgggaagaacggcuucauggucagccccaugaagccccuggagaucaagacccagugcagcgggccgcgcauggaccccaagaucugccccgccgaccccgccuucuucuccuucaucaacaacagcgaccuguggguggccaacaucgagaccggcgaggagcggcgccucaccuucugccaccagggccuguccaacgugcuggacgaccccaagagcgccggggucgcgaccuucgugauccaggaggaguucgaccgguucaccggcuacugguggugccccacggccuccugggaggggagcgagggccucaagacccugcgcauccuguacgaggagguggacgaguccgaggucgaggugauccacgugcccagccccgcccucgaggagcggaagaccgacuccuaccgcuacccgcgcaccgggagcaagaaccccaagaucgcccugaagcuggccgaguuccagacggacucccagggcaagaucgucagcacccaggagaaggagcucgugcagcccuucuccagccuguuccccaagguggaguacaucgcgcgggccggcuggacccgcgacgggaaguacgccugggccauguuccuggaccggccgcagcaguggcuccagcugguccugcucccgcccgcccuguucauccccuccaccgagaacgaggagcagcgccuggcgagcgcccgggccgugccgcgcaacgugcagcccuacgucguguacgaggaggugacgaacgucuggaucaacgugcacgacaucuucuaccccuucccccaguccgagggcgaggacgagcucugcuuccugcgggccaacgagugcaagaccggguucugccaccuguacaaggucaccgccgugcucaagagccagggcuacgacugguccgagccguucagccccggggaggacgaguucaagugccccaucaaggaggagaucgcgcugaccagcggcgagugggaggugcuggcccgccacggcuccaagaucugggucaacgaggagacgaagcucguguacuuccaggggaccaaggacaccccgcuggagcaccaccuguacguggucagcuacgaggccgccggcgagaucgugcggcucaccacgcccggguucucccacagcugcuccaugagccagaacuucgacauguucgugucccacuacagcuccgucagcaccccgcccugcgugcacguguacaagcuguccggccccgacgacgacccccugcacaagcagccccgcuucugggcgagcaugauggaggccgccuccugcccgcccgacuacgucccgcccgagaucuuccacuuccacacccggagcgacgugcgccuguacgggaugaucuacaagccccacgcccuccagcccggcaagaagcaccccaccgugcuguucgucuacggcgggccccaggugcagcuggugaacaacuccuucaagggcaucaaguaccuccggcugaacacgcuggccagccucggguacgcggucguggugaucgacggccgcggcuccugccagcgggggcugcgcuucgagggcgcccugaagaaccagauggggcaggucgagaucgaggaccagguggagggccuccaguucguggccgagaaguacggguucaucgaccugagccgggucgccauccacggcuggagcuacggcggguuccugucccucaugggccugauccacaagccccagguguucaagguggccaucgcgggggccccggucaccguguggauggccuacgacaccggcuacaccgagcgcuacauggacgugcccgagaacaaccagcacggguacgaggccggcagcgucgcccugcacguggagaagcuccccaacgagcccaaccggcugcugauccuccacggcuuccuggacgagaacgugcacuucuuccacacgaacuuccuggucucccagcucauccgcgcggggaagccguaccagcugcagaucuaccccaacgagcgccacagcauccggugccccgaguccggcgagcacuacgaggugacccugcuccacuuccugcaggaguaccuguga

SEQ ID NO: 29359 - RNA, 897 nt, Artificial Sequence
  derived and/or modified sequence opt1 from DPPA2__Homo_sapiens__NP_620170
augagcgacgccaaccuggacuccagcaagaagaacuuccucgagggcgagguggacgacgaggaguccgucauccugacccuggugcccgugaaggacgacgccaacauggagcagauggagccgagcgucuccagcaccuccgacgugaagcucgagaagcccaagaaguacaaccccgggcaccuccugcagacgaacgagcaguucaccgcgccccagaaggcccgcugcaagaucccggcccugccccugcccaccauccugcccccgaucaacaaggugugccgggacacccuccgcgacuggugccagcagcugggccugagcacgaacgggaagaagaucgaggucuaccuccggcugcaccgccacgccuaccccgagcagcggcaggacaugcccgagaugucccaggagacccgccugcagcggugcagccgcaagcggaaggccgugaccaagcgcgcgcggcuccagcgcuccuacgagaugaacgagcgggccgaggagaccaacacgguggaggucaucaccagcgcccccggcgccaugcuggcguccugggcccgcaucgccgcccgggccgugcagccgaaggcgcugaacagcugcuccauccccgugagcgucgaggccuuccucaugcaggccuccggggugcgcuggugcgugguccacggccggcugcugagcgccgacaccaagggcugggugcgccuccaguuccacgccgggcaggcgugggugcccaccacgcaccggcgcaugaucucccuguuccugcuccccgccugcaucuucccgagccccggcaucgaggacaacaugcugugccccgacugcgccaagcggaacaagaagaugaugaagcgccugaugaccgucgagaaguga

SEQ ID NO: 29360 - RNA, 480 nt, Artificial Sequence
  derived and/or modified sequence opt1 from DPPA3__Homo_sapiens__NP_954980
auggaccccagccaguucaacccgaccuacauccccggcagcccccagaugcugaccgaggagaacucccgcgacgacuccggggccagccagaucuccagcgagacgcucaucaagaaccuguccaaccugaccaucaacgccagcuccgagagcgugagcccccucuccgaggcgcugcugcggcgcgaguccgucggcgccgccgugcuccgggagaucgaggacgaguggcuguacagccgccgcggggugcggacccugcucuccguccagcgggagaagauggcccgccugcgguacaugcugcucggcggggugcgcacccacgagcggcgcccgacgaacaaggagcccaagggcgugaagaaggagagccggcccuucaagugccccugcuccuucugcgucagcaacggcugggacccguccgagaacgcccgcaucgggaaccaggacaccaagccccugcagcccuga

SEQ ID NO: 29361 - RNA, 915 nt, Artificial Sequence
  derived and/or modified sequence opt1 from DPPA4__Homo_sapiens__NP_060659
augcugcgcggcagcgccuccagcaccuccauggagaaggccaaggggaaggaguggaccagcacggagaagucccgggaggaggaccagcaggcgagcaaccagcccaacuccaucgcccuccccggcaccagcgccaagcgcaccaaggagaagauguccaucaaggggagcaaggugcugugccccaagaagaaggccgagcacaccgacaacccccggccccagaagaagauccccaucccgccccuccccuccaagcugccgcccgucaaccugauccaccgcgacauccugcgggccuggugccagcagcucaagcugagcuccaagggccagaagcuggacgcguacaagcgccucugcgccuucgccuaccccaaccagaaggacuuccccagcacggccaaggaggcgaagauccggaagucccugcagaagaagcugaagguggagaagggggagaccagccuccaguccagcgagacccacccgcccgagguggcccugccgcccgucggcgagccgcccgcccuggagaacuccaccgcccuccuggagggcgugaacacgguggucgugaccaccagcgcccccgaggcgcugcucgccagcugggcccgcaucuccgcccgggcccgcacccccgaggcgguggagagcccccaggaggccuccgggguccgguggugcguggugcacggcaagagccugcccgccgacacggacggguggguccaccuccaguuccacgccggccaggccugggugcccgagaagcaggaggggcgcguguccgcccuguuccugcugcccgcgagcaacuucccgccgccccaccucgaggacaacaugcugugccccaagugcguccaccggaacaaggugcugaucaagucccuccagugggaguga

SEQ ID NO: 29362 - RNA, 606 nt, Artificial Sequence
  derived and/or modified sequence opt1 from DPT__Homo_sapiens__NP_001928
auggaccugagccuccugugggugcugcucccccuggucaccauggccuggggccaguacggggacuacggcuacccguaccagcaguaccacgacuacuccgacgacgggugggugaaccugaaccgccagggcuucagcuaccagugcccccagggccaggugaucgucgccgugcgguccaucuucagcaagaaggagggguccgaccgccaguggaacuacgcgugcaugcccacgccccagagccucggcgagccgaccgagugcuggugggaggagaucaaccgggccgggauggagugguaccagaccugcuccaacaacggccugguggccggguuccagagccgcuacuucgaguccguccuggaccgggaguggcaguucuacugcugccgcuacagcaagcggugccccuacuccugcuggcucaccaccgaguaccccggccacuacggggaggagauggacaugaucagcuacaacuacgacuacuacauccgcggcgccacgaccaccuucuccgccguggagcgggaccgccaguggaaguucaucaugugccggaugaccgaguacgacugcgaguucgcgaacguguga

SEQ ID NO: 29363 - RNA, 2277 nt, Artificial Sequence
  derived and/or modified sequence opt1 from DPY19L2__Homo_sapiens__NP_776173
augcgcaagcagggcgugagcuccaagcggcugcagagcuccgggcgcagccaguccaagggccggcgcggggccagccucgcccgggagcccgaggucgaggaggagauggagaaguccgcgcugggcgggggcaagcugccccgcggcagcuggcgguccagccccgggcgcauccagucccucaaggagcggaagggccuggagcuggaggugguggccaagaccuuccuccuggggcccuuccaguucguccgcaacagccuggcccagcuccgggagaaggugcaggagcugcaggcccgccgguucuccagccgcaccacgcugggcaucgccguguucgucgcgauccuccacuggcugcaccuggugacccucuucgagaacgaccggcacuucucccaccugagcucccuggagcgcgagaugaccuuccggaccgagauggggcucuacuacagcuacuucaagacgaucaucgaggcccccuccuuccuggagggccuguggaugaucaugaacgaccgccucaccgaguacccgcugaucaucaacgccaucaagcgguuccaccuguaccccgaggugaucaucgccagcugguacugcaccuucaugggcaucaugaaccucuucgggcuggagaccaagacgugcuggaacgucacccgcaucgagccccugaacgaggugcagagcugcgagggccucggggaccccgcgugcuucuacgugggcgucaucuucauccugaacggccugaugaugggccucuucuucauguacggggccuaccuguccgggacccagcugggcgggcucaucaccgugcugugcuucuucuucaaccacggcgaggccacgcgggugauguggaccccgccccugcgcgagagcuucuccuaccccuuccucguccugcagaugugcauccugacccucauccugcgcaccagcuccaacgaccggcgccccuucaucgcccugugccucagcaacguggccuucaugcugccguggcaguucgcgcaguucauccuguucacgcagaucgccucccucuuccccauguacguggucggcuacaucgagcccagcaaguuccagaagaucaucuacaugaacaugaucuccgugacccugagcuucauccugauguucgggaacuccauguaccucagcuccuacuacagcuccagccugcugaugaccugggccaucauccugaagcggaacgagauccagaagcucggcguguccaagcugaacuucuggcugauccaggggagcgccugguggugcggcaccaucauccucaaguuccugacguccaagauccugggggucagcgaccacauccgccucagcgaccugaucgccgcgcggauccugcgcuacaccgacuucgacacccucaucuacacgugcgcccccgaguucgacuucauggagaaggccaccccgcugcgguacaccaagacccugcuccugcccguggugauggucaucacgugcuucaucuucaagaagaccgugcgcgacaucuccuacguccuggccaccaacaucuaccuccggaagcagcugcuggagcacagcgagcucgccuuccacacccugcagcugcucguguucaccgcgcuggccauccugaucaugcgccucaagauguuccugacgccccacaugugcgugauggccucccugaucugcagccggcagcuguucggcuggcuguuccgccggguccgcuucgagaaggugaucuucggcauccucaccgugauguccauccagggguacgccaaccuccggaaccaguggagcaucaucggcgaguucaacaaccugccccaggaggagcugcuccaguggaucaaguacuccaccaccagcgacgccgucuucgcgggggccaugccgacgauggccuccaucaagcugagcacccugcaccccaucgugaaccacccccacuacgaggacgccgaccuccgcgcgcggaccaagaucguguacuccaccuacagccgcaaguccgccaaggagguccgggacaagcugcuggagcuccacgugaacuacuacgugcuggaggaggccuggugcgucgugcgcaccaagcccggcugcagcaugcuggagaucugggacguggaggacccguccaacgccgccaacccgccccucugcagcguccugcuggaggacgcgcgccccuacuucacgaccguguuccagaacuccguguaccggguccucaaggugaacuga

SEQ ID NO: 29364 - RNA, 2151 nt, Artificial Sequence
  derived and/or modified sequence opt1 from DPY19L3__Homo_sapiens__XP_011524828
augaugagcauccgccagcggcgcgagauccgggccaccgagguguccgaggacuuccccgcccaggaggagaacgucaagcuggagaacaagcucccgagcggcugcaccucccgccggcuguggaagauccugagccucacgaucgggggcaccaucgcgcugugcaucgggcugcucaccuccguguaccuggccacccugcacgagaacgaccucugguucagcaacaucaaggagguggagcgcgagaucuccuuccggacggagugcggccuguacuacagcuacuacaagcagaugcugcaggcccccacccucguccagggguuccacggccugaucuacgacaacaagaccgaguccaugaagaccaucaaccugcuccagcgcaugaacaucuaccaggagguguuccugagcauccuguaccgggugcuccccauccagaaguaccuggagcccgucuacuucuacaucuacacgcuguucggccuccaggccaucuacgugaccgcccuguacaucaccuccuggcugcucagcgggaccuggcuguccggccugcucgcggccuucugguacgugacgaaccgcaucgacaccacccgggucgaguucaccaucccgcugcgcgagaacugggcccugcccuucuucgccauccagaucgcggccaucacguacuuccuccggcccaaccugcagccccugagcgagcgccucacccugcuggccaucuucaucuccaccuuccucuucagccugaccuggcaguucaaccaguucaugaugcugaugcaggcccucgugcuguucacgcuggacucccucgacaugcugccggccgugaaggcgaccuggcuguacgggauccagaucaccagccuccugcuggucugcauccuccaguucuucaacuccaugauccugggcagccugcugaucagcuucaaccucuccguguucaucgcccggaagcugcagaagaaccugaagaccgggagcuuccucaaccgccugggcaagcugcuccugcaccuguucauggugcucugccugacgcuguuccucaacaacaucaucaagaagauccugaaccugaaguccgacgagcacaucuucaaguuccucaaggccaaguucggccugggggccacccgggacuucgacgccaaccuguaccucugcgaggaggcguucggccugcugcccuucaacaccuucgggcgccucagcgacacccugcuguucuacgccuacaucuucguccucuccaucacggugaucguggccuucgucguggccuuccacaaccugagcgacuccaccaaccagcagagcgugggcaagauggagaagggcaccgucgaccugaagcccgagaccgccuacaaccucauccacacgauccuguucggguuccuggcgcucuccaccaugcggaugaaguaccuguggaccagccacaugugcguguucgccuccuucggccugugcagccccgagaucugggagcuccugcugaaguccgugcaccucuacaacccgaagcgcaucugcaucaugcgguacagcguccccauccugauccugcucuaccugugcuacaaguucuggcccgggaugauggacgagcuguccgagcuccgcgaguucuacgaccccgacaccguggagcugaugaacuggaucaacagcaacacgccgcgcaaggccgucuucgccggcuccaugcagcugcucgccggggugaagcugugcaccggccggacccugaccaaccacccccacuacgaggacagcucccuccgcgagcggacccgcgcgguguaccagaucuacgccaagcgggcccccgaggagguccacgcccugcugcgcagcuucggcacggacuacgugauccucgaggacagcaucugcuacgagcggcgccaccggcgcgggugccggcugcgcgaccugcucgacaucgcgaacggccacaugauggacgggcccggcgagaacgacccggaccugaagcccgccgaccacccccgguucugcgaggagaucaagcgcaaccugcccccguacguggccuacuucacccgggucuuccagaacaagaccuuccacguguacaagcucucccgcaacaaguga

SEQ ID NO: 29365 - RNA, 300 nt, Artificial Sequence
  derived and/or modified sequence opt1 from DPY30__Homo_sapiens__NP_115963
auggagcccgagcagaugcuggagggccagacccagguggccgagaacccgcacagcgaguacgggcucaccgacaacgucgagcgcaucguggagaacgagaagaucaacgccgagaaguccagcaagcagaagguggaccugcagucccugcccacgcgggcguaccucgaccagaccgucgugcccauccugcugcagggccucgccgugcuggccaaggagcggcccccgaaccccaucgaguuccuggccagcuaccuccugaagaacaaggcccaguucgaggaccgcaacuga

SEQ ID NO: 29366 - RNA, 1560 nt, Artificial Sequence
  derived and/or modified sequence opt1 from DPYS__Homo_sapiens__NP_001376
auggccgcccccagccgccugcugauccggggcgggcgcguggucaacgacgacuucuccgagguggcggacgugcuggucgaggacggcguggugcgggcccuggggcacgaccuccugccgcccggcggggcccccgccggccugcgcguccucgacgccgcgggcaagcuggugcugcccgggggcaucgacacccacacccacaugcaguucccguucauggggagccgguccaucgacgacuuccaccagggcacgaaggccgcccucagcgggggcaccaccaugaucaucgacuucgccaucccccagaagggcgggucccugaucgaggcguucgagaccuggcgcagcugggccgaccccaaggugugcugcgacuacucccugcacgucgccgugacgugguggagcgaccaggugaaggaggagaugaagauccucguccaggacaagggcgugaacuccuucaagauguucauggccuacaaggaccuguacauggugaccgaccuggagcucuacgaggccuucagccggugcaaggagaucggggcgaucgcccagguccacgccgagaacggcgaccugaucgccgagggcgccaagaagaugcuggcgcucgggaucaccggccccgaggggcacgagcugugccgcccggaggccguggaggccgaggccacccugcgggccaucacgaucgcguccgccgugaacugcccccucuacaucguccacgugaugagcaaguccgccgccaaggugaucgccgacgcgcgccgggacggcaaggucguguacggggagcccaucgccgccagccugggcaccgacggcacccacuacuggaacaaggaguggcaccacgccgcgcaccacgugauggggcccccgcugcgccccgaccccuccacccccgacuuccucaugaaccugcuggccaacgacgaccucacgaccaccggcaccgacaacugcacguucaacacgugccagaaggcccuggggaaggacgacuucaccaagaucccgaacggcgucaacgggguggaggaccggaugagcgucaucugggagaagggcgugcacuccggcaagauggacgagaaccgcuucguggccgucaccagcaccaacgccgcgaagaucuucaaccuguacccccggaaggggcgcaucgccgugggcuccgacgccgacaucgugaucugggaccccaaggggacccggaccaucagcgccaagacccaccaccaggccgucaacuucaacaucuucgagggcauggugugccacggggugccccucgucacgaucagccgcggcaaggugguguacgaggcgggcgucuucuccgugaccgccggggacggcaaguucaucccgcggaagcccuucgccgaguacaucuacaagcgcaucaagcagcgggaccggaccugcacccccacgcccguggagcgcgccccguacaagggggaggucgccacccucaagagccgcgugaccaaggaggacgcgaccgccggcacgcgcaagcaggcccaccccuga

SEQ ID NO: 29367 - RNA, 2034 nt, Artificial Sequence
  derived and/or modified sequence opt1 from DPYSL2__Homo_sapiens__NP_001184222
auggccgagcgcaagcagagcggcaaggccgcggaggacgaggaggugcccgccuucuucaagaaccugggguccggcagccccaagccccggcagaaguucugcgggauguucugccccgucgagggcuccagcgagaacaagaccaucgacuucgacucccucagcguggggcgcggcuccggccagguggucgcccagcagcgggacguggcccaccuggggcccgacccgcagccgcccuacagccgccagggccggcgcgccgggggcgagcccuccguggagagcgggcggaaggucgagauccgccgggcguccggcaaggaggcccugcagaacaucaacgaccagagcgaccgccuccugaucaagggcgggaagaucgugaacgacgaccaguccuucuacgccgacaucuacauggaggacggccugaucaagcagaucggggagaaccucaucgugcccggcggcgucaagaccaucgaggcccacagccggauggugauccccgggggcaucgacgugcacacgcgcuuccagaugcccgaccaggggaugaccuccgcggacgacuucuuccagggcaccaaggccgcccuggccgggggcaccacgaugaucaucgaccacgucgugcccgagccgggcaccagccugcucgccgcguucgaccaguggcgggagugggccgacuccaagagcugcugcgacuacucccugcacguggacaucagcgaguggcacaaggggauccaggaggagauggaggcccuggucaaggaccacggcgugaacagcuuccucguguacauggccuucaaggaccgcuuccagcugaccgacugccagaucuacgagguccuguccgugauccgggacaucggggccaucgcccaggugcacgccgagaacggcgacaucaucgccgaggagcagcagcgcauccucgaccuggggaucaccggccccgagggccacguccugagccggcccgaggagguggaggccgaggccgugaaccgcgcgaucacgaucgccaaccagaccaacugcccccucuacaucaccaaggucauguccaagagcuccgccgaggugaucgcccaggcccggaagaaggggaccgucguguacggcgagccgaucacggcgagccuggggaccgacggcucccacuacuggagcaagaacugggccaaggccgccgcguucgugaccuccccgccccugagccccgaccccaccacgcccgacuuccucaacucccugcugagcugcggggaccuccaggucaccggcuccgcccacugcaccuucaacaccgcccagaaggccgugggcaaggacaacuucacgcugauccccgaggggaccaacggcaccgaggagcgcaugagcgugaucugggacaaggccgucgugaccgggaagauggacgagaaccaguucguggcggucacguccaccaacgccgccaagguguucaaccuguacccccggaagggccgcaucgccgugggcagcgacgccgaccucgucaucugggacccggacuccgugaagaccaucagcgcgaagacccacaacuccagccuggaguacaacaucuucgaggggauggagugccgcggcagcccccugguggucaucucccaggggaagaucgugcucgaggacggcacgcugcacgugaccgaggggagcggccgguacaucccccgcaagcccuucccggacuucgucuacaagcggaucaaggcccgcucccggcuggccgagcuccgcggcgugccccgggggcuguacgacggccccgugugcgaggucagcgugaccccgaagaccgugacgcccgccuccagcgccaagaccucccccgcgaagcagcaggcgcccccgguccgcaaccugcaccagagcggguucucccucagcggcgcccagaucgacgacaacaucccccggcgcaccacccagcggaucguggccccgcccgggggccgcgcgaacaucacgucccugggcuga

SEQ ID NO: 29368 - RNA, 2055 nt, Artificial Sequence
  derived and/or modified sequence opt1 from DPYSL3__Homo_sapiens__NP_001184223
auggccagcggccgccgggggugggacuccagccacgaggacgaccugcccguguaccucgcccgccccggcaccaccgaccaggucccccggcagaaguacgggggcauguucugcaacguggagggggcguucgaguccaagacgcuggacuucgacgcccugagcgugggccagcgcggcgccaagacgccccgguccgggcagggcagcgaccgcggguccggcagccggcccgggaucgagggcgacaccccgcgccggggccaggggcgcgaggagucccgggagcccgcccccgccagccccgcgccggccggcgucgagauccgcuccgccaccgggaaggaggugcuccagaaccugggccccaaggacaagagcgaccggcugcucaucaagggcgggcgcaucgugaacgacgaccaguccuucuacgccgacaucuacauggaggacggccugaucaagcagaucggggacaaccugaucguccccggcggggugaagaccaucgaggcgaacggcaagauggugauccccggcgggaucgacguccacacccacuuccagaugccguacaagggcaugaccaccguggacgacuucuuccaggggacgaaggccgcccucgccggcgggaccaccaugaucaucgaccacgugguccccgagcccgagagcucccugaccgaggccuacgagaaguggcgggagugggcggacggcaagagcugcugcgacuacgcccugcacguggacaucacgcacuggaacgacuccgugaagcaggagguccagaaccucaucaaggacaagggcgugaacagcuucaugguguacauggccuacaaggaccuguaccaggucuccaacaccgagcuguacgagaucuucacgugccucggggagcugggcgccaucgcccaggugcacgcggagaacggggacaucaucgcccaggagcagacccgcaugcuggagaugggcaucaccgggcccgagggccacgugcucagccggccggaggagcuggaggccgaggccgucuuccgcgccaucaccaucgcgagccagaccaacugcccccuguacgugaccaaggugauguccaagagcgccgccgaccucaucucccaggcccggaagaagggcaacgucguguucggggagcccaucacggccagccugggcaucgacgggacccacuacugguccaagaacugggcgaaggccgccgccuucgucaccagcccgccccugucccccgaccccaccacgcccgacuacaucaacagccuccuggcguccggcgaccugcagcucagcggcuccgcccacugcaccuucagcaccgcccagaaggccaucgggaaggacaacuucaccgccaucccggagggcacgaacgggguggaggagcgcauguccgugaucugggacaaggcggucgccaccggcaagauggacgagaaccaguucguggccgugaccagcaccaacgccgccaagaucuucaaccuguacccccggaaggggcgcaucuccgucggcagcgacuccgaccuggugaucugggaccccgacgcggugaagaucgucagcgccaagaaccaccaguccgccgccgaguacaacaucuucgagggcauggagcuccgcggggcgccccugguggugaucugccagggcaagaucaugcuggaggacgggaaccuccacgucacgcagggcgccgggcgguucaucccgugcagccccuucagcgacuacguguacaagcgcaucaaggcccggcgcaagauggccgaccugcacgccgugccccggggcauguacgacggcccggucuucgaccugaccaccacccccaagggcgggacgcccgcgggguccgcccgcggcagccccacccggccgaacccgcccgugcgcaaccuccaccaguccggguucagccuguccggcacccagguggacgagggcguccggagcgccuccaagcgcaucguggccccgcccggcgggcggagcaacaucaccucccugagcuga

SEQ ID NO: 29369 - RNA, 1719 nt, Artificial Sequence
  derived and/or modified sequence opt1 from DPYSL4__Homo_sapiens__NP_006417
augagcuuccagggcaagaaguccaucccccgcaucaccagcgaccggcugcucauccgcgggggccggaucgugaacgacgaccaguccuucuacgccgacguccacguggaggacgggcugaucaagcagaucggcgagaaccugaucgugcccgggggcaucaagaccaucgacgcccacggccucaugguccugcccgggggcguggacgugcacacgcgccugcagaugcccguccucgggaugacccccgcggacgacuucugccagggcaccaaggccgcccuggccgggggcaccacgaugauccuggaccacguguuccccgacaccggcgugagccuccuggccgcguacgagcaguggcgggagcgcgccgacuccgccgccugcugcgacuacagccugcacgucgacaucacccgguggcacgaguccaucaaggaggagcucgaggcgcuggugaaggagaagggggugaacagcuuccuggucuucauggccuacaaggaccgcugccagugcuccgacagccagauguacgagaucuucuccaucauccgggaccucggcgcccuggcccaggugcacgccgagaacggggacaucguggaggaggagcagaagcgccugcucgagcugggcaucaccggccccgaggggcacguccugagccaccccgaggagguggaggcggaggccguguaccgggccgucacgaucgccaagcaggccaacugcccccucuacgugaccaaggugauguccaagggcgcggccgacgccaucgcccaggccaagcgccgcggggucgugguguucggcgagccgaucaccgcgagccuggggaccgacggcucccacuacuggagcaagaacugggccaaggccgccgccuucgucacguccccgcccgugaaccccgacccgaccaccgcggaccaccugaccugccuccugagcuccggcgaccugcaggucacggggagcgcccacugcaccuucaccaccgcccagaaggccgugggcaaggacaacuucgcgcucauccccgaggggacgaacggcaucgaggagcggaugagcauggugugggagaagugcgucgccuccgggaagauggacgagaacgaguucguggccgugaccagcaccaacgccgccaagaucuucaacuucuacccccggaagggccgcgucgcggugggcuccgacgccgaccuggugaucuggaaccccaaggccaccaagaucaucagcgccaagacgcacaaccugaacgucgaguacaacaucuucgaggggguggagugccggggcgccccggcgguggucaucucccaggggcgcguggcccucgaggacggcaagauguucgugacccccggggccggccgguucgucccccgcaagaccuuccccgacuucguguacaagcggaucaaggcccgcaaccgccuggccgagauccacggcgugccgcgggggcuguacgacggccccguccacgaggugauggugcccgcgaagcccgggagcggcgccccggcccgcgccuccugccccggcaagaucagcgucccgcccgugcggaaccuccaccaguccggguucagccuguccggcagccaggcggacgaccacaucgcccgccggaccgcccagaagaucauggccccgcccgggggccgcuccaacaucacgagccuguccuga

SEQ ID NO: 29370 - RNA, 1695 nt, Artificial Sequence
  derived and/or modified sequence opt1 from DPYSL5__Homo_sapiens__NP_001240652
augcuggccaacagcgccuccgugcgcauccucaucaagggcgggaaggucgugaacgacgacugcacccacgaggccgacguguacaucgagaacggcaucauccagcaggucgggcgggagcugaugauccccggcggggccaaggugaucgacgccaccggcaagcuggugaucccgggcgggaucgacaccagcacccacuuccaccagaccuucaugaacgcgaccugcgucgacgacuucuaccacggcacgaaggccgcccucgucgggggcaccaccaugaucaucgggcacgugcugcccgacaaggagaccucccugguggacgccuacgagaagugccgcggccucgccgaccccaaggugugcugcgacuacgcccugcacgugggcaucacguggugggcgcccaaggucaaggccgagauggagacccuggugcgggagaagggggugaacagcuuccagauguucaugaccuacaaggaccucuacaugcugcgcgacuccgagcuguaccagguccuccacgccugcaaggacaucggcgccaucgcccgggugcacgcggagaacggggagcugguggccgagggcgccaaggaggcccuggaccucggcaucaccgggccggagggcaucgagaucagccgccccgaggagcuggaggccgaggcgacgcaccgggucaucaccaucgccaaccgcacccacugccccaucuaccuggugaacguguccagcaucuccgccggggacgucaucgccgccgcgaagaugcagggcaagguggugcucgccgagaccacgaccgcccacgccacccugaccgggcugcacuacuaccaccaggacuggagccacgccgcggccuacgucacggugcccccgcuccggcuggacaccaacaccuccaccuaccugaugagccuccuggccaacgacacgcugaacaucgucgccuccgaccaccgccccuucaccaccaagcagaaggcgaugggcaaggaggacuucaccaagaucccccacggcgugagcggggugcaggaccggauguccgucaucugggagcgcggcguggucgggggcaagauggacgagaaccgguucguggccgugacgagcuccaacgccgccaagcuccugaaccuguacccccgcaaggggcggaucaucccgggcgccgacgcggacguggucgugugggaccccgaggccaccaagaccaucagcgccuccacccaggugcagggcggggacuucaaccucuacgagaacaugcgcugccacggcgucccccuggugacgaucagccgggggcgcguggucuacgagaacggcguguucaugugcgccgaggggaccggcaaguucugcccccugcggagcuucccggacaccguguacaagaagcucguccagcgcgagaagacccugaaggugcggggcguggaccgcacgcccuaccugggggacgucgccguggugguccaccccggcaagaaggagauggggacgccccucgcggacaccccgacccgccccgugacccggcacggcggcaugcgcgaccugcacgaguccagcuucucccugagcgggucccagaucgacgaccacgugcccaagcgggccagcgcccgcauccucgcgcccccgggcgggcgguccagcggcaucugguga

SEQ ID NO: 29371 - RNA, 717 nt, Artificial Sequence
  derived and/or modified sequence opt1 from DRAM1__Homo_sapiens__NP_060840
augcugugcuuccuccgcggcauggccuucgugcccuuccugcuggucaccuggagcuccgccgcguucaucaucagcuacgugguggccguccucuccgggcacgugaacccguuccugcccuacaucagcgacaccggcacgaccccgcccgaguccgggaucuucggcuucaugaucaacuucagcgccuuccugggggccgccaccauguacacccgguacaagaucgugcagaagcagaaccagacgugcuacuucuccacccccgucuucaaccucgugagccuggugcugggccucgucggcugcuucgggaugggcaucguggcgaacuuccaggagcuggccgugcccgucgugcacgacgggggcgcccugcucgccuucgugugcggggucguguacacccugcugcaguccaucaucagcuacaaguccugcccccaguggaacagccucuccacgugccacauccgcauggugaucagcgcggucuccugcgccgccgugauccccaugaucgugugcgccagccugaucuccaucaccaagcuggaguggaacccgcgggagaaggacuacgucuaccacguggugagcgccaucugcgaguggaccgucgcguucggcuucaucuucuacuuccucaccuucauccaggacuuccaguccgugacccugcgcaucagcacggagaucaacggcgacaucuga

SEQ ID NO: 29372 - RNA, 618 nt, Artificial Sequence
  derived and/or modified sequence opt1 from DRAP1__Homo_sapiens__NP_006433
augcccagcaagaagaagaaguacaacgcccgcuucccgcccgcccggaucaagaagaucaugcagaccgacgaggagaucggcaagguggcggccgccguccccgugaucaucucccgcgcccuggagcuguuccucgagagccugcucaagaaggccugccaggugacccagucccggaacgcgaagacgaugaccaccagccaccugaagcagugcaucgagcuggagcagcaguucgacuuccucaaggaccuggucgccuccgugcccgacaugcagggggacggcgaggacaaccacauggacggggacaagggcgcccgccgggggcgcaagcccggcagcggcgggcggaagaacggcgggaugggcaccaaguccaaggacaagaagcugagcgggacggacuccgagcaggaggacgagagcgaggacaccgacaccgacggcgaggaggagaccucccagcccccgccccaggccagccaccccuccgcgcacuuccagagcccgcccacgcccuuccuccccuucgccuccacccugccccugccgcccgccccgcccggccccagcgcccccgacgaggaggacgaggaggacuacgacuccuga

SEQ ID NO: 29373 - RNA, 2223 nt, Artificial Sequence
  derived and/or modified sequence opt1 from DRC1__Homo_sapiens__NP_659475
augaacccgcccggcagccuggaggcccucgaccccaacguggacgagcaccuguccacccagauccuggcccccagcguccacuccgacaacagccaggagcgcauccaggcgcggcgccuccggaucgccgcccgccuggaggcccggcgccgggaggcccugggggaguaccucgacggcaagaaggaguccgaggaggaccagagcaaguccuacaagcagaaggaggagagccgccugaagcuggcgaagcuccugcugugcgggaccgagcucgugacgaacauccagguggccaucgacauccgggagauccaccgccgggucgaggaggaggagaucaagcgccagcggaucgagaagcuggagaacgaggugaagaccucccaggacaaguucgacgagaucaccagcaagugggaggagggcaagcagaagcgcaucccccaggagcugugggagaugcucaacacccagcagcugcacugcgccgggcugcucgaggacaagaacaagcugaucuccgagcugcagcaggagcucaagacgaaggacgaccaguacgugaaggaccugaagaagcagagcgacgacaucugccugcuccuggagcggauggaggagcaggucaagaacgugaugaagaccuuccgcgaggagcuguacaacaucgagaaggccuucgagguggagcggcaggagcuccuggcguccaacaagaagaagugggagcaggcccugcaggcccacaacgccaaggagcucgaguaccugaacaaccgcaugaagaaggucgaggacuacgagaagcagcugaaccggcagcgcaucugggacugcgaggaguacaacaugaucaagaucaagcucgagcaggacgugcagauccuggagcagcagcugcagcagcggaaggccaucuaccagcucaaccaggagaagcuggaguacaaccuccaggugcugaagaagcgcgacgaggagagcaccgucaucaagucccagcagaagcgcaagaucaaccggcugcacgacauccugaacaaccuccgcagcaaguacgcgaagcagaucaagcaguuccaggaggagaaccagucccugaccagcgacuacaagcggcuggugaugcaguucaaggagcuccagaaggccaugcgccacuucgcccugaucgacgacgagaaguucugggagaucuggcugaugaacgaggaggaggccaaggaccucaucgcccgggcguucgacguggaccgcaucauccacacgcaccaccugggccugccgugggccgcccccgacuucugguuccugaacaacgucggccccaucucccagcagccccagaaguccgccacccagaucguggaggagaugcucaugcggagcgaggaggaggaggccgaggaggcggccgccgagccggagagcuaccuggaccugcccaagcagaucagcgagaagaccaccaagcgcauccucaugcugcugugcgacgaguccggguuccucaucgagagcaagcugcugucccuccugcugccccucgagcagaacgagugcuaccugcugcggcucgacgccaucuucagcgcccugggcaucgaguccgaggacgaccuguacaagcucgugaacuucuuccugaaguaccgcgcgcaccggcugagcuccagccuccagaucaagcccugcucccaggccagcauggagaaggccuccauggaggagacgagcacccgcuccgagcuggagcuggccgagcagaccgagauggagggggagaaggaggagagccucgucgagggcgagaaggaggaggaggaggagaccccgcccucccccugggugauccaccccaacgacgugcugaagauccuggaggcguucgucauggggcucaagaagccgcgggacagccgcgcgccccugcgggugcagaagaacgugcgcgacaacuccaaggacagcgaguacuggcaggcccugacgaccgucauccccagcuccaagcagaaccucugggacgcccuguacaccgcccuggagaaguaccaccucgugcugacccagcgggccaagcugcuccuggagaacagcucccuggagcagcagaacacggagcuccaggcccugcugcagcaguaccucaacagcaagaucaacuccgagcugcaggucccgcccacccaggugcugcgcgugcccaccaaguga

SEQ ID NO: 29374 - RNA, 1341 nt, Artificial Sequence
  derived and/or modified sequence opt1 from DRD1__Homo_sapiens__NP_000785
augcgcacccugaacaccagcgccauggacggcacggggcucguggucgagcgggacuucuccgugcgcauccugaccgccugcuuccugagccuccugauccuguccacccuccugggcaacacccuggugugcgcggccgucauccgguuccgccaccuccggagcaaggugacgaacuucuucgugaucucccuggccgucagcgaccugcucguggccgugcuggucaugcccuggaaggccguggcggagaucgccggguucuggccguucggcuccuucugcaacaucuggguggccuucgacaucaugugcagcaccgccuccauccugaaccucugcgucaucagcguggaccgcuacugggcgaucuccagccccuuccgguacgagcgcaagaugacccccaaggccgccuucauccugaucuccguggccuggacccugagcguccucaucuccuucauccccgugcagcugagcuggcacaaggccaagccgacgucccccagcgacgggaacgcgaccucccuggccgagaccaucgacaacugcgacagcagccucucccggaccuacgccaucagcuccagcgugaucuccuucuacauccccgucgccaucaugaucgugacguacacccgcaucuaccggaucgcccagaagcagauccgccggaucgcggcccuggagcgcgccgccgugcacgccaagaacugccagaccaccacgggcaacggcaagcccgucgagugcagccagccggaguccagcuucaagauguccuucaagcgggagaccaaggugcugaagacccucagcgugaucaugggggucuucgugugcugcuggcugcccuucuucauccugaacugcauccuccccuucugcggcuccggggagacccagcccuucugcaucgacagcaacacguucgacgucuucgugugguucggcugggcgaacuccagccugaacccgaucaucuacgccuucaacgccgacuuccgcaaggccuucuccacccugcucgggugcuaccggcugugccccgccaccaacaacgcgaucgagaccgugagcaucaacaacaacggcgccgccauguucuccagccaccacgagccccgcggcuccaucagcaaggagugcaaccuggucuaccucaucccccacgccguggggagcuccgaggaccugaagaaggaggaggcggccggcaucgcccggccgcuggagaagcucagccccgcccuguccgugauccuggacuacgacacggacgucagccucgagaagauccagcccaucacccagaacgggcagcaccccaccuga

SEQ ID NO: 29375 - RNA, 1332 nt, Artificial Sequence
  derived and/or modified sequence opt1 from DRD2__Homo_sapiens__NP_000786
auggacccccugaaccucagcugguacgacgacgaccuggagcgccagaacuggucccggccguucaacggcagcgacgggaaggccgaccgcccccacuacaacuacuacgccacccugcucacccugcugaucgcggugaucgucuucggcaacgugcucgugugcauggccgucucccgggagaaggcccugcagacgaccaccaacuaccugaucgugagccucgccguggccgaccugcuggucgcgacccucgugaugcccuggguggucuaccuggagguggugggggaguggaaguucucccgcauccacugcgacaucuucgucacgcuggacgugaugaugugcaccgccagcauccucaaccugugcgccaucuccaucgaccgguacaccgccguggcgaugcccaugcuguacaacacccgcuacagcuccaagcggcgcgucacggugaugaucagcaucguguggguccucuccuucaccaucagcugcccgcugcuguucggccucaacaacgccgaccagaacgagugcaucaucgccaaccccgccuucgugguguacuccagcaucgucuccuucuacgugcccuucaucgugacccugcuggucuacaucaagaucuacaucgugcuccggcgccggcgcaagcgggucaacaccaagcgcagcucccgggccuuccgcgcgcaccuccgggcgccccugaaggggaacugcacgcacccggaggacaugaagcugugcaccgugaucaugaaguccaacggcagcuuccccgugaaccgccggcgcgucgaggccgcccggcgcgcccaggagcuggagauggagaugcugagcagcaccuccccgcccgagcgcacccgguacagccccaucccgcccucccaccaccagcucacgcugcccgaccccagccaccacggccugcacuccacccccgacagccccgccaagcccgagaagaacgggcacgccaaggaccacccgaagaucgccaagaucuucgagauccagaccaugcccaacggcaagacccgcacgucccucaagaccaugagccggcgcaagcugucccagcagaaggagaagaaggccacccagaugcuggccaucgugcucgggguguucaucaucugcuggcugcccuucuucaucacccacauccugaacauccacugcgacugcaacaucccgcccguccucuacagcgcguucacguggcugggcuacgugaacuccgccgugaaccccaucaucuacaccaccuucaacaucgaguuccggaaggccuuccugaagauccuccacugcuga

SEQ ID NO: 29376 - RNA, 1203 nt, Artificial Sequence
  derived and/or modified sequence opt1 from DRD3__Homo_sapiens__NP_001269492
auggccagccugucccagcucagcggccaccugaacuacacgugcggggccgagaacuccaccggcgcgagccaggcccgcccccacgccuacuacgcccuguccuacugcgcccucauccuggcgaucguguucgggaacggccuggucugcauggccgugcucaaggagcgggcccugcagacgaccaccaacuaccugguggucagccucgccguggcggaccugcugguggccacccucgucaugccgugggugguguaccuggaggucaccgggggcguguggaacuucucccgcaucugcugcgacguguucgucacccuggacgugaugaugugcaccgccagcauccucaaccugugcgccaucuccaucgaccgguacaccgccguggucaugcccgugcacuaccagcacggcacggggcagagcuccugccgccggguggcgcugaugaucaccgccgucugggugcucgccuucgccgugagcugcccccugcuguucggcuucaacaccaccggggaccccacggucugcuccaucagcaacccggacuucgugaucuacuccagcguggucuccuucuaccuccccuucggcgugaccguccugguguacgcccgcaucuacgugguccugaagcagcggcgccggaagcgcauccucacccggcagaacagccagugcaacuccgugcgccccggguucccccagcagacccugagcccggaccccgcgcaccuggagcucaagcgguacuacagcaucugccaggacacggcccugggcggccccggguuccaggagcgcggcggggagcugaagcgggaggagaagacccgcaacucccucagccccaccaucgccccgaagcugucccuggaggugcggaagcucagcaacggccgccuguccaccagccugaagcucggcccccugcagccccgcggggucccccugcgggagaagaaggccacgcagaugguggccaucgugcucggcgcguucaucgucugcuggcugccguucuuccugacccacgugcucaacacccacugccagaccugccacgugucccccgagcuguacagcgccacgaccuggcugggguacgucaacuccgcccucaaccccgugaucuacaccaccuucaacaucgaguuccggaaggccuuccugaagauccugagcugcuga

SEQ ID NO: 29377 - RNA, 1260 nt, Artificial Sequence
  derived and/or modified sequence opt1 from DRD4__Homo_sapiens__NP_000788
augggcaaccgcagcaccgccgacgccgacgggcugcucgcgggccgggggcccgccgccggcgccuccgccggggcgagcgccggccuggccggccagggggccgcggcccuggugggcgggguccuccugaucggcgccgugcuggccgggaacucccucgugugcgucagcguggccaccgagcgcgcgcugcagacgcccaccaacuccuucaucgugagccuggccgccgccgaccuccugcuggcccuccugguccugccccucuucguguacuccgaggugcagggcggcgcguggcugcugagcccccggcucugcgacgcccugauggccauggacgucaugcugugcaccgccuccaucuucaaccucugcgccaucagcguggaccgcuucguggcggucgccgugccccugcgguacaaccgccagggcggcucccggcgccagcugcuccugaucggggccaccuggcugcucagcgccgccguggcggccccgguccugugcggccugaacgacgugcggggccgcgaccccgccgugugccggcucgaggaccgcgacuacgucguguacuccagcgugugcuccuucuuccugcccugcccccugaugcuccugcuguacugggccacguuccgggggcuccagcgcugggaggucgcgcggcgcgccaagcugcacggccgggccccgcgccggcccagcgggcccgggcccccgucccccaccccgcccgcgccccgccugccccaggaccccugcgggcccgacugcgccccgcccgcccccggccucccccggggcccgugcgggcccgacugcgcccccgccgcccccagccugccgcaggaccccugcggccccgacugcgccccgcccgcgcccgggcugcccccggaccccugcggcuccaacugcgccccgcccgacgccgugcgcgccgccgcgcucccgccccagaccccgccccagacccgccggcgccggcgcgccaagaucacggggcgggagcgcaaggccaugcgggugcugcccgucguggucggcgccuuccugcucugcuggacccccuucuucguggugcacaucacccaggcgcugugccccgccugcagcgugccgccccgccuggucagcgccgugaccuggcucggcuacgucaacuccgcccugaaccccgugaucuacacgguguucaacgccgaguuccggaacgucuuccgcaaggcgcugcgggccugcugcuga

SEQ ID NO: 29378 - RNA, 1434 nt, Artificial Sequence
  derived and/or modified sequence opt1 from DRD5__Homo_sapiens__NP_000789
augcugcccccgggcagcaacgggaccgccuaccccggccaguucgcccucuaccagcagcuggcgcaggggaacgccgugggcggguccgccggcgccccgccccugggccccagccaggucgugaccgccugccuccugacgcugcucaucaucuggacccugcuggggaacgugcucgucugcgcggccaucgugcgcucccggcaccuccgcgccaacaugaccaacguguucaucgucagccuggccguguccgaccuguucguggcgcugcuggucaugcccuggaaggccguggccgagguggccggcuacuggcccuucggggccuucugcgacgucuggguggcguucgacaucaugugcagcaccgccuccauccucaaccugugcgugaucagcgucgaccgguacugggccaucucccgccccuuccgguacaagcgcaagaugacgcagcggauggcccuggugauggugggccucgccuggacccugagcauccugaucuccuucaucccgguccagcucaacuggcaccgcgaccaggcggccagcuggggcgggcuggaccugcccaacaaccucgccaacuggacccccugggaggaggacuucugggagcccgacgugaacgccgagaacugcgacuccagccugaaccggaccuacgccaucuccagcucccugaucagcuucuacaucccgguggcgaucaugaucgucacguacacccgcaucuaccggaucgcccaggugcagauccgccggaucuccagccucgagcgcgccgccgagcacgcccagagcugccgguccagcgcggccugcgcccccgacaccucccugcgcgccagcaucaagaaggagaccaaggugcugaagacgcucuccgucaucaugggcguguucgucugcugcuggcugcccuucuucauccugaacugcauggugcccuucugcagcgggcacccggagggcccgcccgcgggguuccccugcguguccgagaccaccuucgacgucuucgugugguucggcugggccaacagcucccucaaccccgugaucuacgccuucaacgccgacuuccagaaggucuucgcccagcugcugggcugcagccacuucugcucccggacccccguggagacggugaacaucagcaacgagcucaucuccuacaaccaggacaucgucuuccacaaggagaucgcggccgccuacauccacaugaugcccaacgccgugacccccgggaaccgcgagguggacaacgacgaggaggagggcccguucgaccggauguuccagaucuaccagaccagccccgacggggaccccgucgccgaguccgugugggagcuggacugcgagggcgagaucagccuggacaagaucacccccuucacgccgaacggguuccacuga

SEQ ID NO: 29379 - RNA, 1104 nt, Artificial Sequence
  derived and/or modified sequence opt1 from DRG1__Homo_sapiens__NP_004138
augagcuccacccuggccaagaucgccgagaucgaggcggagauggcccgcacccagaagaacaaggccacggcccaccaccucggccugcugaaggcccggcucgcgaagcugcgccgggagcugaucacccccaagggcggcgggggcgggggcccgggcgagggguucgacguggccaagaccggcgacgcccgcaucggguucgucggcuuccccagcguggggaaguccacccuccugagcaaccuggccggcguguacuccgaggucgcggccuacgaguucacgacccucaccaccgugcccggcgugauccgguacaagggggccaagauccagcugcuggaccuccccggcaucaucgagggggccaaggacgggaagggccgcgggcggcaggucaucgccguggcgcgcacgugcaaccugauccugaucgugcucgacguccugaagccgcugggccacaagaagaucaucgagaacgagcucgagggguucggcauccggcugaacagcaagccgcccaacaucggguucaagaagaaggacaagggcggcaucaaccugaccgcgaccugcccccaguccgagcucgacgccgagaccgucaagagcauccuggccgaguacaagauccacaacgccgacgugacgcugcgcuccgacgccaccgccgacgaccucaucgacgugguggaggggaaccggguguacauccccugcaucuacguccugaacaagaucgaccagaucagcaucgaggagcuggacaucaucuacaaggugccccacugcgugcccaucuccgcccaccaccgcuggaacuucgacgaccuccuggagaagaucugggacuaccugaagcucguccggaucuacaccaagcccaagggccagcugccggacuacaccagccccguggugcugcccuacucccgcacgaccgucgaggacuucugcaugaagauccacaagaaccucaucaaggaguucaaguacgcccuggugugggggcugagcgugaagcacaacccccagaaggucggcaaggaccacacccucgaggacgaggacgugauccagaucgucaagaaguga

SEQ ID NO: 29380 - RNA, 792 nt, Artificial Sequence
  derived and/or modified sequence opt1 from DRGX__Homo_sapiens__NP_001263380
auguucuacuuccacugcccgccccagcuggagggcaccgccaccuucgggaaccacagcuccggcgacuucgacgacggguuccuccgccggaagcagcgccggaaccgcacgaccuucacccugcagcagcuggaggcccucgaggcgguguucgcccagacccacuaccccgacgucuucacgcgggaggagcuggccaugaagaucaaccugaccgaggcccgcguccaggugugguuccagaaccggcgcgccaaguggcggaagaccgagcgcggcgcgagcgaccaggagcccggggccaaggagcccauggccgaggugaccccgccgcccgugcggaacaucaacagcccgccgcccggcgaccaggcccgcuccaagaaggaggcgcucgaggcccagcagucccugggccggacgguggggcccgccggccccuucuuccccagcugccugcccgggacccuccugaacaccgccaccuacgcccaggcgcugucccacgucgccagccucaagggcgggccccugugcuccugcugcgugcccgaccccaugggccugagcuuccuccccacguacggcugccaguccaaccgcaccgccagcguggccacccugcggaugaaggcccgcgagcacuccgaggcgguccugcagagcgccaaccuccugcccuccaccagcuccagccccgggccgguggccaagcccgccccgcccgacggcucccaggagaagacgagccccaccaaggagcagagcgaggccgagaaguccguguga

SEQ ID NO: 29381 - RNA, 4014 nt, Artificial Sequence
  derived and/or modified sequence opt1 from DROSHA__Homo_sapiens__NP_001093882
augaugcagggcaacaccugccaccgcaugagcuuccaccccgggcggggcugcccgcgcgggcggggcgggcacggcgcccgccccuccgcccccagcuuccggccccagaaccugcgccuccugcacccgcagcagccccccgugcaguaccaguacgagcccccguccgcgcccagcaccacguucuccaacagccccgcccccaacuuccugccgccccggcccgacuucguccccuucccgccccccaugcccccguccgcccagggcccccucccccccugcccgauccgcccccccuuccccaaccaccagaugcggcacccguuccccgugcccccgugcuucccccccaugcccccgcccaugcccugccccaacaacccgcccgugcccggggcccccccgggccaggggaccuuccccuucaugaugccccccccgagcaugccccacccccccccgccccccgucaugccccagcaggugaacuaccaguacccgcccggcuacucccaccacaacuuccccccgcccagcuucaacuccuuccagaacaaccccagcuccuuccugcccagcgccaacaacuccagcuccccgcacuuccgccaccugccccccuacccccucccgaaggcgcccagcgagcggcgcucccccgagcggcugaagcacuacgacgaccaccgccaccgggaccacagccacgggcgcggcgagcggcaccgcagccuggaccggcgcgagcggggccgcucccccgaccgccggcgccaggacagccgguaccgcuccgacuacgaccgggggcgcaccccgagccggcaccgcuccuacgagcggagccgcgagcgggagcgcgagcggcaccgccaccgggacaaccgccggucccccagccucgagcgcuccuacaagaaggaguacaagcggagcggcucccgcagccccucccgcgagaagaagcgggcccgcugggaggaggagaaggaccgguggagcgacaaccaguccagcgggaaggacaagaacuacaccuccaucaaggagaaggagcccgaggagacgaugccggacaagaacgaggaggaggaggaggagcugcugaagcccguguggauccgcugcacccacagcgagaacuacuacuccagcgaccccauggaccaggucggcgacagcaccguggugggcaccucccggcuccgcgaccuguacgacaaguucgaggaggagcuggggagccggcaggagaaggccaaggccgcgcgccccccgugggagccccccaagacgaagcucgacgaggaccuggaguccagcuccgagagcgagugcgaguccgacgaggacagcaccugcuccagcuccagcgacuccgaggucuucgacgugaucgccgagaucaagcggaagaaggcccaccccgaccgccugcacgacgagcucugguacaacgacccgggccagaugaacgacgggccccugugcaagugcagcgccaaggcccggcgcaccggcauccggcacuccaucuaccccggggaggaggcgaucaagcccugccgcccgaugaccaacaacgccggccggcuguuccacuaccgcaucacggugagcccccccaccaacuuccucaccgaccggccgaccgucaucgaguacgacgaccacgaguacaucuucgagggcuucuccauguucgcccacgccccccugacgaacaucccccugugcaaggugauccgcuucaacaucgacuacaccauccacuucaucgaggagaugaugcccgagaacuucugcgugaaggggcucgagcuguucagccuguuccucuuccgggacauccuggagcuguacgacuggaaccucaagggcccgcuguucgaggacagcccccccugcugcccccgcuuccacuucaugccgcgguucguccgcuuccugcccgacgggggcaaggaggugcucuccaugcaccagauccugcuguaccuccugcgcugcagcaaggcccuggugcccgaggaggagaucgcgaacaugcuccagugggaggagcuggaguggcagaaguacgccgaggagugcaaggggaugaucgucaccaaccccggcaccaagccguccagcgugcggaucgaccagcuggaccgcgagcaguucaaccccgacgugaucacguuccccaucaucguccacuucggcauccggcccgcccagcucuccuacgccggggacccgcaguaccagaagcuguggaagagcuacgugaagcugcgccaccuccuggccaacucccccaaggugaagcagaccgacaagcagaagcuggcgcagcgggaggaggcccuccagaagauccgccagaagaacaccaugcggcgcgaggucaccguggagcugagcucccagggcuucuggaagacggggauccggagcgacgucugccagcacgccaugaugcugcccgugcugacccaccacauccgcuaccaccagugccucaugcaccuggacaagcugaucggcuacaccuuccaggaccggugccuccugcagcuggccaugacccaccccucccaccaccucaacuucgggaugaacccggaccacgcccgcaacagccuguccaacugcggcauccggcagcccaaguacggcgaccgcaaggugcaccacaugcacaugcggaagaaggggaucaacacgcugaucaacaucaugagccgccucggccaggacgaccccacccccucccggaucaaccacaacgagcgccuggaguuccugggggacgcggucguggaguuccucaccagcgugcaccuguacuaccuguucccgucccucgaggagggcggccuggccaccuaccggacggccaucguccagaaccagcaccuggccaugcucgcgaagaagcuggagcuggaccgcuucaugcucuacgcccacgggcccgaccugugccgcgagagcgaccugcggcacgccauggccaacugcuucgaggcccucaucggcgcgguguaccuggaggggucccuggaggaggccaagcagcucuucggccgccugcuguucaacgaccccgaccuccgggagguguggcugaacuacccccugcacccgcuccagcugcaggagcccaacaccgaccgccagcugaucgagaccagccccguccuccagaagcugaccgaguucgaggaggccaucggggugaucuucacgcacgugcggcugcucgcccgcgccuucacccugcggaccgucggcuucaaccaccugacccucggccacaaccagcgcauggaguuccugggggacagcaucaugcagcugguggcgaccgaguaccucuucauccacuucccggaccaccacgagggccaccugacgcugcuccgguccagccuggugaacaaccgcacccaggccaaggucgccgaggagcuggggaugcaggaguacgccaucaccaacgacaagaccaagcggcccguggcccuccgcacgaagacccuggcggaccugcucgaguccuucaucgccgcccuguacaucgacaaggaccuggaguacgugcacaccuucaugaacgucugcuucuucccccggcucaaggaguucauccugaaccaggacuggaacgaccccaagagccagcugcagcagugcugccucacccugcgcacggagggcaaggagccggacaucccccuguacaagacccuccagaccguggggcccucccacgcccggaccuacacgguggcggucuacuucaagggcgagcgcaucggcugcgggaagggccccagcauccagcaggccgagaugggggccgccauggacgcccuggagaaguacaacuucccgcagauggcgcaccagaagcgguucaucgagcgcaaguaccggcaggagcugaaggagaugcgcugggagcgggagcaccaggagcgcgagcccgacgagaccgaggacaucaagaaguga

SEQ ID NO: 29382 - RNA, 2640 nt, Artificial Sequence
  derived and/or modified sequence opt1 from DRP2__Homo_sapiens__NP_001164655
augaaccugugcuggaacgagaucaagaagaagucccacaaccuccgcgcccggcuggaggccuucagcgaccacagcggcaagcugcagcucccccugcaggagaucaucgacuggcugucccagaaggacgaggagcucagcgcgcagcugccgcugcagggggacguggcccucguccagcaggagaaggagacccacgccgccuucauggaggaggugaagucccgcggccccuacaucuacagcgugcuggaguccgcccaggcguuccugagccagcaccccuucgaggagcucgaggagccccacuccgagagcaaggacaccuccccgaagcagcggauccagaaccugagccgcuucgucuggaagcaggccacgguggccuccgagcugugggagaagcucaccgcccggugcguggaccagcaccgccacaucgagcggacccuggagcagcugcucgagauccagggggcgauggaggagcugagcaccacgcugucccaggccgagggcguccgcgccaccugggagcccaucggggaccucuucaucgacagccugcccgagcacauccaggccaucaagcuguucaaggaggaguucucccccaugaaggacggcgugaagcucgugaacgaccuggcccaccagcuggcgaucagcgacguccaccucuccauggagaacagccaggcccuggagcagaucaacgugcgguggaagcagcugcaggccagcguguccgagcgccucaagcagcugcaggacgcccaccgggacuucggcccggggagccagcacuuccuguccagcuccguccaggugcccugggagcgcgccaucagccccaacaaggugcccuacuacaucaaccaccaggcgcagacgaccugcugggaccacccgaagaugaccgagcucuaccagacccuggccgaccugaacaacaucaaguucuccgccuaccggaccgccaugaagcuccgccggguccagaaggcccugcgccuggaccucgugacccugacgaccgcgcuggagaucuucaacgagcacgaccuccaggccagcgagcacgugauggacgucguggaggugauccacugccugaccgcccuguacgagcggcucgaggaggagcgcggcauccuggucaacgugccccugugcguggacaugucccucaacuggcugcugaacgucuucgacagcgggcgguccggcaagaugcgcgcccugagcuucaagaccgggaucgccugccucugcggcacggaggugaaggagaagcugcaguaccuguucucccaggucgcgaacagcggcucccagugcgaccagcggcaccucggggugcugcugcacgaggccauccaggugccccgccagcucggcgaggucgccgccuucgggggcagcaacguggagcccuccgugcgcagcugcuuccgguucuccaccggcaagccggucaucgaggcgagccaguuccuggagugggugaaccuggagccccagagcaugguguggcucgccguccugcaccgcgugaccaucgccgagcaggucaagcaccagaccaagugcuccaucugccggcagugccccaucaagggguuccgcuaccggagccugaagcaguucaacguggacaucugccagacgugcuuccucaccggccgcgccuccaaggggaacaagcugcacuaccccaucauggaguacuacaccccgaccacgagcuccgagaacaugcgggacuucgccaccacccugaagaacaaguuccgcagcaagcacuacuucuccaagcacccccagcggggcuaccuccccgugcagagcgugcuggaggcggacuacuccgagacccccgccagcuccccgauguggccccacgccgacacgcacagccgcaucgagcacuucgccucccggcuggccgagauggagagccagaacugcuccuucuucaacgacagccucucccccgacgacagcaucgacgaggaccaguaccugcugcgccacagcucccccaucaccgaccgggagccggcguucgggcagcaggcccccugcagcgucgccaccgaguccaagggcgagcuccagaagauccuggcccaccuggaggacgagaaccgcauccuccagggcgagcugcggcgccugaaguggcagcacgaggaggccgcggaggcccccagccucgccgacggguccaccgaggccgcgacggaccaccggaacgaggagcugcuggccgaggcccgcauccuccggcagcacaagagccgccuggagacccgcaugcagauccuggaggaccacaacaagcagcucgagucccagcugcagcggcugcgcgagcuccugcugcagccgcccaccgagagcgacggcuccgggagcgccggcuccagccucgccuccagcccccagcaguccgaggggagccacccccgggagaagggccagaccacgccggacaccgaggcggccgacgacgugggcuccaagagccaggacgugucccugugccuggaggacaucauggagaagcuccgccacgccuuccccagcguccggagcuccgacgugaccgccaacacccugcuggccagcuga

SEQ ID NO: 29383 - RNA, 2523 nt, Artificial Sequence
  derived and/or modified sequence opt1 from DSC1__Homo_sapiens__NP_004939
auggcccuggccagcgcggcccccggcuccaucuucugcaagcagcuccuguucagccugcucgugcugacccugcucugcgacgccugccagaaggucuaccugcgcgugccgucccaccuccaggccgagacccugguggggaaggucaaccuggaggagugccucaagagcgccucccugauccggagcuccgaccccgcguuccgcauccuggaggacggcagcaucuacacgacccacgaccugauccucuccagcgagcggaaguccuucagcaucuuccuguccgacgggcagcgccgggagcagcaggagaucaagguggugcugagcgcccgcgagaacaagucccccaagaagcggcacaccaaggacaccgcccucaagcgcagcaagcggcgcugggcccccaucccggcgucccugauggagaacagccugggccccuucccccagcacguccagcagauccaguccgacgccgcccagaacuacacgaucuucuacagcaucagcgggcccggcguggacaaggagccguucaaccucuucuacaucgagaaggacaccggcgacaucuucugcacccgguccaucgaccgcgagaaguacgagcaguucgcccuguacggguacgccaccacggcggacggcuacgcccccgaguacccccugccccucaucaucaagaucgaggacgacaacgacaacgccccguacuucgagcaccgggugaccaucuucaccguccccgagaacugccgcagcgggaccuccgugggcaaggugacggccaccgaccuggacgagcccgacacccugcacacccggcucaaguacaagauccugcagcagauccccgaccacccgaagcacuucagcauccaccccgacacgggggucaucaccaccaccacgcccuuccuggaccgcgagaagugcgacaccuaccagcucaucauggaggugcgggacaugggcggccagcccuucgggcuguucaacaccggcaccaucacgaucucccuggaggacgagaacgacaacccgcccagcuucaccgagaccuccuacgugaccgaggucgaggagaaccgcaucgacguggagauccuccggaugaaggugcaggaccaggaccugcccaacacgccccacagcaaggccgucuacaagauccugcaggggaacgagaacggcaacuucaucaucuccaccgacccgaacaccaacgagggcgugcucugcguggucaagccccugaacuacgaggugaaccgccaggugauccugcaggucggggugaucaacgaggcgcaguucagcaaggccgccuccagccagacccccacgaugugcaccaccaccgucacggugaagaucaucgacuccgacgagggccccgagugccacccgcccgugaaggucauccagagccaggacggguuccccgccggccaggagcuccugggguacaaggcccuggacccggagaucuccagcggcgagggccuccgguaccagaagcugggggacgaggacaacugguucgagaucaaccagcacaccggcgaccugcgcacccucaaggugcuggaccgcgaguccaaguucgugaagaacaaccaguacaacaucagcgucguggcgguggacgccgucgggcgguccugcaccggcacccugguggugcaccucgacgacuacaacgaccacgcgccccagaucgacaaggaggucacgaucugccagaacaacgaggacuucgccgugcugaagcccguggaccccgacgggccggagaacggcccgcccuuccaguucuuccuggacaacagcgccagcaagaacuggaacaucgaggagaaggacggcaagaccgccauccugcgccagcggcagaaccucgacuacaacuacuacuccguccccauccagaucaaggaccgccacgggcugguggccacccacaugcugaccgugcgggucugcgacugcagcacgcccuccgagugccgcaugaaggacaagagcacccgggacgugcgccccaacgugauccucggccggugggccauccuggccaugguccugggguccgugcuccugcugugcauccucuucacgugcuucugcgugaccgcgaagcgcaccgucaagaagugcuuccccgaggacaucgcccagcagaaccugaucgugagcaacaccgagggccccggggaggaggugaccgaggccaacauccggcugccgaugcagaccuccaacaucugcgacacgagcauguccgucggcaccgugggcgggcagggcaucaagacccagcagagcuucgagauggugaagggcggguacacccucgacuccaacaagggcgggggccaccagacgcuggagagcgucaagggggugggccagggggacaccggccgcuacgccuacaccgacuggcaguccuucacccagccccggcugggcgaggagagcauccgcgggcacacgcucaucaagaacuga

SEQ ID NO: 29384 - RNA, 2544 nt, Artificial Sequence
  derived and/or modified sequence opt1 from DSC2__Homo_sapiens__NP_004940
auggaggccgcccgccccagcggcuccuggaacggggcgcugugccggcuccugcugcucacccuggccauccugaucuucgccagcgacgccugcaagaacgugacccuccacgucccguccaagcuggacgccgagaagcuggugggccgcgugaaccucaaggagugcuucacggcggccaaccugauccacagcuccgaccccgacuuccagauccuggaggacgggagcgucuacaccaccaacaccauccuccuguccagcgagaagcgguccuucacgauccugcucagcaacaccgagaaccaggagaagaagaagaucuucguguuccuggagcaccagaccaaggugcugaagaagcgccacaccaaggagaagguccuccggcgcgccaagcggcgcugggcccccauccccugcuccaugcuggagaacagccugggcccguucccccucuuccugcagcagguccaguccgacacggcgcagaacuacaccaucuacuacagcauccgggggcccggcguggaccaggagccccgcaaccuguucuacguggagcgggacaccggcaaccucuacugcacccgcccgguggaccgggagcaguacgaguccuucgagaucaucgccuucgccacgacccccgacggguacacccccgagcugccccugccgcucaucaucaagaucgaggacgagaacgacaacuaccccaucuucaccgaggagacguacaccuucaccaucuucgagaacugccgcgugggcaccacggucggccaggugugcgccaccgacaaggacgagcccgacaccaugcacacccggcugaaguacagcaucaucggccaggugcccccgucccccacgcuguucagcaugcaccccaccaccggggucaucaccacgaccuccagccagcucgaccgcgagcugaucgacaaguaccagcugaagaucaaggugcaggacauggacggccaguacuucggccuccagaccaccagcacgugcaucaucaacaucgacgacgugaacgaccaccuccccaccuucacccggaccuccuacgucacgagcguggaggagaacaccguggacgucgagauccugcgcgugaccguggaggacaaggaccuggucaacaccgccaacuggcgggcgaacuacaccauccugaaggggaacgagaacggcaacuucaagaucgugacggacgccaagaccaacgaggggguccugugcguggugaagccgcucaacuacgaggagaagcagcagaugauccugcagaucggcgucgugaacgaggcccccuucucccgcgaggccagcccccgguccgccaugagcaccgcgaccgugacggucaacguggaggaccaggacgagggccccgagugcaacccgcccauccagaccgugcgcaugaaggagaacgccgaggucgggaccaccuccaacggcuacaaggccuacgaccccgagacgcgcagcuccagcgggauccgguacaagaagcugaccgaccccaccggcugggugaccaucgacgagaacacgggguccaucaagguguuccgcagccucgaccgggaggccgagaccaucaagaacggcaucuacaacaucaccguccuggccuccgaccagggcgggcggaccugcacgggcacccuggggaucauccuccaggacgugaacgacaacagcccguucauccccaagaagaccgugaucaucugcaagcccaccauguccagcgcggagaucgucgccguggacccggacgagcccauccacgggccgcccuucgacuucucccuggagagcuccacgagcgaggugcagcgcauguggcgccugaaggccaucaacgacaccgccgcccggcucagcuaccagaacgacccgcccuucggguccuacgucgugcccaucaccgugcgcgaccggcugggcaugagcuccgucaccagccuggacgugacgcugugcgacugcaucaccgagaacgacugcacccaccgcguggacccccggaucggcgggggcgggguccagcucggcaagugggcgauccuggccauccugcucgggaucgcccugcuguucugcauccucuucacccuggugugcggcgccuccggcacgagcaagcagcccaaggugauccccgacgaccuggcgcagcagaaccucaucgucuccaacaccgaggcccccggggacgacaagguguacagcgccaacggcuucaccacccagacggugggggccuccgcccagggcgucugcggcaccguggggagcggcaucaagaacgggggccaggagaccaucgagauggugaagggcgggcaccagaccuccgagagcugccgcggcgcggggcaccaccacacgcuggacuccugccggggcgggcacaccgaggucgacaacugccgcuacaccuacagcgaguggcacuccuucacccagccccggcugggcgaggagagcauccgcgggcacacccucaucaagaacuga

SEQ ID NO: 29385 - RNA, 2691 nt, Artificial Sequence
  derived and/or modified sequence opt1 from DSC3__Homo_sapiens__NP_001932
auggccgccgcgggcccccgccggagcgugcgcggggccgucugccugcaccuccugcugacccucgugaucuucucccgggccggcgaggccugcaagaaggugauccugaacgucccgagcaagcuggaggccgacaagaucaucgggcgcgugaaccucgaggagugcuuccgguccgcggaccugauccgcagcuccgaccccgacuuccgggugcugaacgacggcagcgucuacaccgcccgcgccguggcccucuccgacaagaagcggagcuucacgaucuggcuguccgacaagcgcaagcagacccagaaggaggugaccguccugcucgagcaccagaagaaggugagcaagacccggcacacgcgcgagaccgugcugcggcgcgcgaagcggcgcugggcccccauccccugcuccaugcaggagaacagccuggggccguucccccucuuccugcagcaggucgaguccgacgccgcccagaacuacaccguguucuacagcaucuccggccggggcguggacaaggagccccugaaccucuucuacaucgagcgcgacaccgggaaccuguucugcacgcggcccgucgaccgcgaggaguacgacguguucgaccugaucgccuacgcgagcaccgccgacggcuacuccgccgaccucccgcugccccugcccauccggguggaggacgagaacgacaaccaccccgucuucaccgaggccaucuacaacuucgaggugcucgagagcucccgcccggggaccacggugggcgucgugugcgccaccgaccgcgacgagcccgacaccaugcacacccggcugaaguacagcauccugcagcagacgccccgcagccccgggcuguucuccgugcacccgagcaccggcgucaucaccaccgugucccacuaccuggaccgggaggucguggacaaguacagccugaucaugaaggugcaggacauggacggccaguucuucgggcucaucggcacguccacgugcaucaucaccgucaccgacagcaacgacaacgcgcccaccuuccgccagaacgccuacgaggccuucguggaggagaacgccuucaacguggagauccugcggauccccaucgaggacaaggaccugaucaacaccgccaacuggcgcgucaacuucaccauccucaaggggaacgagaacggccacuucaagaucuccaccgacaaggagacgaacgagggcgugcugagcguggucaagccccugaacuacgaggagaaccgccaggugaaccucgagaucggggugaacaacgaggcgccguucgcccgggacaucccccgggucaccgcccugaaccgcgcccuggugaccgugcacguccgggaccucgacgagggccccgagugcacccccgccgcgcaguacgugcgcaucaaggagaaccuggccgugggguccaagaucaacggcuacaaggccuacgacccggagaaccggaacgggaacggccugcgcuacaagaagcuccacgaccccaagggcuggaucacgaucgacgagaucagcggguccaucaucaccagcaagauccuggaccgggaggucgagacccccaagaacgagcuguacaacaucaccgugcucgccaucgacaaggacgaccgcuccugcacgggcacccuggcggugaacaucgaggacgucaacgacaacccgcccgagauccugcaggaguacguggugaucugcaagcccaagaugggguacaccgacauccucgccgucgaccccgacgagccggugcacggcgcccccuucuacuucagccugcccaacaccucccccgagaucagccggcuguggucccugaccaaggugaacgacacggccgcccgccucagcuaccagaagaacgcgggguuccaggaguacaccaucccgaucaccgucaaggaccgggccggccaggccgccaccaagcugcugcgcgugaaccucugcgagugcacgcaccccacccagugccgcgccaccucccggagcaccggcgugauccuggggaagugggcgauccuggccauccuccugggcaucgcccuccucuucagcguccugcugacgcucgugugcgggguguucggcgccaccaaggggaagcgcuuccccgaggaccuggcccagcagaaccugaucaucuccaacaccgaggcgcccggcgacgaccgggucugcagcgccaacggcuucaugacccagacgaccaacaacuccagccagggguucugcggcaccaugggguccggcaugaagaacggcgggcaggagaccaucgagaugaugaagggcgggaaccagacgcucgagagcugccgcggcgccgggcaccaccacacccuggacuccugccggggcggccacaccgagguggacaacugccgcuacaccuacagcgaguggcacuccuucacgcagccgcggcugggggagaagcuccaccgcugcaaccagaacgaggaccggaugcccagccaggacuacgugcugaccuacaacuacgagggccgcgggucccccgccggcagcgucgggugcugcuccgagaagcaggaggaggacggccuggacuuccucaacaaccuggagcccaaguucaucacccuggcggaggccugcaccaagcgguga

SEQ ID NO: 29386 - RNA, 6039 nt, Artificial Sequence
  derived and/or modified sequence opt1 from DSCAM__Homo_sapiens__NP_001380
auguggauccuggcccugagccuguuccagagcuucgccaacguguucagcgaggaccugcacagcagccuguacuucgucaacgcgucccugcaggaggugguguucgccagcaccaccggcacccugguccccugccccgccgccgggaucccgcccgugacccuccggugguaccuggccaccggcgaggagaucuacgacgugcccgggauccggcacguccaccccaacggcacccugcagaucuuccccuucccgcccuccagcuucuccacccucauccacgacaacaccuacuacugcaccgcggagaaccccagcgggaagauccgcucccaggacgugcacaucaaggccgugcugcgggagcccuacaccguccgcguggaggaccagaagaccaugcggggcaacguggccgucuucaagugcaucauccccagcuccguggaggccuacaucaccguggucagcugggagaaggacaccgugucccuggugagcggcucccgcuuccucaucaccagcacgggggcgcuguacaucaaggacguccagaacgaggacggccuguacaacuaccggugcaucacccgccaccgguacaccggggagacccgccaguccaacagcgcccgccuguucgugagcgaccccgccaacuccgcccccagcauccuggacggcuucgaccaccgcaaggccauggcggggcagcggguggagcugcccugcaaggcccucggccaccccgagcccgacuaccgcuggcugaaggacaacaugccgcuggagcucuccggccgguuccagaagacggucaccgggcugcugaucgagaacauccgccccagcgacuccggcagcuacgugugcgagguguccaaccgguacgggaccgccaaggucaucggccgccucuacgugaagcagccccugaaggccaccaucagcccccggaaggucaaguccagcgugggcucccaggugagccuguccugcagcgucacggggaccgaggaccaggagcucuccugguaccgcaacggcgagauccugaaccccgggaagaacgugcggaucaccggcaucaaccacgagaaccugaucauggaccacauggucaaguccgacgggggcgccuaccagugcuucguccgcaaggacaagcucuccgcgcaggacuacguccaggugguccuggaggacggcacccccaagaucaucagcgccuucuccgagaagguggugagccccgccgagcccgucagccugaugugcaacgugaaggggacgccccuccccaccaucaccuggacccuggacgacgaccccauccugaagggcgggucccaccgcaucagccagaugaucacguccgagggcaacguggucagcuaccucaacaucuccagcucccaggugcgggacgggggcguguaccgcugcaccgccaacaacagcgccggcgucgugcuguaccaggcgcggaucaacgugcgcgggcccgccuccauccggcccaugaagaacaucaccgccaucgccggccgcgacaccuacauccacugccgggucaucggguaccccuacuacagcaucaagugguacaagaacuccaaccugcuccccuucaaccaccgccagguggccuucgagaacaacggcacgcugaagcugagcgacgugcagaaggaggucgacgagggggaguacacgugcaacgugcucgugcagccccagcuguccaccagccaguccguccacgugaccgugaaggugccgcccuucauccagcccuucgaguucccgcgguucagcaucggccagcgcguguucauccccugcguggucguguccggcgaccugcccaucacgaucaccuggcagaaggacgggcggcccaucccgggcagccucggggugaccaucgacaacaucgacuucaccagcucccugcgcaucagcaaccugucccucaugcacaacggcaacuacacgugcaucgcgcggaacgaggccgccgccgucgagcaccagagccagcugaucgugcgcgugccgcccaaguucgucgugcagccccgggaccaggacggcaucuacgggaaggcggugauccugaacugcuccgccgagggcuacccgguccccacgaucguguggaaguucagcaagggggccggcgugccccaguuccagcccaucgcccugaacgggcgcauccagguccucuccaacggcagccugcugaucaagcacgugguggaggaggacuccggcuacuaccucugcaaggucagcaacgacgugggggccgacguguccaagagcauguaccugaccgucaagaucccggcgaugaucaccuccuaccccaacaccacgcuggccacccagggccagaagaaggagaugagcugcaccgcccacggggagaagcccaucaucgugcggugggagaaggaggaccgcaucaucaaccccgagauggcccgguaccucgucuccaccaaggaggugggcgaggaggugaucagcacgcugcagauccugccgaccguccgcgaggacuccggguucuucagcugccacgccaucaacuccuacggcgaggaccgcggcaucauccagcucaccgugcaggagccgcccgacccgcccgagaucgagaucaaggacgugaaggcgcggaccaucacgcugcgcuggaccaugggguucgacggcaacagccccaucaccggguacgacaucgagugcaagaacaagagcgacuccugggacagcgcccagcggaccaaggacgucagcccccagcugaacagcgccacgaucaucgacauccaccccuccagcaccuacuccauccgcauguacgccaagaaccggaucggcaagagcgagcccuccaacgagcucaccaucaccgccgacgaggcggcccccgacgggcccccgcaggaggugcaccuggagcccaucagcucccagagcauccgcgugacguggaaggcccccaagaagcaccuccagaacggcaucauccggggcuaccagaucggguaccgcgaguacuccaccggcgggaacuuccaguucaacaucaucagcgucgacaccuccggcgacagcgagguguacacccucgacaaccugaacaaguucacgcaguacgggcuggugguccaggccugcaaccgggcgggcaccggccccuccagccaggagaucaucaccaccacgcucgaggacgugccguccuacccgcccgagaacgugcaggccaucgccaccagccccgagagcaucuccaucagcugguccacccugagcaaggaggcccugaacgggauccuccagggcuuccgcgucaucuacugggccaaccugauggacggggagcugggcgagaucaagaacaucaccacgacccagccgucccucgagcuggacggccuggagaaguacaccaacuacagcauccaggugcucgcguucacccgggccggggacggcgugcgcuccgagcagaucuucacgcggaccaaggaggacguccccgggccgcccgccggcgugaaggccgccgcggccagcgccuccaugguguucgucagcuggcugccgccccugaagcucaacgggaucauccgcaaguacaccguguucugcucccaccccuaccccaccgugaucagcgaguucgaggccucccccgacagcuucuccuaccggauccccaaccugagccgcaaccggcaguacuccgucugggugguggccgucaccagcgcgggccgcggcaacuccagcgagaucaucacgguggagccccuggccaaggcccccgcccggauccucaccuucagcgggaccgugaccacgccguggaugaaggacaucguccugcccugcaaggcggugggcgaccccucccccgccgugaaguggaugaaggacagcaacgggaccccgucccuggucaccaucgacggccgccggagcaucuucuccaacgggagcuucaucauccgcaccgugaaggccgaggacuccggcuacuacagcugcaucgccaacaacaacuggggcuccgacgagaucauccucaaccuccagguccaggugccgcccgaccagccgcgccugacggugagcaagaccaccuccagcuccaucacccucagcuggcugcccggggacaacggcggguccagcauccggggcuacauccugcaguacuccgaggacaacagcgagcaguggggguccuuccccaucagccccagcgagcgcuccuaccggcucgagaaccugaagugcggcacgugguacaaguucacccugaccgcccagaacggcguggggccgggccgcaucagcgagaucaucgaggcgaagacccucgggaaggagccccaguucuccaaggagcaggagcuguucgccagcaucaacacgacccgggugcgccugaaccucaucggcuggaacgacggcgggugccccaucaccuccuucacccuggaguaccggcccuucggcacgaccguguggaccaccgcccagcgcacgagccuguccaagagcuacauccucuacgaccugcaggaggccaccugguacgagcugcagaugcgggugugcaacuccgccgggugcgcggagaagcaggccaacuucgccacccucaacuacgacggcagcaccaucccgccccugaucaaguccgucgugcagaacgaggaggggcugacgaccaacgagggccucaagaugcuggugaccaucagcugcauccuggucggcgugcuccugcuguucgugcuccugcuggucgugcgccggcgccggcgcgagcagcggcucaagcgccugcgggacgccaagucccuggccgagaugcucaugagcaagaacacccgcacguccgacacccugagcaagcagcagcagacccugcggaugcacaucgacaucccccgcgcgcagcuccugaucgaggagcgcgacaccauggagacgaucgacgaccgguccaccgugcugcucaccgacgccgacuucggggaggccgccaagcagaagucccugaccgucacccacacggugcacuaccaguccgucagccaggccaccggcccccugguggacgugagcgacgcgcgcccggggaccaaccccaccacgcggcgcaacgccaaggccggccccaccgcccggaaccgcuacgcgucccaguggacccucaaccggccccacccgaccaucagcgcccacacgcugaccaccgacuggcgccugcccacgccccgggccgccggguccgucgacaaggagagcgacuccuacagcgugucccccagccaggacacggaccgcgcccgguccagcaugguguccaccgagagcgcguccagcaccuacgaggagcucgcccgcgccuacgagcacgccaagauggaggagcagcugcggcacgccaaguucaccaucacggagugcuucaucuccgacaccagcuccgagcagcugaccgcgggcaccaacgaguacacggacagccucaccagcuccaccccgagcgaguccggcaucugccgcuucaccgccuccccgcccaagccccaggacgggggccgggucaugaacauggccgugccgaaggcccaccgccccggggaccugauccaccucccgcccuaccuccggauggacuuccugcugaaccgcggcgggccgggcacgucccgggaccucagccugggccaggccugccuggagccccagaagucccgcacccucaagcggcccaccgugcuggagccgauccccauggaggcggccagcuccgccagcuccacccgcgaggggcagagcuggcagcccggcgccgucgcgacgcugccccagcgcgagggggccgagcugggccaggccgccaagauguccagcucccaggagagccuccuggacucccgggggcaccugaagggcaacaacccguacgccaagagcuacacccucguguga

SEQ ID NO: 29387 - RNA, 6342 nt, Artificial Sequence
  derived and/or modified sequence opt1 from DSCAML1__Homo_sapiens__NP_065744
augaccggcgccggggagccccgccgggaggagcccccgccccagcccagcgccggccugcgcucccgggagagcggggcccccuccgccggcgggugggagcgcgccgagcggggccgcggcgccgccgcgcggcccgccaccgggccgccgccccgccggaucggcccccucuacgggauguggcuggucaccuuccugcuccugcuggacagccuccacaaggcccgccccgaggacgucggcaccucccuguacuucgugaacgacagccugcagcaggucaccuucuccagcuccgucgggguggugguccccugccccgccgcgggcagccccuccgccgcccuccggugguaccuggccaccggcgacgacaucuacgacgugccccacauccgccacgugcacgccaacgggacgcugcagcucuaccccuucagccccuccgcguucaacagcuucauccacgacaacgacuacuucugcaccgccgagaacgccgccggcaagauccggucccccaacauccgcgucaaggccguguuccgggagcccuacaccgugcgcgucgaggaccagcggagcaugcgcgggaacguggcgguguucaagugccugauccccuccagcguccaggaguacguguccguggucagcugggagaaggacaccgugagcaucauccccgagcaccgguucuucaucaccuaccacggcggccuguacaucuccgacgugcagaaggaggacgcccucagcaccuaccgcugcaucaccaagcacaaguacuccggggagacccggcagagcaacggcgcccgccuguccgucacggaccccgccgagagcauccccaccauccuggacggguuccacucccaggaggugugggccggccacaccguggagcuccccugcaccgcgagcggguaccccauccccgccauccgcuggcugaaggacggccggccccugcccgccgacucccgcuggaccaagcggaucaccggccucaccaucagcgaccugcgcaccgaggacuccgggacguacaucugcgaggucaccaacaccuucggcagcgccgaggccaccgggauccugauggugaucgacccgcuccacgucacgcugacccccaagaagcugaagaccggcaucggguccaccgugauccucagcugcgcgcugacgggcucccccgaguucaccauccggugguaccgcaacaccgagcuggugcuccccgacgaggccaucagcauccggggccuguccaacgagacccugcucaucacgagcgcccagaagucccacagcggggccuaccagugcuucgcgacccgcaaggcccagaccgcccaggacuucgccaucaucgcccuggaggacggcacgccccggaucgucagcuccuucagcgagaagguggugaaccccggggagcaguucucccugaugugcgcggccaagggcgcgcccccgcccacggucaccugggcccucgacgacgagcccaucgugcgcgacgggagccaccggaccaaccaguacaccauguccgacggcaccacgaucagccacaugaacgugaccggcccccagauccgcgacgggggcgucuaccggugcaccgcccgcaaccuggugggguccgcggaguaccaggcccggaucaacgugcgcggcccgcccagcauccgggccaugcgcaacaucaccgccgucgccggccgggacacgcugaucaacugccgcgugaucggguaccccuacuacuccaucaagugguacaaggacgcgcuccugcugcccgacaaccaccgccagguggucuucgagaacggcacccucaagcugaccgacgugcagaaggggauggacgagggcgaguaccugugcagcgugcucauccagccccagcuguccaucagccaguccguccacguggccgugaaggugccgccccucauccagcccuucgaguucccgcccgccagcaucgggcagcuccuguacauccccugcgugguguccagcggcgacaugcccauccggaucaccuggcgcaaggacggccaggucaucaucuccgggagcggcgugacgaucgagagcaaggaguucauguccagccugcagaucuccagcgugucccugaagcacaacgggaacuacacgugcaucgccagcaacgcggccgccaccgucucccgggagcgccagcucaucgugcgggugccgccccgcuucgucgugcagcccaacaaccaggacggcaucuacgggaaggccggcgugcugaacugcagcgucgacggcuacccgccgcccaaggugauguggaagcacgccaagggguccggcaacccccagcaguaccaccccgugccccugaccgggcggauccagauccuccccaacagcucccugcugauccgccacguccucgaggaggacaucggcuacuaccugugccaggcgagcaacggggugggcacggacaucuccaagagcauguuccugaccgugaagauccccgccaugaucaccucccaccccaacaccacgaucgccaucaagggccacgccaaggagcucaacugcaccgcccggggcgagcgccccaucaucauccggugggagaagggcgacaccgucaucgaccccgaccgcgugaugcgguacgcgaucgccaccaaggacaacggggacgagguggucagcacgcugaagcugaagcccgccgaccgcggcgacuccguguucuucagcugccacgccaucaacuccuacggggaggaccggggccucauccagcugaccgugcaggagccgcccgacccgcccgagcuggagauccgcgaggucaaggcccggagcaugaaccuccgcuggacccagcgguucgacggcaacagcaucaucaccggguucgacaucgaguacaagaacaaguccgacagcugggacuucaagcaguccacgcgcaacaucagcccgaccaucaaccaggcgaacaucguggaccugcaccccgccuccguguacagcauccggauguacuccuucaacaagaucggccgcagcgagcccuccaaggagcugaccaucagcaccgaggaggccgcccccgacgggccgcccauggacgucacgcuccagcccgugaccucccagagcauccaggugaccuggaaggcgcccaagaaggagcugcagaacggcgucauccgcggcuaccagaucggguaccgggagaacuccccgggcagcaacgggcaguacuccaucguggagaugaaggccaccggcgacagcgaggucuacacgcuggacaaccucaagaaguucgcccaguacgggguggugguccaggccuucaaccgcgccggcaccggccccuccagcuccgagaucaacgcgaccacccuggaggacgugcccagccagcccccggagaacgugcgggcccugagcaucacguccgacgucgccgugaucagcugguccgagccgccccgcagcacccucaacggggugcugaagggcuaccgggucaucuucuggucccuguacguggacggggaguggggcgagaugcagaacaucaccaccacccgcgagcggguggagcuccgcgggauggagaaguucacgaacuacagcguccaggugcuggccuacacccaggccggcgacggcgugcgguccagcguccuguacauccagaccaaggaggacgugcccgggccgcccgcgggcaucaaggccgugcccuccagcgccuccagcgucgugguguccuggcucccgcccaccaagcccaacggggucauccgcaaguacacgaucuucugcagcucccccggcagcgggcagccggcccccuccgaguacgagaccagccccgagcagcuguucuaccggaucgcccaccugaaccgcggccagcaguaccuccuguggguggcggccgugaccuccgccggccgggggaacagcagcgagaaggucaccaucgagcccgccggcaaggccccggcgaagaucaucuccuucgggggcacggugaccacccccuggaugaaggacgugcgccugcccugcaacagcgucggcgaccccgccccggccgugaaguggaccaaggacuccgaggacagcgccauccccguguccauggacgggcaccggcucauccacacgaacggcacccugcugcuccgcgcggucaaggccgaggacagcggguacuacacgugcaccgccacgaacaccggcggguucgacaccaucaucgugaaccugcugguccaggugccgcccgaccagccgcggcucaccguguccaagacgagcgccuccagcaucacccugaccuggauccccggcgacaacggcggguccagcauccgcggcuucgugcugcaguacuccguggacaacagcgaggaguggaaggacguguucaucuccagcuccgagcggagcuucaagcucgacucccugaagugcgggaccugguacaaggugaagcuggccgcgaagaacagcgucggcagcgggcgcaucuccgagaucaucgaggccaagacgcacggccgcgagcccagcuucuccaaggaccagcaccucuucacccacaucaacagcacccacgcccggcugaaccugcagggcuggaacaacgggggcugccccaucaccgccaucgugcucgaguaccgcccgaaggggacgugggccuggcagggccugcgggcgaacuccagcggggagguguuccugaccgagcuccgcgaggccaccugguacgagcugcggaugcgcgccugcaacuccgccggcugcggcaacgagaccgcccaguucgcgacgcuggacuacgacgggagcaccaucccgcccaucaaguccgcccagggcgagggggacgacgucaagaagcuguucaccaucggcugccccgugauccuggccacccuggggguggcccuccuguucaucguccggaagaagcgcaaggagaagcggcugaagcgccuccgggacgccaagagccuggccgagaugcugaucuccaagaacaaccgcagcuucgacacgccggugaaggggccgccccagggcccccggcuccacaucgacaucccgcgcgugcagcugcugaucgaggacaaggaggggaucaagcagcucggcgacgacaaggccaccauccccgucaccgacgccgaguucucccaggccgugaacccccagagcuucugcaccggggugucccugcaccacccgacccugauccagagcacgggcccccucaucgacauguccgacauccggcccggcaccaaccccgucagccgcaagaacgugaaguccgcgcacagcacccggaaccgcuacagcucccaguggacccugacgaagugccaggccagcaccccggcccggacccugaccuccgacuggcgcacggucgggagccagcacggcgugaccgugaccgaguccgacagcuacuccgccagccucucccaggacaccgacaaggggcggaacagcauggucuccacggagagcgccuccagcaccuacgaggagcuggcgcgcgccuacgagcacgccaagcuggaggagcagcuccagcacgccaaguucgagaucaccgagugcuucaucuccgacagcuccagcgaccagaugaccacgggcaccaacgagaacgccgacagcaugaccuccaugagcacccccuccgagcccgggaucugccgcuucacggcgagcccgcccaagccccaggacgccgaccggggcaagaacguggccgugcccaucccccaccgcgccaacaaguccgacuacugcaaccugccccuguacgccaagagcgaggcguucuuccggaaggccgacggccgcgagcccugccccgucgugcccccgcgggaggccuccauccgcaaccucgcccggaccuaccacacccaggcgcgccaccugacccuggaccccgccagcaagucccucgggcugccccaccccggcgccccggccgccgcgagcacggccacccugccccagcggacccucgccaugcccgcgccgcccgccgggaccgcgccgcccgcccccggccccacgcccgccgagcccccgaccgcccccuccgccgcgccgcccgccccgagcaccgagccgccccgcgccgggggcccccacaccaagaugggcgggucccgggacagccugcuggagauguccacgagcggcguggggcgcucccagaagcagggcgccggggcguacagcaaguccuacacccucgucuga

SEQ ID NO: 29388 - RNA, 1182 nt, Artificial Sequence
  derived and/or modified sequence opt1 from DSCC1__Homo_sapiens__NP_076999
augaagcgcacccgggacgagguggacgccacccugcagaucgccaagcucaacgcggccgagcugcugcccgccguccacugccucggcuucgggccgggcgccagcggggccgcggccggcgacuucugccugcuggagcucgagcccacgcugugccagcagcuggaggacgggcacucccucgugauccgcggcgacaaggacgagcaggccgugcugugcagcaaggacaagaccuacgaccugaagaucgccgacaccuccaacaugcuccuguucauccccggcugcaagacccccgaccagcugaagaaggaggacagccacugcaacaucauccacacggagaucuucggguucuccaacaacuacugggagcuccggcgccggcgcccgaagcugaagaagcugaagaagcuccugauggagaaccccuacgagggccccgacagccagaaggagaaggacuccaacagcuccaaguacaccaccgaggaccugcucgaccagauccaggcgagcgaggaggagaucaugacccagcugcagguccugaacgccugcaagaucgggggcuacuggcggauccucgaguucgacuacgagaugaagcugcugaaccacgugacgcagcucguggacuccgagagcugguccuucgggaaggucccccugaacacgugccugcaggagcucggcccgcuggagcccgaggagaugaucgagcacugccugaagugcuacggcaagaaguacguggacgagggggagguguacuucgagcucgacgccgacaagaucugccgcgccgccgcgcggaugcugcugcagaacgccgucaaguucaaccucgccgaguuccaggagguguggcagcagagcgugcccgagggcauggucaccucccuggaccagcugaaggggcucgcccugguggaccgccacagccggcccgagaucaucuuccugcucaagguggacgaccugccggaggacaaccaggagcgcuucaacucccuguucagccuccgggagaaguggaccgaggaggacaucgcccccuacauccaggaccugugcggcgagaagcagaccaucggcgcgcugcucaccaaguacucccacagcagcaugcagaacggggucaagguguacaacucccgccggcccaucagcuga

SEQ ID NO: 29389 - RNA, 357 nt, Artificial Sequence
  derived and/or modified sequence opt1 from DSCR4__Homo_sapiens__NP_005858
augagccugaucauccucacccgcgacgacgagccccggaucuucaccccggacuccgacgccgccagccccgcgcugcacuccacgagcccccugcccgacccggccuccgccagcccccuccaccgcgaggagaagauccugcccaaggugugcaacaucgucuccugccugagcuucucccuccccgccagcccgaccgacuccggccuggccagccccaccaucaucacccgggaggggcagcaguucugggcgaagugccugaucuggaaguaccagcucuaccugcacggccugcacaagaaguccgacgggcgccgggacaagcagaucagcgccucccccagcacguga

SEQ ID NO: 29390 - RNA, 2877 nt, Artificial Sequence
  derived and/or modified sequence opt1 from DSE__Homo_sapiens__NP_037484
augcgcacccacacccggggcgcccccagcguguucuucaucuaccugcucugcuucgucuccgccuacaucacggacgagaacccggaggugaugauccccuucaccaacgcgaacuacgacagccaccccaugcuguacuucucccgcgccgagguggccgagcugcagcuccgggccgccagcucccacgagcacaucgcggcccgccugaccgaggccguccacaccaugcugagcagcccccucgaguaccugccgcccugggaccccaaggacuacuccgcccgguggaacgagaucuucgggaacaaccugggcgcgcucgccauguucugcgugcuguaccccgagaacaucgaggcccgcgacauggccaaggacuacauggagcggauggccgcgcagccguccuggcuggugaaggacgcccccugggacgaggucccccucgcccacagccuggugggguucgccacggccuacgacuuccuguacaacuaccucuccaagacccagcaggagaaguuccuggaggugaucgcgaacgccagcggcuacauguacgagaccuccuaccgccggggguggggcuuccaguaccugcacaaccaccagcccaccaacugcauggcccuccugacgggcagccugguccucaugaaccagggguaccugcaggaggccuaccuguggaccaagcagguccucaccaucauggagaagucccuggugcugcuccgcgaggugaccgacggcagccuguacgaggggguggccuacggcuccuacacgacccggagccuguuccaguacauguuccucgugcagcgccacuucaacaucaaccacuucgggcacccguggcugaagcagcacuucgcguucauguaccggaccauccugcccggcuuccagcgcaccgucgccaucgccgacuccaacuacaacugguucuacggccccgagagccagcucguguuccuggacaaguucgugaugcggaacgggagcggcaacuggcuggccgaccagauccgccggaaccgcgucguggaggggcccggcacgccguccaagggccagcgguggugcacccuccacaccgaguuccugugguacgacgggagccugaaguccgugcccccgcccgacuucggcacccccacgcuccacuacuucgaggacuggggcgucgugaccuacgggagcgcccugcccgcggagaucaaccgcuccuuccugagcuucaaguccgggaagcucggcggccgggccaucuacgacaucgugcaccgcaacaaguacaaggacuggaucaagggguggcgcaacuucaacgccggccacgagcaccccgaccagaacagcuucaccuucgcccccaacggggucccguucaucaccgaggcgcuguacggccccaaguacacguucuucaacaacgugcugauguucucccccgccgucagcaaguccugcuucagccccugggugggccaggugaccgaggacugcuccagcaagugguccaaguacaagcacgaccucgccgccagcugccaggggcgggucguggccgcggaggagaagaacggcguggucuucauccgcggggagggcgugggggccuacaacccgcagcugaaccugaagaacgugcagcggaaccucauccugcugcacccccagcugcuccugcuggucgaccagauccaccucggcgaggagagcccccuggagaccgccgccuccuucuuccacaacguggacgugccguucgaggagaccgucguggacggggugcacggcgccuucauccgccagcgggacggccuguacaagauguacuggauggacgacacgggguacuccgagaaggcgaccuucgccagcgucaccuacccccgcggcuaccccuacaacgggaccaacuacgugaacgugacgaugcaccuccggagccccaucacccgcgccgccuaccuguucaucggcccguccaucgacguccagagcuucaccgugcacggcgacucccagcagcuggacguguucaucgccaccagcaagcacgcguacgccacguaccucuggaccggggaggccaccggccaguccgccuucgcgcaggucaucgccgaccggcacaagauccuguucgaccgcaacagcgccaucaaguccagcaucgugcccgaggugaaggacuacgccgccaucgucgagcagaaccugcagcacuucaagcccguguuccagcuccuggagaagcagauccugucccgggugcgcaacaccgcgagcuuccggaagaccgccgagcgccuccugcgguucuccgacaagcgccagacggaggaggccaucgaccggaucuucgccaucagccagcagcagcagcagcaguccaagagcaagaagaaccgccgggccgggaagcgcuacaaguucgucgacgcggugcccgacaucuucgcccagaucgaggugaacgagaagaagauccgccagaaggcccagauccuggcccagaaggagcucccgaucgacgaggacgaggagaugaaggaccugcuggacuucgccgacgucaccuacgagaagcacaagaacggcgggcucaucaagggccgguucggccaggcgcgcauggugaccaccacgcacucccgggcccccagccuguccgccagcuacacccgccuguuccucauccugaacaucgccaucuucuucgugaugcuggcgaugcagcucaccuacuuccagcgggcccagagccugcacgggcagcgcugccuguacgccguccuccugaucgacuccugcauccugcucuggcuguacagcuccugcagccagucccagugcuga

SEQ ID NO: 29391 - RNA, 3669 nt, Artificial Sequence
  derived and/or modified sequence opt1 from DSEL__Homo_sapiens__NP_115536
augcccaagggcggggccccgcccuggaucauggcccugauguucaccggccaccuccuguuccuggcgcuccugauguucgccuucagcaccuucgaggaguccgugagcaacuacuccgagugggccgucuucacggacgacaucgaccaguucaagacccagaaggugcaggacuuccgccccaaccagaagcugaagaaguccaugcuccaccccagccuguacuucgacgccggggagauccaggccaugcggcagaagucccgcgcgagccaccuccaccucuuccgggccauccgcagcgccgugaccgucaugcuguccaacccgaccuacuaccugcccccgcccaagcacgccgacuucgcggccaaguggaacgagaucuacggcaacaaccucccgccccuggcccuguacugccuccugugccccgaggacaagguggccuucgaguucgugcuggaguacauggaccggauggucggguacaaggacuggcucguggagaacgcccccggcgacgaggugcccaucggccacagccugacgggguucgcgaccgccuucgacuuccuguacaaccuccuggacaaccaccgccggcagaaguaccuggagaagaucugggucaucaccgaggagauguacgaguacuccaaggugcgcagcuggggcaagcagcuccugcacaaccaccaggccaccaacaugaucgcccugcucacgggggcccuggugaccggcgucgacaagggguccaaggcgaacaucuggaagcaggccgugguggacgucauggagaagaccauguuccugcucaaccacaucguggacggcagccuggacgagggcguggccuacggguccuacaccgccaagagcgucacgcaguacguguuccuggcccagcggcacuucaacaucaacaaccucgacaacaacuggcugaagaugcacuucugguucuacuacgcgacccugcuccccggcuuccagcgcaccguggggaucgccgacuccaacuacaacugguucuacggccccgagagccagcuggucuuccuggacaaguucauccucaagaacggcgccgggaacuggcuggcccagcagauccggaagcaccgccccaaggacggcccgauggugcccuccaccgcccagcgguggagcacgcugcacaccgaguacaucugguacgacccccagcucacgccccagccgcccgcggacuacgggaccgccaagauccacaccuuccccaacuggggcguggucaccuacggggccggccugcccaacacccagaccaacacguucgugagcuucaaguccggcaagcugggcgggcgcgccgucuacgacaucgugcacuuccagccguacagcuggaucgacggguggcgguccuucaaccccggccacgagcaccccgaccagaacagcuucaccuucgcgcccaacggccagguguucgucuccgaggcccucuacgggccgaagcugagccaccugaacaacgugcucguguucgcccccucccccagcucccagugcaacaagccgugggagggccagcugggggagugcgcccaguggcugaaguggaccggcgaggaggucggggacgccgcgggcgagaucaucaccgccagccagcacggggagaugguguucguguccggcgaggccgucagcgccuacuccagcgccaugcgccugaaguccguguaccgggcgcuccugcugcucaacagccagacgcugcugguggucgaccacaucgagcgccaggaggacucccccaucaacagcguguccgccuucuuccacaaccucgacaucgacuucaaguacauccccuacaaguucaugaaccgguacaacggcgccaugauggacgugugggacgcccacuacaagauguucugguucgaccaccacgggaacagccccauggccagcauccaggaggcggagcaggccgccgaguucaagaagcgcuggacccaguucgucaacgugaccuuccagauggagccgaccaucacgcggaucgccuacguguucuacggccccuacaucaacgucuccagcugccgcuucaucgacuccagcaaccccgggcugcagaucucccugaacgugaacaacaccgagcacguggucagcaucgugaccgacuaccacaaccucaagacccgcuucaacuaccugggcuucggcggguucgcguccguggccgaccagggccagaucacgcgguucgggcugggcacccaggccaucgucaagcccgugcgccacgaccggaucaucuucccguucggguucaaguucaacaucgccgugggccucauccugugcaucagccuggucauccucaccuuccaguggcgcuucuaccuguccuuccggaagcugaugcgcuggauccucauccuggugaucgcccugugguucaucgagcuccuggacguguggagcacgugcucccagcccaucugcgcgaaguggacccggaccgaggccgagggcagcaagaagucccugagcuccgaggggcaccacauggaccuccccgacgucgugaucaccagccugcccggcuccggggccgagauccugaagcagcuguucuucaacagcagcgacuuccuguacauccgcgugccgaccgccuacaucgacauccccgagaccgagcuggagaucgacuccuucgucgacgccugcgaguggaaggugagcgacauccgguccggccacuuccgccuccugcggggguggcugcagagccucgugcaggacacgaagcugcaccuccagaacauccaccuccacgagcccaaccgcggcaagcuggcgcaguacuucgccaugaacaaggacaagaagcggaaguucaagcgccgggagucccugcccgagcagcgcagccagaugaagggcgccuucgaccgggacgccgaguacauccgcgcccuccggcgccaccuggucuacuacccguccgcgcgccccgugcugagccucuccagcggguccuggacccugaagcugcacuucuuccaggaggugcucggcgccagcaugcgggcccuguacaucguccgcgacccccgggccuggaucuacuccaugcuguacaacagcaagcccucccucuacagccugaagaacgugccggagcaccuggcgaagcuguucaagaucgagggcgggaaggggaagugcaaccugaacuccggcuacgccuucgaguacgagccccugcgcaaggagcucagcaaguccaagagcaacgccgugagccugcugucccaccucuggcuggccaacaccgccgcggcccugcggaucaacaccgaccuccugcccacgagcuaccagcuggucaaguucgaggacaucgugcacuucccccagaagaccaccgagcgcaucuucgccuuccucggcaucccgcugucccccgccagccugaaccagauccucuucgccaccuccacgaaccuguucuaccugcccuacgagggggagaucagcccgaccaacaccaacguguggaagcagaaccucccccgggacgagaucaagcugaucgagaacaucugcuggacccugauggaccgccucggcuaccccaaguucauggacuga

SEQ ID NO: 29392 - RNA, 3150 nt, Artificial Sequence
  derived and/or modified sequence opt1 from DSG1__Homo_sapiens__NP_001933
auggacuggagcuucuuccgcguggucgccaugcuguucaucuuccuggugguggucgaggugaacuccgaguuccggauccaggugcgcgacuacaacaccaagaacggcaccaucaaguggcacagcauccggcgccagaagcgggaguggaucaaguucgccgcggccugccgcgagggggaggacaacuccaagcggaaccccaucgccaagauccacagcgacugcgccgccaaccagcaggucacguaccgcaucuccggcguggggaucgaccagccgcccuacggcaucuucgugaucaaccagaagaccggggagaucaacaucaccagcaucgucgaccgggaggugacccccuucuucaucaucuacugccgcgcgcugaacuccaugggccaggaccuggagcggccccucgagcugcgcgugcggguccuggacaucaacgacaacccgcccguguucagcauggccacguucgccggccagaucgaggagaacuccaacgccaacacccucgugaugauccugaacgcgaccgacgccgacgagcccaacaaccugaacagcaagaucgccuucaagaucauccgccaggagcccuccgacagcccgauguucaucaucaaccggaacaccggggagauccgcacgaugaacaacuuccucgaccgggagcaguacggccaguacgcccuggccguccgcggguccgaccgggacggcggggcggacggcaugagcgccgagugcgagugcaacaucaagauccuggacgugaacgacaacauccccuacauggagcaguccagcuacaccaucgagauccaggagaacacccucaacuccaaccugcuggagauccgcgugaucgaccucgacgaggaguucagcgccaacuggauggccgucaucuucuucaucuccggcaacgaggggaacugguucgagaucgagaugaacgagcggaccaacgugggcauccugaagguggucaagccccuggacuacgaggccaugcagagccuccagcugagcaucggggugcgcaacaaggcggaguuccaccacuccaucaugagccaguacaagcugaaggccuccgccaucagcgugacgguccucaacgugaucgagggccccgucuuccgcccgggcuccaagaccuacguggugaccgggaacaugggcagcaacgacaaggucggggacuucguggccaccgaccuggacacgggccggcccuccaccaccgugcgcuacgucauggggaacaaccccgccgaccugcucgcgguggacagccggaccggcaagcugacgcugaagaacaaggugaccaaggagcaguacaacaugcucggcgggaaguaccagggcaccauccuguccaucgacgacaaccugcagcggaccugcacggggaccaucaacaucaacauccagagcuucggcaacgacgaccgcaccaacaccgagcccaacacgaagaucaccaccaacaccgggcgccaggaguccacgagcuccaccaacuacgacaccagcaccacguccaccgacagcucccaggucuacagcuccgagccgggcaacggcgccaaggaccuccugagcgacaacgugcacuucgggcccgccggcaucgggcugcucaucaugggcuuccuggugcuggggcucguccccuuccugaugaucugcugcgacugcggcggcgcgccccggagcgccgccggguucgagccggugcccgagugcuccgacggcgccauccacagcugggccguggaggggccccagcccgagccgcgcgacaucaccaccgucaucccccagaucccgcccgacaacgccaacaucaucgagugcaucgacaacuccggcguguacaccaacgaguacggcgggcgggagaugcaggaccugggcgggggcgagcgcaugacgggguucgagcucaccgagggcgugaagaccagcggcaugcccgagaucugccaggaguacuccgggacccugcggcgcaacagcaugcgggagugccgcgagggcgggcugaacaugaacuucauggaguccuacuucugccagaaggcguacgccuacgccgacgaggacgagggccggcccagcaacgacugccuccugaucuacgacaucgagggggucggcucccccgccggcagcguggggugcugcuccuucaucggcgaggaccuggacgacagcuuccucgacacgcuggggccgaaguucaagaagcuggccgacaucucccucggcaaggagagcuaccccgaccuggaccccuccuggcccccgcagagcaccgagcccgugugccugccccaggagaccgagcccgucguguccgggcacccgcccaucagcccccacuucggcaccacgaccgugaucagcgaguccaccuaccccagcggcccggggguccugcaccccaagcccauccucgacccccugggcuacgggaacgugaccgugacggaguccuacaccaccagcgacacccugaagccguccguccacgugcacgacaaccgccccgcgagcaacguggucgugacggagcggguggucggccccaucuccggggccgaccuccacggcaugcuggagaugcccgaccugcgcgacggcagcaacgugaucgugaccgagcgggucaucgccccguccagcucccuccccaccagccugaccauccaccacccccgcgaguccagcaacgugguggucacggagcgcgugauccagcccaccuccgggaugaucggcagccuguccaugcacccggagcucgccaacgcccacaacgugaucgucaccgagcggguggugagcggggcgggcgucaccggcaucuccgggacgaccggcaucagcgggggcaucgggagcuccggccuggugggcaccagcaugggggccggcuccggggcccugagcggcgccgggaucuccggcggcgggaucggccucagcucccucgggggcaccgccagcaucgggcacaugcgcuccagcuccgaccaccacuucaaccagacgaucggcagcgcgucccccagcaccgcccggucccgcaucaccaaguacagcaccgugcaguacuccaaguga

SEQ ID NO: 29393 - RNA, 3357 nt, Artificial Sequence
  derived and/or modified sequence opt1 from DSG2__Homo_sapiens__NP_001934
auggcccgcagccccggccgggccuacgcgcugcuccugcugcucaucugcuucaacgugggguccggccugcaccuccagguccugagcacccgcaacgagaacaagcugcugccgaagcacccccaccucgugcggcagaagcgcgccuggaucaccgcccccguggcccugcgggagggggaggaccuguccaagaagaaccccaucgccaagauccacagcgaccucgcggaggagcgcggccugaagaucacguacaaguacaccgggaagggcaucaccgagccgcccuucggcaucuucgucuucaacaaggacaccggggagcugaacgugacguccauccucgaccgggaggagacccccuucuuccugcugaccggcuacgcccucgacgcccgcgggaacaacguggagaagccccuggagcugcggaucaagguccucgacaucaacgacaacgagccgguguucacccaggacguguucgucggcagcguggaggagcuguccgccgcgcacacgcuggugaugaagaucaacgccaccgacgccgacgagcccaacacccucaacagcaagaucuccuaccgcaucgucagccuggagcccgccuacccgccgguguucuaccugaacaaggacaccggggagaucuacacgaccuccgugacccucgaccgggaggagcacagcuccuacacccugacggucgaggcccgcgacggcaacggcgaggugaccgacaagcccgugaagcaggcgcagguccagauccggauccuggacgugaacgacaacauccccguggucgagaacaaggugcucgaggggaugguggaggagaaccaggucaacguggaggucacccgcaucaagguguucgacgccgacgagaucggcagcgacaacuggcuggccaacuucaccuucgccuccgggaacgagggcggcuacuuccacaucgagacggacgcccagaccaacgaggggaucgugacccugaucaaggaggucgacuacgaggagaugaagaaccucgacuucagcgugaucguggcgaacaaggccgccuuccacaaguccauccggagcaaguacaagcccaccccgauccccaucaaggucaaggugaagaacgugaaggagggcauccacuucaaguccagcgucaucagcaucuacguguccgagagcauggaccgcuccagcaaggggcagaucaucggcaacuuccaggccuucgacgaggacacggggcugcccgcccacgcgcgguacgugaagcuggaggaccgcgacaacuggaucuccgucgacagcgugaccuccgagaucaagcucgccaagcugcccgacuucgagagccgguacgugcagaacggcaccuacaccgucaagaucguggccaucuccgaggacuacccgcgcaagacgaucaccggcaccgugcugaucaacgucgaggacaucaacgacaacugccccacccucaucgagcccgugcagacgaucugccacgacgccgaguacgugaacgucaccgccgaggaccuggacgggcaccccaacagcggcccguucuccuucagcgugaucgacaagccgcccgggauggcggagaaguggaagaucgcccggcaggaguccaccagcgugcugcuccagcaguccgagaagaagcugggccgcagcgagauccaguuccugaucuccgacaaccagggguucagcugccccgagaagcagguccucacccugacggugugcgagugccugcacggcuccggcugccgcgaggcccagcacgacagcuacguggggcucggccccgccgcgaucgcccugaugauccuggccuuccugcuccugcugcucgucccccugcugcuccugaugugccacugcgggaagggcgccaagggguucacccccaucccgggcaccaucgagaugcugcaccccuggaacaacgagggcgccccgcccgaggacaagguggugcccagcuuccuccccgucgaccagggcgggucccugguggggcggaacggcgugggcgggauggcgaaggaggccaccaugaagggcagcuccagcgccuccaucgucaaggggcagcacgagaugagcgagauggacggccgcugggaggagcaccggucccugcucagcgggcgcgccacccaguucacgggcgccaccggcgcgaucaugaccaccgagacgaccaagaccgcccgggccaccggggccucccgcgacauggccggcgcgcaggccgccgccguggcgcugaacgaggaguuccugcggaacuacuucacggacaaggccgccagcuacaccgaggaggacgagaaccacaccgccaaggacugccuccugguguacucccaggaggagaccgagagccugaacgccuccaucgggugcugcagcuucaucgagggcgagcucgacgaccgcuuccuggacgaccuggggcucaaguucaagacgcuggcggaggucugccugggccagaagaucgacaucaacaaggagaucgagcagcggcagaagcccgccaccgagaccuccaugaacaccgccagccacucccucugcgagcagacgauggugaacagcgagaacaccuacagcuccggcagcuccuuccccgugcccaagagccugcaggaggccaacgccgagaaggucacccaggagaucgugaccgagcgcuccgugagcucccggcaggcgcagaaggucgccacgccccugcccgaccccauggccagccgcaacgugaucgccaccgagaccuccuacgugaccgggagcacgaugccgcccaccaccgucauccucggccccucccagccccagagccugaucgugaccgagcggguguacgccccggcguccacgcuggucgaccagcccuacgccaacgaggggaccgugguggucaccgagcgcgugauccagccccacggcgggggcagcaacccccucgagggcacccagcaccuccaggacgucccguacgugauggugcgggagcgcgaguccuuccuggcccccagcuccgggguccagcccacgcuggccaugcccaacaucgcggugggccagaacgugaccgucaccgagcgggugcuggccccggccagcacccugcaguccagcuaccagauccccacggagaacagcaugaccgcccgcaacaccaccguguccggggccggcguccccgggccgcuccccgacuucggccuggaggagagcggccacuccaacagcaccaucacgaccuccagcacccgggugaccaagcacuccacggugcagcacagcuacuccuga

SEQ ID NO: 29394 - RNA, 3000 nt, Artificial Sequence
  derived and/or modified sequence opt1 from DSG3__Homo_sapiens__NP_001935
augaugggccuguucccccgcaccaccggggcccucgccaucuucguggucgugauccuggugcacggcgagcugcggaucgagacgaaggggcaguacgacgaggaggagaugaccaugcagcaggcgaagcgccggcagaagcgcgagugggucaaguucgccaagccgugccgggagggcgaggacaacagcaagcgcaaccccaucgccaagaucaccuccgacuaccaggccacccagaagaucacguaccggaucagcggggugggcaucgaccagccgcccuucggcaucuucguggucgacaagaacaccggggacaucaacaucaccgccaucguggaccgcgaggagacccccuccuuccucaucacgugccgggcgcugaacgcccagggccuggacguggagaagccccucauccugaccgucaagauccuggacaucaacgacaacccgcccguguucagccagcagaucuucaugggggagaucgaggagaacuccgccagcaacucccucgugaugauccugaacgccaccgacgcggacgagcccaaccaccugaacagcaagaucgccuucaagaucgucucccaggagcccgccggcacccccauguuccuccugagccgcaacacgggggaggugcggacccugaccaacucccucgaccgcgagcaggccagcuccuaccggcugguggucagcggcgccgacaaggacggcgaggggcuguccacccagugcgagugcaacaucaaggugaaggacgugaacgacaacuuccccauguuccgcgacagccaguacuccgcgcggaucgaggagaacauccucagcuccgagcugcugcgcuuccaggucacggaccucgacgaggaguacaccgacaacuggcuggccguguacuucuucaccagcggcaacgaggggaacugguucgagauccagaccgacccgcggacgaacgagggcauccugaagguggucaaggcccucgacuacgagcagcugcagagcgugaagcuguccaucgccgugaagaacaaggccgaguuccaccagagcgucaucucccgcuaccgggugcagagcacccccgucaccauccaggugaucaacgugcgcgagggcaucgcguuccggcccgccuccaagaccuucacgguccagaaggggaucagcuccaagaagcucguggacuacauccugggcaccuaccaggccaucgacgaggacaccaacaaggccgccagcaacgugaaguacgucauggggcgcaacgacggcggguaccugaugaucgacuccaagaccgcggagaucaaguucgugaagaacaugaaccgcgacagcacguucaucgugaacaagaccaucaccgccgagguccucgccaucgacgaguacaccggcaagacguccaccggcaccguguacgugcggguccccgacuucaacgacaacugcccgaccgccgugcuggagaaggacgccgugugcagcuccagccccuccgucguggugagcgcgcgcacgcugaacaaccgguacaccgggcccuacaccuucgcccucgaggaccagcccgucaagcugccggccgugugguccaucaccacccugaacgccacgagcgcgcuccugcgcgcccaggagcagaucccgcccggcguguaccacaucucccugguccucaccgacagccagaacaaccggugcgagaugccccgcagccugacccuggaggugugccagugcgacaaccgggggaucugcggcaccuccuaccccacgaccagccccgggacccgcuacggccggccccacuccggccgccucgggcccgccgccaucggccugcugcuccuggggcugcuccugcugcugcucgccccgcugcugcuccugaccugcgacugcggcgcggggagcacgggcggcgugaccgggggcuucauccccguccccgacggguccgagggcaccauccaccaguggggcaucgagggggcccacccggaggacaaggagaucaccaacaucugcgugccgcccgugacggccaacggcgccgacuucauggagagcuccgaggucugcaccaacaccuacgcccgggggaccgcgguggagggcacgagcgggauggagaugaccaccaagcugggcgccgccaccgaguccggcggggccgccggcuucgcgacggggaccgugagcggcgccgccuccggguucggcgccgcgaccggcgucgggaucugcagcuccggccagagcgggaccaugcgcacgcggcacuccaccggcgggaccaacaaggacuacgccgacggcgccaucagcaugaacuuccucgacuccuacuucagccagaaggccuucgccugcgcggaggaggacgacggccaggaggccaacgacugccugcugaucuacgacaacgagggggccgacgccaccggcagccccgugggguccgugggcugcugcagcuucaucgccgacgaccucgacgacuccuuccuggacagccuggggcccaaguucaagaagcucgcggagaucucccugggcgucgacggcgaggggaaggaggugcagccgcccagcaaggacuccggcuacgggaucgagagcugcggccaccccaucgaggugcagcagacgggcuucgucaagugccagacccuguccgggagccagggcgccuccgcccucagcaccuccgggagcgugcagcccgccguguccauccccgacccccugcagcacggcaacuaccuggucaccgagacguacagcgccuccgggagccucgugcagcccuccaccgcgggcuucgacccgcugcugacccagaacgugaucgucaccgagcgcgugaucugccccaucagcagcgugcccggcaaccucgccgggcccacgcagcugcggggcucccacaccaugcugugcaccgaggacccgugcagccgccucaucuga

SEQ ID NO: 29395 - RNA, 3180 nt, Artificial Sequence
  derived and/or modified sequence opt1 from DSG4__Homo_sapiens__NP_001127925
auggacuggcuguucuuccgcaacaucugccuccugaucauccugaugguggucauggaggugaacagcgaguucaucguggaggucaaggaguucgacaucgagaacggcaccaccaaguggcagacggugcggcgccagaagcgggaguggaucaaguucgccgccgcgugccgcgagggggaggacaacuccaagcggaaccccaucgccaagauccgcagcgacugcgaguccaaccagaagaucaccuaccggaucagcggcguggggaucgaccgcccgcccuacggcgucuucaccaucaacccccggaccggggagaucaacaucacguccgugguggaccgcgagaucacgccccucuuccugaucuacugccgggcccugaacagccgcggcgaggaccucgagcggccgcuggagcugcgcgucaaggugauggacaucaacgacaacgcccccguguucucccagagcgucuacaccgccuccaucgaggagaacagcgacgcgaacacccucguggugaagcugugcgccaccgacgccgacgaggagaaccaccugaacuccaagaucgccuacaagaucgucagccaggagcccuccggcgcgcccauguucauccucaaccgguacaccggggaggugugcaccaugagcuccuuccuggaccgcgagcagcacagcauguacaaccuggugguccggggcuccgaccgcgacggggccgccgacggccucagcuccgagugcgacugccggaucaaggugcuggacgugaacgacaacuucccgacccuggagaagacgagcuacagcgccuccaucgaggagaacugccucagcuccgagcugauccgccugcaggccaucgaccucgacgaggaggggaccgacaacuggcuggcgcaguaccugauccucagcggcaacgacggcaacugguucgacauccagaccgacccccagaccaacgaggggauccugaaggucgugaagaugcuggacuacgagcaggcccccaacauccagcucuccaucggcgugaagaaccaggccgacuuccacuacagcgucgccucccaguuccagaugcaccccacgccggugcggauccaggucguggacgugcgcgaggggcccgccuuccaccccagcaccauggcguucuccguccgcgagggcaucaagggcagcucccugcugaacuacgugcucgggaccuacaccgccaucgaccuggacacgggcaaccccgccaccgacgugcgguacaucaucgggcacgacgccggcagcuggcugaagaucgacucccgcaccggggagauccaguucagccgggaguucgacaagaaguccaaguacaucaucaacggcaucuacaccgccgagauccucgcgaucgacgacggcagcgggaagacggccaccggcaccaucugcaucgaggucccggacaucaacgacuacugccccaacaucuuccccgagcgccggaccaucugcaucgacucccccagcgugcugaucuccgugaacgagcacagcuacgggagcccguucacguucugcgucguggacgagccgcccggcaucgccgacaugugggacgugcgcuccaccaacgccaccagcgccauccugaccgcgaagcagguccucucccccggguucuacgagauccccauccuggugaaggacagcuacaaccgggccugcgagcuggcccagauggugcagcucuacgccugcgacugcgacgacaaccacaugugccuggacuccggcgcggccggcaucuacacggaggacaucaccggggacaccuacggccccgucaccgaggaccaggccggggugagcaacgugggccuggggcccgccggcaucggcaugaugguccucgggauccugcugcucauccuggcgccccugcuccugcugcugugcugcugcaagcagcgccagccggagggccucgggacgcgguucgcccccgugcccgagggcggcgagggggugaugcaguccuggcgcaucgagggcgcccacccggaggaccggcuguucagcgccuacgcccugcccgggggcgggggcaccgccgacggcgggggcuccguccucgggcgcugcgcgcugcaggccacccccgcccugcucaaccagcacccgcccuucagcgagaucuacaccaacaccuacgccgccggcgggacgguggagggcggcguguccggggucgagcugaacaccggcauggggaccgcggugggccugauggccgccggggccgcgggcgccagcggcgccgcccggaagcgcuccagcaccauggggacgcuccgggacuacgccgacgcggacaucaacauggccuuccuggacuccuacuucagcgagaaggccuacgccuacgccgacgaggacgagggccgccccgcgaacgacugccugcucaucuacgaccacgagggggugggcucccccgucgggagcaucggcugcugcagcuggaucguggacgaccuggacgaguccugcauggagacccuggaccccaaguuccggacccucgccgagaucugccugaacaccgagaucgagccguuccccagccaccaggccugcauccccaucuccacggaccugccccuccugggcccgaacuacuucgugaacgagagcuccgggcugacccccagcgaggucgaguuccaggaggagauggccgccuccgagcccguggugcacggcgacaucaucgucaccgagaccuacgggaacgcggaccccugcgugcagccgacgaccaucaucuucgacccccagcucgcccccaacguggucgugaccgaggccgugauggcccccgucuacgacauccagggcaacaucugcgugccggcggagcuggccgacuacaacaacgugaucuacgccgagcgcguccuggccagccccggcgugcccgacauguccaacagcuccaccacggaggggugcaugggccccgugaugagcgggaacauccucgucggcccggagauccaggugaugcagaugaugucccccgaccugcccaucgggcagaccgugggcagcaccuccccgaugaccagccggcaccgcgucacgcgcuacuccaacauccacuacacccagcaguga

SEQ ID NO: 29396 - RNA, 6819 nt, Artificial Sequence
  derived and/or modified sequence opt1 from DSP__Homo_sapiens__NP_001008844
augagcugcaacggcgggagccacccccggaucaacacccugggccggaugauccgcgccgagagcgggccggaccuccgguacgaggugaccagcggcgggggcggcacgagccgcauguacuacucccggcgcggggucaucaccgaccagaacagcgacggcuacugccagaccgggaccaugucccggcaccagaaccagaacacgauccaggagcugcugcagaacugcagcgacugccucaugcgcgccgagcugaucgugcagcccgagcugaaguacggcgacgggauccagcucacccggucccgcgagcuggacgagugcuucgcgcaggccaacgaccagauggagauccuggacagccucauccgggagaugcgccagaugggccagcccugcgacgccuaccagaagcggcugcugcagcuccaggagcagaugcgcgcccuguacaaggccaucuccgugccccggguccgccgggcgagcuccaagggcgggggcggguacacgugccagagcggcuccggcugggacgaguucaccaagcacgugacgagcgagugccugggguggaugcgccagcagcgggccgagauggacaugguggccuggggcgucgaccucgccuccguggagcagcacaucaacagccaccgcgggauccacaacuccaucggcgacuaccgguggcagcuggacaagaucaaggcggaccugcgcgagaaguccgccaucuaccagcucgaggaggaguacgagaaccugcugaaggccagcuucgagcgcauggaccaccuccggcagcugcagaacaucauccaggccaccucccgcgagaucauguggaucaacgacugcgaggaggaggagcugcucuacgacuggagcgacaagaacaccaacaucgcccagaagcaggaggcguucuccauccggaugagccagcuggaggugaaggagaaggagcugaacaagcucaagcaggaguccgaccagcugguccugaaccagcacccggccagcgacaagaucgaggccuacauggacacccuccagacgcagugguccuggauccugcagaucaccaagugcaucgacgugcaccugaaggagaacgccgccuacuuccaguucuucgaggaggcgcagagcaccgaggccuaccucaaggggcugcaggacuccauccgcaagaaguaccccugcgacaagaacaugccccugcagcaccuccuggagcagaucaaggagcuggagaaggagcgggagaagauccucgaguacaagcgccaggugcagaaccuggucaacaagagcaagaagaucgugcagcugaagccccggaacccggacuaccgcuccaacaagcccaucauccuccgggcccugugcgacuacaagcaggaccagaagaucgugcacaagggcgacgagugcauccugaaggacaacaacgagcgcagcaagugguacgucaccggccccgggggcguggacaugcucgugcccuccgucgggcugaucaucccgccgcccaacccccuggccguggaccucagcugcaagaucgagcaguacuacgaggccauccuggcgcuguggaaccagcuguacaucaacaugaagucccucgugagcuggcacuacugcaugaucgacaucgagaagauccgggccaugacgaucgccaagcugaagaccaugcgccaggaggacuacaugaagaccaucgccgaccuggagcuccacuaccaggaguucauccggaacucccagggcagcgagauguucggggacgacgacaagcgcaagauccagucccaguucaccgacgcccagaagcacuaccagacgcuggucauccagcugcccggcuacccccagcaccagaccgugaccaccacggagaucacccaccacgggaccugccaggacgugaaccacaacaaggucaucgagaccaaccgggagaacgacaagcaggagacguggaugcucauggagcugcagaagauccgccggcagaucgagcacugcgaggggcgcaugacccugaagaaccucccccuggcggaccagggcagcagccaccacaucaccgugaagaucaacgagcugaaguccguccagaacgacagccaggccaucgccgaggugcucaaccagcugaaggacaugcuggccaacuuccggggguccgagaaguacugcuaccuccagaacgagguguucggccuguuccagaagcuggagaacaucaacggggucaccgacggcuaccucaacagccugugcacggugcgcgcgcugcuccaggccauccugcagaccgaggacaugcugaagguguacgaggcccgccucaccgaggaggagaccgucugccuggaccuggacaagguggaggccuaccggugcggccucaagaagaucaagaacgaccugaaccugaagaagucccuccuggccacgaugaagaccgagcugcagaaggcgcagcagauccacagccagaccucccagcaguacccccucuacgaccuggaccuggggaaguucggcgagaaggugacccagcucaccgaccgcuggcagcggaucgacaagcagaucgacuuccgccugugggaccuggagaagcagaucaagcagcuccggaacuaccgcgacaacuaccaggccuucugcaaguggcuguacgacgccaagcggcgccaggacagccuggaguccaugaaguucggggacagcaacacggucaugcgguuccucaacgagcagaagaaccugcacuccgagaucagcggcaagcgcgacaaguccgaggaggugcagaagaucgccgagcugugcgccaacagcaucaaggacuacgagcuccagcuggcguccuacaccagcggccuggagacccuccugaacaucccgaucaagcggaccaugauccagucccccagcggggugauccugcaggaggccgccgacguccacgcccgcuacaucgagcuccugacgcggagcggcgacuacuaccgcuuccuguccgagaugcucaagagccuggaggaccugaagcucaagaacaccaagaucgaggugcuggaggaggagcugcggcucgcccgcgacgcgaacuccgagaacugcaacaagaacaaguuccuggaccagaaccugcagaaguaccaggccgagugcagccaguucaaggccaagcucgccucccuggaggagcugaagcggcaggcggagcucgacggcaagagcgccaagcagaaccuggacaagugcuacggccagaucaaggagcugaacgagaagaucacccgccucaccuacgagaucgaggacgagaagcggcgccggaaguccguggaggaccgcuucgaccagcagaagaacgacuacgaccagcugcagaaggcccgccagugcgagaaggagaaccugggguggcagaagcucgagagcgagaaggccaucaaggagaaggaguacgagaucgagcggcugcgcguccugcuccaggaggagggcacgcggaagcgcgaguacgagaacgagcuggccaaggcguccaaccggauccaggagagcaagaaccagugcacccagguggugcaggagcgcgagucccugcucgucaagaucaaggugcuggagcaggacaaggcccggcugcagcgccucgaggacgagcugaaccgggccaagagcacccuggaggccgagacccgcgugaagcagcggcucgagugcgagaagcagcagauccagaacgaccugaaccaguggaagacgcaguacucccgcaaggaggaggccauccggaagaucgagagcgagcgcgagaaguccgagcgggagaagaacagccugcgcuccgagaucgagcggcuccaggcggagaucaagcgcaucgaggagcggugccgccgcaagcuggaggacagcacccgggagacccagucccagcuggagaccgagcgcagccgguaccagcgcgagaucgacaagcuccggcagcgccccuacggcagccaccgggagacgcagaccgagugcgaguggaccgucgacaccuccaagcugguguucgacgggcugcgcaagaaggugacggccaugcagcucuacgagugccagcugaucgacaagaccacccuggacaagcugcucaagggcaagaaguccgucgaggagguggccuccgagauccagcccuuccugcgcggggccggcagcaucgccggggcguccgccagcccgaaggagaaguacucccugguggaggccaagcgcaagaagcucaucagccccgaguccaccgucaugcugcuggaggcccaggcggccacgggcggcaucaucgacccccaccggaacgagaagcucaccguggacagcgccaucgcccgcgaccugaucgacuucgacgaccggcagcagaucuacgccgcggagaaggccaucaccggguucgacgaccccuucuccggcaagaccgugagcgucuccgaggccaucaagaagaaccugaucgaccgcgagacggggaugcggcuccuggaggcccagaucgccagcggcggggugguggacccggucaacuccguguuccugcccaaggacguggcgcucgcccgcggccugaucgaccgggaccuguaccgcagccucaacgacccccgggacucccagaagaacuucgucgacccggugaccaagaagaaggugagcuacguccagcugaaggagcgcugccggaucgagccccacaccggccugcuccugcuguccgugcagaagcgcagcaugagcuuccaggggauccgccagcccgugaccgucacggagcucguggacuccggcauccugcggcccagcaccgugaacgagcuggaguccgggcagaucagcuacgacgaggucggcgagcgcaucaaggacuuccuccagggguccagcugcaucgccggcaucuacaacgagaccaccaagcagaagcugggcaucuacgaggccaugaagaucgggcuggugcggccgggcacggcccucgagcugcuggaggcgcaggccgccaccggguucaucguggaccccgucuccaaccuccgccugcccguggaggaggccuacaagcggggccuggugggcaucgaguucaaggagaagcuccugagcgccgagcgcgcggucaccggguacaacgaccccgagaccggcaacaucaucucccuguuccaggccaugaacaaggagcucaucgagaaggggcacggcauccggcugcuggaggcccagaucgccaccgggggcaucaucgacccgaaggagagccaccgccuccccguggacaucgcguacaagcggggcuacuucaacgaggagcuguccgagauccugagcgaccccuccgacgacacgaagggguucuucgaccccaacaccgaggagaaccucaccuaccugcagcugaaggagcgcugcaucaaggacgaggagaccggccucugccugcugccgcucaaggagaagaagaagcagguccagacgagccagaagaacacccugcggaagcgccggguggugaucgucgaccccgagaccaacaaggagauguccgugcaggaggccuacaagaaggggcugaucgacuacgagaccuucaaggagcucugcgagcaggagugcgagugggaggagaucacgaucaccggcagcgacggguccacccgcgugguccugguggaccggaagaccggcagccaguacgacauccaggacgccaucgacaagggccugguggaccgcaaguucuucgaccaguaccgguccgggagccucagccugacgcaguucgccgacaugaucucccugaagaacggcgucgggaccagcuccagcaugggcuccggggugagcgacgacguguucuccagcucccgccacgagagcgucuccaagaucagcaccaucuccagcgugcggaaccucaccauccgcuccagcuccuucagcgacacgcuggaggaguccagccccaucgccgcgaucuucgacaccgagaaccuggagaagaucagcaucaccgagggcaucgagcgcggcaucguggacuccaucaccgggcagcggcuccuggaggcccaggccugcacgggcgggaucauccaccccaccaccggccagaagcugagccuccaggacgccgucucccagggcgugaucgaccaggacauggccacccgccugaagccggcgcagaaggccuucaucggguucgagggcgugaaggggaagaagaagaugagcgccgccgaggccgucaaggagaaguggcugcccuacgaggcgggccagcgguuccucgaguuccaguaccugaccgggggccugguggaccccgaggugcacggccgcaucuccaccgaggaggccauccggaagggguucaucgacggccgcgccgcccagcggcuccaggacaccagcuccuacgcgaagauccugaccugccccaagacgaagcugaagaucagcuacaaggacgccaucaaccgcuccauggucgaggacaucaccgggcuccggcugcuggaggccgccagcguguccagcaagggccucccgucccccuacaacaugagcuccgcccccgggagccgcuccggcagccgguccggcagccgcagcgggucccggagcggcucccgcagcgggucccggcgcggcagcuucgacgcgaccgggaacuccagcuacuccuacagcuacuccuucagcuccagcuccaucggccacuga

SEQ ID NO: 29397 - RNA, 3906 nt, Artificial Sequence
  derived and/or modified sequence opt1 from DSPP__Homo_sapiens__NP_055023
augaagaucaucaccuacuucugcaucugggccguggccugggcgauccccgucccgcagagcaagccccuggagcgccacguggagaaguccaugaaccuccaccuccuggcccggagcaacguguccguccaggacgagcugaacgccagcggcaccaucaaggaguccggggugcuggugcacgagggcgaccgcgggcggcaggagaacacgcaggacggccacaagggggagggcaacggcagcaagugggccgaggucgggggcaaguccuucagcaccuacuccacccuggccaacgaggaggggaacaucgagggcuggaacggggacaccggcaaggcggagacguacggccacgacgggauccacggcaaggaggagaacaucaccgccaacgggauccagggccaggugagcaucaucgacaacgccggcgccaccaaccgcuccaacaccaacgggaacacggacaagaacacccagaacggcgacgugggggacgcgggccacaacgaggacgucgccguggugcaggaggacgggccccaggucgccggcagcaacaacuccaccgacaacgaggacgagaucaucgagaacagcugccggaacgagggcaacaccuccgagaucacgccccagaucaacagcaagcgcaacgggaccaaggaggccgaggugaccccgggcaccggggaggacgccggccucgacaacuccgacgggagccccuccggcaacggcgcggacgaggacgaggacgaggggagcggcgacgacgaggacgaggaggccgggaacggcaaggacagcuccaacaacagcaaggggcaggagggccaggaccacggcaaggaggacgaccacgacuccagcaucgggcagaacuccgacagcaaggaguacuacgaccccgagggcaaggaggacccccacaacgagguggacggggacaagacguccaagagcgaggagaacuccgccggcaucccggaggacaacggcagccagcggaucgaggacacccagaagcugaaccaccgcgaguccaagcgggucgagaaccgcaucaccaaggagagcgagacccacgccguggggaagucccaggacaagggcaucgagaucaaggggcccagcuccggcaaccggaacaucacgaaggagguggggaagggcaacgagggcaaggaggacaaggggcagcacggcaugauccuggggaagggcaacgucaagacccagggggagguggugaacaucgagggccccggccagaaguccgagcccgggaacaaggucggccacagcaacaccgggagcgacuccaacagcgacggcuacgacagcuacgacuucgacgacaaguccaugcagggggacgacccgaacagcuccgacgagagcaacggcaacgacgacgccaacuccgagagcgacaacaacuccagcucccgcggcgacgcgagcuacaacuccgacgagagcaaggacaacgggaacggcuccgacagcaagggggccgaggacgacgacuccgacagcaccuccgacacgaacaacagcgacagcaacggcaacgggaacaacggcaacgacgacaacgacaaguccgacagcggcaaggggaaguccgacagcuccgacagcgacuccagcgacuccagcaacuccagcgacuccagcgacuccagcgacuccgacagcuccgacagcaacagcuccagcgacuccgacagcuccgacagcgacuccagcgacuccagcgacuccgacagcuccgacagcuccaacagcuccgacagcuccgacagcagcgacuccagcgacuccagcgacuccagcgacuccagcgacuccaagagcgacuccagcaaguccgagagcgacuccagcgacuccgacagcaaguccgacagcagcgacuccaacagcuccgacagcuccgacaacagcgacuccagcgacuccagcaacuccagcaacuccagcgacuccagcgacuccagcgacuccagcgacagcuccagcuccagcgacuccagcaacuccagcgacuccagcgacuccagcgacuccagcaacuccagcgaguccagcgacuccagcgacagcuccgacagcgacuccagcgacuccagcgacuccagcaacuccaacagcuccgacagcgacuccagcaacuccagcgacuccagcgacagcuccaacagcuccgacagcuccgacagcuccgacagcuccaacagcuccgacagcuccgacagcuccgacagcuccaacagcuccgacagcagcgacuccagcgacuccagcgacuccagcgacuccagcaacuccagcgacuccaacgacagcuccaacagcuccgacagcuccgacagcuccaacagcagcgacuccagcaacuccagcgacuccagcgacuccagcgacuccagcgacuccgacagcuccaacagcuccgacagcuccaacagcuccgacagcagcgacuccagcaacuccagcgacuccagcgacuccagcgacuccagcgacggcuccgacagcgacuccagcaaccgguccgacagcuccaacagcuccgacagcagcgacuccagcgacuccagcaacuccagcgacuccagcgacuccagcgacuccaacgagagcuccaacagcuccgacagcuccgacagcuccaacagcagcgacuccgacagcuccgacagcuccaacagcuccgacagcuccgacagcuccaacagcuccgacagcuccgagagcuccaacagcagcgacaacuccaacagcuccgacagcuccaacagcuccgacagcuccgacagcuccgacagcuccaacagcuccgacagcuccaacagcuccgacagcagcaacuccagcgacuccagcgacuccaacagcuccgacagcuccgacagcuccaacagcuccgacagcuccgacagcuccgacagcuccgacagcagcgacuccagcgacuccagcaacuccagcgacuccagcgacuccagcgacuccagcgacuccagcaacuccagcgacuccagcaacuccagcgacagcuccaacagcuccgacagcuccgacagcuccgacagcuccgacagcuccgacagcuccgacagcuccgacagcuccgacagcuccaacagcagcgacuccagcgacuccagcgacuccagcgacuccagcgacuccagcgacuccagcgacuccagcgacuccagcgaguccagcgacuccagcgacagcuccaacagcuccgacagcuccgacagcuccgacagcuccgacagcuccgacagcuccgacagcuccgacagcuccgacagcagcgacuccagcaacuccagcgacuccagcgacuccagcgacuccagcgacuccagcgacuccagcaacuccagcgacuccagcgacuccagcgagagcuccgacagcuccgacagcuccgacagcuccgacagcuccgacagcuccgacagcuccgacagcuccgacagcuccgacagcuccaacagcagcgacuccagcgacuccagcgacuccagcgacuccagcgacuccagcgacuccagcgacuccagcgacuccagcgacuccagcgacuccagcgacagcuccgacagcuccgacagcuccgacagcuccgacagcuccgacagcuccgacagcaacgaguccagcgacuccagcgacuccagcgacuccagcgacagcuccaacagcuccgacagcuccgacagcuccgacagcuccgacagcaccuccgacagcaacgacgaguccgacagccaguccaagagcgggaacggcaacaacaacggcuccgacagcgacuccgacagcgaggggagcgacuccaaccacagcaccuccgacgacuga

SEQ ID NO: 29398 - RNA, 7950 nt, Artificial Sequence
  derived and/or modified sequence opt1 from DST__Homo_sapiens__NP_001714
augcacagcagcagcuacagcuaccgcagcagcgacagcguguucagcaacaccaccagcacccgcaccucccuggacagcaacgagaaccugcugcuggugcacugcggccccacccugaucaacuccugcaucagcuucggguccgagagcuucgacggccaccgccuggagaugcugcagcagaucgccaaccgggugcagcgcgacuccgugaucugcgaggacaagcucauccuggccgggaacgcccugcagagcgacuccaagcggcucgagagcggcgugcaguuccagaacgaggccgagaucgccggguacauccuggagugcgagaaccugcuccgccagcacgugaucgacgugcagauccugaucgacggcaaguacuaccaggccgaccagcuggugcagcggguggccaagcuccgcgacgagaucauggcgcugcggaacgagugcuccagcguguacagcaagggccgcauccugaccaccgagcagaccaagcucaugaucuccgggaucacccagagccugaacuccggcuucgcccagacccugcaccccagccucaccuccgggcugacccagagccugacccccucccucaccagcuccagcaugacguccggccugagcuccgggaugaccagccggcugacccccuccgucacccccgccuacacgcccggcuuccccagcggccucgugcccaacuucuccagcgggguggagcccaacucccugcagacccugaagcucaugcagauccgcaagccccugcucaagagcagccuccuggaccagaaccugaccgaggaggagaucaacaugaaguucguccaggaccuccugaacuggguggacgagaugcagguccagcuggaccggaccgaguggggcuccgaccuccccagcgucgagucccaccuggagaaccacaagaacgugcaccgcgccaucgaggaguucgagagcucccugaaggaggcgaagaucagcgagauccagaugacggcgccccugaagcugaccuacgccgagaagcugcaccggcucgagucccaguacgccaagcugcugaacaccagccgcaaccaggagcggcaccucgacacccugcacaacuucgugucccgcgccacgaacgagcugaucuggcugaacgagaaggaggaggaggaggucgcguacgacuggagcgagcggaacaccaacaucgcccgcaagaaggacuaccacgccgagcucaugcgggagcuggaccagaaggaggagaacaucaaguccgugcaggagaucgccgagcagcugcuccuggagaaccaccccgcccgccugaccaucgaggcguaccgcgccgccaugcagacccaguggagcuggauccuccagcugugccagugcguggagcagcacaucaaggagaacacggccuacuucgaguucuucaacgacgccaaggaggcgaccgacuaccugcggaaccucaaggacgccauccagcgcaaguacuccugcgaccggagcuccagcauccacaagcuggaggaccugguccaggaguccauggaggagaaggaggagcuccugcaguacaagagcaccaucgccaaccugauggggaaggccaagaccaucauccagcucaagccccgcaacagcgacugcccccugaagacguccauccccaucaaggccaucugcgacuaccggcagaucgagaucaccaucuacaaggacgacgagugcgugcuggcgaacaacagccaccgcgccaaguggaaggugaucucccccaccggcaacgaggccauggucccgagcgugugcuucaccgugccgccgcccaacaaggaggccguggaccucgcgaaccggaucgagcagcaguaccagaacgugcugacgcuguggcacgagucccacaucaacaugaaguccgucguguccuggcacuaccucaucaacgagaucgaccgcauccgggccagcaacguggccuccaucaagaccaugcugccgggcgagcaccagcagguccugagcaaccuccagucccgcuucgaggacuuccuggaggacagccaggagucccagguguucagcggguccgacaucacccagcuggagaaggaggugaacgucugcaagcaguacuaccaggagcuccucaagagcgccgagcgggaggagcaggaggaguccguguacaaccuguacaucagcgaggugcgcaacauccggcuccgccuggagaacugcgaggaccggcugauccgccagauccggacgccccuggagcgcgacgaccugcacgaguccgucuuccggaucaccgagcaggagaagcugaagaaggagcucgagcgccugaaggacgaccugggcacgaucaccaacaagugcgaggaguucuucagccaggccgcggccagcuccagcgugcccacccuccgcuccgagcugaacgugguccugcagaacaugaaccagguguacagcauguccagcaccuacaucgacaagcucaagacggugaaccugguccugaagaacacccaggccgccgaggcccucgugaagcuguacgagaccaagcugugcgaggaggaggcggugaucgccgacaagaacaacaucgagaaccucaucuccacccugaagcaguggcggagcgaggucgacgagaagcgccagguguuccacgcccuggaggacgagcuccagaaggccaaggccaucuccgacgagauguucaagacguacaaggagcgggaccuggacuucgacuggcacaaggagaaggcggaccagcugguggagcgcuggcagaacguccacgugcagaucgacaaccggcuccgcgaccuggaggggaucggcaagagccugaaguacuaccgggacaccuaccacccccucgacgacuggauccagcaggucgagaccacccagcgcaagauccaggagaaccagccggagaacuccaagacgcuggccacccagcugaaccagcagaagaugcucgucagcgagaucgagaugaagcaguccaagauggacgagugccagaaguacgccgagcaguacagcgccaccgugaaggacuacgagcugcagaccaugacguaccgggcgaugguggacucccagcagaagucccccgucaagcgccggcgcaugcaguccagcgccgaccugaucauccaggaguucauggaccuccggacccgcuacaccgcccuggugacccugaugacgcaguacaucaaguucgccggggacucccucaagcggcuggaggaggaggagaucaagcgcugcaaggagaccagcgagcacggcgccuacagcgaccugcuccagcggcagaaggcgaccgugcuggagaacuccaagcugaccggcaagaucagcgagcucgagcgcauggucgccgagcugaagaagcagaagucccggguggaggaggagcugcccaaggugcgcgaggccgccgagaacgagcuccggaagcagcagcgcaacgucgaggacaucagccugcagaagauccgcgccgaguccgaggcgaagcaguaccggcgcgagcuggagacgaucgugcgggagaaggaggccgccgagcgcgagcucgagcgggugcgccagcugaccaucgaggccgaggccaagcgggcggccgucgaggagaaccugcucaacuuccgcaaccagcuggaggagaacaccuucacccggcgcacgcuggaggaccaccucaagcggaaggaccugagccugaacgaccucgagcagcagaagaacaagcugauggaggagcugcgccggaagcgcgacaacgaggaggagcuccugaagcugaucaagcagauggagaaggaccucgccuuccagaagcaggucgccgagaagcagcugaaggagaagcagaagaucgagcuggaggcgcggcgcaagaucaccgagauccaguacacgugccgggagaacgcccugcccgugugcccgaucacccaggccacguccugccgcgccgucaccgggcuccagcaggagcacgacaagcagaaggccgaggagcugaagcagcaggucgacgagcugaccgcggccaaccggaaggccgagcaggacaugcgcgagcucaccuacgagcugaacgcccugcagcucgagaagacgagcuccgaggagaaggcccgccugcugaaggacaagcucgacgagaccaacaacacccugcggugccugaagcucgagcuggagcgcaaggaccaggcggagaagggcuacagccagcagcugcgggagcucgggcgccagcugaaccagaccaccggcaaggccgaggaggccaugcaggaggccuccgaccugaagaagaucaagcggaacuaccagcucgagcuggagagccugaaccacgagaaggggaagcuccagcgcgagguggaccggaucacgcgcgcccacgcggucgccgagaagaacauccagcaccugaacucccagauccacagcuuccgggacgagaaggagcuggagcgccuccagaucugccagcggaaguccgaccaccugaaggagcaguucgagaagucccacgagcagcugcuccagaacaucaaggccgagaaggagaacaacgacaagauccagcgccugaacgaggagcuggagaaguccaacgagugcgccgagaugcucaagcagaagguggaggagcugacccggcagaacaacgagaccaagcugaugaugcagcgcauccaggccgagagcgagaacaucgugcucgagaagcagaccauccagcagcggugcgaggcgcugaagauccaggccgacggcuucaaggaccagcugcgcuccacgaacgagcaccuccacaagcagaccaagaccgagcaggacuuccagcggaagaucaagugccuggaggaggaccuggccaagagccagaaccucgucagcgaguucaagcagaagugcgaccagcagaacaucaucauccagaacaccaagaaggaggugcgcaaccugaacgccgagcugaacgcguccaaggaggagaagcggcgcggcgagcagaaggugcagcuccagcaggcccagguccaggagcugaacaaccggcugaagaaggugcaggacgagcuccaccugaagacgaucgaggagcagaugacccaccgcaagaugguccuguuccaggaggagagcgggaaguucaagcaguccgccgaggaguuccgcaagaagauggagaagcucauggagagcaaggugaucaccgagaacgacaucuccggcauccggcuggacuucgugagccugcagcaggagaacucccgcgcccaggagaacgccaagcucugcgagaccaacaucaaggagcuggagcggcagcugcagcaguaccgcgagcagaugcagcaggggcagcacauggaggcgaaccacuaccagaagugccagaagcucgaggacgagcugaucgcccagaagcgggaggucgagaaccugaagcagaagauggaccagcagaucaaggagcacgagcaccagcucgugcugcugcagugcgagauccagaagaaguccacggccaaggacugcaccuucaagcccgacuucgagaugaccgugaaggagugccagcacuccggcgagcucagcucccgcaacaccgggcaccuccaccccacgccgcggagcccccugcuccgcuggacccaggagccccagccccuggaggagaaguggcagcaccgggucguggagcagaucccgaaggaggugcaguuccagccgcccggcgcgccccuggagaaggagaagucccagcagugcuacagcgaguacuucucccagaccagcaccgagcuccagaucacguucgacgagaccaaccccaucacccgccuguccgagaucgagaagauccgggaccaggcccugaacaacagccggccgcccguccgguaccaggacaacgccugcgagauggagcucgugaaggugcugacgccccuggagaucgccaagaacaagcaguacgacaugcacacggaggucaccacccucaagcaggagaagaacccggugcccuccgccgaggaguggaugcuggagggcugccgcgccagcgggggccugaagaagggggacuuccucaagaagggccuggagcccgagaccuuccagaacuucgacggcgaccacgccugcagcgugcgggacgacgaguucaaguuccaggggcugcgccacacggucaccgcgcggcagcucguggaggccaagcugcuggacaugcgcaccaucgagcagcuccggcugggccugaagaccguggaggagguccagaagacgcucaacaaguuccugaccaaggccaccuccaucgccgggcuguaccucgagagcaccaaggagaagaucuccuucgcgagcgccgccgagcgcaucaucaucgacaagaugguggcccuggccuuccuggaggcgcaggccgccacgggcuucaucaucgaccccaucuccgggcagaccuacagcguggaggacgccguccucaagggcgugguggacccggaguuccgcauccggcugcuggaggccgagaaggcggccgucggcuacuccuacagcuccaagacccucagcguguuccaggccauggagaaccgcaugcuggaccggcagaaggggaagcacauccuggaggcccagaucgccuccggcggggugaucgaccccguccgcggcauccgggugccgcccgagaucgcgcuccagcaggggcugcugaacaacgccauccuccaguuccugcacgagccgagcuccaacacccgcguguuccccaaccccaacaacaagcaggcccuguacuacagcgagcugcuccggaugugcgucuucgacguggagucccagugcuuccuguuccccuucggcgagcgcaacaucagcaaccugaacgugaagaagacccaccggaucuccgucguggacacgaagaccggcagcgagcucaccguguacgaggccuuccagcgcaaccugaucgagaaguccaucuaccuggagcucagcgggcagcaguaccaguggaaggaggcgauguucuucgagagcuacggccacuccagccacaugcugaccgacacgaagaccgggcugcacuucaacaucaacgaggccaucgagcagggcaccaucgacaaggcccucgucaagaaguaccaggaggggcugaucacccugacggagcucgccgacucccugcugagccggcucgugccgaagaaggaccugcacucccccguggccggcuacuggcugaccgcgagcggcgagcgcaucuccguccucaaggccagccggcgcaaccugguggaccggaucaccgcccugcgcugccucgaggcccagguguccaccgggggcaucaucgacccccugacggggaagaaguaccgggucgccgaggcgcugcaccgcggccucguggacgagggguucgcccagcagcugcggcagugcgagcuggugaucaccggcaucggccacccgaucaccaacaagaugaugagcgucguggaggccgugaacgccaacaucaucaacaaggagauggggauccgcugccucgaguuccaguaccugaccggcgggcugaucgagccccagguccacucccggcucagcaucgaggaggcccuccaggugggcaucaucgacgugcugaucgcgacgaagcucaaggaccagaaguccuacguccgcaacaucaucugcccccagaccaagcgcaagcugaccuacaaggaggcccuggagaaggccgacuucgacuuccacaccggccucaagcugcuggaggugagcgagccccucaugacggggaucuccagccuguacuacuccagcuga

SEQ ID NO: 29399 - RNA, 498 nt, Artificial Sequence
  derived and/or modified sequence opt1 from DSTN__Homo_sapiens__XP_011527445
auggccagcggcgugcaggucgccgacgaggugugccgcaucuucuacgacaugaaggugcggaagugcuccacccccgaggagaucaagaagcgcaagaaggcggucaucuucugccugagcgccgacaagaagugcaucaucguggaggaggggaaggagauccucgugggcgacgucggggugaccaucacggacccguucaagcacuucgugggcaugcugcccgagaaggacugccgguacgcccuguacgacgccuccuucgagaccaaggagagccgcaaggaggagcucauguucuuccugugggcccccgagcuggcgccccucaaguccaagaugaucuacgccagcuccaaggacgccaucaagaagaaguuccaggggaucaagcacgagugccaggccaacggcccggaggaccugaaccgggcgugcaucgccgagaagcugggcgggagccucaucgucgccuucgagggcugccccguguga

SEQ ID NO: 29400 - RNA, 2790 nt, Artificial Sequence
  derived and/or modified sequence opt1 from DSTYK__Homo_sapiens__NP_056190
auggagggcgacggggugcccuggggcagcgagccggucuccgggcccggccccgggggcggcgggaugauccgcgagcugugccggggcuucgggcgcuaccggcgcuaccucggccggcugcgccagaaccugcgggagacccagaaguucuuccgcgacaucaagugcagccacaaccacacgugccucuccagccugaccgggggcggcggggccgagcggggccccgccggggacguggcggagaccggccugcaggccggccagcucuccugcaucagcuucccgcccaaggaggagaaguaccugcagcagaucguggacugccugcccugcauccucauccuggggcaggacugcaacgucaagugccagcugcucaaccugcugcucggcguccaggugcugcccaccaccaagcugggguccgaggagagcugcaagcuccgccggcugcgcuucacguacggcacccagacccgggugucccuggcccucccggggcaguacgagcuggugcacacccugguggcccaccagggcaacugggagacgauccccgaggaggaccucgagguccaggagaacaacgaggacgccgcgcacgugcuggccgagcuggaggugaccaugcaccacgcccuccugcaggaggucgacgugguggucgcccccugccagggccugcgccccaccguggacgugcucggggaccuggucaacgacuuccugccggugaucaccuacgcgcuccacaaggacgagcugagcgagcgggacgagcaggagcugcaggagauccgcaaguacuucuccuuccccguguucuucuucaagguccccaagcucggcagcgagaucaucgacuccagcacgcggcgcauggaguccgagcggagcccccuguaccgccagcugaucgaccucggguaccuguccagcucccacuggaacugcggcgccccggggcaggacaccaaggcccagagcaugcugguggagcagagcgagaagcuccggcaccuguccaccuucagccaccaggugcugcagacccgccucgucgacgccgccaaggcgcugaaccuggugcacugccacugccucgacaucuucaucaaccaggccuucgacaugcagcgcgaccugcagaucacgcccaagcggcuggaguacacccgcaagaaggagaacgagcuguacgagucccucaugaacaucgccaaccggaagcaggaggagaugaaggacaugaucgucgagacccugaacaccaugaaggaggagcugcucgacgacgccacgaacauggaguucaaggacgugaucgugcccgagaacggcgagcccgucggcacccgcgagaucaagugcugcauccggcagauccaggagcugaucaucagccgccugaaccaggccguggcgaacaagcucaucuccagcguggacuaccugcgggaguccuucgucgggacccuggagcgcugccuccagagccuggagaagucccaggacgugagcgugcacaucaccuccaacuaccugaagcagauccucaacgccgccuaccacgucgaggugacguuccacagcggcuccagcgugacccggaugcugugggagcagaucaagcagaucauccagcgcaucaccugggucuccccgcccgccaucacccuggaguggaagcggaagguggcccaggaggcgaucgagagccucuccgccagcaagcuggccaaguccaucugcagccaguuccgcacgcggcugaacagcucccacgaggccuucgccgcgagccuccgccagcuggaggccgggcacuccggccggcuggagaagaccgaggaccucuggcugcgcgugcggaaggaccacgcgccccgccuggcccggcucagccuggaguccugcagccugcaggacguccuccugcaccgcaagcccaagcuggggcaggagcucggccgcggccaguacggggugguguaccugugcgacaacuggggcgggcacuucccgugcgcccugaaguccgucgugccgcccgacgagaagcacuggaacgaccucgcccuggaguuccacuacaugcggagccugcccaagcacgagcgccucguggaccugcacggcuccgucaucgacuacaacuacggcgggggcagcuccaucgccgugcugcucaucauggagcggcugcaccgcgaccuguacaccgggcucaaggccggccugacccuggagacgcggcuccagaucgcccuggacguggucgaggggauccgcuuccugcacagccagggccucgugcaccgggacaucaagcugaagaacgugcugcucgacaagcagaaccgcgcgaagaucaccgaccugggcuucugcaagcccgaggccaugauguccgggagcaucgucggcacccccauccacauggcccccgagcuguucaccgggaaguacgacaacuccguggacguguacgccuucggcauccucuucugguacaucugcagcggguccgucaagcugccggaggccuucgagcggugcgcgagcaaggaccaccuguggaacaacgugcgccggggcgcccgccccgagcggcuccccguguucgacgaggagugcuggcagcugauggaggccugcugggacggcgacccccugaagcgcccgcuccuggggaucguccagcccaugcugcagggcaucaugaaccggcucugcaagagcaacuccgagcagcccaaccgcgggcuggacgacagcacguga

SEQ ID NO: 29401 - RNA, 630 nt, Artificial Sequence
  derived and/or modified sequence opt1 from DTD1__Homo_sapiens__NP_543010
augaaggccgugguccagcgcgugacccgggccagcgugaccgucggcggggagcagaucuccgcgaucggccgcgggaucugcgugcugcucggcaucagccuggaggacacgcagaaggagcuggagcacauggugcggaagauccucaaccugcgcgucuucgaggacgaguccgggaagcacuggagcaaguccgugauggacaagcaguacgagauccugugcgugagccaguucacccuccagugcguccugaagggcaacaagcccgacuuccaccuggccaugccgaccgagcaggccgagggcuucuacaacuccuuccucgagcagcugcggaagaccuaccgccccgagcugaucaaggacgggaaguucggcgccuacaugcagguccacauccagaacgacgggcccgugacgaucgagcucgagagccccgccccgggcaccgcgaccuccgaccccaagcagcugagcaagcuggagaagcagcagcagcggaaggagaagacccgcgccaaggggcccuccgagagcuccaaggagcggaacacgccccgcaaggaggaccggagcgccuccagcggcgccgagggcgacguguccagcgagcgcgagccguga

SEQ ID NO: 29402 - RNA, 1851 nt, Artificial Sequence
  derived and/or modified sequence opt1 from DTHD1__Homo_sapiens__NP_001130008
augugccuggagaagcgcuaccucgacgugcugagcgacgucaccggcccccagguguccugcuacaucaccgccccgagcuacgugcugcagcagcucgagugccggaucaucaaccacauguccagccugaucgucggggacaacgaggagcugguguccaacgugaucacgaucgagugcagcgacaaggagaagcgcguccccuuccccaucggcaucgccauccccuucaccgcgcgguaccgcgggaacuaccgggacaucauggugaaggugugcgacaucaaccuccaguccagcuaccugaacccgaacucccuggagggcaugaagggcggcuacaaggggaccugcgccagcgucaagguguacaagcucgggaucuucuccguggucagcugccugaagaaggaguccuucaccgugacgaagaagggccuggcccucaagagcuccauggacagccgcaucucccugaacuacccgcccgggguguucaccagccccguccuggugcagcucaagauccagcccguggaccccgcccuggucgcccaccugaaggcgcagcaggacaccuucuacuccgugcagagcaccagcccccucauccacauccagcaccccuccacguacccguuccagaagcccgugacccuguuccugcccugcagccccuaccucgacaagaacaaccugggcuccgagaucgaccacaagcggcgcgccagcgccaccaucaaccggaucaccccguccuacuucaaccgcacgaagaucgccagcauccggaagccccgcaagaacgcguccgagugccugaagcuccugggguuccggagccaggacuccggcuggugcggccuggacgacgucgugaagaccauccagagcgggcucguguccgucgagcuguacgagcaccuggagcgcuucaucgugcuccaccugagcuccaccauggacaacagccaccuggucaccuucgugaagucccucgaggaggccaugcugagcacgaccgccugcaucgugcugucccaccagaaggacaacccccaccggaucgccguccucguggugcccagcaaggaccugucccagguccugaaggaccuccaccuggagggcuucgggggcccgcccgagcccagccgccacuuccaggugcgggagggcgagcagcugcuccugcgcuucaccgggaacaucuucgccagcuccaacggcaaggacuacgggaaggacuacacccugaucuuccaccuccagcggaagccccgccuggagcugcagaucaaggagguggacgaguucggcaacuacagcugcccgcacuacaaggggacgaucgucguguacaaggugcccaagggcaagaucguccccaaccucaaccagucccuggugaucaacgagaaccacagccagcugcccaucugcaagcugccgcucaagcugcccaagcacaagaagcugaucaaccggccccaguccaccaagcgcgugagcaaggacccggucgaggcgcucugggacaaccugcugcacuggcucgccgaggagcuguccgaggagaacgccgagagccuguccagcacccucccccugcgccgguccaccauccagcugaucaagcucaagaaccccgacgaccugacggagcagauccacgaguuccugugcuucuggaagaagucccuccccaccuucaccgacaagcugcgccugcucgcccggcaccuccgcaagaucggccggagcgaccuggccgaggagcugaaguucaagugggagaacaagguguucaccgagccgcagcagugcuucgacguggcgcccgaguga

SEQ ID NO: 29403 - RNA, 1380 nt, Artificial Sequence
  derived and/or modified sequence opt1 from DTL__Homo_sapiens__NP_001273158
augggcuacagcucccugauccucgacagcaccggguccacccuguucgccaacugcacggacgacaacaucuacauguucaacaugaccggccugaagaccagccccguggccaucuucaacgggcaccagaacuccaccuucuacgucaagagcucccucagcccggacgaccaguuccugguguccggcagcuccgacgaggcggccuacaucuggaaggugagcacgcccuggcagccgcccaccguccugcucgggcacucccaggaggugaccagcgugugcuggugccccuccgacuucaccaagaucgccacgugcagcgacgacaacacccugaagaucuggcgccugaaccggggccucgaggagaagcccggcggggacaagcuguccaccgucggcugggccagccagaagaagaaggagucccgccccgggcuggugaccgugacgagcagccaguccacccccgccaaggcgccgcgggucaagugcaaccccagcaacuccagccccuccagcgccgccugcgcccccuccugcgcgggcgaccucccgcugcccagcaacacccccaccuucuccaucaagacgagccccgccaaggcccgcuccccgaucaaccggcgcgggagcguguccagcgugucccccaagccgcccagcuccuucaagaugagcauccggaacugggucacccgcacccccuccagcagcccgcccaucacgccgcccgccuccgagaccaagaucaugagcccccggaaggcccugauccccgugucccagaaguccagccaggcggaggccugcagcgagucccgcaaccgggugaagcgccggcucgacagcuccugccuggagagcgucaagcagaagugcgugaaguccugcaacugcgugaccgagcuggacggccaggucgagaaccuccaccuggaccugugcugccucgccggcaaccaggaggaccugagcaaggacucccuggggcccaccaagagcuccaagaucgagggcgccgggaccagcaucuccgagccgcccagccccaucagccccuacgccuccgagagcugcggcacgcucccccugccccugcgccccugcggcgagggguccgagauggugggcaaggagaacagcuccccggagaacaagaacuggcuccuggcgauggccgccaagcggaaggccgagaaccccagcccccgcucccccagcucccagaccccgaacagccggcgccaguccgggaagacccugcccagccccgugaccaucacgcccuccagcaugcggaagaucugcaccuacuuccaccgcaagucccaggaggacuucugcggcccggagcacagcaccgagcucuga

SEQ ID NO: 29404 - RNA, 1116 nt, Artificial Sequence
  derived and/or modified sequence opt1 from DTNA__Homo_sapiens__NP_001121647
augaucgaggacagcggcaagcgcgggaacaccauggccgagcggcgccagcuguucgccgagaugcgggcgcaggaccucgaccgcauccggcuguccaccuaccgcacggccugcaagcugcgguucgugcagaagaagugcaaccuccaccuggucgacaucuggaacgugaucgaggcccugcgcgagaacgcccucaacaaccuggaccccaacaccgagcugaacgugagccggcucgaggccguccuguccaccaucuucuaccagcugaacaagcgcaugccgaccacgcaccagauccacguggagcagagcaucucccuccugcugaacuuccuccuggcggccuucgaccccgagggccacgggaagaucagcguguucgccgucaagauggcccuggcgacccucugcggcgggaagaucauggacaagcugcgguacaucuucuccaugaucagcgacuccagcggcgugaugguguacggccgcuacgaccaguuccugcgggagguccucaagcugcccaccgccguguucgaggggcccuccuucggcuacaccgagcagagcgcccgcuccugcuucagccagcagaagaaggugacgcugaacggguuccucgacacccugauguccgacccgccgccccagugccuggucuggcucccccugcugcaccggcucgccaacguggagaacguguuccaccccgucgagugcagcuacugccacuccgagagcaugaugggcuuccgcuaccggugccagcagugccacaacuaccagcugugccaggacugcuucuggcgcgggcacgccggcggcucccacagcaaccagcaccagaugaaggaguacaccagcuggaagucccccgcgaagaagcugaccaacgcccucagcaagucccugagcugcgccuccagccgggagccccugcaccccauguucccggaccagcccgagaagccccucaaccuggcccacaucgugcccccgcgccccgugacguccaugaacgacacccuguucagccacuccguccccagcuccgggagccccuucaucacccgguccagcgacggcgccuucgggggcugcguguga

SEQ ID NO: 29405 - RNA, 1863 nt, Artificial Sequence
  derived and/or modified sequence opt1 from DTNB__Homo_sapiens__NP_001243232
augaucgaggagagcggcaacaagcgcaagaccauggccgagaagcggcagcuguucaucgagaugcgcgcccagaacuucgacgugauccggcucuccaccuaccgcacggcgugcaagcugcgguucguccagaagcgcugcaaccugcaccucguggacaucuggaacaugaucgaggccuuccgggacaacgggcugaacacccuggaccacaccaccgagaucagcgugucccgccucgagacggucaucagcuccaucuacuaccagcugaacaagcggcugcccagcacccaccagaucuccguggagcagagcaucucccuccugcugaacuucaugaucgccgccuacgacagcgagggccgcgggaagcucaccguguucuccgucaaggccaugcuggcgaccaugugcggcgggaagaugcuggacaagcuccgguacguguucagccagauguccgacagcaacggccugaugaucuucuccaaguucgaccaguuccugaaggaggugcucaagcugccgacggccgucuucgagggccccagcuucggguacaccgagcacuccgugcggaccugcuucccccagcagcgcaagaucaugcugaacauguuccucgacaccaugauggccgacccgccgccccagugccugguguggcugccccucaugcaccgccuggcccacgucgagaacguguuccaccccguggagugcagcuacugccggugcgaguccaugaugggcuuccgcuaccggugccagcagugccacaacuaccagcugugccagaacugcuucuggcgcgggcacgcgggcgggccccacagcaaccagcaccagaugaaggagcacagcuccuggaagucccccgccaagaagcucagccacgccaucagcaagucccugggcugcguccccacgcgggagcccccgcaccccguguuccccgagcagcccgagaagccgcuggaccucgcccacaucgugccgccccgcccccugaccaacaugaacgacaccauggucagccacauguccagcggcgugcccacccccacgaagcggcugcaguacucccaggacauccccagccaccucgccgacgagcacgcgcugaucgccuccuacguggcccgccugcagcacugcgcccgcguccucgacagccccucccggcuggacgaggagcaccgccugaucgcccgguacgcggcccgccucgccgccgaggccgggaacgugacccggccgcccaccgaccugagcuucaacuucgacgcgaacaagcagcagcgccagcugaucgccgagcucgagaacaagaaccgggagauccugcaggagauccagcgccugcggcucgagcacgagcaggccucccagcccacccccgagaaggcccagcagaacccgacgcugcuggccgagcuccgccugcugcggcagcgcaaggacgagcuggagcagcggaugagcgcgcuccaggagucccgccgggagcugauggugcagcuggaggagcucaugaagcugcugaaggcccaggccaccggcagcccccacaccucccccacccacgggggcggccgcccgaugcccaugcccguccggagcacgagcgccggguccacccccacccacugcccgcaggacagccucuccggcgucgggggcgacgugcaggaggcguucgcccaggggacccgccggaaccugcgcaacgaccugcucguggccgccgacagcaucacgaacaccauguccagccuggugaaggagcugcacuccgccgaggagggcgcggaggaggaggaggagaagaugcagaacggcaaggaccgcggguga

SEQ ID NO: 29406 - RNA, 813 nt, Artificial Sequence
  derived and/or modified sequence opt1 from DTNBP1__Homo_sapiens__NP_001258596
augcugagcgcccacugggagaagaagaagaccucccucguggagcugcaggagcagcugcagcagcuccccgcccugaucgcggaccuggagagcaugaccgccaaccucacgcaccuggaggccuccuucgaggaggucgagaacaaccugcuccaccuggaggaccugugcggccagugcgagcucgagcgcugcaagcacaugcagagccagcagcuggagaacuacaagaagaacaagcggaaggagcuggagaccuucaaggccgagcucgacgccgagcacgcgcagaaggugcuggagauggagcacacccagcagaugaagcugaaggagcgccagaaguucuucgaggaggccuuccagcaggacauggagcaguaccucuccaccggguaccugcagaucgccgagcggcgcgagccgaucggcagcauguccagcauggaggugaacgucgacaugcuggagcagauggaccucauggacaucuccgaccaggaggcccuggacguguuccugaacagcgggggcgaggagaacacggugcucucccccgcgcuggggcccgagagcuccacgugccagaacgagaucacccugcagguccccaacccgagcgagcuccgggccaagccgcccuccagcuccagcacgugcaccgacuccgccacccgcgacaucagcgagggcggcgagagccccguggugcaguccgacgaggaggagguccagguggacaccgcccuggccaccagccacaccgaccgggaggcgacccccgacgggggcgaggacuccgacagcuga

SEQ ID NO: 29407 - RNA, 1863 nt, Artificial Sequence
  derived and/or modified sequence opt1 from DTX1__Homo_sapiens__XP_011536311
augagccgccccggccacgggggccugaugccggugaacgggcucggcuucccgccccagaacgucgcccgggugguggucugggaguggcugaacgagcacucccgcuggcggcccuacaccgccaccgugugccaccacaucgagaacgugcugaaggaggacgcgcgcgggagcgucgugcucggccagguggacgcccagcugguccccuacaucaucgaccugcaguccaugcaccaguuccggcaggacacgggcaccaugcgccccgugcggcgcaacuucuacgaccccagcuccgcccccgggaagggcaucgugugggagugggagaacgacgggggcgccuggaccgccuacgacauggacaucugcaucaccauccagaacgcguacgagaagcagcacccguggcucgaccugagcucccugggguucugcuaccucaucuacuucaacagcaugucccagaugaaccggcagacgcgccggcgccggcgccugcggcgccggcuggaccucgccuacccccugaccgucggcagcauccccaagucccagagcuggcccgugggcgccuccagcgggcagccgugcuccugccagcagugccugcucgugaacagcacccgcgccgcguccaacgccauccuggccagccagcggcgcaaggccccgcccgcgccgccccugcccccgccgcccccgcccggcgggccgcccggcgcccucgccguccggcccuccgccaccuucacgggcgccgcccugugggcggcccccgccgccgggcccgccgagcccgcgcccccgcccggcgccccgccccgcagccccggggcccccggcggggcccgcacccccggccagaacaaccugaaccggcccggcccccagcgcaccaccagcguguccgcccgggcgagcaucccgcccggggugcccgcccuccccgucaagaaccugaacggcacggggcccgugcaccccgcccuggccggcaugaccgggauccuccugugcgcggccggccugcccgugugccucacccgcgcccccaagcccauccugcacccgccgcccgucuccaagagcgacgugaagcccgugcccggcguccccggggugugccggaagaccaagaagaagcaccugaagaaguccaagaaccccgaggacgucgugcgccgguacaugcagaaggugaagaacccgcccgacgaggacugcacgaucugcauggagcgccucgucaccgccagcggcuacgagggggugcugcggcacaagggcgugcgccccgagcuggucgggcggcucggccgcugcggccacauguaccaccuccugugccugguggccauguacuccaacgggaacaaggacggcagccugcagugccccacgugcaaggcgaucuacggggagaagaccggcacccagccgcccggcaagauggaguuccaccugaucccccacucccuccccggguuccccgacacccagaccauccggaucguguacgacauccccaccggcauccaggggcccgagcacccgaaccccggcaagaaguucacggcccgcggguucccccggcacugcuaccugcccaacaacgagaagggccgcaagguccugcggcuccugaucaccgccugggagcgccggcugaucuucaccaucggcaccagcaacacgaccggggaguccgacaccgugguguggaacgagauccaccacaagaccgaguucggcagcaaccucacggggcacggcuacccggacgccuccuaccuggacaacguccuggccgagcucaccgcgcagggggugagcgaggccgccgccaaggccuga

SEQ ID NO: 29408 - RNA, 1869 nt, Artificial Sequence
  derived and/or modified sequence opt1 from DTX2__Homo_sapiens__NP_001096064
auggccauggcccccagcccgucccuggugcaggucuacaccagccccgcggccguggccgugugggaguggcaggacggccucgggaccuggcaccccuacuccgccacggucugcagcuucaucgagcagcaguucgugcagcagaagggccagcgcuucgggcugggcucccuggcccacagcaucccccucgggcaggcggacccgucccuggcccccuacaucaucgaccugcccagcuggacccaguuccggcaggacaccggcaccaugcgcgccgugcggcgccaccucuucccccagcacuccgccccgggccgcggggucgugugggaguggcugagcgacgacggcuccuggacggcguacgaggccagcgugugcgacuaccuggagcagcaggucgcccgggggaaccagcucguggaccuggcgccccugggcuacaacuacaccgugaacuacaccacccacacgcagaccaacaagaccuccagcuucugccgguccguccgccggcaggccgggccgcccuaccccgugaccacgaucaucgccccgcccggccacaccggcguggccugcagcugccaccagugccucuccgggagccgcaccggccccgucuccgggcgguaccgccacagcaugaccaaccugcccgccuaccccgugccccagcacccgccccaccggacggccagcguguucggcacccaccaggccuucgcgcccuacaacaagcccucccugagcggcgcccgcuccgcgccccggcucaacaccaccaacgccuggggcgccgccccgcccagccuggggucccagccccuguaccgcagcucccucagccaccuggggccccagcaccucccgcccggcuccagcacguccggggccgucagcgccucccugcccagcggcccguccagcucccccggcagcgugcccgccaccgugcccaugcagaugccgaagcccucccggguccagcaggcccuggcggggaugaccagcgugcugaugagcgccaucggccuccccgugugccugucccgcgcgccccagccgaccagcccgcccgccucccggcuggccagcaagucccacgggagcgucaagcgccuccggaagauguccgugaagggcgccacgcccaagcccgagcccgagcccgagcaggucaucaagaacuacaccgaggagcugaaggugcccccggacgaggacugcaucaucugcauggagaagcugagcaccgccuccggguacagcgacgugaccgacuccaaggccaucggcagccucgccgucggccaccugacgaagugcucccacgcguuccaccuccugugccugcuggccauguacugcaacgggaacaaggacggcagccuccagugccccuccugcaagaccaucuacggggagaagaccggcacccagccccaggggaagauggaggugcugcgcuuccagaugagccugcccggccacgaggacugcggcacgauccucaucguguacuccaucccgcacgggauccagggccccgagcaccccaaccccgggaagccguucaccgcccgcggcuucccccggcagugcuaccugcccgacaacgcccagggccgcaagguccuggagcuccugaagguggccuggaagcggcgccugaucuucaccguggggaccagcagcacgaccggcgagaccgacaccgucguguggaacgagauccaccacaagaccgagauggaccggaacaucacggggcacggcuacccggaccccaacuaccuccagaacgugcuggcggagcuggccgcccagggggucaccgaggacugccucgagcagcaguga

SEQ ID NO: 29409 - RNA, 1053 nt, Artificial Sequence
  derived and/or modified sequence opt1 from DTX3__Homo_sapiens__NP_001273174
augcccauccugagcuccagcggcuccaagauggccgccugcgggggcaccugcaagaacaaggugaccgucagcaagccggugugggacuuccucuccaaggagacgcccgcgcgccuggcccggcugcgcgaggagcaccgggugagcauccucaucgacggggagaccuccgacaucuacguccugcagcugagcccccagggccccccgcccgccccccccaacgggcucuaccuggcccgcaaggcccugaagggccuccugaaggaggcggagaaggagcugaagaaggcccagcggcagggcgagcucauggggugccuggcccugggcgggggcggggagcacccggagaugcaccgcgccggcccccccccccuccgggcggccccgcugcugccccccggcgcccgcgggcuccccccgcccccccccccgcugccccccccccugccgccccggcuccgcgaggaggccgaggagcaggaguccaccugccccaucugccugggcgagauccagaacgccaagacccuggagaagugccggcacagcuucugcgaggggugcaucacgcgcgcgcuccaggugaagaaggccugccccaugugcggccgguucuacggccagcugguggggaaccagccgcagaacggccgcaugcuggucuccaaggacgccacccuccugcugcccagcuacgagaaguacgggaccaucgugauccaguacguguuccccccgggcguccagggggccgagcaccccaaccccggcgugcgguaccccggcaccacgcgcguggccuaccucccggacugccccgaggggaacaagguccugacccuguuccggaaggcguucgaccagcgccucaccuucaccaucggcacguccaugaccaccgggcggcccaacgugaucaccuggaacgacauccaccacaagacgagcugcaccggcgggccccagcuguucggcuacccggaccccaccuaccugacccgcgugcaggaggagcuccgggccaagggcaucacggacgacuga

SEQ ID NO: 29410 - RNA, 1542 nt, Artificial Sequence
  derived and/or modified sequence opt1 from DTX4__Homo_sapiens__NP_001287656
auggaggugggcaucaccauccagcacgccuacgagaagcagcaccccuggaucgaccugaccagcaucggguucuccuacgucaucgacuucaacacgaugggccagaucaaccgccagacccagcggcagcgccgggugcgccggcgccucgaccugaucuacccgauggugaccgggacccugcccaaggcccagagcuggcccgucucccccggcccggcgacgagcccgcccaugucccccugcagcugcccccagugcgugcucgugauguccgucaaggccgccguggugaacgggagcaccggcccccugcagcugcccgucacccggaagaacaugcccccgcccggcguggugaagcucccgccccugcccggguccggcgccaagccccuggacagcaccgggacgauccgcggcccccucaagaccgcccccucccaggucauccggcgccaggcgagcuccaugccgaccgggaccacgaugggcagccccgccuccccgcccggccccaacagcaagaccgggcggguggcccuggccacccugaaccgcaccaaccuccagcggcuggcgaucgcccagucccgcgugcugaucgccagcggcguccccacggugcccgugaagaaccucaacggguccagccccgucaacccggcccuggccggcaucaccggcauccugaugagcgcggccgggcuccccgugugccugacccggcccccgaagcuggugcuccacccgccgcccgucuccaagagcgagaucaaguccauccccggcgugagcaacaccucccgcaagacgaccaagaagcaggccaagaaggggaagacccccgaggaggugcugaagaaguaccugcagaagguccggcacccgcccgacgaggacugcaccaucugcauggagcgccucacggcccccagcggcuacaaggggccccagcccaccgugaagcccgaccuggucggcaagcugucccggugcggccacguguaccacaucuacugccucguggccauguacaacaacgggaacaaggacggcagccugcagugccccacgugcaagaccaucuacggggucaagaccggcacccagccgcccgggaagauggaguaccaccugaucccccacucccuccccggccaccccgacugcaagaccauccgcaucaucuacagcaucccgcccggcauccaggggcccgagcaccccaaccccggcaaguccuucagcgcgcggggguucccccgccacugcuaccugccggacuccgagaagggccgcaaggugcugaagcuccugcugguggccugggaccggcgccucaucuucgccaucgggaccagcuccacgaccggcgagagcgacaccgucaucuggaacgaggugcaccacaagaccgaguucggcuccaaccugacggggcacggcuaccccgacgccaacuaccuggacaacgugcucgccgagcuggcggcccaggggaucagcgaggacuccaccgcccaggagaaggacuga

SEQ ID NO: 29411 - RNA, 639 nt, Artificial Sequence
  derived and/or modified sequence opt1 from DTYMK__Homo_sapiens__NP_036277
auggccgcccgccggggcgcgcugaucgugcucgagggggucgaccgcgccggcaagagcacccagucccggaagcugguggaggcccugugcgccgccgggcaccgcgcggagcuccugcgguuccccgagcgcagcaccgagaucggcaagcugcucuccagcuaccugcagaagaaguccgacguggaggaccacagcguccaccuccuguucuccgccaaccggugggagcaggucccgcugaucaaggagaagcugagccagggggugacgcucgugguggaccgcuacgccuucuccggcguggccuucaccggcgcgaaggagaacuucagccuggacuggugcaagcagcccgacgucgggcugcccaagcccgaccucgugcuguuccugcagcuccagcuggccgacgccgccaagcggggcgccuucgggcacgagcgcuacgagaacggcgcguuccaggagcgggcccugcgcugcuuccaccagcucaugaaggacaccacccugaacuggaagaugguggacgccuccaagagcaucgaggccguccacgaggacauccgggugcuguccgaggacgccauccgcacggcgaccgagaagccgcucggggagcuguggaaguga

SEQ ID NO: 29412 - RNA, 4656 nt, Artificial Sequence
  derived and/or modified sequence opt1 from DUOX1__Homo_sapiens__NP_787954
augggcuucugccuggcccucgccuggacccugcuggugggggcguggacgccccucggcgcccagaaccccaucagcugggagguccagcgcuucgacgggugguacaacaaccugauggagcaccgguggggcuccaaggggagccgccugcagcggcucgugcccgccuccuacgccgacggcguguaccagccccugggcgagccccaccucccgaacccccgcgaccucagcaacaccaucucccgggggcccgccggccuggcgagccugcgcaaccggaccguccucgggguguucuucggcuaccacgugcuguccgaccuggucagcguggagacccccgggugcccggccgaguuccucaacauccgcaucccgcccggcgaccccauguucgaccccgaccagcggggcgacgugguccugcccuuccagcgcucccggugggaccccgagaccgggcgcagccccuccaacccgcgggaccccgccaaccaggugacgggcuggcuggacgggagcgccaucuacggcuccagccacuccuggagcgacgcgcuccgcuccuucagccggggccagcuggccuccgggcccgaccccgccuucccgcgcgacagccagaacccccugcucaugugggccgcccccgaccccgcgaccggccagaacgggccgcggggccuguacgccuucggggccgagcgcggcaaccgggagcccuuccugcaggcccucggccugcugugguuccgcuaccacaaccucugggcccagcggcuggcgcgccagcaccccgacugggaggacgaggagcuguuccagcacgcccgcaagcgggugaucgccaccuaccagaacaucgccgucuacgaguggcuccccagcuuccugcagaagacccugccggaguacacgggguaccgccccuuccucgaccccuccaucagcuccgaguucguggccgcgagcgagcaguuccuguccaccauggugccgcccggcgucuacaugcggaacgccagcugccacuuccagggggugaucaaccgcaacuccagcgugucccgggcccugcgcgucugcaacagcuacuggucccgggagcaccccagccuccaguccgccgaggacguggacgcccugcugcucggcauggcgagccagaucgccgagcgcgaggaccacgugcuggucgaggacgugcgggacuucuggcccgggccgcugaaguucucccgcaccgaccaccucgccagcugccugcagcggggccgcgaccugggccuccccuccuacaccaaggcccgggcggcccuggggcugagccccaucacgcgcuggcaggacaucaaccccgcccucucccggagcaacgacaccgugcuggaggccaccgccgcgcuguacaaccaggaccugagcuggcucgagcugcugccgggcgggcuccuggagucccaccgcgaccccggcccccuguucagcaccaucguccucgagcaguucgugcggcugcgcgacggggaccgguacugguucgagaacacgcgcaacggccuguucuccaagaaggagaucgaggagauccgcaacaccacccugcaggacguccugguggccgugaucaacaucgaccccagcgcccugcagccgaacgucuucguguggcacaagggcgaccccugcccccagccccggcagcucuccaccgaggggcugccggccugcgcccccagcgugguccgcgacuacuucgagggcuccggguucggcuucggcgugacgaucgggacccugugcugcuucccccucgugagccugcuguccgcguggaucgucgcccggcuccgcaugcggaacuucaagcgccugcagggccaggaccggcagagcaucguguccgagaagcuggucgggggcauggaggcccucgaguggcaggggcacaaggagcccugccgcccggugcugguguaccugcagcccggccagauccggguggucgacggccgccucaccgugcugcggaccauccagcugcagccgccccagaaggugaacuucguccucagcuccaaccgcgggcggcgcacgcugcugcucaagauccccaaggaguacgaccuggugcuccuguucaaccuggaggaggagcggcaggcccugguggagaaccuccgcggcgcccugaaggagagcgggcuguccauccaggagugggagcuccgggagcaggagcugaugcgcgcggccgucacccgggagcagcgccggcaccuccuggagaccuucuuccgccaccuguucagccaggugcuggacaucaaccaggccgacgccggcacccucccccuggacuccagccagaaggugcgcgaggcgcugacgugcgagcucagccgggccgaguucgccgagucccuggggcugaagccccaggacauguucgucgagagcauguucucccucgccgacaaggacggcaacggcuaccugagcuuccgcgaguuccuggacauccucgugguguucaugaagggguccccggaggagaagucccggcugauguuccgcauguacgacuucgacggcaacgggcugaucagcaaggacgaguucauccggaugcuccgcagcuucaucgagaucuccaacaacugccugagcaaggcccagcuggcggaggucguggaguccauguuccgggagagcggcuuccaggacaaggaggagcucaccugggaggacuuccacuucaugcugcgcgaccacaacuccgagcugcgguucacccagcucugcgugaagggggucgaggugcccgaggugaucaaggaccugugccgccgggccagcuacaucucccaggacaugaucugccccagcccccgcgucuccgcccggugcagccgcuccgacaucgagaccgagcugacgccgcagcggcuccagugccccauggacaccgacccgccccaggagauccgccggcgcuucggcaagaaggugaccagcuuccagccccugcuguucaccgaggcccaccgggagaaguuccagcgcagcugccuccaccagacggugcagcaguucaagcgcuucaucgagaacuaccggcgccacaucggcugcgucgccguguucuacgcgaucgccgggggccuguuccuggagcgggccuacuacuacgccuucgccgcgcaccacaccgggaucaccgacaccacccgcgugggcaucauccucucccgggggacggccgccagcaucuccuucauguucagcuacauccugcugaccaugugccgcaaccucaucaccuuccugcgggagaccuuccugaaccgcuacguccccuucgacgccgcgguggacuuccaccggcucaucgccuccacggccaucgugcugaccguccugcacagcgugggccacguggucaacguguaccucuucuccaucagcccccuguccgugcugagcugccucuuccccggccuguuccacgacgacggguccgagcugccgcagaaguacuacuggugguucuuccagaccguccccggccucaccgggguggugcugcugcucauccuggccaucauguacgucuucgccagccaccacuuccgccggcgcuccuuccggggcuucuggcugacgcaccaccucuacauccugcuguacgugcugcucaucauccacggcagcuucgcgcugauccagcugccccgcuuccacaucuucuuccucguccccgccaucaucuacgggggcgacaagcuggugucccugagccggaagaagguggagaucuccgucgugaaggccgagcuccugccgagcggggugacccaccuccgcuuccagcggccccagggcuucgaguacaaguccgggcaguggguccgcaucgccugccuggcccugggcaccaccgaguaccaccccuucacgcugaccagcgcgccccacgaggacacccucagccugcacauccgggccgccggcccguggaccacgcgccugcgggagaucuacuccgcccccaccggggaccgcugcgcccgcuaccccaagcucuaccuggacggccccuucggggagggccaccaggaguggcacaaguucgaggugagcgugcuggucgggggcggcaucggggugaccccguucgcguccauccucaaggaccugguguucaagagcuccgucagcugccagguguucugcaagaagaucuacuucaucugggugacccggacgcagcgccaguucgaguggcuggccgacaucauccgggaggucgaggagaacgaccaccaggaccucguguccgugcacaucuacaucacccagcuggccgagaaguucgaccugcgcaccaccaugcucuacaucugcgagcggcacuuccagaagguccugaaccgcagccuguucacgggccuccgguccaucacccacuucgggcgcccgcccuucgagcccuucuucaacagccugcaggaggugcacccccaggugcggaagaucggcgucuucuccugcgggccgcccggcaugaccaagaacguggagaaggccugccagcugaucaaccgccaggaccggacccacuucagccaccacuacgagaacuucuga

SEQ ID NO: 29413 - RNA, 4647 nt, Artificial Sequence
  derived and/or modified sequence opt1 from DUOX2__Homo_sapiens__NP_054799
augcugcgcgcccggcccgaggcccucaugcugcugggcgcgcuccugaccgggagccugggccccuccgggaaccaggacgcccucagccugcccugggaggugcagcgcuacgacggcugguucaacaaccugcggcaccacgagcgcggggccgucggcugccggcuccagcgccgggugcccgccaacuacgccgacggcguguaccaggcgcuggaggagccccagcugccgaacccccgccggcucuccaacgccgccacccgcgggaucgccggccugcccagccugcacaaccggacgguccucgggguguucuucggcuaccacgugcuguccgacgucgugagcguggagacccccgggugcccggcggaguuccugaacauccgcaucccgcccggcgaccccgucuucgaccccgaccagcggggcgacguggugcuccccuuccagcgcucccggugggaccccgagaccgggcgcagccccuccaacccgcgggaccuggccaaccaggucaccggcuggcuggacgggagcgccaucuacggcuccagccacuccuggagcgacgcccuccgcuccuucagcggcgggcagcuggccuccggccccgaccccgcguucccccgggacagccagaacccgcugcucaugugggccgcccccgaccccgccacggggcagaacggcccccgcgggcuguacgccuucggcgcggagcggggcaaccgcgagccguuccugcaggcccucgggcugcugugguuccgcuaccacaaccucugggcccagcggcuggcccgccagcaccccgacugggaggacgaggagcuguuccagcacgcccggaagcgcgugaucgcgaccuaccagaacaucgccguguacgaguggcuccccuccuuccugcagaagacccugcccgaguacaccggcuaccggccguuccucgaccccagcaucagccccgaguucgucguggccuccgagcaguucuucagcacgauggugccgcccggggucuacaugcgcaacgccuccugccacuuccggaaggugcugaacaagggcuuccagagcucccaggcccugcgcgugugcaacaacuacuggauccgggagaaccccaaccucaacagcacccaggaggucaacgagcugcugcucgggauggcgucccagaucagcgagcuggaggacaacaucgugguggaggaccugcgcgacuacuggcccggcccgggcaaguucucccggaccgacuacgucgccagcuccauccagcgcgggcgggacaugggccuccccagcuacucccaggcccugcuggccuucgggcucgacaucccccgcaacuggagcgaccugaaccccaacguggacccgcagguccuggaggcgaccgccgcccuguacaaccaggaccucucccagcuggagcugcuccugggcgggcugcucgagagccacggcgaccccggcccccuguucuccgccaucgugcuggaccaguucgugcggcuccgcgacggggaccgguacugguucgagaacacgcgcaacggccuguucagcaagaaggagaucgaggacauccggaacaccacccugcgcgacguccucguggccgugaucaacaucgaccccuccgcgcugcagccgaacgucuucguguggcacaagggggcccccugcccccagcccaagcagcugaccacggacggccucccgcagugcgcgccccugaccgugcuggacuucuucgagggcagcagccccggguucgccaucaccaucaucgcccucugcugccugccccuggucucccuccugcugagcggcgugguggccuacuuccgcgggcgggagcacaagaagcuccagaagaagcugaaggaguccgucaagaaggaggccgccaaggacggcgugccggccauggaguggcccgggcccaaggagcgcagcucccccaucaucauccagcugcucagcgaccggugccuccaggugcugaaccgccaccucaccguccugcggguggugcagcugcagccgcuccagcaggucaaccugauccuguccaacaaccgcggcugccggacgcuccugcugaagauccccaaggaguacgaccucgugcugcuguucagcuccgaggaggagcgcggcgccuucgugcagcagcucugggacuucugcguccggugggcgcuggggcugcacguggccgagaugagcgagaaggagcuguuccgcaaggccgugaccaagcagcagcgggagcgcauccuggagaucuucuuccggcaccuguucgcccagguccucgacaucaaccaggcggacgccggcacccugccccuggacuccagccagaaggugcgcgaggcccugaccugcgagcucucccgggccgaguucgccgagagccuggggcucaagccgcaggacauguucguggaguccauguucagccuggcggacaaggacggcaacggguaccuguccuuccgcgaguuccucgacauccuggucguguucaugaagggcagccccgaggacaagagccggcugauguucacgauguacgaccucgacgagaacggcuuccuguccaaggacgaguucuucaccaugaugcgcagcuucaucgagaucuccaacaacugccugagcaaggcccagcucgccgagguggucgaguccauguuccgggagagcggguuccaggacaaggaggagcugaccugggaggacuuccacuucaugcugcgcgaccacgacuccgagcuccgguucacccagcugugcgugaagggcgggggcgggggcggcaacgggauccgcgacaucuucaagcagaacaucagcugccgcguguccuucaucacgcggacccccggcgagcgcagccacccccaggggcugggcccgcccgcccccgaggcccccgagcucgggggcccgggccugaagaagcgguucgggaagaaggcggccguccccacgccccgccuguacaccgaggcccuccaggagaagaugcagcggggcuuccuggcccagaagcugcagcaguacaagcgcuucguggagaacuaccggcgccacaucgugugcgucgccaucuucuccgcgaucugcguggggguguucgccgaccgggccuacuacuacggcuucgccagcccgcccuccgacaucgcgcagaccacccucgucggcaucauccugagccgcgggaccgccgccuccgugagcuucauguucuccuacauccugcucaccaugugccggaaccugaucacguuccugcgcgagaccuuccucaaccgguacgugcccuucgacgccgccgucgacuuccaccgcuggaucgcgauggccgccguggugcuggccauccugcacagcgccggccacgcggucaacguguacaucuucuccgugagcccccucagccugcuggccugcaucuuccccaacgucuucgugaacgacggguccaagcucccgcagaaguucuacuggugguucuuccagaccgugcccggcaugaccgggguccugcugcuccuggugcuggccaucauguacgucuucgccagccaccacuuccggcgccgguccuuccgcggcuucuggcucacccaccaccuguacauccugcuguacgcccuccugaucauccacggcagcuacgcgcugauccagcuccccacguuccacaucuacuuccuggugcccgccaucaucuacgggggcgacaagcuggugucccucagccggaagaaggucgagaucuccguggugaaggccgagcugcugccgagcggggucaccuaccuccaguuccagcgcccccagggcuucgaguacaaguccgggcagugggugcgcaucgccugccuggcccugggcaccaccgaguaccaccccuucacgcucaccagcgcgccccacgaggacacccugucccugcacauccgggccgugggcccguggaccacgcgccuccgggagaucuacagcucccccaaggggaacggcugcgccggguaccccaagcuguaccuggacggccccuucggggagggccaccaggaguggcacaaguucgaggucagcgugcucgugggcgggggcaucggggucaccccguucgccuccauccugaaggaccugguguucaagagcucccucggcagccagaugcugugcaagaagaucuacuucaucugggugacccgcacccagcggcaguucgaguggcuggcggacaucauccaggaggucgaggagaacgaccaccaggaccucguguccgugcacaucuacgucacgcagcuggccgagaaguucgaccugcgcaccaccaugcucuacaucugcgagcggcacuuccagaaggugcugaaccgcagccuguucaccggccuccggagcaucacgcacuucgggcgcccgcccuucgagcccuucuucaacucccugcaggaggugcacccccagguccggaagaucggcguguucagcugcgggccgcccggcaugaccaagaacguggagaaggccugccagcuggucaaccgccaggaccgggcccacuucaugcaccacuacgagaacuucuga

SEQ ID NO: 29414 - RNA, 1452 nt, Artificial Sequence
  derived and/or modified sequence opt1 from DUOXA1__Homo_sapiens__NP_001263193
auggccacccugggccacaccuuccccuucuacgccgggccgaagcccacguuccccauggacaccacccucgcgagcaucaucaugaucuuccugaccgcccuggccacguucaucgugauccuccccggcauccgcgggaagacccggcuguucuggcugcuccgcgucgugaccucccuguucaucggcgccgccauccuggcggugaacuucagcuccgaguggagcgucggccagguguccaccaacacgagcuacaaggccuucuccagcgaguggaucuccgccgacaucgggcuccaggugggccucgggggcgucaacaucacccugaccgggaccccggugcagcagcugaacgagacgaucaacuacaacgaggaguucaccuggcggcugggcgagaacuacgccgaggaguacgcgaaggcccuggagaaggggcuccccgaccccgugcuguaccuggccgagaaguucacgccccgcagcccgugcggccucuaccggcaguaccgccuggccggccacuacaccuccgccaugcugugggucgcguuccucugcuggcugcuggccaacgugaugcucagcaugcccgugcuggucuacgggggcuacaugcugcucgccaccgggaucuuccagcugcuggcccuccuguucuucuccauggccaccagccugaccucccccugcccccuccaccugggcgcgagcgugcugcacacccaccacggcccggccuucuggaucacgcucaccaccgggcugcugugcgugcuccugggccuggccauggccgucgcccaccggaugcagccccaccgccucaaggcguucuucaaccaguccguggacgaggaccccaugcuggaguggagccccgaggagggcgggcugcucuccccgcgguaccgcagcauggccgacagccccaagucccaggacaucccccugagcgaggccuccagcaccaaggccuacuaccggccccgccggcugucccucgugccggccgacguccgcgggcuggcgcccgccgcccugagcgcccugcccggcgcgcuccuggcccaggccuggcgggcccugcuccccggccugcgcugcccgaaggccgggaaggagucccggcugggcccgccccacagccccuggcgcuucgggcccgagggcugcgaggagcggugggcggagcacacgggggacagcccccgcccccuccggggccgcggcaccgggcgccuguggcgguggggcuccaaggagcgccgggccugcggggugcgcgccaugcugccgcggcucguguccaacagcggccugaagcgccccuccugccuggaccuccccaagugcugggacuaccggcgcgacgcccgggccuucuuccaccuccuggagcccaccccgugcgucaccagccgccacacgccccugaucuga

SEQ ID NO: 29415 - RNA, 963 nt, Artificial Sequence
  derived and/or modified sequence opt1 from DUOXA2__Homo_sapiens__NP_997464
augacccuguggaacggcgugcuccccuucuacccgcagccccgccacgccgccggguucagcgucccccugcugaucgugauccucguguuccuggcgcuggccgccuccuuccuccugauccugcccggcauccgggggcacagccgcugguucuggcucguccgggugcugcugucccucuucaucggcgccgagaucguggccguccacuucagcgcggagugguucguggggaccgugaacacgaacaccuccuacaaggccuucagcgccgcccgcgucaccgcgcgggugcgccugcuggugggccucgagggcaucaacaucacccugacggggaccccgguccaccagcugaacgagaccaucgacuacaacgagcaguucaccuggcggcucaaggagaacuacgccgccgaguacgccaacgcccuggagaagggccugcccgaccccgugcucuaccuggcggagaaguucacgcccuccagcccgugcgggcuguaccaccaguaccaccucgccggccacuacgccuccgccacccuguggguggccuucugcuucuggcugcucagcaacguccugcuguccacccccgcgccccucuacgggggccuggcccugcucaccacgggcgccuucgcccuguucgggguguucgcccuggcgagcaucuccagcgugccccucugcccgcugcgccugggcuccagcgcccucaccacccaguacggggccgccuucugggucacccuggccacgggcgugcugugccucuuccugggcggggcgguggucucccugcaguacgugcggcccagcgcccuccgcacccugcuggaccaguccgccaaggacugcagccaggagcggggcgggagcccccucauccugggcgacccccugcacaagcaggccgcgcugccggaccucaagugcaucaccaccaaccuguga

SEQ ID NO: 29416 - RNA, 663 nt, Artificial Sequence
  derived and/or modified sequence opt1 from DUPD1__Homo_sapiens__NP_001003892
augaccagcggcgaggugaagaccucccugaagaacgccuacagcuccgccaagcgccucagccccaagauggaggaggagggggaggaggaggacuacugcacgccgggcgcguucgagcuggagcggcuguucuggaaggggagcccccaguacacccacgucaacgagguguggcccaagcucuacaucggcgacgaggccaccgcccuggaccgcuaccggcugcagaaggccggguucacccacgugcucaacgccgcgcacggccgcuggaacgucgacacgggccccgacuacuaccgggacauggacauccaguaccacgggguggaggccgacgaccugccgaccuucgaccuguccguguucuucuaccccgccgccgcguucaucgaccgcgcccucuccgacgaccacagcaagauccugguccacugcgugaugggccggucccgcagcgccacccuggugcucgccuaccugaugauccacaaggacaugacccuggucgacgccauccagcaggucgcgaagaaccggugcgugcuccccaaccgcggguuccugaagcagcugcgggagcucgacaagcagcuggugcagcagcgccggcgcucccagcggcaggacggcgaggaggaggacgggcgcgagcuguga

SEQ ID NO: 29417 - RNA, 1482 nt, Artificial Sequence
  derived and/or modified sequence opt1 from DUS2__Homo_sapiens__NP_001258691
augauccugaacagccucucccugugcuaccacaacaagcugauccucgcccccauggugcgcgucggcacccugccgaugcggcugcucgcccuggacuacggggcggacaucguguacugcgaggagcugaucgaccucaagaugauccagugcaagcgcguggucaacgaggugcugagcaccguggacuucgucgcccccgacgaccgggugguguuccgcacgugcgagcgggagcagaaccgcgucguguuccagaugggcaccuccgacgccgagcgggcccuggccguggcgcgccucgucgagaacgacguggccgggaucgacgugaacaugggcugccccaagcaguacagcaccaagggcgggaugggcgccgcccugcuguccgaccccgacaagaucgagaagauccucagcacccuggucaaggggacgcggcgcccggugaccugcaagauccggauccugcccucccucgaggacacccugagccuggugaagcgcaucgagcggaccggcaucgcggccaucgccguccacgggcgcaagcgggaggagcgcccccagcaccccguguccugcgaggugaucaaggccaucgccgacacgcucagcaucccggucaucgcgaacggcgggucccacgaccacauccagcaguacagcgacaucgaggacuuccggcaggccaccgccgccuccagcgugaugguggcccgcgcggccauguggaaccccuccaucuuccugaaggagggccugcggccccucgaggaggucaugcagaaguacauccgcuacgccgugcaguacgacaaccacuacaccaacaccaaguacugccugugccagaugcugcgggagcagcucgagagcccccagggccgccugcugcacgccgcccaguccagccgcgagaucugcgaggcguucgggcucggcgccuucuacgaggagacgacccaggagcuggacgcccagcaggcccggcuguccgccaagaccagcgagcagaccggggagccggcggaggacacgagcggcgucaucaagauggccgugaaguucgaccgccgggccuaccccgcccagaucacccccaagaugugccuccuggaguggugccgccgggagaagcuggcgcagcccguguacgagaccguccagcgcccgcucgaccggcuguucuccagcaucgugaccguggccgagcagaaguaccaguccacgcugugggacaagagcaagaagcucgccgagcaggccgccgcgaucgucugccugcgcucccagggccugcccgaggggcggcucggcgaggagagccccucccugcacaagcgcaagcgggaggcccccgaccaggaccccgggggcccgcgcgcccaggagcuggcccagcccggggaccucugcaagaagcccuucguggcccugggcagcggcgaggaguccccgcuggaggggugguga

SEQ ID NO: 29418 - RNA, 1449 nt, Artificial Sequence
  derived and/or modified sequence opt1 from DUSP10__Homo_sapiens__NP_009138
augcccccgagcccccuggacgaccgcguggucguggcccucucccggcccgugcgcccccaggaccugaaccugugccucgacagcuccuaccugggcagcgccaacccgggguccaacagccacccgcccgucaucgcgaccaccguggugucccugaaggccgccaaccucacguacaugcccagcuccagcggcuccgcccggagccugaacugcgggugcuccagcgccuccugcugcaccgucgcgaccuacgacaaggacaaccaggcccagacccaggccaucgccgcgggcacgaccaccaccgccaucgggacgagcacgaccugccccgccaaccagauggugaacaacaacgagaacaccggcucccugagccccuccagcggcguggggagccccgucuccggcacccccaagcagcucgccagcaucaagaucaucuacccgaacgaccuggccaagaagaugaccaagugcuccaagagccaccuccccucccaggggcccgugaucaucgacugccgccccuucauggaguacaacaagagccacauccagggcgcggugcacaucaacugcgccgacaagaucucccggcgccggcugcagcaggggaagaucaccguccuggaccugaucagcugccgcgagggcaaggacuccuucaagcggaucuucagcaaggagaucaucguguacgacgagaacaccaacgagccgucccgcgugaugcccagccagccccuccacaucguccuggagucccugaagcgggagggcaaggagccccucgugcugaagggcgggcugagcuccuucaagcagaaccacgagaaccucugcgacaacagccugcagcugcaggagugccgcgaggucgggggcggcgccuccgccgccagcucccuccugccgcagcccauccccacgacccccgacaucgagaacgcggagcugaccccgauccuccccuuccuguuccuggggaacgagcaggacgcccaggaccucgacaccaugcagcggcugaacaucggcuacgugaucaacgugacgacccaccucccccuguaccacuacgagaaggggcuguucaacuacaagcgccugcccgccaccgacagcaacaagcagaaccuccggcaguacuucgaggaggccuucgaguucaucgaggaggcccaccagugcggcaaggggcugcugauccacugccaggcgggcgugagccgcuccgccaccaucgucaucgccuaccucaugaagcacacgcggaugaccaugaccgacgccuacaaguucgugaagggcaagcgcccgaucaucagccccaaccugaacuucauggggcagcugcucgaguucgaggaggaccugaacaacggcgugacgccccggauccugaccccgaagcucaugggggucgagaccguggucuga

SEQ ID NO: 29419 - RNA, 1134 nt, Artificial Sequence
  derived and/or modified sequence opt1 from DUSP11__Homo_sapiens__NP_003575
augcgcaacagcgagacccuggagcggggcguggggggcugccgcgucuucuccugccucgggagcuaccccggcaucgagggggccggccuggcccugcucgcggaccuggcccugggcgggcggcuccugggcacccacaugucccaguggcaccacccgcgcagcggguggggccggcgccgggacuucuccgggcgcagcuccgccaagaagaagggcggcaaccacauccccgagcgguggaaggacuaccugcccguggggcagcgcaugcccggcacgcgguucaucgccuucaaggugccgcuccagaagagcuucgagaagaagcuggcccccgaggagugcuucuccccccuggaccucuucaacaagauccgcgagcagaacgaggagcuggggcugaucaucgaccucaccuacacccagcgguacuacaagcccgaggaccugccggagaccguccccuaccugaagaucuucacggugggccaccaggugcccgacgacgagaccaucuucaaguucaagcacgcggucaacggcuuccucaaggagaacaaggacaacgacaagcugaucggggugcacugcacccacggccugaaccgcaccggguaccucaucugccgguaccugaucgacguggagggcguccgccccgacgacgccaucgagcuguucaaccggugccgcgggcacugccucgagcggcagaacuacaucgaggaccugcagaacggcccgauccgcaagaacuggaacagcuccgugccccggagcuccgacuucgaggacagcgcccaccugaugcagcccgugcacaacaagcccgucaagcagggcccgcgcuacaaccuccaccagauccaggggcacuccgccccccgccacuuccacacgcagacccagagccugcagcaguccgugcggaaguucagcgagaacccccacguguaccagcgccaccaccugcccccgcccggcccccccggggaggacuacucccaccggcgcuacagcuggaacgucaagccgaacgcgagccgggccgcccaggaccgccggcgcugguaccccuacaacuacucccggcucagcuaccccgccugcugggaguggacccaguga

SEQ ID NO: 29420 - RNA, 1023 nt, Artificial Sequence
  derived and/or modified sequence opt1 from DUSP12__Homo_sapiens__NP_009171
augcuggaggcccccggcccgagcgacgggugcgagcucuccaaccccagcgccucccgcgugagcugcgcgggccagaugcuggagguccagcccgggcuguacuucggcggggccgccgccguggccgagcccgaccaccuccgggaggcgggcaucaccgccgugcugaccgucgacuccgaggagccgagcuucaaggccggccccgggguggaggaccuguggcgccucuucgugcccgcccuggacaagcccgagacggaccugcucucccaccuggaccggugcgucgcguucaucggccaggcccgcgccgaggggcgggccgugcuggugcacugccacgccggcgucagccgcuccguggcgaucaucaccgccuuccucaugaagaccgaccagcugccguucgagaaggccuacgagaagcugcagauccucaagcccgaggccaagaugaacgagggguucgaguggcagcugaagcuguaccaggccaugggcuacgagguggacaccagcuccgcgaucuacaagcaguaccggcuccagaaggucacggagaaguaccccgagcugcagaaccugccccaggagcuguucgccguggacccgaccaccgugagccagggccucaaggacgagguccuguacaagugccgcaagugccggcgcucccucuuccggagcuccagcauccuggaccaccgcgagggguccggccccaucgccuucgcccacaagcggaugacccccagcuccaugcugacgaccgggcgccaggcccagugcaccagcuacuucaucgagcccgugcaguggauggagagcgcgcuccugggcgugauggacggccagcugcucugcccgaagugcuccgccaagcuggggagcuucaacugguacggcgagcagugcuccugcgggcgguggaucacccccgccuuccagauccacaagaaccgcgucgacgagaugaagauccugcccgugcucggcagccagacggggaagaucuga

SEQ ID NO: 29421 - RNA, 567 nt, Artificial Sequence
  derived and/or modified sequence opt1 from DUSP13__Homo_sapiens__NP_001007272
auggccgagaccagccugcccgagcucggcggggaggacaaggccaccccgugccccuccauccuggagcuggaggagcuccugcgcgcgggcaagagcuccugcagccggguggacgaggucuggcccaaccuguucaucggggacgccgccacggccaacaaccgcuucgagcucuggaagcugggcaucacccacgugcugaacgccgcgcacaaggggcucuacugccagggcggccccgacuucuacggguccagcguguccuaccugggcgucccggcccacgaccugcccgacuucgacaucagcgccuacuucuccagcgccgcggacuucauccaccgggcccucaacacccccggggccaaggugcuggugcacugcgucgugggcgugucccgcagcgccacccugguccucgccuaccugaugcugcaccagcggcucucccugcgccaggcggugaucacggugcggcagcaccgcugggucuuccccaaccggggguuccugcaccagcucugccgccuggaccagcagcugcggggcgccggccagagcuga

SEQ ID NO: 29422 - RNA, 597 nt, Artificial Sequence
  derived and/or modified sequence opt1 from DUSP14__Homo_sapiens__NP_008957
augagcucccgcggccacagcacccugccccggacccucauggccccgcgcaugaucuccgagggggacaucggcgggaucgcccagaucacgagcucccuguuccugggccgggggagcguggcguccaaccgccaccuccugcaggcccggggcaucacgugcaucgucaacgccaccaucgagauccccaacuucaacuggccccaguucgaguacgugaaggugccccuggccgacaugccgcacgcccccaucggccucuacuucgacaccgucgcggacaagauccacagcgugucccgcaagcacggggccacccuggugcacugcgccgccggcgucagccgguccgcgacccugugcaucgccuaccucaugaaguuccacaacgugugccugcuggaggccuacaacugggugaaggcccgccggcccgucauccgccccaacgugggguucuggcggcagcucaucgacuacgagcgccagcuguucggcaagagcaccgugaagaugguccagaccccguacgggaucgugcccgacguguacgagaaggagucccggcaccugaugcccuacuggggcaucuga

SEQ ID NO: 29423 - RNA, 708 nt, Artificial Sequence
  derived and/or modified sequence opt1 from DUSP15__Homo_sapiens__NP_542178
augggcaacgggaugaccaaggugcugcccggccucuaccuggggaacuucaucgacgccaaggaccuggaccagcucggccgcaacaagaucacccacaucaucagcauccacgaguccccgcagccccugcugcaggacaucacguaccuccggauccccgucgccgacacccccgaggugccgaucaagaagcacuucaaggagugcaucaacuucauccacugcugccgccugaacgggggcaacugccuggugcacugcuucgcgggcaucagccgguccaccaccaucgucacggccuacgugaugaccgugaccgggcucggcuggcgcgacguccuggaggccaucaaggccacccggcccaucgccaaccccaaccccggguuccgccagcagcuggaggaguucggcugggcgagcucccagaagcuccggcgccagcuggaggagcgguucggggagagcccguuccgcgacgaggaggagcugcgggcccuccugccccugugcaagcgcugccggcagggcuccgccacgagcgccuccagcgcgggcccccacuccgccgccagcgaggggaccgugcagcgccucgugccccggaccccgcgcgaggcccaccggccccugccccugcucgcccgcgucaagcagaccuucuccugccugccccggugccugagccgcaagggcgggaaguga

SEQ ID NO: 29424 - RNA, 1554 nt, Artificial Sequence
  derived and/or modified sequence opt1 from DUSP16__Homo_sapiens__XP_005253545
augcugccccucagccugcagaccguguucucccuguacuucugggucaacuggcgccgggccagcacccucuucacgugccugcaggagcugaugcagcagaacggcaucggguacgugcucaacgccuccaacacgugcccgaagcccgacuucauccccgagagccacuuccugcgcgugcccgucaacgacuccuucugcgagaagauccugccguggcucgacaagagcguggacuucaucgagaaggcgaaggccuccaacggcugcgugcugguccacugccuggccgggaucagccgguccgccaccaucgccaucgcguacaucaugaagcgcauggacaugagccucgacgaggccuaccgguucgugaaggagaagcgccccaccaucucccccaacuucaacuuccugggccagcugcucgacuacgagaagaagaucaagaaccagaccggggccagcggccccaaguccaagcugaagcugcuccaccuggagaagccgaacgagcccgugcccgccgucagcgagggcgggcagaaguccgagacgccccugagcccgcccugcgcggacuccgccaccagcgaggccgccggccagcggcccgugcaccccgccuccgugccgagcguccccagcgugcagcccucccuccuggaggacagcccccuggugcaggcgcucuccgggcugcaccugagcgccgaccgccucgaggacuccaacaagcugaagcggagcuucucccuggacaucaagagcgucuccuacagcgccuccauggccgccagccuccacggcuucuccagcuccgaggacgcgcuggaguacuacaagccgagcaccacccuggacgggaccaacaagcucugccaguucucccccgugcaggagcugagcgagcagacccccgagaccucccccgacaaggaggaggccagcaucccgaagaagcugcagacggcccgccccagcgacucccagagcaagcggcuccacuccgugcgcaccagcuccagcggcaccgcccagcggucccugcugagcccccuccaccgcuccggcagcgucgaggacaacuaccacaccuccuuccuguucgggcugagcacgucccagcagcaccucaccaagagcgccggccuggggcugaagggcuggcacuccgacauccucgcgccccagaccagcaccccgucccugacgagcagcugguacuucgccaccgaguccagccacuucuacuccgccagcgccaucuacggcggguccgccagcuacuccgcguacagcugcucccagcugccgaccugcggcgaccagguguacagcgugcggcgccggcagaagcccuccgaccgcgccgacagccggcgcuccuggcacgaggagagccccuucgagaagcaguucaagcggcgcuccugccagauggaguucggggagagcaucauguccgagaaccgcagccgggaggagcucggcaaggucgggucccagagcagcuucuccggcagcauggagaucaucgagguguccuga

SEQ ID NO: 29425 - RNA, 567 nt, Artificial Sequence
  derived and/or modified sequence opt1 from DUSP18__Homo_sapiens__NP_001291723
augaccgcccccagcugcgccuucccggugcaguuccgccagcccuccgucagcggccugucccagaucaccaagagccucuacaucuccaacgggguggcggccaacaacaagcugaugcugagcuccaaccagaucacgauggugaucaacgucagcguggagguggucaacacccucuacgaggacauccaguacaugcagguccccguggccgacucccccaacagccggcugugcgacuucuucgacccgaucgccgaccacauccacuccguggagaugaagcagggccgcacccugcuccacugcgccgcgggggugagccgguccgccgcccugugccuggccuaccucaugaaguaccacgcgaugagccugcuggacgcccacaccuggacgaaguccugccgccccaucauccggcccaacagcggcuucugggagcagcucauccacuacgaguuccagcuguucgggaagaacaccgugcacauggucuccagccccgugggcaugaucccggacaucuacgagaaggaggugcgccugaugaucccccucuga

SEQ ID NO: 29426 - RNA, 1104 nt, Artificial Sequence
  derived and/or modified sequence opt1 from DUSP1__Homo_sapiens__NP_004408
auggugauggaggucggcacccuggacgccgggggccuccgcgcccugcugggggagcgggcggcccagugccuccugcuggacugccgcagcuucuucgccuucaacgccggccacaucgccggguccgugaacgugcgguucagcaccaucguccgccggcgcgcgaagggcgccaugggccucgagcacaucgugcccaacgccgagcugcgggggcgccugcucgccggcgcguaccacgccgugguccugcuggacgagcgguccgccgcccucgacggggccaagcgcgacggcacgcuggcgcuggccgccggggcccucugccgggaggcccgcgcggcccagguguucuuccugaagggcggcuacgaggccuucagcgccuccugcccggagcugugcagcaagcaguccacccccauggggcucagccugccccuguccaccagcgugcccgacuccgccgagagcggcugcuccagcugcuccaccccgcucuacgaccagggcgggcccgucgagauccugcccuuccuguaccucggcagcgcguaccacgccucccggaaggacaugcuggacgcccuggggaucacggcccucaucaacgugagcgccaacugccccaaccacuucgagggccacuaccaguacaaguccaucccgguggaggacaaccacaaggcggacaucagcagcugguucaacgaggccaucgacuucaucgacuccaucaagaacgccgggggccgcgucuucgugcacugccaggccgggaucagccgguccgcgaccaucugccuggccuaccugaugcgcaccaaccgggugaagcucgacgaggccuucgaguucgucaagcagcgccggagcaucaucucccccaacuucagcuucaugggccagcugcugcaguucgagucccaggugcucgcgccccacugcagcgccgaggccggcucccccgccauggccgugcuggaccgcgggaccagcacgaccaccgucuucaacuucccgguguccauccccgugcacagcaccaacuccgcccugagcuaccuccagucccccaucacgaccagccccuccugcuga

SEQ ID NO: 29427 - RNA, 573 nt, Artificial Sequence
  derived and/or modified sequence opt1 from DUSP21__Homo_sapiens__NP_071359
augaccgccagcgccuccagcuucuccagcucccagggcgugcagcagcccagcaucuacuccuucagccagaucacccgcucccuguuccucagcaacggggucgcggccaacgacaagcugcugcucuccagcaaccggaucacggccaucgugaacgccuccguggaggucgugaacguguucuucgagggcauccaguacaucaaggucccggugaccgacgcccgcgacagccggcuguacgacuucuucgaccccaucgcggaccugauccacaccaucgacaugcgccaggggcggacccuccugcacugcauggccggcgugucccgcagcgccucccugugccucgccuaccugaugaaguaccacagcaugucccugcucgacgcgcacacguggaccaagagccggcgccccaucauccggcccaacaacggguucugggagcagcugaucaacuacgaguucaagcuguucaacaacaacaccguccgcaugaucaacagcccggugggcaacauccccgacaucuacgagaaggaccuccggaugaugaucuccauguga

SEQ ID NO: 29428 - RNA, 618 nt, Artificial Sequence
  derived and/or modified sequence opt1 from DUSP22__Homo_sapiens__NP_001273484
augggcaacgggaugaacaagauccugcccggccucuacaucgggaacuucaaggacgcccgcgacgccgagcagcugagcaagaacaaggugacccacauccuguccguccacgacagcgcgcggccgaugcucgagggcgugaaguaccugugcauccccgccgccgacucccccagccagaaccugacccgccacuucaaggaguccaucaaguucauccacgagugccggcuccgcggggagagcugccuggugcacugccuggccggcgucucccggagcgugacgcucgugaucgccuacaucaugaccgucaccgacuucggcugggaggacgcgcugcacaccgugcgcgccgggcgguccugcgccaaccccaacgugggcuuccagcgccagcugcaggaguucgagaagcacgagguccaccaguaccggcaguggcucaaggaggaguacggggagagcccgcugcaggacgccgaggaggcgaagaacauccugggcaaguacaaggagcaggggcgcacggagccccagcccggcgcccggcgcugguccagcuuccccgcccucgccccgcugaccuacgacaacuacaccaccgagacguga

SEQ ID NO: 29429 - RNA, 453 nt, Artificial Sequence
  derived and/or modified sequence opt1 from DUSP23__Homo_sapiens__NP_060293
augggcgugcagcccccgaacuucagcuggguccugcccgggcgccucgccggccuggcccugccccggcuccccgcgcacuaccaguuccugcuggaccucggggugcgccaccuggugucccugaccgagcggggcccgccccacagcgacuccugccccgggcucacccugcaccgccugcggauccccgacuucugcccgcccgcccccgaccagaucgaccgcuucguccagaucguggacgaggccaacgcccggggcgaggccgugggcguccacugcgcgcucggguucggccgcacggggaccaugcuggccugcuaccuggugaaggagcggggccucgccgccggggacgcgaucgccgagauccgccggcugcgccccggcagcaucgagaccuacgagcaggagaaggccguguuccaguucuaccagcggaccaaguga

SEQ ID NO: 29430 - RNA, 3477 nt, Artificial Sequence
  derived and/or modified sequence opt1 from DUSP27__Homo_sapiens__XP_005245660
auggccacccgcaaggacaccgaggaggagcaggucgugcccagcgaggaggacgaggccaacgugcgggcggugcaggcccacuaccugcgcuccccgagccccucccaguacagcauggucuccgacgccgagacggagagcaucuucauggagcccauccaccucuccagcgccaucgccgcgaagcagaucaucaacgaggagcugaagcccccgggcgugcgggccgacgccgagugccccgggaugcuggaguccgccgagcagcuccugguggaggaccuguacaaccgcguccgggagaagauggacgacaccagccucuacaacacccccugcgugcuggaccugcagcgcgcgcucgugcaggaccggcaggaggcccccuggaacgaggucgacgagguguggccgaacguguucaucgccgagaaguccgucgccgugaacaagggccgccugaagcggcuggggaucacccacauccucaacgccgcgcacggcacggggguguacaccggccccgaguucuacaccggccuggagauccaguaccugggggucgagguggacgacuuccccgagguggacaucagccagcacuuccgcaaggccuccgaguuccucgacgaggcccugcugaccuaccggggcaagguccucgugagcuccgagauggggaucagccgcuccgccgugcuggucguggccuaccugaugaucuuccacaacauggcgauccucgaggcccugaugacggugcggaagaagcgcgccaucuaccccaacgagggcuuccugaagcagcuccgggagcugaacgagaagcugauggaggagcgcgaggaggacuacgggcgggagggcggcagcgccgaggccgaggagggggagggcaccggguccaugcucggcgcgcgcguccacgcccugaccguggaggaggaggacgacagcgccagccaccuguccggcagcucccucgggaaggccacccaggccagcaagccgcugacgcugaucgacgaggaggaggaggagaagcucuacgagcaguggaagaagggccaggggcugcuguccgacaaggucccccaggacggcgggggcuggcggagcgcguccagcggccagggcggggaggagcucgaggacgaggacguggagcgcaucauccaggaguggcagucccggaacgagcgcuaccaggccgagggguaccgccgguggggccgcgaggaggagaaggaggaggagagcgacgccggguccagcgugggccggcgccggcgcacccuguccgagagcuccgccugggagagcgucuccagccacgacaucugggugcugaagcagcagcucgagcugaaccggcccgaccacggccgccggcgccgggcggacuccaugagcagcgaguccaccugggacgccuggaacgagcgccugcucgagaucgagaaggaggccagccggcgcuaccacgccaaguccaagcgggaggaggccgcggaccgcagcuccgaggccgggagccgggugcgcgaggacgacgaggacuccgucggcagcgaggccuccagcuucuacaacuucugcucccggaacaaggacaagcugaccgcccuggagcgcuggaagaucaagcgcauccaguucggguuccacaagaaggaccucggcgccggggacagcuccggcgagcccggcgcggaggaggccgugggggagaagaacccgagcgacgugucccugacggccuaccaggccuggaagcugaagcaccagaagaaggucggcagcgagaacaaggaggaggugguggagcucuccaagggggaggacagcgcccuggcgaagaagcggcagcgccggcuggagcugcucgagcgcagccggcagacccuggaggagucccagagcauggccuccugggaggccgacagcuccaccgccagcggcuccaucccccugagcgcguucugguccgccgaccccagcgucuccgccgacggcgacaccacgagcgugcucuccacccagagccaccgcucccaccugagccaggccgccuccaacaucgcggggugcagcaccuccaaccccaccacgccgcugcccaaccuccccgugggccccggggacaccaucagcaucgccagcauccagaacuggaucgccaacgucguguccgagacccuggcccagaagcagaacgagaugcugcuccugagccgguccccgagcguggccuccaugaaggcgguccccgccgccagcugccugggcgacgaccagguguccaugcucagcgggcacuccagcuccagccugggcggcugccugcucccccagucccaggcccgccccagcuccgacaugcagagcgugcuguccugcaacaccacgcugagcuccccggccgagagcugccggagcaagguccgcgggaccuccaagcccaucuucagccucuucgcggacaacguggaccugaaggagcugggccggaaggagaaggagaugcagauggagcuccgcgagaagauguccgaguacaagauggagaagcuggccagcgacaacaagcgguccagccuguucaagaagaagaaggugaaggaggacgaggacgacggggucggcgacggggacgaggacaccgacuccgccaucggcagcuuccgcuacuccagccgguccaacagccagaagcccgagaccgacacgugcuccagccucgccgugugcgaccacuacgcguccggcagccgcguggggaaggagauggacuccagcaucaacaaguggcuguccggccugcggaccgaggagaagccgcccuuccagagcgacuggagcggguccagccgcggcaaguacacccgguccagccuccugcgcgagaccgaguccaagagcuccagcuacaaguucuccaagagccaguccgaggagcaggacacgagcuccuaccacgaggccaacgggaacagcguccgguccaccagccgcuucuccagcuccagcacccgcgagggccgggagaugcacaaguucagccgcuccaccuacaacgagaccagcuccagccgggaggagucccccgagcccuacuucuuccgccggacgccggagagcuccgagcgcgaggagagccccgagccccagcggcccaacugggcccgcucccgggacugggaggacguggaggagagcuccaagagcgacuucuccgaguucggcgccaagcgcaaguucacccagagcuucaugcgguccgaggaggagggggagaaggagcgcaccgagaaccgggaggagggccgcuucgccagcgggcggcgcucccaguaccggcgcagcaccgaccgggaggaggaggaggagauggacgacgaggcgaucaucgccgccuggcgccgccggcaggaggagacgcgcaccaagcugcagaagcggcgcgaggacuga

SEQ ID NO: 29431 - RNA, 531 nt, Artificial Sequence
  derived and/or modified sequence opt1 from DUSP28__Homo_sapiens__NP_001028747
augggccccgccgaggccgggcgccggggcgcggccagcccggugcccccgccccugguccgcguggcccccucccucuuccuggggagcgcccgggccgcgggcgccgaggagcagcuggcccgcgccggggugacccucugcgucaacgugucccggcagcagcccggcccccgcgcgcccggcguggccgagcugcgggucccgguguucgacgaccccgccgaggaccugcucgcccaccuggagccgaccugcgccgcgauggaggccgccgugcgcgccgggggcgccugccuggucuacugcaagaacgggcggagccgcuccgcggccgugugcacggccuaccucaugcggcaccgcggccugagccuggccaaggccuuccagauggugaaguccgcgcggcccgucgccgagcccaaccccggguucuggagccagcuccagaaguacgaggaggcccugcaggcccaguccugccugcagggcgagccgcccgcccucggccuggggcccgaggcguga

SEQ ID NO: 29432 - RNA, 945 nt, Artificial Sequence
  derived and/or modified sequence opt1 from DUSP2__Homo_sapiens__NP_004409
augggccuggaggccgcccgcgagcucgagugcgcggcccuggggacccugcuccgggacccccgcgaggccgagcggacccugcugcucgacugccgcccguuccuggccuucugccggcgccacgugcgggccgcgcgccccguccccuggaacgcccugcuccggcgccgggcccgcgggcccccggccgcggugcuggccugccugcuccccgaccgggcccugcgcacgcggcuggugcgcggcgagcucgcccgggccgucgugcuggacgagggcagcgcguccguggccgagcugcgccccgacagccccgcccacguccuccuggccgcccugcuccacgagacccgggcggggccgaccgccguguacuuccugcgcggcggcuucgacggguuccagggcugcugccccgaccugugcuccgaggcccccgcccccgcccucccgcccaccggggacaagacgagccgguccgacagccgcgcgcccguguacgaccagggcgggcccgucgagauccugccguaccuguuccucggcuccugcagccacuccagcgaccugcagggccugcaggccugcgggaucaccgccgugcucaacguguccgccagcugccccaaccacuucgagggccuguuccgcuacaaguccauccccgucgaggacaaccagaugguggagaucagcgccugguuccaggaggcgaucggguucaucgacugggugaagaacuccggcggccggguccuggugcacugccaggccgggaucagccgcuccgccaccaucugccucgccuaccugaugcagagccggcgcgugcggcuggacgaggcguucgacuucgucaagcagcgccggggcgugaucucccccaacuucagcuucauggggcagcuccugcaguucgagacccaggugcugugccacuga

SEQ ID NO: 29433 - RNA, 558 nt, Artificial Sequence
  derived and/or modified sequence opt1 from DUSP3__Homo_sapiens__NP_004081
augagcggcuccuucgagcugagcgugcaggaccucaacgaccugcuguccgacgggagcggcugcuacucccuccccagccagccgugcaacgaggucacgccccgcaucuacguggggaacgccuccguggcccaggacauccccaagcugcagaagcugggcaucacccacguccucaacgcggccgaggggcggagcuucaugcacgugaacaccaacgccaacuucuacaaggacuccggcaucaccuaccugggcaucaaggccaacgacacccaggaguucaaccugagcgccuacuucgagcgcgcggccgacuucaucgaccaggcccucgcccagaagaacgggcgggugcugguccacugccgcgagggcuacucccggagccccacccuggugaucgcguaccucaugaugcgccagaagauggacgugaaguccgcccugagcaucguccggcagaaccgcgagaucgggccgaacgacggcuuccuggcccagcucugccagcugaacgaccggcuggccaaggaggggaagcucaagcccuga

SEQ ID NO: 29434 - RNA, 1185 nt, Artificial Sequence
  derived and/or modified sequence opt1 from DUSP4__Homo_sapiens__NP_001385
auggugaccauggaggagcugcgcgagauggacugcagcguccucaagcggcugaugaaccgcgacgagaacggcgggggcgccgggggcuccgggagccacggcacccugggccuccccuccgggggcaagugccugcugcucgacugccggccguuccuggcccacagcgcgggguacauccugggcuccgugaacgugcgcugcaacacgaucguccggcgccgggccaaggggagcgugucccucgagcagauccugcccgccgaggaggaggugcgcgcccggcugcgcagcggccucuacuccgccgucaucguguacgacgagcggagcccccgcgcggagucccugcgggaggacagcaccgugucccuggucgugcaggcccuccgccggaacgccgagcgcaccgacaucugccugcugaagggcggguacgagcgguucagcuccgaguaccccgaguucugcagcaagaccaaggcccucgcggccaucccgccgcccgugccgcccuccgccacggagccccuggaccugggcugcagcuccugcgggacgccccuccacgaccagggcggccccgucgagauccugcccuuccuguaccucgggagcgccuaccacgccgcgcgccgggacaugcuggacgcccugggcaucaccgcccuccugaacgugagcuccgacugccccaaccacuucgaggggcacuaccaguacaagugcauccccguggaggacaaccacaaggccgacaucagcuccugguucauggaggccaucgaguacaucgacgcggucaaggacugccgcggccgggugcuggugcacugccaggccgggaucagccgcuccgccaccaucugccucgccuaccugaugaugaagaagcgcguccggcuggaggaggccuucgaguucgugaagcagcgccggagcaucaucucccccaacuucagcuucaugggccagcuccugcaguucgagucccaggugcuggcgaccagcugcgccgccgaggccgccuccccgagcggcccccuccgcgagcgggggaagacccccgcgacccccaccucccaguucgucuucagcuucccgguguccgugggcguccacagcgcccccuccagccugcccuaccugcacucccccaucacgaccagcccgagcugcuga

SEQ ID NO: 29435 - RNA, 1155 nt, Artificial Sequence
  derived and/or modified sequence opt1 from DUSP5__Homo_sapiens__NP_004410
augaaggugaccagccuggacggccgccagcuccggaagaugcugcgcaaggaggccgccgcgcggugcgucgugcuggacugccgccccuaccucgccuucgccgccuccaacgugcgggggagccugaacgucaaccugaacuccguggugcuccgccgggcccgcggcggggcggucagcgcccgguacgugcugccggacgaggccgcccgcgcgcggcugcuccaggagggcgggggcggcguggccgccgucguggugcuggaccaggggucccgccacuggcagaagcugcgggaggagagcgccgcccgcgucgugcucaccucccugcuggcgugccuccccgccggcccccggguguacuuccugaagggcggguacgagacguucuacagcgaguaccccgagugcugcgucgacgugaagccgaucucccaggagaagaucgagagcgagcgcgcccugaucucccagugcgggaagcccguggucaacgugagcuaccggcccgccuacgaccagggcggccccguggagauccucccguuccuguaccugggguccgccuaccacgcgagcaagugcgaguuccucgccaaccugcacaucaccgcccugcucaacgucucccgccggaccagcgaggccugcgccacccaccuccacuacaaguggauccccguggaggacucccacacggcggacaucagcucccacuuccaggaggccaucgacuucaucgacugcgugcgcgagaagggcgggaagguccuggugcacugcgaggccggcaucagccggagccccaccaucugcauggccuaccugaugaagaccaagcaguuccgccugaaggaggccuucgacuacaucaagcagcgccgguccauggucagccccaacuucggcuucauggggcagcugcuccaguacgaguccgagauccugccgagcacccccaacccccagcccccguccugccagggcgaggcggccgggagcucccugaucggccaccuccagacgcugagccccgacaugcagggggccuacugcaccuuccccgccuccgugcuggcgcccgugccgacccacagcaccgucuccgagcucagccgcucccccguggccacggccaccagcugcuga

SEQ ID NO: 29436 - RNA, 1146 nt, Artificial Sequence
  derived and/or modified sequence opt1 from DUSP6__Homo_sapiens__NP_001937
augaucgacacccugcgccccgugccguucgccagcgagauggccaucuccaagaccgucgcguggcucaacgagcagcuggagcugggcaacgagcggcuccugcugauggacugccgcccccaggagcucuacgagagcucccacaucgagagcgccaucaacguggccauccccgggaucaugcugcggcgccugcagaagggcaaccuccccgugcgggcccuguucacgcgcggggaggaccgggaccgcuucacccggcgcugcggcaccgacaccgucgugcuguacgacgaguccagcuccgacuggaacgagaacaccgggggcgagagcgugcucggccugcugcucaagaagcugaaggacgaggggugccgggccuucuaccuggagggcggguucuccaaguuccaggcggaguucagccuccacugcgagacgaaccuggacggcuccugcagcuccagcuccccgccccugcccguccucgggcugggcggccugcgcaucagcuccgacagcuccagcgacaucgagagcgaccucgaccgggaccccaacuccgccaccgacagcgacggguccccgcugagcaacucccagcccagcuuccccguggagauccugcccuuccucuaccugggcugcgccaaggacuccaccaaccuggacgugcucgaggaguucgggaucaaguacauccugaacgucacgccgaaccugcccaaccucuucgagaacgccggcgaguucaaguacaagcagauccccaucagcgaccacuggucccagaaccugagccaguucuuccccgaggcgaucuccuucaucgacgaggcccgcggcaagaacugcggggugcuggugcacugccucgccggcaucagccgguccgucaccgugaccguggccuaccugaugcagaagcugaaccucagcaugaacgacgccuacgacaucgucaagaugaagaaguccaacaucagcccgaacuucaacuucauggggcagcugcuggacuucgagcgcacccucggccuguccagccccugcgacaaccgggugcccgcgcagcagcuguacuucacgacccccuccaaccagaacguguaccaggucgacagccuccagagcaccuga

SEQ ID NO: 29437 - RNA, 1260 nt, Artificial Sequence
  derived and/or modified sequence opt1 from DUSP7__Homo_sapiens__NP_001938
augaagaaccagcugcgcgggcccccggcccgggcccacaugagcaccuccggcgcggccgccgccggcgggacccgcgccggcagcgagcccggggcgggcuccggcagcggggccggcacgggggccggcgccgcgaccggggccggcgccaugcccugcaaguccgccgaguggcuccaggaggagcuggaggcccggggcggggcgagccugcuccugcuggacugccgcccccacgagcuguucgaguccagccacaucgagaccgccaucaaccucgccaucccgggccugaugcuccggcgccugcggaaggggaaccugcccauccgcuccaucauccccaaccacgccgacaaggagcgguucgccacccgcugcaaggcggccacggugcuccuguacgacgaggccaccgccgaguggcagcccgagccgggcgcccccgcgagcguccugggccuccugcugcagaagcuccgggacgacgggugccaggccuacuaccugcagggcggguucaacaaguuccagaccgaguacuccgagcacugcgagaccaacguggacagcuccagcucccccagcuccagcccgcccacguccgugcugggccucgggggccugcgcaucagcagcgacugcuccgacggcgagagcgaccgggagcugcccuccagcgccaccgaguccgacgggagccccguccccuccagccagccggccuuccccgugcagauccuccccuaccuguaccugggcugcgccaaggacuccaccaaccucgacgugcuggggaaguacggcaucaaguacauccugaacgucacccccaaccucccgaacgcguucgagcacgggggcgaguucacguacaagcagauccccaucagcgaccacuggucccagaaccugagccaguucuuccccgaggccaucuccuucaucgacgaggcccgcagcaagaagugcggcgugcuggugcacugccucgccgggaucucccggagcgucaccgugaccguggcguaccugaugcagaagaugaaccugucccucaacgacgccuacgacuucgucaagcgcaagaaguccaacaucagccccaacuucaacuucaugggccagcugcuggacuucgagcggacccucgggcugagcagcccgugcgacaaccacgccuccagcgagcagcuguacuucuccacgcccaccaaccacaaccucuucccccugaacacccuggagagcaccuga

SEQ ID NO: 29438 - RNA, 1878 nt, Artificial Sequence
  derived and/or modified sequence opt1 from DUSP8__Homo_sapiens__XP_011518235
auggccggcgaccgccugccccggaaggugauggacgccaagaagcucgcgagccugcugcgcgggggcccggggggcccccucgucaucgacucccggagcuucguggaguacaacuccuggcacgugcugagcuccgucaacaucugcugcagcaagcuggugaagcgccggcuccagcaggggaaggugaccaucgccgagcugauccagcccgccgcccgcucccaggucgaggccaccgagccccaggacgugguggucuacgaccagagcacgcgggacgcguccgugcuggccgccgacagcuuccucuccauccugcugagcaagcucgacggcugcuucgacuccguggccauccugaccggcggguucgcgaccuucagcuccugcuucccgggccugugcgaggggaagcccgccgcccuccugcccaugagccugucccagcccugccucccgguccccagcgugggccugacccgcauccugccccaccucuaccuggggucccagaaggacgugcugaacaaggaccucaugacgcagaacggcaucagcuacguccugaacgccagcaacuccugccccaagccggacuucaucugcgagagccgguucaugcgcgugcccaucaacgacaacuacugcgagaagcugcuccccuggcuggacaaguccaucgaguucaucgacaaggccaagcugagcuccugccaggugaucguccacugccucgcgggcaucagccgguccgccaccaucgccaucgccuacaucaugaagaccauggggaugagcuccgacgacgccuaccgcuucgugaaggaccggcgccccagcaucuccccgaacuucaacuuccugggccagcugcucgaguacgagcggagccugaagcugcucgcggcccugcagggggaccccggcacccccuccggcacgcccgagccgccccccagccccgccgccggggccccgcugccccgccucccccccccgaccuccgagagcgcggccaccggcaacgccgccgcccgggaggggggccuguccgcggggggcgagccccccgccccgcccaccccccccgccacgagcgcccugcagcagggccuccgcgggcugcaccuguccagcgaccggcuccaggacaccaaccgccugaagcggagcuucucccuggacaucaagagcgcguacgccccgucccgccgccccgacggccccgggcccccggaccccggcgaggcccccaagcucugcaagcuggacagccccuccggggccgcccugggccugagcuccccgagccccgacucccccgacgcggcccccgaggcccggccgcgcccccggcgccggccccgccccccggccggcagccccgcccggucccccgcgcacagccucgggcugaacuucggcgacgccgcccgccagaccccccggcacgggcuguccgcccucagcgccccgggccugcccgggcccggccagccggcgggccccggggccugggcccccccccuggacuccccgggcacccccagccccgacgggcccuggugcuucuccccggagggcgcccagggcgcggggggcgugcucuucgcccccuucgggcgcgccggcgcccccgggcccggcggcgggagcgaccugcggcgccgggaggccgcgcgcgccgagccgcgggacgcccgcacgggcuggcccgaggagcccgcccccgagacccaguucaagcggcgcagcugccagauggaguucgaggaggggauggucgagggccgggcccgcggggaggagcuggcggcccucggcaagcaggccuccuucagcggcuccguggaggugaucgaggucagcuga

SEQ ID NO: 29439 - RNA, 1248 nt, Artificial Sequence
  derived and/or modified sequence opt1 from DUSP9__Homo_sapiens__XP_011529425
auggaggccgcccaggugggccccaaggggcgccagcugccgggcaagcacgucguggcgcccgugguccagcggguggggagccgcucccccauggagggccucgggcggagcugccuguggcugcgccgggagcucagcccgccccgcccccggcugcugcuccuggacugccgcucccgggagcuguacgaguccgcccgcaucggcggcgcccucagcguggcccugcccgcccugcuccugcggcgccugcggcgcgggucccucagcguccgggcgcugcugcccggcccgccccuccagccgccgccgcccgcccccgugcugcuguacgaccagggcggcgggcgccggcgccgcggggaggccgaggccgaggcggaggagugggaggccgaguccgugcucggcacccugcugcagaagcuccgggaggagggguaccuggccuacuaccugcagggcggguucagccgguuccaggccgagugcccccaccucugcgagaccucccuggccggccgcgcgggcagcuccauggcccccguccccgggcccgugcccguggucggccuggggagccucugccugggcuccgacugcagcgacgccgaguccgaggccgaccgcgacagcauguccugcgggcuggacagcgagggcgccacgcccccgcccgugggccuccgggcgagcuuccccgugcagauccugcccaaccuguaccucggguccgcccgcgacagcgccaaccuggagucccuggccaagcucggcauccgguacauccugaacgucacccccaaccugcccaacuucuucgagaagaacggggacuuccacuacaagcagauccccaucagcgaccacuggucccagaaccucagccgcuucuucccggaggccaucgaguucaucgacgaggcgcugucccagaacugcggcgugcuggugcacugccucgccggggucagccgguccgugaccgugaccgucgccuaccugaugcagaagcugcaccucagccugaacgacgccuacgaccuggugaagcgcaagaaguccaacaucagccccaacuucaacuucaugggccagcugcucgacuucgagcggucccugcgccuggaggagcggcacagccaggagcagggcuccgggggccaggccagcgcggccuccaacccgcccagcuucuucacgacccccaccuccgacggggccuucgagcucgcccccaccuga

SEQ ID NO: 29440 - RNA, 759 nt, Artificial Sequence
  derived and/or modified sequence opt1 from DUT__Homo_sapiens__NP_001020419
augacgccccugugcccgcgccccgcccucugcuaccacuuccugaccagccugcuccgguccgccaugcagaacgcgcgcggcgcccggcagcgcgccgaggccgccgugcugagcgggcccgggcccccgcugggccgggcggcccagcacggcaucccccgcccccucuccagcgccgggcggcugucccagggcugccgcggcgccagcaccgucggggcggccggcuggaagggggagcugcccaaggccggcggguccccggcccccggccccgagacccccgccaucagcccguccaagcgggcgcgccccgccgaggugggcgggaugcagcuccgguucgcccgccugagcgagcacgccaccgcccccacccggggcuccgcgcgcgccgccggguacgaccuguacagcgccuacgacuacacgaucccgcccauggagaaggccguggucaagaccgacauccagaucgcgcuccccuccggcugcuacggccggguggcgccccgcagcgggcuggccgccaagcacuucaucgacgugggcgccggggucaucgacgaggacuaccggggcaacgugggggugguccuguucaacuucggcaaggagaaguucgaggugaagaagggcgaccgcaucgcccagcucaucugcgagcggaucuucuaccccgagaucgaggaggugcaggcccuggacgacaccgagcgcggguccggcggguucggcagcaccgggaagaacuga

SEQ ID NO: 29441 - RNA, 483 nt, Artificial Sequence
  derived and/or modified sequence opt1 from DUX4__Homo_sapiens__XP_011529816
auggcgcugcccaccccgagcgacuccacccuccccgccgaggcgcgcggccgggggcgccggcgccggcugguguggacgcccagccaguccgaggcccugcgcgccugcuucgagcggaaccccuacccgggcaucgccacccgcgagcggcucgcccaggcgaucgggauccccgagccccgcguccagaucugguuccagaacgagcggagccgccagcugcggcagcaccgccgggagucccgccccuggccgggccggcgcgggccgcccgagggccggcgcaagcggaccgccgugaccggcagccagacggcccugcuccugcgcgccuucgagaaggaccgcuuccccgggaucgcggcccgggaggagcuggcccgcgagaccggccuccccgagucccggauccagaucugguuccagaaccgccgggcccgccaccccgggcagggcgggcgggcccccgcccagguguga

SEQ ID NO: 29442 - RNA, 2211 nt, Artificial Sequence
  derived and/or modified sequence opt1 from DVL2__Homo_sapiens__NP_004413
auggccggcagcuccaccgggggcgggggcgugggggagaccaaggucaucuaccaccuggacgaggaggagacgcccuaccucgugaagauccccgugcccgccgagcgcaucacccugggcgacuucaagagcguccugcagcggcccgcgggcgccaaguacuucuucaaguccauggaccaggacuucgggguggugaaggaggagaucagcgacgacaacgcccgccuccccugcuucaacggccgggucguguccuggcuggugagcuccgacaacccccagcccgagauggccccgcccguccacgagccccgcgccgagcuggcgccgcccgcgccgccccucccgccccugccgcccgagcggaccagcgggaucggcgacucccgcccgcccagcuuccaccccaacguguccagcucccacgagaaccuggagcccgagaccgagacggagagcguggucucccuccggcgcgagcggccccgccggcgcgacagcuccgagcacggggccggcggccaccggaccgggggccccagccgccuggagcggcaccuggccggguacgaguccagcagcacccucaugaccuccgagcuggagagcacgucccugggcgacagcgacgaggaggacaccaugucccgcuucagcuccagcaccgagcaguccagcgccucccggcuccugaagcgccaccggcgccggcgcaagcagcgcccgccccggcuggagcgcaccagcuccuucagcuccgugacggacagcaccaugucccucaacaucaucaccgugacccugaacauggagaaguacaacuuccugggcaucagcaucgucgggcaguccaacgagcggggcgacgggggcaucuacaucgggagcaucaugaagggcggcgccguggccgccgacgggcgcaucgagcccggcgacaugcuccuccaggugaacgacaugaacuucgagaacaugagcaacgacgacgccguccgggugcugcgcgacaucgugcacaagcccgggcccaucguccugacgguggcgaagugcugggaccccagcccccaggccuacuucacccugccccggaacgagcccauccagcccaucgaccccgccgccugggugucccacuccgccgcgcugaccggcaccuuccccgccuaccccgggagcuccagcauguccacgaucaccagcggcuccagccuccccgacggcugcgaggggcgcggccuguccguccacaccgacauggccagcgugaccaaggccauggccgcgcccgaguccgggcuggagguccgggaccgcauguggcucaagaucacgauccccaacgccuuccugggcagcgacgugguggacuggcuguaccaccacgucgagggguucccggagcggcgcgaggcccggaaguacgccuccggccuccugaaggccggccugauccgccacaccgugaacaagaucaccuucagcgagcagugcuacuacguguucggggaccucuccggcgggugcgagagcuaccuggucaaccugagccucaacgacaacgacggcuccagcggcgcguccgaccaggacacccuggcgccccugcccggggccacgcccuggccgcuccugcccaccuucagcuaccaguaccccgcgccccacccguacagcccccagccgccgcccuaccacgagcuguccuccuacaccuacggcgggggcagcgccuccagccagcacuccgaggggagccgguccagcggcuccacccgcagcgacggcggggccggccggacggggcgccccgaggagcgggcccccgaguccaagagcggcuccgggagcgagagcgagcccuccagccgcggcggcucccuccgccgcgggggcgaggccagcgggaccuccgacggcgggcccccgcccagccggggcuccaccggcggggcccccaaccugcgggcccaccccggccugcaccccuacgggcccccgcccggcauggcccuccccuacaaccccaugaugguggugaugaugccgcccccgcccccgcccgucccgcccgccgugcagccgcccggggccccgcccgugcgcgaccugggcagcgucccgcccgagcugaccgccucccggcagagcuuccacauggcgaugggcaaccccuccgaguucuucguggacgugauguga

SEQ ID NO: 29443 - RNA, 2151 nt, Artificial Sequence
  derived and/or modified sequence opt1 from DVL3__Homo_sapiens__NP_004414
augggcgagaccaagaucaucuaccaccuggacgggcaggagacccccuaccucgugaagcugccccugcccgccgagcgcgucacgcucgccgacuucaagggcgugcugcagcggcccagcuacaaguucuucuucaaguccauggacgacgacuucgggguggucaaggaggagaucagcgacgacaacgcgaagcugcccugcuucaacggccgcgugguguccuggcucgucagcgccgaggggucccaccccgaccccgcccccuucugcgccgacaaccccagcgagcugcccccgcccauggagcggaccggcggcaucggggacucccggccgcccagcuuccacccccacgccggcgggggcucccaggagaaccuggacaacgacaccgagaccgacagccucguguccgcgcagcgcgagcgcccccggcgccgggacgggcccgagcacgccacgcgccugaacggcaccgccaagggcgagcggcgccgggagcccgggggcuacgacagcuccagcacccugauguccagcgagcucgagaccacguccuucuucgacagcgacgaggacgacuccaccagccgcuucagcuccagcaccgagcaguccagcgccucccggcugaugcgccggcacaagcgccggcgccggaagcagaaggugagccgcaucgagcgcuccagcuccuucagcuccaucaccgacagcacgaugucccugaacaucaucaccgucacccucaacauggagaaguacaacuuccuggggaucagcaucgugggccaguccaacgagcggggcgacgggggcaucuacaucgggagcaucaugaagggcggggcgguggccgccgacggccgcaucgagcccggcgacaugcugcuccaggucaacgagaucaacuucgagaacauguccaacgacgacgccgugcgggugcugcgcgagaucguccacaagcccgggcccaucacccugacgguggccaagugcugggaccccagcccccggggcugcuucacccucccccgcuccgagcccauccggcccaucgaccccgcggccugggugagccacaccgccgccaugaccgggacguuccccgccuacggcaugagccccucccugagcaccaucaccuccaccagcuccagcaucacguccagcaucccggacaccgagcgccuggacgacuuccaccucuccauccacagcgacauggcggccaucgucaaggccauggccucccccgagagcgggcuggaggugcgggaccgcauguggcugaagaucaccauccccaacgccuucaucggcuccgacguggucgacuggcucuaccacaacguggagggcuucaccgaccggcgcgaggcgcggaaguacgccagcaaccugcugaaggccggguucauccgccacacggugaacaagaucaccuucuccgagcagugcuacuacaucuucggcgaccucugcgggaacauggccaaccugagccugcacgaccacgacggcuccagcggggccagcgaccaggacacccucgcgccgcugccccaccccggcgccgcccccuggccgauggccuuccccuaccaguacccgcccccgccccaccccuacaacccccacccgggcuuccccgagcugggguacuccuacggcgggggcagcgcguccagccagcacuccgagggcagccgguccagcggguccaaccgcagcggcuccgaccggcgcaaggagaaggaccccaaggccggggacagcaaguccggcgggagcggcuccgagagcgaccacaccacgcgguccagccuccgcggcccccgcgagcgggccccguccgagcgcagcgggcccgccgccagcgagcacucccaccggagccaccacucccuggcgagcucccugcgcagccaccacacccaccccuccuacgggcccccgggcgucccgccccucuacggcccgcccaugcugaugaugccgccgccgcccgccgccauggggccgcccggcgccccgcccggccgggaccuggccagcgugccgcccgagcucaccgcgucccgccagagcuuccggauggccauggggaaccccuccgaguucuucgucgacgugauguga

SEQ ID NO: 29444 - RNA, 1191 nt, Artificial Sequence
  derived and/or modified sequence opt1 from DXO__Homo_sapiens__XP_006715068
auggacccccgcggcaccaagcgcggggccgagaagaccgagguggccgagccgcgcaacaagcugccccggcccgcgcccagccucccgacggaccccgcccuguacuccggccccuuccccuucuaccgccggccgagcgagcuggggugcuucucccucgacgcccagcgccaguaccacggcgacgcccgggcccugcgcuacuacagcccgccgcccaccaacgggcccggccccaacuucgaccugcgggacggcuaccccgaccgcuaccagccccgggacgaggagguccaggagcgccucgaccaccuccugugcuggcugcuggagcaccgggggcgccuggagggcgggcccggcuggcucgcggaggccaucgugaccuggcgggggcaccugaccaagcugcucacgacccccuacgagcgccaggagggcuggcagcuggccgccucccgguuccagggcacccuguaccucagcgagguggagacccccaacgcgcgcgcccagcggcuggcccggcccccgcugcuccgggagcugauguacaugggguacaaguucgagcaguacaugugcgccgacaagcccggcuccagccccgaccccuccggggaggucaacacgaacguggccuucugcagcgugcugcgcucccgccucggcagccacccgcugcuguucuccggcgaggucgacugcaccgacccccaggcgcccagcacccagcccccgaccugcuacguggagcucaagacguccaaggagaugcacagccccgggcaguggcgguccuucuaccgccacaagcugcugaaguggugggcccagagcuuccuccccggcgugccgaacgucguggccggguuccggaaccccgacggcuucguguccagccugaagaccuuccccaccaugaagauguucgaguacguccgcaacgaccgggacggguggaaccccagcgugugcaugaacuucugcgccgccuuccuguccuucgcgcagagcaccgugguccaggacgacccgcgccucgugcaccuguucuccugggagcccggcggccccgugacggucagcgugcaccaggacgcccccuacgccuuccugccgaucugguacguggaggccaugacccaggaccuccccuccccgcccaagacccccagccccaaguga

SEQ ID NO: 29445 - RNA, 2010 nt, Artificial Sequence
  derived and/or modified sequence opt1 from DYM__Homo_sapiens__NP_060123
augggcagcaacuccagccgcaucggggaccugcccaagaacgaguaccucaagaagcuguccggcaccgagagcaucuccgagaacgacccguucuggaaccagcugcucagcuucuccuuccccgcccccaccagcuccagcgagcugaagcugcucgaggaggccacgaucuccgugugccggagccuggucgagaacaacccccgcaccgggaaccugggcgcgcucaucaagguguuccugucccggaccaaggagcugaagcucagcgccgagugccagaaccacaucuucaucuggcagacccacaacgcccuguucaucaucugcugccugcucaagguguucaucugccagauguccgaggaggagcugcagcugcacuucacguacgaggagaaguccccggggaacuacagcagcgacuccgaggaccuccuggaggagcugcucugcugccugaugcagcugaucaccgacaucccccuccuggacaucaccuacgagaucagcgucgaggccaucagcaccauggugguguuccuguccugccagcuguuccacaaggagguccuccgccagagcaucucccacaaguaccugaugcggggccccugccuccccuacacgagcaagcuggugaagacccugcucuacaacuucauccgccaggagaagccgcccccgcccggcgcccacguguucccccagcaguccgacgggggcgggcugcuguacggccucgcgagcggggucgccaccggccuguggaccguguucacgcugggcggggugggcuccaaggccgccgcgagccccgagcucuccagcccccuggccaaccagucccugcuccugcugcucguccuggccaaccugaccgacgccagcgacgcccccaacccguaccggcaggcgaucauguccuucaagaacacccaggacagcucccccuuccccagcuccaucccccacgccuuccagaucaacuucaacagccucuacaccgcccugugcgagcagcagacguccgaccaggccacccugcugcucuacacccugcugcaccagaacagcaacauccgcaccuacaugcucgcccggacggacauggagaaccuggugcugccgauccucgagauccuguaccacguggaggagcgcaacagccaccacgucuacauggcgcugaucauccuccugauccugaccgaggacgacggguucaaccgguccauccacgaggugauccucaagaacaucaccugguacagcgagcgcgugcugaccgagaucucccugggcagccuccugauccuggucgugauccggacgauccaguacaacaugacccgcacccgggacaaguaccuccacaccaacugccuggccgcccuggccaacauguccgcccaguuccgcagccuccaccaguacgcggcccagcggaucaucucccuguucagccugcucuccaagaagcacaacaaggugcuggagcaggccacgcagagccugcgcggcucccucagcuccaacgacgucccccugcccgacuacgcccaggaccugaacgugaucgaggaggugauccggaugaugcucgagaucaucaacagcugccugaccaacucccugcaccacaaccccaaccucgucuacgcccugcuguacaagcgcgaccucuucgagcaguuccggacccacccgagcuuccaggacaucaugcagaacaucgaccuggugaucuccuucuucagcagccgccugcuccaggcgggggccgagcuguccgucgagcgcgugcuggagaucaucaagcagggcguggucgcccuccccaaggaccggcugaagaaguuccccgagcugaaguucaaguacguggaggaggagcagcccgaggaguucuucaucccguacguguggagccucgucuacaacuccgccguggggcuguacuggaacccccaggacauccagcuguucaccauggacagcgacuga

SEQ ID NO: 29446 - RNA, 633 nt, Artificial Sequence
  derived and/or modified sequence opt1 from DYNAP__Homo_sapiens__NP_775900
augguggccgacaucaagggcaacgagcagaucgagaaguacagcuggcgcgaggccugcgacaccggguccagccggauggaccgcaagcacggcaaguacauccugaacgucgagcacuccgagaaccagcccccgaucacccaccccaacgaccaggaggcgcacagcuccaucugcuggugccuccccagcaacgacaucacguccgacgugagccccaaccugaccggggugugcgucaacccgggcauccuggcccacucccggugccuccagagcgaguccugcaacacccaggugaaggaguacugccgcaacgacuggagcauguggaagguguuccuggccugccugcucgccugcgucaucaugaccgccaucggggugcugaucaucugccuggugaacaacaagggcuccgcgaacagcuccaucgucauccagcucagcacgaacgacggcgagugcgugaccgugaagcccgggacccccucccccgccugcccgcccaccaugacgaccaccagcaccguccccgccuccacggccaccgagagcaccaccagcacggcgaccgccgccaccaccuccacggagcccaucaccguggccccgaccgaccaccuguga

SEQ ID NO: 29447 - RNA, 13941 nt, Artificial Sequence
  derived and/or modified sequence opt1 from DYNC1H1__Homo_sapiens__NP_001367
augagcgagcccggcgggggcgggggcgaggacgggagcgccggccuggaggugagcgccgugcagaacguggccgacguguccgugcugcagaagcaccuccggaagcuggugccccugcugcuggaggacggcggggaggcccccgccgcccuggaggccgcccuggaggagaaguccgcccuggagcagaugcggaaguuccuguccgacccccaggugcacaccgugcugguggagcggagcacccugaaggaggacgugggcgacgagggggaggaggagaaggaguucaucuccuacaacaucaacaucgacauccacuacggcgucaagagcaacucccuggccuucaucaagcggacccccgugaucgacgccgacaagcccgugagcucccagcugcgcgugcugacccucagcgaggacucccccuacgagacccugcacagcuucaucuccaacgccguggcccccuucuucaagagcuacauccgggaguccgggaaggccgaccgcgacggcgacaagauggcccccagcguggagaagaagaucgccgagcuggagaugggccuccugcaccuccagcagaacaucgagaucccggagaucucccuccccauccaccccaugaucaccaacguggcgaagcagugcuacgagcgcggggagaagcccaaggugacggacuucggcgacaagguggaggacccgaccuuccugaaccagcugcagagcggggugaaccgcuggauccgggagauccagaaggugaccaagcucgaccgcgaccccgccagcggcaccgcccugcaggagaucuccuucuggcugaaccucgagcgggcccuguaccgcauccaggagaagcgggagagccccgaggugcugcucacgcuggacauccugaagcacggcaagcgcuuccacgccaccgucuccuucgacaccgacaccgggcucaagcaggcgcuggagacggugaacgacuacaacccccugaugaaggacuucccgcucaacgaccugcugagcgccaccgagcucgacaagauccggcaggcccugguggccaucuucacccaccuccggaagauccggaacaccaaguaccccauccagcgcgcccugcggcuggucgaggcgaucucccgcgaccugagcucccagcuccugaaggugcugggcacgcggaagcucaugcacgucgccuacgaggaguucgagaaggugaugguggccugcuucgaggucuuccagaccugggacgacgaguacgagaagcuccaggugcugcugcgcgacaucgugaagcgcaagcgggaggagaaccucaagauggucuggcgcaucaaccccgcccaccggaagcugcaggcccgccuggaccagaugcggaaguuccgccggcagcacgagcagcuccgcgcggugaucgugcggguccugcgcccccaggugaccgccguggcccagcagaaccagggggaggucccggagccccaggacaugaagguggccgaggugcuguucgacgcggccgacgccaacgccaucgaggaggucaaccucgccuacgagaacgugaaggagguggacggccuggacgucagcaaggaggggaccgaggcgugggaggccgccaugaagcgguacgacgagcgcaucgaccggguggagacgcgcaucaccgcccggcugcgcgaccagcucggcaccgccaagaacgcgaacgagauguuccggaucuucucccgcuucaacgcccuguucgugcggccccacauccgcggcgccauccgcgaguaccagacccagcugauccagcgggucaaggacgacaucgagagccuccacgacaaguucaaggugcaguacccccagucccaggccugcaagaugagccacgugcgcgaccugccgcccgucuccgggagcaucaucugggccaagcagaucgaccggcagcugacggcguacaugaagcgcguggaggacgugcucggcaaggggugggagaaccacgucgagggccagaagcugaagcaggacggggacuccuuccggaugaagcugaacacccaggagaucuucgacgacugggcccgcaaggugcagcagcggaaccucggcgugagcggccgcaucuucaccaucgaguccacccggguccgcgggcggacgggcaacgugcugaagcugaaggugaacuuccuccccgagaucaucacccugagcaaggagguccgcaaccugaaguggcucggguuccgggugccccuggccaucgugaacaaggcccaccaggcgaaccagcuguacccguucgccaucucccucaucgagagcguccgcaccuacgagcggaccugcgagaagguggaggagcgcaacacgaucagccugcugguggccggccucaagaaggagguccaggcccugaucgccgaggggaucgcgcuggugugggaguccuacaagcucgaccccuacgugcagcggcuggccgagaccgucuucaacuuccaggagaagguggacgaccugcucaucaucgaggagaagaucgaccuggaggugcgcagccuggagaccugcauguacgaccacaagaccuucuccgagauccucaaccggguccagaaggccguggacgaccugaaccugcacagcuacuccaaccuccccaucugggugaacaagcuggacauggagaucgagcgcauccugggcguccggcuccaggccggccugcgcgccuggacccaggugcugcucgggcaggcggaggacaaggccgagguggacauggacaccgacgccccgcaggucagccacaagcccggcggggagcccaagaucaagaacgugguccacgagcugcgcaucaccaaccaggugaucuaccugaacccgcccaucgaggagugccgguacaagcucuaccaggagauguucgccuggaagauggugguccugucccugccccgcauccagagccagcgguaccaggugggcgugcacuacgagcucaccgaggaggagaaguucuaccgcaacgcccugacccggaugcccgacggccccgucgcgcuggaggaguccuacagcgccgugauggggaucguguccgaggucgagcaguacgugaagguguggcuccaguaccagugccugugggacaugcaggccgagaacaucuacaaccgccugggcgaggaccucaacaaguggcaggcccugcugguccagauccggaaggcgcgcgggacguucgacaacgccgagaccaagaaggaguucggcccgguggugaucgacuacgggaagguccagagcaaggugaaccucaaguacgacuccuggcacaaggaggugcugagcaaguucggccagaugcugggcuccaacaugaccgaguuccacagccagaucuccaagagccggcaggagcucgagcagcacagcgucgacaccgccuccacgagcgacgccgugaccuucaucaccuacgugcagucccugaagcgcaagaucaagcaguucgagaagcaggucgagcuguaccggaacgggcagcgccuccuggagaagcagcgguuccaguucccgcccagcuggcuguacaucgacaacaucgagggcgaguggggcgccuucaacgacaucaugcgccggaaggacuccgcgauccagcagcaggucgccaaccuccagaugaagaucgugcaggaggaccgcgccgucgagagccggaccacggaccugcugaccgacugggagaagaccaagcccgugaccggcaaccuccgcccggaggaggcccugcaggcccugacgaucuacgaggggaaguucggccggcucaaggacgaccgcgagaagugcgcgaaggccaaggaggcccuggagcugaccgacaccggccuccuguccgggagcgaggagcgcgugcaggucgcccuggaggagcuccaggaccugaagggcgugugguccgagcugagcaaggugugggagcagaucgaccagaugaaggagcagcccugggucuccgugcagccccggaagcuccgccagaaccuggacgcccugcucaaccagcucaagagcuuccccgcgcggcugcgccaguacgccuccuacgaguucgugcagcggcuccugaagggguacaugaagaucaacaugcuggucaucgagcucaagagcgaggcccucaaggaccgccacuggaagcagcugaugaagcggcugcacgugaacuggguggucuccgagcucacccugggccagaucugggacguggaccugcagaagaacgaggccaucgugaaggacguccuccugguggcccagggggagauggcgcuggaggaguuccucaagcagauccgcgagguguggaacacguacgagcuggaccuggucaacuaccagaacaagugccggcucauccgcggcugggacgaccuguucaacaaggugaaggagcacaucaacagcguguccgccaugaagcugagcccguacuacaaggucuucgaggaggacgcccucuccugggaggacaagcugaaccggaucauggcccuguucgacguguggaucgacgugcagcgccggugggucuaccucgagggcaucuucaccgggagcgcggacaucaagcaccuccugcccguggagacccagcgcuuccagagcaucuccaccgaguuccucgcccugaugaagaaggugagcaagagcccccuggucauggacgugcucaacauccagggcguccagcggagccuggagcgccuggccgaccuccuggggaagauccagaaggcccugggcgaguaccucgagcgggagcgcuccagcuucccccgguucuacuucgugggggacgaggaccugcuggagaucaucggcaacuccaagaacguggccaagcuccagaagcacuucaagaagauguucgcgggcgucagcuccaucauccugaacgaggacaacagcguggugcuggggaucuccagccgcgagggcgaggaggucauguucaagacgccgguguccaucaccgagcaccccaagaucaacgaguggcucacccugguggagaaggagaugcgggucacccuggccaagcuccuggccgagagcgugacggagguggagaucuucgggaaggccaccuccaucgaccccaacaccuacaucaccuggaucgacaaguaccaggcccagcuggucgugcucagcgcgcagaucgccugguccgagaacguggagacggcccugagcuccaugggcggcgggggcgacgccgcgccccugcacagcguccucagcaacguggaggugacccugaacguccuggcggacuccgugcucauggagcagccgccccugcgccgccggaagcuggagcaccucaucaccgagcuggugcaccagcgcgacgucacccggagccugaucaaguccaagaucgacaacgccaagagcuucgaguggcucucccagaugcgcuucuacuucgaccccaagcagacggacgugcugcagcagcugagcauccagauggccaacgccaaguucaacuacggguucgaguaccucggcgugcaggacaagcugguccagaccccgcugaccgaccggugcuaccucaccaugacgcaggcgcuggaggcccgccugggcgggucccccuucgggcccgccgggaccggcaagaccgagagcgugaaggcccucgggcaccagcugggccgguucgugcuggucuucaacugcgacgagaccuucgacuuccaggccauggggcgcaucuucgugggccucugccaggugggcgcgugggggugcuucgacgaguucaaccggcuggaggagcgcaugcuguccgccgucagccagcagguccagugcauccaggaggcccuccgggagcacuccaaccccaacuacgacaagaccagcgccccgaucacgugcgagcugcugaacaagcaggucaaggucucccccgacauggccaucuucaucaccaugaaccccggcuacgcggggcgcagcaaccuccccgacaaccugaagaagcuguuccggucccucgccaugaccaagccggaccgccagcugaucgcccaggugaugcuguacagccagggcuuccggaccgccgaggugcucgccaacaagaucguccccuucuucaagcugugcgacgagcagcuguccagccagucccacuacgacuucgggcuccgcgcgcucaagagcgugcuggugagcgccggcaacgucaagcgggagcgcauccagaagaucaagcgggagaaggaggagcgcggcgaggccguggacgagggggagaucgccgagaaccuccccgagcaggagauccugauccaguccgugugcgagacgaugguccccaagcugguggcggaggacaucccgcuccuguucagccugcucuccgacguguuccccggcguccaguaccaccgcggggagaugaccgcccugcgggaggagcugaagaaggugugccaggagauguaccucaccuacggcgacggcgaggaggucggcgggaugugggucgagaaggugcugcagcuguaccagaucacccagaucaaccacgggcucaugaugguggggcccagcggguccggcaagagcauggccuggcgcguccugcugaaggcccucgagcggcuggagggcguggagggggucgcccacaucaucgaccccaaggcgaucuccaaggaccaccuguacggcacgcuggacccgaacacccgcgaguggaccgacggccuguucacccacgugcugcggaagaucaucgacagcgugcgcggcgagcugcagaagcggcaguggaucgucuucgacggggacguggaccccgaguggguggagaaccucaacuccguccuggacgacaacaagcugcucacgcugcccaacggcgagcgccugagccugccgcccaacgugcggaucauguucgaggugcaggaccugaaguacgccacccuggccaccgucucccgcugcggcauggugugguucagcgaggacgugcucuccaccgacaugaucuucaacaacuuccuggcccggcugcgcagcaucccccucgacgagggggaggacgaggcccagcggcgccggaagggcaaggaggacgagggggaggaggcggccucccccaugcugcagauccagcgcgacgccgccacgaucaugcagcccuacuucaccagcaacggccuggucaccaaggcccucgagcacgcguuccagcuggagcacaucauggaccugacccggcuccgcugccuggggucccuguucagcaugcuccaccaggccugccggaacguggcccaguacaacgccaaccaccccgacuuccccaugcagaucgagcagcuggagcgcuacauccagcgguaccugguguacgccauccucuggucccugagcggcgacagccgccugaagaugcgcgcggagcucggcgaguacauccggcgcaucacgaccgucccccugcccaccgccccgaacauccccaucaucgacuacgagguguccaucagcggggaguggucccccuggcaggccaaggugccgcagaucgaggucgagacccacaagguggccgcgcccgacguggucgugcccacgcuggacaccgugcggcacgaggcccuccuguacaccuggcuggccgagcacaagccccucguccugugcggcccgcccgggagcggcaagaccaugacgcuguucuccgcccuccgcgcccugcccgacauggaggugguggggcugaacuucagcuccgcgaccacccccgagcuccugcugaagaccuucgaccacuacugcgaguaccggcgcacgccgaacggcgucgugcucgcccccgugcagcugggcaaguggcugguccucuucugcgacgagaucaaccugcccgacauggacaaguacgggacccagcgggugaucagcuucauccgccagaugguggagcacggcggguucuaccggaccuccgaccagaccugggucaagcuggagcgcauccaguucgugggcgccugcaacccgcccacggaccccggccggaagccccucagccaccgcuuccugcggcacgugcccgucguguacguggacuaccccgggcccgccucccugacccagaucuacggcaccuucaaccgcgccaugcuccggcugauccccagccugcgcaccuacgcggagccccucaccgccgccauggucgaguucuacacgaugucccaggagcgguucacccaggacacccagccgcacuacaucuacagcccccgcgagaugacccggugggugcgcgggaucuucgaggcccugcgcccccuggagacgcuccccguggagggccugauccggaucugggcccacgaggcgcugcgccucuuccaggaccggcuggucgaggacgaggagcgccgguggaccgacgagaacaucgacaccguggcccugaagcacuucccgaacaucgaccgcgagaaggccaugucccggcccauccucuacagcaacuggcuguccaaggacuacauccccguggaccaggaggagcugcgcgacuacgucaaggcccggcucaagguguucuacgaggaggagcuggacgugccccugguccucuucaacgaggugcuggaccacgugcugcgcaucgaccggaucuuccgccagccgcaggggcaccuccugcugaucggcgucagcggcgcggggaagaccacgcucucccgguucguggccuggaugaacggccugagcgucuaccagaucaaggugcaccgcaaguacaccggggaggacuucgacgaggaccugcggaccgugcuccgccggagcggcugcaagaacgagaagaucgccuucaucauggacgaguccaacguccuggacagcggguuccuggagcgcaugaacacccuccuggccaacggcgaggugcccggccuguucgagggggacgaguacgccacgcucaugacccagugcaaggagggcgcgcagaaggaggggcugaugcuggacucccacgaggagcucuacaagugguucaccagccaggugauccggaaccugcacgucguguucaccaugaaccccuccagcgagggccugaaggaccgcgccgccacguccccggcccucuucaaccggugcgugcugaacugguucggggacuggagcaccgaggcccuguaccaggucggcaaggaguucaccuccaagauggaccucgagaagcccaacuacaucgugcccgacuacaugcccguggucuacgacaagcugccgcagccgcccagccaccgcgaggcgaucgugaacuccugcguguucguccaccagacccugcaccaggccaacgcccgccuggccaagcggggcgggcgcacgauggccaucacgccccggcacuaccucgacuucaucaaccacuacgcgaaccuguuccacgagaagcgcagcgagcuggaggagcagcagaugcaccucaacgugggccugcggaagaucaaggagaccguggaccaggucgaggagcugcgccgggaccuccgcaucaagucccaggagcuggaggugaagaacgccgccgccaacgacaagcugaagaagauggugaaggaccagcaggaggcggagaagaagaaggucaugagccaggagauccaggagcagcuccacaagcagcaggaggugaucgccgacaagcagauguccgugaaggaggaccuggacaaggucgagccggccgugaucgaggcccagaacgccgucaagagcaucaagaagcagcaccuggucgaggugcgguccauggcgaacccgcccgccgccgugaagcucgcccuggagagcaucugccugcuccugggggagagcaccacggacuggaagcagauccgcuccaucaucaugcgggagaacuucauccccaccaucgucaacuucagcgccgaggagaucuccgacgcgauccgcgagaagaugaagaagaacuacaugagcaacccguccuacaacuacgagaucgugaaccgggccagccuggccugcggccccauggugaagugggccaucgcccagcucaacuacgcggacaugcugaagcgcgucgagccccugcggaacgagcuccagaagcuggaggacgacgccaaggacaaccagcagaaggccaacgagguggagcagaugauccgcgaccuggaggccuccaucgcccgguacaaggaggaguacgcggugcucaucagcgaggcccaggccaucaaggccgaccuggcggccgucgaggccaaggugaaccgcuccaccgcccugcucaagagccuguccgccgagcgggagcgcugggagaagaccagcgagacguucaagaaccagauguccaccaucgcgggggacugccugcucagcgccgccuucaucgccuacgccggcuacuucgaccagcagaugcgccagaaccuguucaccaccuggucccaccaccuccagcaggcgaacauccaguuccggacggacaucgcccgcaccgaguaccucagcaacgccgacgagcggcugcgcuggcaggccuccagccugcccgccgacgaccucugcaccgagaacgcgaucaugcugaagcgguucaaccgcuacccgcugaucaucgaccccuccggccaggccaccgaguucaucaugaacgaguacaaggaccggaagaucacgcgcaccagcuuccucgacgacgccuuccggaagaaccuggagagcgcccugcgcuucgggaacccccuccuggugcaggacgucgaguccuacgaccccgugcugaacccggugcucaaccgggagguccgccggaccggcgggcgcgugcugaucacccugggcgaccaggacaucgaccucagccccuccuucgugaucuuccugagcacgcgggaccccaccgucgaguucccgcccgaccugugcucccgcgugaccuucgugaacuucaccgucacccggagcucccuccagagccagugccugaacgaggugcugaaggcggagcgccccgacguggacgagaagcgguccgaccuccugaagcugcagggcgaguuccagcuccgccugcggcagcuggagaagucccuccugcaggcccugaacgaggucaaggggcgcauccucgacgacgacacgaucaucaccacccuggagaaccugaagcgcgaggccgccgaggugacccggaaggucgaggagacggacaucgugaugcaggagguggagaccgucucccagcaguaccucccccugagcaccgccugcuccagcaucuacuucaccauggagucccugaagcagauccacuuccucuaccaguacagccugcaguucuuccuggacaucuaccacaacgugcucuacgagaaccccaaccugaagggcgugacggaccacacccagcgccuguccaucaucaccaaggaccucuuccaggucgcguucaaccggguggcccgcgggaugcugcaccaggaccacaucaccuucgccaugcugcucgcccggaucaagcugaagggcacggugggggagcccaccuacgacgccgaguuccagcacuuccugcgcggcaacgagaucguccucagcgcgggcuccacgccccggauccaggggcugaccguggagcaggccgaggccgugguccgccugagcugccuccccgccuucaaggaccugaucgccaaggugcaggcggacgagcaguucggcaucuggcuggacagcuccagcccggagcagacggugcccuaccucugguccgaggagacccccgccacccccaucgggcaggccauccaccggcugcugcucauccaggccuuccgcccggaccggcugcuggccauggcgcacauguucgucagcaccaaccucggcgaguccuucaugagcaucauggagcagccccuggaccugacgcacaucguggggaccgaggugaagcccaacacccccguccugaugugcuccgugccgggcuacgacgccagcggccacguggaggaccucgccgccgagcagaacacccagaucacguccaucgcgaucgggagcgccgagggcuucaaccaggccgacaaggccaucaacaccgccgucaaguccgggcgcugggugaugcugaagaacgugcaccuggcgcccggcuggcucaugcagcuggagaagaagcugcacagccuccagccccacgccugcuuccggcuguuccugaccauggagaucaaccccaaggucccggugaaccuccugcgcgccgggcggaucuucguguucgagccgccgcccggcgucaaggccaacaugcugcgcaccuucuccagcaucccggugucccggaucugcaagagccccaacgagcgcgcccggcucuacuuccugcuggcgugguuccacgccaucauccaggagcgccuccgcuacgcgccccugggcugguccaagaaguacgaguucggggagagcgaccugcgguccgccugcgacacgguggacaccuggcucgacgacaccgccaagggccgccagaacaucagccccgacaagaucccguggagcgcgcugaagacccugauggcccaguccaucuacgggggccgggucgacaacgaguucgaccagcgccuccugaacacguuccuggagcgccuguucaccacccgcagcuucgacuccgaguucaagcuggccugcaagguggacggccacaaggacauccagaugcccgacgggauccggcgcgaggaguucgugcagugggucgagcugcuccccgacacccagacgcccagcuggcugggccugccgaacaacgccgagcgggugcuccugaccacccaggggguggacaugaucuccaagaugcugaagaugcagaugcucgaggacgaggacgaccuggcguacgccgagaccgagaagaagacccgcacggacagcaccuccgacggccggcccgccuggaugcgcacccugcacaccacggccagcaacuggcuccaccugaucccccagacccugucccaccucaagcggaccgucgagaacaucaaggacccgcuguuccgcuucuucgagcgggaggugaagaugggggccaagcugcuccaggacgugcgccaggaccuggcggacgucguccaggugugcgagggcaagaagaagcagaccaacuaccugcggacgcucaucaacgagcuggucaagggcauccugccccgcagcuggucccacuacaccgugcccgccgggaugaccgugauccagugggucagcgacuucuccgagcggaucaagcagcuccagaacaucagccuggccgccgccuccggcggggcgaaggagcugaagaacauccacgugugccucggcgggcuguucgugcccgaggccuacaucaccgccacgcgccaguacgucgcccaggccaacagcuggucccuggaggagcucugccuggaggugaacgugaccaccagccagggcgcgacccuggacgccugcuccuucggcgucacggggcucaagcugcagggcgcgaccugcaacaacaacaagcugagccucagcaacgccaucuccaccgcgcugccgcugacccagcuccggugggugaagcagacgaacaccgagaagaaggccagcgucgugacccugcccguguaccugaacuucacccgcgccgaccucaucuucacggucgacuucgagaucgccaccaaggaggacccccgcuccuucuacgagcgcgggguggccgugcugugcaccgaguga

SEQ ID NO: 29448 - RNA, 1827 nt, Artificial Sequence
  derived and/or modified sequence opt1 from DYNC1I1__Homo_sapiens__NP_001129029
augagcgacaaguccgaccugaaggccgagcucgagcgcaagaagcagcggcuggcccagauccgcgaggagaagaagcggaaggaggaggagcgcaagaagaaggaggcggacaugcagcagaagaaggagcccgugcaggacgacagcgaccuggaccggaagcgccgggagaccgaggcccuccugcaguccaucggcaucagcccggagccgccccugguccccacccccaugucccccagcuccaagagcguguccacgcccagcgaggccgggucccaggacagcggcgaccucgggccccugacccgccggcgccugcacaagcucggcguguccaaggucacccagguggacuuccugccgcgggagguggucagcuacuccaaggagacccagacgccccuggccacccaccagagcgaggaggacgaggaggacgaggagaugguggaguccaagguggggcaggacagcgagcucgagaaccaggacaagaagcaggaggucaaggaggccccgccccgcgagcugaccgaggaggagaagcagcagauccugcacuccgaggaguuccucaucuucuucgaccggaccauccgcgugaucgagcgggcgcuggccgaggacagcgacaucuucuucgacuacagcggccgcgagcuggaggagaaggacggcgacgugcaggccggggccaaccucuccuucaaccggcaguucuacgacgagcacuggagcaagcaccgcgucgugacgugcauggacuggucccugcaguaccccgagcugaugguggcgagcuacaacaacaacgaggacgcgccccacgagcccgacggcgucgcccucguguggaacaugaaguucaagaagaccacccccgaguacguguuccacugccaguccagcgucauguccgugugcuucgcccgguuccacccgaaccugguggucgggggcaccuacagcgggcagaucgugcugugggacaaccgcucccaccggcgcacgcccgugcagcgcacgccccucagcgccgccgcccacacccaccccgucuacugcgugaacgucgugggcacccagaacgcccacaaccugaucaccguguccaccgacggcaagaugugcagcuggucccuggacaugcucagcaccccgcaggaguccauggagcuggucuacaacaagagcaagcccguggccgugaccgggauggccuuccccacgggcgacgucaacaacuucguggugggguccgaggagggcaccgucuacaccgcgugccggcacggcagcaaggccgggaucggcgagguguucgaggggcaccagggccccgugaccgggaucaacugccacauggccgucggcccgaucgacuucucccaccuguucgugacgagcagcuucgacuggaccgugaagcucuggaccaccaagcacaacaagccccuguacuccuucgaggacaacgccgacuacgucuacgacgugauguggagccccgugcaccccgcccuguucgcgugcgucgacggcauggggcgccucgaccuguggaaccugaacaacgacacggaggugccgaccgccuccguggccaucgagggcgccagcgcccucaaccggguccgcugggcgcaggccgggaaggagguggccgugggcgacuccgaggggcggaucugggucuacgacgugggcgagcuggccgugccccacaacgacgaguggacccgcuucgcgcggacccuggucgagauccgcgccaaccgggccgacagcgaggaggagggcacgguggagcucuccgccuga

SEQ ID NO: 29449 - RNA, 1893 nt, Artificial Sequence
  derived and/or modified sequence opt1 from DYNC1I2__Homo_sapiens__NP_001258715
augagcgacaaguccgagcugaaggccgagcucgagcgcaagaagcagcggcuggcccagauccgcgaggagaagaagcggaaggaggaggagcgcaagaagaaggagaccgaccagaagaaggaggcgguggcccccguccaggaggagagcgaccuggagaagaagcggcgcgaggccgaggcccuccugcaguccaugggccugaccccggagagccccaucgccgagcagccccuccggguggugacggcggacacgugccuguuccacuaccuggugcccccgcccaugucccccagcuccaagagcgucuccacccccagcgaggccgggucccaggacagcggcgacggggccgugggcucccgccgggggccgaucaagcucggcauggccaagaucacccaggucgacuucccgccccgcgagaucgugaccuacaccaaggagacccagacccccgugauggcgcagcccaaggaggacgaggaggaggacgacgacgucguggcccccaagccgcccaucgagcccgaggaggagaagacgcugaagaaggacgaggagaacgacagcaaggccccgccccacgagcugaccgaggaggagaagcagcagauccuccacuccgaggaguuccugagcuucuucgaccacuccacccggaucguggagcgcgcccugagcgagcagaucaacaucuucuucgacuacuccggccgggaccucgaggacaaggagggggagauccaggccggcgcgaagcugagccugaaccgccaguucuucgacgagcgguggagcaagcaccgcgucguguccugccucgacuggagcucccaguaccccgagcugcugguggccagcuacaacaacaacgaggacgcgccccacgagcccgacggggucgcccucguguggaacaugaaguacaagaagaccacgcccgaguacguguuccacugccaguccgccgucaugagcgccaccuucgccaaguuccaccccaaccugguggugggcgggaccuacuccggccagaucguccugugggacaaccggagcaacaagcgcaccccggugcagcggacgccccucuccgccgccgcccacacccaccccguguacugcgucaacguggucggcacccagaacgcgcacaaccugaucagcaucuccaccgacgggaagaucugcagcuggucccuggacaugcucagccacccccaggacuccauggagcuggugcacaagcagagcaaggccguggccgucacguccaugagcuucccggugggcgacgugaacaacuucgucgugggguccgaggagggcagcguguacaccgccugccgccacggcagcaaggccgggaucuccgagauguucgagggccaccaggggcccaucaccggcauccacugccacgcggccgucggggccguggacuucagccaccuguucgugaccuccagcuucgacuggacggucaagcucuggaccaccaagaacaacaagccccuguacuccuucgaggacaacgccgacuacguguacgacgugauguggagcccgacccaccccgcgcuguucgccugcgucgacggcaugggccggcucgaccuguggaaccugaacaacgacacggaggugcccaccgccuccaucagcguggaggggaaccccgcccucaaccgcguccgcuggacccacuccggccgggagaucgccgugggggacagcgagggccagaucgugaucuacgacgucggggagcagaucgcggugccgcgcaacgacgagugggcccgguucggccgcacccuggccgagaucaacgccaaccgggccgacgcggaggaggaggccgccacgcgcauccccgccuga

SEQ ID NO: 29450 - RNA, 1572 nt, Artificial Sequence
  derived and/or modified sequence opt1 from DYNC1LI1__Homo_sapiens__NP_057225
auggccgccgugggccgcgucgggagcuucggcuccagcccgccggggcuguccagcaccuacaccggcgggccccucggcaacgagaucgcguccggcaacgggggcgccgccgccggggacgacgaggacggccagaaccuguggagcugcauccuguccgaggugagcacgcggucccgcagcaagcuccccgccgggaagaacgugcugcugcucggcgaggacggcgcggggaagaccucccugauccggaagauccagggcaucgaggaguacaagaaggggcgcggccuggaguaccucuaccugaacguccacgacgaggaccgggacgaccagacccgcugcaacguguggauccuggacggcgaccucuaccacaaggggcugcugaaguucagccucgacgccgugucccugaaggacacccuggucaugcucgugguggacaugagcaagcccuggacggcccuggacucccugcagaagugggccagcgucgugcgggagcacguggacaagcucaagaucccgcccgaggagaugaagcagauggagcagaagcugauccgcgacuuccaggaguacgucgagcccggcgaggacuuccccgcguccccgcagcggcgcaacaccgccagccaggaggacaaggacgacuccguggugcugccccucggggccgacacccugacccacaaccugggcauccccguccucguggugugcacgaagugcgacgccaucagcguccuggagaaggagcacgacuaccgggacgagcacuucgacuucauccagagccacauccgcaaguucugccugcaguacggggccgcgcucaucuacaccuccgugaaggagaacaagaacaucgaccugguguacaaguacaucguccagaagcuguacggcuuccccuacaagaucccggccgugguggucgagaaggacgccguguucauccccgccggcugggacaacgacaagaagaucgggauccuccacgagaacuuccagacccugaaggccgaggacaacuucgaggacaucaucaccaagccgcccguccggaaguucgugcacgagaaggagaucauggcggaggacgaccagguguuccugaugaagcuccagagccugcuggccaagcagccgcccacggccgccggccgccccgucgacgccagcccccgggugcccgggggcagcccccgcacccccaaccgguccgugagcuccaacgucgcgagcgugucccccauccccgccgggagcaagaagaucgaccccaacaugaaggccggcgccaccuccgagggcgugcucgccaacuucuucaacagccugcuguccaagaagaccgggagccccggcgggcccggcgucuccgggggcagcccggcgggcggggccggcgggggcuccagcggccucccgcccuccacgaagaaguccgggcagaagcccgugcuggacgugcacgccgagcuggaccgcaucacccggaagcccgucaccgugagccccaccacgcccaccuccccgaccgagggcgaggccagcuga

SEQ ID NO: 29451 - RNA, 12945 nt, Artificial Sequence
  derived and/or modified sequence opt1 from DYNC2H1__Homo_sapiens__NP_001073932
auggccaacggcaccgccgacgugcgcaagcuguucaucuucaccaccacccagaacuacuucgggcucaugagcgagcugugggaccagccccugcucugcaacugccuggagaucaacaacuuccuggacgacggcaaccagaugcuccugcgggugcagcgcagcgacgccgggaucagcuucagcaacaccaucgaguucggcgacaccaaggacaaggugcugguguucuucaagcuccggcccgaggugaucaccgacgagaaccugcacgacaacauccuggugagcuccaugcucgagagccccaucuccagccuguaccaggccgugcgccagguguucgcccccaugcugcucaaggaccaggaguggucccggaacuucgaccccaagcugcagaaccugcucagcgagcuggaggccgggcugggcaucgugcuccgccgguccgacaccaaccugaccaagcugaaguucaaggaggacgacacccgcggcauccucacgcccagcgacgaguuccaguucuggaucgagcaggcccaccgggggaacaagcagaucuccaaggagcgcgcgaacuacuucaaggagcuguucgagaccaucgcccgggaguucuacaaccuggacagccucucccugcuggaggugguggaccucguggagaccacccaggacguggucgacgacguguggcgccagacggagcacgaccacuaccccgagagccggaugcugcaccuccuggacaucaucggcggguccuucggccgcuucgugcagaagaagcuggggacccugaaccucugggaggaccccuacuaccuggucaaggagagccugaaggccggcaucuccaucugcgagcagugggugaucgugugcaaccaccucaccggccaggucuggcagcgguacgugccccaccccuggaagaacgagaaguacuuccccgagacccuggacaagcuggggaagcgccucgaggaggugcuggccauccggacgauccacgagaaguuccuguacuuccuccccgcgagcgaggagaagaucaucugccugacccgcgucuucgagcccuucaccggccugaaccccgugcaguacaaccccuacaccgagccccucuggaaggccgccgugagccaguacgagaagaucaucgcccccgccgagcagaagaucgcggggaagcugaagaacuacaucuccgagauccaggacagcccgcagcagcugcugcaggccuuccucaaguacaaggagcuggucaagcggcccacgaucuccaaggagcugaugcucgagcgcgagacccugcuggcccggcucguggacagcaucaaggacuuccgccuggacuucgagaaccgcugccggggcauccccggcgacgccuccgggccccugagcggcaagaaccucuccgaggucgugaacagcaucguguggguccgccagcuggagcugaagguggacgacaccaucaagaucgccgaggcgcuccuguccgaccugccgggguuccggugcuuccaccagagcgccaaggaccuccuggaccagcugaagcucuacgagcaggagcaguucgacgacuggucccgcgacauccagagcggccuguccgacagccgguccgggcugugcaucgaggccagcucccgcaucauggagcucgacagcaacgacggccugcugaaggugcacuacuccgaccggcucgucauccugcugcgcgaggugcggcagcucagcgcccugggcuucgugauccccgccaagauccagcaggucgcgaacaucgcccagaaguucugcaagcaggccaucauccugaagcaggucgcccacuucuacaacagcaucgaccagcagaugauccagucccagcgccccaugaugcuccagagcgcccuggcguucgagcagaucaucaagaacuccaaggccgggagcggcgggaagucccagaucaccugggacaaccccaaggagcuggagggcuacauccagaagcuccagaacgccgccgagcggcuggcgacggagaaccgcaagcugcggaaguggcacaccaccuucugcgagaagguggucgugcucaugaacaucgaccugcugcgccagcagcagcgguggaaggacgggcuccaggagcugcgcaccggccuggccacgguggaggcccagggcuuccaggccagcgacaugcacgccuggaagcagcacuggaaccaccagcucuacaaggcgcuggagcaccaguaccagauggggcuggaggcccucaacgagaaccugccggagaucaacaucgaccugaccuacaagcagggccggcuccaguuccggccgcccuucgaggagauccgggccaaguacuaccgcgagaugaagcgcuucaucgggauccccaaccaguucaagggcgucggggaggccggcgacgaguccaucuucagcaucaugaucgaccggaacgccuccggcuuccugaccaucuucagcaaggcggaggaccuguuccgccggcucuccgccgugcugcaccagcacaaggaguggaucgugaucgggcaggucgacauggaggcccugguggagaagcaccucuucaccgugcacgacugggagaagaacuucaaggcccugaagaucaagggcaaggaggucgagcgccugccgagcgccgugaagguggacugccucaacaucaacugcaaccccgucaagacggugaucgacgaccugauccagaagcuguucgaccuccuggugcugucccucaagaaguccauccaggcgcaccuccacgagaucgacaccuucgucaccgaggccauggaggugcugaccaucaugccccaguccguggaggagaucggggacgccaaccuccaguacagcaagcugcaggagcggaagccggagauccugccccucuuccaggaggccgaggacaagaaccgccugcugcggacggucgcgggcggcgggcucgagaccaucuccaaccugaaggccaagugggacaaguucgagcugaugauggagagccaccagcucaugaucaaggaccagaucgaggugaugaagggcaacgucaagagccgccugcagaucuacuaccaggagcuggagaaguucaaggcccggugggaccagcucaagcccggggacgacgucaucgagaccggccagcacaacacccuggacaaguccgccaagcugaucaaggagaagaagaucgaguucgacgaccucgaggugacccgcaagaagcugguggacgacugccaccacuuccggcuggaggagcccaacuucagccucgccuccagcaucuccaaggacaucgagagcugcgcgcagaucugggccuucuacgaggaguuccagcagggguuccaggagauggccaacgaggacuggaucacguuccgcaccaagaccuaccuguucgaggaguuccugaugaacuggcacgaccggcuccgcaaggucgaggagcacuccgugaugaccgugaagcugcagagcgaggucgacaaguacaagaucgugaucccgauccugaaguacgugcggggcgagcaccucucccccgaccacuggcuggaccuguuccgccuccugggccugccccgggggacgagccuggagaagcuccuguucggcgaccugcuccgcgucgccgacaccaucguggccaaggcggccgaccugaaggaccugaacucccgggcccagggggaggugaccauccgcgaggcccuccgggagcuggaccuguggggcgucggggccguguucacccucaucgacuacgaggacagccagucccgcacgaugaagcugaucaaggacuggaaggacaucgugaaccaggucggcgacaaccgcugccugcuccagagccugaaggacucccccuacuacaagggcuucgaggacaaggugagcaucugggagcggaagcuggcggagcucgacgaguaccugcagaaccugaaccacauccagcgcaaguggguguaccucgagccgaucuucgggcggggcgcccugcccaaggagcagacccgcuucaaccgggucgacgaggacuuccgcuccaucaugaccgacaucaagaaggacaaccgggugaccacgcugaccacccacgccgggauccgcaacagccuccugaccauccuggaccagcuccagcggugccagaagucccugaacgaguuccuggaggagaagcgcagcgccuucccccgguucuacuucaucggcgacgacgaccuccuggagauccuggggcagagcacgaaccccuccgucauccagagccaccucaagaagcuguucgcgggcaucaacuccgugugcuucgacgagaaguccaagcacaucaccgccaugaagucccuggagggcgagguggucccguucaagaacaaggugccccucagcaacaacguggagaccuggcugaacgaccuggcccucgagaugaagaagacccuggagcagcugcucaaggagugcgucacgaccgggcgcuccagccagggcgccguggaccccucccuguuccccagccagauccugugccucgccgagcagaucaaguucaccgaggacguggagaacgcgaucaaggaccacucccugcaccagaucgagacccagcuggucaacaagcucgagcaguacacgaacaucgacaccagcuccgaggacccggggaacaccgagagcggcauccuggagcugaagcucaaggcccugauccuggacaucauccacaacaucgacguggugaagcagcucaaccagauccagguccacaccacggaggacugggccuggaagaagcagcugcgguucuacaugaaguccgaccacacgugcugcgugcagaugguggacagcgaguuccaguacaccuacgaguaccaggggaacgccuccaagcuggucuacacgccccugacggacaagugcuaccugacccugacccaggccaugaagaugggccucggcgggaaccccuacggccccgcggggaccggcaagacggagagcgugaaggcccugggcgggcugcucggccgccaggugcuggucuucaacugcgacgaggggaucgacgugaaguccaugggccggaucuucguggggcuggucaagugcggcgccuggggcugcuucgacgaguucaaccgccucgaggagagcgugcugagcgccguguccaugcagauccagaccauccaggacgcccugaagaaccaccggaccgucugcgagcuccuggggaaggagguggaggugaacagcaacuccggcaucuucaucaccaugaacccggcggggaagggcuacgggggccgccagaagcugcccgacaaccucaagcagcuguuccggcccgucgccaugagccaccccgacaacgagcugaucgccgaggugauccucuacuccgagggcuucaaggacgccaaggugcugagccgcaagcuggucgccaucuucaaccucucccgcgagcugcugaccccgcagcagcacuacgacugggggcuccgggcgcugaagacggugcugcgcggcagcgggaaccuccugcggcagcugaacaaguccggcaccacccagaacgccaacgagagccacaucgugguccaggcccuccgccugaacaccauguccaaguucacguucaccgacugcacccgguucgacgcccugaucaaggacguguuccccgggaucgagcucaaggagguggaguacgacgagcugagcgcggcccugaagcaggucuucgaggaggccaacuacgagaucauccccaaccagaucaagaaggcccucgagcuguacgagcagcugugccagcgcaugggcguggugaucgucggcccguccggggccggcaagagcacccucuggcggaugcugcgcgcggcccugugcaagacggggaagguggugaagcaguacaccaugaaccccaaggccaugccccgguaccagcuccugggccacaucgacauggacacccgcgagugguccgacggcguccugaccaacagcgcccgccagguggugcgcgagccccaggacgucuccagcuggaucaucugcgacggggacaucgacccggaguggaucgagucccucaacagcgugcuggacgacaaccggcugcugacgaugcccagcggcgagcgcauccaguucgggcccaacgugaacuucgucuucgagacccacgaccucuccugcgccagccccgcgaccaucucccggaugggcaugaucuuccugagcgacgaggagaccgaccugaacucccucaucaagagcuggcugcgcaaccagccggccgaguaccggaacaaccuggagaacuggaucggggacuacuucgagaaggcccuccagugggugcugaagcagaacgacuacguggucgagacgucccuggugggcaccgucaugaacggccucagccaccuccacgggugccgcgaccacgacgaguucaucaucaaccugauccggggccucgggggcaaccugaacaugaagucccgccuggaguucaccaaggagguguuccacugggcccgggaguccccgcccgacuuccacaagcccauggacaccuacuacgacuccacgcgcgggcgccucgccaccuacgugcugaagaagccggaggaccugaccgcggacgacuucagcaacggccucacccugcccgucauccagacgcccgacaugcagcggggccuggacuacuucaagcccuggcucuccagcgacaccaagcagccguucauccugguggggcccgagggcugcgggaagggcaugcugcuccgcuacgccuucucccagcugcggagcacccagaucgccaccgugcacugcuccgcccagacgaccagccgccaccuccugcagaagcugucccagaccugcauggucaucagcaccaacacggggcggguguaccgccccaaggacugcgagcggcuggugcuguaccugaaggacaucaaccugcccaagcucgacaaguggggcaccagcacccuggucgcguuccugcagcagguccucaccuaccagggcuucuacgacgagaaccuggaguggguggggcuggagaacauccagaucgucgccuccaugagcgccggcgggcgccucggccggcacaagcugacgacccgcuucaccuccaucgugcggcugugcagcaucgacuacccggagcgcgagcagcuccagaccaucuacggggccuaccuggagcccgugcugcacaagaaccucaagaaccacuccaucuggggcagcuccagcaagaucuaccugcuggccggcuccaugguccagguguacgagcagguccgggcgaaguucaccgucgacgacuacagccacuacuucuucacgcccugcauccucacccagugggugcuggggcuguuccgcuacgaccucgagggcggguccagcaaccacccccuggacuacgugcuggagaucgucgccuacgaggcccggcgccucuuccgggacaagaucgugggcgccaaggagcugcaccuguucgacaucauccucaccuccguguuccagggcgacugggggagcgacauccuggacaacauguccgacagcuucuacgucaccuggggcgcccgccacaacuccggggcgcgggccgccccgggccagccccugccgccccacgggaagccgcucggcaagcugaacagcacggaccugaaggacgugaucaagaagggccucauccacuacgggcgcgacaaccagaaccuggacauccuccuguuccacgaggugcuggaguacaugucccgcaucgaccggguccugagcuuccccggcgggagccuccugcuggccggccgcuccggggugggccggcgcaccaucaccagccucgugucccacaugcacggcgccguccuguucagccccaagaucucccggggguacgagcugaagcaguucaagaacgaccucaagcacgugcugcagcuggcgggcaucgaggcccagcaggucguccuccugcuggaggacuaccaguucgugcacccgaccuuccucgagaugaucaacagccugcuguccagcggggaggugcccggccucuacacgcuggaggagcuggagccccuccugcugccccucaaggaccaggccucccaggacggguucuucggcccggucuucaacuacuucaccuaccgcauccagcagaaccugcacaucgugcugaucauggacagcgccaacuccaacuucaugaucaacugcgagagcaaccccgcgcuccacaagaagugccaggugcuguggauggagggcugguccaacagcuccaugaagaagauccccgagaugcuguucagcgagaccgggggcggggagaaguacaacgacaagaagcggaaggaggagaagaagaagaacuccgucgaccccgacuuccucaagagcuuccugcugauccacgagagcugcaaggccuacggcgccaccccgucccgcuacaugacguuccugcacguguacagcgccaucuccagcuccaagaagaaggagcuccugaagcggcagagccaccuccaggccgggguguccaagcucaacgaggcgaaggcccuggucgacgagcugaaccgcaaggccggcgagcagagcgugcuccugaagaccaagcaggacgaggccgacgccgcgcugcagaugaucaccguguccaugcaggacgccagcgagcagaagaccgagcucgagcggcugaagcaccgcaucgccgaggaggucgugaagaucgaggagcggaagaacaagaucgacgacgagcugaaggaggugcagccccucgucaacgaggccaagcuggccgugggcaacaucaagcccgagucccugagcgagauccgcucccuccggaugcccccggacgugauccgcgacauccuggaggggguccugcggcucaugggcaucuucgacacgagcuggguguccaugaaguccuuccuggcgaagcgcgggguccgggaggacaucgccaccuucgacgcccgcaacaucuccaaggagauccgggagagcguggaggagcuccuguucaagaacaagggcuccuucgaccccaagaacgccaagcgcgccagcaccgcggccgcgccccuggccgcgugggugaaggccaacauccaguacagccacguccuggagcgcauccacccccucgagaccgagcaggccggccuggaguccaaccugaagaagacggaggaccggaagcgcaagcucgaggagcugcugaacagcguggggcagaagguguccgagcucaaggagaaguuccagagccggaccuccgaggccgccaagcuggaggcggaggucagcaaggcccaggagaccaucaaggccgccgaggugcugaucaaccagcucgaccgcgagcacaagcgguggaacgcccagguggucgagaucaccgaggagcuggcgacgcugccgaagcgcgcccagcucgccgccgccuucaucaccuaccuguccgcggcccccgagagccugcggaagaccugccucgaggaguggaccaaguccgccggccuggagaaguucgaccugcgccgguuccucugcacggagagcgagcagcugaucuggaaguccgaggggcugcccagcgacgaccucuccaucgagaacgcccuggugauccugcagaucaucggccucaagagcuggucccgcgugugccccuuccugaucgacccgagcucccaggcgaccgaguggcugaagacccaccucaaggacagccggcuggaggucaucaaccagcaggacuccaacuucaucaccgcccuggagcucgccgugcgcuucgggaagacgcugaucauccaggagauggacggcguggagcccguccuguacccccuccugcggcgcgaccugguggcccagggcccccgguacgugguccagaucggggacaagaucaucgacuacaacgaggaguuccgccucuuccugagcacccggaacccgaaccccuucaucccgcccgacgccgcgagcaucgugaccgaggugaacuucaccacgacccgcuccggccugcgggggcagcuccuggcccugaccauccagcacgagaagccggaccucgaggagcagaagaccaagcugcugcagcaggaggaggacaagaagauccagcucgccaagcuggaggagagccugcucgagacgcuggccaccucccagggcaacauccuggagaacaaggaccucaucgagagccugaaccagaccaaggccuccagcgcgcugauccaggagucccucaaggagagcuacaagcugcagaucucccuggaccaggagcgcgacgccuaccucccccuggccgagagcgccuccaagauguacuucaucaucagcgaccuguccaagaucaacaacauguaccgcuucagccucgccgcguuccugcggcuguuccagcgcgcccuccagaacaagcaggacuccgagaacaccgagcagcggauccagagccugaucuccagccugcagcacauggucuacgaguacaucugccgcugccucuucaaggccgaccagcugauguucgcccugcacuucgugcgggggaugcaccccgagcuguuccaggagaacgagugggacaccuucacgggcguggucgugggcgacaugcugcgcaaggcggacucccagcagaagauccgggaccagcugccgagcuggaucgaccaggagcgcagcugggccguggccacccugaagaucgcccuccccucccuguaccagacccugugcuucgaggacgccgcgcucuggcggaccuacuacaacaacagcaugugcgagcaggaguuccccuccauccuggccaagaaggucagccuguuccagcagauccucguggugcaggcccugcgccccgaccggcugcaguccgccauggcccucuucgcgugcaagacgcuggggcugaaggaggucagcccgcucccccugaaccugaagcgccucuacaaggagacccuggagaucgagcccauccugaucaucaucucccccggcgccgacccgagccaggagcuccaggagcuggccaacgccgagcgguccggggagugcuaccaccagguggccaugggccaggggcaggcggaccuggccauccagaugcucaaggagugcgcccgcaacggcgacuggcugugccugaagaaccuccaccugguggucagcuggcugcccgugcucgagaaggagcugaacacccugcagcccaaggacaccuuccggcucuggcugacggccgaggugcaccccaacuucaccccgauccugcuccaguccagccugaagaucaccuacgagagcccgcccggccugaagaagaaccucaugcgcaccuacgagagcuggacgcccgagcagaucuccaagaaggacaacacccaccgggcccacgcgcuguucagccuggccugguuccacgccgccugccaggagcgccggaacuacaucccgcagggguggaccaaguucuacgaguucucccucagcgaccugcgcgcgggcuacaacaucaucgaccggcuguucgacggggccaaggacguccagugggaguucgugcacggccuccuggagaacgccaucuacggcgggcgcaucgacaacuacuucgaccugcgcgugcuccaguccuaccugaagcaguucuucaacagcagcgucaucgacguguucaaccagcggaacaagaaguccaucuuccccuacagcgugucccugccccagagcugcuccauccucgacuaccgcgccgucaucgagaagauccccgaggacgacaagccgagcuucuucggccugcccgccaacaucgcgcgguccagccagcgcaugaucuccagccaggugaucucccagcugcggauccucgggcgcagcaucaccgccggcuccaaguucgaccgggagaucuggagcaacgagcugucccccgugcugaaccucuggaagaagcugaaccagaacagcaaccugauccaccagaaggugcccccgcccaacgaccgccaggggucccccauccucagcuucaucauccuggagcaguucaacgccauccggcuggugcaguccgugcaccagagccucgccgcccugagcaaggucauccgcggcacgacccugcucuccagcgaggugcagaagcuggcguccgcccugcucaaccagaagugcccccuggccuggcagagcaagugggagggccccgaggacccccugcaguaccuccgggggcugguggcccgcgcccuggcgauccagaacugggucgacaaggccgagaagcaggcccuccuguccgagacccuggaccucagcgagcuguuccaccccgacaccuuccugaacgcccuccggcaggagacggcgcgcgccgugggccgguccgucgacagccugaaguucguggccuccuggaaggggcgccugcaggaggccaagcuccagaucaagaucagcggccugcugcucgaggggugcuccuucgacggcaaccagcugagcgagaaccagcuggacuccccgagcguguccagcguccuccccugcuucaugggcuggaucccccaggacgccugcgggcccuacuccccggacgagugcaucagccugcccguguacaccagcgcggagcgggaccgcguggucaccaacaucgacgugcccugcggcgggaaccaggaccaguggauccagugcggcgccgcccuguuccucaagaaccaguga

SEQ ID NO: 29452 - RNA, 270 nt, Artificial Sequence
  derived and/or modified sequence opt1 from DYNLL1__Homo_sapiens__NP_001032584
augugcgaccgcaaggccgugaucaagaacgccgacaugagcgaggagaugcagcaggacuccgucgagugcgcgacccaggcccuggagaaguacaacaucgagaaggacaucgccgcccacaucaagaaggaguucgacaagaaguacaaccccaccuggcacugcaucgugggccggaacuucgggagcuacgugacgcacgagaccaagcacuucaucuacuucuaccucggccaggucgccauccugcuguucaaguccggguga

SEQ ID NO: 29453 - RNA, 270 nt, Artificial Sequence
  derived and/or modified sequence opt1 from DYNLL2__Homo_sapiens__NP_542408
augagcgaccgcaaggccgugaucaagaacgccgacauguccgaggacaugcagcaggacgcggucgacugcgccacccaggccauggagaaguacaacaucgagaaggacaucgccgccuacaucaagaaggaguucgacaagaaguacaaccccaccuggcacugcaucgugggccggaacuucgggagcuacgugacgcacgagaccaagcacuucaucuacuucuaccugggccaggucgcgauccuccuguucaaguccggguga

SEQ ID NO: 29454 - RNA, 312 nt, Artificial Sequence
  derived and/or modified sequence opt1 from DYNLRB1__Homo_sapiens__NP_001268658
augaacagccagcgccggggcccccacuccugccugaagaccgccccgaaggccaagcccuuccacugggaggcgcucgccgccuaccugcuggacaccagcauccccaucaaguccacgauggacaaccccaccaccacccaguacgccagccucaugcacuccuucauccugaaggcccgcagcacggugcgggacaucgacccgcagaacgaccugaccuuccuccgcauccgguccaagaagaacgagaucauggucgcgcccgacaaggacuacuuccugaucgugauccagaaccccaccgaguga

SEQ ID NO: 29455 - RNA, 300 nt, Artificial Sequence
  derived and/or modified sequence opt1 from DYNLT1__Homo_sapiens__NP_001278531
auggaggacuaccaggccgccgaggaggcgaucgagagcgccaucggcgggaacgccuaccagcacuccaaggugaaccaguggaccaccaacgucguggagcagacgcugagccagcucaccaagcugggcaagcccuucaaguacaucgugaccugcgucaucaugcagaagaacggggccggccugcacaccgccuccagcugcuucugggacuccagcacggacggguccugcaccgugcgcugggagaacaagaccauguacugcaucgugagcgcguucggccucuccaucuga

SEQ ID NO: 29456 - RNA, 351 nt, Artificial Sequence
  derived and/or modified sequence opt1 from DYNLT3__Homo_sapiens__NP_006511
auggaggaguaccaccgccacugcgacgaggugggcuucaacgccgaggaggcccacaacaucgucaaggagugcguggacggggugcugggcggggaggacuacaaccacaacaacaucaaccaguggaccgcgagcaucgucgagcagucccucacccaccuggugaagcugggcaaggccuacaaguacaucgugacgugcgccgucgugcagaaguccgccuacggguuccacaccgccagcagcugcuucugggacaccaccuccgacggcacgugcaccgugcggugggagaaccgcaccaugaacugcaucgucaacguguucgcgaucgccaucgugcucuga

SEQ ID NO: 29457 - RNA, 2292 nt, Artificial Sequence
  derived and/or modified sequence opt1 from DYRK1A__Homo_sapiens__NP_001387
augcacaccggcggggagaccagcgccugcaagcccuccagcgugcgccuggccccguccuucagcuuccacgcggccggccuccagauggccgggcagaugccccacucccaccaguacagcgaccggcgccagcccaacaucuccgaccagcaggucagcgcccuguccuacagcgaccagauccagcagccccugacgaaccaggugaugccggacaucgugaugcuccagcggcgcaugccccagaccuuccgggaccccgccaccgcgccccugcgcaagcuguccgucgaccucaucaagaccuacaagcacaucaacgagguguacuacgccaagaagaagcggcgccaccagcagggccagggggacgacagcucccacaagaaggagcggaagguguacaacgacggcuacgacgacgacaacuacgacuacaucgucaagaacggcgagaaguggauggaccgcuacgagaucgacagccugaucgggaagggcuccuucggccagguggugaaggccuacgaccgggucgagcaggaguggguggccaucaagaucaucaagaacaagaaggcguuccugaaccaggcccagaucgaggugcgccuccuggagcugaugaacaagcacgacacggagaugaaguacuacaucguccaccucaagcggcacuucauguuccgcaaccaccugugccugguguucgagaugcucagcuacaaccuguacgaccugcuccggaacaccaacuuccgcggggugucccugaaccugacccggaaguucgcccagcagaugugcaccgcccuccuguuccuggccacgccggagcucagcaucauccacugcgaccugaagcccgagaacauccugcucugcaaccccaagcgcuccgcgaucaagaucgucgacuucgggagcagcugccagcugggccagcggaucuaccaguacauccagucccgcuucuaccggagccccgaggugcugcucggcaugccguacgaccuggccaucgacauguggucccuggggugcauccucguggagaugcacaccggcgagccccuguucagcggggccaacgaggucgaccagaugaacaagaucguggaggugcugggcaucccgcccgcccacauccucgaccaggcccccaaggcgcgcaaguucuucgagaagcugcccgacggcaccuggaaccugaagaagaccaaggacgggaagcgcgaguacaagccgcccggcacgcggaagcuccacaacauccugggggucgagaccggcgggcccggcggccgccgggccggggaguccggccacaccguggccgacuaccugaaguucaaggaccucauccugcgcaugcuggacuacgaccccaagacccggauccagcccuacuacgcccuccagcacagcuucuucaagaagacggccgacgaggggaccaacaccuccaacagcguguccaccagccccgcgauggagcagucccagagcuccggcacgaccagcuccaccagcuccagcuccgggggcagcagcggcaccuccaacagcgggcgcgcccgguccgacccgacgcaccagcaccgccacagcggcgggcacuucaccgccgccguccaggccauggacugcgagacccacagcccccaggugcggcagcaguuccccgcgccccugggcugguccgggaccgaggccccgacgcaggucaccguggagacccaccccgugcaggagaccacguuccacgucgcgccccagcagaacgcccugcaccaccaccacggcaacuccagccaccaccaccaccaccaccaccaccaccaccaccaccacggccagcaggcccucgggaaccgcacccggccgcgcguguacaacucccccaccaacagcuccagcacccaggacuccauggaggugggccacagccaccacuccaugacgagccuguccagcagcaccaccuccagcuccaccagcuccagcuccaccgggaaccagggcaaccaggccuaccagaaccggcccgucgccgccaacacgcuggacuucggccagaacggggccauggacgugaaccugaccguguacagcaacccccgccaggagaccggcaucgcggggcacccgaccuaccaguucuccgccaacacgggccccgcccacuacaugaccgaggggcaccucaccaugcggcagggcgccgaccgcgaggagagccccaugaccggcgucugcgugcagcagucccccguggccagcuccuga

SEQ ID NO: 29458 - RNA, 1890 nt, Artificial Sequence
  derived and/or modified sequence opt1 from DYRK1B__Homo_sapiens__NP_004705
auggccgugccgcccggccacgggcccuucagcggcuuccccgggccccaggagcacacccagguccugcccgacgugcgccuccugccccggcgccugccccucgccuuccgggacgcgaccuccgcgccccugcgcaagcugagcguggaccucaucaagacguacaagcacaucaacgaggucuacuacgccaagaagaagcggcgcgcccagcaggccccgccccaggacuccagcaacaagaaggagaagaaggugcugaaccacggcuacgacgacgacaaccacgacuacaucgugcgguccggggagcgcuggcuggagcgguacgagaucgacagccucaucggcaagggcuccuucgggcaggucgugaaggccuacgaccaccagacccaggagcugguggccaucaagaucaucaagaacaagaaggccuuccugaaccaggcccagaucgagcuccgccugcuggagcucaugaaccagcacgacaccgagaugaaguacuacaucguccaccugaagcggcacuucauguuccgcaaccaccugugccucguguucgagcugcugagcuacaaccucuacgaccugcugcggaacacccacuuccgcggcgugucccucaaccugacgcggaagcuggcgcagcagcucugcaccgcccugcuguuccucgccacccccgagcugagcaucauccacugcgaccugaagcccgagaacauccuccugugcaacccgaagcgcuccgccaucaagaucgucgacuucgggagcuccugccagcugggccagcggaucuaccaguacauccagagccgcuucuaccggucccccgaggugcuccuggggacccccuacgaccuggccaucgacauguggagccucggcugcauccugguggagaugcacacgggcgagccccuguucuccgggagcaacgaggucgaccagaugaaccgcaucguggaggugcucggcaucccgcccgcggccaugcuggaccaggcccccaaggcccggaaguacuucgagcgccugcccgggggcggcuggacccuccgccggaccaaggagcugcgcaaggacuaccaggggccgggcacccggcgccugcaggagguccucggggugcagacgggcgggcccggcggccggcgcgccggggagcccggccacucccccgcggacuaccugcgguuccaggaccuggugcugcgcaugcucgaguacgagccggccgcccggaucagcccccugggggcccugcagcacggcuucuuccgccggaccgccgacgaggcgaccaacaccgggcccgccggcagcuccgccagcacgucccccgccccgcucgacacgugccccagcuccagcaccgccuccagcaucuccagcuccggcgggagcuccggcagcuccagcgacaaccgcaccuaccgguacuccaaccgcuacugcgggggccccgggccgcccaucaccgacugcgagaugaacagcccccaggugcccccgucccagccccugcggcccugggcgggcggcgacgucccccacaagacccaccaggccccggccagcgccagcucccugcccgggaccggcgcgcagcucccgccccagccccgcuaccuggggcggccgcccagccccaccagcccgcccccgcccgagcugauggacgugucccucgucggcggccccgccgacugcuccccgccccaccccgcccccgcgccccagcaccccgccgccagcgcccugcgcacgcggaugaccgggggccgcccgccccugcccccgcccgacgaccccgccacccucgggccccaccugggccugcgcggggugccccaguccaccgccgccagcuccuga

SEQ ID NO: 29459 - RNA, 1587 nt, Artificial Sequence
  derived and/or modified sequence opt1 from DYRK2__Homo_sapiens__NP_003574
augaacgaccaccuccacgugggcagccacgcccacgggcagauccagguccagcagcuguucgaggacaacuccaacaagcgcaccgugcugaccacgcagcccaacggccugaccaccguggggaagaccggccuccccgucgugcccgagcggcagcuggacagcauccaccgccggcagggguccagcacgucccucaagagcauggagggcaugggcaaggugaaggccacccccaugacccccgagcaggcgaugaagcaguacaugcagaagcugaccgccuucgagcaccacgagaucuucuccuacccggagaucuacuuccuggggcugaacgccaagaagcgccagggcaugaccgggggccccaacaacgggggcuacgacgacgaccagggcagcuacguccaggugccccacgaccacguggccuaccgguacgagguccucaaggugaucgggaagggcuccuucggccagguggucaaggccuacgaccacaaggugcaccagcacguggcgcugaagaugguccgcaacgagaagcgguuccaccgccaggccgccgaggagauccggauccuggagcaccuccgcaagcaggacaaggacaacacgaugaacgugauccacaugcuggagaacuucaccuuccggaaccacaucugcaugaccuucgagcugcucagcaugaaccuguacgagcugaucaagaagaacaaguuccagggguucucccucccccuggugcgcaaguucgcccacagcauccugcagugccucgacgcgcugcacaagaaccggaucauccacugcgaccugaagccggagaacauccuccugaagcagcagggccgcuccgggaucaaggucaucgacuucggcagcuccugcuacgagcaccagcggguguacacguacauccagagccgcuucuaccgggcccccgaggugauccugggggcccgcuacggcaugcccaucgacauguggucccucgggugcauccuggccgagcugcucaccggcuacccccugcugccgggcgaggacgagggggaccagcucgccugcaugaucgagcugcugggcaugcccagccagaagcuccuggacgcguccaagcgggccaagaacuucgucagcagcaagggguacccccgcuacugcaccgugaccacgcuguccgacggcagcgugguccucaacgggggccggucccgccgcggcaagcugcgggggcccccggagagccgcgaguggggcaacgcccugaaggggugcgacgacccccucuuccuggacuuccugaagcagugccucgagugggaccccgccgugcggaugacccccggccaggcccugcgccacccguggcugcggcgccggcuccccaagccgcccaccggggagaagaccuccgucaagcgcaucacggagagcaccggcgcgaucaccuccaucagcaagcugcccccgcccuccagcuccgccagcaagcugcggaccaaccuggcccagaugacggacgccaacggcaacauccagcagcgcaccgugcuccccaagcugguguccuga

SEQ ID NO: 29460 - RNA, 1707 nt, Artificial Sequence
  derived and/or modified sequence opt1 from DYRK3__Homo_sapiens__NP_001004023
augaaguggaaggagaagcugggcgacgggguguacgacaccuucaugaugaucgacgagaccaagugcccgcccugcagcaacguccucugcaaccccuccgagccgcccccgccccgccggcugaacaugacgaccgagcaguucaccggcgaccacacccagcacuuccuggacgggggcgagaugaagguggagcagcuguuccaggaguucgggaaccgcaagagcaacacgauccaguccgacggcaucagcgacuccgagaagugcagccccaccgugucccagggcaagagcuccgacugccucaacaccgucaagagcaacuccagcuccaaggcccccaagguggugccgcugacccccgagcaggcccucaagcaguacaagcaccaccugacggcguacgagaagcuggagaucaucaacuaccccgagaucuacuucgucgggcccaacgccaagaagcggcacggcgugaucgggggcccgaacaacgggggcuacgacgacgccgacggcgccuacauccacgugccccgcgaccaccucgccuaccgguacgagguccugaagaucaucgggaagggcagcuucggccagguggcgcgcguguacgaccacaagcugcggcaguacgucgcccucaagauggugcgcaacgagaagcgguuccaccgccaggccgccgaggagauccggauccuggagcaccugaagaagcaggacaagaccggcuccaugaacgugauccacaugcucgagagcuucaccuuccgcaaccacgucugcauggcguucgagcugcuguccaucgaccucuacgagcugaucaagaagaacaaguuccagggcuucagcgugcagcuggugcggaaguucgcccaguccauccuccagagccuggacgcccugcacaagaacaagaucauccacugcgaccucaagcccgagaacauccugcugaagcaccacgggcgcagcuccaccaaggucaucgacuucggcagcuccugcuucgaguaccagaagcucuacacguacauccagagccgguucuaccgcgcccccgagaucauccuggggucccgguacagcacccccaucgacaucugguccuucggcugcauccuggccgagcuccugaccgggcagccccuguuccccggcgaggacgagggcgaccagcucgcgugcaugauggagcugcuggggaugcccccgcccaagcuccuggagcagagcaagcgcgccaaguacuucaucaacuccaagggcaucccccgguacugcagcgugaccacgcaggccgacgggcgcgugguccuggugggcgggcggucccgccgcggcaagaagcgggggcccccggggagcaaggacuggggcaccgcccucaaggggugcgacgacuaccuguucaucgaguuccugaagcgcugccuccacugggaccccuccgcccggcugacccccgcgcaggcccugcgccaccccuggaucagcaaguccgugccgcggccccucaccacgaucgacaaggucagcggcaagcgcguggucaaccccgccuccgccuuccaggggcugggcagcaagcugccgcccguggugggcaucgccaacaagcucaaggcgaaccugauguccgagaccaacgggagcaucccccugugcagcguccugcccaagcucaucuccuga

SEQ ID NO: 29461 - RNA, 6246 nt, Artificial Sequence
  derived and/or modified sequence opt1 from DYSF__Homo_sapiens__NP_001123927
augcugugcugccugcuggugcgcgccagcaaccugcccuccgccaagaaggaccggcgcagcgaccccguggccucccucaccuuccggggcgugaagaagcgcaccaaggugaucaagaacagcgucaaccccguguggaacgagggguucgagugggaccugaagggcaucccccuggaccagggguccgagcuccacguggucgugaaggaccacgagaccaugggccggaaccgcuuccugggggaggccaaggugccccugcgggagguccucgccaccccgagccuguccgccagcuucaacgcgccccugcucgacaccaagaagcagcccaccggcgccucccuggugcuccaggugagcuacacgccccuccccggcgccgucccccuguucccgccgcccacgccccuggagcccucccccacccuccccgaccuggacgugguggccgacaccgggggcgaggaggacacggaggaccaggggcugaccggcgacgaggccgagcccuuccucgaccagagcgggggccccggcgcgcccaccacgccccgcaagcugcccucccggccgccgccccacuaccccgggaucaagcgcaagcggagcgcccccaccucccgcaagcugcucagcgacaagccccaggacuuccagauccggguccaggugaucgagggccgccagcugcccggggugaacaucaagcccgucgugaaggugaccgccgccggccagaccaagcggacccgcauccacaagggcaacagcccccuguucaacgagacccuguucuucaaccuguucgacagcccgggggagcuguucgacgagcccaucuucaucaccgucguggacucccggagccuccgcaccgacgcccugcugggcgaguuccggauggacguggggaccaucuaccgcgagccccggcacgcguaccuccgcaaguggcugcugcucagcgaccccgacgacuucuccgccggcgcccgcggguaccugaagacgagccugugcguccucggcccgggcgacgaggcgccccuggagcggaaggaccccuccgaggacaaggaggacaucgagagcaaccugcuccgccccaccgggguggcccugcggggcgcgcacuucugccugaaggucuuccgcgccgaggaccucccgcagauggacgacgccgugauggacaacgugaagcagaucuucggguucgaguccaacaagaagaaccuggucgaccccuucguggaggugagcuucgccggcaagaugcugugcuccaagauccucgagaagaccgccaacccccaguggaaccagaacaucacccugcccgcgauguucccgagcaugugcgagaagaugcggauccgcaucaucgacugggaccggcugacgcacaacgacaucgucgccaccaccuaccuguccaugagcaagaucuccgcccccgggggcgagaucgaggaggagcccgccggcgccgugaagcccagcaaggcguccgaccucgacgacuaccugggguuccugccgaccuucggccccugcuacaucaaccucuacgggagcccccgcgaguucacgggcuuccccgacccguacaccgagcugaacaccgggaagggcgagggcguggccuaccgggggcgccugcuccugucccuggagaccaagcucgucgagcacagcgagcagaagguggaggaccugcccgccgacgacauccugcggguggagaaguaccuccgccggcgcaaguacucccuguucgccgcguucuacagcgccacgaugcugcaggacgucgacgacgccauccaguucgagguguccaucggcaacuacgggaacaaguucgacaugaccugccucccccuggccagcaccacccaguacagccgggccguguucgacggcugccacuacuacuaccugcccuggggcaacgucaagccgguggugguccucuccagcuacugggaggacaucucccaccgcaucgagacgcagaaccagcugcuggggaucgcggaccggcucgaggccggccuggagcagguccaccuggcccucaaggcccagugcagcaccgaggacguggacucccuggucgcccagcugaccgacgagcucaucgcggggugcagccagccccugggcgacauccacgagacccccuccgccacccaccuggaccaguaccucuaccagcugcgcacgcaccaccugagccagaucaccgaggccgcccucgcccugaagcuggggcacuccgagcucccggcggcccuggagcaggccgaggacuggcugcuccggcugcgcgcccuggcggaggagccccagaacagccuccccgacaucgugaucuggaugcugcagggcgacaagcgcguggccuaccagcggguccccgcccaccaggugcuguucucccgccggggcgccaacuacugcgggaagaacugcggcaagcuccagaccaucuuccugaaguacccgauggagaaggugcccggggcccgcaugcccguccagauccgggugaagcugugguucggccucagcguggacgagaaggaguucaaccaguucgcggaggggaagcuguccgucuucgccgagaccuacgagaacgagacgaagcuggcccucgugggcaacuggggcaccaccgggcugaccuaccccaaguucagcgacgugacgggcaagaucaagcugccgaaggacuccuuccgccccagcgccggguggaccugggccggcgacugguucgucugccccgagaagacccuccugcacgacauggacgcggggcaccuguccuucguggaggagguguucgagaaccagacccggcuccccggcggccaguggaucuacaugagcgacaacuacacggacgucaacggggagaaggugcugccgaaggacgacaucgagugcccccugggcuggaagugggaggacgaggaguggagcaccgaccucaaccgcgccguggacgagcaggggugggaguacuccaucaccaucccgcccgagcggaagccgaagcacuggguccccgccgagaagauguacuacacccaccgccggcgccggugggugcgccugcggcgccgggaccugagccagauggaggcccucaagcgccaccggcaggccgaggcggagggcgaggggugggaguacgccucccuguucggcuggaaguuccaccuggaguaccgcaagacggacgccuuccggcgccgccgguggcgccggcgcauggagccccucgagaagaccggccccgccgcgguguucgcccuggagggggcccugggcggggucauggacgacaagagcgaggacuccaugagcguguccacccucagcuucggcgugaaccggccgaccaucuccugcaucuucgacuacggcaaccgcuaccaccuccggugcuacauguaccaggcccgcgaccuggccgcgauggacaaggacagcuucuccgaccccuacgccaucgucagcuuccuccaccagucccagaagacggugguggucaagaacacccugaaccccaccugggaccagacccugaucuucuacgagaucgagaucuucggggagcccgccacgguggccgagcagccgcccagcaucguggucgagcucuacgaccacgacaccuacggcgccgacgaguucauggggcggugcaucugccagcccucccuggagcgcaugccccggcuggcgugguucccgcucacccgcggcagccagcccuccggggagcugcuggccagcuucgagcucauccagcgggagaagcccgccauccaccacaucccgggcuucgaggugcaggagaccucccgcauccuggacgagagcgaggacacggaccugcccuacccgccgccccagcgggaggccaacaucuacauggucccccagaacaucaagcccgcccuccagcgcaccgcgaucgagauccuggccuggggccugcggaacaugaaguccuaccagcucgccaacaucuccagccccucccuggugguggagugcgggggccagaccguccagagcugcgugauccgcaaccugcggaagaaccccaacuucgacaucugcacccucuucauggaggugaugcugccccgcgaggagcuguacugcccgcccaucacggucaaggugaucgacaaccgccaguucgggcggcgcccgguggucggccagugcaccauccggucccucgagagcuuccugugcgaccccuacuccgccgagagccccagcccccagggcgggccggacgacgugagccugcugucccccggcgaggacgugcucaucgacaucgacgacaaggagccccugauccccauccaggaggaggaguucaucgacugguggagcaaguucuucgccuccaucggggagcgcgagaagugcggcagcuaccuggagaaggacuucgacacccucaaggucuacgacacccagcuggagaacguggaggcguucgaggggcuguccgacuucugcaacacguucaagcucuaccggggcaagacccaggaggagaccgaggacccgagcgugaucggggaguucaagggccuguucaagaucuacccccugcccgaggaccccgccaucccgaugccgccccgccaguuccaccagcucgccgcccagggcccccaggagugccugguccggaucuacaucgugcgcgcguucgggcugcagccgaaggaccccaacggcaagugcgaccccuacaucaagaucuccaucgggaagaaguccguguccgaccaggacaacuacaucccgugcacccucgagcccgucuucggcaagauguucgagcugaccugcacgcugccccucgagaaggaccugaagaucacccuguacgacuacgaccuccugagcaaggacgagaagaucggcgagaccgugguggaccuggagaaccggcuccugagcaaguucggggcccgcugcggccugccccagaccuacugcgucuccgggccgaaccaguggcgggaccagcuccgccccagccagcugcugcaccucuucugccagcagcaccgggugaaggcccccguguaccgcacggaccgggucauguuccaggacaaggaguacuccaucgaggagaucgaggccggccgcauccccaacccgcaccuggggcccguggaggagcggcuggcccuccacgugcugcagcagcagggccugguccccgagcacguggagagccgcccccucuacuccccgcugcagcccgacaucgagcagggcaagcugcagauguggguggaccucuuccccaaggcgcuggggcggcccggcccgcccuucaacaucacgccccgccgggcccgccgcuucuuccugcggugcaucaucuggaacacccgcgacgucauccucgacgaccugagccugaccggggagaagauguccgacaucuacgugaagggcuggaugaucggguucgaggagcacaagcagaagacggacgugcacuaccggagccucggcggcgaggggaacuucaacuggcgcuucaucuuccccuucgacuaccugccggccgagcaggucugcaccaucgccaagaaggacgccuucuggcggcuggacaagaccgaguccaagauccccgcgcgcgugguguuccagaucugggacaacgacaaguucagcuucgacgacuuccucggcucccugcagcuggaccucaaccggaugcccaagcccgccaagaccgccaagaagugcagccuggaccagcuggacgacgccuuccacccggagugguucgucucccucuucgagcagaagacggugaaggggugguggcccugcguggccgaggagggcgagaagaagauccuggcggggaagcuggagaugacccucgagaucgucgccgagagcgagcacgaggagcgccccgccggccagggccgggacgagccgaacaugaaccccaagcuggaggacccccgccggcccgacaccuccuuccugugguucaccagcccguacaagacgaugaaguucauccucuggcgccgguuccgcugggccaucauccuguucaucauccuguucauccuccugcuguuccucgcgaucuucaucuacgccuuccccaacuacgccgccaugaagcuggugaagcccuucuccuga

SEQ ID NO: 29462 - RNA, 1131 nt, Artificial Sequence
  derived and/or modified sequence opt1 from DYX1C1__Homo_sapiens__NP_001028731
augccccuccaggugagcgacuacuccuggcagcagaccaagaccgccgucuuccucagccugccgcugaagggcgugugcgugcgcgacacggacgucuucugcaccgagaacuaccucaaggugaacuucccgcccuuccuguucgaggccuuccuguacgcgcccaucgacgacgaguccagcaaggccaagaucgggaacgacaccaucguguucacccucuacaagaaggaggccgccaugugggagacgcuguccgucaccggcguggacaaggagaugaugcagcggauccgcgagaaguccauccugcaggcccaggagcgggcgaaggaggccaccgaggccaaggccgcggccaagcgcgaggaccagaaguacgcccucagcgugaugaugaagaucgaggaggaggagcggaagaagaucgaggacaugaaggagaacgagcgcaucaaggccaccaaggcccuggaggcguggaaggaguaccagcggaaggccgaggagcagaagaagauccagcgcgaggagaagcugugccagaaggagaagcagaucaaggaggagcggaagaagaucaaguacaagagccucacgcgcaaccuggccucccggaaccuggcccccaaggggcgcaacagcgagaacaucuucaccgagaagcucaaggaggacuccauccccgcgccccggagcgucggcuccaucaagaucaacuucacgccccgcguguucccgaccgcccugcgggagagccagguggccgaggaggaggaguggcugcacaagcaggccgaggcccgccgggccaugaacaccgacaucgcggagcucugcgaccugaaggaggaggagaagaaccccgaguggcugaaggacaaggggaacaagcuguucgccaccgagaacuaccuggccgccaucaacgccuacaaccuggcgauccgccucaacaacaagaugccccugcuguaccucaaccgggccgccugccaccugaagcugaagaaccuccacaaggccaucgaggacuccagcaaggcguaccgcaucaugaagcggcaccuccgccugauccaccccaccaagcuguacaagcugaugcugcgccgguucggcauguga

SEQ ID NO: 29463 - RNA, 2547 nt, Artificial Sequence
  derived and/or modified sequence opt1 from DZIP1__Homo_sapiens__NP_055749
augcaggccgaggccgcggacugguucagcuccaugcccuuccagaagcacguguacuacccgcuggccagcggccccgaggggcccgacgucgccguggccgccgcggccgccggcgccgcguccauggccugcgcgcccccgagcgccgccuccgggccccuccccuucuuccaguuccgcccccggcuggagagcguggacuggcgccggcuguccgccaucgacgucgacaagguggccggcgccguggacguccucacccugcaggagaacaucaugaacaucaccuucugcaagcuggaggacgagaagugcccgcacugccagagcgggguggaccccgugcuccugaagcugauccgccucgcccaguucacgaucgaguaccugcugcacucccaggaguuccucaccagccagcugcacacccuggaggagcggcuccgccugucccacugcgacggcgagcagagcaagaagcugcucaccaagcaggccggcgagaucaagacgcugaaggaggagugcaagcggcgcaagaagaugaucuccacccagcagcugaugaucgaggcgaaggccaacuacuaccagugccacuucugcgacaaggccuucaugaaccaggccuuccuccagagccacauccagcggcgccacaccgaggagaacucccacuucgaguaccagaagaacgcccagaucgagaagcugcggagcgagaucgucgugcugaaggaggagcuccagcugacccgcuccgagcuggaggcggcccaccacgccagcgccgugcgguucuccaaggaguacgagaugcagaagacgaaggaggaggacuuccucaagcuguucgaccgcuggaaggaggaggagaaggagaagcuggucgacgagauggagaaggugaaggagauguucaugaaggaguucaaggagcucaccagcaagaacagcgcccuggaguaccagcuguccgagauccagaaguccaacaugcagaucaagagcaacaucgggacccucaaggacgcgcacgaguucaaggaggaccggagccccuacccccaggacuuccacaacgugaugcagcugcuggacucccaggagagcaaguggaccgcccgcguccaggccauccaccaggagcacaagaaggagaagggccggcuccugucccacaucgagaagcugcgcacgagcaugaucgacgaccucaacgccuccaacguguucuacaagaagcggaucgaggagcuggggcagcgccugcaggagcagaacgagcucaucaucacccagcggcagcagaucaaggacuucacgugcaacccgcugaacagcaucuccgagcccaaggugaacgcgcccgcccugcacacccucgagaccaagagcucccugcccaugguccacgagcaggccuucagcucccacauccuggagccgaucgaggagcucagcgaggaggagaagggccgcgagaacgagcagaagcugaacaacaacaagaugcaccuccgcaaggcccugaaguccaacagcucccugaccaaggggcugcggaccaugguggagcagaaccugauggagaagcucgagacccugggcaucaacgccgacauccgcggcaucagcagcgaccagcugcaccgggugcucaaguccgucgagagcgagcgccacaagcaggagcgggagauccccaacuuccaccagauccgcgaguuccuggagcaccagguguccugcaagaucgaggagaaggcgcugcucagcuccgaccagugcagcgugucccagauggacacgcugagcaccggggagguccccaagaugauccagcugcccuccaagaaccggcagcucauccgccagaaggccgugagcaccgaccggaccuccgucccgaagaucaagaagaacgugauggaggaccccuucccccgcaagagcuccacgaucaccacgcccccguucagcuccgaggaggagcaggaggacgacgaccugauccgggccuacgccagccccggcccccugcccgugccgccgccccagaacaagggguccuucggcaagaacaccgucaagagcgacgccgacggcaccgaggggagcgagaucgaggacaccgacgacucccccaagcccgcgggcguggccgugaagacccccaccgagaaggucgagaagauguucccccaccgcaagaacgugaacaagccggucgggggcacgaacgugcccgagauguucaucaagaaggaggagcuccaggagcugaagugcgccgacguggaggacgaggacugggacaucagcucccuggaggaggagaucagccucgggaagaaguccggcaaggagcagaaggagcccccgcccgccaagaacgagccccacuucgcccacgugcugaacgcguggggcgccuucaaccccaaggggcccaagggcgaggggcugcaggagaacgagagcuccacccucaagagcucccuggucaccgugaccgacuggagcgacacguccgacguguga

SEQ ID NO: 29464 - RNA, 1314 nt, Artificial Sequence
  derived and/or modified sequence opt1 from E2F1__Homo_sapiens__NP_005216
auggcccuggccggcgcgcccgccgggggcccgugcgcccccgcccucgaggcccugcugggggcgggcgcccuccgccugcuggacagcucccagaucgugaucaucagcgccgcccaggacgcguccgccccccccgccccgaccgggcccgccgcccccgcggccggccccugcgacccggaccuccugcuguucgccaccccccaggccccccggcccacgccgagcgccccccgccccgcgcucggccggcccccggucaagcgccggcuggaccuggagaccgaccaccaguaccucgccgaguccagcgggcccgcccgcggccgggggcgccaccccggcaagggggugaagucccccggcgagaagagccgguacgagaccucccugaaccugaccacgaagcgcuuccucgagcugcugagccacuccgccgacggcguggucgaccucaacugggccgcggaggugcugaaggugcagaagcggcgcaucuacgacaucaccaacguccuggaggggauccagcucaucgccaagaagagcaagaaccacauccaguggcugggcucccacaccaccgugggggugggcggccggcuggaggggcucacgcaggaccugcgccagcugcaggagagcgagcagcagcucgaccaccugaugaacaucugcaccacccagcugcggcuccuguccgaggacaccgacagccagcgccuggccuacgucacgugccaggaccuccgguccaucgccgacccggccgagcagauggugauggugaucaaggcgccccccgagacccagcugcaggccgucgacagcuccgagaacuuccagaucagccugaagagcaagcagggccccaucgacguguuccucugcccggaggagaccguggggggcaucucccccgggaagacccccagccaggaggucacguccgaggaggagaaccgcgccaccgacagcgccaccaucgugucccccccgcccagcucccccccgagcucccugaccacggaccccagccagucccugcucagccuggagcaggagccccugcucucccggaugggcagccugcgcgcgcccguggacgaggaccggcuguccccgcucgucgccgccgacagccugcuggagcacgugcgcgaggacuucuccggccuccugcccgaggaguucaucagccugucccccccccacgaggcccuggacuaccacuucgggcucgaggagggcgaggggauccgcgaccuguucgacugcgacuucggcgaccugaccccgcucgacuucuga

SEQ ID NO: 29465 - RNA, 1005 nt, Artificial Sequence
  derived and/or modified sequence opt1 from E2F3__Homo_sapiens__NP_001230005
augccccugcagcagcaggccaagcgccggcucgagcugggcgagagcgggcaccaguaccuguccgacggccucaagaccccgaaggggaagggccgcgccgcgcugcggagccccgacucccccaagaagaagacccgcuacgacacgagccuggggcuccugaccaagaaguucauccagcugcucucccagagccccgacggcgugcuggaccugaacaaggccgccgagguccucaaggugcagaagcggcgcaucuacgacaucaccaacgugcuggagggcauccaccugaucaagaagaaguccaagaacaacguccaguggauggggugcagccucuccgaggacggcgggaugcuggcccagugccagggccugagcaaggaggugaccgagcucucccaggaggagaagaagcuggacgagcugauccagagcugcacgcucgaccugaagcugcucaccgaggacuccgagaaccagcggcuggccuacgugaccuaccaggacauccgcaagaucagcgggcugaaggaccagaccgucaucguggugaaggcgccgcccgagacgcggcucgagguccccgacuccaucgagagccugcagauccaccuggccuccacccagggccccaucgagguguaccucugcccggaggagaccgagacccacagccccaugaagacgaacaaccaggaccacaacggcaacauccccaagcccgccuccaaggaccuggccagcaccaacagcgggcacuccgacugcagcguguccaugggcaaccugagcccgcucgcgucccccgccaaccugcugcagcagaccgaggaccagauccccagcaaccucgaggggcccuucgucaaccugcugccgccccuccugcaggaggacuaccugcucucccugggcgaggaggagggcaucagcgaccuguucgacgccuacgaccucgagaagcugccccugguggaggacuucaugugcuccuga

SEQ ID NO: 29466 - RNA, 1242 nt, Artificial Sequence
  derived and/or modified sequence opt1 from E2F4__Homo_sapiens__NP_001941
auggccgaggccggcccccaggcgccgcccccgcccgggacccccagccgccacgagaagucccugggccuccugaccacgaaguucgugagccugcuccaggaggccaaggacgggguccuggaccugaagcucgccgccgacacccuggccgugcggcagaagcgccggaucuacgacaucaccaacgugcuggagggcaucgggcucaucgagaagaaguccaagaacagcauccaguggaagggcgucggccccgggugcaacacccgcgagaucgcggacaagcugaucgagcugaaggccgagaucgaggagcuccagcagcgggagcaggagcuggaccagcacaaggugugggugcagcaguccauccgcaacgucacggaggacgugcagaacagcugccuggccuacgugacccacgaggacaucugccggugcuucgccggcgacacccuccuggcgauccgcgcccccuccgggaccagccuggagguccccauccccgagggccucaacgggcagaagaaguaccagauccaccugaaguccgugagcggccccaucgaggugcugcucgucaacaaggaggccugguccagcccgcccguggccgugcccgucccgccgcccgaggaccugcugcagucccccagcgccguguccacgcccccgccccuccccaagcccgcgcuggcccagagccaggaggccucccggcccaacagcccccagcugacccccaccgccgugcccggcuccgccgagguccaggggauggcgggccccgccgccgagaucaccgugagcgggggccccggcacggacagcaaggacuccggggagcucagcucccugccgcugggccccaccacccucgacacccgcccccugcagagcuccgcccugcucgacagcuccagcuccagcuccagcuccagcuccagcuccagcaacuccaacagcagcuccagcuccgggccgaaccccagcacguccuucgagcccaucaaggccgaccccaccggcgugcuggagcugccgaaggagcucagcgagaucuucgaccccacccgggagugcauguccagcgagcugcuggaggagcucauguccagcgaggucuucgcgccccugcugcgccucagcccgccgcccggggaccacgacuacaucuacaaccuggacgaguccgagggcgugugcgaccuguucgacgugcccguccucaaccuguga

SEQ ID NO: 29467 - RNA, 1038 nt, Artificial Sequence
  derived and/or modified sequence opt1 from E2F5__Homo_sapiens__NP_001077057
auggccgccgcggagcccgccagcuccggccagcaggccccggccgggcagggccaggggcagcgcccccccccccagccgccccaggcccaggcgccccagcccccgccccccccccagcugggcggggccggcggcgggagcucccggcacgagaagagccucggccugcugaccaccaaguucgugucccuccugcaggaggccaaggacgggguccuggaccucaaggccgcggccgacacgcuggccgugcgccagaagcggcgcaucuacgacaucaccaacgugcuggagggcaucgaccucaucgagaagaagagcaagaacuccauccaguggaagggggucggcgccggcugcaacaccaaggaggugaucgaccggcugcgcuaccugaaggccgagaucgaggaccucgagcugaaggagcgggagcuggaccagcagaagcucuggcugcagcagagcaucaagaacgugauggacgacuccaucaacaaccgcuucagcuacgucacccacgaggacaucugcaacugcuucaacggggacacgcugcucgcgauccaggccccguccggcacccagcuggaggugcccauccccgagauggggcagaacggccagaagaaguaccagaucaaccugaagagccacuccggccccauccacgugcuccugaucaacaaggagagcuccagcuccaagccggucguguuccccgugccccccccggacgaccugacccagcccagcucccagagccucacccccgucacgccccagaagagcuccauggccacccagaaccugccggagcagcacgugagcgagcggucccaggcccugcagcagaccagcgccaccgacaucuccagcggguccaucagcggcgacaucaucgacgagcucauguccagcgacguguucccccugcugcgccucucccccacgcccgcggacgacuacaacuucaaccuggacgacaacgagggggucugcgaccuguucgacgugcagauccucaacuacuga

SEQ ID NO: 29468 - RNA, 750 nt, Artificial Sequence
  derived and/or modified sequence opt1 from E2F6__Homo_sapiens__NP_001265204
augaaccccagcccguccaagauccgcaucaaccuggaggacaacgugcaguacgucagcaugcggaaggcccucaaggugaagcgcccccgguucgacgugucccuggucuaccugacccgcaaguucauggaccucgugcggagcgcccccggcgggauccuggaccugaacaagguggccaccaagcucggcguccgcaagcggcgcguguacgacaucacgaacgugcuggacgggaucgaccuggucgagaagaaguccaagaaccacauccgguggaucggcagcgaccucuccaacuucggggccgugccccagcagaagaagcugcaggaggagcugagcgaccucuccgccauggaggacgcccuggacgagcugaucaaggacugcgcccagcagcuguucgagcucaccgacgacaaggagaacgagcgccuggcguacgugaccuaccaggacauccacagcauccaggccuuccacgagcagaucgucaucgccgugaaggccccggcggagacccggcucgacgugcccgcgccccgcgaggacuccaucacgguccacauccggagcaccaacggccccaucgacguguaccugugcgagguggagcagggccagaccuccaacaagcgcagcgagggggucggcaccuccagcuccgagagcacgcacccggaggggcccgaggaggaggagaacccccagcaguccgaggagcugcucgaggugagcaacuga

SEQ ID NO: 29469 - RNA, 2736 nt, Artificial Sequence
  derived and/or modified sequence opt1 from E2F7__Homo_sapiens__NP_976328
auggaggugaacugccugacccucaaggaccugaucagcccccgccagccgcggcuggacuucgccgucgaggacggcgagaacgcccagaaggagaacaucuucguggaccgcucccggauggcgcccaagacccccaucaagaacgagcccaucgaccucagcaagcagaagaaguucacgccggagcgcaaccccaucacccccgugaaguucgucgaccggcagcaggccgagcccuggaccccgaccgccaaccugaagaugcugaucuccgccgccagccccgacauccgcgaccgggagaagaagaagggccucuuccgccccaucgagaacaaggacgacgcguucacggacucccugcagcuggacguggugggggacagcgccgucgacgaguucgagaagcagcggcccucccgcaagcagaagucccucgggcugcugugccagaaguuccucgcccgguacccgagcuacccccugagcaccgagaagaccaccaucucccuggacgagguggccgugagccucggcgucgagcgccggcgcaucuacgacaucgugaacgugcuggagucccugcaccucgucagccggguggcgaagaaccaguacggguggcacggccgccacucccugcccaagacgcugcggaaccuccagcgccugggcgaggagcagaaguacgaggagcagauggccuaccugcagcagaaggagcucgaccugaucgacuacaaguucggggagcggaagaaggacggcgaccccgacagccaggagcagcagcugcucgacuucuccgagccggacugccccagcuccagcgccaacagccgcaaggacaagucccugcggaucaugagccagaaguucgugaugcuguuccucgucuccaagaccaagaucgugacccuggacguggccgccaagauccugaucgaggagagccaggacgcgcccgaccacuccaaguucaagaccaagguccgccgccucuacgacaucgccaacgugcugacgagccuggcccucaucaagaaggugcacgucaccgaggagcgggggcgcaagcccgccuucaaguggaucggcccgguggacuucuccagcuccgacgaggagcugguggacgucagcgccuccgugcugcccgagcucaagcgggagaccuacgggcagauccaggucugcgcgaagcagaagcuggcccgccacggcagcuucaacaccgugcaggccuccgagcggauccagcgcaaggugaacagcgagcccuccagccccuaccgggaggagcagggcuccgggggcuacagccuggagaucgggucccucgccgccgucuaccgccagaagaucgaggacaacagccagggcaaggcguucgccagcaagcggguggugccgcccuccagcucccuggaccccgucgcccccuucccggugcugagcguggaccccgaguacugcgucaacccccucgcccacccgguguucuccguggcccagacggaccugcaggcguucagcaugcagaacggccugaacgggcaggucgacgugucccucgccagcgccgccuccgcgguggagagccugaagcccgcccugcuggccggccagccccucgucuacgugcccuccgccagccuguucaugcuguacgggucccuccaggagggcccggccagcggguccggcagcgagcgcgacgaccgguccagcgaggcgcccgccaccguggagcugagcuccgcccccagcgcccagaagcgccugugcgaggagcggaagccccaggaggaggacgagccggccaccaagcgccagucccgggaguacgaggacggcccccucagccuggucaugcccaagaagcccuccgacagcaccgaccuggcguccccgaagacgauggggaaccgcgccagcaucccccucaaggacauccacgugaacggccagcugcccgccgccgaggagaucuccgggaaggccaccgcgaacagccugguguccagcgaguggggcaaccccucccggaacaccgacgucgagaagccgagcaaggagaacgaguccaccaaggagcccagccuccugcaguaccugugcgugcagucccccgccgggcucaacggcuucaacgugcugcugagcggcucccagacgcccccgaccgucgggcccagcagcggccagcuccccuccuucagcgugcccugcauggugcugccguccccgccccuggggcccuuccccguccucuacagccccgccaugcccggcccgguguccagcacccugggggcccugcccaacaccggccccgugaacuucucccuccccggccuggggagcaucgcgcagcugcucgucggcccgacggccguggugaaccccaaguccagcacccugcccuccgccgacccccagcugcagagccagccgucccucaaccugagccccgucaugucccgcagccacuccguggugcagcagcccgagagccccgucuacguggggcacccgguguccgucgugaagcugcaccagagccccgugcccgucacccccaagagcauccagcggacccaccgcgagacguucuucaagaccccgggcucccucggcgaccccgugcugaagcgccgggagcgcaaccagagccggaacaccuccagcgcccagcgccggcuggagauccccuccgggggcgccgacuga

SEQ ID NO: 29470 - RNA, 2604 nt, Artificial Sequence
  derived and/or modified sequence opt1 from E2F8__Homo_sapiens__NP_078956
auggagaacgagaaggagaaccuguucugcgagccccacaagcgcggccucaugaagaccccgcugaaggagagcaccacggccaacaucgugcuggccgagauccagcccgacuucgggccccucaccacccccaccaagccgaaggagggcucccagggggagcccuggacgcccaccgcgaaccugaagaugcugaucagcgccgucucccccgagauccggaaccgcgaccagaagcggggccucuucgacaaccgcagcgggcugccggaggccaaggacugcauccacgagcaccuguccggcgacgaguucgagaagucccagcccucccggaaggagaagucccucggccugcugugccacaaguuccucgcccgcuaccccaacuaccccaacccggccgugaacaacgacaucugccuggacgagguggcggaggagcugaacgucgagcggcgccggaucuacgacaucgugaacgugcucgagagccugcacauggucagccgccuggccaagaaccgguacaccuggcacgggcgccacaaccucaacaagacccugggcacgcugaaguccaucggggaggagaacaaguacgccgagcagaucaugaugaucaagaagaaggaguacgagcaggaguucgacuucaucaagagcuacuccaucgaggaccacaucaucaagagcaacaccggccccaacgggcaccccgacaugugcuucguggagcuccccggcguggaguuccgggccgcguccgucaacagccgcaaggacaagucccugcgggugaugagccagaaguucgugaugcuguuccucgucuccaccccgcagaucgugagccuggagguggccgccaagauccugaucggcgaggaccacgucgaggaccucgacaagagcaaguucaagaccaagauccgccggcuguacgacaucgccaacgugcuguccagccucgaccugaucaagaaggugcacgucacggaggagcgcgggcggaagcccgccuucaaguggaccggccccgagaucucccccaacaccagcggguccagcccggugauccacuucacccccuccgaccuggaggugcgccggagcuccaaggagaacugcgcgaagaaccucuucagcacgcgcggcaagcccaacuucacccgccaccccucccugaucaagcuggucaagagcaucgaguccgaccggcgcaagaucaacagcgccccguccagccccaucaagaccaacaaggccgaguccagccagaacuccgcccccuuccccagcaagauggcccagcucgcggccaucugcaagaugcagcuggaggagcagagcuccgagagccggcagaaggugaaggugcagcuggcccgcuccggcccgugcaagcccgucgcgccccucgacccgcccgugaacgccgagauggagcugaccgcccccagccugauccagccccucgggauggucccgcugauccccagcccccugagcuccgccgugccccucauccugccgcaggcccccagcggccccuccuacgccaucuaccugcagcccacgcaggcccaccagagcgugaccccgccccaggggcucucccccaccgucugcaccacgcacagcuccaaggcgaccggcagcaaggacuccaccgacgccaccacggagaaggccgccaacgacaccagcaaggcguccgccagcacccggcccgggagccugcugccggcccccgagcgccagggcgccaagucccggacccgcgagcccgccggcgagcgggggagcaagcgcgcguccaugcuggaggacagcggcuccaagaagaaguucaaggaggaccucaaggggcuggagaacgugagcgccacgcuguuccccuccggcuaccucaucccgcugacccagugcagcucccugggggccgagagcauccucuccggcaaggagaacagcuccgcccugagccccaaccaccggaucuacuccagccccaucgccggcgugauccccgucaccuccagcgagcugaccgcggugaacuucccguccuuccacgugacgccccucaagcugauggucagccccaccagcguggccgccgugccggucgggaacucccccgcccuggccagcucccaccccgugcccauccagaacccgagcuccgcgaucgugaacuucacccuccagcaccugggccugaucagccccaacguccagcucuccgccagccccggguccggcaucgugcccgugagcccgcgcaucgaguccgucaacguggcccccgagaacgccgggacccagcagggccgggcgaccaacuacgacagccccgugcccggccagucccagccgaacgggcagagcgucgccgugacgggcgcccagcagcccgugcccgucacccccaaggggucccagcugguggccgagagcuucuuccgcaccccgggcggccccaccaagcccacguccagcuccugcauggacuucgagggggccaacaagaccagccugggcacccucuucgugccccagcggaagcuggaggucagcaccgaggacgugcacuga

SEQ ID NO: 29471 - RNA, 2355 nt, Artificial Sequence
  derived and/or modified sequence opt1 from E4F1__Homo_sapiens__NP_004415
auggagggcgccauggccgugcgcgucaccgcggcccacaccgccgaggcccaggccgaggcggggcgggaggccggcgagggggccguggccgcgguggccgccgcccuggcccccagcggcuuccucgggcugccggcgcccuucuccgaggaggacgaggacgacguccaccgcugcggccggugccaggccgaguucacggcccuggaggacuucgugcagcacaagauccagaaggccugccagcgcgccccgcccgaggcgcuccccgccacccccgccaccaccgcccugcugggccaggaggugguccccgccgcgcccgggccggaggagcccaucacgguggcccacaucguggucgaggccgccagccucgccgcggacaucucccacgccagcgaccuggugggcgggggccacaucaaggaggugaucgucgccgccgaggcggagcugggggacggcgagauggccgaggcccccggcagcccccaccagcaggggcucggccuggccggggagggcgagcaggcccaggugaagcugcucgugaacaaggacggccgguacgucugcgcgcugugccacaagaccuucaagaccggguccauccugaaggcccacauggugacccacuccagccgcaaggaccacgagugcaagcucugcggcgccuccuuccggacgaaggggagccugauccgccaccaccggcgccacaccgacgagcggccguacaagugcuccaagugcggcaagagcuuccgcgaguccggggcccugacccggcaccucaagagccugacccccugcacggagaagauccgcuucuccgugagcaaggacgucgugguguccaaggaggacgcccgggcgggcagcggcgccggggccgccggccuggggaccgccaccuccagcgucaccggcgagcccaucgagacgagccccgugauccaccucgugaccgacgcgaaggggaccgucauccacgaggugcacguccagaugcaggagcugucccugggcaugaaggcccucgccccggagccgcccgugagccaggagcugcccugcuccagcgagggcucccgcgagaaccugcuccaccaggccaugcagaacagcgggaucgugcuggagcgggcggccggcgaggagggggcccuggagcccgcccccgccgcgggcuccagcccccagccccucgccgucgccgccccgcagcugcccgugcuggaggugcagccccucgagacccaggucgccuccgaggcgagcgccgugccccgcacgcacccgugcccccagugcuccgagaccuuccccaccgccgccacccuggaggcccacaagcgggggcacacgggcccgcgccccuucgcgugcgcccagugcggcaaggccuuccccaaggccuaccugcucaagaagcaccaggaggugcacguccgggagcgccgcuuccggugcggggacugcggcaagcuguacaagaccaucgcgcacgugcgcgggcaccggcgcgugcacagcgacgagcggcccuacccgugccccaagugcggcaagcgcuacaagaccaagaacgcccagcagguccacuuccggacccaccuggaggagaagccccacgugugccaguucugcucccgcggcuuccgggagaaggggagccucgugcgccacguccggcaccacacgggcgagaagcccuucaagugcuacaagugcgggcgcggcuucgccgagcacgggacccugaaccggcaccuccgcaccaagggcggcugccugcuggagguggaggagcugcucguguccgaggacagcccggccgccgcgaccacgguccugaccgaggacccccacaccgugcugguggaguucuccagcgucguggccgacacccaggaguacaucaucgaggccacggccgacgacgccgagaccuccgaggcgaccgagaucaucgaggggacccagaccgagguggacagccacaucaugaaggucgugcagcagaucgugcaccaggccagcgccggccaccagaucaucguccagaacgugacgauggacgaggagaccgcccucgggcccgaggccgcggccgccgacaccaucaccaucgccacgcccgagucccugaccgagcaggucgccaugacccuggcgagcgccaucuccgagggcaccgugcuggccgcccgggcggggacgagcggcaccgagcaggccaccgugaccaugguguccagcgaggacaucgagauccucgagcacgccggcgagcuggucaucgccuccccggaggggcagcuggaggugcagacggugaucgucuga

SEQ ID NO: 29472 - RNA, 807 nt, Artificial Sequence
  derived and/or modified sequence opt1 from EAF1__Homo_sapiens__NP_149074
augaacggcaccgccaacccccugcucgaccgcgaggagcacugccugcggcugggggagagcuucgagaagcgcccgcgggccuccuuccacaccauccgcuacgacuucaagcccgcgagcaucgacacguccugcgagggcgagcuccagguggggaagggcgacgaggucaccaucacccugccccacauccccgggagcaccccgcccaugacgguguucaagggcaacaagcggcccuaccagaaggacugcgugcugaucaucaaccacgacaccggcgaguacguccucgagaagcuguccagcuccauccaggugaagaagacccgcgccgaggggagcuccaagauccaggcccggauggagcagcagcccacccgcccgccccagacgagccagcccccgcccccgcccccgcccaugcccuuccgggcccccaccaagcccccggugggccccaagaccagcccccugaaggacaaccccuccccggagccccagcucgacgacaucaagcgcgagcugcgggccgaggucgacaucaucgagcagauguccagcuccagcggguccagcuccagcgacagcgaguccagcuccggcagcgacgacgacuccagcuccagcgggggcgaggacaacggccccgcguccccgccccagcccagccaccagcagcccuacaacucccgccccgccguggccaacgggaccagccggccccagggcuccaaccagcugaugaacacgcuccgcaacgaccugcagcugagcgaguccgggagcgacuccgacgacuga

SEQ ID NO: 29473 - RNA, 783 nt, Artificial Sequence
  derived and/or modified sequence opt1 from EAF2__Homo_sapiens__NP_060926
augaacagcgccgccggcuucucccaccuggaccgccgggagcgcgugcucaagcugggggagagcuucgagaagcagccccggugcgcguuccacaccguccgcuacgacuucaagccggccuccaucgacaccagcuccgagggcuaccuggaggugggggagggcgagcaggucacgaucacccuccccaacaucgaggggagcaccccgcccgugaccguguucaagggcuccaagaagcccuaccugaaggagugcauccugaucaucaaccacgacacgggcgagugccggcucgagaagcugagcuccaacaucaccgugaagaagacccgcgucgaggggagcuccaagauccaguaccggaaggagcagcagcagcagcagauguggaacagcgcccgcacccccaaccuggugaagcacucccccagcgaggacaagaugucccccgccagcccgaucgacgacaucgagcgggagcucaaggccgaggcgucccugauggaccagaugagcuccugcgacagcagcuccgacagcaaguccagcuccagcuccagcuccgaggacagcuccagcgacuccgaggacgaggacugcaagagcuccacgagcgacaccggcaacugcguguccgggcaccccaccaugacccaguaccgcauccccgacaucgacgccagccacaaccgguuccgcgacaacuccggccugcucaugaacacgcugcggaacgaccugcagcucagcgagagcggguccgacagcgacgacuga

SEQ ID NO: 29474 - RNA, 1572 nt, Artificial Sequence
  derived and/or modified sequence opt1 from EARS2__Homo_sapiens__NP_001077083
auggccgcccugcuccgccggcugcugcagcgcgagcggcccagcgcggccuccggccgcccgguggggcggcgcgaggccaaccucggcaccgacgccggggucgccgugcgggugcgcuucgcgcccagccccaccggcuuccugcaccucgggggccugcggacggcccuguacaacuacaucuucgccaagaaguaccagggcuccuucauccugcgccucgaggacaccgaccagacccgggucgugcccggggccgcggagaacaucgaggacaugcuggagugggccggcaucccgcccgacgagagcccccgccgcgggggccccgccgggccguaccagcagucccagcggcuggagcucuacgcccaggccaccgaggcgcugcugaagacgggcgccgccuaccccugcuucugcagcccccagcggcucgagcugcugaagaaggaggcccuccgcaaccaccagacgccccgguacgacaaccgcugccggaacaugucccaggagcaggucgcccagaagcuggcgaaggacccgaagcccgccauccgcuuccggcuggagcaggucgugcccgccuuccaggaccucguguacggcuggaaccgccacgagguggccagcguggagggggaccccgugaucaugaaguccgacggcuucccgaccuaccaccuggccugcgucguggacgaccaccacauggggaucagccacgugcugcgcggcuccgaguggcucgucagcaccgcgaagcaccuccugcuguaccaggcccugggcuggcagccgccccacuucgcccaccucccccugcugcugaaccgggacggguccaagcucagcaagcgccagggcgacguguuccuggagcacuucgccgccgacggguuccugcccgacucccuccuggacaucaucaccaacugcggcagcggguucgcggagaaccagaugggccggacccugcccgagcucaucacccaguucaaccugacccaggugacgugccacuccgcccugcucgaccuggagaagcugcccgaguucaaccgccuccaccuccagcggcuggucagcaacgagucccagcgccggcagcuggugggcaagcuccaggugcuggucgaggaggccuucgggugccagcugcagaaccgcgacgugcugaaccccguguacgucgagcggauccugcugcuccgccagggccacaucugccggcugcaggaccuggugagcccggucuacagcuaccucuggacccgccccgccguggggcgggcgcagcuggacgccaucuccgagaagguggacgucaucgccaagcgcgugcugggccuccuggagcggagcuccaugagccugacccaggacaugcucaacggggagcugaagaagcuguccgagggccucgagggcaccaaguacagcaacgugaugaagcugcugcgcauggcccucuccgggcagcagcagggcccgcccgucgccgagaugaugcuggcgcuggggcccaaggaggugcgggagcgcauccagaagguggucagcuccuga

SEQ ID NO: 29475 - RNA, 642 nt, Artificial Sequence
  derived and/or modified sequence opt1 from EBAG9__Homo_sapiens__NP_001265867
auggccaucacccaguuccgccuguucaaguucugcacgugccucgccaccguguucagcuuccugaagcggcugaucugccgcuccggccgggggcgcaagcucagcggcgaccagaucacccugcccaccaccgucgacuacuccagcgugccgaagcagacggacguggaggaguggaccuccugggacgaggacgcgcccaccagcgucaagaucgagggcgggaacgggaacguggccacccagcagaacucccuggagcagcucgagcccgacuacuucaaggacaugacgcccaccauccggaagacccagaagaucgugaucaagaagcgcgagccgcugaacuucggcauccccgacggcagcaccggguucuccagccggcuggccgccacgcaggaccuccccuucauccaccaguccagcgagcugggcgaccuggacaccuggcaggagaacaccaacgccugggaggaggaggaggacgcggccuggcaggccgaggagguccuccgccagcagaagcuggccgaccgggagaagcgcgcggccgagcagcagcggaagaagauggagaaggaggcccagcgccugaugaagaaggagcagaacaagaucggggugaagcucuccuga

SEQ ID NO: 29476 - RNA, 1776 nt, Artificial Sequence
  derived and/or modified sequence opt1 from EBF1__Homo_sapiens__NP_076870
auguucggcauccaggagagcauccagcgcuccgggagcuccaugaaggaggagccccugggcagcgggaugaacgccguccggaccuggaugcagggcgccgggguccucgacgcgaacaccgccgcccaguccggcgugggccuggcccgcgcccacuucgagaagcagccgcccagcaaccugcggaaguccaacuucuuccacuucgugcucgcgcuguacgaccgccaggggcagcccgucgagaucgagcggacggccuucgugggcuucguggagaaggagaaggaggccaacagcgagaagaccaacaacgggauccacuaccgccugcagcuccuguacuccaacggcauccggaccgagcaggacuucuacguccgccugaucgacagcaugaccaagcaggccaucguguacgaggggcaggacaagaaccccgagaugugccgggugcuccugacgcacgagaucaugugcucccgcugcugcgacaagaaguccugcggcaaccggaacgagaccccgagcgaccccgucaucaucgaccgcuucuuccugaaguucuuccucaagugcaaccagaacugccugaagaacgcgggcaacccccgggacaugcgccgguuccaggugguggucagcaccaccgugaacguggacgggcacguccuggccguguccgacaacauguucgugcacaacaacagcaagcacggccgccgggcccgccggcucgaccccuccgaggggacgcccagcuaccuggagcacgccacccccugcaucaaggccaucucccccagcgagggcuggaccaccggcggggcgacggucaucaucaucggcgacaacuucuucgacgggcuccaggugaucuucggcaccaugcugguguggagcgagcugaucacgccccacgccauccgcguccagaccccgccccggcacauccccggggugguggaggucacccuguccuacaagagcaagcaguucugcaagggcacccccggccgcuucaucuacaccgcccucaacgagccgaccaucgacuacggguuccagcgccugcagaaggugaucccccggcaccccggcgaccccgagcgccugccgaaggaggucauccucaagcgggccgccgaccugguggaggcgcuguacgggaugccccacaacaaccaggagaucauccucaagcgcgccgccgacaucgccgaggcccuguacuccgugccccggaaccacaaccagcugcccgcgcucgccaacacgagcguccacgccggcaugaugggggugaacuccuucagcggccagcuggccgugaacgucuccgaggccagccaggcgaccaaccagggcuucacccgcaacuccagcuccgugagcccgcacggguacgugcccuccaccacgccccagcagaccaacuacaacagcgucaccaccuccaugaacggcuacgggagcgccgccauguccaaccugggcgggagccccacguuccucaacggcuccgccgcgaacagcccguacgccaucgugcccagcucccccaccauggccagcuccaccagccugccguccaacugcagcuccagcuccggcaucuucagcuucucccccgccaacauggugagcgccgucaagcagaaguccgcguucgcccccguggugcggccccagaccagcccgccgcccacgugcaccuccaccaacgggaacagccugcaggccaucuccggcaugaucgugccgcccauguga

SEQ ID NO: 29477 - RNA, 1728 nt, Artificial Sequence
  derived and/or modified sequence opt1 from EBF2__Homo_sapiens__NP_073150
auguucggcauccaggacacccuggggcgcggccccacccucaaggagaagucccugggggccgagauggacuccgugcggagcuggguccgcaacgugggcguggucgacgccaacguggcggcccaguccgggguggcccugagccgggcccacuucgagaagcagccgcccuccaaccuccgcaagagcaacuucuuccacuucguccuggcccuguacgaccggcagggccagcccguggagaucgagcgcacggcguucguggacuucgucgagaacgacaaggagcagggcaacgagaagaccaacaacgggacccacuacaagcuccagcugcuguacuccaacggcgugcggaccgagcaggaccucuacgugcgccugaucgacagcgucacgaagcagcccaucgccuacgaggggcagaacaagaacccggagaugugccgggugcugcucacccacgaggugaugugcucccgcugcugcgagaagaaguccugcggcaaccggaacgagacccccagcgaccccgucaucaucgaccgcuucuuccugaaguucuuccugaagugcaaccagaacugccucaagaccgccgggaacccccgggacaugcgccgguuccagguggugcugagcacgaccgucaacguggacggccacgugcuggccgucuccgacaacauguucgugcacaacaacagcaagcacggccgccgggcgcgccggcucgacccguccgaggccacccccugcaucaaggccaucagccccuccgagggguggaccacgggcggggccauggugaucaucaucggcgacaacuucuucgacggccugcaggucguguucgggaccaugcuggucuggagcgagcucaucacgccccacgccauccgcgugcagaccccgccccggcacauccccggcguggucgaggugacccuguccuacaagagcaagcaguucugcaagggggcgcccggccgcuucaucuacaccgcccugaacgagccgaccaucgacuacggguuccagcgccuccagaaggugaucccccggcaccccggcgaccccgagcgccuggccaaggagaugcugcucaagcgggccgccgaccuggucgaggcgcuguacggcaccccgcacaacaaccaggacaucauccucaagcgcgccgccgacaucgccgaggcccuguacagcgugccccggaaccccucccagcugcccgcgcucagcuccagcccggcccacuccgggaugaugggcaucaacagcuacgggucccagcugggcgugagcaucuccgagagcacgcaggggaacaaccagggcuacauccgcaacaccuccagcaucagcccccggggcuacagcuccagcuccacgccccagcagagcaacuacuccaccagcagcaacuccaugaacggguacagcaacguccccauggccaaccugggcgugccggggucccccggcuuccucaacgggagccccaccggcuccccguacggcaucaugagcuccagccccaccgugggguccagcuccaccagcuccauccugcccuucagcuccagcgucuuccccgccgugaagcagaaguccgccuucgcgccggugauccgcccccagggcagccccagccccgccugcuccagcgggaacggcaacggcuuccgggccaugaccgggcuggucgugccgcccauguga

SEQ ID NO: 29478 - RNA, 1656 nt, Artificial Sequence
  derived and/or modified sequence opt1 from EBF3__Homo_sapiens__NP_001005463
auguucggcauccaggagaacaucccccgcgggggcaccaccaugaaggaggagccccuggggagcggcaugaaccccgugcgguccuggaugcacacggccggggucguggacgccaacaccgcggcccagagcggcgugggccucgcccgcgcccacuucgagaagcagccgcccuccaaccugcgcaagagcaacuucuuccacuucguccuggcccucuacgaccggcaggggcagcccguggagaucgagcggaccgcguucguggacuucgucgagaaggagaaggagcccaacaacgagaagaccaacaacggcauccacuacaagcugcagcugcucuacuccaacggggugcgcacggagcaggaccuguacgugcggcugaucgacagcaugaccaagcaggccaucgucuacgagggccaggacaagaaccccgagaugugccgcgugcuccugacccacgagaucaugugcucccggugcugcgacaagaaguccugcgggaaccgcaacgagacccccuccgacccggugaucaucgaccgguucuuccugaaguucuuccucaagugcaaccagaacugccugaagaacgccggcaacccccgcgacaugcggcgcuuccaggucguggugagcacgaccgucaacguggacggccacgugcuggccgucuccgacaacauguucgugcacaacaacagcaagcacgggcggcgcgcgcggcgccucgaccccuccgaggccacccccugcaucaaggccaucagcccguccgagggcuggaccaccgggggcgccaccgugaucaucaucggcgacaacuucuucgacgggcugcaggucguguucggcaccaugcugguguggagcgagcucaucacgccccacgccauccggguccagacgccgccccgccacauccccgggguggucgaggugacccuguccuacaagagcaagcaguucugcaagggcgcgcccgggcgguucguguacaccgcccugaacgagcccaccaucgacuacggcuuccagcgccuccagaaggucaucccccgccacccgggcgaccccgagcggcugcccaaggaggugcugcucaagcgcgccgccgaccugguggaggcccuguacgggaugccccacaacaaccaggagaucauccucaagcgggcggccgacaucgccgaggcccuguacuccgucccgcgcaaccacaaccagauccccacgcugggcaacaaccccgcccacaccgggaugaugggcgugaacagcuucagcucccagcucgcggugaacgucagcgagaccucccaggccaacgaccaggugggguacagccggaacaccuccagcgugagcccccgcggcuacgucccgagcuccacgccccagcagagcaacuacaacaccguguccaccagcaugaacggcuacggguccggcgccauggccagccugggggugcccggcuccccgggguuccugaacggcagcuccgccaacagccccuacggcaugaagcagaaguccgcguucgcccccgucgugcggccccaggccagcccgccgcccagcugcaccuccgccaacgggaacggccuccaggcgaugagcgggcugguggucccgcccauguga

SEQ ID NO: 29479 - RNA, 1797 nt, Artificial Sequence
  derived and/or modified sequence opt1 from EBF4__Homo_sapiens__NP_001103984
auggacgcccugccccgcagcggccucaaccugaaggaggagccgcugcuccccgccgggcugggcuccgugcggagcuggaugcagggggcgggcauccuggacgccuccaccgccgcccagagcggggucggccucgcccgcgcgcacuucgagaagcagccgcccuccaaccugcgcaagagcaacuucuuccacuucgugcuggccauguacgaccggcagggccagcccguggaggucgagcggaccgccuucaucgacuucguggagaaggaccgcgagcccggggccgagaagacgaacaacggcauccacuaccggcuccgccugguguacaacaacgggcugcggaccgagcaggaccucuacguccgccugaucgacuccaugagcaagcaggcgaucaucuacgagggccaggacaagaaccccgagaugugccgggugcugcucacccacgagaucaugugcucccgcugcugcgaccgcaagagcugcgggaaccggaacgagacccccuccgacccggugaucaucgaccgguucuuccugaaguucuuccugaagugcaaccagaacugccucaagaacgccggcaacccccgcgacaugcggcgcuuccaggucguggugagcacgaccgucuccguggacggccacgugcuggccgucagcgacaacauguucgugcacaacaacuccaagcacgggcggcgcgcccggcgccuggaccccagcgaggccgcgacccccugcaucaaggccaucuccccgggcgagggguggaccacgggcggcgccaccgugaucgucaucggggacaacuucuucgacggccuccaggugguguucgggaacguccugguguggagcgagcugaucacgccccacgccauccgcgugcagaccccgccccggcacauccccggcgucguggaggucacccucuccuacaagagcaagcaguucugcaaggggugccccggccgcuucguguacaccgcccugaacgagcccaccaucgacuacggcuuccagcggcugcagaaggugaucccccgccacccgggggaccccgagcggcuccccaaggagguccugcugaagcgcgcggccgaccucgccgaggcccuguacggcgugcccgggagcaaccaggagcugcuccugaagcgggccgcggacguggccgaggcccuguacuccaccccgcgcgcccccggcccccucgcgccccuggccccgagccacccccaccccgccgucguggggaucaacgccuucuccagcccgcuggccaucgcggugggcgacgccacgcccggccccgagcccggguacgcccgguccugcagcuccgccagcccgcgcggcuucgcccccucccccgggagccagcaguccggcuacgggggcggccucggggcgggccucgggggcuacggcgcccccggggucgccggccugggggugccgggcagccccuccuuccugaacgggagcaccgccaccucccccuucgccaucaugcccagcuccccgccccuggcggccgccagcuccaugagccugcccgccgccgcgcccaccacgagcguguucuccuucagcccggucaacaugaucuccgccgugaagcagcggagcgccuucgcccccgugcuccgcccgcccuccagcccgccccaggcgugcccccgggcccacggcgagggccugcccgaccaguccuucgaggacagcgacaaguuccacucccccgcccgcgggcugcagggccucgccuacagcuga

SEQ ID NO: 29480 - RNA, 690 nt, Artificial Sequence
  derived and/or modified sequence opt1 from EBI3__Homo_sapiens__NP_005746
augacgccccagcugcuccuggcccuggugcucugggccagcugcccgcccugcuccggccgcaaggggccgcccgcggcccugacccugccccggguccagugccgcgccagccgguaccccaucgccguggacugcuccuggacccucccgcccgcccccaacagcaccucccccgugagcuucaucgcgaccuaccgccugggcauggccgcccgggggcacuccuggcccugccugcagcagacccccacgagcaccuccugcaccaucaccgacguccagcuguucagcauggccccguacgugcucaacgugacggcgguccaccccuggggcuccagcuccagcuucgugcccuucaucaccgagcacaucaucaagcccgacccgcccgagggggugcgccugagcccccucgccgagcggcagcugcagguccagugggagcccccgggcuccuggcccuuccccgagaucuucucccugaaguacuggauccgcuacaagcggcagggcgccgcccgcuuccaccggguggggcccaucgaggccaccagcuucauccuccgcgcggugcggccgcgcgcccgguacuacguccagguggccgcccaggaccugaccgacuacggcgagcuguccgacuggagccuccccgccacggcgaccaugagccuggggaaguga

SEQ ID NO: 29481 - RNA, 693 nt, Artificial Sequence
  derived and/or modified sequence opt1 from EBP__Homo_sapiens__NP_006570
augaccaccaacgccggcccccugcacccguacuggccccagcaccuccgccuggacaacuucgugcccaacgaccggcccacguggcacauccuggccggccucuucagcgucaccggggugcugguggucaccaccuggcugcucuccgggcgcgcggccguggugccgcugggcacguggcggcgccugagccucugcugguucgccgucugcggguucauccaccuggugaucgagggcugguucgugcuguacuacgaggaccuccugggcgaccaggccuuccugucccagcucuggaaggaguacgccaagggggacagccgguacauccugggcgacaacuucaccgucugcauggagaccaucaccgcgugccugugggggccccucucccuguggguggugaucgccuuccugcgccagcacccccuccgguucauccugcagcuggucgugagcgugggccagaucuacggggacguccucuacuuccugacggagcaccgcgacggcuuccagcacggcgagcuggggcacccccucuacuucugguucuacuucguguucaugaacgcccuguggcuggugcucccgggcguccuggugcuggacgccgugaagcaccucacccacgcgcaguccacccuggacgccaaggccaccaaggccaagagcaagaagaacuga

SEQ ID NO: 29482 - RNA, 405 nt, Artificial Sequence
  derived and/or modified sequence opt1 from EBPL__Homo_sapiens__NP_001265565
augggggccgagugggagcugggggccgaggcgggcgggagccuccugcugugcgccgcccuccuggccgccggcugcgcgcuggggcuccgccugggccggggccagggggccgccgaccgcggcgcccugaucuggcucugcuacgacgcgcuggugcacuucgcccuggaggggcccuucgucuaccucucccuggugggcaacguggccaacagcgacgggcugaucgccucccucuggaaggaguacggcaaggccgacgcgcggugggucuacuucgacccgaccaucgugagcguggagauccugaccgucgcccuggacggcucccucgcccuguuccugaucuacgccaucgugaaggagaaguacuaccgcgaccggguggccuggggcgaguga

SEQ ID NO: 29483 - RNA, 2034 nt, Artificial Sequence
  derived and/or modified sequence opt1 from ECD__Homo_sapiens__NP_001129224
auggaggagaccaugaagcuggccaccauggaggacacgguggaguacugccucuuccugauccccgacgagagccgcgacuccgacaagcacaaggagauccugcagaaguacaucgagcggaucaucacccgcuucgccccgaugcucguccccuacaucuggcagaaccagcccuucaaccugaaguacaagcccggcaagggcggggugccggcgcacauguucggggugaccaaguucggcgacaacaucgaggacgagugguucaucgucuacgugaucaagcagaucaccaaggaguuccccgagcugguggcccggaucgaggacaacgacggggaguuccuccugaucgaggccgccgacuuccugcccaaguggcucgaccccgagaacagcacgaaccgcgucuucuucugccacggcgagcugugcaucaucccggcgccccggaaguccggcgccgagagcuggcugcccaccacgcccccgaccaucccccaggcccucaacaucaucaccgcccacuccgagaagauccuggccagcgaguccauccgcgcggccgugaaccggcgcauccggggguaccccgagaagauccaggccagccugcaccgcgcccacugcuuccuccccgccggcaucguggcgguccugaagcagcggccgcgccugguggccgccgccgugcaggccuucuaccuccgggaccccaucgaccugcgcgcgugccgggucuucaagaccuuccugcccgagacccgcaucaugaccuccgugacguucaccaagugccucuacgcccagcuggugcagcagcgguucguccccgaccgccggagcggguaccgccugccgccgcccuccgacccccaguaccgggcccacgagcucggcaugaagcuggcccacggguucgagauccugugcagcaagugcagcccccacuucuccgacugcaagaagucccucgugaccgccagcccccugugggcguccuuccuggagagccucaagaagaacgacuacuucaagggccugaucgagggcuccgcccaguaccgcgagcgccuggagauggccgagaacuacuuccagcucagcguggacuggcccgagcggcuggagguccaguggcgcgaccccgggcugcuccaggccccgccgcccggcuucacccccuucaucugccugagccugcucuccacgugggacaacagcucccuggccaugagccccggggaggagauccugacccuccugcagaccauccccuucgacaucgaggaccugaagaaggaggcggccaaccugcccccggaggacgacgaccaguggcucgaccugucccccgaccagcucgaccagcugcugcaggaggccgugggcaagaaggagagcgaguccgugagcaaggaggagaaggagcagaacuacgaccugaccgaggucuccgagagcaugaaggccuucaucuccaaggugagcacgcacaagggcgcggagcucccccgggagcccuccgaggccccgaucaccuucgacgccgacagcuuccugaacuacuucgacaagauccuggggccccgccccaacgaguccgacagcgacgaccucgacgacgaggacuucgagugccuggacuccgacgacgaccuggacuucgagacccacgagcccggcgaggaggccagccucaaggggacccuggacaaccugaaguccuacauggcccagauggaccaggagcucgcgcacacgugcaucagcaagagcuucaccacccggaaccagguggagccggucucccagaccacggacaacaacagcgacgaggaggacuccggcaccggggagagcgugauggcccccgucgacguggaccugaaccugguguccaacauccucgagagcuacuccagccaggccggccuggccggccccgccuccaaccugcuccagagcauggggguccagcugcccgacaacaccgaccaccgcccgaccuccaagcccacgaagaacuga

SEQ ID NO: 29484 - RNA, 2211 nt, Artificial Sequence
  derived and/or modified sequence opt1 from ECE2__Homo_sapiens__NP_001032401
augaacguggcccugcaggagcucggcgccgggagcaacgucggcuuccagaaggggacccgccagcugcugggcucccggacccagcucgagcuggugcuggcgggggccagccuccugcuggccgcccuccugcugggcugccucguggcccugggcguccaguaccaccgcgaccccucccacagcacgugccugaccgaggcgugcauccggguggccgggaagauccucgagucccuggaccgcggcgugagcccgugcgaggacuucuaccaguucuccugcgggggcuggauccggcgcaacccccugcccgacgggcggagccgcuggaacaccuucaacucccucugggaccagaaccaggccauccugaagcaccuccuggagaacaccacguucaacagcuccagcgaggccgagcagaagacccagcgguucuaccuguccugccugcaggucgagcgcaucgaggagcucggcgcgcagccccugcgggaccugaucgagaagaucggcggguggaacaucaccggcccgugggaccaggacaacuucauggaggugcucaaggccguggccgggaccuaccgcgccacgcccuucuucaccgucuacaucagcgccgacuccaagagcuccaacagcaacgugauccagguggaccaguccggccuguuccugcccagccgggacuacuaccucaaccgcaccgcgaacgagaagguccugaccgccuaccuggacuacauggaggagcucggcaugcugcucgggggccggcccacgagcacccgcgagcagaugcagcagguccuggagcuggagauccagcuggccaacaucaccgugccgcaggaccagcggcgcgacgaggagaagaucuaccacaagauguccaucagcgagcuccaggcccuggcccccuccauggacuggcuggaguuccucagcuuccugcugagcccccucgagcuguccgacuccgagcccguggugguguacgggauggacuaccugcagcaggucagcgagcucaucaaccggaccgagccguccauccugaacaacuaccugaucuggaaccuggugcagaagacgaccagcucccucgaccgccgguucgagagcgcgcaggagaagcugcuggagacccucuacggcaccaagaaguccugcgugccccgcuggcagacgugcaucagcaacaccgacgacgcccugggguucgcccugggcucccucuucgucaaggccaccuucgaccgccagagcaaggagaucgccgagggcaugaucuccgagauccggaccgcguucgaggaggcccuggggcagcugguguggauggacgagaagacgcgccaggccgccaaggagaaggccgacgcgaucuacgacaugaucggcuuccccgacuucauccucgagcccaaggagcuggacgacguguacgacggguacgagaucagcgaggacuccuucuuccagaacaugcugaaccucuacaacuucagcgccaaggucauggccgaccagcugcggaagccgcccagccgcgaccagugguccaugacgccccagaccgugaacgccuacuaccugcccaccaagaacgagaucgucuucccggcgggcauccuccaggcccccuucuacgcccggaaccaccccaaggcccugaacuucgggggcaucggcguggugauggggcacgagcugacccacgccuucgacgaccagggccgcgaguacgacaaggaggggaaccuccggcccugguggcagaacgagagccuggcggccuuccgcaaccacaccgccugcauggaggagcaguacaaccaguaccaggucaacggcgagcggcugaacgggcgccagacccucggcgagaacaucgccgacaacggcgggcugaaggccgcguacaacgccuacaaggccuggcugcggaagcacggcgaggagcagcagcucccggccguggggcugaccaaccaccagcuguucuucgugggcuucgcccaggucuggugcuccgugcgcacgcccgagagcucccacgagggccucgugaccgacccccacagccccgcgcgguuccgcguccuggggacccuguccaacagccgggacuuccuccgccacuucggcugcccgguggggucccccaugaaccccggccagcugugcgaggugugguga

SEQ ID NO: 29485 - RNA, 2322 nt, Artificial Sequence
  derived and/or modified sequence opt1 from ECEL1__Homo_sapiens__NP_001277716
auggagcccccguacagccugaccgcccacuacgacgaguuccaggaggugaaguacgucucccgcugcggcgccgggggcgcgcgcggggccagccucccgcccggcuucccccugggggccgcccgguccgccaccggcgcgcggagcggccugccccgcuggaaccggcgcgaggugugccuccuguccgggcugguguucgccgccggccucugcgccauccuggcggccaugcuggcccucaaguaccuggggcccgucgccgccggcgggggcgcgugccccgagggcugccccgagcggaaggccuucgcccgcgccgcccgguuccuggcggccaaccucgacgccagcaucgacccgugccaggacuucuacuccuucgccugcgggggcuggcugcgccggcacgccauccccgacgacaagcugacguacgggaccaucgcggccaucggcgagcagaacgaggagcgccuccggcgccugcuggcccggcccggcgggggccccgggggcgccgcccagcgcaaggugcgggcguucuuccgcagcugccucgacaugcgggagaucgagcgccuggggccgcggcccaugcuggaggugaucgaggacugcggcggcugggaccucgggggcgccgaggagcgccccggggucgccgcccgcugggaccugaaccggcugcucuacaaggcgcagggcguguacuccgccgccgcccuguucagccugaccgugucccucgacgaccgcaacagcucccgguacgucauccgcaucgaccaggacgggcugacccugcccgagcggacgcucuaccuggcccaggacgaggacagcgagaagauccuggcggccuaccgcguguucauggagcgggugcucucccugcugggcgccgacgccgucgagcagaaggcccaggagauccuccagguggagcagcagcuggcgaacaucaccgugagcgagcacgacgaccugcgccgggacgucuccagcauguacaacaaggugacccucggccagcugcagaagaucaccccgcaccuccgcuggaaguggcuccuggaccagaucuuccaggaggacuucuccgaggaggaggaggugguccugcucgccacggacuacaugcagcaggucagccagcugauccggagcacgccccaccgcgugcugcacaacuaccucguguggcgggugguggucgugcuguccgagcaccugagcccgcccuuccgcgaggcccugcacgagcucgcccaggagauggagggguccgacaagccccaggagcuggcccgggucugccugggccaggcgaaccgccacuucgggauggcccucggcgcccuguucgugcacgagcacuucagcgccgcguccaaggccaaggugcagcagcuggucgaggacaucaaguacauccucgggcagcggcuggaggagcuggacuggauggacgccgagacccgcgccgccgcgcgggccaagcuccaguacaugauggugauggugggcuaccccgacuuccugcugaagcccgacgccgucgacaaggaguacgaguucgaggugcacgagaagaccuacuucaagaacauccucaacagcauccgcuucuccauccagcugagcgugaagaagauccgccaggaggucgacaaguggcugcugcccccgcaggcccugaacgccuacuaccugcccaacaagaaccagaugguguuccccgcgggcauccuccagcccacccuguacgacccggacuucccccagucccugaacuacgggggcaucgggaccaucaucggccacgagcucacccacggcuacgacgacuggggcgggcaguacgaccggagcgggaaccugcugcacugguggaccgaggccuccuacagccgcuuccuccggaaggccgagugcaucgugcgccuguacgacaacuucacggucuacaaccagcgggugaacggcaagcacacccugggggagaacaucgccgacaugggcggccucaagcuggccuaccacgcguaccagaagugggugcgcgagcacgggcccgagcacccgcugccccggcucaaguacacccacgaccagcuguucuucaucgccuucgcccagaacuggugcaucaagcgccggucccagagcaucuaccugcagguccucaccgacaagcacgcccccgagcacuaccgcgugcugggcuccgugagccaguucgaggaguucgggcgggcguuccacugccccaaggacuccccgaugaaccccgcccacaagugcagcgucugguga

SEQ ID NO: 29486 - RNA, 681 nt, Artificial Sequence
  derived and/or modified sequence opt1 from ECHDC1__Homo_sapiens__NP_001099014
augaugcugcagcuccuggagaaggugaucgagcuggagaacuggaccgagggcaaggggcucaucguccgcggcgccaagaacaccuucagcuccgggagcgaccugaacgccgugaagucccugggcacgcccgaggacgggauggcggugugcauguucaugcagaacacccucacccgguucaugcgccugccgcugaucagcgucgcccucgugcagggcugggcccugggcgggggcgccgaguucaccacggccugcgacuuccggcugaugacccccgaguccaagauccgcuucgugcacaaggagauggggaucauccccagcuggggcgggaccacccggcucgucgagaucaucggcucccgccaggcgcugaaggugcugagcggcgcccucaagcuggacuccaagaacgcccugaacaucgggaugguggaggagguccuccagagcuccgacgagaccaagagccuggaggaggcccaggaguggcugaagcaguucauccaggggcccccggaggugauccgggcgcucaagaaguccgugugcagcggccgcgagcuguaccuggaggaggcccuccagaacgagcgggaccugcugggcacggucuggggcgggcccgccaaccucgaggccaucgccaagaagggcaaguucaacaaguga

SEQ ID NO: 29487 - RNA, 912 nt, Artificial Sequence
  derived and/or modified sequence opt1 from ECHDC3__Homo_sapiens__NP_078969
auggccgccguggcgguccugcgcgccuucggcgccagcgggcccaugugccuccggcgcggcccgugggcccagcugcccgcccgguucugcucccgcgaccccgcgggggccggccggcgcgagagcgagccccggccgaccuccgcccgccagcuggacgggauccggaacaucgugcucagcaaccccaagaagcgcaacacccugucccuggccaugcucaagagccugcaguccgacauccugcacgacgcggacagcaacgaccucaaggugaucaucaucuccgccgagggccccgucuucagcuccggccacgaccugaaggagcugacggaggagcaggggcgggacuaccacgccgagguguuccagaccugcagcaaggugaugaugcacauccgcaaccaccccgucccggugaucgccauggugaacggccucgccaccgcggccgggugccagcuggucgccuccugcgacaucgccguggccagcgacaaguccagcuucgcgacccccggcgugaacgucgggcuguucugcuccacgcccggcguggcccucgcccgggccgugccccgcaaggucgcccuggagaugcuguucaccggcgagccgaucagcgcgcaggaggcccuccugcacgggcugcucuccaagguggugcccgaggccgagcugcaggaggagaccaugcggaucgcccgcaagaucgccagccugagccggcccgucgugucccucggcaaggcgaccuucuacaagcagcugccccaggaccuggggacggccuacuaccucaccagccaggccaugguggacaaccuggcccugcgcgacggccaggagggcaucaccgcguuccuccagaagcggaagccggucuggucccacgagcccguguga

SEQ ID NO: 29488 - RNA, 873 nt, Artificial Sequence
  derived and/or modified sequence opt1 from ECHS1__Homo_sapiens__NP_004083
auggccgcccugcgcgugcuccugagcugcguccggggcccccugcgcccgcccgugcggugccccgcguggcgccccuucgccuccggggccaacuucgaguacaucaucgccgagaagcggggcaagaacaacaccguggggcucauccagcugaaccgcccgaaggcccugaacgcgcucugcgacggccugaucgacgagcugaaccaggcccucaagaccuucgaggaggaccccgccgucggggccaucgugcugacgggcggcgacaaggcguucgccgccggggccgacaucaaggagaugcagaaccugagcuuccaggacugcuacuccagcaaguuccucaagcacugggaccaccugacccaggugaagaagcccgucaucgccgcggugaacggcuacgccuucgggggcgggugcgagcuggccaugaugugcgacaucaucuacgccggcgagaaggcccaguucgcgcagcccgagauccucaucggcaccaucccgggggccggcgggacccagcggcugacgcgcgccgugggcaagucccuggccauggagaugguccucaccggcgaccggaucagcgcccaggacgcgaagcaggccgggcugguguccaagaucugccccguggagacccuggucgaggaggccauccagugcgccgagaagaucgccagcaacuccaagaucgugguggcgauggccaaggagagcgucaacgccgccuucgagaugacccucacggagggcuccaagcuggagaagaagcuguucuacagcaccuucgcgaccgacgaccgcaaggaggggaugaccgccuucguggagaagcggaaggccaacuucaaggaccaguga

SEQ ID NO: 29489 - RNA, 858 nt, Artificial Sequence
  derived and/or modified sequence opt1 from ECI1__Homo_sapiens__NP_001171500
auggcccugguggccagcguccgcgugcccgcgcgggugcuccugcgcgccggcgcccggcugccgggggccgcccucggccgcaccgagcgggcggccgggggcggggacggcgcccgccgguucggcucccagcgcguccugguggagcccgacgccggggcgggcguggccgucaugaaguucaagaacccgcccgugaacagccugucccucgaguuccugaccgagcuggugaucagccucgagaagcuggagaacgacaaguccuuccgcggggucauccugacgagcgaccggcccggcguguucuccgccgggcucgaccugaccgagaugugcggccggagccccgcccacuacgccggcuacuggaaggcggugcaggagcuguggcuccgccuguaccaguccaaccugguccucgugagcgccaucaacggggccugccccgccggcgggugccugguggcccugaccugcgacuaccggauccucgcggacaacccccgccugaaggacacccuggagaacacgaucggccaccgggccgccgagcgcgcccuccagcugggccuccuguucccgcccgccgaggcgcugcaggucgggaucguggaccaggugguccccgaggagcagguccaguccaccgcccugagcgccaucgcccaguggauggccauccccgaccacgcgcggcagcucaccaaggccaugaugcgcaaggccaccgccucccggcuggugacgcagcgcgacgcggacgugcagaacuucgugagcuucaucuccaaggacagcauccagaagucccugcagauguaccucgagcggcugaaggaggagaagggcuga

SEQ ID NO: 29490 - RNA, 1095 nt, Artificial Sequence
  derived and/or modified sequence opt1 from ECI2__Homo_sapiens__NP_006108
augaaccgcaccgccaugcgggccagccagaaggacuucgagaacuccaugaaccaggugaagcugcucaagaaggaccccggcaacgaggucaagcugaagcuguacgcgcucuacaagcaggccaccgaggggcccugcaacaugcccaagcccggcguguucgaccugaucaacaaggccaagugggacgccuggaacgcccuggggagccuccccaaggaggcggcccgccagaacuacguggaccuggucuccagccuguccccgagccucgaguccagcucccagguggagcccggcacggaccgcaagagcaccggguucgagacccugguggucaccuccgaggacggcaucacgaagaucauguucaaccggcccaagaagaagaacgccaucaacaccgagauguaccacgagaucaugcgggcccugaaggcggccagcaaggacgacuccaucaucaccgugcucaccggcaacggggacuacuacagcuccggcaacgaccugacgaacuucaccgacaucccgcccgggggcguggaggagaaggccaagaacaacgccguccugcuccgcgaguucguggggugcuucaucgacuuccccaagccccugaucgccguggucaacggccccgcggugggcaucagcgugacccugcucgggcuguucgacgccgucuacgccuccgaccgggccaccuuccacacgccguucagccaccugggccagucccccgaggggugcagcagcuacaccuuccccaagaucaugucccccgccaaggcgaccgagaugcucaucuucggcaagaagcugaccgccggcgaggccugcgcccaggggcuggugacggagguguucccggacagcaccuuccagaaggaggucuggacccgccucaaggccuucgcgaagcugccgcccaacgcccugcggaucuccaaggaggugauccgcaagcgggagcgcgagaagcuccacgccgugaacgccgaggagugcaacguccugcagggccgguggcugagcgacgagugcaccaacgccguggugaacuuccucucccgcaagagcaagcuguga

SEQ ID NO: 29491 - RNA, 618 nt, Artificial Sequence
  derived and/or modified sequence opt1 from ECSCR__Homo_sapiens__NP_001071161
augggcaccgccggggccaugcagcugugcugggugauccucggcuuccugcuguuccgcgggcacaacagccagcccaccaugacgcagaccuccagcucccagggcgggcucggcggccugagccugaccaccgagccggucuccagcaaccccggguacauccccuccagcgaggcgaaccggcccucccaccucagcuccacgggcaccccgggggccggcgugcccagcuccgggcgcgacggcggcaccagccgggacaccuuccagacggugccgcccaacuccaccaccaugagccuguccaugcgcgaggacgccaccauccugcccagccccacguccgagaccguccucaccguggccgccuucggggugaucagcuucaucgucauccuggugguggucgugaucauccuggugggcgucgugagccuccgguucaagugccgcaaguccaaggagagcgaggacccccagaagcccggguccagcggccuguccgagagcugcuccaccgcgaacggcgagaaggacagcaucacgcugaucuccaugaagaacaucaacaugaacaacgggaagcagagccucuccgccgagaaggugcuguga

SEQ ID NO: 29492 - RNA, 891 nt, Artificial Sequence
  derived and/or modified sequence opt1 from ECSIT__Homo_sapiens__NP_001135936
augagcugggugcaggccacccugcucgcccgcggccugugccgggcguggggcgggaccugcggggccgcccugacgggcaccuccaucagccaggucccccgccggcucccgcgcgggcugcacugcuccgccgccgcgcacagcuccgagcagagccuggugcccuccccgcccgagccccggcagcgccccaccaaggcccucgugcccuucgaggaccuguucggccaggcccccggcggggagcgggacaaggccagcuuccugcagaccguccagaaguucgcggagcacuccgugcgcaagcggggccacaucgacuucaucuaccucgcccugcgcaagaugcgggaguacgggguggagcgcgaccuggccgucuacaaccagcuccugaacaucuucccgaaggagguguuccggccccgcaacaucauccagcggaucuucgugcacuacccccgccagcaggagugcggcaucgccguccuggagcagauggagaaccacggggugaugcccaacaaggagacggaguuccuccugauccagaucuucggccgcaagagcuacccgaugcugaagcucgugcggcugaagcugugguucccccgguucaugaacgucaaccccuuccccgugccgcgcgaccucccccaggaccccguggagcuggccauguucggccugcggcacauggagcccgaccucuccgcgcgcgucaccaucuaccaggugccgcugcccaaggacagcaccggggccgccgacccgccccagccccacaucgugggcuccgggcgcgacgccggcggcgucgagccccugcuccccgacgccgcggggcccggcgugugcgaggaguggcuggggcagcugcggguguga

SEQ ID NO: 29493 - RNA, 2745 nt, Artificial Sequence
  derived and/or modified sequence opt1 from ECT2__Homo_sapiens__NP_001245244
auggccgagaacagcgugcugaccuccaccacgggccgcaccagccucgccgacuccagcaucuucgacuccaaggucaccgagaucagcaaggagaaccugcugaucggguccaccagcuacguggaggaggagaugccccagaucgagacgcgggugauccucguccaggaggcgggcaagcaggaggagcugaucaaggcccugaagaccaucaagaucauggaggugccggugaucaagaucaaggaguccugccccggcaagagcgacgagaagcucaucaaguccgucaucaacauggacaucaaggugggcuucgugaagauggagagcgucgaggaguucgaggggcuggacucccccgaguucgagaacguguucguggucaccgacuuccaggacagcguguucaacgaccuguacaaggccgacugccgcgugaucgggcccccggucgugcucaacugcucccagaagggcgagccccugcccuucagcugccggccccuguacugcaccuccaugaugaaccucgugcugugcuucacgggguuccgcaagaaggaggagcugguccggcucgugacccuggugcaccacaugggcggggucauccgcaaggacuucaacagcaaggugacccaccugguggccaacugcacccagggcgagaaguuccgggucgccgugucccucgggacgccgaucaugaagcccgaguggaucuacaaggcgugggagcgccggaacgagcaggacuucuacgccgccgucgacgacuuccgcaacgaguucaaggugccgcccuuccaggacugcauccugagcuuccugggcuucagcgacgaggagaagaccaacauggaggagaugaccgagaugcagggcgggaaguaccucccccugggcgacgagcggugcacccaccugguggucgaggagaacaucgugaaggaccuccccuucgagcccuccaagaagcuguacguggucaagcaggagugguucugggggagcauccagauggacgcccgcgcgggcgagacgauguaccuguacgagaaggccaacacccccgagcucaagaaguccgugagcaugcugucccugaacaccccgaacagcaaccggaagcgccggcgccucaaggagacccuggcccagcugucccgggagacggacgugagccccuucccgccccgcaagcggcccuccgccgagcacagccucuccaucggcagccugcuggacaucuccaacacccccgagagcuccaucaacuacggggacacccccaagagcugcaccaaguccagcaaguccagcacgcccgucccgagcaagcaguccgcccgcuggcaggucgcgaaggagcucuaccagaccgagagcaacuacgugaacauccuggccaccaucauccagcuguuccaggugccccucgaggaggagggccagcgcgggggccccauccuggcccccgaggagaucaagaccaucuucggguccaucccggacaucuucgacgugcacacgaagaucaaggacgaccuggaggaccucaucgugaacugggacgagagcaaguccaucggcgacaucuuccugaaguacagcaaggaccuggucaagaccuacccgcccuucgugaacuucuucgagauguccaaggagaccaucaucaagugcgagaagcagaagccccgcuuccacgccuuccucaagaucaaccaggccaagcccgagugcggccgccagagccugguggagcugcucauccggcccguccagcgccugcccuccguggcgcugcugcucaacgaccugaagaagcacaccgccgacgagaacccggacaagagcacgcuggagaaggccaucgggucccucaaggaggugaugacccacaucaacgaggacaagcggaagaccgaggcccagaagcagaucuucgacgucguguacgagguggacggcugccccgccaaccugcugagcucccaccgcagccucguccagcggguggagaccaucucccugggggagcaccccugcgaccgcggcgagcaggucacgcuguuccucuucaacgacugccuggagaucgcgcggaagcgccacaaggugaucgggaccuuccggagcccccacggccagacccgcccgcccgccucccugaagcacauccaccucaugccccugagccagaucaagaaggugcuggacauccgggagaccgaggacugccacaacgccuucgcccuccuggugcggcccccgaccgagcaggccaacguccugcucagcuuccagaugacguccgacgagcugcccaaggagaacuggcugaagaugcucugccggcacguggcgaacaccaucugcaaggccgacgccgagaaccugaucuacaccgccgaccccgagagcuucgaggugaacaccaaggacauggacuccacgcugagccgcgcgucccgggccaucaagaagaccagcaagaaggucacccgcgccuucuccuucagcaagacccccaagcgggcccuccgccgggcccugaugacgucccacggcagcguggaggggcgcuccccgagcuccaacgacaagcacgugaugagccgccuguccagcaccuccagccucgcgggcauccccucccccagccuggucagccugcccuccuucuucgagcggcgcagccacacccucucccggagcaccacgcaccugaucuga

SEQ ID NO: 29494 - RNA, 894 nt, Artificial Sequence
  derived and/or modified sequence opt1 from EDA2R__Homo_sapiens__NP_001186616
auggacugccaggagaacgaguacugggaccaguggggccgcugcgugaccugccagcggugcgggcccggccaggagcugagcaaggacugcggguacggcgagggcggggacgccuacugcaccgccugcccgccccgccgguacaaguccagcuggggccaccaccgcugccaguccugcaucacgugcgcggucaucaaccgggugcagaaggugaacugcaccgccaccagcaacgccgucugcggggacugccucccccgcuucuaccggaagacccgcaucggcgggcugcaggaccaggagugcauccccugcacgaagcagaccccgaccuccgaggugcagugcgccuuccagcugagccucguggaggccgacgcgcccaccgucccgccccaggaggccacgcugguggcccugguguccagccuccuggucguguucacccuggccuuccucggccuguucuuccuguacugcaagcaguucuucaaccggcacugccagcgcgggggccuccugcaguucgaggcggacaagaccgccaaggaggagucccuguuccccgugccgcccagcaaggagaccuccgccgagagccaggucuccgagaacaucuuccagacgcagccccucaaccccauccuggaggacgacugcagcuccaccagcggcuuccccacccaggaguccuucaccauggccagcugcacguccgagagccacagccacugggugcacucccccaucgagugcaccgagcuggaccuccagaaguucagcuccagcgccuccuacaccggggcggagacccugggcgggaacacgguggagagcaccggcgaccggcuggagcucaacguccccuucgaggugccgucccccuga

SEQ ID NO: 29495 - RNA, 1170 nt, Artificial Sequence
  derived and/or modified sequence opt1 from EDA__Homo_sapiens__NP_001005609
augggcuaccccgagguggagcgccgggagcugcuccccgccgccgcgccccgcgagcgggggagccagggcugcgggugcggcggggcccccgcccgcgccggcgagggcaacuccugccugcuguuccucggguucuucggccugagccuggcccuccaccuccugacccugugcugcuaccuggagcugcgguccgagcuccgccgggagcgcggggcggagagccggcugggcggguccggcacccccggcacgagcgggacccuguccagccucggcgggcuggaccccgacucccccaucaccagccaccugggccagcccucccccaagcagcagccgcucgagcccggcgaggccgcccugcacagcgacucccaggacgggcaccagauggcccugcucaacuucuucuuccccgacgagaagcccuacagcgaggaggagucccgccggguccgccggaacaagcgcagcaaguccaacgagggcgcggacgggccggugaagaacaagaagaagggcaagaaggccgggccgcccggccccaacggcccgcccgggccgcccggcccgcccgggccccaggggccgcccggcauccccggcauccccggcauccccgggaccacggugaugggcccgcccgggccgcccggcccgcccgggccccagggcccgcccggccugcaggggcccagcggcgccgccgacaaggccgggacccgggagaaccagcccgcggucgugcaccuccagggccagggcuccgccauccaggugaagaacgaccugagcgggggcguccugaacgacuggagccgcaucaccaugaaccccaagguguucaagcugcacccccgguccggggagcucgaggugcuggucgacggcaccuacuucaucuacagccagguguacuacaucaacuucacggacuucgccuccuacgagguggucguggacgagaagcccuuccugcagugcacccgcagcaucgagaccgggaagaccaacuacaacacgugcuacaccgccggcgugugccuccugaaggcccggcagaagaucgcggucaagauggugcacgccgacaucuccaucaacaugagcaagcacaccaccuucuucggcgccauccgccugggggaggcccccgccuccuga

SEQ ID NO: 29496 - RNA, 618 nt, Artificial Sequence
  derived and/or modified sequence opt1 from EDARADD__Homo_sapiens__NP_542776
auggccagccccgacgacccgcugcgcgccgaccacauggugaaggagcccgucgaggacaccgaccccuccacccucagcuucaacauguccgacaaguaccccauccaggacacggagcugccgaaggcggaggagugcgacaccaucacccugaacugcccccggaacagcgacaugaagaaccagggcgaggagaacggguuccccgacuccaccggcgacccccucccggagaucagcaaggacaacuccugcaaggagaacugcacgugcagcuccugccugcugcgcgcccccaccaucagcgaccuccugaacgaccaggaccugcucgacgugauccggaucaagcuggaccccugccaccccaccgugaagaacuggcgcaacuucgccuccaagugggggaugagcuacgacgagcugugcuuccucgagcagcggccgcagucccccacccuggaguuccugcuccgcaacagccagcggacggucggccagcugauggagcugugccgccucuaccaccgggccgacguggagaaggugcugcgccggugggucgacgaggaguggcccaagcgcgagcgcggggaccccucccggcacuucuga

SEQ ID NO: 29497 - RNA, 1347 nt, Artificial Sequence
  derived and/or modified sequence opt1 from EDAR__Homo_sapiens__NP_071731
auggcccacgugggcgacugcacccagacccccuggcugccgguccucguggugagccugaugugcuccgcccgcgcggaguacagcaacugcggggagaacgaguacuacaaccagacgaccggccugugccaggagugcccgcccugcgggcccggcgaggagcccuaccucuccugcggguacggcaccaaggacgaggacuacggcugcguccccugccccgccgagaaguucagcaagggcggguaccagaucugccggcgccacaaggacugcgagggguucuuccgggccaccgugcugacgcccggcgacauggagaacgacgccgagugcgggccgugccugcccggcuacuacaugcucgagaaccgcccccggaacaucuacggcauggugugcuacuccugccugcuggcgcccccgaacaccaaggagugcgucggggccaccagcggcgccuccgccaacuuccccgggaccagcggcuccagcacgcucucccccuuccagcacgcccacaaggagcugagcggccaggggcaccuggcgaccgcccucaucaucgccauguccaccaucuucaucauggccaucgccaucgugcugaucaucauguucuacauccugaagaccaagcccagcgcgccggccugcugcacgucccaccccggcaagagcguggaggcccaggucuccaaggacgaggagaagaaggaggcccccgacaacguggugauguucagcgagaaggacgaguucgagaagcucaccgccacccccgcgaagccgaccaaguccgagaacgacgccagcagcgagaacgagcagcugcugucccgcagcgucgacuccgacgaggagcccgcccccgacaagcaggggagccccgagcucugccugcugucccucgugcaccuggcccgggagaaguccgccacgagcaacaagagcgcgggcauccagucccgccggaagaagauccuggacguguacgccaacgucugcggggugguggagggccucagcccgaccgagcugcccuucgacugccuggagaagaccucccgcaugcucagcuccaccuacaacagcgagaaggccgucgugaagacguggcggcaccuggccgaguccuucggccugaagcgcgacgagaucgggggcaugaccgacgggaugcagcuguucgaccggaucagcaccgccggcuacuccauccccgagcuccugaccaagcucgugcagaucgagcgccuggacgcggucgagagccugugcgccgacauccucgagugggccgggguggugcccccggccucccagccccacgcggccagcuga

SEQ ID NO: 29498 - RNA, 4206 nt, Artificial Sequence
  derived and/or modified sequence opt1 from EDC4__Homo_sapiens__NP_055144
auggccagcugcgccuccaucgacaucgaggacgcgacccagcaccugcgcgacauccucaagcuggaccggcccgccggcgggccgagcgccgaguccccccgccccagcuccgccuacaacggcgaccugaacgggcuccuggugcccgacccgcugugcagcggcgacuccaccagcgccaacaagacggggcuccggaccaugccccccaucaaccugcaggagaagcaggucaucugccuguccggcgacgacagcuccaccugcaucggcauccucgcgaaggagguggagaucguggccagcuccgacagcuccaucagcuccaaggcccgcgggagcaacaaggucaagauccagcccguggccaaguacgacugggagcagaaguacuacuacggcaaccugaucgcgguguccaacagcuuccuggccuacgccauccgggccgccaacaacgggagcgcgaugguccgcgugaucuccgugagcaccuccgagcggacgcuccugaagggcuucaccgggagcgucgccgaccuggccuucgcccaccucaacuccccgcagcuggccugccuggacgaggcgggcaaccucuucguguggcgccuggcccuggugaacggcaagauccaggaggagauccucguccacauccggcagcccgaggggaccccccugaaccacuuccgccggaucaucuggugccccuucaucccggaggagagcgaggacugcugcgaggaguccagccccaccguggcccugcuccacgaggaccgcgccgaggugugggaccuggacaugcugcgguccagccacuccacguggcccgucgacgugagccagaucaagcagggcuucaucguggucaaggggcacuccaccugccucagcgagggcgcccugucccccgacggcaccgugcuggcgaccgccagccacgacggguacgugaaguucuggcagaucuacaucgagggccaggacgagccgcgcugccuccacgaguggaagccccacgacgggcggccccuguccugccugcucuucugcgacaaccacaagaagcaggaccccgacgucccguucuggcgcuuccugaucacgggcgccgaccagaaccgggagcugaagauguggugcaccgugagcuggaccugccuccagaccauccgcuucucccccgacaucuucagcagcguguccgucccccccagccugaaggugugccuggaccucuccgccgaguaccugauccugagcgacguccagcggaaggugcucuacgugauggagcugcugcagaaccaggaggaggggcacgccugcuucuccagcaucuccgaguuccuccugacgcacccgguccugagcuucggcauccagguggugucccgcugccggcuccgccacaccgagguccugcccgcggaggaggagaacgacagccugggcgccgacgggacccacggcgccggggccauggaguccgcggccggcgugcugaucaagcucuucugcgugcacaccaaggcccugcaggacguccagauccgcuuccagccccagcugaaccccgacgugguggccccgcuccccacgcacaccgcccacgaggacuucaccuucggggagagccggcccgagcugggcuccgagggccuggggagcgcggcccacggcucccagccggaccuccgccggaucgucgagcugcccgcccccgccgacuuccugagccucuccagcgagaccaagcccaagcugaugacgccggacgccuucaugacccccagcgcgucccugcagcagaucaccgccagccccuccagcuccagcuccgggagcuccagcuccagcuccagcuccagcuccagccucaccgccguguccgccaugagcagcacguccgccguggaccccagccugacccgcccgcccgaggagcugacccucucccccaagcugcagcuggacggcagccucaccauguccagcuccgggagccugcaggcguccccccggggccugcucccgggccugcugcccgcccccgccgacaagcucacgcccaaggggccgggccagguccccaccgccaccagcgcgcugucccuggagcuccaggagguggagccccuggggcugccccaggccagcccgucccgcacccggagccccgacgugaucuccagcgccuccacggcccucagccaggacauccccgagaucgccuccgaggcgcugagccgcggcuucggcagcuccgcccccgaggggcuggagccggacagcauggccuccgccgccagcgcgcuccaccugcuguccccccggccccgcccgggccccgagcucgggccccagcugggccuggacgggggccccggcgacggggaccggcacaacaccccgagccuccuggaggccgcccugacccaggaggccuccacccccgacagccaggucuggcccaccgcccccgacaucacgcgcgagaccugcuccacccucgcggagagcccgcggaacggccugcaggagaagcacaagucccuggccuuccaccgcccccccuaccaccuccugcagcagcgggacagccaggacgccuccgccgagcagagcgaccacgacgacgagguggcgucccuggccagcgccuccgggggcuucgggaccaaggugcccgccccgcgccuccccgccaaggacuggaagacgaagggcagcccccggaccucccccaagcugaagcgcaagagcaagaaggacgacggcgacgcggccauggggagccggcugaccgagcaccaggucgccgagccgcccgaggacuggcccgcccucaucuggcagcagcagcgcgagcuggccgagcugcgccacucccaggaggagcuccugcagcggcugugcacccagcucgagggccugcagagcacggugaccgggcacguggagcgcgcgcuggagacccggcacgagcaggagcagcgccggcucgagcgcgcccuggccgagggccagcagcgggggggccagcugcaggagcagcucacccagcagcugucccaggcccugagcuccgccgucgcgggccgccucgagcggagcauccgcgacgagaucaagaagacggugcccccgugcgugucccggagccuggagcccauggccgggcagcuguccaacagcgucgccaccaagcucaccgccguggagggcuccaugaaggagaacaucagcaagcugcugaaguccaagaaccucaccgacgccaucgcgcgcgccgccgccgacacgcugcaggggcccaugcaggcggccuaccgggaggccuuccagagcgugguccugcccgccuucgagaaguccugccaggccauguuccagcagaucaacgacagcuuccgccucggcacccaggaguaccugcagcagcuggagucccacaugaagagccggaaggcgcgcgagcaggaggcccgggagccggugcucgcccagcugcgcgggcugguguccacccuccagagcgccaccgagcagauggccgcgacggucgccggcagcgugcgggccgaggugcagcaccagcugcacgucgccgugggcucccugcaggagagcauccucgcccaggugcagcgcaucgucaagggggagguguccguggcgcugaaggagcagcaggccgccgucaccagcuccaucaugcaggccaugcggagcgcggccggcacccccgugcccuccgcccaccuggacugccaggcccagcaggcccacauccuccagcugcugcagcaggggcaccucaaccaggcguuccagcaggcccugaccgccgccgaccugaaccucgugcuguacgucugcgagacgguggaccccgcccagguguucggccagccgcccugcccccugagccagccgguccugcucucccugauccagcagcuggcgagcgaccucggcacccgcaccgaccugaagcuguccuaccucgaggaggccgugaugcaccuggaccacagcgaccccaucacccgcgaccacaugggguccgugauggcccagguccggcagaagcuguuccaguuccuccaggccgagccccacaacagccugggcaaggccgcgcgccggcugucccucaugcugcacgggcuggugacgcccagccucccguga

SEQ ID NO: 29499 - RNA, 1974 nt, Artificial Sequence
  derived and/or modified sequence opt1 from EDEM1__Homo_sapiens__NP_055489
augcaguggcgcgcccuggugcucggccugguccugcuccggcuggggcugcacggcgugcucuggcugguguucgggcugggccccagcaugggguucuaccagcgcuucccgcucuccuucggcuuccagcggcugcgcagccccgacggccccgccucccccaccagcgggccggucggccggcccgggggcguguccgggcccagcuggcugcagcccccgggcaccggcgcggcccagagcccccgcaaggcgccccggcgccccgggccgggcaugugcgggcccgccaacuggggcuacgugcucggcgggcggggccgcgggcccgacgaguacgagaagcgguacuccggcgccuucccgccccagcugcgcgcccagaugcgggaccuggcccgcgggauguucgucuucggcuacgacaacuacauggcccacgccuucccccaggacgagcucaaccccauccacugccggggccgcgggcccgaccggggcgacccguccaaccugaacaucaacgacgugcuggggaacuacagccucacgcugguggacgcgcuggacacccucgccaucaugggcaacuccagcgaguuccagaaggccgucaagcuggugaucaacaccguguccuucgacaaggacagcaccguccagguguucgaggccacgauccgcgugcuggggucccuccugagcgcccaccggaucaucaccgacuccaagcagcccuucggcgacaugaccaucaaggacuacgacaacgagcugcucuacauggcgcacgaccuggccguccgccugcuccccgccuucgagaacaccaagacgggcauccccuacccgcgggugaaccugaagaccggggugccgcccgacaccaacaacgagaccugcacggccggcgccgggagccugcucgucgaguucggcauccugucccgccugcucggggacagcaccuucgaguggguggcgcgccgggccgugaaggcccuguggaaccugcgcagcaacgacaccggccuccugggcaacgucgugaacauccagaccgggcacugggugggcaagcaguccgggcugggcgccggccucgacagcuucuacgaguaccugcugaaguccuacauccucuucggggagaaggaggaccuggagauguucaacgccgcguaccagagcauccagaacuaccugcggcgcggccgggaggccugcaacgagggggagggcgacccgccccucuacgucaacgugaacauguucuccgggcagcugaugaacacguggaucgacagccugcaggccuucuuccccggccugcagguccucaucggcgacguggaggacgccaucugccugcacgccuucuacuacgcgaucuggaagcgcuacggggcccugcccgagcgguacaacuggcagcuccaggcccccgacgugcuguucuacccccugcgccccgagcucgucgaguccaccuaccugcuguaccaggccaccaagaaccccuucuaccuccacgugggcauggacauccugcagagccuggagaaguacaccaaggugaagugcggguacgcgacgcuccaccacgucaucgacaaguccaccgaggaccggauggagagcuucuuccuguccgagaccugcaaguaccuguaccuccuguucgacgaggacaacccggugcacaagagcggcacccgcuacauguucacgaccgaggggcacaucguguccgucgacgagcaccuccgggagcugcccuggaaggaguucuucagcgaggagggcggccaggaccagggcgggaaguccgugcaccgccccaagccccacgagcugaaggugaucaacagcuccagcaacugcaaccgggucccggacgagcgccgguacucccugccccucaagagcaucuacaugcgccagaucgaccagaugguggggcugaucuga

SEQ ID NO: 29500 - RNA, 1413 nt, Artificial Sequence
  derived and/or modified sequence opt1 from EDIL3__Homo_sapiens__NP_001265571
augaagcgcagcguggccgucuggcugcucgugggccugucccugggggugccccaguucggcaagggggacaucugcgacccgaaccccugcgagaacggcgggaucugccuccccggccuggccgacggcagcuucuccugcgagugccccgacggguucaccgacccgaacugcagcuccgucguggaggugggccccugcacccccaaccccugccacaacgggggcacgugcgagaucagcgaggcguaccgcggggacaccuucaucggcuacgucugcaagugcccgcggggcuucaacgggauccacugccagcacaacaucaacgagugcgagguggagcccugcaagaacggcgggaucugcaccgaccugguggccaacuacuccugcgagugccccggcgaguucaugggccggaacugccaguacaagugcagcgggccccucggcaucgagggcgggaucaucuccaaccagcagaucaccgccagcuccacgcaccgcgcccuguucgggcugcagaagugguacccguacuacgcccggcucaacaagaagggccugaucaacgcguggaccgccgccgagaacgaccgcuggcccuggauccagaucaaccugcagcggaagaugcgcgucaccggcgugaucacccagggggccaagcggaucggcagccccgaguacaucaaguccuacaagaucgcguacagcaacgacgggaagacgugggccauguacaaggugaagggcaccaacgaggacauggucuuccgcgggaacaucgacaacaacacccccuacgccaacuccuucaccccgcccaucaaggcccaguacgugcggcucuacccccaggugugccgccggcacugcacgcugcgcauggagcugcucggcugcgagcugagcggcugcuccgagccccuggggaugaaguccggccacauccaggacuaccagaucaccgccagcagcaucuuccggacccucaacauggacauguucaccugggagccgcgcaaggcgcggcuggacaagcaggggaaggucaacgccuggacgagcggccacaacgaccagucccaguggcuccagguggaccugcuggugcccaccaaggucaccgggaucaucacccagggcgccaaggacuucggccacgugcaguucguggggagcuacaagcuggccuacuccaacgacggcgagcacuggacggucuaccaggacgagaagcagcgcaaggacaagguguuccaggggaacuucgacaacgacacccaccggaagaacgugaucgacccgcccaucuacgcccgccacauccggauccuccccuggagcugguacggccgcaucacccugcgcuccgagcugcucggcugcaccgaggaggaguga

SEQ ID NO: 29501 - RNA, 639 nt, Artificial Sequence
  derived and/or modified sequence opt1 from EDN1__Homo_sapiens__NP_001946
auggacuaccugcucaugaucuucagccugcuguucguggccugccagggcgcccccgagaccgcgguccucggggccgagcuguccgccgugggcgagaacgggggcgagaagccgacccccagcccgcccuggcgccugcggcgcuccaagcggugcagcugcuccagccucauggacaaggagugcguguacuucugccaccuggacaucaucugggucaacacgcccgagcacguggugcccuacgggcugggcagcccccgcuccaagcgggcccucgagaaccugcugcccaccaaggccaccgaccgcgagaaccggugccagugcgcgucccagaaggacaagaagugcuggaacuucugccaggccggcaaggagcuccgcgccgaggacaucauggagaaggacuggaacaaccacaagaaggggaaggacugcagcaagcugggcaagaagugcaucuaccagcagcugguccgggggcgcaagauccggcgcuccagcgaggagcaccuccggcagacccgcuccgagacgaugcggaacagcgugaaguccagcuuccacgacccgaagcugaagggcaagcccucccgcgagcgguacgugacccacaaccgcgcccacugguga

SEQ ID NO: 29502 - RNA, 579 nt, Artificial Sequence
  derived and/or modified sequence opt1 from EDN3__Homo_sapiens__NP_001289385
auggagcccggccuguggcuccuguucgggcugaccgugaccagcgccgccggcuucgucccgugcucccagagcggggacgcgggccgccgcggggugucccaggcccccacggccgcccggagcgagggcgacugcgaggagaccguggccggccccggggaggagaccgucgcgggccccggggagggcaccguggccccgacggcccuccaggggcccucccccggcagccccggccaggagcaggccgcggagggggccccggagcaccaccggucccgccggugcacgugcuucaccuacaaggacaaggagugcguguacuacugccaccuggacaucaucuggaucaacacccccgagcagaccguccccuacggccugagcaacuaccgcggguccuuccggggcaagcgcagcgccggcccccucccggggaaccugcagcugucccaccggccccaccuccgcugcgccugcgugggccgguacgacaaggccugccugcacuucugcacccagacccuggacgugagccgccucaagucccggaccaacaaggcgagccgccuguga

SEQ ID NO: 29503 - RNA, 957 nt, Artificial Sequence
  derived and/or modified sequence opt1 from EDNRA__Homo_sapiens__NP_001159527
auggagacccugugccuccgcgccagcuucuggcuggcccuggugggcugcgucaucuccgacaaccccgagcgguacagcaccaaccucuccaaccacguggacgacuucacgaccuuccgcgggaccgagcugagcuuccuggugaccacgcaccagccgaccaaccucguccugcccuccaacggcagcaugcacaacuacugcccccagcagaccaagaucaccuccgcguucaaguacaucaacacggugaucagcugcaccaucuucaucguggggauggucggcaacgccacccugcuccggaucaucuaccagaacaagugcaugcgcaacgggcccaacgcccugaucgccucccuggcccucggcgaccugaucuacguggugaucgaccugccgaucaacgucuucaaguucuaccaggacgugaaggacugguggcuguucggcuucuacuucugcaugccccucgugugcaccgcgaucuucuacacgcugaugaccugcgagaugcucaaccggcgcaacgggagccugcggaucgcccuguccgagcaccucaagcagcgccgggaggucgccaagaccguguucugccugguggucaucuucgcccugugcugguucccccuccaccugagccgcauccugaagaagaccguguacaacgagauggacaagaaccggugcgagcuccuguccuuccugcuccugauggacuacaucggcaucaaccuggcgacgaugaacagcugcaucaaccccaucgcccucuacuucguguccaagaaguucaagaacugcuuccagagcugccugugcugcugcugcuaccaguccaagagccugaugaccuccgucccgaugaacgggaccagcauccaguggaagaaccacgaccagaacaaccacaacaccgaccgcagcucccacaaggacagcaugaacuga

SEQ ID NO: 29504 - RNA, 1329 nt, Artificial Sequence
  derived and/or modified sequence opt1 from EDNRB__Homo_sapiens__NP_000106
augcagcccccgcccagccugugcggccgcgcccucguggcccugguccuggcgugcgggcucucccggaucuggggcgaggagcgcggguucccgcccgaccgggccacgccccugcugcagaccgccgagaucaugaccccgcccaccaagacccucuggcccaagggcagcaacgccucccuggcccgcagccuggcgcccgccgaggugcccaagggggaccggaccgccggcuccccgccccgcacgaucagcccgccgcccugccagggccccaucgagaucaaggagaccuucaaguacaucaacaccguggucuccugccucguguucgugcuggggaucaucggcaacagcacccugcuccggaucaucuacaagaacaagugcaugcgcaacgggcccaacauccugaucgccucccuggcgcucggcgaccugcugcacaucgucaucgacauccccaucaacguguacaagcuccuggccgaggacuggcccuucggggccgagaugugcaagcuggugcccuucauccagaaggccagcgucggcaucacggugcucucccugugcgcccugagcaucgaccgguaccgcgcgguggccuccuggagccggaucaagggcaucgggguccccaaguggaccgccguggagaucgugcucaucugggucguguccgugguccuggccgugcccgaggccaucggcuucgacaucaucaccauggacuacaaggggagcuaccugcgcaucugccuccugcaccccgugcagaagaccgcguucaugcaguucuacaagacggccaaggacugguggcuguucuccuucuacuucugccucccccuggccaucaccgccuucuucuacacccugaugaccugcgagaugcuccggaagaaguccggcaugcagaucgcccugaacgaccaccugaagcagcgccgggaggucgcgaagacgguguucugccucgugcuggucuucgcccugugcuggcucccgcugcaccugagccgcauccucaagcugacccuguacaaccagaacgaccccaaccggugcgagcuccugagcuuccugcucgugcuggacuacaucggcaucaacauggccagccugaacuccugcaucaaccccaucgcccuguaccucgucagcaagcgcuucaagaacugcuucaaguccugccugugcugcuggugccagagcuucgaggagaagcagucccuggaggagaagcagagcugccucaaguucaaggccaacgaccacggguacgacaacuuccgguccagcaacaaguacuccagcuccuga

SEQ ID NO: 29505 - RNA, 4236 nt, Artificial Sequence
  derived and/or modified sequence opt1 from EEA1__Homo_sapiens__NP_003557
augcugcgccggauccuccagcgcacccccggccggguggggagccagggcuccgaccuggacagcuccgccaccccgaucaacacggucgacgugaacaacgagagcuccagcgagggguucaucugcccccagugcaugaagucccugggcagcgccgacgagcuguucaagcacuacgaggcggugcacgacgccgggaacgacuccggccacggcggggagagcaaccuggcccugaagcgcgacgacgucacccuccugcggcaggaggugcaggaccugcaggccucccucaaggaggagaagugguacagcgaggagcugaagaaggagcuggagaaguaccagggccuccagcagcaggaggccaagcccgacgggcuggugaccgacuccagcgcggagcugcagucccucgagcagcagcuggaggaggcccagaccgagaacuucaacaucaagcagaugaaggaccuguucgagcagaaggccgcccagcucgcgacggagaucgccgacaucaagagcaaguacgacgaggagcgcucccugcgggaggccgccgagcagaaggucacccgccugaccgaggagcucaacaaggaggccaccgugauccaggaccugaagacggagcugcuccagcggcccggcaucgaggacguggcgguccugaagaaggagcugguccaggugcagacccucauggacaacaugacccuggagcgcgagcgggagagcgagaagcugaaggacgagugcaagaagcuccagucccaguacgccagcagcgaggccaccaucucccagcugcgcagcgagcuggccaaggggccgcaggagguggccguguacgugcaggagcuccagaagcugaaguccagcgucaacgagcugacgcagaagaaccagacccucaccgagaaccugcugaagaaggagcaggacuacaccaagcucgaggagaagcacaacgaggaguccgugagcaagaagaacauccaggcgacgcugcaccagaaggaccuggacugccagcagcuccagucccggcugagcgccuccgagaccagccugcaccgcauccacguggagcucuccgagaagggcgaggccacccagaagcugaaggaggagcugagcgaggucgagaccaaguaccagcaccucaaggccgaguucaagcagcugcagcagcagcgggaggagaaggagcagcacggccugcagcugcaguccgagaucaaccagcuccacagcaagcugcuggagacggagcgccagcucggggaggcccacggccggcugaaggagcagcgccagcuguccagcgagaagcucauggacaaggagcagcaggucgcggaccugcagcugaagcucucccggcuggaggagcagcugaaggagaaggugaccaacagcaccgagcuccagcaccagcuggacaagaccaagcagcagcaccaggagcagcaggcccugcagcaguccacgaccgccaagcuccgcgaggcccagaacgaccuggagcagguccugcggcagaucggggacaaggaccagaagauccagaaccucgaggcccugcugcagaaguccaaggagaacaucagccuccuggagaaggagcgcgaggaccuguacgcgaagauccaggccggcgagggcgagaccgccgugcucaaccagcugcaggagaagaaccacacccugcaggagcaggucacgcagcucaccgagaagcugaagaaccagagcgagagccacaagcaggcccaggagaaccugcacgaccaggugcaggagcagaaggcgcaccuccgcgccgcccaggaccgggugcugucccuggagaccagcgugaacgagcucaacucccagcugaacgagagcaaggagaaggugucccagcuggacauccagaucaaggccaagaccgagcuccugcugagcgccgaggcggccaagacggcccagcgcgccgaccuccagaaccaccuggacaccgcccagaacgcgcugcaggacaagcagcaggagcucaacaagaucaccacccagcuggaccaggugacggccaagcugcaggacaagcaggagcacugcucccagcucgagagccaccugaaggaguacaaggagaaguaccugucccucgagcagaagaccgaggagcuggaggggcagaucaagaagcuggaggccgacagccucgaggucaaggccuccaaggagcaggcccugcaggaccugcagcagcagcggcagcucaacaccgaccuggagcugcgcgcgaccgagcucagcaagcagcuggagauggagaaggagaucguguccagcacccggcuggaccuccagaagaaguccgaggcccuggagagcaucaagcagaagcugacgaagcaggaggaggagaagcagauccucaagcaggacuucgagacccugagccaggagaccaagauccagcacgaggagcugaacaaccgcauccagaccacggugaccgagcuccagaaggucaagauggagaaggaggcccugaugaccgagcuguccaccgugaaggacaagcucagcaagguguccgacagccugaagaacuccaagagcgaguucgagaaggagaaccagaagggcaaggccgcgauccuggaccucgagaagacgugcaaggagcugaagcaccagcugcagguccagauggagaacacccucaaggagcagaaggagcugaagaagucccuggagaaggagaaggaggccagccaccagcucaagcuggagcugaacuccaugcaggagcagcucauccaggcccagaacacccugaagcagaacgagaaggaggagcagcagcugcaggggaacaucaacgagcucaagcagagcuccgagcagaagaagaagcagaucgaggcccugcagggcgagcugaagaucgccgugcuccagaagaccgagcuggagaacaagcugcagcagcagcucacgcaggcggcccaggagcuggccgccgagaaggagaagaucagcgugcugcagaacaacuacgagaagucccaggagaccuucaagcagcuccagagcgacuucuacgggcgggaguccgagcugcuggccacccgccaggaccucaagagcgucgaggagaagcucucccuggcgcaggaggaccugaucagcaaccggaaccagaucggcaaccagaacaagcucauccaggagcugaagaccgccaaggccacgcuggagcaggacuccgccaagaaggagcagcagcuccaggagcgcugcaaggcccugcaggacauccagaaggagaagucccugaaggagaaggagcucgugaacgagaaguccaagcuggcggagaucgaggagaucaagugccggcaggagaaggagaucaccaagcugaacgaggagcucaagagccacaagcuggagagcaucaaggagaucaccaaccugaaggacgccaagcagcuccugauccagcagaagcuggagcuccagggcaaggccgacagccugaaggccgcgguggagcaggagaagcgcaaccagcagauccugaaggaccaggucaagaaggaggaggaggagcucaagaaggaguucaucgagaaggaggccaagcugcacagcgagaucaaggagaaggagguggggaugaagaagcacgaggagaacgaggccaagcugaccaugcagaucacggcccucaacgagaaccugggcaccgugaagaaggaguggcaguccagccagcggcgcgucuccgagcuggagaagcagaccgacgaccuccgcggggagaucgccgugcuggaggcgaccgugcagaacaaccaggacgagcggcgggcccugcucgagcgcugccugaagggcgagggggagaucgagaagcugcagacgaagguccucgagcugcagcggaagcuggacaacaccaccgccgccgugcaggagcucggccgcgagaaccagagccugcagaucaagcacacccaggcccugaaccgcaagugggcggaggacaacgaggugcagaacugcauggccugcggcaagggguucuccgucacggugcggcgccaccacugccggcagugcggcaacaucuucugcgccgagugcagcgccaagaacgcccucacccccuccagcaagaagcccgugcgcgucugcgacgcgugcuucaacgaccugcagggguga

SEQ ID NO: 29506 - RNA, 1326 nt, Artificial Sequence
  derived and/or modified sequence opt1 from EED__Homo_sapiens__NP_003788
augagcgagcgcgagguguccaccgcccccgccggcaccgacaugccggcggccaagaagcagaagcugagcuccgacgagaacagcaaccccgaccucuccggggacgagaacgacgacgccgucagcaucgaguccggcacgaacaccgagcggcccgacacccccaccaacacgccgaacgcccccgggcgcaagagcuggggcaaggggaaguggaaguccaagaagugcaaguacagcuucaagugcgugaacucccugaaggaggaccacaaccagccccuguucggcgugcaguucaacuggcacagcaaggagggcgacccccucgucuucgccaccgugggguccaaccgggugacccuguacgagugccacagccagggcgagauccgccugcuccaguccuacgucgacgcggacgccgacgagaacuucuacacgugcgccuggaccuacgacagcaacaccucccacccgcugcuggccguggcggggagccggggcaucauccgcaucaucaaccccaucaccaugcagugcaucaagcacuacguggggcacggcaacgccaucaacgagcucaaguuccacccccgggaccccaaccugcugcucuccgucagcaaggaccacgcccugcgccuguggaacauccagaccgacacgcucguggccaucuucggcgggguggagggccaccgggacgagguccugagcgccgacuacgaccugcucggggagaagaucauguccugcggcauggaccacagccugaagcuguggcgcaucaacuccaagcggaugaugaacgcgaucaaggagagcuacgacuacaacccgaacaagaccaaccgccccuucaucucccagaagauccacuuccccgacuucagcacccgggacauccaccgcaacuacguggacugcgugcgguggcucggcgaccugauccuguccaagagcugcgagaacgccaucgucugcuggaagcccgggaagauggaggacgacaucgacaagaucaagccguccgagagcaacgugaccauccucggccgcuucgacuacucccagugcgacaucugguacaugcgguucagcauggacuucuggcagaagaugcuggcccuggggaaccaggugggcaagcucuacgucugggaccuggagguggaggacccccacaaggccaagugcacgacccugacccaccacaagugcggggccgcgauccgccagaccuccuucagccgggacuccagcauccucaucgccgugugcgacgacgccuccaucuggcgcugggaccggcugcgcuga

SEQ ID NO: 29507 - RNA, 1389 nt, Artificial Sequence
  derived and/or modified sequence opt1 from EEF1A1__Homo_sapiens__XP_011533816
augggcaaggagaagacccacaucaacaucguggucaucgggcacguggacagcggcaaguccaccacgaccgggcaccugaucuacaagugcggcgggaucgacaagcgcaccaucgagaaguucgagaaggaggccgccgagaugggcaagggcagcuucaaguacgcgugggugcucgacaagcugaaggccgagcgggagcgcgggaucaccaucgacaucucccuguggaaguucgagacgagcaaguacuacgucaccaucaucgacgcccccggccaccgggacuucaucaagaacaugaucaccgggaccucccaggccgacugcgccgugcucaucguggcggccggcgucggggaguucgaggccggcaucagcaagaacggccagacgcgcgagcacgcccugcuggcguacacccucggggugaagcagcugaucgugggcgucaacaagauggacuccaccgagccgcccuacagccagaagcgguacgaggagaucgugaaggagguguccaccuacaucaagaagaucggguacaaccccgacacggucgccuucgugcccaucagcggcuggaacggcgacaacaugcuggagcccuccgccaacaugcccugguucaagggguggaaggugacccgcaaggacggcaacgccagcgggaccacccuccuggaggcccuggacugcauccucccgcccacgcggcccaccgacaagccccugcgccugccccuccaggacgucuacaagaucggcgggaucggcaccgugcccgugggccgggucgagaccggggugcugaagccgggcaugguggucacguucgcgcccgugaacgugaccaccgaggucaaguccguggagaugcaccacgaggcccugagcgaggcccuccccggggacaacgucggcuucaacgugaagaacguguccgucaaggacgugcgccgggggaacguggccggcgacagcaagaacgacccgcccauggaggccgcgggcuucaccgcccaggucaucauccugaaccaccccgggcagaucuccgccggcuacgcccccgugcuggacugccacacggcccacaucgcgugcaaguucgccgagcucaaggagaagaucgaccgccggagcgggaagaagcuggaggacggccccaaguuccugaaguccggggacgccgccaucguggacauggucccgggcaagcccaugugcguggagagcuucagcgacuacccgccccucggccgcuucgccgugcgggacaugcgccagaccgucgcggugggggugaucaaggccgucgacaagaaggccgccggcgcggggaaggugaccaaguccgcccagaaggcccagaaggccaaguga

SEQ ID NO: 29508 - RNA, 1392 nt, Artificial Sequence
  derived and/or modified sequence opt1 from EEF1A2__Homo_sapiens__NP_001949
augggcaaggagaagacgcacaucaacaucguggucaucgggcacguggacagcggcaaguccaccacgaccgggcaccugaucuacaagugcggcgggaucgacaagcgcaccaucgagaaguucgagaaggaggccgccgagaugggcaagggcagcuucaaguacgcgugggugcucgacaagcugaaggccgagcgggagcgcgggaucaccaucgacaucucccuguggaaguucgagacgaccaaguacuacaucaccaucaucgacgcccccggccaccgggacuucaucaagaacaugaucaccgggacgagccaggccgacugcgccguccucaucguggcggccggcgugggggaguucgaggccggcaucuccaagaacggccagacccgcgagcacgcccugcuggcguacacccucggggucaagcagcugaucgugggcgugaacaagauggacagcaccgagccggccuacuccgagaagcgguacgacgagaucgucaaggaggugagcgccuacaucaagaagaucggguacaaccccgccacggugcccuucguccccaucuccggcuggcacggcgacaacaugcuggagccgagccccaacaugcccugguucaagggguggaagguggagcgcaaggagggcaacgccuccggggugagccuccuggaggcgcuggacaccauccugcccccgacccggcccaccgacaagccccugcgccugccccuccaggacgucuacaagaucggcgggaucggcacggugccggugggccgggucgagaccgggauccugcgccccggcaugguggugaccuucgcccccgucaacaucaccacggaggugaaguccguggagaugcaccacgaggcccugagcgaggcccuccccggggacaacgucggcuucaacgugaagaacgucuccgugaaggacauccggcgcgggaacgugugcggcgacagcaaguccgacccgccccaggaggccgcgcaguucaccagccaggucaucauccugaaccaccccggccagaucuccgccggguacagccccgugaucgacugccacaccgcccacaucgccugcaaguucgccgagcugaaggagaagaucgaccggcgcagcggcaagaagcucgaggacaacccgaagucccucaagagcggggacgcggccaucguggagaugguccccggcaagcccaugugcguggaguccuucagccaguacccgccccuggggcgguucgccgugcgcgacaugcggcagaccgucgccgugggcgugaucaagaacgucgagaagaaguccggcggggccggcaaggugaccaagagcgcgcagaaggcccagaaggccgggaaguga

SEQ ID NO: 29509 - RNA, 678 nt, Artificial Sequence
  derived and/or modified sequence opt1 from EEF1B2__Homo_sapiens__NP_001032752
augggcuucggggaccugaagucccccgccggccuccaggugcugaacgacuaccuggccgacaagagcuacaucgagggguacgucccgagccaggcggacguggccguguucgaggccgucuccagcccgccgcccgccgaccucugccacgcccugcgcugguacaaccacaucaaguccuacgagaaggagaaggcgagccugcccggcgugaagaaggcccucgggaaguacggccccgccgacguggaggacaccaccggcuccggggccacggacagcaaggacgacgacgacaucgaccuguucggcuccgacgacgaggaggagagcgaggaggcgaagcggcugcgcgaggagcggcucgcccaguacgaguccaagaaggccaagaagcccgcccuggucgccaagagcuccauccugcucgacgugaagcccugggacgacgagaccgacauggcgaagcuggaggagugcgugcgcagcauccaggccgacgggcuggucuggggcuccagcaagcucgugcccgugggguacggcaucaagaagcugcagauccagugcgucguggaggacgacaaggugggcaccgacaugcuggaggagcagaucaccgccuucgaggacuacguccaguccauggacguggccgccuucaacaagaucuga

SEQ ID NO: 29510 - RNA, 1944 nt, Artificial Sequence
  derived and/or modified sequence opt1 from EEF1D__Homo_sapiens__NP_001123525
augcgcagcggcaaggccuccugcacccuggagaccgugugggaggacaagcacaaguacgaggaggccgagcggcgcuucuacgagcacgaggcgacgcaggccgccgccagcgcccagcagcuccccgcggaggggccggccaugaacggccccgggcaggacgaccccgaggacgccgacgaggccgaggcgcccgacggcgggucccggcgcgacccgcgcaagagccaggacucccggaagccccugcagaagaagcggaagcgcagccccaaguccggccugggccccgccgaccucgcccugcuggggcucagcgccgagcgggucuggcuggacaagucccuguucgaccaggccgagagcuccuaccgccagaagcucgcggacguggccgcccaggccgccuggccgcccgcgcuggcccccuggggccugugcacccacgggaaccagguggccugccaccacgucaccuggggcaucugggugaacaagagcuccuucgaccaggccgagcgggccuucguggaguggagccaggcgcuccugcuggcccccgaggggucccgccggcagggcaccccgaacacgggccagcaggucgccgugcccgaccucgcccaccagcccagcccgcccgugaacgggcagccgccccugggcucccugcaggcccucguccgcgagguguggcuggagaagccccgguacgacgcggccgagcgcggguucuacgaggcccuguucgacggccacccgcccggcaaggugcggcuccaggagcgcgccgggcuggcggagggcgcccggcgcgggcggcgcgaccgccggggccgcaacauccuggggaacaagcgggccggccuccgccgggccgacggcgaggcccccagcgcgcugcccuacugcuacuuccugcagaaggacgccgaggcccccuggcucuccaagcccgccuacgacagcgccgagugccgccaccacgcggccgaggcccugcgggucgccuggugccuggaggccgcgagccucucccaccgccccgggccccggagcggccuguccgugagcucccugcgcccgaaccggaagauggccaccaacuuccucgcccacgagaagaucugguucgacaaguucaaguacgacgacgccgagcgccgguucuacgagcagaugaacgggcccguggcgggcgccagccgccaggagaacggggccuccgucauccugcgggacaucgcccgcgcccgggagaacauccagaagucccuggcgggcagcagcggccccggggccuccagcggcaccuccggggaccacggcgagcucguggugcgcaucgccagccuggaggucgagaaccagucccugcgcgggguggugcaggagcuccagcaggccaucagcaagcuggaggcccggcugaacguccucgagaaguccagcccgggccaccgcgcgaccgcgccccagacgcagcacgugucccccaugcgccagguggagcccccggccaagaagcccgccacccccgccgaggacgacgaggacgacgacaucgaccuguucggcagcgacaacgaggaggaggacaaggaggccgcccagcugcgggaggagcggcuccgccaguacgccgagaagaaggccaagaagcccgcgcuggucgccaagagcuccauccugcucgacgugaagccgugggacgacgagaccgacauggcccagcuggaggccugcguccggagcauccagcuggacgggcugguguggggcgccuccaagcucgugcccgucggguacggcauccgcaagcugcagauccagugcgugguggaggacgacaaggucggcaccgaccugcucgaggaggagaucacgaaguucgaggagcacgugcagagcguggacaucgcggccuucaacaagaucuga

SEQ ID NO: 29511 - RNA, 420 nt, Artificial Sequence
  derived and/or modified sequence opt1 from EEF1E1__Homo_sapiens__NP_001129122
auggccgccgcggccgagcugagccuccuggagaagucccugggccucagcaaggggaacaaguacuccgcccagggcgagcgccagauccccgugcugcagaccaacaacgggccgagccugaccggccucacgaccaucgccgcccaccuggucaagcaggcgaacaaggaguaccugcucggguccaccgccgaggagaaggccaucgugcagcaguggcuggaguaccgggugacccaggucgacggccacagcuccaagaacgacauccacacgcugcucaaggaccugaacagcuaccuggaggacaagguguaccucaccggcuacaacuucacccuggccgacauccugcucuacuacgggcugcaccgcuucaucauccggaagcugcgccacaccgaggugggcaacuga

SEQ ID NO: 29512 - RNA, 1314 nt, Artificial Sequence
  derived and/or modified sequence opt1 from EEF1G__Homo_sapiens__NP_001395
auggccgccggcacccuguacaccuaccccgagaacuggcgcgcguucaaggcccucaucgccgcccaguacagcggggcccaggugcggguccuguccgcgccgccccacuuccacuucggccagacgaaccgcacccccgaguuccugcggaaguuccccgccgggaaggugccggccuucgagggcgacgacggguucugcguguucgagagcaacgccaucgcguacuacgucuccaacgaggagcuccgcggcagcacccccgaggccgccgcccagguggugcagugggucuccuucgccgacagcgacaucgugccgcccgcguccaccuggguguuccccacgcugggcaucaugcaccacaacaagcaggccaccgagaacgccaaggaggagguccggcgcauccuggggcuccuggacgccuaccugaagacccggaccuuccucgugggcgagcgcgugacgcuggccgacaucaccgucgugugcacccugcucuggcuguacaagcagguccuggagcccagcuuccggcaggcguuccccaacaccaaccgcugguuccucacgugcaucaaccagccccaguuccgggccgugcugggggaggugaagcugugcgagaagauggcccaguucgacgccaagaaguucgccgagacccagccgaagaaggacacgccccgcaaggagaagggcucccgggaggagaagcagaagccccaggcggagcgcaaggaggagaagaaggccgccgcccccgccccggaggaggagauggacgagugcgagcaggcgcucgccgccgagcccaaggccaaggaccccuucgcgcaccuccccaagagcaccuucgugcuggacgaguucaagcggaaguacuccaacgaggacacccugagcgucgcccugccguacuucugggagcacuucgacaaggacggguggucccugugguacagcgaguaccgcuuccccgaggagcucacccagaccuucauguccugcaaccugaucaccggcauguuccagcggcuggacaagcuccgcaagaacgccuucgccagcgugauccuguucggcacgaacaacuccagcuccaucagcggggugugggucuuccggggccaggagcuggccuucccccucagccccgacuggcaggucgacuacgaguccuacaccuggcgcaagcuggacccggggagcgaggagacccagacccuggugcgggaguacuucuccugggagggcgcguuccagcacgugggcaaggccuucaaccaggggaagaucuucaaguga

SEQ ID NO: 29513 - RNA, 2577 nt, Artificial Sequence
  derived and/or modified sequence opt1 from EEF2__Homo_sapiens__NP_001952
auggugaacuucaccgucgaccagauccgcgccaucauggacaagaaggccaacauccggaacaugagcgugaucgcgcacguggaccacggcaaguccacccugacggacagccucgucugcaaggccgggaucaucgccuccgcccgcgccggcgagacccgguucaccgacacccgcaaggacgagcaggagcggugcaucacgaucaagagcaccgcgaucucccuguucuacgagcugagcgagaacgaccucaacuucaucaagcaguccaaggacggggccggcuuccugaucaaccugaucgacagccccgggcacguggacuucuccagcgaggugaccgccgcccuccgcgucaccgacggcgcgcuggugguggucgacugcguguccggcgugugcguccagacggagaccgugcugcggcaggccaucgccgagcgcaucaagccggugcucaugaugaacaagauggaccgggcccugcuggagcuccagcuggagcccgaggagcuguaccagaccuuccagcgcaucgucgagaacgugaacgugaucaucagcaccuacggggagggcgaguccgggcccaugggcaacaucaugaucgaccccguccucgggacggugggcuucggcagcgggcugcacggcugggccuucacccugaagcaguucgcggagauguacguggccaaguucgccgccaagggggagggccagcucggcccggccgagcgggcgaagaaggucgaggacaugaugaagaagcuguggggcgaccgcuacuucgaccccgccaacgggaaguucuccaagagcgccaccucccccgaggggaagaagcugccccggaccuucugccagcucauccuggacccgaucuucaagguguucgacgccaucaugaacuucaagaaggaggagacggccaagcugaucgagaagcucgacaucaagcuggacagcgaggacaaggacaaggagggcaagccccugcucaaggcggugaugcgccgguggcugcccgccggggacgcccugcuccagaugaucaccauccaccuccccuccccggucaccgcccagaaguaccgcugcgagcugcuguacgagggcccgcccgacgacgaggccgcgaugggcaucaagagcugcgaccccaaggggccccugaugauguacaucagcaagauggugcccaccuccgacaagggccgguucuacgccuucgggcgcgucuucagcggccugguguccacggggcucaaggugcggaucaugggccccaacuacacccccggcaagaaggaggaccuguaccugaagccgauccagcgcaccauccucaugauggggcgguacgucgagcccaucgaggacgugcccugcggcaacaucguggggcuggucggcguggaccaguuccuggugaagaccgggacgaucaccaccuucgagcacgcccacaacaugcgcgucaugaaguucagcgugucccccgugguccgcguggccguggaggcgaagaacccggccgaccuccccaagcuggucgagggccugaagcggcucgccaagagcgaccccauggugcagugcaucaucgaggaguccggcgagcacaucaucgccggggccggcgagcugcaccuggagaucugccucaaggaccuggaggaggaccacgcgugcauccccaucaagaaguccgacccgguggucagcuaccgcgagaccgugagcgaggaguccaacgugcugugccugagcaagucccccaacaagcacaaccggcucuacaugaaggcccgccccuucccggacgggcuggccgaggacaucgacaagggcgaggucagcgcccggcaggagcugaagcagcgcgcccgguaccucgcggagaaguacgagugggacguggccgaggcccgcaagaucuggugcuucggccccgacgggacgggccccaacauccugaccgacaucaccaagggggugcaguaccugaacgagaucaaggacuccgucguggccggcuuccagugggccaccaaggagggggcgcucugcgaggagaacaugcggggcgugcgcuucgacguccacgacgugacgcugcacgccgacgccauccaccggggcgggggccagaucauccccaccgcccgccggugccuguacgcgagcgugcucaccgcccagccgcgccugauggagcccaucuaccuggucgagauccagugccccgagcaggucgucgggggcaucuacggggugcucaaccggaagcgcggccacguguucgaggagucccagguggccggcacccccauguucguggugaaggccuaccugccggugaacgagagcuucggguucacggccgaccugcgguccaacaccggcgggcaggcguucccccagugcgucuucgaccacuggcagauccuccccggcgaccccuucgacaacagcagccgcccgucccaggugguggccgagacccggaagcgcaaggggcugaaggagggcauccccgcccuggacaacuuccucgacaagcuguga

SEQ ID NO: 29514 - RNA, 1791 nt, Artificial Sequence
  derived and/or modified sequence opt1 from EEFSEC__Homo_sapiens__NP_068756
auggccggccgccgggugaacgucaacgugggggugcugggccacaucgacagcgggaagaccgcccucgcgcgcgcccuguccaccacggccagcaccgccgccuucgacaagcagccccagucccgggagcgcggcaucacccuggaccucggguucagcugcuucuccgucccgcugcccgcgcggcugcgcagcucccuccccgaguuccaggccgcccccgaggccgagccggagcccggcgagccccugcuccaggugacccugguggacugccccggccacgcgagccugauccggacgaucaucgggggcgcccagaucaucgaccugaugaugcucgucaucgacgugaccaaggggaugcagacccaguccgccgagugccuggugaucggccagaucgccugccagaagcuggucguggugcucaacaagaucgaccugcugccggaggggaagcgccaggccgcgaucgacaagaugaccaagaagaugcagaagacgcucgagaacaccaaguuccggggcgcccccaucauccccgucgccgccaagcccggcgggccggaggcccccgagaccgaggcgccccagggcauccccgagcugaucgagcugcucaccagccagaucuccaucccgacgcgcgaccccagcgggcccuuccugauguccguggaccacugcuucagcaucaagggccagggcaccgugaugaccgggaccauccuguccggcagcaucucccucggggacagcgucgagauccccgcccugaagguggugaagaaggucaaguccaugcagauguuccacaugccgaucacgagcgccaugcagggcgaccggcuggggaucugcgugacccaguucgaccccaagcuccuggagcgcggccuggugugcgcccccgagagccuccacaccguccacgccgcgcugaucuccguggagaagauccccuacuuccggggcccgcugcagaccaaggccaaguuccacaucacgguggggcacgagaccgucaugggccgccucauguucuucagccccgcccccgacaacuucgaccaggagcccauccuggacuccuucaacuucagccaggaguaccuguuccaggagcaguaccucuccaaggaccugaccccggccgugaccgacaacgacgaggccgacaagaaggcggggcaggccacggagggccacugcccccggcagcagugggcccuggucgaguucgagaagcccgugaccugcccgcgccucugccuggugaucgggagccggcuggacgccgacauccacaccaacacgugccgccucgcguuccacggcauccugcugcacggccucgaggaccggaacuacgccgacuccuuccugccccgccugaaggucuacaagcucaagcacaagcacgggcugguggagcgggccauggacgacuacagcgugaucggccgcucccuguucaagaaggagaccaacauccagcuguucgucgggcucaaggugcaccugagcaccggcgagcuggggaucaucgacuccgccuucggccagagcggcaaguucaagauccacauccccgggggccucucccccgagagcaagaagauccugaccccggcccugaagaagcgcgcgcgggccgggcgcggcgaggccacccggcaggaggaguccgccgagcgcagcgagcccucccagcacgugguccucagccugacguucaagcgguacguguucgacacccacaagcgcauggugcagucccccuga

SEQ ID NO: 29515 - RNA, 429 nt, Artificial Sequence
  derived and/or modified sequence opt1 from EFCAB11__Homo_sapiens__NP_001271195
auguucuucagcgaggcccgcgcccggucccgcaccugggaggcgagccccuccgagcaccggaaguggguggaggucuucaaggccugcgacgaggaccacaagggcuaccugagccgcgaggacuucaagaccgccguggugaugcuguucggguacaagccguccaagaucgaggucgacagcgugauguccagcaucaaccccaacacguccggcauccuccuggagggguuccucaacaucgugcggaagaagaaggaggcccagcgcuaccggaacgagguccgccacaucuucaccgccuucgacaccuacuaccggggcuuccugacccuggaggacuucaagaaggcguuccgccagguggcccccaagcuccccgagcggacggugcuggaggucuuccgcgggaucuucagcgccuga

SEQ ID NO: 29516 - RNA, 480 nt, Artificial Sequence
  derived and/or modified sequence opt1 from EFCAB1__Homo_sapiens__XP_005251361
augaaccgcaagaagcugcagaagcucaccgacacccugacgaagaacugcaagcaccuguuccggggcuucgacaaggacaacgacgggugcgugaacguccucgaguggauccacggccugagccuguuccuccgcgggucccuggaggagaagaugaaguacugcuucgagguguucgaccugaacggcgacggguucaucagcaaggaggagauguuccacaugcucaagaacucccugcugaagcagcccagcgaggaggacccggacgagggcaucaaggaccucguggagaucacccugaagaagauggaccacgaccacgacggcaagcuguccuucgccgacuacgagcucgccguccgggaggagacccugcugcucgaggcguucgggcccugccugcccgaccccaagagccagauggaguucgaggcccagguguucaaggacccgaacgaguucaacgacauguga

SEQ ID NO: 29517 - RNA, 1482 nt, Artificial Sequence
  derived and/or modified sequence opt1 from EFEMP1__Homo_sapiens__NP_001034438
augcugaaggcccucuuccugaccaugcugacccucgcccuggucaagagccaggacacggaggagaccaucaccuacacccagugcacggacggcuacgagugggaccccgugcgccagcagugcaaggacaucgacgagugcgacaucgugccggacgcgugcaagggcgggaugaagugcgugaaccacuacgggggcuaccugugccuccccaagaccgcccagaucaucgucaacaacgagcagccccagcaggagacccagcccgccgaggggaccuccggcgccacgaccggcgugguggccgcgagcuccauggccaccagcgggguccugccgggcgggggcuucguggccuccgccgcggccguggccgggcccgagaugcagaccggccggaacaacuucgucauccgccggaaccccgccgacccccagcgcaucccgagcaaccccucccaccggauccagugcgccgcgggcuacgagcagagcgagcacaacgugugccaggacaucgacgagugcacggccgggacccacaacugccgcgccgaccaggugugcaucaaccugcggggcuccuucgccugccagugcccgcccggguaccagaagcgcggcgagcagugcgucgacaucgacgagugcaccaucccgcccuacugccaccagcggugcgugaacacccccggcagcuucuacugccagugcucccccggguuccagcucgccgcgaacaacuacacgugcguggacaucaacgagugcgacgccagcaaccagugcgcccagcagugcuacaacauccugggcuccuucaucugccagugcaaccagggguacgagcugagcuccgaccgccucaacugcgaggacaucgacgagugccggaccagcuccuaccugugccaguaccagugcgucaacgagcccggcaaguucagcugcaugugcccccagggguaccagguggugcgcucccggaccugccaggacaucaacgagugcgagaccacgaacgagugccgcgaggacgagaugugcuggaacuaccacggcggcuuccggugcuacccccgcaaccccugccaggacccguacauccugacccccgagaaccggugcgucugccccgugagcaacgccaugugccgcgagcucccccagagcaucguguacaaguacauguccauccggagcgaccgcuccgucccgagcgacaucuuccagauccaggccaccaccaucuacgcgaacacgaucaacaccuuccggaucaaguccgggaacgagaacggcgaguucuaccugcgccagaccagccccguguccgccaugcuggugcucgucaagagccuguccgggccccgcgagcacaucguggaccuggagaugcucaccgucagcuccaucggcacguuccggaccagcuccgugcugcgccugaccaucaucguggggcccuucagcuucuga

SEQ ID NO: 29518 - RNA, 1332 nt, Artificial Sequence
  derived and/or modified sequence opt1 from EFEMP2__Homo_sapiens__NP_058634
augcugcccugcgccagcugccucccgggcucccugcugcucugggcccugcugcuccugcugcucgggagcgcgagcccccaggacuccgaggagcccgacuccuacaccgagugcaccgacggcuacgagugggaccccgacagccagcacugccgcgacgugaacgagugccugacgaucccggaggccugcaagggggagaugaagugcaucaaccacuacggcggguaccugugccucccccgguccgccgccgucaucaacgaccugcacggcgagggcccgccgccgcccgugccgcccgcccagcaccccaaccccugcccgcccggguacgagcccgacgaccaggacagcugcguggacgucgacgagugcgcgcaggcccugcacgacugccgccccucccaggacugccacaaccuccccggcagcuaccagugcacgugccccgacggguaccggaagaucggccccgagugcguggacaucgacgagugccgcuaccgguacugccagcaccgcugcgugaaccugcccggguccuuccggugccagugcgagcccggcuuccagcugggccccaacaaccgcagcugcgucgacgugaacgagugcgacaugggggcccccugcgagcagcggugcuucaacuccuacggcaccuuccucugccgcugccaccagggguacgagcugcaccgggacggcuucagcugcuccgacaucgacgagugcagcuacuccagcuaccugugccaguaccgcugcaucaacgagcccggccgguucuccugccacugcccccagggguaccagcuccuggccacccgccugugccaggacaucgacgagugcgagagcggcgcgcaccagugcagcgaggcccagaccugcgugaacuuccacgggggcuaccggugcgucgacaccaaccgcugcguggagcccuacauccagguguccgagaaccggugccucugcccggccagcaacccccugugccgcgagcagcccuccagcaucguccaccgguacaugaccaucaccuccgagcgcagcgugccggccgacguguuccagauccaggccacguccgucuaccccggggcguacaacgccuuccagauccgggccggcaacagccagggcgacuucuacauccgccagaucaacaacguguccgccaugcuggugcucgcccgccccgucaccgggccccgggaguacgugcuggaccuggagauggugaccaugaacagccucauguccuaccgcgcgagcuccguccugcggcugaccguguucgugggcgccuacacguucuga

SEQ ID NO: 29519 - RNA, 2502 nt, Artificial Sequence
  derived and/or modified sequence opt1 from EFHB__Homo_sapiens__NP_653316
augaacauggagaucggccacccccacgaggggaaggacgaccugggcgacaagcgcgugaucauggggaccaaguucccgauggagcucggcauccgggucgggcugggcaaggaggacagccgcugcggcgagucccccguggugagcaacaagugcgaggggcggauggccccgcccgagaccaaguucccccuguccaagggccucgagauggggcuggagcgccagaacaucagccggacggucaugcagcgcggcucccuggggguggacagcguguccgccagccagggcaccaagcccucccuccugcccggccggauggggcuggagaacgagagccuccuggcgggcuacacccacgagcgcaucauccagcccccgcuggggcgggucugcggcuccagccaggccgccggcucccgccgggcgccccucgccagcgggcccgagggcguggaggagcugguggggaagcccgccuucgucauggagccgcgccaggagauggagaaggagagcacgugcgugcugaugaagcccaacaccgagaucaagcuccccguggaggucgacaucggccugacccaggccgaggggcccgacgagaccaagaacaccgagccgcagaugggccuggugaucgagccgccccagugccaguucgcccagcagcacgagcagcggaaggaggccggcaacaucgaguccgggguggagccgcccgaccgcauccggcccaucuacuccggcaaguucuucgaccgcacgcccugcuggcccagcgcggggaaggucauccccgugggcuaccggguggcgaccugccucaccgagaagcugccccgccugaucaccccgcccgaggccaagaaguacuucaacuuccgguacccgcccgccggggucgagcgcguguucuacggccgggccaacgacccccagaucgcccccuaccucacgcacggcauccgcuccaagaucagcgugcuggccaacacccugaucaacccccagcccaucaccaccuuccagcagaagaucaaggacaagaaggagagcaucuaccucuccaaccgccgggcgccccugggcaagagccacgaccaggccccggggcugcccaaggggauggacacgaccaacaccaccuucggcacggccgucaucaaggaguacuccgccaaggacguggugaacccgcccaagagcuacgaggaggucuucaaggaggggaacgagggccacgaccucuacguggucucccacaacgacuacuacgccggcgaggccaagaaccgcaaguacaaccccagcuccuuccaccggugcagcguguacggggugcccacgccccacuucaacgacggccgcgccauggccaagucccuguacuggcugcacgagcuccagaugaagcgcggggcgaaguucgucagcaagcgggccgacgacuucaaggagaaguuccagcacaagcugggccgggugcuggaccccaucgccgagaccaugaacgugccgcccgacugcaccuucggcgccugccuccgccccgaggaguacggggucggcgaccugauccacaaccggcugcccgacgaguaccuccgcgggaaggaccggcagcgcgcccugaucgcggccgugcggcaccaccugaagaaggugaacuaccagaaguucgacacccuccuggccgccuuccgccacuacgacaagaagggcgacgggaugaucgacaaggacgagcugcaggaggcgugcgaccaggccaaccucucccuggacgacaagcugcucgaccagcuguucgacuacugcgacgucgacaacgacggcuucaucaacuaccuggaguucgccaacuuccucaacuggaaggacaagaugcugcugaaggaguacgaggagcgggugaucaucaagggccgcaagccggacugcgugaaccccaccgaggccaacgucgaggagcccgagcagacccugcucaucaagcccgaggacaucgugcugaaggaggccgggagcaccgagaagacgcugcggacccuccugcgcccguccgacaaggugagcaacuacuacaagaccaccuccagcgagaucaacgcgaucgucggcgccauccccuccacgugcuaccccaucugcggggugcccaccauccggagcgacaucccggcgccccgcauccgccggaucuccgaccgcaccaacuacggcgaggaggggagcgccuacagccugcucuaccccaccaucuucgcccggaagggcguguucgagcgcgacuucuucaagacgcgguccaaggaggagaucgccgagauccugugcaacaucggcgucaagcugagcgacgaggaguucgagaacguguggaaccucgccuccaagaagcaccaccgcggggaggugugcgucgagaacauccggaacgugcuggacgagcugcgccacgccgaccggaucaagugcaagacccucauguga

SEQ ID NO: 29520 - RNA, 1866 nt, Artificial Sequence
  derived and/or modified sequence opt1 from EFHC1__Homo_sapiens__NP_001165891
augcugaagaccgccuuccaccgcagccagacccucuccuaccggaacggcuacgccaucgugcgccggcccacggucgggaucggcggggaccgccugcaguucaaccagcugagccaggcggagcucgacgagcuggccuccaaggccccggugcugaccuacggccagcccaagcaggccccgcccgccgacuucauccccgcgcacguggccuucgacaagaagguccucaaguucgacgccuacuuccaggaggacgugcccaugagcaccgaggagcaguaccggauccgccaggugaacaucuacuacuaccuggaggacgacuccaugagcgucaucgagcccgugguggagaacuccgggauccugcagggcaagcucaucaagcggcagcgccuggccaagaacgaccggggcgaccacuaccacuggaaggaccugaaccgcgggaucaacaucaccaucuacggcaagacguuccgggucguggacugcgaccaguucacccagguguuccucgagagccaggggaucgagcugaacccgcccgagaagauggcgcuggaccccuacaccgagcuccgcaagcagccccugcggaaguacgucacccccuccgacuucgaccagcugaagcaguuccucacguucgacaagcagguccugcgcuucuacgccaucugggacgacaccgacagcauguacggcgagugccggaccuacaucauccacuacuaccugauggacgacaccguggagauccgcgaggugcacgagcggaacgacgggcgcgacccguucccccuccugaugaaccggcagcgcgugcccaaggugcuggucgagaacgccaagaacuucccccagugcgugcucgagaucuccgaccaggaggugcuggagugguacacggccaaggacuucaucgucggcaagagccugaccauccucggccggaccuucuucaucuacgacugcgacccguucacccgccgcuacuacaaggagaaguucgggaucacggaccugccccggaucgacguguccaagcgcgagcccccgcccgugaagcaggagcugccgcccuacaacggcuucgggcucgucgaggacagcgcccagaacugcuucgcgcugauccccaaggcccccaagaaggacgugaucaagaugcuggucaacgacaacaaggugcuccgguaccuggccgugcuggagucccccauccccgaggacaaggaccgccgguucgucuucagcuacuuccucgccaccgacaugaucuccaucuucgagcccccggugcgcaacagcggcaucaucggcgggaaguaccugggccggaccaagguggucaagcccuacuccaccguggacaaccccguguacuacgggccgagcgacuucuucaucggcgccgucaucgagguguucgggcaccgcuucaucauccuggacacggacgaguacgugcucaaguacauggagagcaacgcggcccaguacucccccgaggcccuggccagcauccagaaccacguccggaagcgcgaggcccccgcgcccgaggccgaguccaagcagaccgagaaggacccgggcgugcaggagcuggaggcccucaucgacaccauccagaagcagcugaaggaccacagcugcaaggacaacauccgggaggccuuccagaucuacgacaaggaggccuccggcuacguggaccgcgacauguucuucaagaucugcgagagccugaacguccccguggacgacucccucgugaaggagcugauccggaugugcagccacggggagggcaagaucaacuacuacaacuucguccgcgcguucuccaacuga

SEQ ID NO: 29521 - RNA, 2250 nt, Artificial Sequence
  derived and/or modified sequence opt1 from EFHC2__Homo_sapiens__NP_079460
auggcccugccccuccugccgggcaacagcuucaaccgcaacguggggaaggagaaguuccacaagucccagcacuggggcuucugcaacaacgucaugaugcuggugagcgacgagaagcccgggaucggcggggagccccuccugggccagaagaucaagcccaagugcuccaucuacccgaagggcgacgggagcgacgugcccuccugggucgccuucgacaagcagguccugagcuucgacgcguaccucgaggaggaggugcuggacaagucccagaccaacuaccggauccgcuacuacaagaucuacuucuaccccgaggacgacaccauccaggugaacgagcccgaggugaagaacagcggccugcuccaggggacguccauccggcgccaccggaucacccugccgccgcccgacgaggaccaguucuacaccguguaccacuucaacgucggcaccgaggugguguucuacgggcgcacguucaagaucuacgacugcgacgccuucacccggaacuuccugcgcaagaucggcgucaaggugaacccgcccgugcagugccccgaggaccccuacaugaagauccggcgcgaggucguggagcacguggagccccuccggcccuacgagagccuggacacccugaagcaguuccuccaguaccacggcaagauccugugcuucuucugccugugggacgacuccgucagcauguucggggaccgccgggagcucauccugcacuacuuccugugcgacgacaccaucgagaucaaggagcuccugccccacuccagcggccgcgacgcccugaagauguuccuccggcgcuccaagcugcccaagaacugcccgccccggguguaccagcccgggcagaucacggaccgcgccgugcugaacagcuacggcgacuucaucaagaaccaggccgacggcuaccucuucgaccgguacaagcuggggaaggucgaccaggaguucuacaaggacuccgaccugagccucggcgugaccaucaacgugugggggcgcaagguccugcuguacgacugcgacgaguucaccaaguccuacuacaagagcaaguacggcaucgagaacuucaccagcguguccugcaagccgcccagcccgccgcccaagaucgagcggaaguucccgcccuacaacggguucggcuccgaggaggacagccuccgcaacugcaucgaccugaagcccacgccccaccgccggaacuucaagaaguucauggagaaggacuccuacggcagcaaguccaacauccugcgcuucuucgcgaagcucgucaccgacaagugcguggaccuggaccggauguucgugaucagcuacuaccugggggacgacaccaucuccgucuucgagcccaucgagcgcaacagcggcaucgccgggggcauguuccucaagcggucccgcgugaagaagcccgggcaggagguguucaagagcgagcuguccgaguacaucaaggccgaggagcuguacaucggcgucaccgugaacgugaacggcuaccucuuccggcugcugaacgccgacgaguacacgcucaacuacauggagcagaacaccgacaaguaccccuucagcaaccugaagcuggcgcuccagaagcugaagcaggaggaggggaagucccgcgagcugaagcaggucuucaaggccgccgacagcaagcacaccaacaugguggacuacaacaccuuccgggacauccugaugucccucacggugggcaaccuggccgagcaggaguucgucaccaucgcccgccacuaccgggugcccgaggggaccugcagcgacauggacuuccugaucgcgcucgcccacgagaaguucaagaagaacauguucgagaacuucgacaccuucaucuacuccugcguguacgaggaccgcgagaagaagaacguccugcccacgaaggacaucaagcggcugugcaagagcagccgccucccccuguccgacgaccugcucgagagccugcugucccgguucgaggacagcgagaagcagaucgacuacaaguccuucuucagcgcccucaacuggcgcaagaaccccgugcccgagcugcagccggccuccuaccugaaggagcggugcgaggacguguggcucggcaugcccagccccauccccgccaaguacaucgacuacuggaccuuccugaaggacgcguucgggcuggaggaggaguga

SEQ ID NO: 29522 - RNA, 432 nt, Artificial Sequence
  derived and/or modified sequence opt1 from EFHD1__Homo_sapiens__NP_001230181
augggcgagcugcaguacgacgccgggcgcgacggcuucaucgaccucauggagcugaagcugaugauggagaagcucggggcgccccagacccaccugggccucaagagcaugaucaaggagguggacgaggacuucgacgggaagcuguccuuccgggaguuccugcugaucuuccacaaggccgccgccggcgagcuccaggaggacagcggccugauggcccuggccaagcucuccgagaucgacgucgcgcuggagggggugaagggcgccaagaacuucuucgaggccaaggugcaggcccugagcuccgcgagcaaguucgaggccgagcucaaggccgagcaggacgagcgcaagcgggaggaggaggagcgccggcugcgccaggccgccuuccagaagcugaaggcgaacuucaacaccuga

SEQ ID NO: 29523 - RNA, 618 nt, Artificial Sequence
  derived and/or modified sequence opt1 from EFNA1__Homo_sapiens__NP_004419
auggaguuccugugggcgccccuccugggccugugcugcagccucgccgccgccgaccgccacaccguguucuggaacuccagcaacccgaaguuccggaacgaggacuacaccauccacguccagcugaacgacuacguggacaucaucugcccccacuacgaggaccacuccguggccgacgccgccauggagcaguacauccuguaccucgucgagcacgaggaguaccagcugugccagccccagagcaaggaccaggugcgcuggcagugcaaccggcccuccgccaagcacgggccggagaagcugagcgagaaguuccagcgcuucacgcccuucacccucggcaaggaguucaaggaggggcacuccuacuacuacaucagcaagcccauccaccagcacgaggaccggugccugcgccugaaggugaccgucuccggcaagaucacccacagcccccaggcccacgacaacccgcaggagaagcggcucgccgccgacgaccccgaggugcgcgugcugcacuccaucgggcacagcgcggcgccccggcuguucccccucgccuggacgguccugcugcucccgcugcugcuccugcagacccccuga

SEQ ID NO: 29524 - RNA, 642 nt, Artificial Sequence
  derived and/or modified sequence opt1 from EFNA2__Homo_sapiens__NP_001396
auggcccccgcccagcgcccgcugcucccccugcugcuccugcugcucccccugcccccgccgcccuucgcgcgggccgaggacgccgcccgcgccaacagcgaccgguacgcgguguacuggaaccgcuccaacccccgguuccacgccggcgccggggacgacggcgggggcuacaccgucgaggugagcaucaacgacuaccuggacaucuacugcccccacuacggggcgccccucccgcccgccgagcgcauggagcacuacgugcuguacauggucaacggcgagggccacgccuccugcgaccaccggcagcgcggguucaagcggugggagugcaaccgccccgccgcccccggcgggccccugaaguucagcgagaaguuccagcuguucacccccuucucccucggcuucgaguuccggccggggcacgaguacuacuacaucagcgccacgccgcccaacgcgguggaccgccccugccugcggcucaagguguacguccgccccaccaacgagacccuguacgaggcccccgagcccaucuucaccuccaacaacagcugcuccagccccggcggcugccggcuguuccucuccacgaucccggugcuguggacccugcucgggagcuga

SEQ ID NO: 29525 - RNA, 717 nt, Artificial Sequence
  derived and/or modified sequence opt1 from EFNA3__Homo_sapiens__NP_004943
auggccgccgcgccccugcuccugcugcuccugcuggugccggucccccuccugccccugcucgcccagggccccgggggcgcccuggggaaccgccacgccguguacuggaacagcuccaaccagcaccuccggcgcgagggcuacaccgugcaggucaacgugaacgacuaccuggacaucuacugcccgcacuacaacagcuccggggugggccccggcgccgggcccggccccgggggcggggcggagcaguacguccuguacauggugagccggaacggcuaccggaccugcaacgccucccagggcuucaagcgcugggagugcaaccgcccgcacgccccgcacagccccaucaaguucuccgagaaguuccagcgguacagcgccuucucccugggguacgaguuccacgcgggccacgaguacuacuacaucagcacgcccacccacaaccuccacuggaagugccugcgcaugaagguguucgucugcugcgccuccaccagccacuccggggagaagccggugcccacccugccccaguucacgaugggccccaacgugaagaucaacguccucgaggacuucgagggcgagaacccccaggugcccaagcuggagaaguccaucagcgggaccagccccaagcgggagcaccucccccuggccgugggcaucgccuucuuccugaugaccuuccuggccuccuga

SEQ ID NO: 29526 - RNA, 606 nt, Artificial Sequence
  derived and/or modified sequence opt1 from EFNA4__Homo_sapiens__NP_005218
augcgccugcucccccugcugcggaccgugcucugggccgccuuccugggcagcccgcugcgcgggggcuccagccuccggcacgucguguacuggaacuccagcaacccccgccugcugcgcggggacgcgguggucgagcucggccugaacgacuaccuggacaucgugugcccccacuacgaggggcccggcccgcccgagggccccgagaccuucgcccucuacaugguggacuggcccggguacgaguccugccaggccgagggcccgcgggccuacaagcggugggucugcagccugcccuucgggcacgugcaguucuccgagaagauccagcgcuucacgcccuucagccugggcuucgaguuccuccccggggagaccuacuacuacaucuccgugccgacccccgagagcuccggccagugccugcggcugcaggucagcgugugcugcaaggagcgcaaguccgagagcgcccaccccgugggcucccccggggagagcggcaccuccggguggcggggcggcgacacgccgagcccccucugccugcugcuccugcugcuccugcugauccuccgccugcugcggauccucuga

SEQ ID NO: 29527 - RNA, 687 nt, Artificial Sequence
  derived and/or modified sequence opt1 from EFNA5__Homo_sapiens__NP_001953
augcugcacguggagaugcucacccuggucuuccuggugcucuggaugugcguguucagccaggaccccggcuccaaggccgucgccgaccgcuacgcgguguacuggaacagcuccaacccgcgguuccagcgcggggacuaccacaucgacgugugcaucaacgacuaccuggacgucuucugcccccacuacgaggacagcgugcccgaggacaagaccgagcgguacgugcuguacauggucaacuucgacggcuacuccgccugcgaccacacgagcaagggguucaagcgcugggagugcaaccggccccacuccccgaacggcccccucaaguucagcgagaaguuccagcuguucacccccuucucccugggguucgaguuccgccccggccgggaguacuucuacaucagcuccgccaucccggacaacggccgccggagcugccucaagcugaagguguucgugcgccccaccaacuccugcaugaagaccaucgggguccacgaccggguguucgacgugaacgacaaggucgagaacagccuggagcccgccgacgacacggugcacgaguccgccgagcccagccgcggcgagaacgcggcccagaccccgcggauccccucccgccuccuggccauccuccuguuccugcuggccaugcuccugacccuguga

SEQ ID NO: 29528 - RNA, 1041 nt, Artificial Sequence
  derived and/or modified sequence opt1 from EFNB1__Homo_sapiens__NP_004420
auggcccgccccggccagcgguggcuggggaaguggcucguggccauggucgugugggcgcugugccgccuggccacgccccucgccaagaaccuggagcccgugagcugguccagccugaaccccaaguuccucuccggcaaggggcuggucaucuaccccaagaucggcgacaagcuggacaucaucugcccgcgggccgaggccgggcgccccuacgaguacuacaagcucuaccuggugcggcccgagcaggcggccgccugcagcaccgugcuggaccccaacguccucgugaccugcaaccgcccggagcaggagauccgguucaccaucaaguuccaggaguucucccccaacuacaugggccuggaguucaagaagcaccacgacuacuacaucaccagcaccuccaacggcagccuggaggggcucgagaaccgcgagggcggggugugccggacgcgcaccaugaagaucaucaugaaggucggccaggaccccaacgccgugacccccgagcagcugaccacgucccggccgagcaaggaggcggacaacaccgugaagauggccacccaggcccccgggucccgcggcagccugggcgacuccgacgggaagcacgagaccgucaaccaggaggagaaguccggccccggggccagcggcggcagcuccggggaccccgacggcuucuucaacagcaagguggcccucuucgcggccgugggggccggcugcgucaucuuccugcugaucaucaucuuccucacggugcugcugcucaagcugcggaagcgccaccggaagcacacccagcagcgcgccgccgcgcugucccucagcacccuggccagcccgaagggcggguccggcaccgccgggacggagcccagcgacaucaucaucccccugcggaccaccgagaacaacuacugcccccacuacgagaagguguccggcgacuacgggcacccggucuacaucgugcaggagaugccgccccagagccccgccaacaucuacuacaagguguga

SEQ ID NO: 29529 - RNA, 1002 nt, Artificial Sequence
  derived and/or modified sequence opt1 from EFNB2__Homo_sapiens__NP_004084
auggccgugcgccgggacagcgucuggaaguacugcuggggcgugcugauggugcucugccgcaccgccaucuccaagagcaucguccuggagcccaucuacuggaacuccagcaacuccaaguuccugcccgggcagggccucgugcuguacccccagaucggggacaagcuggacaucaucugccccaagguggacagcaagaccgucggccaguacgaguacuacaagguguacaugguggacaaggaccaggcggaccggugcacgaucaagaaggagaacacgccccuccugaacugcgccaagccggaccaggacaucaaguucaccaucaaguuccaggaguucucccccaaccugugggggcucgaguuccagaagaacaaggacuacuacaucaucagcaccuccaacggcagccuggagggccuggacaaccaggagggcggggucugccagacccgcgccaugaagauccucaugaagguggggcaggacgccuccagcgccggcuccacccggaacaaggaccccacccgccggcccgagcuggaggcggggaccaacggccgcagcuccacgaccagcccguucgugaagcccaaccccggcuccagcaccgacgggaacuccgccggccacagcgggaacaacauccugggcagcgaggucgcccucuucgccggcaucgcguccgggugcaucaucuucaucgugaucaucaucacccuggugguccugcuccugaaguaccggcgccggcaccgcaagcacagcccccagcacacgaccacccugucccucagcacccuggccacgccgaagcgguccggcaacaacaacgggagcgagcccuccgacaucaucaucccccugcgcaccgccgacagcguguucugcccccacuacgagaagguguccggcgacuacgggcacccggucuacaucgugcaggagaugccgccccagagccccgccaacaucuacuacaagguguga

SEQ ID NO: 29530 - RNA, 1023 nt, Artificial Sequence
  derived and/or modified sequence opt1 from EFNB3__Homo_sapiens__NP_001397
augggcccgccccacagcgggcccggcggggugcgcgucggcgcccugcuccugcugggggugcucggccugguguccggccugagccucgagcccgucuacuggaacuccgccaacaagcgguuccaggcggagggcggguacgugcuguacccccagaucggggaccgccuggaccuccugugcccccgggcccgcccgcccggcccccacagcucccccaacuacgaguucuacaagcuguaccucgucgggggcgcccagggccggcgcugcgaggccccgcccgcccccaaccugcugcugaccugcgaccggcccgaccucgaccugcgcuucaccaucaaguuccaggaguacagccccaaccucugggggcacgaguuccggucccaccacgacuacuacaucaucgcgacgagcgacggcacccgcgaggggcuggagucccugcagggcggcgugugccucacccgggggaugaaggugcugcugcgcgugggccagagcccccgcgggggcgccgucccccggaagccgguguccgagaugcccauggagcgggaccgcggggccgcccacagccucgagcccggcaaggagaaccugcccggcgacccgaccuccaacgcgacgagccgcggggccgagggcccccugcccccgcccuccaugcccgccguggccggggccgcgggcgggcucgcccugcugcuccugggcgucgccggcgccgggggcgccaugugcuggcggcggcgccgggcgaagcccagcgagucccgccaccccgggccgggcagcuucgggcgcggcggcucccuggggcucggcgggggcggcgggaugggcccccgggaggccgagcccggggagcugggcaucgcccugcgcgggggcggcgccgccgacccgcccuucugcccccacuacgagaaggugagcggggacuacggccaccccguguacaucguccaggacgggccgccccagagcccgcccaacaucuacuacaagguguga

SEQ ID NO: 29531 - RNA, 2466 nt, Artificial Sequence
  derived and/or modified sequence opt1 from EFR3A__Homo_sapiens__NP_055952
augcccacccgcgugugcugcugcugcagcgcccugcggccccgcuacaagcggcucgucgacaacaucuuccccgaggaccccaaggacggccuggugaagaccgacauggagaagcugacguucuacgccguguccgcgcccgagaagcucgaccgcaucgggagcuaccuggccgagcggcugucccgcgacgucgugcggcaccgcagcggcuacgugcucaucgccauggaggcccuggaccagcugcucauggccugccacucccagagcaucaagccguucgucgaguccuuccugcacaugguggcgaagcugcucgagagcggggagcccaagcuccaggugcugggcaccaacuccuucgucaaguucgccaacaucgaggaggacacccccagcuaccaccggcgcuacgacuucuucgugucccgguucagcgccaugugccacuccugccacagcgaccccgagauccgcaccgagauccggaucgccgggauccgcggcauccagggcgugguccggaagacggugaacgacgagcugcgcgcgaccaucugggagccgcagcacauggacaagaucgugcccucccugcuguucaacaugcagaagaucgaggaggucgacagccggaucgggccgcccuccagcccguccgccaccgacaaggaggagaaccccgccgugcucgccgagaacugcuuccgcgagcugcugggccgggccaccuucgggaacaugaacaacgcggugcgccccgucuucgcccaccucgaccaccacaagcugugggaccccaacgaguucgccgugcacugcuucaagaucaucauguacagcauccaggcccaguacagccaccacgugauccaggagauccugggccaccucgacgcccggaagaaggacgcgccgcgcguccgcgccgggaucauccaggugcugcuggaggccguggccaucgccgcgaagggcuccaucggccccacgguccucgagguguucaacacccugcugaagcaccuccggcugagcgucgaguucgaggccaacgaccugcagggcggguccguggggagcgugaaccucaacaccuccagcaaggacaacgacgagaagaucguccagaacgccaucauccagaccaucggcuucuucggcuccaaccugcccgacuaccagcgcagcgagaucaugauguucaucauggggaaggugcccguguucggcacguccacccacacccuggacaucagccagcucggggaccugggcacccggcgcauccagaucaugcugcuccggucccugcugauggucacgagcggguacaaggccaagaccaucgugaccgcccucccgggcuccuuccuggacccccugcucagccccucccugauggaggacuacgagcugcgccagcucgugcuggaggucaugcacaaccugauggaccggcacgacaaccgcgcgaagcugcggggcauccgcaucauccccgacguggccgaccucaagaucaagcgggagaagaucugccgccaggacaccagcuucaugaagaagaacgggcagcagcuguaccggcacaucuaccugggcugcaaggaggaggacaacgugcagaagaacuacgagcuccuguacacgucccuggcccucaucaccaucgagcuggccaacgaggaggucgugaucgaccugauccgccucgcgaucgcccugcaggacagcgccaucaucaacgaggacaaccugccgauguuccaccggugcgggaucauggcccucguggccgcguaccugaacuucgucucccagaugaucgccgugcccgccuucugccagcacgugagcaaggucaucgagauccgcaccauggaggcccccuacuuccugcccgagcacaucuuccgggacaagugcaugcuccccaagagccuggagaagcacgagaaggaccuguacuuccucaccaacaagaucgccgagucccugggcgggagcggcuacuccguggagcgccugagcgugcccuacgucccccaggugacggacgaggaccggcucucccgccgcaagagcaucguggacaccgucuccauccagguggacauccugagcaacaacgugccguccgacgacgucgugagcaacaccgaggagaucaccuucgaggcgcugaagaaggccaucgacacguccggcauggaggagcaggagaaggagaagcggcgccucgugaucgagaaguuccagaaggcccccuucgaggagaucgccgcccagugcgagagcaaggcgaaccugcugcacgaccggcucgcccagauccuggagcugaccauccgcccgccgcccucccccagcgggacccucaccaucacguccggccacgcccaguaccagagcguccccguguacgagaugaaguuccccgaccugugcguguacuga

SEQ ID NO: 29532 - RNA, 2454 nt, Artificial Sequence
  derived and/or modified sequence opt1 from EFR3B__Homo_sapiens__NP_055786
auguacggcgugugcgggugcugcggcgcccugcgcccccgguacaagcgccucgucgacaacaucuucccggaggaccccgaggacgggcuggugaagaccaacauggagaagcugaccuucuacgcccucagcgcgcccgagaagcuggaccggaucggcgccuaccuguccgagcgccucauccgggacguggggcgccaccgguacggcuacgucugcaucgccauggaggcccuggaccagcugcucauggccugccacugccagagcaucaaccuguucguggaguccuuccugaagaugguggcgaagcuccuggagagcgagaagcccaaccugcagauccucggcacgaacuccuucgucaaguucgccaacaucgaggaggacaccccgagcuaccaccgcuccuacgacuucuucgugagccgguucuccgagaugugccacagcucccacgacgaccuggagaucaagaccaagauccgcaugagcgggaucaagggccugcagggggugguccggaagaccgugaacgacgagcuccaggccaacaucugggacccccagcacauggacaagaucgugcccucccugcuguucaaccuccagcacgucgaggaggccgagagccgcucccccagcccgcugcaggcgcccgagaaggagaaggagucccccgccgagcuggccgagcggugccuccgcgagcugcugggccgggccgccuucgggaacaucaagaacgcgaucaagcccgugcucauccaccuggacaaccacagccugugggagccgaagguguucgccauccgcugcuucaagaucaucauguacuccauccagccccagcacagccaccucgucauccagcagcugcugggccaccucgacgccaacagccgguccgccgccacggugcgcgcgggcaucguggagguccugagcgaggccgccgugaucgccgccaccggguccgugggccccaccguccuggagauguucaacacccuccugcggcagcugcgccucagcaucgacuacgcgcugacgggguccuacgacggcgccgugagccugggcaccaagaucaucaaggagcacgaggagcggauguuccaggaggccgugaucaagaccgucggguccuucgccagcacccuccccacguaccagcgcuccgaggugauccuguucaucaugagcaaggucccgcgccccucccugcaccaggccguggacaccggccggaccggggagaaccgcaaccggcucacccagaucaugcugcucaagagccugcuccagguguccacgggcuuccagugcaacaacaugaugagcgcgcugcccuccaacuuccuggaccgccugcugagcaccgcccugauggaggacgccgagauccgccucuucguccuggagauccugaucuccuucaucgaccgccacgggaaccggcacaaguucagcaccaucuccacccucagcgacaucagcgugcugaagcugaagguggacaagugcucccgccaggacacggucuucaugaagaagcacagccagcagcucuaccggcacaucuaccuguccugcaaggaggagaccaacgugcagaagcacuacgaggcccuguacggccuccuggcgcugaucagcaucgagcucgccaacgaggagguggucguggaccugauccgccuggugcucgccguccaggacguggcccaggugaacgaggagaaccugcccgucuacaaccggugcgcccuguacgcgcucggcgccgccuaccugaaccugaucucccagcucaccaccgugccggccuucugccagcacauccacgaggugaucgagacgcgcaagaaggaggcccccuacaugcugcccgaggacgucuucguggagcggccccgccugagccagaaccucgacgggguggucaucgagcugcuguuccggcaguccaagaucagcgaggugcucggcggguccggcuacaacagcgaccgccugugccugccguacaucccccagcucaccgacgaggaccggcuguccaagcgccggagcaucggggagaccaucucccuccagguggaggucgagagccgcaacucccccgagaaggaggagcgcgugcccgcggaggagaucaccuacgagacgcugaagaaggccaucguggacagcgucgccguggaggagcaggagcgggagcgccggcgccagguggucgagaaguuccagaaggccccguucgaggagaucgccgcgcacugcggcgcccgggccucccugcugcagagcaagcucaaccagaucuucgagaucaccauccggcccccgcccagccccuccggcaccaucaccgccgcguacgggcagccccagaaccacagcauccccguguacgagaugaaguucccggaccugugcguguacuga

SEQ ID NO: 29533 - RNA, 1179 nt, Artificial Sequence
  derived and/or modified sequence opt1 from EFS__Homo_sapiens__NP_001264103
auggccaucgccaccagcguguacgucgugcccccgcccgcgcgccccugccccaccuccggcccgcccgccgggcccugcccgcccagccccgaccugaucuacaagaucccccgggccuccggcacgcagcucgccgcgccccgcgacgcccuggagguguacgacgucccgcccaccgcccugcgggugcccagcuccgggcccuacgacugcccggccagcuucucccacccccucacccgcguggcgccccagcccccgggcgaggacgacgccccgcccagccccgagccgcccggggcccuggccucccacgaccaggacacccuggcccagcuccuggcccggagcccgcccccgccccaccgcccccggcugcccuccgcggagagccucucccgccggccccugcccgcccugcccguccccgaggcccccagccccucccccgugccgagccccgcccccggccgcaagggcuccauccaggaccggccccucccgcccccgccgccccgccugcccggguacggcgggcccaagguggagggcgaccccgaggggcgggagauggaggacgaccccgccggccaccacaacgaguacgagggcauccccauggcggaggaguacgacuacguccaccugaaggggauggacaaggcccagggcagccgcccgcccgaccaggccugcacgggggaccccgagcuccccgagcggggcaugcccgccccgcaggaggcccugucccccggcgagccccugguggugagcaccggggaccuccagcugcuguacuucuacgcgggccagugccagagccacuacuccgcccuccaggccgccgucgccgcgcugaugagcuccacccaggccaaccagcccccgcgccuguucgugccccacagcaagcggguggucguggccgcccaccgccucguguucgucggggacacccugggccggcuggcggccuccgcgccccuccgcgcccaggugcgggccgccgggacggcccugggccaggcccugcgcgccaccgugcucgccgucaagggcgcggcccugggguaccccagcuccccggccauccaggagauggugcagugcgugaccgagcuggccggccaggcccuccaguucaccacgcugcugaccagccucgcgcccuga

SEQ ID NO: 29534 - RNA, 3210 nt, Artificial Sequence
  derived and/or modified sequence opt1 from EFTUD1__Homo_sapiens__NP_001035700
auggugcugaacagccucgacaagaugauccagcugcagaagaacaccgccaacauccgcaacaucugcguccuggcccacguggaccacggcaacgaggaguaccucaucaaccugaucgacucccccgggcacguggacuucagcuccgaggucagcaccgcggugcggaucugcgacggcugcaucaucguggucgacgccguggagggggugugcccgcagacgcaggccguccugcgccaggccuggcucgagaacauccggcccgugcuggugaucaacaagaucgaccgccugaucgucgagcucaaguucacgccccaggaggccuacucccaccugaagaacauccuggagcagaucaacgcgcucaccggcacccuguucaccagcaaggugcuggaggagcgggccgagcgcgagaccgagucccaggugaaccccaacagcgagcagggggagcaggucuacgacugguccaccggccucgaggacaccgacgacagccaccuguacuucuccccggagcagggcaacgugguguucacgagcgccaucgacggguggggcuucgggaucgagcacuucgcccggaucuacucccagaagaucggcaucaagaaggagguccugaugaagacccucuggggcgacuacuacaucaacaugaaggcgaagaagaucaugaagggggaccaggccaagggcaagaagccccuguucgugcagcugauccucgagaacaucuggagccuguacgacgccgugcugaagaaggacaaggacaagaucgacaagaucgucaccucccucgggcugaagaucggcgcccgcgaggcccggcacagcgaccccaaggugcagaucaacgcgaucugcucccaguggcugcccaucagccacgccgugcucgccauggucugccagaagcugccgagcccccuggacaucaccgccgagcgcguggagcggcucaugugcacggggucccagaccuucgacagcuucccgcccgagacccaggcccugaaggcggccuucaugaagugcggcuccgaggacaccgcccccgucaucaucuucgugagcaagauguucgccguggacgccaaggcgcugccccagaacaagccccgcccccucacgcaggaggagaucgcccagcggcgcgagcgggcccgccagcggcacgccgagaagcuggccgcggcccagggccaggccccgcuggagcccacccaggacggguccgccaucgagaccugccccaagggcgaggagccccgcggggacgagcagcaggucgagagcaugaccccgaagcccgugcuccaggaggagaacaaccaggaguccuucaucgcguucgcccggguguucagcggcgucgcccgccgggggaagaagaucuucgugcugggccccaaguacagcccccuggaguuccuccgccgcgugccgcugggcuucuccgccccgcccgacgggcugccccaggucccccacauggccuacugcgcgcucgagaaccuguaccugcucaugggccgggagcuggaguaccuggaggaggugccgcccgggaacgugcucggcaucgggggccugcaggacuucguccugaaguccgccacgcugugcagccuccccuccugcccgcccuucaucccccugaacuucgaggccacccccaucgugcgcguggccgucgagcccaagcaccccagcgagaugccccagcuggugaagggcaugaagcuccugaaccaggccgacccgugcgugcagauccugauccaggagaccggggagcacguccucgugaccgcgggcgaggugcaccuccagcggugccuggacgaccugaaggagcgcuucgccaagauccacaucuccgucagcgagcccaucauccccuuccgggagacgaucaccaagcccccgaagguggacauggugaacgaggagaucgggaagcagcagaaggucgccgugauccaccagaugaaggaggaccaguccaagauccccgagggcauccagguggacagcgacgggcugaucaccaucaccacgcccaacaagcuggccacccucuccguccgcgccaugccccugccggaggaggugacccagauccuggaggagaacagcgaccucauccgguccauggagcagcugaccagcagccugaacgagggcgagaacacgcacaugauccaccagaagacccaggagaagaucugggaguucaagggcaagcucgagcagcaccugaccgggcgccgguggcgcaacaucguggaccagaucugguccuucggcccccggaagugcgggcccaacauccuggucaacaagagcgaggacuuccagaacuccguguggaccggccccgcggacaaggccagcaaggaggccucccgcuaccgggaccucggcaacagcaucguguccggguuccagcuggccacgcugagcggcccgaugugcgaggagccccucaugggggucugcuucgugcuggagaagugggaccuguccaaguucgaggagcagggcgcgagcgaccucgccaaggaggggcaggaggagaacgagaccugcuccggcggcaacgagaaccaggagcugcaggacgggugcagcgaggccuucgagaagcgcaccucccagaagggcgagagcccccugaccgacugcuacgggcccuucuccggccagcucaucgccaccaugaaggaggccugccgguacgcgcuccaggugaagccgcagcgccugauggccgccauguacacgugcgacaucauggccaccggggacguccugggccggguguacgccgugcugagcaagcgcgagggccggguccugcaggaggagaugaaggaggggaccgacauguucaucaucaaggcggugcuccccguggccgaguccuucggcuucgccgacgagauccgcaagcgcaccagcgggcuggccagcccccagcuggucuucucccacugggagaucaucccgagcgaccccuucugggugcccacgaccgaggaggaguaccuccacuucggcgagaaggccgacuccgagaaccaggcgcggaaguacaugaacgccgugcgcaagcggaaggggcuguacgucgaggagaagaucguggagcacgccgagaagcagcgcacccugagcaagaacaaguga

SEQ ID NO: 29535 - RNA, 2814 nt, Artificial Sequence
  derived and/or modified sequence opt1 from EFTUD2__Homo_sapiens__NP_001136077
auggacgacgacgacgacgacgacgacgugggcgaccacgacgacgaccaccccgggauggaggucgugcugcacgaggacaagaaguacuacccgaccgccgaggagguguacggccccgaggucgagaccaucgugcaggaggaggacacgcagccccucaccgagcccaucaucaagccggugaagaccaagaaguucacccugauggagcagacgcugcccgucaccguguacgagauggacuuccucgccgaccugauggacaacagcgagcugauccgcaacgugacccucugcgggcaccuccaccacggcaagaccugcuucgucgacugccugaucgagcagacgcaccccgagauccggaagcgcuacgaccaggaccugugcuacaccgacauccuguucaccgagcaggagcgcggggugggcaucaaguccacccccgugacggucgugcugccggacaccaagggcaagagcuaccucuucaacaucauggacacccccgggcacgugaacuucuccgacgaggucaccgcgggccugcggaucagcgacgggguggugcuguucaucgacgccgccgagggcgucaugcucaacacggagcggcugaucaagcacgccgugcaggagcgccuggccgugaccgucugcaucaacaagaucgaccggcucauccuggagcugaagcucccgcccaccgacgcguacuacaagcugcgccacaucguggacgaggugaacgggcugaucuccauguacagcaccgacgagaaccucauccugagcccccugcucggcaacgucugcuucuccuccagccaguacuccaucugcuucacgcugggcagcuucgccaagaucuacgccgacaccuucggggacaucaacuaccaggaguucgccaagcggcuguggggcgacaucuacuucaaccccaagacccgcaaguucaccaagaaggcgcccacguccagcucccagcggagcuucguggaguucauccucgagccccuguacaagauccuggcccaggucgugggggacguggacaccucccucccgcgcacccuggacgagcugggcauccaccucaccaaggaggagcugaagcugaacauccggccccuccugcgccuggucugcaagaaguucuucggcgaguucacgggguucguggacaugugcgugcagcacauccccagccccaaggucggcgccaagccgaagaucgagcacaccuacaccgggggcguggacuccgaccucggggaggccaugagcgacugcgaccccgacggcccccugaugugccacaccacgaagauguacagcaccgacgacggcgugcaguuccacgccuucgggcggguccuguccggcaccauccacgcggggcagcccgugaaggugcucggcgagaacuacacccuggaggacgaggaggacagccagaucugcacggucgggcgccuguggaucuccguggcccgguaccacaucgaggugaaccgcgucccggccggcaacugggugcucaucgagggcguggaccagcccaucgucaagaccgccaccaucaccgagccccgggggaacgaggaggcccagaucuuccgcccccugaaguucaacaccacgagcgugaucaagaucgcgguggagccggucaaccccuccgagcugcccaagaugcuggacggccuccggaaggugaacaagagcuacccgucccugaccaccaagguggaggagagcggggagcacgucauccugggcaccggggagcucuaccuggacugcgugaugcacgaccugcgcaagauguacuccgagaucgacaucaagguggccgaccccgucgugacguucugcgagaccguggucgagaccagcucccucaagugcuucgccgagacccccaacaagaagaacaagaucacgaugaucgccgagccccuggagaagggccuggccgaggacaucgagaacgagguggugcagaucaccuggaaccgcaagaagcucggcgaguucuuccagaccaaguacgacugggaccugcuggcggcccggagcaucugggccuucgggccggacgccaccggccccaacauccucgucgacgacacgcugcccuccgagguggacaaggcccugcucgggagcgugaaggacuccaucguccagggcuuccaguggggcacccgcgaggggccccugugcgacgagcugauccggaacgugaaguucaagauccucgacgcgguggucgcccaggagccgcugcaccgcggcgggggccagaucauccccaccgcccggcgcgugguguacagcgccuuccugauggcgacgccccggcucauggagcccuacuacuucgucgaggugcaggccccggccgacugcguguccgccgucuacaccgugcuggcccgccggcgcgggcacgugacccaggacgcgcccauccccggcagcccccuguacaccaucaaggccuucaucccggccaucgacuccuucggcuucgagaccgaccuccggacgcacacccaggggcaggccuucagccugagcgucuuccaccacuggcagaucgugcccggcgacccccuggacaaguccaucgugauccgcccccucgagccgcagcccgcgccccaccuggcccgggaguucaugaucaagacccgccggcgcaaggggcugagcgaggacgucuccaucagcaaguucuucgacgaccccaugcuccuggagcuggccaagcaggacgugguccucaacuacccgauguga

SEQ ID NO: 29536 - RNA, 3501 nt, Artificial Sequence
  derived and/or modified sequence opt1 from EGF__Homo_sapiens__NP_001171601
augcugcucacccugaucauccugcuccccguggucagcaaguucuccuucgugagccuguccgccccgcagcacuggagcugccccgagggcacccuggccgggaacggcaacuccacgugcguggggcccgcgcccuuccucaucuucagccacggcaacuccaucuuccgcaucgacaccgaggggaccaacuacgagcagcuggucguggacgccggcgugagcgucaucauggacuuccacuacaacgagaagcggaucuacuggguggaccuggagcgccagcuccugcagcggguguuccugaacggcucccgccaggagcgggucugcaacaucgagaagaacgugagcgggauggccaucaacuggaucaacgaggaggugaucugguccaaccagcaggagggcaucaucaccgucacggacaugaaggggaacaacagccacauccuccuguccgcccugaaguacccggccaacguggcgguggaccccgucgagcgcuucaucuucuggagcuccgagguggccggcagccucuaccgggccgaccuggacggggugggcgucaaggcccugcucgagaccuccgagaagaucaccgcggugagccuggacgugcuggacaagcgccucuucuggauccaguacaaccgggagggcuccaacagccugaucugcagcugcgacuacgacgggggcuccguccacaucagcaagcaccccacccagcacaaccuguucgccaugucccucuucggggaccgcaucuucuacagcacguggaagaugaagaccaucuggaucgccaacaagcacaccggcaaggacauggugcggaucaaccugcacuccagcuucgugccccugggcgagcucaaggucgugcacccgcuggcccagcccaaggccgaggacgacaccugggagcccgagcagaagcugugcaagcuccgcaaggggaacugcuccagcacggucugcggccaggaccugcagucccaccugugcaugugcgcggagggguacgcccucagccgggaccgcaaguacugcgaggacgugaacgagugcgccuucuggaaccacggcugcacccuggggugcaagaacacccccggcuccuacuacugcacgugcccggugggcuucguccugcuccccgacgggaagcggugccaccagcuggugagcugcccccgcaacguguccgagugcagccacgacugcguccugaccuccgagggcccccucugcuucugcccggaggggagcgugcuggagcgggacggcaagaccugcuccgggugcagcucccccgacaacggcggcugcagccagcugugcgugccccucagccccgucuccugggagugcgacugcuucccgggguacgaccugcagcuggacgagaaguccugcgccgccagcggcccccagcccuuccuccuguucgcgaacagccaggacauccgccacaugcacuucgacgggaccgacuacggcacccugcucucccagcagauggggaugguguacgcccuggaccacgaccccguggagaacaagaucuacuucgcccacacggcccugaaguggaucgagcgggccaacauggacggcagccagcgcgagcggcugaucgaggagggcgucgacgugccggaggggcucgcgguggacuggaucggccgccgcuucuacuggaccgaccgggggaagucccugaucggccgcagcgaccugaacggcaagcgguccaagaucaucaccaaggagaacaucagccagccccgcgggaucgccguccaccccauggccaagcgccucuucuggaccgacacgggcaucaacccccggaucgaguccagcucccugcaggggcugggccggcucgugaucgccagcuccgaccugaucuggccgagcgggaucaccaucgacuuccugaccgacaagcucuacuggugcgacgccaagcaguccgugaucgagauggcgaaccuggacggcagcaagcgccggcgccugacccagaacgacgucggccaccccuucgccguggccguguucgaggacuacgucugguucagcgacugggccaugcccuccgugaugcgggugaacaagcgcacggggaaggaccggguccgccuccagggcagcaugcugaagccguccagccugguggugguccacccccucgcgaagcccggggccgaccccugccuguaccagaacggcgggugcgagcacaucugcaagaagcggcugggcaccgccuggugcuccugccgcgagggcuucaugaaggccagcgacgggaagaccugccucgcccuggacggccaccagcugcucgccgggggcgagguggaccugaagaaccaggugaccccgcuggacauccucuccaagacgcgggucagcgaggacaacaucaccgagucccagcacaugcugguggcggagaucauggugagcgaccaggacgacugcgcccccgucgggugcuccauguacgcccgcugcaucagcgagggcgaggacgcgaccugccagugccugaagggcuucgccggggacggcaagcucugcuccgacaucgacgagugcgagaugggggugcccgugugcccgcccgccagcuccaagugcaucaacaccgagggcggguacgucugccggugcagcgagggcuaccagggcgacgggauccacugccuggacuccacgcccccgccccaccuccgcgaggacgaccaccacuacagcgugcgcaacuccgacagcgagugcccccugagccacgacggcuacugccugcacgacggggugugcauguacaucgaggcccuggacaaguacgccugcaacugcgucgugggcuacaucggcgagcggugccaguaccgcgaccucaaguggugggagcugcggcacgccgggcacggccagcagcagaaggugaucgucguggcggugugcgucguggugcuggucaugcuccugcugcucucccuguggggcgcccacuacuaccgcacccagaagcugcucagcaagaaccccaagaaccccuacgaggaguccagccgggacgugcgcucccggcgccccgccgacaccgaggacgggaugagcuccugcccgcagcccugguucguggucaucaaggagcaccaggaccugaagaacgggggccagcccguggccggcgaggacgggcaggcggccgacggcagcaugcagcccaccuccuggcggcaggagccgcagcugugcgggaugggcaccgagcaggggugcuggauccccgucagcuccgacaagggcagcugcccccaggugauggagcgcuccuuccacaugcccagcuacggcacgcagacccucgagggcgggguggagaagccgcacucccugcugagcgccaacccccucuggcagcagcgggcccuggacccgccccaccagauggagcugacccaguga

SEQ ID NO: 29537 - RNA, 1665 nt, Artificial Sequence
  derived and/or modified sequence opt1 from EGFL6__Homo_sapiens__NP_001161362
augccccugccguggagccucgcccugccccugcuccuguccuggguggccggcggguucggcaacgcggccagcgcccgccaccacgggcugcucgccuccgcccggcagcccggcgucugccacuacgggaccaagcuggcgugcugcuacggcuggcgccggaacagcaagggcgugugcgaggcgaccugcgagcccgggugcaaguucggcgagugcguggggccgaacaagugccgcugcuuccccggcuacacggggaagaccugcucccaggacgucaacgagugcggcaugaagccccggcccugccagcaccgcugcgugaacacccacggcagcuacaagugcuucugccuguccgggcacaugcucaugccggacgcgaccugcgugaacagccggacgugcgccaugaucaacugccaguacuccugcgaggacaccgaggagggcccccagugccugugccccagcuccgggcugcgccucgcccccaacggccgggacugccuggacaucgacgagugcgccagcggcaaggucaucugcccguacaaccgccggugcgugaacaccuucggguccuacuacugcaagugccacaucggcuucgagcugcaguacaucagcgggcgcuacgacugcaucgacaucaacgagugcaccauggacucccacacgugcagccaccacgccaacugcuucaacacccagggcuccuucaagugcaagugcaagcagggguacaagggcaacggccuccggugcagcgccauccccgagaacuccgugaaggagguccugcgcgcccccgggaccaucaaggaccggaucaagaagcugcucgcccacaagaacagcaugaagaagaaggccaagaucaagaacgugacccccgagccgacgcgcacccccacccccaaggugaaccugcagcccuucaacuacgaggagaucgucagccggggcgggaacucccacggcgggaagaagggcaacgaggagaagaugaaggagggccuggaggacgagaagcgcgaggagaaggcccucaagaacgacaucgaggagcggagccugcgcggggacguguucuucccgaaggugaacgaggccggcgaguucgggcugauccucguccagcggaaggcccugaccuccaagcuggagcacaaggcggaccucaacaucagcguggacugcuccuucaaccacggcaucugcgacuggaagcaggaccgcgaggacgacuucgacuggaaccccgccgaccgcgacaacgccaucggguucuacauggccgugcccgcccuggcgggccacaagaaggacaucggccggcugaagcuccugcugcccgaccuccagccgcagagcaacuucugccugcuguucgacuaccgccucgccggggacaaggucggcaagcugcggguguucgugaagaacuccaacaacgcccuggccugggagaagacgaccagcgaggacgagaaguggaagaccgggaagauccagcucuaccagggcaccgacgccacgaaguccaucaucuucgaggcggagcgcggcaaggggaagaccggcgagaucgccgucgacggggugcugcuggugagcggccucugccccgacucccugcugagcgucgacgacuga

SEQ ID NO: 29538 - RNA, 822 nt, Artificial Sequence
  derived and/or modified sequence opt1 from EGFL7__Homo_sapiens__XP_011517068
augcgcggcagccaggaggugcugcucauguggcugcugguccucgccgucgggggcaccgagcacgccuaccggcccgggcgccgggugugcgccgugcgcgcccacggcgacccgguguccgagagcuucgugcagcgggucuaccagcccuuccugaccacgugcgacgggcaccgcgccugcuccaccuaccggaccaucuaccgcaccgccuaccggcgcagccccggccuggcccccgcgcggccgcgcuacgccugcugccccggcuggaagcggacguccgggcuccccggcgccugcggggccgcgaucugccagcccccgugccgcaacggcgggagcugcgugcagcccggccggugccgcugccccgccggcuggcgcggggacacgugccaguccgacguggacgagugcagcgcccggcggggcgggugcccccagcgcugcgucaacaccgccggcuccuacuggugccagugcugggagggccacagccuguccgccgacgggacccugugcgugccgaagggcgggccgccccggguggcgcccaaccccaccggcgucgacagcgccaugaaggaggaggugcagcgccuccagucccgcguggaccugcuggaggagaagcuccagcugguccuggcgccccuccacagccuggccucccaggcccuggagcacgggcuccccgaccccggcagccugcuggugcacuccuuccagcagcucggccggaucgacagccuguccgagcagaucagcuuccuggaggagcagcucgggagcugcuccugcaagaaggacagcuga

SEQ ID NO: 29539 - RNA, 882 nt, Artificial Sequence
  derived and/or modified sequence opt1 from EGFL8__Homo_sapiens__NP_085155
augggcagccgcgccgagcugugcacccuccucgggggcuucuccuuccugcugcugcugauccccggggagggcgccaagggcgggagccuccgggagucccagggcgugugcagcaagcagacccuggucgugccccugcacuacaacgaguccuacagccagcccguguacaagcccuaccucacgcugugcgcggggcgccggaucugcuccaccuaccgcaccauguaccgggucauguggcgcgaggugcggcgcgaggugcagcagacccacgccgucugcugccagggcuggaagaagcggcaccccggggcccugacgugcgaggccaucugcgccaagccgugccucaacggcggggugugcgugcgccccgaccagugcgagugcgcgcccggcuggggcgggaagcacugccacgucgacguggacgagugccggaccagcaucacccugugcucccaccacugcuucaacaccgccggcagcuucacgugcgggugcccccacgaccuggugcucggcgucgacggccggaccugcauggagggguccccggagccgcccaccagcgccuccauccugagcguggccgugcgcgaggcggagaaggacgagcgcgcccugaagcaggagauccacgagcuccggggccgccuggagcggcuggagcagugggccgggcaggccggcgccuggguccgcgcggugcuccccgugccgcccgaggagcugcagcccgagcaggucgccgagcugugggggcggggcgaccgcaucgagucccucagcgaccaggugcugcugcucgaggagcggcugggcgccugcuccugcgaggacaacagccuggggcucggcgugaaccaccgcuga

SEQ ID NO: 29540 - RNA, 3054 nt, Artificial Sequence
  derived and/or modified sequence opt1 from EGFLAM__Homo_sapiens__NP_001192230
auggaccugauccgcggcgugcuccugcggcugcuccugcuggccagcucccucgggcccggcgccgucagccugcgcgcggccauccggaagccggggaaggugggcccgccccuggacaucaagcucggggcccugaacugcaccgccuucuccauccaguggaagaugccccgccaccccggcagccccauccugggcuacaccguguucuacuccgaggucggggccgacaagagccuccaggagcagcugcacuccgugccccugagccgggacauccccacgaccgaggaggugaucggcgaccucaagccggggaccgaguaccgcgucuccaucgcggccuacagccaggccggcaaggggcggcuguccagcccccgccacgugaccacgcugucccaggacagcugccucccgcccgccgcgccccagcagccccacgugaucgucguguccgacagcgagguggcccuguccuggaagcccggcgccagcgagggcuccgcccccauccaguacuacagcgucgaguucauccggccggacuucgacaagaaguggaccagcauccacgagcgcauccagauggacuccauggugaucaaggggcuggaccccgacaccaacuaccaguucgccgugcgggcgaugaacagccacggccccagcccccgcuccuggccguccgacaucauccggacccucugccccgaggaggccgggagcggccgcuacggcccccgguacaucacggacaugggggccggcgaggacgacgagggguucgaggacgaccuggaccuggacaucuccuucgaggaggucaagccccucccggccaccaagggcgggaacaagaaguuccugguggagagcaagaagauguccaucagcaaccccaagaccaucucccgccugaucccgcccaccagcgccucccuccccgugacgaccgucgcgccccagcccaucccgauccagcggaagggcaagaacggcguggccaucaugagccgccuguucgacaugcccugcgacgagacccugugcuccgccgacagcuucugcgugaacgacuacaccuggggcgggucccggugccagugcacccucgggaagggcggggagagcugcuccgaggacaucgucauccaguacccccaguucuucggccacagcuacgugaccuucgagccccugaagaacagcuaccaggccuuccagaucacccuggaguuccgcgccgaggcggaggacggccuccugcuguacugcggggagaacgagcacggccgcggggacuucaugucccucgccaucauccggcgcagccugcaguuccgguucaacugcggcaccgggguggccaucaucgucuccgagacgaagaucaagcugggcggcuggcacaccgugaugcucuaccgcgacgggcugaacggccugcuccagcugaacaacgggaccccggucaccggccagagccagggccaguacuccaagaucacguuccggacgccccuguaccucgggggcgcccccagcgccuacuggcuggugcgcgcgaccgggaccaaccggggcuuccaggggugcgugcagucccuggccgucaacggccgccggaucgacaugcgccccuggccgcucggcaaggcccugagcggggccgacgugggcgagugcuccagcgggaucugcgacgaggcguccugcauccacggcgggaccugcaccgccaucaaggccgacagcuacaucugccugugcccccugggcuucaagggccggcacugcgaggacgccuucacccucaccaucccccaguuccgcgagucccugcggagcuacgccgcgacgcccuggccgcuggagccccagcacuaccucuccuucauggaguucgagaucaccuuccgccccgacagcggggacggcgugcugcuguacuccuacgacaccgggagcaaggacuuccucagcaucaaccuggccggcgggcacgucgaguuccgguucgacugcggcuccggcaccggggugcugcgcagcgaggacccccucacgcugggcaacuggcacgagcugcgggugucccgcaccgccaagaacgggauccuccaggucgacaagcagaagaucguggagggcauggccgagggcggguucacccagaucaagugcaacaccgacaucuucaucggcggggugccgaacuacgacgacgucaagaagaacagcggcgugcugaagcccuucuccgggagcauccagaagaucauccugaacgaccggaccauccacgugaagcacgacuucacguccggcgucaacguggagaacgccgcgcaccccugcgugcgcgcccccugcgcccacggcgggagcugccggccgcgcaaggagggcuacgacugcgacugcccccucggguucgagggccugcacugccagaaggagugcgggaacuacugccugaacaccaucaucgaggccaucgagaucccccaguucaucggccgcuccuaccucaccuacgacaaccccgacauccugaagcgggucagcggcucccgcagcaacguguucaugcgguucaagaccacggccaaggacgggcugcuccuguggcgcggcgacuccccgaugcggcccaacagcgacuucaucucccuggggcuccgcgacggcgcgcugguguucagcuacaaccugggguccggcgucgccagcaucauggugaacggcuccuucaacgacgggcgguggcaccgcgugaaggccguccgggacggccagagcgggaagaucaccguggacgacuacggcgcccgcaccggcaagagccccgggaugaugcggcagcucaacaucaacggcgcgcuguacgucgggggcaugaaggagaucgcccugcacaccaaccgccaguacaugcgggggcucgugggcugcaucucccacuucacgcugagcaccgacuaccacaucucccugguggaggacgccguggacggcaagaacaucaacacgugcggggccaaguga

SEQ ID NO: 29541 - RNA, 3633 nt, Artificial Sequence
  derived and/or modified sequence opt1 from EGFR__Homo_sapiens__NP_005219
augcgccccagcggcaccgccggggccgcccugcucgcccugcuggccgcccucugcccggccucccgggcgcuggaggagaagaaggugugccagggcaccagcaacaagcugacgcagcucgggaccuucgaggaccacuuccugucccugcagcgcauguucaacaacugcgaggucgugcucggcaaccuggagaucaccuacgugcagcggaacuacgaccugagcuuccucaagaccauccaggaggucgccggguacgugcugaucgcccugaacacgguggagcgcaucccccucgagaaccugcagaucauccggggcaacauguacuacgagaacuccuacgcccuggcgguccucagcaacuacgacgccaacaagaccggccugaaggagcugcccaugcgcaaccuccaggagauccugcacggggccgugcgguucuccaacaaccccgcccugugcaacguggagagcauccaguggcgcgacaucgucuccagcgacuuccucuccaacaugagcauggacuuccagaaccaccugggcuccugccagaagugcgacccgagcugccccaacggguccugcuggggcgccggggaggagaacugccagaagcugaccaagaucaucugcgcgcagcagugcagcggccggugccgcggcaagucccccagcgacugcugccacaaccagugcgccgccgggugcaccggcccccgggaguccgacugccucgugugccgcaaguuccgggacgaggccacgugcaaggacacgugcccgccccugaugcuguacaaccccaccaccuaccagauggacgugaaccccgaggggaaguacagcuucggcgcgaccugcgucaagaagugcccgcgcaacuacguggugaccgaccacggcagcugcguccgggccugcggggccgacuccuacgagauggaggaggacggcgugcgcaagugcaagaagugcgaggggcccugccggaaggugugcaacggcaucgggaucggcgaguucaaggacagccucuccaucaacgccaccaacaucaagcacuucaagaacugcaccagcaucuccggcgaccugcacauccugcccgucgccuuccgcggggacagcuucacgcacacgcccccgcucgacccccaggagcuggacauccugaagaccgugaaggagaucaccggcuuccuccugauccaggccuggcccgagaaccggaccgaccugcacgcguucgagaaccucgagaucauccgcgggcggaccaagcagcacggccaguucucccuggccguggucagccugaacaucaccucccucgggcugcgcagccugaaggagaucuccgacggcgacgugaucaucagcggcaacaagaaccucugcuacgccaacaccaucaacuggaagaagcuguucgggacguccggccagaagaccaagaucaucagcaaccgcggggagaacuccugcaaggccaccggccaggugugccacgcccugugcagccccgaggggugcuggggcccggagccccgggacugcgucuccugccgcaacgugagccggggccgcgagugcgucgacaagugcaaccuccuggagggggagccccgggaguucguggagaacuccgagugcauccagugccaccccgagugccugccgcaggcgaugaacaucacgugcaccggccgcgggcccgacaacugcauccagugcgcccacuacaucgacggcccccacugcgugaagaccugccccgccggcgucaugggggagaacaacacccugguguggaaguacgccgacgcgggccacgugugccaccucugccacccgaacugcaccuacgggugcacgggccccgggcuggagggcugccccaccaacggcccgaagauccccagcaucgccaccgggauggucggcgcccugcuccugcugcucgugguggcccuggggaucggccuguucaugcggcgccggcacaucguccgcaagcggacccuccgccggcugcugcaggagcgcgagcucguggagccccugacgcccagcggggaggccccgaaccaggcgcugcuccggauccugaaggagaccgaguucaagaagaucaaggugcugggcuccggcgccuucgggaccgucuacaagggccucuggauccccgagggggagaaggugaagauccccguggccaucaaggagcugcgcgaggccaccagccccaaggccaacaaggagauccuggacgaggcguacgucauggccuccguggacaacccgcacgugugccggcuccugggcaucugccugaccagcacgguccagcucaucacccagcugaugcccuucgggugccugcucgacuacgugcgcgagcacaaggacaacaucggcucccaguaccugcugaacuggugcgugcagaucgccaagggcaugaacuaccucgaggaccggcgccugguccaccgcgaccuggccgcccggaacgugcucgugaagacgccccagcacgucaagaucaccgacuucgggcuggcgaagcugcucggcgccgaggagaaggaguaccacgccgagggcgggaaggugcccaucaaguggauggcccuggagagcauccugcaccgcaucuacacccaccaguccgacguguggagcuacggggucaccgugugggagcucaugaccuucggcuccaagccguacgacggcauccccgcgagcgagaucuccagcauccuggagaagggggagcggcugccccagcccccgaucugcaccaucgacguguacaugaucauggucaagugcuggaugaucgacgccgacucccgccccaaguuccgggagcucaucaucgaguucagcaagauggcccgcgacccccagcgguaccuggugauccagggcgacgagcgcaugcaccuccccuccccgacggacagcaacuucuaccgggcccugauggacgaggaggacauggacgacguggucgacgccgacgaguaccugaucccccagcagggguucuucuccagccccagcaccucccgcacgccccugcucagcucccugagcgcgaccuccaacaacagcaccguggccugcaucgaccggaacggccugcaguccugcccgaucaaggaggacagcuuccuccagcgcuacuccagcgaccccaccggcgcccugaccgaggacuccaucgacgacaccuuccugcccgugccggaguacaucaaccagagcguccccaagcggcccgccggguccgugcagaaccccguguaccacaaccagccgcucaaccccgcccccagccgcgacccccacuaccaggacccgcacuccacggcggucggcaaccccgaguaccugaacaccgugcagccgaccugcgugaacagcaccuucgacucccccgcccacugggcccagaaggggagccaccagaucucccuggacaaccccgacuaccagcaggacuucuuccccaaggaggccaagcccaacggcaucuucaaggggagcacggccgagaacgcggaguaccuccgggucgcgccccagagcuccgaguucaucggcgccuga

SEQ ID NO: 29542 - RNA, 1281 nt, Artificial Sequence
  derived and/or modified sequence opt1 from EGLN1__Homo_sapiens__NP_071334
auggccaacgacagcggcgggcccggcgggccgucccccagcgagcgcgaccggcaguacugcgagcugugcggcaagauggagaaccuccugcgcugcucccggugccgcagcuccuucuacugcugcaaggagcaccagcggcaggacuggaagaagcacaagcuggugugccaggggagcgagggcgcccucggccacggggucggcccccaccagcacuccgggcccgcgccgcccgccgccgugcccccgccccgcgccggcgcccgggagccccgcaaggcggccgcccggcgcgacaacgccagcggggacgcggccaagggcaaggugaaggccaagccgcccgccgaccccgccgcggccgccucccccugccgggccgccgcgggcgggcagggcagcgccgucgccgccgaggccgagcccgggaaggaggagcccccggcgcgcuccagccuguuccaggagaaggccaaccuguacccgcccuccaacacccccggcgacgcccucagccccggcgggggccugcggcccaacgggcagaccaagccccugcccgcccucaagcuggcccuggaguacaucgugccgugcaugaacaagcacggcaucugcguggucgacgacuuccucgggaaggagacgggccagcagaucggcgacgaggugcgcgcgcugcacgacaccgggaaguucaccgacggccagcuggugucccagaaguccgacagcagcaaggacauccgcggggacaagaucaccuggaucgagggcaaggagcccgggugcgagacgaucggccuccugauguccagcauggacgaccugauccggcacugcaacggcaagcucgggagcuacaagaucaacggccggaccaaggccauggucgccugcuaccccgggaacggcaccggguacgugcgccacguggacaaccccaacggcgacggccggugcgugaccugcaucuacuaccugaacaaggacugggacgccaaggucuccgggggcauccugcgcaucuucccggaggggaaggcgcaguucgccgacaucgagcccaaguucgaccggcuccuguucuucuggagcgaccgccgcaacccccacgaggugcagccggccuacgccacgcgguacgccaucaccgucugguacuucgacgcggacgagcgcgcccgggccaaggugaaguaccugaccggcgagaagggcgugcgcgucgagcucaacaagcccuccgacagcguggggaaggacguguucuga

SEQ ID NO: 29543 - RNA, 1224 nt, Artificial Sequence
  derived and/or modified sequence opt1 from EGLN2__Homo_sapiens__NP_444274
auggacagccccugccagccgcagccccugucccaggcccucccccagcugcccggcagcuccagcgagccgcuggagcccgagcccgggcgcgcccggaugggcguggaguccuaccuccccugcccgcugcugcccagcuaccacugccccgggguccccuccgaggcgagcgccggcuccgggaccccgcgcgccaccgccacgagcaccaccgccagcccccuccgggacggcuucggcgggcaggacggcggggagcugcgcccccugcaguccgagggcgcggccgcccucgugaccaaggggugccagcggcuggccgcgcagggcgcccgccccgaggccccgaagcggaagugggccgaggacggcggggacgcccccucccccagcaagcgccccugggcgcggcaggagaaccaggaggccgagcgcgagggcgggauguccugcagcugcuccagcggcuccggcgaggccagcgccgggcugauggaggaggcccucccgagcgcgcccgagcggcuggcccuggacuacaucgugcccugcaugcgcuacuacggcaucugcgucaaggacuccuuccucggggccgcccugggcgggcgggugcuggccgagguggaggcgcucaagcgcggcggccggcugcgcgacgggcagcuggucagccagcgggccaucccgccccgcuccauccggggcgaccagaucgccuggguggaggggcacgagcccggcugccgcagcaucggggcccucauggcccacguggacgcggucauccggcacugcgccggccgccugggcuccuacgugaucaacgggcgcacgaaggccaugguggccugcuaccccggcaacgggcugggcuacguccggcacguggacaacccccacggggacggccgcugcaucacgugcaucuacuaccucaaccagaacugggacgugaagguccacggcgggcugcugcagaucuucccggagggccggcccgugguggcgaacaucgagccccucuucgaccgccugcugaucuucuggagcgaccggcgcaacccgcacgaggucaagcccgccuacgccacccgguacgccaucaccgugugguacuucgacgccaaggagcgcgcggccgccaaggacaaguaccagcucgccuccgggcagaagggcgugcagguccccgugagccagcccccgacccccaccuga

SEQ ID NO: 29544 - RNA, 720 nt, Artificial Sequence
  derived and/or modified sequence opt1 from EGLN3__Homo_sapiens__NP_071356
augccccugggccacaucaugcgccucgaccuggagaagaucgcccuggaguacaucgugccgugccuccacgaggucggguucugcuaccuggacaacuuccugggcgagguggugggggacugcguccucgagcgggugaagcagcugcacugcaccggcgcccugcgcgacgggcagcucgcgggcccccgggccggcgugagcaagcgccaccuccgcggggaccagaucaccuggaucggcgggaacgaggagggcugcgaggccaucuccuuccugcucagccugaucgaccggcugguccucuacugcgggucccggcugggcaaguacuacgugaaggagcgcagcaaggccaugguggccugcuaccccggcaacgggacgggcuacguccggcacguggacaaccccaacggggacggccgcugcaucacgugcaucuacuaccugaacaagaacugggacgcgaagcuccacggcgggauccugcggaucuucccggagggcaaguccuucaucgccgacguggagcccaucuucgaccgccugcuguucuucuggagcgaccggcgcaacccccacgagguccagcccuccuacgccacccgguacgccaugaccgugugguacuucgacgcggaggagcgcgccgaggccaagaagaaguuccggaaccugacccgcaagaccgagagcgcccugaccgaggacuga

SEQ ID NO: 29545 - RNA, 1632 nt, Artificial Sequence
  derived and/or modified sequence opt1 from EGR1__Homo_sapiens__NP_001955
auggccgccgcgaaggccgagaugcagcugaugagcccccuccagaucuccgacccguucggcagcuucccccacucccccaccauggacaacuaccccaagcuggaggagaugaugcugcucagcaacggggccccgcaguuccugggcgccgccggggcgcccgagggcuccgggagcaacuccagcuccagcuccagcggcggcgggggcgggggcgggggcggcuccaacagcuccagcuccagcuccaccuucaacccccaggccgacacgggggagcagcccuacgagcaccugaccgccgagagcuucccggacaucagccucaacaacgagaaggugcuggucgagaccuccuaccccagccagaccacgcgccugccgcccaucaccuacaccggccgguucucccucgagcccgcccccaacagcgggaacacccuguggcccgagccccuguucucccucgugagcggccugguguccaugacgaacccgcccgcgagcuccagcuccgcccccagccccgccgccuccagcgccuccgcgagccaguccccgccccugagcugcgccguccccuccaacgacagcagccccaucuacuccgccgccccgaccuuccccacccccaacaccgacaucuuccccgagccgcagagccaggccuuccccggcuccgcggggacggcccuccaguacccgccgcccgccuaccccgccgccaagggcggguuccaggugcccaugauccccgacuaccuguucccccagcagcagggcgaccuggggcucggcacccccgaccagaagcccuuccagggccuggagagccgcacccagcagccgucccugacgccccucagcaccaucaaggcguucgccacccaguccgggagccaggaccugaaggcccugaacaccuccuaccagagccagcucaucaagcccucccggaugcgcaaguaccccaaccggccgagcaagaccccgccccacgagcgccccuacgccugccccguggaguccugcgaccggcgcuucagccgguccgacgagcugacgcgccacauccggauccacaccggccagaagcccuuccagugccgcaucugcaugcggaacuucagccgcuccgaccaccugaccacccacauccggacgcacaccggggagaagcccuucgccugcgacaucugcggccgcaaguucgcgcggagcgacgagcgcaagcggcacaccaagauccaccuccgccagaaggacaagaaggccgacaagagcgucguggccuccagcgccaccuccagccuguccagcuaccccuccccgguggcgacgagcuaccccucccccgucaccaccagcuaccccuccccggccaccacgagcuaccccucccccgugccgaccagcuucuccagccccggguccagcaccuaccccucccccgugcacagcggcuucccgagccccuccgucgccaccacguacagcuccgugccgcccgccuuccccgcccaggugagcuccuuccccagcuccgcggucaccaacagcuucuccgccagcaccggccuguccgacaugaccgccaccuucagcccccggacgaucgagaucugcuga

SEQ ID NO: 29546 - RNA, 1431 nt, Artificial Sequence
  derived and/or modified sequence opt1 from EGR2__Homo_sapiens__NP_001129650
augaugaccgccaaggccguggacaagauccccgucacccugagcggcuucgugcaccagcucuccgacaacaucuacccgguggaggaccuggcggccacgagcgucaccaucuuccccaacgccgagcucgggggccccuucgaccagaugaacgggguggccggcgacgggaugaucaacaucgacaugaccggcgagaagcgcucccuggaccugcccuacccgagcuccuucgcccccgugagcgcgccccggaaccagaccuucacguacaugggcaaguucuccaucgacccccaguacccgggggccagcugcuaccccgagggcaucaucaacaucgucuccgccgggauccugcagggcgugaccagccccgccuccaccaccgcgagcuccagcgugacguccgccagccccaacccgcucgccaccgggccccugggcgucugcaccaugucccagacccagcccgaccuggaccaccucuacagcccgcccccgccgccgccgcccuacuccggcugcgccggggaccuguaccaggaccccagcgccuuccugagcgcggccacgaccuccaccagcuccagccucgccuacccgccgccgcccuccuaccccagccccaagcccgccaccgaccccggccuguuccccaugauccccgacuaccccggguucuuccccucccagugccagcgcgaccugcacggcacggccggccccgaccggaagcccuuccccugcccccucgacacccugcgcgugcccccgccccugacgccccucagcaccauccggaacuucacccugggcgggcccuccgcgggggugaccggccccggggccagcggcggcuccgaggggccccgccugcccggcagcuccagcgccgccgccgcggccgccgccgccgcggccuacaacccccaccaccucccccugcggcccauccugcgcccccggaaguacccgaaccgccccuccaagacccccguccacgagcggcccuacccgugccccgccgaggggugcgaccgccgguucagccgcuccgacgagcucacccggcacauccgcauccacacgggccacaagcccuuccagugccggaucugcaugcgcaacuucagccgguccgaccaccugaccacccacauccgcacccacacgggggagaagccguucgccugcgacuacugcggccggaaguucgcgcgcagcgacgagcgcaagcggcacaccaagauccaccuccgccagaaggagcgcaagagcuccgcccccagcgccuccgugcccgcccccagcaccgccuccugcagcggcggggugcagccgggcgggacccugugcuccagcaacuccagcucccugggcgggggcccccuggcgcccugcagcucccggacgcggacccccuga

SEQ ID NO: 29547 - RNA, 1002 nt, Artificial Sequence
  derived and/or modified sequence opt1 from EGR3__Homo_sapiens__NP_001186810
auggacaucggccugaccaacgagaagcccaaccccgagcucagcuacuccgggagcuuccagcccgcccccggcaacaagaccgugaccuaccuggggaaguucgccuucgacucccccagcaacuggugccaggacaacaucaucucccugaugagcgcgggcauccucggggucccgcccgccuccggcgcccugagcacccagaccuccaccgccagcauggugcagccgccccagggcgacguggaggccauguaccccgcgcugccgcccuacuccaacugcggggaccucuacagcgagcccgucuccuuccacgacccccagggcaaccccgggcuggccuacagcccccaggacuaccaguccgccaagcccgcccuggacagcaaccucuucccgaugauccccgacuacaaccuguaccaccaccccaacgacaugggcuccauccccgagcacaagccguuccaggggauggaccccauccgcgugaacccgccgcccaucacgccccuggagaccaucaaggcguucaaggacaagcagauccaccccggcuucggcagccucccccagccgccccugacccugaagcccauccggccccgcaaguaccccaaccggcccuccaagacgccccuccacgagcgcccgcacgccugccccgccgaggggugcgaccggcgcuucagccggagcgacgagcugacccgccaccuccggauccacaccggccacaagcccuuccagugccgcaucugcaugcgguccuucagccgcuccgaccaccugaccacccacauccggacgcacaccggggagaagcccuucgccugcgaguucugcggccgcaaguucgcccggagcgacgagcgcaagcggcacgcgaagauccaccugaagcagaaggagaagaaggccgagaagggcggggccccguccgccagcuccgccccgcccgugagccuggcgcccgucgugacgaccugcgccuga

SEQ ID NO: 29548 - RNA, 1770 nt, Artificial Sequence
  derived and/or modified sequence opt1 from EGR4__Homo_sapiens__NP_001956
auggccguggcccgcggcgucgggagccccgagccggcgcccccccagcuguacaaguggggcgggugcggccucggggagcccggcuccgcccuggagcggcgcggcgccgccgcccgggggcgcugcggccgggcgcgcgccccgcggcugcccgacagcuucccccgcggggagugccccaagccgggcgcccgggccccccgcuccgugcggugcggggagccccuccccccggcgagccccccccccgcccgcccgcaggcccagcgggcccgcccccgggccccccacucccgccggcgcgcgaugcugcaccugagcgaguucuccgagcccgacgcccuccuggugaagagcaccgagggcugcugcgccgagccguccgccgagcugccccggcuccccgcccgcgacgcgcccgccgccaccggcuacccgggggccggcgacuuccugagcugggcccugaacuccugcggggcgagcggcgaccucgccgacuccugcuuccuggagggccccgcccccacgcccccgcccgggcugagcuacuccggcagcuucuucauccaggccguccccgagcacccgcacgaccccgaggcccucuucaaccugauguccgggauccugggccucgcgcccuuccccgggccggaggccgccgccagccgguccccccuggacgcgcccuuccccgccggcagcgacgcccugcucccgggcccccccgaccuguacagccccgaccugggggccgccccguuccccgaggcguucugggaggccucccccugcgccggcgcccccagccagugccucuacgagccgcagcuguccccccccgacgugaagcccgggcugcgcgccccgcccgcgagccccgcccucgacgccguguccgccuucaagggccccuacgccccgugggagcugcugagcgucggggcgcccggcaacugcggcucccagggggacuaccaggccgcccccgaggcccgcuucccggugaucggcaccaagaucgaggaccuccugagcaucuccugccccgcggagcugcccgccgugcccgccaaccggcucuacccgagcggggccuacgacgccuucccccuggcgcccggcgaccugggggagggcgccgagggccuccccgggcugcugaccccgcccuccggcgaggggggcagcuccggcgacgggggcgaguuccucgccagcacccagccccagcuguccccccuggggcuccgcagcgccgccgcggccgacuucccgaagccccuggucgccgacauccccggcuccagcgggguggccgcccccccggugcccccccccccgcccacgcccuucccccaggcgaaggcccggcgcaagggccggcgcggcgggaagugcuccacccggugcuucugcccgcgcccccacgccaaggccuucgcgugccccgucgagagcugcgugcggagcuucgcccgcuccgacgagcugaaccggcaccuccgcauccacaccggccacaagcccuuccagugccggaucugccugcgcaacuucagccgguccgaccaccugaccacgcacgugcgcacccacaccggggagaagccguucgccugcgacgucugcggccggcgcuucgcccggagcgacgagaagaagcgccacuccaaggugcaccucaagcagaaggcccgcgcggaggagcggcugaaggggcugggcuucuacagccugggccucuccuucgccagccuguga

SEQ ID NO: 29549 - RNA, 3483 nt, Artificial Sequence
  derived and/or modified sequence opt1 from EHBP1__Homo_sapiens__NP_001136087
auggccagcguguggaagcgccugcagcgggucggcaagcacgccuccaaguuccaguucguggcgagcuaccaggagcucaugguggagugcaccaagaaguggcagcccgacaagcuggucgugguguggacccgccggucccgccgcaagagcuccaaggcccacagcuggcagccggggaucaagaaccccuaccggggcgucgugguguggcccguccccgagaacaucgagaucacggugacccuguucaaggacccgcacgccgaggaguucgaggacaaggaguggaccuucgugaucgagaacgagucccccagcgggcggcgcaaggcccucgccaccuccagcaucaacaugaagcaguacgcgucccccaugcccacgcagaccgacgucaagcugaaguucaagccgcugagcaagaaggugguguccgccgcccuccaguucagccuguccugcaucuuccugcgggagggcaaggccaccgacgaggacaugcagagccucgcgucccugaugagcaugaagcaggccgacaucgggaaccuggacgacuucgaggaggacaacgaggacgacgacgagaaccgcgucaaccaggaggagaaggccgccaagaucaccgagcucaucaacaagcugaacuuccuggacgaggccgagaaggaccucgcgacggugaacuccaaccccuucgacgaccccgacgccgccgagcugaaccccuucggcgacccggacagcgaggagcccaucaccgagaccgccagcccccggaagaccgaggacuccuucuacaacaacagcuacaaccccuucaaggaggugcagacgccgcaguaccugaaccccuucgacgagcccgaggccuucgucaccaucaaggacuccccgccccagagcaccaagcgcaagaacauccggcccguggacauguccaaguaccucuacgcggacagcuccaagaccgaggaggaggagcuggacgagagcaaccccuucuacgagcccaaguccacgccgccgcccaacaaccuggugaaccccguccaggagcucgagaccgagcgccgggugaagcgcaaggcccccgccccgcccgugcugagccccaagaccggcguccugaacgagaacaccguguccgccgggaaggaccucagcacgucccccaagcccagccccaucccgucccccguccugggccggaagcccaacgccagccagucccugcucguguggugcaaggaggugaccaagaacuaccgcggggucaagaucaccaacuucaccacgagcuggcggaacggccuguccuucugcgcgauccugcaccacuuccgccccgaccucaucgacuacaagagccugaacccgcaggacaucaaggagaacaacaagaaggccuacgacggguucgccagcaucggcaucucccggcugcucgagcccagcgacauggugcugcuggccauccccgacaagcucaccgugaugaccuaccuguaccagauccgcgcccacuucuccggccaggagcugaacgucgugcagaucgaggagaacagcuccaagagcaccuacaagguggggaacuacgagacggacaccaacuccagcgucgaccaggagaaguucuacgcggagcucuccgaccugaagcgcgagcccgagcugcagcagccgaucagcggcgccguggacuuccucucccaggacgacagcguguucgucaacgacuccggggugggcgagagcgaguccgagcaccagacccccgacgaccaccugagccccuccaccgccagccccuacugccggcgcaccaagagcgacacggagccgcagaagucccagcagagcuccggccggaccagcggguccgacgaccccggcaucugcagcaacaccgacuccacgcaggcccaggugcugcucgggaagaagcgccugcugaaggcggagacccucgagcugagcgaccuguacgucuccgacaagaagaaggacaugagcccgcccuucaucugcgaggagaccgacgagcagaagcugcagacccucgacaucggcuccaaccuggagaaggagaagcuggagaacagccggucccucgagugccgcagcgaccccgagucccccaucaagaagaccagccugucccccacgagcaagcugggguacuccuacagccgggaccucgaccuggccaagaagaagcacgccagccugcgccagaccgaguccgaccccgacgccgaccggaccacccucaaccacgccgaccacagcuccaagaucgugcagcaccgccugcugagccggcaggaggagcucaaggagcgcgcgcgggugcugcuggagcaggcccgccgggacgccgcccucaaggccggcaacaagcacaacacgaacaccgcgaccccguucugcaaccgccagcuguccgaccagcaggacgaggagcggcgccggcagcugcgcgagcgcgcccggcagcucaucgccgaggcccgcagcggcgucaagauguccgagcugcccagcuacggggagauggccgcggagaagcugaaggagcgguccaaggccagcggcgagcagaacuccaagcucguggaccugaagcugaagaagcuccuggaggugcagccccaggucgccaacagcccguccagcgccgcgcagaaggccgugaccgaguccagcgagcaggacaugaaguccgggacggaggaccugcgcaccgagcggcuccagaagaccaccgagcgcuuccggaaccccguggucuucagcaaggacuccacggugcgcaagacccagcugcagagcuucagccaguacaucgagaaccggcccgagaugaagcgccagcgguccauccaggaggacaccaagaagggcaacgaggagaaggccgccaucaccgagacgcagcgcaagcccagcgaggacgaggugcugaacaagggguucaaggacaccucccaguacgucgugggcgagcucgccgcgcuggagaacgagcagaagcagaucgacacccgggccgcccugguggagaagcgccuccgguaccugauggacaccggccgcaacacggaggaggaggaggccaugaugcaggagugguucaugcuggucaacaagaagaacgcccucauccggcgcaugaaccagcugagccugcucgagaaggagcacgaccuggagcggcgcuacgagcugcucaaccgggagcugcgcgcgaugcuggccaucgaggacuggcagaagaccgaggcccagaagcgccgggagcagcuccugcuggacgagcucguggcccuggugaacaagcgcgacgcccugguccgggaccucgacgcgcaggagaagcaggccgaggaggaggacgagcaccuggagcgcacccuggagcagaacaaggggaagauggccaagaaggaggagaagugcgugcuccaguga

SEQ ID NO: 29550 - RNA, 1647 nt, Artificial Sequence
  derived and/or modified sequence opt1 from EHD1__Homo_sapiens__NP_001269374
auggagcagcccggcaccgccgccagccccguguccgggagcauguucuccugggucagcaaggacgcgcgccggaagaaggagcccgagcuguuccagaccguggccgagggccuccgccagcuguacgcccagaagcugcucccccuggaggagcacuaccgguuccacgaguuccacucccccgcccuggaggacgccgacuucgacaacaagccgauggugcuccuggucgggcaguacagcacgggcaagaccaccuucauccgccaccugaucgagcaggacuuccccgggaugcggaucggccccgagcccaccacggacuccuucaucgcggugaugcacggcccgaccgagggggugguccccggcaacgcccucgugguggacccccgccggcccuuccgcaagcugaacgccuucgggaacgccuuccugaaccgguucaugugcgcgcagcucccgaaccccguccuggacagcaucuccaucaucgacacccccggcauccugagcggggagaagcagcgcaucucccggggcuacgacuucgccgccgugcucgagugguucgccgagcgcguggaccggaucauccugcuguucgacgcccacaagcucgacaucagcgacgaguucuccgaggucaucaaggcgcugaagaaccacgaggacaagauccgcguggugcugaacaaggccgaccagaucgagacccagcagcucaugcgggucuacggcgcccugauguggagccuggggaagaucaucaacacgcccgagguggugcgcgucuacaucggcuccuucuggagccacccgcuccugauccccgacaaccggaagcuguucgaggccgaggagcaggaccucuucaaggacauccagucccugccccgcaacgccgcgcugcggaagcucaacgaccugaucaagcgcgcccggcuggccaaggugcacgccuacaucaucagcucccucaagaaggagaugcccaacguguucgggaaggagagcaagaagaaggagcuggucaacaaccugggcgagaucuaccagaagaucgagcgcgagcaccagaucagcccgggcgacuuccccucccuccgcaagaugcaggagcugcugcagacccaggacuucagcaaguuccaggcccucaagcccaagcugcuggacaccguggacgacaugcucgcgaacgacaucgcccggcugauggugaugguccgccaggaggagucccugaugcccagccagguggucaagggcggggccuucgacgggaccaugaacggcccguucgggcacggcuacggcgagggggccggcgaggggaucgacgacguggaguggguggucggcaaggacaagcccacguacgacgagaucuucuacacccucucccccgugaacgggaagaucaccggcgccaacgcgaagaaggagauggucaagagcaagcugcccaacaccgugcugggcaagaucuggaagcucgccgacguggacaaggacgggcugcuggacgacgaggaguucgcccuggccaaccaccucaucaaggugaagcuggagggccacgagcugccggcggaccucccgccccaccuggucccgcccuccaagcggcgccacgaguga

SEQ ID NO: 29551 - RNA, 1632 nt, Artificial Sequence
  derived and/or modified sequence opt1 from EHD2__Homo_sapiens__NP_055416
auguucagcuggcugaagcgcggcggggcccggggccagcagcccgaggccauccgcaccgugaccuccgcgcucaaggagcuguaccggacgaagcugcucccccuggaggagcacuaccgcuucggggccuuccacagccccgcccuggaggacgccgacuucgacggcaagcccaugguccucguggccgggcaguacuccaccggcaagaccagcuucauccaguaccugcuggagcaggaggugcccggcucccgggucgggccggagcccaccacggacugcuucguggcggugaugcacggcgacaccgaggggaccguccccggcaacgcccucgugguggaccccgacaagccguuccgcaagcugaaccccuucgggaacaccuuccugaaccgguucaugugcgcccagcuccccaaccagguccuggagagcaucuccaucaucgacacgcccggcauccugagcggcgccaagcagcgcgugucccggggguacgacuucccggcggugcuccgcugguucgccgagcgggucgaccugaucauccuccuguucgacgcccacaagcuggagaucagcgacgaguucuccgaggccaucggcgcccugcgcgggcacgaggacaagauccggguggugcucaacaaggcggacauggucgagacccagcagcugaugcgcguguacggcgcccugaugugggcccucggcaagguggucgggacccccgaggugcugcggguguacaucggcagcuucuggucccagccccugcucguccccgacaaccgccggcuguucgagcuggaggagcaggaccucuuccgcgacauccaggggcugccgcggcacgccgcccugcgcaagcucaacgaccuggugaagcgggcgcgccuggugcgcguccacgccuacaucaucagcuaccucaagaaggagaugcccuccguguucggcaaggagaacaagaagaagcagcugauccugaagcuccccgucaucuucgccaagauccagcuggagcaccacaucagccccggggacuucccggacugccagaagaugcaggagcugcucauggcccacgacuucaccaaguuccacucccugaagcccaagcugcucgaggcccuggacgagaugcugacgcacgacaucgcgaagcucaugccccugcugcggcaggaggagcuggagagcaccgaggugggcgugcagggcggggccuucgagggcacccacauggggcccuucgucgagcgcggcccggacgaggccauggaggacggggaggagggcuccgacgacgaggccgaguggguggugaccaaggacaagagcaaguacgacgagaucuucuacaaccucgcccccgcggacggcaagcugagcggguccaaggccaagacguggauggucggcaccaagcugcccaacagcgugcucgggcggaucuggaagcuguccgacguggaccgcgacggcaugcuggacgacgaggaguucgcccucgccagccaccugaucgaggcgaagcuggaggggcacggccuccccgccaaccugccgcggcgccuggucccgcccuccaagcggcgccacaagggcagcgccgaguga

SEQ ID NO: 29552 - RNA, 1608 nt, Artificial Sequence
  derived and/or modified sequence opt1 from EHD3__Homo_sapiens__NP_055415
auguucagcuggcugggcaccgacgaccgccggcgcaaggaccccgagguguuccagaccgucuccgaggggcugaagaagcuguacaagagcaagcugcucccgcuggaggagcacuaccgguuccacgaguuccacucccccgcccuggaggacgccgacuucgacaacaagcccauggugcuccuggugggccaguacagcacggggaagaccaccuucauccgcuaccugcucgagcaggacuuccccggcaugcggaucgggccggagcccaccacggacuccuucaucgcggucaugcagggcgacauggagggcaucauccccgggaacgcccuggugguggaccccaagaagccguuccgcaagcugaacgccuucggcaacgccuuccucaaccgguucgucugcgcccagcugcccaaccccgugcuggagagcaucuccgugaucgacacccccgggauccucagcggcgagaagcagcgcaucucccggggguacgacuucgcggccguccuggagugguucgccgagcgcguggaccggaucauccuccucuucgacgcccacaagcuggacaucagcgacgaguucuccgaggugaucaaggcgcugaagaaccacgaggacaagaugcgcgucgugcucaacaaggccgaccagaucgagacccagcagcugaugcggguguacggcgcccugauguggagccucggcaagaucgucaacaccccggaggugauccgcguguacaucggguccuucuggagccacccccugcugauccccgacaaccggaagcuguucgaggccgaggagcaggaccuguuccgcgacauccagucccugccccggaacgccgcgcuccgcaagcugaacgaccugaucaagcgggcccgccucgccaagguccacgccuacaucaucagcucccugaagaaggagaugccgagcguguucggcaaggacaacaagaagaaggagcuggugaacaaccucgccgagaucuacgggcggaucgagcgcgagcaccagaucucccccggcgacuuccccaaccugaagcgcaugcaggaccagcugcaggcgcaggacuucagcaaguuccagccccucaagagcaagcugcuggaggucguggacgacaugcucgcccacgacaucgcccagcugauggugcugguccggcaggaggagucccagcgcccgauccagauggugaagggcggggccuucgagggcacgcuccacgggcccuucggccacggguacggcgagggcgccggggagggcaucgacgacgcggagugggucguggcccgggacaagcccauguacgacgagaucuucuacacccugagccccguggacgggaagaucaccggcgccaacgccaagaaggagaugguccgcuccaagcugccgaacagcgugcucgggaagaucuggaagcuggccgacaucgacaaggacggcaugcuggacgacgacgaguucgcgcuggccaaccaccucaucaaggugaagcuggagggccacgagcugcccaacgagcuccccgcccaccuccugcccccguccaagcggaaggucgccgaguga

SEQ ID NO: 29553 - RNA, 1626 nt, Artificial Sequence
  derived and/or modified sequence opt1 from EHD4__Homo_sapiens__NP_644670
auguucagcuggaugggccgccaggccgggggccgggagcgcgccgggggcgcggacgccgugcagaccgucaccgggggccugcggucccucuaccugcgcaaggugcugccccucgaggaggccuaccgguuccacgaguuccacagcccggcccuggaggacgccgacuucgagaacaagcccaugauccugcucgugggccaguacuccacggggaagaccaccuucauccgcuaccugcuggagcaggacuuccccggcaugcggaucgggcccgagccgaccacggacagcuucaucgcggucauguacggcgagaccgagggguccacccccggcaacgcccucgugguggaccccaagaagcccuuccgcaagcugagccgguucggcaacgccuuccugaaccgcuucaugugcucccagcucccgaaccagguccucaagagcaucuccgugaucgacagccccgggauccuguccggcgagaagcagcggaucagccgcggguacgacuucugccaggugcuccagugguucgccgagcgggucgaccgcaucauccugcuguucgacgcgcacaagcucgacaucuccgacgaguucagcgaggccaucaaggccuuccggggccaggacgacaagauccgcguggugcugaacaaggccgaccaggucgacacccagcagcugaugcggguguacggcgcccucauguggucccuggggaaggugaucaacacgcccgagguccugcgcguguacaucggcagcuucugggcgcagccccuccagaacaccgacaaccggcgccuguucgaggccgaggcccaggaccuguuccgggacauccagucccucccgcagaaggccgccgugcgcaagcugaacgaccugaucaagcgcgcgcggcucgccaagguccacgccuacaucaucagcuaccugaagaaggagaugcccuccguguucgggaaggagaacaagaagcgcgagcugaucagccggcuccccgagaucuacauccagcugcagcgcgaguaccagaucagcgccggcgacuuccccgaggugaaggccaugcaggagcagcuggagaacuacgacuucaccaaguuccacucccucaagccgaagcugaucgaggcggucgacaacaugcugagcaacaagaucagcccccucaugaaccugaucucccaggaggagaccuccacgcccacccagcuggugcagggcggggccuucgacggcaccaccgaggggcccuucaaccagggcuacggggagggcgccaaggagggggccgacgaggaggaguggguggucgccaaggacaagccgguguacgacgagcuguucuacacgcugagccccaucaacggcaagaucuccggcgucaacgcgaagaaggagauggugaccagcaagcugcccaacuccgugcucgggaagaucuggaagcuggccgacugcgacugcgacggcaugcuggacgaggaggaguucgcccucgccaagcaccugaucaagaucaagcuggacggguacgagcugcccagcucccucccgccccaccuggucccgcccagccaccggaagucccugcccaaggcggacuga

SEQ ID NO: 29554 - RNA, 969 nt, Artificial Sequence
  derived and/or modified sequence opt1 from EHF__Homo_sapiens__NP_001193545
augggccugcccgagcgccgggggcucgugcugcugcucagccuggccgagauccuguucaagaucaugauccucgagggcgggggcgucaugaaccugaacccggggaacaaccugcuccaccagccgcccgccuggaccgacuccuacagcacgugcaacguguccagcggcuucuucggcgggcaguggcacgagauccacccccaguacuggaccaaguaccaggugugggaguggcugcagcaccuccuggacaccaaccagcuggacgcgaacugcauccccuuccaggaguucgacaucaacggcgagcaccugugcuccaugagccuccaggaguucacccgcgccgccgggaccgccggccagcugcuguacuccaaccuccagcaccugaaguggaacgggcagugcagcuccgaccuguuccagagcacgcacaacgucaucgugaagaccgagcagaccgagcccuccaucaugaacaccuggaaggacgagaacuaccucuacgacacgaacuacggcagcaccguggaccugcuggacuccaagaccuucugccgggcccagaucagcaugaccacgaccucccaccuccccgucgcggagagccccgacaugaagaaggagcaggacccgcccgccaagugccacaccaagaagcacaacccccgcggcacccaccugugggaguucauccgggacauccugcucaaccccgacaagaacccggggcugaucaagugggaggaccgcuccgagggcguguuccgguuccucaagagcgaggccguggcccagcugugggggaagaagaagaacaacuccagcaugacguacgagaagcugagccgcgcgaugcgguacuacuacaagcgcgagauccuggagcgggucgacggccgccggcucguguacaaguucggcaagaacgcccgcggguggcgggagaacgagaacuga

SEQ ID NO: 29555 - RNA, 1884 nt, Artificial Sequence
  derived and/or modified sequence opt1 from EHHADH__Homo_sapiens__NP_001159887
auggccuucggcgggggccuggagcucgcccuggggugccacuaccgcaucgcgcacgccgaggcccaggugggccugcccgaggucacccucgggcugcugccgggcgcccggggcacccagcuccugccccgccugacgggggugcccgccgcgcucgaccugaucaccagcggccggcgcauccuggccgacgaggcccucaagcuggggauccuggacaagguggucaacuccgaccccguggaggaggccauccgguucgcgcagcgcgugagcgaccagccgcucgagucccggcgccugugcaacaagcccauccagagccugcccaacauggacuccaucuucagcgaggcccuccugaagaugcggcgccagcaccccggcugccuggcccaggaggccugcguccgggccgugcaggcggccgugcaguacccguacgaggucgggaucaagaaggaggaggagcuguuccucuaccugcuccaguccggccaggcccgcgcccugcaguacgccuucuucgcggagcggaaggccaacaaguggagcacccccuccggcgccagcuggaagaccgccuccgcccgccccgugagcuccgugggggucgugggccuggggacgaugggccggggcaucgugaucagcuucgcgcgcgcccggauccccgucaucgccguggacuccgacaagaaccagcucgccaccgccaacaagaugaucaccagcgugcuggagaaggaggcguccaagaugcagcagagcgggcacccgugguccggccccaagccccgccugaccagcagcgucaaggagcucgggggcguggaccuggugaucgaggccgucuucgaggagaugucccugaagaagcaggucuucgccgagcucagcgccgugugcaagcccgaggcguuccugugcacgaacaccuccgcccuggacguggacgagaucgccagcuccaccgaccggccgcaccucgugaucgggacccacuucuucagccccgcccacgucaugaagcugcuggaggugauccccucccaguacagcucccccacgaccaucgccaccgugaugaaccucagcaagaagaucaagaagaucggcgucguggugggcaacugcuucggguucgucggcaaccgcaugcugaacccguacuacaaccaggcguacuuccugcucgaggagggguccaagcccgaggagguggaccaggugcuggaggaguucggcuucaagauggggcccuuccgggucagcgaccuggccggccucgacgugggcuggaagucccgcaaggggcagggccugaccgggcccacgcugcucccgggcacccccgcccgcaagcgggggaaccgccgguacugccccauccccgacgugcugugcgagcugggccgcuucggccagaagaccgggaagggcugguaccaguacgacaagccgcuggggcggauccacaagcccgaccccuggcucagcaaguuccugucccgcuaccggaagacccaccacaucgagccgcgcacgaucagccaggacgagauccuggagcggugccucuacucccugaucaacgaggccuuccgcauccugggcgagggcaucgccgcgagccccgagcacaucgacgucguguaccuccacggguacggcuggccccggcacaagggcgggcccauguucuacgccuccaccguggggcugccgaccguccuggagaagcuccagaaguacuaccgccagaaccccgacaucccccagcuggagcccagcgacuaccugaagaagcucgccagccagggcaacccgccccugaaggaguggcagucccuggccggcagccccuccagcaagcucuga

SEQ ID NO: 29556 - RNA, 2427 nt, Artificial Sequence
  derived and/or modified sequence opt1 from EHMT1__Homo_sapiens__NP_001138999
auggccgccgcggacgccgaggccgugcccgcccgcggcgagccccagcaggacugcugcgucaagaccgagcugcucggggaggagacccccauggccgcggacgagggcagcgccgagaagcaggccggggaggcccacauggcggccgacggcgagacgaacggguccugcgagaacagcgacgccuccagccacgccaacgccgcgaagcacacccaggacuccgcccgggugaacccccaggacggcaccaacacccugacgcgcaucgccgagaacggcgugagcgagcgggacuccgaggccgccaagcagaaccacgucaccgcggacgacuucgugcagaccagcgugaucggguccaacggcuacauccugaacaagcccgcccuccaggcccagccgcugcgcaccacgagcacccuggccuccagccuccccgggcacgccgcgaagacccugcccggcggggccggcaagggccggacccccuccgccuucccgcagacgcccgccgccccgcccgcgacccugggggagggcagcgccgacaccgaggaccgcaagcuccccgcccccggggccgacgucaaggugcaccgggcgcgcaagaccaugcccaaguccguggucggccugcacgccgccagcaaggacccccgggaggugcgcgaggcccgggaccacaaggagccgaaggaggagaucaacaagaacaucuccgacuucggccgccagcagcugcucccgcccuuccccagccugcaccagucccugccccagaaccagugcuacauggccacgaccaagagccagaccgcgugccuccccuucgugcuggccgccgccgucagccggaagaagaagcgccggauggggaccuacucccuggugcccaagaagaagacgaaggugcucaagcagcgcaccgucaucgagauguucaagagcaucacccacuccaccgugggcagcaagggggagaaggaccugggcgccuccagccugcacgugaacggggagucccucgagauggacagcgacgaggacgacuccgaggagcuggaggaggacgacggccacggcgcggagcaggccgccgccuuccccacggaggacagccggaccuccaaggagagcauguccgaggccgaccgcgcgcagaagauggacggggagagcgaggaggagcaggaguccgucgacaccggcgaggaggaggagggcggcgacgagagcgaccuguccagcgaguccagcaucaagaagaaguuccucaagcggaaggggaagaccgacagcccguggaucaagcccgcccgcaagcggcgccgccggucccgcaagaagcccagcggcgcccugggcuccgagagcuacaaguccagcgccggguccgcggagcagacggcccccggcgacagcaccggguacauggaggugucccuggacagccucgaccugcgggugaagggcauccuguccagccaggccgaggggcucgccaacggcccggacguccuggagaccgacggccugcaggaggugccccucugcuccugccgcauggagacccccaagagccgggagaucacgacccuggccaacaaccagugcauggcgaccgaguccguggaccacgagcuggggcgcugcaccaacagcgucgugaaguacgagcucaugcggccguccaacaaggcgccccugcugguccucugcgaggaccaccgcggccggauggugaagcaccagugcugccccgggugcggcuacuucugcacggccggcaacuucauggagugccagcccgagagcagcaucucccaccgcuuccacaaggacugcgccagccgggugaacaacgccuccuacugcccgcacugcggggaggagagcuccaaggccaaggaggucaccaucgccaaggccgacaccaccagcaccgugacgcccgugcccggccaggagaagggguccgcccuggagggccgcgccgacaccaccaccgggagcgcggccgggcccccgcuguccgaggacgacaagcuccagggcgccgccagccacguccccgagggguucgaccccacgggccccgcggggcugggccggccgacccccgggcugucccagggccccggcaaggagacccucgagagcgcccugaucgcccuggacuccgagaagcccaagaagcuccgcuuccacccgaagcagcuguacuucagcgcccggcagggggagcugcagaaggugcugcucaugcugguggacggcaucgaccccaacuucaagauggagcaccagaacaagcgcuccccgcugcacgccgcggccgaggccgggcacgucgacaucugccacaugcucgugcaguucugccggcugggcagcccccgcucccgggggugccugugguga

SEQ ID NO: 29557 - RNA, 3702 nt, Artificial Sequence
  derived and/or modified sequence opt1 from EHMT2__Homo_sapiens__NP_001276342
augcgcggccugccccgggggcgcggccucaugcgggcccgcgggcggggccgcgccgcgccgcccgggagccggggccgcggccgcgggggcccccaccgggggcggggccgcccccggucccugcugagccucccgcgcgcccaggccuccuggacgccccagcugagcaccgggcugaccuccccgcccgugcccugccuccccagccagggcgaggcccccgccgagaugggcgcgcugcugcucgagaaggagacccgcggggccaccgagcggguccacggcucccugggggacacgccccggagcgaggagacccugccgaaggccacccccgacucccucgagcccgccggccccagcuccccggcgagcgugaccgugaccgucggcgacgagggggccgacacgcccgugggcgccacgccccugaucggggacgaguccgagaaccuggagggcgacggggaccuccgcggcggccggauccugcuggggcacgccaccaagagcuuccccuccagcccguccaagggcgggagcugccccucccgcgccaagaugagcaugaccggcgcgggcaagagcccgcccuccgugcagagccucgccaugcggcugcuguccaugcccggcgcccagggcgccgccgcggccgggagcgagcccccgcccgccaccaccucccccgagggccagcccaagguccaccgcgcccgcaagaccaugagcaagcccgggaacggccagccgcccgugcccgagaagcggcccccggagauccagcacuuccgcauguccgacgacgugcacagccucgggaaggucaccuccgaccuggccaagcggcgcaagcugaacagcggcggcgggcucuccgaggagcugggcagcgcgcggcgcuccggggaggugacgcugaccaagggcgaccccggcagccucgaggagugggagaccguggucggggacgacuucucccuguacuacgacagcuacuccguggacgagcggguggacagcgacuccaagagcgaggucgaggcccugaccgagcagcucagcgaggaggaggaggaggaggaggaggaggaggaggaggaggaggaggaggaggaggaggaggaggaggaggaggacgaggaguccggcaaccagagcgaccgcuccgggagcuccggccggcgcaaggccaagaagaaguggcggaaggacagccccugggugaagcccucccgcaagcggcgcaagcgggagccgccccgcgccaaggagccccgcggggugagcaacgacaccuccagccuggagaccgagcggggguucgaggagcugccccucugcuccugccggauggaggccccgaagaucgaccgcaucagcgagcgcgcgggccacaagugcauggccaccgaguccgucgacggggagcugagcggcugcaacgccgccauccugaagcgggagaccaugcgccccuccagccggguggcgcucauggugcugugcgagacgcaccgcgcccggauggucaagcaccacugcugccccgggugcggcuacuucugcaccgccgggaccuuccuggagugccaccccgacuuccgcguggcccaccgguuccacaaggccugcgugucccagcucaacggcauggucuucugcccgcacugcggcgaggacgcgagcgaggcccaggaggugaccaucccccgcggggacggcgucacgccgcccgccgggaccgccgcccccgcgcccccgccccugagccaggacgugcccggccgggccgacaccucccagcccagcgcccgcaugcgggggcacggcgagccccgccggccgcccugcgacccccuggccgacaccaucgacuccagcggccccucccucacgcugccgaacgggggcugccugagcgccguggggcucccccugggccccgggcgcgaggcgcuggagaaggcccucgucauccaggaguccgagcggcgcaagaagcugcgguuccacccccgccagcuguaccugagcgugaagcagggcgagcuccagaaggugauccugaugcugcucgacaaccuggacccgaacuuccaguccgaccagcagagcaagcggacgccccugcacgccgccgcgcagaagggcuccgucgagaucugccacgugcuccugcaggccggggccaacaucaacgccguggacaagcagcagcgcacgccccugauggaggccgucgugaacaaccaccucgagguggcgcgguacaugguccagcgcggcgggugcguguacagcaaggaggaggacggcuccacgugccugcaccacgccgccaagaucggcaaccuggagauggugagccuccugcuguccaccgggcaggucgacgugaacgcccaggacagcggcggguggacccccaucaucugggccgcggagcacaagcacaucgaggugauccgcaugcuccugacccggggcgccgacgucacccugaccgacaacgaggagaacaucugccuccacugggccuccuucaccgggagcgccgccaucgcggaggugcugcugaacgcccgcugcgaccuccacgccgugaacuaccacggcgacaccccgcugcacaucgccgcgcgggaguccuaccacgacugcguccuccuguuccugagccgcggcgccaaccccgagcugcggaacaaggagggggacaccgccugggaccucacccccgagcgcagcgacgugugguucgcccugcagcugaaccggaagcuccgccugggcguggggaaccgggccauccgcaccgagaagaucaucugccgggacgucgcgcgcggcuacgagaacgugcccaucccgugcgugaacggggucgacggcgagcccugccccgaggacuacaaguacaucuccgagaacugcgagaccagcaccaugaacaucgaccggaacaucacccaccuccagcacugcacgugcguggacgacugcuccagcuccaacugccugugcggccagcugagcauccgcugcugguacgacaaggacgggcggcugcuccaggaguucaacaagaucgagcccccgcugaucuucgagugcaaccaggccugcuccugcuggcgcaacugcaagaaccgggugguccagagcggcaucaaggugcgccugcagcucuaccggaccgccaagaugggguggggcgugcgcgcccugcagaccaucccccaggggaccuucaucugcgaguacgucggcgagcugaucuccgacgccgaggcggacgugcgcgaggacgacagcuaccucuucgaccuggacaacaaggacggcgagguguacugcaucgacgcccgguacuacgggaacaucucccgcuucaucaaccaccugugcgaccccaacaucauccccguccggguguucaugcuccaccaggaccugcgcuucccgcggaucgccuucuucagcucccgcgacauccggacgggcgaggagcugggguucgacuacggcgaccgcuucugggacaucaagagcaaguacuucacgugccagugcggcuccgagaagugcaagcacagcgccgaggccaucgcgcucgagcagucccggcuggcccgccuggacccccaccccgagcuccugcccgagcuggggagccucccgcccgugaacaccuga

SEQ ID NO: 29558 - RNA, 1023 nt, Artificial Sequence
  derived and/or modified sequence opt1 from EI24__Homo_sapiens__XP_011541371
auggccgacagcgugaagaccuuccugcaggaccucgcccgcggcaucaaggacuccaucugggggaucugcaccaucagcaagcuggacgcgcggauccagcagaagcgcgaggagcagcggcgccggcgcgccuccagcguccuggcccagcggcgcgcccaguccaucgagcggaagcaggagagcgagccccgcaucgugucccggaucuuccagugcugcgccuggaacggcgggguguucugguucagccuccugcuguucuaccgcgucuucaucccggugcuccaguccgugacggcgcggaucaucggcgaccccagccugcacggggacgucugguccuggcuggaguucuuccucaccagcaucuucuccgcccugugggugcugccccucuucgugcugagcaaggucgugaacgccaucugguuccaggacaucgccgaccuggcguucgagguguccggccgcaagccccacccguuccccagcgucuccaagaucaucgccgacaugcuguucaaccuccugcuccaggcccuguuccugauccagggcauguucgugagccucuuccccauccaccugguggggcagcuggucucccuccugcacaugagccugcucuacagccuguacugcuucgaguaccggugguucaacaagggcaucgagaugcaccagcgccuguccaacaucgagcggaacuggcccuacuacuucggguucggccucccgcuggccuuccugaccgccaugcagagcuccuacaucaucagcgggugccucuucuccauccuguucccccuguucaucaucagcgcgaacgaggccaagacccccggcaaggccuaccucuuccagcugcgccuguucucccucgugguguuccugagcaaccggcuguuccacaagacggucuaccuccaguccgcccugagcuccagcaccuccgccgagaaguuccccagcccgcaccccucccccgcgaagcugaaggccaccgccggccacuga

SEQ ID NO: 29559 - RNA, 564 nt, Artificial Sequence
  derived and/or modified sequence opt1 from EID1__Homo_sapiens__NP_055150
augagcgagauggccgagcuguccgagcucuacgaggagagcuccgaccugcagauggacgugaugcccggcgagggggaccugccgcagauggaggucggcagcgggucccgcgagcucagccugcggcccucccgcagcggcgcccagcagcuggaggaggaggggcccauggaggaggaggaggcgcagcccauggccgccccggagggcaagcggucccucgccaacggccccaacgccggggagcagcccggccagguggcgggggccgacuucgagagcgaggacgagggcgaggaguucgacgacugggaggacgacuacgacuaccccgaggaggagcagcuguccggggccggcuaccgcgugagcgccgcgcuggaggaggccgacaagauguuccuccggacccgcgagccggcccuggacggcggguuccagaugcacuacgagaagacccccuucgaccagcuggccuucaucgaggagcuguucucccucauggucgugaaccggcugacggaggagcucggcugcgacgagaucaucgaccgcgaguga

SEQ ID NO: 29560 - RNA, 498 nt, Artificial Sequence
  derived and/or modified sequence opt1 from EIF1AD__Homo_sapiens__NP_001229411
augagccaggccaccaagcgcaagcacguggucaaggaggugcugggcgagcacaucgugcccuccgaccagcagcagaucguccgggugcuccgcaccccggggaacaaccugcacgagguggagacggcccagggccagcgguuccuggucagcaugcccuccaaguaccgcaagaacaucuggaucaagcgcggggacuuccucaucguggaccccaucgaggagggcgagaaggugaaggcggagaucagcuucguccugugcaaggaccacgugcggucccugcagaaggagggguucuggcccgaggccuucagcgagguggccgagaagcacaacaaccggaaccgccagacccagccggagcuccccgccgagccccagcuguccggcgaggagagcuccagcgaggacgacuccgaccuguucgucaacaccaaccggcgccaguaccacgagagcgaggaggaguccgaggaggaggaggccgcguga

SEQ ID NO: 29561 - RNA, 435 nt, Artificial Sequence
  derived and/or modified sequence opt1 from EIF1AX__Homo_sapiens__NP_001403
augcccaagaacaagggcaagggcgggaagaaccgccggcgcgggaagaacgagaacgagagcgagaagcgggagcugguguucaaggaggacggccaggaguacgcccaggucaucaagaugcucgggaacggccgccuggaggccaugugcuucgacggcgugaagcggcugugccacauccgcgggaagcuccggaagaagguguggaucaacaccuccgacaucauccuggucggccugcgcgacuaccaggacaacaaggcggacgugauccucaaguacaacgccgacgaggcccggagccugaaggccuacggggagcugccggagcacgccaagaucaacgagaccgacacguucggccccggggacgacgacgagauccaguucgacgacaucggcgacgacgacgaggacaucgacgacaucuga

SEQ ID NO: 29562 - RNA, 384 nt, Artificial Sequence
  derived and/or modified sequence opt1 from EIF1AY__Homo_sapiens__NP_001265541
augcccaagaacaagggcaagggcgggaagaaccgccggcgcgggaagaacgagaacgagagcgagaagcgggagcugguguucaaggaggacggccaggaguacgcccaggucaucaagaugcucgggaacggccgccuggaggcccugugcuucgacggcgugaagcggcucugccacauccgcgggaagcugcggaagaaggacaacaaggcggacgugauccugaaguacaacgccgacgaggcccgcucccucaaggccuacggcgagcugccggagcacgccaagaucaacgagaccgacaccuucgggcccggcgacgacgacgagauccaguucgacgacaucggggacgacgacgaggacaucgacgacaucuga

SEQ ID NO: 29563 - RNA, 342 nt, Artificial Sequence
  derived and/or modified sequence opt1 from EIF1__Homo_sapiens__NP_005792
augagcgccauccagaaccugcacuccuucgaccccuucgccgacgcgagcaagggcgacgaccuccugccggccgggaccgaggacuacauccacauccgcauccagcagcggaacggccgcaagacccugacgaccgugcaggggaucgccgacgacuacgacaagaagaagcucgucaaggccuucaagaagaaguucgccugcaacggcaccgugaucgagcaccccgaguacggggaggugauccagcugcagggcgaccagcggaagaacaucugccaguuccuggucgagaucggccucgcgaaggacgaccagcugaaggugcacggguucuga

SEQ ID NO: 29564 - RNA, 1758 nt, Artificial Sequence
  derived and/or modified sequence opt1 from EIF2A__Homo_sapiens__NP_114414
auggcccccagcaccccgcugcucaccgugcgcggcuccgaggggcuguacauggucaacggcccgccccacuucacggagagcaccguguucccccgggaguccgggaagaacugcaaggugugcaucuucagcaaggacggcacccuguucgccugggggaacggcgagaaggucaacaucaucuccgugaccaacaagggccuccugcacagcuucgaccugcucaaggcggugugccuggaguucucccccaagaacacgguccuggccaccuggcagcccuacaccaccagcaaggacgggacggccggcauccccaaccuccagcuguacgacgugaagaccgggaccugccugaaguccuucauccagaagaagaugcagaacuggugccccagcugguccgaggacgagacccucugcgcccgcaacgugaacaacgagguccacuucuucgagaacaacaacuucaacacgaucgccaacaagcugcaccuccagaagaucaacgacuucgugcugagcccgggcccccagcccuacaagguggcggucuacgugcccggguccaagggcgccccgagcuucgugcggcuguaccaguaccccaacuucgccggcccccacgccgcgcuggccaacaaguccuucuucaaggccgacaaggucaccaugcucuggaacaagaaggccaccgccgugcuggugaucgcgagcaccgacgucgacaagacgggggccuccuacuacggcgagcagacccugcacuacaucgccaccaacggggagagcgccguggugcagcuccccaagaacggcccgaucuacgacgucguguggaacuccagcagcaccgaguucugcgccguguacggcuucaugcccgcgaaggccacgaucuucaaccugaagugcgaccccgucuucgacuucgggaccggcccccgcaacgccgccuacuacuccccgcacgggcacauccuggugcucgccggcuucgggaaccugcggggccagauggaggucugggacgugaagaacuacaagcugaucagcaagcccguggcguccgacagcaccuacuucgccuggugccccgacggcgagcacauccucaccgccacgugcgcgccccgccugcgggucaacaacggguacaagaucuggcacuacaccggcuccauccugcacaaguacgacgugccgagcaacgccgagcucuggcaggucuccuggcagcccuuccuggacgggaucuuccccgccaagaccaucaccuaccaggccgugcccagcgaggugccgaacgaggagcccaagguggccacggccuaccggcccccggcgcugcgcaacaagcccaucaccaacuccaagcuccacgaggaggagccgccccagaacaugaagccccagagcggcaacgacaagccccuguccaagaccgcccugaagaaccagcgcaagcacgaggccaagaaggccgccaagcaggaggcgcggagcgacaagucccccgaccucgcccccaccccggcgccccagagcacgccccgcaacaccgucucccagagcaucuccggggaccccgagaucgacaagaagaucaagaaccugaagaagaagcugaaggccaucgagcagcucaaggagcaggccgccaccggcaagcagcuggagaagaaccagcuggagaagauccagaaggagaccgcccuccugcaggagcuggaggaccucgagcugggcaucuga

SEQ ID NO: 29565 - RNA, 1893 nt, Artificial Sequence
  derived and/or modified sequence opt1 from EIF2AK1__Homo_sapiens__NP_055228
augcagggcgggaacagcggcgugcgcaagcgggaggaggagggggacggcgccggggccgucgcggcgcccccggccaucgacuuccccgccgagggccccgaccccgaguacgacgaguccgacgugccggccgagauccaggugcugaaggagccccuccagcagcccaccuuccccuucgccgucgccaaccagcugcugcucgugagccugcuggagcaccucucccacgugcacgagccgaacccccugcgcagccggcaggucuucaagcugcucugccagaccuucaucaagaugggccugcuguccagcuucacgugcuccgacgaguucagcucccuccgccugcaccacaaccgggccaucacccaccugaugcgcagcgccaaggagcgggugcgccaggaccccugcgaggacaucucccggauccagaagauccgcagccgggagguggcgcucgaggcccagaccucccgcuaccugaacgaguucgaggagcuggccauccucgggaagggcggguacggccgggucuacaaggugcgcaacaagcuggacgggcaguacuacgccaucaagaagauccugaucaagggcgccaccaagacggugugcaugaagguccuccgggaggugaaggugcuggcgggccugcagcaccccaacaucgucggguaccacaccgccuggaucgagcacgugcacgugauccagccgcgcgccgaccgggccgccaucgagcuccccagccuggagguccuguccgaccaggaggaggaccgcgagcagugcggcgugaagaacgacgagagcuccagcuccagcaucaucuucgcggagcccacccccgagaaggagaagcgguucggggagagcgacaccgagaaccagaacaacaaguccgugaaguacacgaccaaccucgucauccgcgagagcggcgagcuggaguccacccuggagcuccaggagaacggccuggccgggcugagcgccuccagcaucguggagcagcagcucccgcugcggcgcaacucccaccuggaggagagcuucaccuccacggaggagagcuccgaggagaacgugaacuuccucggccagaccgaggcccaguaccaccugaugcugcacauccagaugcagcucugcgagcugagccugugggacuggaucgucgagcgcaacaagcgggggcgcgaguacguggacgaguccgccugccccuacgucauggcgaacguggccaccaagaucuuccaggagcucguggagggcgucuucuacauccacaacauggggaucgugcaccgggaccugaagccccgcaacaucuuccugcacggccccgaccagcaggucaagaucggcgacuucgggcucgccugcaccgacauccugcagaagaacacggacuggaccaaccggaacggcaagcgcaccccgacccacacgagccggguggggaccugccuguacgccucccccgagcagcucgagggcagcgaguacgacgccaaguccgacauguacagccuggggguggugcugcuggagcuguuccagcccuucggcaccgagauggagcgcgcggagguccucaccggccugcggacggggcagcuccccgagucccugcgcaagcggugcccggugcaggccaaguacauccagcaccugacccgccggaacagcagccagcgccccuccgccauccagcuccugcagagcgagcuguuccagaacuccggcaacgugaaccucacccugcagaugaagaucaucgagcaggagaaggagaucgccgagcugaagaagcagcucaaccugcugagccaggacaaggggguccgggacgacggcaaggacgggggcgugggcuga

SEQ ID NO: 29566 - RNA, 1533 nt, Artificial Sequence
  derived and/or modified sequence opt1 from EIF2AK2__Homo_sapiens__NP_001129124
auggccggcgaccugagcgccggguucuucauggaggagcucaacaccuaccgccagaagcagggcgugguccugaaguaccaggagcugcccaacuccgggccgccccacgaccggcgcuucaccuuccaggugaucaucgacggccgggaguuccccgagggggagggccgcagcaagaaggaggcgaagaacgccgccgccaagcucgccguggagauccugaacaaggagaagaaggcggucagcccccugcuccugaccaccaccaacagcuccgagggccugagcauggggaacuacaucggccucaucaaccggaucgcccagaagaagcgccugaccgugaacuacgagcagugcgccuccggggugcacggcccggagggguuccacuacaagugcaagaugggccagaaggaguacagcaucggcacgggguccaccaagcaggaggccaagcagcuggcggccaagcucgccuaccugcagauccugagcgaggagaccuccgucaagagcgacuaccucuccagcggcuccuucgccaccacgugcgagagccaguccaacagccuggugaccuccacccuggccagcgagagcuccagcgagggggacuucuccgcggacaccagcgagaucaacuccaacagcgacucccucaacagcuccagccugcugaugaacggccuccggaacaaccagcgcaaggccaagcggucccuggcgccccgcuucgaccugcccgacaugaaggagacgaaguacaccguggacaagcggaaggccgagcgcgaggucaaggcccucgccaagcuggaccacgugaacaucgugcacuacaacggcugcugggacggguucgacuacgaccccgagaccagcgacgacucccuggagagcuccgacuacgacccggagaacagcaagaacuccagccgguccaagaccaagugccucuucauccagauggaguucugcgacaagggcacgcuggagcaguggaucgagaagcgccgcggggagaagcuggacaagguccucgcccuggagcuguucgagcagaucaccaagggcguggacuacauccacagcaagaagcucauccaccgggaccugaagcccagcaacaucuuccugguggacaccaagcaggucaagaucggggacuucggccucgugaccucccugaagaacgacggcaagcggacgcgcagcaaggggacccugcgguacaugucccccgagcagaucagcucccaggacuacggcaaggagguggaccucuacgcccuggggcugauccucgccgagcugcugcacgucugcgacaccgccuucgagaccagcaaguucuucacggaccuccgcgacggcaucaucuccgacaucuucgacaagaaggagaagacccugcugcagaagcuccugagcaagaagcccgaggaccggccgaacaccuccgagauccugcgcacccugacgguguggaagaagucccccgagaagaacgagcgccacacgugcuga

SEQ ID NO: 29567 - RNA, 3351 nt, Artificial Sequence
  derived and/or modified sequence opt1 from EIF2AK3__Homo_sapiens__NP_004827
auggagcgcgccaucagccccggccugcucgugcgggcccugcugcuccugcugcuccugcuggggcucgcggcccgcaccgucgccgccggccgggcccgcgggcugccggcgcccaccgccgaggccgccuucggccugggggcggccgccgcccccacguccgccacccgggugcccgcggccggcgccguggccgccgcggaggucaccguggaggacgccgaggcccucccggccgccgcgggcgagcaggagccccgcgggcccgagcccgacgacgagaccgagcugcggccgcgcggccggagccuggugaucaucuccacgcucgacgggcgcaucgccgcccuggaccccgagaaccacggcaagaagcagugggaccuggacgucgggagcggcucccucgugagcuccagccuguccaagcccgagguguucggcaacaagaugaucauccccagccuggacggggcccucuuccagugggaccaggaccgggaguccauggagaccgucccguucaccguggagagccugcuggaguccagcuacaaguucggcgacgacgugguccucgucgggggcaagucccugaccacguacggccugagcgccuacuccgggaaggugcgcuacaucugcagcgcgcucggcugccggcagugggacuccgacgagauggagcaggaggaggacauccugcugcuccagcgcacccagaagaccgugcgggccguggggccccgcagcggcaacgagaaguggaacuucagcguggggcacuucgagcugcgguacauccccgacauggagacccgcgccggcuucaucgaguccacguucaagcccaacgagaacaccgaggagagcaagaucaucuccgacgucgaggagcaggaggccgcgaucauggacaucgugaucaaggugagcgucgccgacuggaaggugauggccuucuccaagaagggcgggcaccuggagugggaguaccaguucugcaccccgaucgccagcgccuggcuccugaaggacggcaaggugauccccaucucccuguucgacgacaccagcuacacguccaacgacgacguccucgaggacgaggaggacaucguggaggcggcccgcggggccaccgagaacagcgucuaccugggcauguaccgggggcagcuguaccuccaguccagcgugcggaucuccgagaaguuccccagcucccccaaggcccuggagagcgugaccaacgagaacgccaucaucccgcugcccaccaucaaguggaagccccucauccacucccccagccgcacgccgguccuggugggcuccgacgaguucgacaagugccugagcaacgacaaguucagccacgaggaguacuccaacggcgcgcucagcauccugcaguaccccuacgacaacggguacuaccugcccuacuacaagcgcgagcggaacaagcgcuccacccagaucaccgugcgguuccucgacaacccccacuacaacaagaacauccgcaagaaggacccgguccugcugcugcacugguggaaggagaucguggccaccauccucuucugcaucaucgccacgaccuucaucgugcggcgccuguuccacccccacccccaccggcagcgcaaggagagcgagacccagugccagaccgagaacaaguacgacuccgucagcggcgaggccaacgacuccagcuggaacgacaucaagaacuccggguacaucagccgguaccugacggacuucgagccgauccagugccucggccgcgggggcuucggcgugguguucgaggccaagaacaaggucgacgacugcaacuacgcgaucaagcggauccgccugcccaaccgggagcuggcccgcgagaaggugaugcgggaggugaaggcccucgccaagcuggagcaccccgggaucguccgcuacuucaacgcguggcuggaggcgcccccggagaaguggcaggagaagauggacgagaucuggcucaaggacgaguccaccgacuggccccugagcucccccagccccauggacgccccguccgugaagauccggcgcauggaccccuucgccaccaaggagcacaucgagaucaucgcccccagcccccagcggucccgcagcuucagcgugggcaucuccugcgaccagaccagcuccagcgagucccaguucagcccgcuggaguucuccgggauggaccacgaggacaucagcgaguccgucgacgccgccuacaaccuccaggacagcugccugacggacugcgacguggaggacggcaccauggacggcaacgacgaggggcacuccuucgagcugugccccagcgaggccucccccuacgugcgcagccgggagcgcaccuccagcuccaucgucuucgaggacagcggcugcgacaacgccuccagcaaggaggagcccaagaccaaccggcuccacaucgggaaccacugcgccaacaagcugacggcguucaagccgaccagcuccaagagcuccagcgaggccacccuguccaucagcccgccccgccccaccacccucucccuggaccugacgaagaacaccaccgagaagcuccagcccagcucccccaagguguaccuguacauccagaugcagcugugccggaaggagaaccucaaggacuggaugaacggccgcugcaccaucgaggagcgggagcgcagcgugugccugcacaucuuccugcagaucgccgaggccgucgaguuccuccacuccaaggggcugaugcaccgggaccugaagcccagcaacaucuucuucacgauggacgacguggugaaggucggcgacuucggccucgugaccgccauggaccaggacgaggaggagcagaccgugcugacccccaugccggcguacgcccgccacacggggcaggucggcaccaagcuguacaugucccccgagcagauccacgggaacagcuacucccacaagguggacaucuucagccucggccugauccuguucgagcuccuguaccccuucuccacccagauggagcgggugcgcacccugacggacguccggaaccucaaguucccgccccuguucacccagaaguaccccugcgaguacgugauggugcaggacaugcugagccccuccccgauggagcgccccgaggccaucaacaucaucgagaacgccgucuucgaggaccucgacuuccccgggaagaccgugcugcggcagcgcagccggagccuguccagcuccggcaccaagcacagccgccaguccaacaacagccacagcccccucccguccaacuga

SEQ ID NO: 29568 - RNA, 4950 nt, Artificial Sequence
  derived and/or modified sequence opt1 from EIF2AK4__Homo_sapiens__NP_001013725
auggccggcgggcgcggcgcccccgggcggggccgcgacgagccgcccgagagcuacccccagcggcaggaccacgagcugcaggcgcucgaggccaucuacggggccgacuuccaggaccugcgccccgacgccugcggcccggugaaggagccgcccgagaucaaccugguccucuacccccagggccugaccggggaggagguguacgugaaggucgaccugcgggugaagugcccgcccaccuaccccgacgugguccccgagaucgagcucaagaacgccaagggccuguccaacgagagcgugaaccugcucaagucccgccuggaggagcuggcgaagaagcacugcggggaggugaugaucuucgagcucgccuaccacguccagagcuuccuguccgagcacaacaagcccccgcccaagagcuuccacgaggagaugcuggagcggcgcgcccaggaggagcagcagcggcuccuggaggccaagcgcaaggaggagcaggagcagcgggagauccugcacgagauccagcgccggaaggaggagaucaaggaggagaagaagcgcaaggagauggcgaagcaggagcggcucgagaucgccucccugagcaaccaggaccacacguccaagaaggaccccggcgggcaccgcaccgccgccauccugcacggcggcagccccgacuucguggggaacggcaagcaccgggccaacuccagcgggcgcucccggcgcgagcggcaguacagcgugugcaacuccgaggacagccccggcuccugcgagauccucuacuucaacaugggcagccccgaccagcugaugguccacaaggggaagugcaucggcuccgacgagcagcuggggaagcucguguacaacgcgcuggagaccgccaccggcggguucgugcugcucuacgaguggguccugcaguggcagaagaagaugggccccuuccugacgagccaggagaaggagaagaucgacaagugcaagaagcagauccagggcaccgagaccgaguucaacagccucgugaagcugucccacccgaacgugguccgcuaccuggccaugaaccucaaggagcaggacgacagcaucgugguggacauccuggucgagcacaucuccggggugagccuggccgcccaccucucccacagcggccccauccccgugcaccagcugcgccgguacaccgcgcagcugcucuccgggcuggacuaccugcacagcaacuccgucgugcacaagguccucagcgccuccaacgugcugguggacgccgagggcacggucaagaucaccgacuacagcaucuccaagcgccuggccgacaucugcaaggaggacguguucgagcagacccgggugcgcuucagcgacaacgcccuccccuacaagaccgggaagaagggcgacgucuggcggcugggccugcuccugcugucccugagccaggggcaggagugcggcgaguacccggugacgauccccuccgaccuccccgcggacuuccaggacuuccugaagaagugcgugugccuggacgacaaggagcgcuggagcccccagcagcuccugaagcacuccuucaucaacccgcagcccaagaugccccuggucgagcagagcccggaggacagcgaggggcaggacuacguggagaccgugauccccuccaaccggcuccccagcgccgccuucuucuccgagacccagcgccaguucagccgguacuucaucgaguucgaggagcugcagcugcucggcaagggggccuucggcgccgucaucaaggugcagaacaagcuggacggcugcugcuacgcggugaagcgcauccccaucaacccggccucccggcaguuccgccggaucaagggggaggucacccugcucagccgccugcaccacgagaacaucgugcgguacuacaacgccuggaucgagcgccacgagcggcccgccggccccgggacgcccccgcccgacuccggcccccuggcgaaggacgaccgcgccgcccggggccagcccgccagcgacaccgacgggcucgacuccguggaggccgcggccccgccgcccauccugagcuccagcgucgagugguccaccagcggcgagcgcuccgccagcgcccgcuuccccgccaccgggcccggcuccagcgacgacgaggacgacgacgaggacgagcacgggggcguguucagccaguccuuccugcccgcgagcgacuccgagagcgacaucaucuucgacaacgaggacgagaacuccaagagccagaaccaggacgaggacugcaacgagaagaacggcugccacgaguccgagcccagcgugacgaccgaggccguccacuaccucuacauccagauggaguacugcgagaaguccacccugcgggacaccaucgaccaggggcuguaccgcgacacggugcggcucuggcgccuguuccgggagauccuggacggccucgccuacauccacgagaaggggaugauccaccgcgaccugaagcccgugaacaucuuccuggacagcgacgaccacgucaagaucggcgacuucgggcucgccaccgaccaccuggccuucuccgcggacagcaagcaggacgaccagaccggcgaccugaucaaguccgacccgagcggccaccucaccgggauggugggcacggcccuguacgugucccccgagguccaggggagcaccaaguccgccuacaaccagaagguggaccuguucagccucggcaucaucuucuucgagauguccuaccaccccauggugaccgccagcgagcggaucuucguccugaaccagcugcgcgaccccaccagcccgaaguuccccgaggacuucgacgacggggagcacgcgaagcagaaguccgugaucagcuggcuccugaaccacgaccccgccaagcggccgacggccaccgagcugcucaaguccgagcugcugcccccgccccagauggaggagagcgagcuccacgaggugcugcaccacacccugaccaacgucgacggcaaggccuaccgcacgaugauggcccagaucuucucccagcggaucagccccgcgaucgacuacaccuacgacuccgacauccucaagggcaacuucagcauccgcaccgccaagaugcagcagcacgugugcgagaccaucauccggaucuucaagcgccacggggccgugcagcugugcacgccccugcuccugccccggaaccgccagaucuacgagcacaacgaggccgcccuguucauggaccacuccggcaugcucgucaugcugcccuucgaccugcggaucccguucgcgcgcuacguggcccggaacaacauccucaaccugaagcgcuacugcaucgagcggguguuccgcccccgcaagcuggaccgguuccaccccaaggagcuccuggagugcgccuucgacaucgucaccagcaccaccaacuccuuccugcccaccgccgagaucaucuacacgaucuacgagaucauccaggaguucccggcccuccaggagcgcaacuacagcaucuaccugaaccacaccaugcugcucaaggcgauccugcugcacugcgggauccccgaggacaagcucucccagguguacaucauccuguacgacgccgugaccgagaagcugacccggcgcgaggucgaggccaaguucugcaaccucagccuguccagcaacucccugugccggcucuacaaguucaucgagcagaagggcgaccugcaggaccugaugcccacgaucaacagccucaucaagcagaagaccgggaucgcccagcuggugaaguacggccugaaggaccucgaggagguggucggccugcugaagaagcucgggaucaagcuccaggugcugaucaaccugggccugguguacaagguccagcagcacaacgggaucaucuuccaguucguggcguucaucaagcgccggcagcgcgccgugcccgagauccuggccgccggcggccgguacgaccuccugaucccgcaguuccgcgggccccaggcccugggccccguccccaccgcgaucgggguguccaucgccaucgacaagaucagcgccgccguccucaacauggaggagagcgugaccaucuccagcugcgaccugcugguggucuccgugggccagaugagcaugucccgggccaucaaccucacgcagaagcuguggaccgcggggaucaccgccgagaucauguacgacuggagccagucccaggaggagcugcaggaguacugccgccaccacgagaucaccuacguggcccuggucagcgacaaggagggcucccacgugaaggucaagagcuucgagaaggagcggcagacggagaagcgcgugcucgagaccgagcugguggaccacgugcugcagaagcuccggaccaaggucaccgacgagcgcaacggccgggaggccuccgacaaccuggccgugcagaaccugaaggggagcuucuccaacgcgagcggccucuucgagauccacggggccacgguggucccgaucguguccgugcuggcccccgagaagcugagcgccuccacccgccggcgcuacgagacccagguccagacccgccuccagacgagccuggccaaccugcaccagaaguccagcgagaucgagauccucgcgguggaccugcccaaggagaccauccugcaguuccucagccuggagugggacgccgacgagcaggccuucaacaccaccgugaagcagcugcucucccggcugcccaagcagcgcuaccugaagcucgucugcgacgagaucuacaacaucaagguggagaagaaggugagcguccuguuccuguacuccuaccgggacgacuacuaccgcauccucuucuga

SEQ ID NO: 29569 - RNA, 918 nt, Artificial Sequence
  derived and/or modified sequence opt1 from EIF2B1__Homo_sapiens__NP_001405
auggacgacaaggagcugaucgaguacuucaagagccagaugaaggaggaccccgacauggccuccgccguggcggccauccgcacccuccuggaguuccugaagcgggacaagggcgagaccauccaggggcuccgcgccaaccugacgagcgccaucgagacccugugcggcgucgacuccagcguggccguguccagcgggggcgagcuguuccuccgguucaucucccuggcgagccucgaguacuccgacuacagcaagugcaagaagaucaugaucgagcgcggggagcuguuccugcggcgcaucucccucagccggaacaagaucgccgaccugugccacaccuucaucaaggacggcgccaccauccugacgcacgccuacucccgcgucgugcuccgggugcuggaggcggccgucgccgccaagaagcgcuucagcguguacgugaccgagucccagccggaccugagcggcaagaagauggccaaggcgcucugccaccugaacguccccgugaccgugguccuggacgccgccgugggguacaucauggagaaggccgaccucgugaucgucggcgccgagggggugguggagaacggcgggaucaucaacaagaucggcaccaaccagauggcggucugcgccaaggcccagaacaagcccuucuacgugguggccgaguccuucaaguucguccggcuguucccccugaaccagcaggacgugccggacaaguucaaguacaaggccgacacgcucaagguggcgcagaccggccaggaccugaaggaggagcaccccugggucgacuacaccgcccccagccugaucacccuccuguucacggaccugggggugcucacccccuccgccgucagcgacgagcugaucaagcuguaccucuga

SEQ ID NO: 29570 - RNA, 1056 nt, Artificial Sequence
  derived and/or modified sequence opt1 from EIF2B2__Homo_sapiens__NP_055054
augcccggcagcgccgccaagggguccgagcugagcgagcgcaucgaguccuucguggagacccucaagcggggcgggggcccgcgcagcuccgaggagauggcgcgggagacccuggggcugcuccgccagaucaucacggaccaccgguggagcaacgccggcgagcugauggagcugauccgccgggagggccgccggaugaccgccgcccagcccuccgagaccaccgucgggaacauggugcgccgggugcucaagaucauccgcgaggaguacggccggcugcacgggcgcagcgacgaguccgaccagcaggagagccugcacaagcuccugacguccggcgggcugaacgaggacuucagcuuccacuacgcccagcuccaguccaacaucaucgaggcgaucaacgagcugcuggucgagcucgagggcaccauggagaacaucgccgcccaggcccuggagcacauccacagcaacgaggugaucaugaccaucggcuucucccggaccguggaggcguuccugaaggaggccgcccgcaagcggaaguuccacgucaucguggccgagugcgcccccuucugccaggggcacgagauggcggugaaccucagcaaggccggcaucgagacgaccgucaugaccgacgccgccaucuucgccgugaugucccgcgugaacaaggucaucaucgggaccaagacgauccuggcgaacggcgcccugcgggccgugaccggcacccacacccucgcccuggccgcgaagcaccacagcacgccccugaucgugugcgccccgauguucaagcucagcccccaguuccccaacgaggaggacuccuuccacaaguucgucgcccccgaggaggugcugccguucaccgagggggacauccuggagaaggugagcguccacugccccguguucgacuacgugccgcccgagcucaucacccuguucaucuccaacaucggcgggaacgcccccagcuacaucuaccgccugauguccgagcucuaccaccccgacgaccacguccuguga

SEQ ID NO: 29571 - RNA, 1269 nt, Artificial Sequence
  derived and/or modified sequence opt1 from EIF2B3__Homo_sapiens__XP_011540698
auggaguuccaggccguggucauggccgugggcgggggcagccgcaugaccgaccugaccuccagcauccccaagccccuccugcccguggggaacaagccccugaucugguacccccucaaccugcuggagcgggucggcuucgaggaggugaucguggucacgacccgcgacgugcagaaggcgcucugcgccgaguucaagaugaagaugaagccggacaucgugugcauccccgacgacgccgacauggggaccgccgacucccugcgguacaucuaccccaagcugaagaccgacguccucgugcugagcugcgaccugaucacggacguggcccuccacgaggucguggaccuguuccgcgcguacgacgccucccuggccaugcucaugcggaagggccaggacagcaucgagcccgugccgggccagaaggggaagaagaaggccgucgagcagcgcgacuucaucggcguggacuccaccgggaagcggcugcuguucauggcgaacgaggccgaccucgacgaggagcuggugaucaagggcagcauccugcagaaguccaucaccagcauccgcuccgagcucauccccuaccugguccggaagcaguucagcuccgccagcucccagcaggggcaggaggagaaggaggaggaccugaagaagaaggagcucaagagccuggacaucuacuccuucaucaaggaggccaacacccugaaccucgcccccuacgacgcgugcuggaacgccugccgcggcgaccggugggaggaccugagccgcucccaggugcggugcuacgugcacaucaugaaggagggccugugcagccgcgucagcacgcucgggcuguacauggaggccaaccgccaggugcccaagcugcucuccgcccugugcccggaggagccgcccgugcacagcuccgcccagaucgucagcaagcaccuggugggcgucgacucccucaucgggcccgagacccagaucggcgagaaguccagcaucaagcggagcgugaucggcuccagcugccugaucaaggaccgggugaccaucaccaacugccugcucaugaacuccgucacgguggaggaggggagcaacauccagggcuccgugaucugcaacaacgcggucaucgagaagggggccgacaucaaggacugccugaucggcagcgggcagcgcaucgaggccaaggccaagcgggugaacgaggugaucgucggcaacgaccagcugauggagaucuga

SEQ ID NO: 29572 - RNA, 1572 nt, Artificial Sequence
  derived and/or modified sequence opt1 from EIF2B4__Homo_sapiens__NP_001029288
auggccgccguggcggucgccgugcgcgaggacagcggcuccgggaugaaggccgagcugcccccgggccccggggccgugggccgggagaugaccaaggaggagaagcuccagcugcgcaaggagaagaagcagcagaagaagaagcggaaggaggagaagggggccgagcccgagaccggcagcgcggucuccgccgcccagugccaggugggccccacgcgcgagcugccggagagcgggauccagcucggcacgccccgggagaaggugcccgccgggcgcuccaaggcggagcugcgggccgagcgccgggccaagcaggaggccgagcgcgcccugaagcaggcgcggaagggcgagcagggcgggcccccgcccaaggccagccccuccaccgccggcgagacccccagcggggucaagcgccucccggaguacccccagguggacgaccugcugcuccggcgccuggugaagaagcccgagcggcagcagguccccacccgcaaggacuacggcuccaaggugagccuguucucccaccucccgcaguacagccggcagaacucccugacccaguucaugagcauccccuccagcgugauccaccccgccaugguccgccuggggcuccaguacucccagggccuggugagcggcuccaacgcccggugcaucgcgcugcuccgcgcccugcagcaggucauccaggacuacaccacgcccccgaacgaggagcugagccgggaccucgugaacaagcugaagcccuacaugagcuuccugacccagugccgcccccucuccgccagcaugcacaacgccaucaaguuccugaacaaggagaucaccuccguggggagcuccaagcgcgaggaggaggccaagagcgagcugcgggcggccaucgaccgcuacgugcaggagaagaucguccucgccgcccaggccaucucccgguucgcguaccagaagaucagcaacggcgacgugauccugguguacgggugcuccagccuggucucccgcauccuccaggaggccuggaccgagggccggcgcuuccgggugguggucguggacagccgccccuggcuggaggggcggcacacccugcgcucccucguccacgccggcgugccggccagcuaccugcugauccccgcggccuccuacgugcuccccgaggucagcaaggugcugcugggcgcccacgcccuccuggccaacggguccgugaugagccgggucggcacggcgcagcuggcccucguggcccgcgcccacaacgugcccguccuggugugcugcgagaccuacaaguucugcgagcgggugcagaccgacgccuucgucuccaacgagcuggacgacccggacgaccuccagugcaagcgcggggagcacguggcgcuggccaacuggcagaaccacgccagccugcggcuccugaaccugguguacgacgucaccccgcccgagcugguggaccucgugaucacggagcugggcaugauccccugcagcuccguccccguggugcugcgcgucaagagcuccgaccaguga

SEQ ID NO: 29573 - RNA, 2166 nt, Artificial Sequence
  derived and/or modified sequence opt1 from EIF2B5__Homo_sapiens__NP_003898
auggccgcccccguggucgcgccgcccggcgugguggucagccgcgccaacaagcgguccggggccggccccgggggcagcgggggcggcggggcccgcggcgccgaggaggagcccccgccgccccugcaggcggugcucguggccgacuccuucgaccggcgcuucuuccccaucagcaaggaccagccccggguccugcugccccucgccaacguggcccugaucgacuacacccuggaguuccucaccgcgacgggggugcaggagaccuucgucuucugcugcuggaaggccgcccagaucaaggagcaccuccugaaguccaaguggugccgccccaccagccugaacguggugcggaucaucaccuccgagcuguaccgcagccugggcgacguccuccgggacguggacgccaaggcccuggugcgcuccgacuuccugcucgucuacggggacgugaucagcaacaucaacaucacgcgggcgcuggaggagcaccgccugcggcgcaagcucgagaagaacguguccgucaugaccaugaucuucaaggagagcucccccagccacccgacccggugccacgaggacaacgugguggucgccguggacuccaccacgaaccgcgugcugcacuuccagaagacccagggccugcggcgcuucgccuucccccucagccuguuccagggcuccagcgacggggucgaggugcgguacgaccugcucgacugccacaucuccaucugcagcccccaggucgcccagcuguucaccgacaacuucgacuaccagacccgcgacgacuucgugcggggccugcucgugaacgaggagauccuggggaaccagauccacaugcacgucacggccaaggaguacggcgcgcgcgugagcaaccugcacauguacuccgccgugugcgccgacgucauccgccgguggguguacccccucaccccggaggccaacuucaccgacagcaccacgcaguccugcacccacagccgccacaacaucuaccggggccccgaggugucccuggggcacggcagcauccuggaggagaacguccuccugggguccggcaccgugaucgggagcaacugcuucaucaccaacuccgugaucggccccggcugccacaucggggacaacgucgugcuggaccagacguaccucuggcagggcgugcgcgucgccgcgggggcccagauccaccagagccugcugugcgacaacgccgaggugaaggagcgggugacccucaagccccgcuccguccugaccagccaggugguggucggcccgaacaucacccugcccgagggguccgugaucagccuccacccgcccgacgccgaggaggacgaggacgacggcgaguucuccgacgacagcggcgccgaccaggagaaggacaaggugaagaugaagggguacaaccccgcggaggucggcgccgccgggaagggcuaccuguggaaggccgcggggaugaacauggaggaggaggaggagcugcagcagaaccucuggggccugaagaucaacauggaggaggaguccgagagcgaguccgagcagagcauggacagcgaggagcccgacucccggggcgggagcccccagauggacgacaucaagguguuccagaacgaggugcugggcacgcuccagcgcgggaaggaggagaacaucuccugcgacaaccugguccuggagaucaacagccugaaguacgccuacaacaucucccucaaggaggugaugcagguccugagccacguggugcuggaguucccccuccagcagauggacuccccgcuggacagcucccgguacugcgcccugcuccugccccugcucaaggccuggagccccguguuccgcaacuacaucaagcgggccgcggaccaccuggaggcccuggccgccaucgaggacuucuuccucgagcacgaggcccugggcaucuccauggcgaagguccugauggccuucuaccagcucgagauccuggccgaggagaccauccugagcugguucucccagcgcgacaccaccgacaagggccagcagcuccggaagaaccagcagcugcagcgcuucauccaguggcugaaggaggccgaggaggagagcuccgaggacgacuga

SEQ ID NO: 29574 - RNA, 948 nt, Artificial Sequence
  derived and/or modified sequence opt1 from EIF2S1__Homo_sapiens__NP_004085
augcccggccugagcugccgcuucuaccagcacaaguucccggagguggaggacgucgugauggugaacguccgguccaucgccgagaugggggccuacgugagccuccuggaguacaacaacaucgagggcaugauccugcucuccgagcugagccgccggcgcauccgguccaucaacaagcugauccgcaucgggcggaacgagugcguggucgugauccgcguggacaaggagaagggcuacaucgaccucagcaagcggcgcgucucccccgaggaggcgaucaagugcgaggacaaguucaccaagagcaagaccguguacuccauccugcggcacguggccgagguccuggaguacacgaaggacgagcagcucgagagccuguuccagcgcaccgccuggguguucgacgacaaguacaagcggcccggguacggcgccuacgacgccuucaagcacgcgguguccgaccccagcauccuggacucccucgaccugaacgaggacgagcgcgagguccugaucaacaacaucaaccggcgccucaccccgcaggccgugaagauccgggccgacaucgagguggccugcuacggcuacgaggggaucgacgcggucaaggaggcccugcgcgccggccugaacugcagcaccgagaacaugcccaucaagaucaaccucaucgccccgccccgguacgugaugacgaccaccacccuggagcgcacggaggggcuguccgugcucagccaggccauggcggucaucaaggagaagaucgaggagaagcggggcguguucaacgugcagauggagcccaaggucgugaccgacaccgacgagaccgagcuggcccgccagauggagcgccuggagcgggagaacgccgaggucgacggggacgacgacgccgaggagauggaggccaaggcggaggacuga

SEQ ID NO: 29575 - RNA, 1002 nt, Artificial Sequence
  derived and/or modified sequence opt1 from EIF2S2__Homo_sapiens__NP_003899
augagcggcgacgagaugaucuucgaccccaccauguccaagaagaagaagaagaagaagaagccguucaugcuggacgaggagggggacacccagacggaggagacccagcccagcgagaccaaggagguggagcccgagcccaccgaggacaaggaccucgaggccgacgaggaggacacgcgcaagaaggacgccuccgacgaccuggacgaccugaacuucuucaaccagaagaagaagaagaagaagaccaagaagaucuucgacaucgacgaggcggaggagggcgucaaggaccucaagaucgagagcgacgugcaggagccgaccgagcccgaggacgaccuggacaucaugcuggggaacaagaagaagaagaagaagaacgugaaguuccccgacgaggacgagauccucgagaaggacgaggcccuggaggacgaggacaacaagaaggacgacggcaucuccuucagcaaccagaccgggcccgccugggccggcuccgagcgggacuacacguacgaggagcugcucaaccgcgucuucaacaucaugcgggagaagaacccggacaugguggccggcgagaagcgcaaguucgugaugaagccgccccaggucgugcggguggggaccaagaagaccagcuucgucaacuucaccgacaucugcaagcugcugcaccgccagcccaagcaccuccuggcguuccugcucgccgagcugggcacguccgggagcaucgacggcaacaaccagcuggugaucaaggggcgguuccagcagaagcagaucgagaacgugcuccgccgguacaucaaggaguacgugaccugccacacgugccgcucccccgacaccauccugcagaaggacacccggcuguacuuccuccagugcgagaccugccacagccgcugcuccgucgccagcaucaagaccggcuuccaggccgugaccggcaagcgggcgcagcugcgcgccaaggccaacuga

SEQ ID NO: 29576 - RNA, 1419 nt, Artificial Sequence
  derived and/or modified sequence opt1 from EIF2S3__Homo_sapiens__NP_001406
auggccggcggggaggccggcgugacccuggggcagccccaccucagccgccaggaccugaccacgcuggacgucaccaagcucaccccgcugucccacgaggugaucagccggcaggcgaccaucaacaucggcacgaucgggcacguggcccacggcaaguccaccgucgugaaggccaucagcggcgugcacaccguccgcuucaagaacgagcuggagcggaacaucaccaucaagcucggguacgccaacgccaagaucuacaagcuggacgaccccuccugcccccgccccgagugcuaccggagcugcggcuccagcacgccggacgaguuccccaccgacauccccgggaccaagggcaacuucaagcuggugcgccacguguccuucgucgacugccccgggcacgacauccucauggcgaccaugcugaacggcgccgccgugauggacgccgcgcugcuccugaucgccggcaacgagagcugcccgcagccccagacguccgagcaccuggccgccaucgagaucaugaagcucaagcacauccugauccugcagaacaagaucgaccucgugaaggagagccaggccaaggagcaguacgagcagauccuggcguucguccaggggaccguggccgagggcgcccccaucauccccaucuccgcccagcugaaguacaacaucgagguggucugcgaguacaucgugaagaagaucccggugccgccccgggacuucaccagcgagccccgccucaucgucauccgguccuucgacgugaacaagcccgggugcgagguggacgaccugaagggcggcgucgccgggggcagcauccugaagggggugcucaaggugggccaggagaucgagguccgccccgggaucguguccaaggacagcgagggcaagcugaugugcaagcccaucuucuccaagaucgucagccuguucgcggagcacaacgaccuccaguacgccgcccccggcgggcugaucggcguggggaccaagaucgacccgacgcugugccgggccgaccgcauggugggccagguccucggggccgugggcgcgcugcccgagaucuucaccgagcuggagaucagcuacuuccuccugcggcgccugcucggcgugcggaccgagggggacaagaaggccgccaagguccagaagcuguccaagaacgaggugcugauggugaacaucggcagccucuccaccgggggccgcgucagcgccgugaaggccgaccuggggaagaucgugcugacgaaccccgucugcaccgaggugggcgagaagaucgcgcucucccggcgcguggagaagcacuggcggcugaucggcugggggcagauccgccggggcgucaccaucaagcccaccguggacgacgacuga

SEQ ID NO: 29577 - RNA, 4149 nt, Artificial Sequence
  derived and/or modified sequence opt1 from EIF3A__Homo_sapiens__NP_003741
augcccgccuacuuccagcgcccggagaacgcccugaagcgggcgaacgaguuccucgaggugggcaagaagcagcccgcccuggacguccuguacgacgugaugaagagcaagaagcaccgcaccuggcagaagauccacgagcccaucaugcucaaguaccuggagcugugcguggaccuccggaagucccaccuggccaaggaggggcuguaccaguacaagaacaucugccagcaggucaacaucaagagccucgaggacguggugcgcgccuaccugaagauggccgaggagaagaccgaggcggccaaggaggagucccagcagaugguccuggacaucgaggaccucgacaacauccagacgcccgagagcgugcugcuguccgccgugagcggcgaggacacccaggaccggaccgaccgccuccugcugaccccgugggucaaguuccucugggaguccuaccggcagugccuggaccugcuccgcaacaacagccggguggagcgccuguaccacgacaucgcccagcaggcguucaaguucugccugcaguacacgcggaaggccgaguuccgcaagcucugcgacaaccugcggaugcaccugucccagauccagcgccaccacaaccagagcaccgccaucaaccucaacaaccccgagucccagagcaugcaccuggagacccggcuggugcagcucgacuccgccaucagcauggagcuguggcaggaggccuucaaggcggucgaggacauccacgggcuguucucccucagcaagaagccccccaagccgcagcugauggccaacuacuacaacaagguguccaccguguucuggaagagcggcaacgcccuguuccacgccuccacgcuccaccgccuguaccaccugagccgggagaugcgcaagaaccucacccaggacgagaugcagcggaugagcacccgcguccugcuggccacccucuccauccccaucacgcccgagcggaccgacaucgcgcgccugcuggacauggacgggaucaucguggagaagcagcgccggcucgccacccugcugggccuccaggcccccccgacccgcaucggccugaucaacgacauggugcgguucaacguccugcaguacguggugcccgaggucaaggaccuguacaacuggcucgagguggaguucaacccccugaagcugugcgagcgcgugacgaagguccucaacugggugcgggagcagcccgagaaggagccggagcugcagcaguacgucccccagcugcagaacaacaccauccuccgccugcugcagcaggugagccagaucuaccaguccaucgaguucagccggcucaccucccuggugcccuucgucgacgccuuccagcuggagcgcgccaucguggacgcggcccggcacugcgaccuccaggugcgcaucgaccacaccagccggacgcuguccuucgggagcgaccugaacuacgccacccgcgaggacgcccccaucggcccgcaccuccaguccaugcccagcgagcagauccggaaccagcugaccgccauguccagcguccuggcgaaggcccucgaggugaucaagcccgcccacauccugcaggagaaggaggagcagcaccagcuggccgugaccgcguaccucaagaacucccgcaaggagcaccagcggauccuggcccgccggcagacgaucgaggagcgcaaggagcggcuggagagccucaacauccagcgcgagaaggaggagcuggagcagcgcgaggccgagcugcagaagguccggaaggccgaggaggagcgccuccggcaggaggccaaggagcgcgagaaggagcggauccugcaggagcacgagcagaucaagaagaagaccgugcgcgagcggcuggagcagaucaagaagaccgagcucggggcgaaggccuucaaggacaucgacaucgaggaccuggaggagcuggaccccgacuucaucauggccaagcagguggagcagcucgagaaggagaagaaggagcugcaggagcgccugaagaaccaggagaagaagaucgacuacuucgagcgggccaagcgccucgaggagaucccgcugaucaaguccgccuacgaggagcagcggaucaaggacauggaccugugggagcagcaggaggaggagcgcaucaccacgaugcagcucgagcgggagaaggcgcuggagcacaagaaccgcaugagccggaugcuggaggaccgcgaccucuucgucaugcggcugaaggccgcccgccaguccguguacgaggagaagcugaagcaguucgaggagcggcucgccgaggagcgccacaaccggcuggaggagcgcaagcgccagcggaaggaggagcgccggaucaccuacuaccgcgagaaggaggaggaggagcagcggcgcgccgaggagcagaugcugaaggagcgggaggagcgcgagcgggcggagcgcgccaagcgggaggaggagcuccgcgaguaccaggagcgggugaagaagcuggaggaggucgagcgcaagaagcggcagcgcgagcuggagaucgaggagcgggagcgccggcgcgaggaggagcgccggcucggcgacagcucccugagccgcaaggacagccgguggggggaccgcgacuccgagggcaccuggcggaagggccccgaggccgacagcgaguggcgccgggggccccccgagaaggaguggcgccggggcgaggggcgcgacgaggaccggucccaccgccgggacgaggagcgcccgcggcgccugggcgacgacgaggaccgggagcccagccuccgccccgacgacgaccgggugccgcgccggggcauggacgacgaccgcgggccccgccggggccccgaggaggaccgcuucucccggcgcggggccgacgacgaccggcccagcuggcgcaacaccgacgacgaccggccgccccgccggaucgcggacgaggaccgcggcaacuggcggcacgccgacgacgaccgccccccccggcgcgggcuggacgaggaccggggcuccuggcgcacggccgacgaggaccggggcccgcgccgggggauggacgacgaccgcggcccccgccgggggggcgccgacgacgagcgcagcuccuggcggaacgccgacgacgaccgcgggccccggcgcggccuggacgacgaccggggcccccgccgggggauggacgacgaccgcggcccgcggcgcgggauggacgacgaccggggcccccgccgggggauggacgacgaccgcggcccccggcgcggccucgacgacgaccgggggcccuggcgcaacgcggacgacgaccggaucccgcgccgcggcgccgaggacgaccgggggcccuggcgcaacauggacgacgaccggcugagccgccgggccgacgacgaccgcuucccccggcgcggcgacgacucccggcccggcccguggcgcccccuggugaagcccgggggcuggcgggagaaggagaaggcccgcgaggagagcugggggcccccgcgggagucccgccccagcgaggagcgggagugggaccgcgagaaggagcgggaccgcgacaaccaggaccgggaggagaacgacaaggaccccgagcgcgagcgcgaccgggagcgcgacgucgaccgggaggaccgcuuccggcgcccgcgggacgagggcggguggcgccggggccccgccgaggaguccagcuccuggcgcgacagcagccggcgcgacgaccgggaccgcgacgaccggcgccgggagcgcgacgaccggcgcgaccuccgggagcgccgcgaccugcgggacgaccgcgaccggcgcggccccccccugcgguccgagcgcgaggaggugagcuccuggcggcgcgcggacgaccggaaggacgaccgcguggaggagcgggacccgccccgccgggucccccccccggcccucagccgcgaccgggagcgcgaccgggaccgcgagcgggagggggagaaggagaaggccuccuggcgcgccgagaaggaccgcgagagccugcggcgcaccaagaacgagaccgacgaggacggcuggaccacggugcggcgcuga

SEQ ID NO: 29578 - RNA, 2445 nt, Artificial Sequence
  derived and/or modified sequence opt1 from EIF3B__Homo_sapiens__NP_001032360
augcaggacgccgagaacguggccguccccgaggcggccgaggagcgcgccgagccgggccagcagcagcccgccgccgagcccccgcccgcggaggggcugcuccggcccgccggccccggggcccccgaggccgcgggcaccgaggccagcuccgaggagguggggaucgccgaggccggcccggagagcgaggugcgcaccgagcccgccgcggaggccgaggccgccuccggccccagcgagucccccagcccgcccgccgcggaggagcugcccgggucccacgccgagcccccgguccccgcccagggcgaggcccccggggagcaggcccgggacgagcgcagcgacucccgggcgcaggccgugagcgaggacgccggcgggaacgagggccgcgccgccgaggcggagccccgggcccuggagaacggcgacgccgacgagccguccuucagcgaccccgaggacuucguggacgacgucuccgaggaggagcuccugggggacgugcugaaggaccgcccccaggaggccgacggcaucgacagcgugaucgucguggacaacgugccccaggucgggccggaccggcucgagaagcugaagaacgugauccacaagaucuucuccaaguucggcaagaucacgaacgacuucuaccccgaggaggacggcaagaccaagggguacaucuuccuggaguacgcgagccccgcccacgccguggacgccgucaagaacgccgacggcuacaagcucgacaagcagcacaccuuccgcgugaaccuguucaccgacuucgacaaguacaugacgaucuccgacgagugggacauccccgagaagcagccguucaaggaccuggggaaccuccgguacuggcuggaggaggcggagugccgcgaccaguacagcgugaucuucgaguccggcgaccggaccagcaucuucuggaacgacgucaaggaccccgugagcaucgaggagcgcgcccgguggaccgagaccuacgugcgcuggucccccaaggggacguaccuggccaccuuccaccagcggggcaucgcccucuggggcggggagaaguucaagcagauccagcgcuucagccaccagggcguccagcugaucgacuucuccccgugcgagcgguaccuggugaccuucagcccccucauggacacccaggacgacccccaggccaucaucaucugggacauccugacggggcacaagaagcgcggcuuccacugcgaguccagcgcgcacuggcccaucuucaaguggucccacgacgggaaguucuucgcccggaugacccuggacacccucagcaucuacgagaccccguccaugggccugcuggacaagaagucccucaagaucuccggcaucaaggacuucagcuggucccccgggggcaacaucaucgccuucugggugcccgaggacaaggacauccccgcccgcgucacgcugaugcagcugccgacccgccaggagauccgggugcgcaaccucuucaacgucguggacugcaagcugcacuggcagaagaacggggacuaccugugcgugaaggucgaccggacccccaagggcacccaggggguggugacgaacuucgagaucuuccgcaugcgggagaagcagguccccguggacguggucgagaugaaggagaccaucaucgccuucgcgugggagcccaacggcagcaaguucgccgugcuccacggcgaggccccgcgcaucuccgugagcuucuaccacgucaagaacaacgggaagaucgagcugaucaagauguucgacaagcagcaggccaacaccaucuucuggagcccccagggccaguucguggugcuggcggggcuccggagcaugaacggcgcccuggccuucgucgacaccuccgacugcacggugaugaacaucgccgagcacuacauggccagcgacguggagugggaccccaccggccgcuacgucgugaccagcguguccugguggagccacaaggucgacaacgcguacuggcuguggaccuuccaggggcggcuccugcagaagaacaacaaggaccgcuucugccagcugcucuggcggccccgcccgcccacgcugcugucccaggagcagaucaagcagaucaagaaggaccucaagaaguacagcaagaucuucgagcagaaggaccggcugucccagagcaaggccuccaaggagcugguggagcgccggcgcaccaugauggaggacuuccggaaguaccgcaagauggcccaggagcucuacauggagcagaagaacgagcggcuggagcugcgcggcgggguggacaccgacgagcucgacagcaacgucgacgacugggaggaggagaccaucgaguucuucgugacggaggagaucaucccccugggcaaccaggaguga

SEQ ID NO: 29579 - RNA, 2742 nt, Artificial Sequence
  derived and/or modified sequence opt1 from EIF3C__Homo_sapiens__NP_001254503
augagccgcuucuucaccaccggcuccgacagcgaguccgagagcucccugagcggggaggagcucgugacgaagcccgucggcgggaacuacggcaagcagccgcugcugcucuccgaggacgaggaggacaccaagcggguggugcgcagcgccaaggacaagcgguucgaggagcugaccaaccugauccgcaccauccggaacgccaugaagauccgcgacgucacgaagugccucgaggaguucgagcugcuggggaaggcguacggcaaggccaaguccaucguggacaaggagggcgugccccgguucuacauccgcauccucgccgaccuggaggacuaccugaacgagcucugggaggacaaggaggggaagaagaagaugaacaagaacaacgccaaggcccugagcacccugcggcagaagauccgcaaguacaaccgggacuucgagucccacaucaccagcuacaagcagaaccccgagcaguccgcggacgaggacgccgagaagaacgaggaggacagcgagggcuccagcgacgaggacgaggacgaggacggggucuccgccgccaccuuccucaagaagaaguccgaggcgcccagcggcgagagccgcaaguuccugaagaagauggacgacgaggacgaggacagcgaggacuccgaggacgacgaggacugggacacggggagcaccuccagcgacuccgacagcgaggaggaggagggcaagcagaccgcccuggccucccgguuccucaagaaggccccgaccacggacgaggacaagaaggccgcggagaagaagcgcgaggacaaggccaagaagaagcacgaccgcaagagcaagcggcuggacgaggaggaggaggacaacgagggcggggagugggagcgggugcgcggcggggugccccuggucaaggagaagcccaagauguucgccaagggcaccgagaucacccacgccguggugaucaagaagcucaacgagauccugcaggcccggggcaagaaggggaccgaccgcgcggcccagaucgagcugcuccagcugcugguccagaucgccgccgagaacaaccucggcgagggggugaucgugaagaucaaguucaacaucaucgccucccuguacgacuacaaccccaaccuggcgacguacaugaagccggagauguggggcaagugccucgacugcaucaacgagcugauggacauccuguucgccaaccccaacaucuucgucggggagaacauccucgaggagagcgagaaccugcacaacgccgaccagccccugcgggugcgcggcugcauccucacccugguggagcgcauggacgaggaguucaccaagaucaugcagaacaccgacccccacucccaggaguacgucgagcaccugaaggacgaggcccaggugugcgccaucaucgagcgggugcagcgcuaccucgaggagaagggcacgaccgaggaggucugccggaucuaccugcugcgcauccuccacaccuacuacaaguucgacuacaaggcgcaccagcggcagcugaccccgcccgaggggagcuccaagagcgagcaggaccaggccgagaacgagggcgaggacuccgccgugcugauggagcgccucugcaaguacaucuacgccaaggaccggacggaccgcauccggaccugcgcgauccugugccacaucuaccaccacgcccugcacagccgcugguaccaggcccgggaccucaugcugaugucccaccuccaggacaacauccagcacgccgacccgcccgugcagauccuguacaaccgcaccaugguccagcuggggaucugcgccuuccggcagggccugaccaaggacgcgcacaacgcccugcucgacauccagagcuccgggcgcgccaaggagcugcugggccagggccuccugcugcggagccuccaggagcgcaaccaggagcaggagaagguggagcggcgccggcagguccccuuccaccuccacaucaaccuggagcugcuggagugcguguaccuggugagcgccaugcuccuggagauccccuacauggccgcgcacgaguccgacgcccgccgccggaugaucagcaagcaguuccaccaccagcugcgcgucggggagcggcagccccuccuggggcccccggaguccaugcgcgagcacgugguggccgccagcaaggccaugaagaugggcgacuggaagacgugccacuccuucaucaucaacgagaagaugaacggcaaggucugggaccuguuccccgaggcggacaaggugcggaccaugcucgugcgcaagauccaggaggagagccugcggaccuaccuguucaccuacuccagcgucuacgacuccaucagcauggagacgcucuccgacauguucgagcuggaccugcccaccgugcacagcaucaucuccaagaugaucaucaacgaggagcucauggccagccuggaccagcccacccagaccguggucaugcaccgcacggagccgaccgcccagcagaaccuggcccuccagcuggcggagaagcuggggucccucguggagaacaacgagcggguguucgaccacaagcagggcaccuacggcggguacuuccgcgaccagaaggacggcuaccggaagaacgagggguacaugcgccggggcggcuaccgccagcagcagagccagaccgccuacuga

SEQ ID NO: 29580 - RNA, 1338 nt, Artificial Sequence
  derived and/or modified sequence opt1 from EIF3E__Homo_sapiens__NP_001559
auggccgaguacgaccugaccacccgcaucgcccacuuccucgaccggcaccugguguucccccugcucgaguuccugagcgucaaggagaucuacaacgagaaggagcugcuccagggcaagcuggaccugcucuccgacacgaacaugguggacuucgcgauggacguguacaagaaccuguacagcgacgacaucccgcacgcccugcgcgagaagcggaccaccgucguggcccagcucaagcagcugcaggccgagaccgagcccaucgugaagauguucgaggaccccgagacgacccgccagaugcaguccacccgggacgggcgcaugcuguucgacuaccucgccgacaagcacggcuuccggcaggaguaccuggacacccuguaccgcuacgcgaaguuccaguacgagugcgggaacuacagcggcgccgccgaguaccucuacuucuuccggguccuggugcccgccacggaccgcaacgcgcuguccagccucugggggaagcuggccuccgagauccugaugcagaacugggacgccgccauggaggaccucacccggcugaaggagaccaucgacaacaacagcguguccagcccgcugcagucccuccagcagcgcaccuggcugauccacuggagccuguucgucuucuucaaccaccccaagggccgggacaacaucaucgaccucuuccuguaccagccccaguaccugaacgccauccagacgaugugcccccacauccuccgcuaccugaccaccgcggugaucaccaacaaggacgugcggaagcgccggcagguccugaaggaccucgugaaggugauccagcaggaguccuacacguacaaggacccgaucaccgaguucgucgagugccuguacgugaacuucgacuucgacggcgcccagaagaagcugcgcgagugcgagagcgugcucgucaacgacuucuuccugguggccugccuggaggacuucaucgagaacgcccgccucuucaucuucgagaccuucugccggauccaccagugcaucuccaucaacaugcuggccgacaagcugaacaugacccccgaggaggcggagcgguggaucgugaaccucauccgcaacgcccgccuggacgccaagaucgacagcaagcuggggcacgucgugaugggcaacaacgccgugucccccuaccagcaggucaucgagaagaccaagagccucuccuuccggagccagaugcuggccaugaacaucgagaagaagcugaaccagaacagccgcuccgaggcgcccaacugggccacgcaggacagcggguucuacuga

SEQ ID NO: 29581 - RNA, 1074 nt, Artificial Sequence
  derived and/or modified sequence opt1 from EIF3F__Homo_sapiens__NP_003745
auggccacccccgccgugccggucagcgcgccgcccgccacccccacgccggugcccgccgccgcccccgcguccgugcccgccccgacccccgcccccgccgcggcccccgucccggccgccgcccccgcgagcuccagcgaccccgccgccgccgccgcggccaccgccgcccccggccagaccccggccuccgcgcaggcccccgcccagacgcccgcccccgcccugccggggcccgcgcuccccggccccuuccccgggggccgcguggugcggcugcaccccgucauccuggccagcaucguggacuccuacgagcgccggaacgagggggccgcccgcgugaucggcacccuccugggcaccgucgacaagcacagcguggaggugaccaacugcuucuccgucccccacaacgagagcgaggacgagguggcgguggacauggaguucgccaagaacauguacgagcugcacaagaaggucucccccaacgagcucauccuggggugguacgccacgggccacgacaucaccgagcacagcgugcugauccacgaguacuacucccgggaggccccgaaccccauccaccucaccguggacaccagccugcagaacgggcgcauguccaucaaggccuacgucagcacgcugaugggcgugcccgggcggaccaugggcgugauguucaccccgcucaccgucaaguacgcguacuacgacacggagcgcaucggcguggaccugaucaugaagaccugcuucucccccaaccgggugaucgggcugagcuccgaccuccagcaggucggcggggccagcgcccgcauccaggacgcccugagcaccgugcugcaguacgccgaggacguccucuccggcaaggugagcgcggacaacaccgugggccgguuccugaugucccuggucaaccaggugcccaagaucgugcccgacgacuucgagacgaugcucaacagcaacaucaacgaccugcugauggucaccuaccucgccaaccugacccagucccagaucgcccugaacgagaagcucgugaaccuguga

SEQ ID NO: 29582 - RNA, 1059 nt, Artificial Sequence
  derived and/or modified sequence opt1 from EIF3H__Homo_sapiens__NP_003747
auggccagccgcaaggagggcaccggguccaccgccacgagcuccagcuccaccgcgggcgccgccgggaagggcaaggggaagggcggcagcggggacuccgccgugaagcagguccagaucgacggccugguggugcucaagaucaucaagcacuaccaggaggaggggcagggcaccgaggucgugcagggggugcugcugggccucgucguggaggaccggcuggagaucaccaacugcuuccccuucccccagcacacggaggacgacgccgacuucgacgaggugcaguaccagauggagaugaugcgcagccugcggcacgucaacaucgaccaccuccacgugggcugguaccaguccaccuacuacgggagcuucgugacccgcgcgcugcuggacucccaguucagcuaccagcacgccaucgaggaguccgucgugcucaucuacgaccccaucaagaccgcccagggcagccugucccugaaggccuaccggcucacgcccaagcugauggaggugugcaaggagaaggacuucagccccgaggcgcugaagaaggccaacaucaccuucgaguacauguucgaggagguccccaucgugaucaagaacucccaccucaucaacgugcugaugugggagcuggagaagaaguccgccgucgccgacaagcacgagcuccugagccuggccagcagcaaccaccucgggaagaaccugcagcugcucauggaccgcguggacgagaugucccaggacaucgugaaguacaacaccuacaugcggaacaccagcaagcagcagcagcagaagcaccaguaccagcagcgccggcagcaggagaacaugcagcgccagucccggggcgagccgccccugcccgaggaggaccugagcaagcuguucaagccgccccagccgcccgcgcgcauggacucccuccugaucgccggccagaucaacacguacugccagaacaucaaggaguucaccgcccagaaccucgggaagcuguucauggcccaggcccugcaggaguacaacaacuga

SEQ ID NO: 29583 - RNA, 630 nt, Artificial Sequence
  derived and/or modified sequence opt1 from EIF3J__Homo_sapiens__NP_001271265
auggccgccgcggccgccgccgccggcgacagcgacuccugggacgcggacgccuucagcguggaggacccgguccgcaaggucgggggcgggggcaccgccgggggcgaccggugggagggcgaggacgaggacgaggacgugaagcuggaggagccggaggagcccaaggugcucacccccgaggagcagcuggccgacaagcugcgccucaagaagcugcaggaggaguccgaccuggagcucgcgaaggagacguucggggugaacaacgccguguacggcaucgacgccaugaaccccagcucccgggacgacuucaccgaguucgggaagcugcugaaggacaagaucacccaguacgagaagucccucuacuacgccagcuuccuggagguccuggugcgcgacgugugcaucagccucgagaucgacgaccugaagaagaucaccaacucccugacgguccucugcagcgagaagcagaagcaggagaagcaguccaaggccaagaagaagaagaagggcguggugcccgggggcggccugaaggcgaccaugaaggacgaccuggccgacuacgggggcuacgacgggggcuacguccaggacuacgaggacuucauguga

SEQ ID NO: 29584 - RNA, 657 nt, Artificial Sequence
  derived and/or modified sequence opt1 from EIF3K__Homo_sapiens__NP_037366
auggccauguucgagcagaugcgcgccaacgugggcaagcugcucaaggggaucgaccgguacaaccccgagaaccuggcgacccuggagcgcuacgucgagacccaggccaaggagaacgccuacgaccucgaggccaaccuggccgugcugaagcucuaccaguucaacccggcguucuuccagacgaccgugaccgcccagauccugcugaaggcccucaccaaccugccccacacggacuucacccugugcaagugcaugaucgaccaggcccaccaggaggagcggcccauccgccagauccucuaccugggcgaccugcucgagaccugccacuuccaggcguucuggcaggcccuggacgagaacauggaccugcucgaggggaucaccggcuucgaggacagcguccggaaguucaucugccacgugguggggaucacguaccagcacaucgaccgcuggcugcuggccgagaugcucggcgaccuguccgacagccagcugaaggucuggauguccaaguacggcuggagcgccgacgaguccgggcagaucuucaucugcagccaggaggaguccaucaagcccaagaacaucguggagaagaucgacuucgacagcguguccagcaucauggccuccagccaguga

SEQ ID NO: 29585 - RNA, 1125 nt, Artificial Sequence
  derived and/or modified sequence opt1 from EIF3M__Homo_sapiens__NP_006351
augagcgugcccgccuucaucgacaucuccgaggaggaccaggccgcggagcugcgcgccuaccucaagagcaagggcgccgagaucuccgaggagaacagcgagggcgggcugcacgucgaccuggcccagaucaucgaggccugcgacgugugccucaaggaggacgacaaggacguggaguccgucaugaacagcguggugucccugcugcucauccuggagccggacaagcaggaggcgcugaucgagagccucugcgagaagcuggucaaguuccgggagggggagcgccccucccugcggcuccagcugcugagcaaccucuuccacggcauggacaagaacacccccgugcgcuacaccguguacugcucccugaucaaggucgccgccagcugcggggccauccaguacauccccacggagcuggaccaggugcggaaguggaucuccgacuggaaccucaccaccgagaagaagcacacccugcugcgccuccuguacgaggcgcugguggacugcaagaaguccgacgccgccagcaaggucaugguggagcuccugggcagcuacacggaggacaacgccucccaggcccggguggacgcgcaccgcugcaucguccgggcccugaaggacccgaacgccuuccucuucgaccaccuccugacccugaagcccgugaaguuccuggagggcgagcugauccacgaccuccugaccaucuucgugagcgccaagcuggccuccuacgucaaguucuaccagaacaacaaggacuucaucgacagccucgggcugcugcacgagcagaacauggcgaagaugcgccuccugaccuucaugggcauggccguggagaacaaggagaucagcuucgacacgaugcagcaggagcugcagaucggggccgacgacguggaggccuucgucaucgacgccgugcggaccaagaugguguacugcaagaucgaccagacccagcgcaaggucguggucucccacagcacccaccggacguucggcaagcagcaguggcagcagcucuacgacacccugaacgcguggaagcagaaccugaacaaggugaagaacucccuccugagccuguccgacaccuga

SEQ ID NO: 29586 - RNA, 1044 nt, Artificial Sequence
  derived and/or modified sequence opt1 from EIF4A1__Homo_sapiens__NP_001191439
augagcgccucccaggacagccgcucccgggacaacggccccgacgggauggagccggagggcgugaucgagagcaacuggaacgagaucgucgacuccuucgacgacaugaaccugagcgagucccuccugcgcgggaucuacgccuacggcuucgagaagcccagcgcgauccagcagcgggccauccugcccugcaucaagggguacgacgugaucgcccaggcccaguccggcaccggcaagaccgccacguucgcgaucagcauccuccagcagaucgagcuggaccugaaggccacccaggcccucgugcuggcccccacccgcgagcuggcgcagcagauccagaaggucgugauggcccucggggacuacaugggcgccuccugccacgccugcaucgggggcaccaacgugcgggccgagguccagaagcugcagauggaggcgccgcacaucaucguggggacgcccggccgcguguucgacaugcugaaccggcgcuaccucagccccaaguacaucaagauguucguccuggacgaggccgacgagaugcugucccggggcuucaaggaccagaucuacgacaucuuccagaagcucaacagcaacacccagguggugcugcuguccgccaccaugcccagcgacguccucgaggugaccaagaaguucaugcgcgacccgauccggauccuggugaagaaggaggagcugacgcucgaggggauccgccaguucuacaucaacgucgagcgggaggaguggaagcuggacacccugugcgaccucuacgagacccugaccaucacgcaggccgugaucuucaucaacacccgccggaagguggacuggcugaccgagaagaugcacgcccgcgacuucaccgucuccgcgaugcacggcgacauggaccagaaggagcgggacgugaucaugcgcgaguuccggagcggguccagccgcgugcucaucacgaccgaccugcugggcaagcucuacccccagaaccggagccgcuggaccgucuggcccuga

SEQ ID NO: 29587 - RNA, 1224 nt, Artificial Sequence
  derived and/or modified sequence opt1 from EIF4A2__Homo_sapiens__NP_001958
augagcggcggguccgccgacuacaaccgcgagcacggcgggcccgagggcauggacccggacggggugaucgagagcaacuggaacgagaucgucgacaacuucgacgacaugaaccugaaggagucccuccugcggggcaucuacgccuacggcuucgagaagcccagcgcgauccagcagcgcgccaucauccccugcaucaagggguacgacgugaucgcccaggcccaguccggcaccgggaagaccgccacguucgcgaucagcauccugcagcagcucgagaucgaguucaaggagacccaggcccuggugcuggcccccacccgggagcucgcccagcagauccagaaggucauccuggcgcugggcgacuacaugggggcgaccugccacgccugcaucggcggcacgaacgugcgcaacgagaugcagaagcuccaggccgaggccccgcacaucguggucgggacccccggccggguguucgacaugcugaaccgccgguaccugucccccaaguggaucaagauguucgugcucgacgaggccgacgagaugcugagccgcggguucaaggaccagaucuacgagaucuuccagaagcugaacaccuccauccaggucgugcuccugagcgccaccaugcccacggacgugcuggaggucaccaagaaguucaugcgggacccgauccgcauccucgugaagaaggaggagcugacccuggagggcaucaagcaguucuacaucaacguggagcgggaggaguggaagcucgacacccugugcgaccuguacgagacgcucaccaucacccaggccgucaucuuccugaacacccgccggaagguggacuggcugacggagaagaugcacgcccgcgacuucaccguguccgcccuccacggcgacauggaccagaaggagcgggacgucaucaugcgcgaguuccggagcggguccagccgcgugcugaucaccaccgaccugcucgcgcggggcaucgacgugcagcaggucucccuggugaucaacuacgaccugcccacgaaccgcgagaacuacauccaccggaucgggcgcggcgggcgcuucggccggaagggcguggccaucaacuucgucaccgaggaggacaagcgcauccuccgggacaucgagaccuucuacaacaccacgguggaggagaugcccaugaacgucgccgaccugaucuga

SEQ ID NO: 29588 - RNA, 1236 nt, Artificial Sequence
  derived and/or modified sequence opt1 from EIF4A3__Homo_sapiens__NP_055555
auggccaccaccgccacgauggcgaccagcggcuccgcccgcaagcggcugcucaaggaggaggacaugaccaagguggaguucgagaccagcgaggaggucgacgugacgcccaccuucgacaccauggggcugcgcgaggaccugcuccggggcaucuacgccuacggguucgagaagccguccgccauccagcagcgcgccaucaagcagaucaucaagggccgggacgugaucgcgcagagccaguccgggaccggcaagacggccaccuucagcaucuccguccugcagugccuggacauccaggugcgcgagacccaggcccucauccuggcccccacccgggagcuggcggugcagauccagaagggccuccuggcccugggggacuacaugaacguccagugccacgccugcaucggcgggacgaacgugggcgaggacauccgcaagcucgacuacgggcagcacguggucgccggcacccccggccggguguucgacaugauccgccggcgcagccugcggacccgcgccaucaagaugcuggugcucgacgaggcggacgagaugcugaacaagggguucaaggagcagaucuacgacgucuaccgguaccugcccccggccacccagguggugcucaucuccgccacgcugccccacgagauccuggagaugaccaacaaguucaugaccgaccccauccgcauccucgucaagcgggacgagcugacccuggagggcaucaagcaguucuucguggccguggagcgcgaggaguggaaguucgacacgcucugcgaccuguacgacacccugaccaucacccaggccgucaucuucugcaacacgaagcggaagguggacuggcucaccgagaagaugcgcgaggcgaacuucaccgugagcuccaugcacggggacaugccccagaaggagcgggagagcaucaugaaggaguuccgcuccggcgccagccgcguccugaucuccaccgacgugugggcccggggccuggacgugccgcaggucagccucaucaucaacuacgaccugcccaacaaccgcgagcuguacauccaccggaucgggcgcuccggccgguacgggcgcaagggcguggccaucaacuucgucaagaacgacgacauccggauccuccgcgacaucgagcaguacuacagcacgcagaucgacgagaugcccaugaacguggccgaccugaucuga

SEQ ID NO: 29589 - RNA, 1836 nt, Artificial Sequence
  derived and/or modified sequence opt1 from EIF4B__Homo_sapiens__NP_001408
auggccgccagcgcgaagaagaagaacaagaagggcaagaccaucucccugaccgacuuccucgccgaggacgggggcaccgggggcgggagcacguacguguccaagcccgucagcugggccgacgagaccgacgaccuggagggcgacguguccaccacguggcacagcaacgacgacgacguguaccgcgccccgcccaucgaccgguccauccugcccaccgcgccccgcgccgcccgggagccgaacaucgaccgcagccggcuccccaaguccccgcccuacaccgccuuccugggcaaccugcccuacgacgucaccgaggagagcaucaaggaguucuuccgcgggcucaacaucuccgccgugcggcugccccgcgagcccagcaaccccgagcggcugaagggcuucggguacgcggaguucgaggaccucgacucccugcugagcgcccucucccugaacgaggagagccugggcaaccgccggauccgcguggacgucgccgaccaggcccaggacaaggaccgggacgaccgcuccuucgggcgggaccgcaaccgggacagcgacaagacggacaccgacuggcgcgcccggccggcgaccgacuccuucgacgacuacccgccccgccggggcgacgacagcuucggcgacaaguaccgcgaccgcuacgacagcgaccgguaccgcgacggguaccgggacggcuaccgcgacgggccccggcgcgacauggaccgguacggcggccgcgaccgguacgacgaccgcgggucccgggacuacgaccgcggcuacgacagccggaucggguccggccgccgggccuucgggagcggcuaccgccgggacgacgacuaccgcggcgggggcgaccgguacgaggaccgcuacgaccgccgggacgaccgcuccuggagcucccgggacgacuacagccgcgacgacuaccggcgcgacgaccgggggccgccccagcgccccaagcucaaccugaagccccgguccacccccaaggaggacgacagcuccgccagcacgucccagagcacccgcgccgccuccaucuucggcggggcgaagcccguggacaccgccgcccgggagcgcgagguggaggagcggcugcagaaggagcaggagaagcuccagcgccagcuggacgagcccaagcuggagcggcgcccccgggagcgccacccgagcuggcgguccgaggagacccaggagcgcgagcggagccgcacgggcuccgagagcagccagaccggcaccuccaccacgagcucccgcaacgcccggcgccgggagagcgagaagucccucgagaacgagacccugaacaaggaggaggacugccacagccccaccuccaagccgcccaagcccgaccagccccugaaggucaugcccgccccgccgcccaaggagaacgcgugggugaagcgcagcuccaacccgcccgcccggagccaguccagcgacaccgagcagcagucccccacgagcgggggcgggaagguggcccccgcccagcccuccgaggagggccccgggcgcaaggacgagaacaaggucgacggcaugaacgcccccaagggccagaccgggaacagcucccggggccccggggacggcggcaaccgcgaccacuggaaggagagcgaccggaaggacgggaagaaggaccaggacagccgcuccgcgcccgagccgaagaagcccgaggagaaccccgccagcaaguucuccagcgccuccaaguacgccgcgcucagcguggacggcgaggacgagaacgagggggaggacuacgccgaguga

SEQ ID NO: 29590 - RNA, 705 nt, Artificial Sequence
  derived and/or modified sequence opt1 from EIF4E2__Homo_sapiens__NP_001263265
augaacaacaaguucgacgcccugaaggacgacgacagcggcgaccacgaccagaacgaggagaacuccacccagaaggacggggagaaggagaagaccgagcgcgacaagaaccagagcuccagcaagcggaaggccgugguccccggccccgcggagcacccccuccaguacaacuacacguucugguacucccgccggacccccgggcgccccaccagcucccagagcuacgagcagaacaucaagcagaucggcaccuucgccuccguggagcaguucuggcgguucuacagccacauggugcgcccgggggaccugacgggccacuccgacuuccaccuguucaaggagggcaucaagcccaugugggaggacgacgccaacaagaacgggggcaaguggaucauccggcuccgcaaggggcuggccagccggugcugggagaaccugauccucgccaugcugggcgagcaguucauggucggggaggagaucugcggcgcggugguguccguccgcuuccaggaggacaucaucagcaucuggaacaagaccgccuccgaccaggccaccaccgcccggauccgcgacacgcugcggcgcgugcucaaccugccgcccaacaccaucauggaguacaagacccacaccgacagcaucaaggacaacuccagcuuccggaacacgaagaucacccuguga

SEQ ID NO: 29591 - RNA, 357 nt, Artificial Sequence
  derived and/or modified sequence opt1 from EIF4E3__Homo_sapiens__NP_001128121
augcgcggcgagcggcgcccccugugggaggaggagagcaacgccaagggcgggguguggaagaugaaggucccgaaggacuccaccagcaccguguggaaggagcuccugcuggccacgaucggggagcaguucaccgacugcgcggccgccgacgacgaggugaucggcgucuccgugagcgugcgggaccgcgaggacgucguccagguguggaacgugaacgccucccucgugggggaggccaccgugcuggagaagaucuacgagcugcucccccacaucaccuucaaggcggucuucuacaagccccacgaggagcaccacgccuucgagggcggccgggggaagcacuga

SEQ ID NO: 29592 - RNA, 357 nt, Artificial Sequence
  derived and/or modified sequence opt1 from EIF4EBP1__Homo_sapiens__NP_004086
augagcggcggguccagcugcucccagacccccagccgcgccaucccggccacccggcgcgugguccugggcgacggggugcagcugccgcccggcgacuacuccacgacccccgggggcacccuguucagcaccacgcccggcgggacccggaucaucuacgaccgcaaguuccugauggagugccggaacucccccgugaccaagaccccgccccgcgaccuccccacgauccccggcgucaccagccccuccagcgacgagcccccgauggaggcgucccagagccaccuccggaacucccccgaggacaagcgcgccgggggcgaggagagccaguucgagauggacaucuga

SEQ ID NO: 29593 - RNA, 363 nt, Artificial Sequence
  derived and/or modified sequence opt1 from EIF4EBP2__Homo_sapiens__NP_004087
augagcuccagcgccggcuccgggcaccagcccagccagucccgcgccaucccgacccggaccguggcgaucagcgacgccgcccagcugccccacgacuacugcacgacccccggcgggacccucuucuccaccacgcccggcgggacccgcaucaucuacgaccggaaguuccugcuggaccgccggaacagcccgauggcccagaccccgcccugccaccuccccaacauccccggcgucaccucccccggcacgcugaucgaggacagcaagguggaggugaacaaccugaacaaccucaacaaccacgaccgcaagcacgccgucggggacgacgcgcaguucgagauggacaucuga

SEQ ID NO: 29594 - RNA, 303 nt, Artificial Sequence
  derived and/or modified sequence opt1 from EIF4EBP3__Homo_sapiens__NP_003723
augagcaccuccaccagcugccccaucccgggcgggcgcgaccagcugcccgacugcuacuccacgacccccggcgggacccucuacgccaccacgcccggcgggacccggaucaucuacgaccgcaaguuccugcuggagugcaagaacagcccgaucgcccggaccccgcccugcugccucccccagauccccggcgugaccacgccgcccaccgcgccccuguccaagcuggaggagcucaaggagcaggagaccgaggaggagauccccgacgacgcccaguucgagauggacaucuga

SEQ ID NO: 29595 - RNA, 714 nt, Artificial Sequence
  derived and/or modified sequence opt1 from EIF4E__Homo_sapiens__NP_001124150
augcucgaccucaccagccgcggccagguggggaccucccggcgcauggccgaggccgcgugcagcgcccacuuccuggagacgacccccaccccgaacccgcccaccacggaggaggagaagaccgaguccaaccaggaggucgccaaccccgagcacuacaucaagcacccccugcagaaccggugggcccucugguucuucaagaacgacaagagcaagaccuggcaggccaaccugcgccugaucuccaaguucgacaccguggaggacuucugggcgcucuacaaccacauccagcugagcuccaaccugaugcccggcugcgacuacagccucuucaaggacgggaucgagcccaugugggaggacgagaagaacaagcggggcgggcgcuggcugaucacgcugaacaagcagcagcggcgcuccgaccucgaccgguucuggcuggagacccugcucugccugaucggcgagagcuucgacgacuacuccgacgacgugugcggcgccgucgugaacgugcgcgccaagggggacaagaucgccaucuggaccaccgagugcgagaaccgggaggcggucacgcacaucggccgcguguacaaggagcggcuggggcugcccccgaagaucgugaucggcuaccagagccacgccgacaccgccaccaaguccgggagcaccacgaagaaccgcuucgucguguga

SEQ ID NO: 29596 - RNA, 2436 nt, Artificial Sequence
  derived and/or modified sequence opt1 from EIF4ENIF1__Homo_sapiens__NP_001157974
auggaccgccggagcaugggcgagaccgaguccggggacgccuuccuggaccucaagaagcccccggccagcaagugcccccaccgcuacaccaaggaggagcugcuggacaucaaggagcucccccacuccaagcagcggcccagcugccuguccgagaaguacgacagcgacggcgugugggacccggagaaguggcacgcgucccuguaccccgccagcgggcgcuccagccccgucgagucccucaagaaggagcuggacaccgaccggcccagccuggugcgccggaucgugggcaucgucgagugcaacgggggcguggccgaggaggacgagguggaggucauccucgcccaggagccggccgcggaccaggaggugccccgcgacgccgugcugcccgagcagucccccggcgacuucgacuucaacgaguucuucaaccuggacaaggucccgugccucgccagcaugaucgaggacgugcugggggagggcuccgugagcgccucccgguucagccgcugguucuccaaccccagccggagcgggucccgcagcuccagccugggcuccacgccccacgaggagcucgagcggcuggcggggcuggagcaggccauccucagccccggccagaacuccggcaacuacuucgccccgaucccccuggaggaccacgccgagaacaaggucgacauccuggagaugcuccagaaggccaagguggaccugaagccccugcucagcucccugagcgcgaacaaggagaagcugaaggaguccagccacuccggggugguccucagcguggaggagguggaggccggccugaaggggcugaaggucgaccagcaggucaagaacuccacccccuucauggccgagcaccucgaggagacccugagcgccgugaccaacaaccgccagcugaagaaggacggcgacaugaccgccuucaacaagcucguguccaccaugaagcggaaccuggagagccaccugauguccccggcggagauccccggccagcccgugcccaagaacauccuccaggagcugcuggggcagccggugcagcgccccgccagcagcaaccuccuguccggccugauggggagccucgagcccaccacgucccugcugggccagcgggcccccagcccgccccucucccaggucuuccagacccgcgccgccagcgcggacuaccugcggccccgcaucccgucccccaucggguucacccccggcccccagcagcugcucggcgacccguuccaggggaugcggaagcccaugagccccaucaccgcccagcagaugucccagcuggagcugcagcaggccgcccuggagggccucgcccugccccacgaccuggcggugcaggccgccaacuucuaccagccgggguucggcaagccccaggucgaccgcacgcgcgacggguuccggaaccgccagcagcgggugaccaagagccccgcccccgugcaccgcggcaacuccagcuccccggcgcccgccgccagcaucaccuccaugcucagccccuccuucacccccacgagcgucauccggaagauguacgagagcaaggagaaguccaaggaggagccggccagcggcaaggccgcgcugggggacuccaaggaggacacccagaaggccagcgaggagaaccugcucuccagcuccagcgugcccuccgccgaccgcgacagcucccccaccaccaacagcaagcuguccgcccugcagcggagcuccugcagcacgccccucucccaggccaaccgcuacaccaaggagcaggacuaccggccgaaggcgaccggccgcaagacccccacgcuggccagccccgugcccaccaccccguuccugcggcccguccaccaggugccccucgugccgcacguccccauggugcgccccgcccaccagcugcaccccgggcuggugcagcggaugcucgcccagggcguccacccgcagcaccuccccucccugcugcagaccggggugcugccgcccggcauggaccugagccaccuccagggcaucagcgggcccauccugggccagcccuucuacccccugcccgccgcgucccacccgcuccugaacccccgccccgggacgccccugcaccucgccauggugcagcagcagcugcagcggagcguccugcacccgcccggcuccggcagccacgccgccgcgguguccgugcagaccacgccccagaacguccccagccgcuccgggcucccgcacaugcacagccagcuggagcaccggcccucccagcgcagcuccagccccgugggccuggccaagugguucggguccgacgugcuccagcagccccugccgagcaugcccgccaaggucaucuccguggacgagcuggaguaccggcaguga

SEQ ID NO: 29597 - RNA, 4821 nt, Artificial Sequence
  derived and/or modified sequence opt1 from EIF4G1__Homo_sapiens__NP_001181876
augaacaaggccccccagagcaccggcccgccccccgcccccuccccggggcugccccagcccgcguuccccccgggccagaccgcccccguggucuucagcacgccccaggccacccagaugaacacccccucccagccgcgccaggggggcuuccggagccuccagcacuucuaccccucccgcgcccagccccccagcuccgccgcgagccgggugcaguccgccgccccggcccgccccgggcccgcggcccacguguaccccgccggcagccaggucaugaugaucccgucccagaucagcuaccccgccucccagggcgccuacuacauccccgggcagggccggagcaccuacguggugcccacgcagcaguacccgguccagcccggggcgcccggcuucuaccccggggccuccccgaccgaguucggcaccuacgccggcgccuacuaccccgcccagggggugcagcaguuccccaccggcguggcgccggcccccguccugaugaaccagcccccccagaucgccccgaagcgcgagcggaagacgauccgcauccgggaccccaaccaggggggcaaggacaucaccgaggagaucaugagcggcgcccgcaccgccuccacccccacgcccccgcagaccgggggcgggcuggagccccaggcgaacggcgagaccccccagguggccgugaucguccggcccgacgaccgcagccagggggccaucaucgccgaccggccgggccuccccggccccgagcacucccccagcgagagccagccguccagccccucccccacccccagcccgucccccgugcuggagcccgggagcgagcccaaccuggccgugcucuccaucccgggcgacacgaugaccaccauccagaugagcgucgaggaguccacccccaucagccgcgagacgggggagcccuaccggcuguccccggagcccaccccccuggcggagcccauccucgagguggaggugacccugagcaagccgguccccgaguccgaguucagcuccagcccccugcaggcccccaccccgcucgccucccacacgguggagauccacgagcccaacggcauggugcccagcgaggaccuggagcccgaggucgaguccagcccggagcuggcccccccccccgcgugcccgagcgagucccccgugcccaucgcccccaccgcccagccggaggagcuccugaacggggcccccagcccccccgccguggaccuguccccggucagcgagcccgaggagcaggcgaaggaggugaccgccuccauggccccccccaccaucccgagcgccacgcccgccaccgcgcccuccgccaccagcccggcccaggaggaggagauggaggaggaggaggaggaggaggagggcgaggccggcgaggccggggaggcggaguccgagaagggcggggaggagcuccugccccccgagagcacccccaucccggccaaccugucccagaaccucgaggccgccgcggccacgcaggucgccgugagcgugcccaagcgccggcgcaagaucaaggagcugaacaagaaggaggccgucggcgaccugcucgacgccuucaaggaggcgaaccccgccgugcccgagguggagaaccagccgcccgccggguccaaccccggccccgagagcgagggcuccggggucccgccccggcccgaggaggccgacgagaccugggacagcaaggaggacaagauccacaacgccgagaacauccagcccggcgagcagaaguacgaguacaaguccgaccaguggaagccgcugaaccuggaggagaagaagcgcuacgaccgggaguuccuccugggguuccaguucaucuucgcgagcaugcagaagcccgagggccugccccacaucagcgacguggugcucgacaaggccaacaagaccccccugcgcccgcuggaccccacccgccuccagggcaucaacugcgggcccgacuucacgcccuccuucgccaaccugggccggaccacccugagcacccgcgggccgccccggggcgggcccggcggcgagcucccccgcgggccggccggccuggggccccggcgcucccagcagggcccccggaaggagccgcgcaagaucaucgccaccguccugaugacggaggacaucaagcucaacaaggcggagaaggccuggaagcccagcuccaagcggaccgccgccgacaaggaccgcggggaggaggacgcggacggcagcaagacccaggaccuguuccggcgcgugcgguccauccugaacaagcucaccccccagauguuccagcagcugaugaagcaggugacgcagcuggccaucgacaccgaggagcgccucaagggcgucaucgaccugaucuucgagaaggccaucagcgagcccaacuucuccguggccuacgccaacaugugccggugccugauggcgcucaaggugccgaccaccgagaagcccacggucaccgugaacuuccgcaagcugcugcugaaccggugccagaaggaguucgagaaggacaaggacgacgacgagguguucgagaagaagcagaaggagauggacgaggccgccaccgccgaggagcgcgggcggcucaaggaggagcuggaggaggcccgcgacaucgcgcgccggcgcagccugggcaacaucaaguucaucggggagcucuucaagcugaagaugcugaccgaggccaucaugcacgacugcgucgugaagcuccugaagaaccacgacgaggagucccuggagugccucugccggcugcugacgaccaucggcaaggaccucgacuucgagaaggccaagccccgcauggaccaguacuucaaccagauggagaagaucaucaaggagaagaagaccagcucccggauccgcuucaugcugcaggacgugcuggaccuccgggggagcaacugggucccccgccggggcgaccagggcccgaagaccaucgaccagauccacaaggaggccgagauggaggagcaccgcgagcacaucaaggugcagcagcugauggccaagggguccgacaagcggcgcggcgggccccccggccccccgaucagccgggggcugccccucguggacgacggcggcuggaacacgguccccaucuccaaggggagccgccccaucgacaccucccggcugaccaagaucaccaagccgggcagcaucgacagcaacaaccagcuguucgcgcccgggggccgccucuccuggggcaaggggagcuccggcgggagcggcgccaagcccuccgacgccgccagcgaggccgcgcggcccgccacguccacccugaaccgcuucagcgcccugcagcaggccgugccgaccgaguccaccgacaaccggcgcgugguccagcggagcucccucagccgcgagcgcggggagaaggcgggcgaccggggcgaccgccuggagcgguccgagcgcgggggcgaccggggggaccgccuggaccgggcccgcacgcccgccaccaagcggagcuucuccaaggagguggaggagcgcagccgggagcgccccucccagcccgagggccuccggaaggccgccagccugaccgaggaccgcgaccgggggcgcgacgcggugaagcgggaggccgcccugccgcccgucuccccccucaaggccgcccugagcgaggaggagcuggagaagaagagcaaggcgaucaucgaggaguaccuccaccugaacgacaugaaggaggccgugcagugcgugcaggagcuggccuccccgagccuccuguucaucuucguccgccacggcguggaguccacccuggagcggagcgccaucgcccgcgagcacaugggccagcuccugcaccagcugcucugcgcggggcaccuguccacggcccaguacuaccagggccuguacgagauccucgagcuggccgaggacauggagaucgacaucccccacguguggcuguaccucgccgagcuggucacccccauccugcaggaggggggcgugcccaugggggagcucuuccgcgagaucaccaagccgcugcggccccugggcaaggcggccagccuccugcuggagauccucggccugcugugcaaguccauggggcccaagaaggugggcacccucuggcgcgaggccgggcugagcuggaaggaguuccugcccgagggccaggacaucggcgccuucgucgccgagcagaagguggaguacacgcucggggaggaguccgaggcgccgggccagcgggcccugcccagcgaggagcugaaccgccagcucgagaagcugcugaaggagggguccagcaaccagcggguguucgacuggaucgaggccaaccucuccgagcagcagaucgucagcaacacccuggugcgcgcccugaugaccgccgugugcuacuccgcgaucaucuucgagaccccccuccgggucgacguggccgugcugaaggcccgcgccaagcugcuccagaaguaccugugcgacgagcagaaggagcugcaggcccucuacgcgcugcaggcccuggucgugacgcucgagcagcccccgaaccugcugcggauguucuucgacgcccucuacgacgaggacguggucaaggaggacgccuucuacagcugggaguccagcaaggaccccgcggagcagcagggcaaggggguggcccugaaguccgucaccgccuucuucaaguggcugcgcgaggccgaggaggagagcgaccacaacuga

SEQ ID NO: 29598 - RNA, 2610 nt, Artificial Sequence
  derived and/or modified sequence opt1 from EIF4G2__Homo_sapiens__NP_001036024
auggagagcgccaucgccgagggcggggcgucccgcuucagcgccuccagcggcgggggcgggucccggggcgcgccccagcacuacccgaagaccgccggcaacagcgaguuccuggggaagacccccggccagaacgcccagaaguggauccccgcccgcuccacgcggcgcgacgacaacagcgccgccaacaacuccgccaacgagaaggagcggcacgacgcgaucuuccgcaaggugcgggggauccucaacaagcugacccccgagaaguucgacaagcugugccucgagcugcugaacgucggcguggagagcaagcucauccugaagggggugauccugcucaucgucgacaaggcccuggaggagccgaaguacuccagccuguacgcccagcucugccugcgccuggccgaggacgcccccaacuucgacggccccgcggccgagggccagcccgggcagaagcaguccaccaccuuccggcgccuccugaucagcaagcugcaggacgaguucgagaaccggacgcgcaacguggacguguacgacaagcgggagaacccgcuccugcccgaggaggaggagcagcgcgccaucgccaagaucaagaugcugggcaacaucaaguucaucggggagcucggcaagcuggaccugauccacgaguccauccuccacaagugcaucaagacccugcuggagaagaagaagcggguccagcucaaggacaugggcgaggaccuggagugccugugccagaucaugcgcaccguggggccccggcucgaccacgagcgcgccaagagccugauggaccaguacuucgcgcggaugugcucccugaugcucagcaaggagcugcccgcccgcauccgguuccugcuccaggacaccguggagcugcgcgagcaccacugggucccgcgcaaggccuuccuggacaacggccccaagacgaucaaccagauccggcaggacgccgugaaggaccucgggguguucauccccgcccccauggcgcagggcaugcgcuccgacuucuuccuggaggggccguucaugccgccccggaugaagauggaccgcgacccccugggcggccucgccgacauguucgggcagaugcccggcagcgggaucggcaccgggcccggcgucauccaggaccgguucagccccaccaugggccgccaccgguccaaccagcuguucaacgggcacggcgggcacaucaugcccccgacccagagccaguucggcgagaugggcgggaaguucaugaagucccagaucagccugcgccccgcccaguccuuccucaugaacaagaaccaggugcccaagcugcagccccagaucacgaugaucccgcccagcgcccagcccccgcggacccagaccccgccccugggccagacgccccagcucgggcugaagaccaacccgccccugauccaggagaagcccgccaagaccuccaagaagcccccgcccagcaaggaggagcugcucaagcugaccgagaccguggucacggaguaccugaacuccggcaacgcgaacgaggccgugaacggggugcgcgagaugcgggcccccaagcacuuccuccccgagaugcugagcaaggucaucauccugucccucgaccgcagcgacgaggacaaggagaaggccuccagccugaucucccugcucaagcaggagggcaucgcgaccagcgacaacuucaugcaggccuuccugaacgugcuggaccagugccccaagcucgagguggacaucccccuggucaaguccuaccuggcccaguucgccgcccgggcgaucaucagcgagcucguguccaucagcgagcuggcccagccccuggagagcggcacccacuucccccucuuccugcugugccuccagcagcuggccaagcugcaggaccgcgaguggcucaccgagcuguuccagcaguccaaggugaacaugcagaagaugcugccggagaucgaccagaacaaggaccggaugcucgagauccuggaggggaagggccugagcuuccucuucccccugcugaagcucgagaaggagcugcugaagcagaucaagcucgaccccagcccccagacgaucuacaaguggaucaaggacaacaucuccccgaagcugcacgucgacaagggguucgugaacauccugaugaccuccuuccuccaguacaucagcuccgaggucaacccgcccagcgacgagaccgacuccagcuccgcccccagcaaggagcagcuggagcaggagaagcagcugcuccuguccuucaagcccgugaugcagaaguuccugcacgaccacguggaccuccaggucagcgcccuguacgcgcuccaggugcacugcuacaacuccaacuuccccaagggcaugcugcugcgcuucuucgugcacuucuacgacauggagaucaucgaggaggaggccuuccuggccuggaaggaggacaucacccaggaguuccccgggaagggcaaggcccucuuccaggucaaccaguggcugacguggcuggagaccgccgaggaggaggagagcgaggaggaggcggacuga

SEQ ID NO: 29599 - RNA, 747 nt, Artificial Sequence
  derived and/or modified sequence opt1 from EIF4H__Homo_sapiens__NP_071496
auggccgacuucgacaccuacgacgaccgcgccuacagcuccuucggcgggggccgggggagccgcggcuccgccgggggccacggcagccggucccagaaggagcugcccaccgagccgcccuacaccgcguacguggggaaccuccccuucaacaccguccagggcgacaucgacgccaucuucaaggaccugagcauccgcuccgugcggcuggugcgcgacaaggacaccgacaaguucaagggguucugcuacgucgaguucgacgagguggacagccucaaggaggcccugaccuacgacggcgcccugcucggggaccggucccugcgcguggacaucgcggagggccggaagcaggacaagggcggguucggcuuccgcaagggcgggcccgacgaccggggcauggggagcucccgcgagagccggggcgggugggacucccgcgacgacuucaacagcggcuuccgggacgacuuccucgggggccgcggcgggucccggccgggcgaccgccggacggggccgcccaugggcagccgcuuccgggacgggccgccccugcgcggcuccaacauggacuuccgcgagcccaccgaggaggagcgggcccagcgcccccggcugcagcugaagccccgcaccgucgccacgccccucaaccagguggccaaccccaacagcgcgaucuucggcggggcccggccccgcgaggaggugguccagaaggagcaggaguga

SEQ ID NO: 29600 - RNA, 462 nt, Artificial Sequence
  derived and/or modified sequence opt1 from EIF5A2__Homo_sapiens__NP_065123
auggccgacgagaucgacuucaccaccggcgacgccggggcgagcuccacguaccccaugcagugcagcgcccugcgcaagaacggcuucgugguccucaaggggcggccgugcaagaucguggagauguccaccagcaagaccggcaagcacgggcacgccaaggugcaccuggucggcaucgacaucuucaccggcaagaaguacgaggacaucugccccuccacgcacaacauggacgugcccaacaucaagcgcaacgacuaccagcugaucugcauccaggacggguaccucagccugcugaccgagaccggcgaggugcgggaggaccucaagcugcccgagggggagcugggcaaggagaucgaggggaaguacaacgccggcgaggacguccagguguccgugaugugcgccaugagcgaggaguacgcggucgccaucaagccgugcaaguga

SEQ ID NO: 29601 - RNA, 555 nt, Artificial Sequence
  derived and/or modified sequence opt1 from EIF5A__Homo_sapiens__NP_001137232
augugcggcaccgggggcaccgacagcaagacgcgccggcccccgcaccgcgccuccuuccugaagcggcucgagagcaagccccugaagauggccgacgaccuggacuucgagaccggggacgcgggcgccuccgccaccuuccccaugcagugcagcgcccuccgcaagaacggguucgugguccugaagggccggcccugcaagaucguggagauguccaccagcaagacgggcaagcacgggcacgccaaggugcaccuggucggcaucgacaucuucaccgggaagaaguacgaggacaucugcccguccacccacaacauggacgugcccaacaucaagcgcaacgacuuccagcucaucggcauccaggacggguaccugagccugcuccaggacuccggcgaggugcgggaggaccugcgccugcccgagggcgaccucgggaaggagaucgagcagaaguacgacugcggcgaggagauccugaucaccguccugagcgcgaugacggaggaggccgccguggccaucaaggcgauggccaaguga

SEQ ID NO: 29602 - RNA, 1296 nt, Artificial Sequence
  derived and/or modified sequence opt1 from EIF5__Homo_sapiens__NP_892116
augagcgugaacgucaaccgcuccgugagcgaccaguucuaccgguacaagaugccccgccugaucgccaagguggagggcaaggggaacggcaucaagaccgucaucgugaacaugguggacgucgccaaggcgcucaaccggccgcccaccuaccccacgaaguacuucgggugcgagcugggcgcccagacccaguucgacgugaagaacgaccgcuacaucgugaacgggucccacgaggccaacaagcugcaggacaugcucgacggcuucaucaagaaguucguccugugccccgagugcgagaacccggagaccgaccugcacgugaaccccaagaagcagaccaucggcaacagcugcaaggccugcggguaccggggcaugcucgacacgcaccacaagcugugcaccuucauccugaagaacccccccgagaacuccgacagcgggaccggcaagaaggagaaggagaagaagaaccgcaaggggaaggacaaggagaacggcuccgugagcuccagcgagaccccgcccccccccccgccccccaacgagaucaaccccccgccccacacgauggaggaggaggaggacgacgacuggggcgaggacaccaccgaggaggcccagcggcgccggauggacgagaucuccgaccacgcgaagguccucacccugagcgacgaccuggagcgcacgaucgaggagcgggugaacauccucuucgacuucgugaagaagaagaaggaggagggggucaucgacuccagcgacaaggagaucguggccgaggccgagcgccuggacgugaaggccaugggcccccugguccucaccgaggugcuguucaacgagaagauccgggagcagaucaagaaguaccgccggcacuuccugcgcuucugccacaacaacaagaaggcgcagcgguaccuccugcacgggcuggagugcguggucgccaugcaccaggcccagcucaucuccaagaucccccacauccugaaggagauguacgacgccgaccugcucgaggaggaggugaucaucagcugguccgagaaggccagcaagaaguacguguccaaggagcuggcgaaggagauccgcgucaaggccgagccguucaucaaguggcugaaggaggccgaggaggagagcagcggcggcgaggaggaggacgaggacgagaacaucgagguggucuacuccaaggccgccagcgugcccaagguggagaccgucaaguccgacaacaaggacgacgacaucgacaucgacgcgaucuga

SEQ ID NO: 29603 - RNA, 738 nt, Artificial Sequence
  derived and/or modified sequence opt1 from EIF6__Homo_sapiens__NP_001254739
auggccgugcgcgccagcuucgagaacaacugcgagaucggcugcuucgcgaagcugaccaacaccuacugccucgucgccaucgggggcuccgagaacuucuacagcguguucgagggggagcuguccgacacgauccccgugguccacgccagcaucgccggcugccggaucaucgggcgcaugugcgugggcaaccggcacggccugcucgugccgaacaacaccaccgaccaggagcugcagcacauccgcaacucccugcccgacaccguccagauccggcgcguggaggagcggcucagcgcccuggggaacgugacgaccugcaacgacuacgucgcgcuggugcaccccgaccucgaccgcgagaccgaggagauccuggccgacgugcugaaggucgagguguuccggcagaccguggccgaccagguccucgugggcuccuacugcguguucagcaaccagggcgggcugguccaccccaagacguccaucgaggaccaggacgagcugagcucccuccuccaggugccgcugguggccgggaccgucaaccgcggcagcgaggugaucgcggccggcaugguggucaacgacuggugcgccuucugcgggcuggacaccaccuccacggagcugagcguggucgaguccguguucaagcugaacgaggcccagcccagcaccaucgccaccuccaugcgggacagccucaucgacucccugaccuga

SEQ ID NO: 29604 - RNA, 1092 nt, Artificial Sequence
  derived and/or modified sequence opt1 from ELAC1__Homo_sapiens__NP_061166
augagcauggacgugaccuuccugggcaccggggccgccuaccccuccccgacgcgcggcgcgagcgccgucgugcuccggugcgagggggagugcuggcuguucgacugcggcgaggggacccagacccagcugaugaagucccagcucaaggccggccgcaucaccaagaucuucaucacgcaccuccacggcgaccacuucuucgggcugcccggccuccugugcaccaucagccugcaguccgggagcaugguguccaagcagcccaucgagaucuacggccccgucgggcuccgggacuucaucuggcgcaccauggagcugagccacaccgagcugguguuccacuacgugguccacgagcucgugccgacggccgaccagugccccgccgaggagcugaaggaguucgcgcacgugaaccgggccgacuccccgcccaaggaggagcagggccgcaccauccugcucgacagcgaggagaacuccuaccugcuguucgacgacgagcaguucgucgugaaggccuuccggcuguuccaccgcauccccagcuucggcuucuccguggucgagaagaagcggcccgggaagcugaacgcccagaagcugaaggaccucggcgugccgcccgggcccgcguacggcaagcugaagaacggcaucagcgugguccuggagaacggggugaccaucagcccccaggacgugcucaagaagcccaucgucggccgcaagaucugcauccugggggacugcuccggcguggugggggacggcggcgucaagcugugcuucgaggccgaccuccugauccacgaggccacccuggacgacgcccagauggacaaggccaaggagcacgggcacuccacgccccagauggcggccaccuucgccaagcucugccgggccaagcgccuggugcugacccacuucagccagcgguacaagccgguggcccucgcgcgcgagggcgagaccgacgggaucgccgagcugaagaagcaggccgaguccguccuggaccuccaggaggugacgcuggccgaggacuucauggucaucagcauccccaucaagaaguga

SEQ ID NO: 29605 - RNA, 2361 nt, Artificial Sequence
  derived and/or modified sequence opt1 from ELAC2__Homo_sapiens__NP_001159434
augugggcccugugcagccuccugcgcuccgccgcgggccggaccaugagccaggggcgcaccaucucccaggcccccgcccggcgcgagcggccgcgcaaggacccccugcggcaccuccgcacgcgggagaagcgcggccccagcgggugcuccggcgggcccaacaccguguaccugcaggucguggccgccggcagccgggacuccggcgcggcccuguacguguucagcgaguucaaccgcuaccucuucaacugcggggagggcguccagcggcugaugcaggagcacaagcugaagguggcccgccucgacaacaucuuccugacccggaugcacugguccaacgucgggggccugagcgggaugauccucacccugaaggagacgggccugccgaagugcgugcucuccggcccgccccagcuggagaaguaccuggaggccaucaagaucuucagcgggccccucaagggcaucgagcuggcggugcgcccccacuccgcccccgaguacgaggacgagaccaugaccguguaccagauccccauccacagcgucucccagcggcgcggggugcgggacagcucccugguggucgccuucaucugcaagcuccaccugaagcgcggcaacuuccuggugcucaaggccaaggagaugggccugcccguggggaccgccgcgaucgccccgaucaucgccgccgucaaggacggcaagagcaucacgcacgaggggcgggagauccuggccgaggagcucugcaccccgcccgaccccggcgcggccuucgugguggucgagugccccgacgaguccuucauccagcccaucugcgagaacgccaccuuccagcgcuaccaggggaaggccgacgcccccguggcgcuggugguccacauggcccccgccagcgugcugguggacagccgcuaccagcaguggauggagcgguucggcccggacacccagcaccucguccugaacgagaacugcgccuccgugcacaaccugcgcagccacaagauccagacgcagcucaaccugauccaccccgacaucuucccccugcucaccuccuuccggugcaagaaggagggccccacccugagcgucccgauggugcagggggagugccugcucaaguaccagcugcgcccccggcgcgaguggcagcgggacgccaucaucacgugcaaccccgaggaguucaucguggaggcgcugcagcuccccaacuuccagcaguccguccaggaguaccgccggagcgcccaggacggcccggcccccgccgagaagcgcucccaguaccccgagaucaucuuccuggggaccggcagcgcgaucccgaugaagauccggaacguguccgccacccuggugaacaucagccccgacaccucccuccugcuggacugcggggagggcaccuucggccagcucugccgccacuacggggaccaggucgaccgggugcugggcacgcuggccgccguguucgucagccaccuccacgccgaccaccacaccgggcugcccuccauccugcugcagcgcgagcgggcgcucgccagccugggcaagccccugcacccgcuccuggugguggcccccaaccagcugaaggccuggcuccagcaguaccacaaccagugccaggagguccugcaccacaucuccaugauccccgccaagugccugcaggagggggcggagaucagcucccccgccguggagcgccucaucagcucccugcugcggaccugcgaccucgaggaguuccagaccugccuggugcgccacugcaagcacgccuucggcugcgcccugguccacacgagcggcuggaaggugguguacagcggggacaccaugccgugcgaggcccucguccggaugggcaaggacgcgacccugcugauccacgaggccacccucgaggacgggcuggaggaggaggccguggagaagacgcacuccaccaccagccaggccaucuccgugggcaugcgcaugaacgcggaguucaucaugcugaaccacuucagccagcgcuacgccaaggucccccucuucucccccaacuucagcgagaaggugggcguggccuucgaccacaugaaggucugcuucggggacuuccccaccaugccgaagcugaucccgccccugaaggcccucuucgccggcgacaucgaggagauggaggagcggcgcgagaagcgggagcugcgccaggugcgggcggcccugcucucccgcgagcuggccgggggccuggaggacggggagccccagcagaagcgggcccacacggaggagccccaggccaagaaggugcgcgcgcaguga

SEQ ID NO: 29606 - RNA, 804 nt, Artificial Sequence
  derived and/or modified sequence opt1 from ELANE__Homo_sapiens__NP_001963
augacccugggccgccggcucgccugccuguuccuggccugcgugcuccccgcgcugcugcucgggggcaccgcccuggccagcgagaucgucgggggccgccgggcccgcccgcacgccuggcccuucauggugucccugcagcuccgcgggggccacuucugcggcgcgacgcugaucgcccccaacuucgugaugagcgccgcccacugcgucgcgaacgugaacgugcgggccguccggguggugcugggggcccacaaccucucccgccgggagcccacccgccaggucuucgccgugcagcggaucuucgagaacggcuacgacccggugaaccugcugaacgacaucgucauccuccagcugaacgggagcgccaccaucaacgcgaacguccagguggcccagcugcccgcccagggccgccggcucgggaacggcgugcagugccuggccaugggcugggggcugcucggccgcaaccgggggaucgccuccgugcugcaggagcugaacgugaccgucgugacgagccucugccgccgguccaacgugugcacccugguccgcggccggcaggcgggcgugugcuucggggacagcggcagcccccuggugugcaacgggcucauccacggcaucgccuccuucguccgcgggggcugcgccuccggccuguaccccgacgccuucgccccgguggcgcaguucgucaacuggaucgacagcaucauccagcgguccgaggacaaccccugcccccacccccgcgacccggaccccgccagccgcacccacuga

SEQ ID NO: 29607 - RNA, 981 nt, Artificial Sequence
  derived and/or modified sequence opt1 from ELAVL1__Homo_sapiens__NP_001410
augagcaacggcuacgaggaccacauggccgaggacugccgcggggacaucggccggaccaaccugaucgugaacuaccugccccagaacaugacccaggacgagcugcgcucccuguucagcuccaucggggaggucgagagcgccaagcucauccgggacaagguggcgggccacucccugggguacggcuucgugaacuacgucacggccaaggacgccgagcgcgccaucaacacccugaacggccuccggcugcagagcaagaccaucaagguguccuacgcccgcccgagcuccgaggugaucaaggacgcgaaccuguacaucagcgggcucccccggaccaugacgcagaaggacgucgaggacauguucucccgcuucggccggaucaucaacagccgcgugcugguggaccagaccaccgggcugucccggggcgucgccuucauccgcuucgacaagcggagcgaggccgaggaggccaucaccuccuucaacgggcacaagccgcccggcagcuccgagcccaucacggugaaguucgcggccaaccccaaccagaacaagaacguggcccuccugagccagcuguaccacucccccgcccgccgguucggcgggcccguccaccaccaggcccagcgcuuccgguucagcccgaugggcguggaccacaugagcgggcucuccggcgugaacguccccggcaacgcgagcuccggguggugcaucuucaucuacaaccugggccaggacgccgacgaggggauccuguggcagauguucggccccuucggggccgugaccaacgugaaggucauccgcgacuucaacaccaacaagugcaagggcuucggcuucgugaccaugacgaacuacgaggaggccgccauggcgaucgccagccucaacggguaccggcugggcgacaagauccuccagguguccuucaagaccaacaagagccacaaguga

SEQ ID NO: 29608 - RNA, 1041 nt, Artificial Sequence
  derived and/or modified sequence opt1 from ELAVL2__Homo_sapiens__NP_001164668
auggagacccagcugagcaacggcccgaccugcaacaacacggccaacgggcccaccaccaucaacaacaacugcuccagccccguggacuccggcaacaccgaggacagcaagacgaaccucaucgucaacuaccugccccagaacaugacccaggaggagcugaagucccucuucgggagcaucggcgagaucgaguccugcaagcuggugcgcgacaagaucaccgggcagagccugggcuacggcuucgugaacuacaucgaccccaaggacgccgagaaggcgaucaacacccucaacgggcugcggcugcagacgaagaccaucaaggucuccuacgcccgcccgagcuccgccagcauccgggacgccaaccucuacguguccggccugcccaagaccaugacccagaaggagcuggagcagcuguucagccaguacgggcgcaucaucacgucccggauccucguggaccaggucaccggcaucagccgcggggugggcuucauccgguucgacaagcgcaucgaggccgaggaggcgaucaagggccugaacgggcagaagccgcccggcgccaccgagcccaucaccgugaaguucgccaacaaccccucccagaagacgaaccaggccauccucagccagcuguaccagucccccaaccggcgcuaccccgggccgcuggcgcagcaggcccagcgguuccgcuucagccccaugaccaucgacggcaugaccagccucgccggcaucaacauccccgggcaccccggcaccggguggugcaucuucgucuacaaccuggccccggacgccgacgaguccauccuguggcagauguucggccccuucggggcggugacgaacgugaaggucauccgggacuucaacaccaacaagugcaagggcuucggcuucgugaccaugaccaacuacgacgaggccgccauggccaucgccagccucaacggguaccgccugggcgaccgggugcugcaggucuccuucaagacgaacaagacccacaaggcguga

SEQ ID NO: 29609 - RNA, 1104 nt, Artificial Sequence
  derived and/or modified sequence opt1 from ELAVL3__Homo_sapiens__NP_001411
auggugacccagauccugggcgccauggagagccaggucgggggcgggcccgccggcccggcgcuccccaacgggccccugcugggcaccaacggcgccacggacgacuccaagaccaaccucaucgugaacuaccugccccagaacaugacccaggacgaguucaagagccuguucggguccaucggcgacaucgagagcugcaagcucgugcgcgacaagaucaccgggcagucccugggcuacggguucgucaacuacagcgacccgaacgacgccgacaaggccaucaacacgcugaacggccucaagcugcagaccaagaccaucaagguguccuacgcccggcccagcuccgcgagcauccgcgacgccaaccuguacguguccggccuccccaagaccaugagccagaaggagauggagcagcuguucucccaguacgggcggaucaucacgagccgcauccuggucgaccaggugaccggcgugucccgcggggucggcuucauccgguucgacaagcggaucgaggccgaggaggccaucaagggccucaacgggcagaagccccugggcgcggccgagccgaucaccgugaaguucgccaacaaccccagccagaagaccgggcaggcccugcucacgcaccuguaccaguccagcgcccgccgguacgcgggcccccugcaccaccagacccagcgcuuccggcucgacaaccugcugaacauggccuacggggugaaguccccgcucagccugaucgcccgcuucagccccaucgccaucgacggcauguccggccuggccggggucggccucagcgggggcgcggccggggccggcuggugcaucuucguguacaaccugucccccgaggccgacgagagcgugcuguggcagcuguucggccccuucggggccgucaccaacgugaaggugauccgggacuucaccacgaacaagugcaagggcuucggguucgucaccaugaccaacuacgacgaggcggccauggccaucgccucccucaacggcuaccgccugggggagcgggugcuccaggugagcuucaagaccuccaagcagcacaaggccuga

SEQ ID NO: 29610 - RNA, 1116 nt, Artificial Sequence
  derived and/or modified sequence opt1 from ELAVL4__Homo_sapiens__NP_001281277
auggaguggaacggccugaagaugaucaucagcaccauggagccccagguguccaacgggccgaccagcaacacguccaacggccccagcuccaacaaccgcaacugccccagccccaugcagaccggggccaccaccgacgacuccaagacgaaccucaucgucaacuaccugccgcagaacaugacccaggaggaguuccggagccuguucggcuccaucggggagaucgagagcugcaagcucgugcgcgacaagaucaccggccagucccugggcuacggguucgugaacuacaucgaccccaaggacgccgagaaggcgaucaacacccugaacggccuccggcugcagacgaagaccaucaaggucagcuacgcccgccccuccagcgccuccauccgggacgccaaccuguacgugagcgggcuccccaagaccaugacccagaaggagcuggagcagcuguucucccaguacggccgcaucaucacgagccggauccucguggaccaggucaccggggugucccgcggcgugggcuucauccgguucgacaagcgcaucgaggccgaggaggcgaucaaggggcugaacggccagaagccgagcggggccaccgagcccaucaccgucaaguucgccaacaaccccagccagaaguccagccaggcccugcucucccagcuguaccagagccccaaccggcgcuacccgggcccccugcaccaccaggcgcagcgguuccgccucgacaaccugcugaacauggccuacggcgugaagcgguucucccccaucacgaucgacgggaugaccagccucgugggcaugaacauccccgggcacaccggcaccggguggugcaucuucgucuacaaccuguccccggacagcgacgaguccgugcuguggcagcuguucggccccuucggcgccgugaacaacgucaaggugauccgcgacuucaacacgaacaagugcaagggguucggcuucgugaccaugaccaacuacgacgaggccgccauggcgaucgccagccucaacggguaccggcugggcgaccgcguccuccagguguccuucaagaccaacaaggcccacaagagcuga

SEQ ID NO: 29611 - RNA, 1788 nt, Artificial Sequence
  derived and/or modified sequence opt1 from ELF1__Homo_sapiens__NP_001138825
auggccgccgugguccagcagaacgaccugguguucgaguucgcgagcaacgugauggaggacgagcgccagcucggcgaccccgccaucuucccggccgucaucguggagcacgugcccggggccgacauccugaacuccuacgccggccuggcgugcgucgaggagcccaacgacaugaucaccgagagcucccucgacguggccgaggaggagaucaucgacgacgacgacgacgacaucacccugacgguggaggccagcugccacgacggggacgagaccaucgagaccaucgaggccgcggaggcccugcucaacauggacucccccggcccgaugcuggacgagaagcggaucaacgggauccccgaggucauggagacccagcagguccaggagaaguacgccgacagccccggcgccuccagccccgagcagccgaagcgcaagaagggccggaagacgaagccgccccgccccgacucccccgccaccacccccaacaucagcgugaagaagaagaacaaggacgggaagggcaacaccaucuaccugugggaguuccuccuggcgcugcuccaggacaaggccacgugccccaaguacaucaaguggacccagcgggagaaggggaucuucaagcugguggacuccaaggccgugagccgccuguggggcaagcacaagaacaagcccgacaugaacuacgagaccauggggcgggcccuccgcuacuacuaccagcggggcauccuggccaagguggagggccagcgccuggucuaccaguucaaggagaugccgaaggaccucaucuacaucaacgacgaggaccccuccagcuccaucgagagcuccgaccccagccuguccagcagcgcgaccuccaaccggaaccagacgagccgcucccgggugagcuccagccccggggugaagggcggggccaccaccguccugaagccgggcaacuccaaggccgccaagcccaaggaccccguggagguggcccagcccagcgagguccuccgcaccgugcagccgacgcagucccccuaccccacccagcuguuccggaccgugcacgucgugcagcccguccaggcggugccggagggcgaggccgcccgcaccagcacgaugcaggacgagacccugaacuccagcgugcaguccauccggaccauccaggcccccacccagguccccgugguggucagcccgcgcaaccagcagcuccacacggugacccugcagaccgugccccugaccacggucaucgccuccaccgaccccagcgcggggaccggcucccagaaguucauccuccaggccauccccagcucccagccgaugaccgugcugaaggagaacgugaugcugcagagccagaaggccgggagcccgcccuccaucguccucggccccgcccaggugcagcagguccugacgagcaacgugcagaccaucugcaacgggaccguguccguggcgagcucccccagcuucuccgccaccgcccccgucgugacguucagcccccgguccagccagcugguggcccacccgcccggcaccgucaucaccuccgugaucaagacccaggagaccaagacgcucacccaggagguggagaagaaggagagcgaggaccaccugaaggagaacaccgagaagaccgagcagcagccccagcccuacgucauggugguguccagcuccaacggcuucacgagccaggucgccaugaagcagaacgagcugcucgagcccaacuccuucuga

SEQ ID NO: 29612 - RNA, 1515 nt, Artificial Sequence
  derived and/or modified sequence opt1 from ELF2__Homo_sapiens__NP_001263386
auggccaccagccugcacgagggccccaccaaccagcucgaccugcugauccgcgccguggaggcguccguccacagcuccaacgcccacugcacggacaagaccaucgaggccgccgaggcccuccugcacauggagagcccgaccugccugcgggacucccgcagccccguggagguguucgucccgcccugcguguccacccccgaguucauccacgcggccaugcggcccgacgugaucacggagaccgucguggaggugagcaccgaggaguccgagcccauggacaccagccccaucccgacgucccccgacagccacgagcccaugaagaagaagaaggggaacaccaccuaccucugggaguuccugcuggaccuccugcaggacaagaacacgugcccccgcuacaucaaguggacgcagcgggagaagggcaucuucaagcuggucgacuccaaggccgugagcaagcucugggggaagcacaagaacaagccggacaugaacuacgagaccaugggccgcgcccugcgguacuacuaccagcgcgggauccuggcgaagguggagggccagcggcucgucuaccaguucaaggacaugcccaagaacaucguggugaucgacgacgacaaguccgagaccugcaacgaggaccuggccggcaccacggacgagaagucccuggagcgcgucagccucagcgccgagucccugcugaaggccgccagcagcgugcgguccgggaagaacagcucccccaucaacugcagccgcgcggagaagggcguggcccgggucgugaacaucaccucccccgggcacgacgccagcucccgcagcccgaccaccacggccuccgugagcgccaccgcggccccgcggaccguccgcguggccaugcagguccccguggugaugaccucccucggccagaagaucagcacggucgccgugcaguccgugaacgccggggcgccccugaucaccagcaccucccccaccacggccaccagccccaaggucgugauccagaccauccccaccgugaugcccgccuccacggagaacggcgacaagaucaccaugcagccggccaagaucaucaccauccccgccacccagcuggcgcagugccagcuccagaccaagagcaaccugaccggcuccgggagcaucaacaucgucggcacgccccuggccgugcgggcccucacccccgugagcaucgcccacgggaccccggucaugcgccuguccaugcccacccagcaggcgagcggccagacgcccccgcgggugaucuccgccgugaucaagggccccgaggucaagagcgaggccguggccaagaagcaggagcacgacgugaagacccugcagcucgucgaggagaagcccgccgacgggaacaagaccgugacccacguggucgugguguccgcgcccagcgccaucgcccugccggucaccaugaagaccgagggccuggugaccugcgagaaguga

SEQ ID NO: 29613 - RNA, 1116 nt, Artificial Sequence
  derived and/or modified sequence opt1 from ELF3__Homo_sapiens__NP_001107781
auggccgcgaccugcgagaucagcaacaucuucuccaacuacuucagcgccauguacuccagcgaggacuccacccuggccagcgugcccccggccgccacguucggcgccgacgaccucguccugacccuguccaacccccagaugagccucgaggggaccgagaaggcguccuggcugggcgagcagccccaguucuggagcaagacccaggugcuggacuggaucuccuaccagguggagaagaacaaguacgacgccagcgccaucgacuucucccgcugcgacauggacggggccacgcucugcaacugcgcgcuggaggagcugcggcucgucuucggcccccugggggaccagcugcacgcccagcuccgcgaccugaccagcuccagcuccgacgagcugagcuggaucaucgagcuccuggagaaggacggcauggccuuccaggaggcccuggacccgggccccuucgaccaggggucccccuucgcccaggagcuccuggacgacggccagcaggcgagccccuaccacccggggagcugcggcgccggggcccccucccccggcagcuccgacgugagcaccgccggcaccggggccucccggagcucccacagcuccgacagcggcggguccgacguggaccuggaccccacggacggcaagcuguucccgagcgacggcuuccgcgacugcaagaagggggaccccaagcacggcaagcggaagcgcgggcggccccgcaagcucuccaaggaguacugggacugccuggagggcaagaaguccaagcacgcgccccgggggacccaccucugggaguucauccgcgacauccugauccacccggagcugaacgagggccucaugaagugggagaaccggcacgagggcgucuucaaguuccugcgcagcgaggccguggcccagcugugggggcagaagaagaagaacagcaacaugaccuacgagaagcucucccgggccaugcgcuacuacuacaagcgggagauccuggagcgcguggacggccggcgccuggucuacaaguucgggaagaacagcuccggcuggaaggaggaggaggugcuccagagccggaacuga

SEQ ID NO: 29614 - RNA, 1992 nt, Artificial Sequence
  derived and/or modified sequence opt1 from ELF4__Homo_sapiens__XP_005262446
auggccaucacccugcagcccagcgaccucaucuucgaguucgccuccaacggcauggacgacgacauccaccagcuggaggacccgagcguguuccccgcggucaucguggagcagguccccuaccccgaccugcuccaccuguacuccgggcuggagcucgacgacgugcacaacggcaucaucaccgacgggacgcugugcaugacccaggaccagauccuggagggcagcuuccuccugaccgacgacaacgaggccaccucccacacgaugagcaccgccgaggugcugcucaacauggaguccccgagcgacauccuggacgagaagcagaucuucuccaccagcgagaugcugcccgacuccgaccccgcccccgccgugacccucccgaacuaccuguuccccgcgagcgagcccgacgcccugaaccgcgccggggacacguccgaccaggagggccacagccucgaggagaaggccucccgggaggagagcgcgaagaagaccggcaaguccaagaagcgcauccggaagaccaaggggaaccgcagcaccucccccgucacggacccgagcauccccauccggaagaaguccaaggacggcaaggggagcaccaucuaccugugggaguuccugcucgcccugcugcaggaccgcaacacgugccccaaguacaucaaguggacccagcgggagaagggcaucuucaagcucguggacagcaaggccguguccaagcugugggggaagcagaagaacaagcccgacaugaacuacgagaccaugggccgcgcccugcgguacuacuaccagcgcggcauccucgccaaggucgaggggcagcggcugguguaccaguucaaggagaugccgaaggaccugguggucaucgaggacgaggacgagagcuccgaggcgaccgccgccccgccccaggccagcaccgccuccguggcgagcgccuccaccacgcgccggaccagcucccgcgugagcucccggagcgcgccccagggcaagggguccagcuccugggagaagcccaagauccagcacgucggccuccagcccagcgccucccuggagcugggccccagccucgacgaggagauccccaccaccagcacgaugcugguguccccggccgagggccaggugaagcugaccaaggccgucagcgccuccagcgugcccuccaacauccaccucgggguggcccccgucgggagcggcuccgcccugacccugcagaccaucccccucacgaccgugcugaccaacgggccgcccgccagcaccacggcgcccacccagcuggugcuccaguccgucccggccgccagcaccuucaaggacaccuucacgcugcaggccuccuucccccugaacgcgagcuuccaggacucccagguggccgcccccggcgcgccccucauccugagcggccugccgcagcuccuggccggggccaaccgccccaccaaccccgcgcccccgaccgucaccggcgccgggcccgccggccccuccagccagcccccggggaccgugaucgccgccuucauccggacguccggcaccaccgccgcgccccgcgugaaggagggcccccugcggagcagcuccuacguccaggggauggugaccggcgcccccauggaggggcugcucgugccggaggagacgcugcgcgagcugcuccgggaccaggcccaccuccagccccugcccacccaggucgugagccgcggcucccacaaccccagccugcuggggaaccagacccuguccccgcccagccgccccaccgugggccucacgcccgucgccgagcuggagcuguccagcggcuccgggagccuccugauggccgagccguccgugaccaccagcggcucccugcucacccggagccccacgcccgccccguucucccccuucaaccccaccagccugaucaagauggagccccacgacaucuga

SEQ ID NO: 29615 - RNA, 483 nt, Artificial Sequence
  derived and/or modified sequence opt1 from ELF5__Homo_sapiens__NP_001230009
augcuggacagcgugacccacuccaccuuccuccccaacgccagcuucugcgacccgcugauguccuggacggaccuguucagcaacgaggaguacuaccccgccuucgagcaccagaccgacgcggacuccaacugccucaagaccagcggcaucaagucccaggacugccacagccacucccgcaccagccugcaguccagccaccugugggaguucguccgggaccuccugcugucccccgaggagaacugcgggauccucgagugggaggaccgcgagcagggcaucuuccggguggucaagagcgaggcccuggccaagaugugggggcagcgcaagaagaacgaccggaugacguacgagaagcugucccgcgcccuccgguacuacuacaagaccggcauccuggagcgcguggaccggcgccugguguacaaguucgggaagaacgcccacggcuggcaggaggacaagcucuga

SEQ ID NO: 29616 - RNA, 288 nt, Artificial Sequence
  derived and/or modified sequence opt1 from ELK1__Homo_sapiens__NP_001244097
auggaccccagcgugacccuguggcaguuccuccugcagcugcuccgcgagcagggcaacgggcacaucaucuccuggaccagccgggacggcggggaguucaagcuggucgacgccgaggagguggcccgccuguggggccuccggaagaacaagacgaacaugaacuacgacaagcugucccgcgcgcugcgguacuacuacgacaagaacaucauccgcaaggugagcgggcagaaguucgucuacaaguucguguccuacccggagagccacugcgcccccuga

SEQ ID NO: 29617 - RNA, 1224 nt, Artificial Sequence
  derived and/or modified sequence opt1 from ELK3__Homo_sapiens__XP_006719338
auggagagcgccaucacccuguggcaguuccuccugcagcugcuccuggaccagaagcacgagcaccugaucugcuggaccuccaacgacggcgaguucaagcuccugaaggccgaggagguggcgaagcugugggggcuccgcaagaacaagacgaacaugaacuacgacaagcugagccgggcccugcgcuacuacuacgacaagaacaucaucaagaaggucaucggccagaaguucguguacaaguucguguccuuccccgagauccucaagauggacccgcacgccgucgagaucagccgggagucccugcugcuccaggacagcgacugcaaggccucccccgaggggcgcgaggcccacaagcacggccuggcggcccugcggagcaccucccgcaacgaguacauccacagcgggcucuacuccagcuucaccaucaacucccugcagaacccgcccgacgccuucaaggccaucaagaccgagaagcuggaggagccgcccgaggacagcccgcccguggaggaggugcggacggucauccgcuucgugaccaacaagaccgacaagcacgugacccggcccgucgugucccuccccagcacguccgaggcggccgccgccagcgccuuccuggcguccagcgugagcgccaagaucuccagccugaugcuccccaacgccgccuccaucagcuccgccagccccuucuccagccgcucccccagccugucccccaacagcccccugcccuccgagcaccggagccucuuccuggaggcggccugccacgacuccgacagccuggagccgcucaaccuguccagcggcuccaagaccaagagccccagccugccgcccaaggccaagaagcccaagggccucgagaucuccgccccgccccugguccugagcgggaccgacaucggcuccaucgcccucaacagccccgcgcugcccuccgggagccugacccccgccuucuucacggcccagacccccaacggccuccugcugacccccuccccgcuccugagcuccauccacuucuggagcucccugagccccguggcgccccucuccccggcccgccugcaggggcccagcacccuguuccaguuccccacgcuccugaacggccacaugcccgugccgauccccucccuggaccgggccgccagccccguccugcucuccagcaacagccagaaguccuga

SEQ ID NO: 29618 - RNA, 1218 nt, Artificial Sequence
  derived and/or modified sequence opt1 from ELK4__Homo_sapiens__NP_068567
auggacagcgccaucacccuguggcaguuccuccugcagcugcuccagaagccccagaacaagcacaugaucugcuggaccuccaacgacggccaguucaagcugcugcaggccgaggagguggcgcgccucugggggauccggaagaacaagccgaacaugaacuacgacaagcugagccgcgcccugcgguacuacuacgucaagaacaucaucaagaaggugaacggccagaaguucguguacaaguucgucuccuaccccgagauccucaacauggaccccaugacgguggggcgcaucgagggcgacugcgagagccugaacuucuccgaggugagcuccagcuccaaggacgucgagaacgggggcaaggacaagcccccgcagcccggcgccaagaccagcucccggaacgacuacauccacagcgggcuguacuccagcuucacccucaacucccugaacagcuccaacgugaagcuguucaagcucaucaagaccgagaaccccgccgagaagcuggccgagaagaaguccccgcaggagcccacgcccagcgugaucaaguucgucaccacccccagcaagaagcccccgguggagcccguggcggccaccaucagcaucggccccuccaucagccccuccagcgaggagacgauccaggcccuggagacccucgucuccccgaagcugcccagccuggaggcccccaccuccgcgagcaacgugaugaccgccuucgccacgacgccgcccaucuccagcaucccgccccuccaggagccgccccgcacccccuccccgccccugagcucccaccccgacaucgacaccgacaucgacagcguggccucccagcccauggagcugcccgagaaccucagccuggagcccaaggaccaggacuccguccugcucgagaaggacaaggugaacaacagcucccggagcaagaagcccaaggggcuggagcuggcccccacgcucgugaucaccagcuccgaccccagcccgcugggcauccugucccccagccuccccaccgcgucccugacccccgccuucuucagccaggucgccugcucccuguucauggugagcccgcuccuguccuucaucugccccuucaagcagauccagaaccuguacacccaggugugcuuccuccugcugcgcuucguccucgagcggcugugcgugaccgugauguga

SEQ ID NO: 29619 - RNA, 1923 nt, Artificial Sequence
  derived and/or modified sequence opt1 from ELL2__Homo_sapiens__NP_036213
auggccgccggcgggaccggcgggcugcgcgaggagcagcgguacggccucagcugcgggcgccugggccaggacaacaucaccgugcugcacgucaagcucacggagaccgcgauccgggcccuggagaccuaccagucccacaagaaccugauccccuuccgcccgagcauccaguuccagggccuccacgggcuggugaagauccccaagaacgacccccugaacgaggugcacaacuucaacuucuaccucuccaacgucggcaaggacaacccccaggggagcuucgacugcauccagcagaccuucuccagcuccggcgccagccagcugaacugccugggguucauccaggacaagaucacggugugcgccaccaacgacuccuaccagaugacccgggagcgcaugacccaggccgaggaggagagccggaaccgcuccacgaaggugaucaagccgggcggccccuacgucgggaagcgggugcagauccgcaaggcgccccaggccgugagcgacaccguccccgagcggaagcgcuccaccccgaugaaccccgccaacaccauccggaagacgcacagcuccagcaccaucucccagcgccccuaccgggaccgcgugauccaccuccuggcccugaaggcguacaagaagcccgagcuccuggcccggcugcagaaggacggcgugaaccagaaggacaagaacagccucggggccauccugcagcaggucgccaaccugaacuccaaggaccucagcuacacccugaaggacuacguguucaaggagcugcagcgcgacuggccgggcuacagcgagaucgaccggcgcucccucgagagcgugcugucccggaagcugaaccccagccagaacgccgcgggcaccucccgcagcgagucccccgucugcagcucccgcgacgccgugagcagcccccagaagcggcuccuggacagcgaguucaucgacccgcugaugaacaagaaggcccgcaucucccaccucacgaaccgggugccgcccacccugaacgggcaccugaaccccaccagcgagaaguccgccgccggccucccccugccgcccgcggccgccgccauccccacgcccccgccccugcccagcaccuaccuccccaucucccacccgccccagaucgucaacagcaacuccaacagccccagcacccccgaggggcgcggcacccaggaccugcccguggacuccuucagccagaacgacuccaucuacgaggaccagcaggacaaguacaccagccggacgucccuggagacccugcccccggggagcgugcuccugaagugccccaagcccauggaggagaaccacuccaugagccacaagaaguccaagaagaaguccaagaagcacaaggagaaggaccagaucaagaagcacgacaucgagaccaucgaggagaaggaggaggaccucaagcgcgaggaggagaucgccaagcugaacaacuccagccccaacuccagcggcggcgucaaggaggacugcaccgcguccauggagccgagcgccaucgagcugcccgacuaccucaucaaguacaucgccaucguguccuacgagcagcggcagaacuacaaggacgacuucaacgccgaguacgacgaguaccgcgcccugcacgcgcggauggagacgguggcccgccgguucaucaagcuggacgcccagcgcaagcggcucagccccgggagcaaggaguaccagaacguccacgaggaggugcugcaggaguaccagaagaucaagcaguccagccccaacuaccacgaggagaaguaccgcugcgaguaccugcacaacaagcuggcccacaucaagcggcucaucggcgaguucgaccagcagcaggcggaguccuggagcuga

SEQ ID NO: 29620 - RNA, 1866 nt, Artificial Sequence
  derived and/or modified sequence opt1 from ELL__Homo_sapiens__NP_006523
auggccgcccugaaggaggaccgcagcuacggccucuccugcgggcgggugagcgacggcuccaaggucagcguguuccacgugaagcugaccgacuccgcgcugcgcgccuucgagagcuaccgggcccgccaggacuccgucagccuccggcccuccauccgcuuccaggggagccagggccacaucuccaucccgcagcccgacugccccgccgaggcccggaccuucagcuucuaccuguccaacaucgggcgcgacaacccccagggcagcuucgacugcauccagcaguacguguccagccacggcgaggugcaccuggacugccucggguccauccaggacaagaucacggucugcgcgaccgacgacagcuaccagaaggcccggcaguccauggcccaggccgaggaggagacccgcagccggagcgcgaucgugaucaaggccggcgggcgcuaccugggcaagaaggugcaguuccggaagccggcccccggggccaccgacgccguccccucccgcaagcgggcgacgcccaucaaccuggccagcgccauccgcaaguccggcgccagcgccguguccggcgggagcggcgugucccagcggccguuccgcgaccggguccuccaccuccuggcgcugcgccccuaccggaaggccgagcugcugcuccgccugcagaaggacgggcugacccaggccgacaaggacgcccucgacggccugcugcagcaggucgccaacaugagcgcgaaggacgggaccugcacccuccaggacugcauguacaaggacgugcagaaggacuggcccggcuacuccgagggcgaccagcagcugcugaagcgcgugcucgugcggaagcugugccagccccagagcacggggucccugcucggcgacccggccgccagcuccccgcccggggagcgcggccggagcgccuccccgccccagaagcgccugcagccgcccgacuucaucgacccccuggccaacaagaagccccggaucagccacuucacccagcgcgcgcagcccgccgugaacggcaagcucgggguccccaacggccgggaggcccugcugcccacccccgggccgcccgccuccaccgacacgcucagcuccagcacccaccucccgccccgccuggagccgccccgggcgcacgacccccuggccgacgugagcaacgaccugggccacuccgggcgcgacugcgagcacggcgaggccgccgcccccgcgcccaccgugcggcugggccucccccugcugaccgacugcgcccagcccagccgcccccacgggucccccagccgguccaagcccaagaagaaguccaagaagcacaaggacaaggagcgcgccgccgaggacaagccgcgggcccagcuccccgacugcgcgcccgccacgcacgccacccccggcgccccggccgacacccccgggcugaacgggaccugcagcgucagcuccgugcccacgagcaccuccgagacccccgacuaccugcucaaguacgcggccaucagcuccagcgagcagcgccaguccuacaagaacgacuucaacgccgaguacagcgaguaccgggaccugcacgcccgcaucgagcggaucacccgccgcuucacgcagcuggacgcgcagcuccggcagcugucccagggcagcgaggaguacgagaccacccgcggccagauccugcaggaguaccggaagaucaagaagaccaacacgaacuacagccaggagaagcaccgcugcgaguaccugcacuccaagcucgcccacaucaagcggcugaucgccgaguacgaccagcgccagcugcaggccuggccguga

SEQ ID NO: 29621 - RNA, 744 nt, Artificial Sequence
  derived and/or modified sequence opt1 from ELMO1__Homo_sapiens__NP_569709
augcaggucgugaaggagcaggucaugcgcgcccugaccaccaagcccagcucccucgaccaguucaagagcaagcugcagaaccuguccuacacggagauccucaagauccggcagagcgagcgcaugaaccaggaggacuuccagucccggcccauccuggagcugaaggagaagauccagcccgagauccucgagcugaucaagcagcagcgccugaaccggcucguggaggggaccugcuuccgcaagcugaacgcccggcgccggcaggacaaguucugguacugccgccugagccccaaccacaaggugcuccacuacggcgaccuggaggagagcccccagggcgaggugccgcacgacucccugcaggacaagcuccccguggcggacaucaaggccgucgugaccgggaaggacugcccccacaugaaggagaagggcgcccugaagcagaacaaggaggugcuggagcucgccuucuccauccuguacgacagcaacugccagcugaacuucaucgcccccgacaagcacgaguacugcaucuggaccgacgggcucaacgcgcugcugggcaaggacaugauguccgaccucacgcggaacgaccuggacacccugcucagcauggagaucaagcugcgccugcucgaccuggagaacauccagaucccggacgccccgccgcccauccccaaggagcccuccaacuacgacuucgucuacgacugcaacuga

SEQ ID NO: 29622 - RNA, 2163 nt, Artificial Sequence
  derived and/or modified sequence opt1 from ELMO2__Homo_sapiens__NP_877496
augcccccgcccagcgacaucgugaaggucgccaucgaguggcccggcgccaacgcgcagcugcucgagaucgaccagaagcgcccccuggccuccaucaucaaggaggugugcgacggguggagccugccgaaccccgaguacuacacccuccgguacgccgacggcccccagcuguacaucaccgagcagacgcgcuccgacaucaagaacgggaccauccugcagcucgccaucagccccucccgggccgcgcgccagcugauggagcggacccagagcuccaacauggagacccgccuggacgccaugaaggagcucgccaagcugagcgccgacgugacguucgcgaccgaguucaucaacauggacggcaucaucguccugacccggcucguggaguccgggaccaagcugcugagccacuacuccgagaugcucgccuucacgcugaccgccuuccuggagcucauggaccacggcaucgugagcugggacauggucuccaucaccuucaucaagcagaucgccggcuacgugagccagccgaugguggacgucuccauccugcagcgcagccuggccauccucgaguccauggugcugaacagccagucccuguaccagaagaucgcggaggagaucaccguggggcagcucaucagccaccuccaggucagcaaccaggagauccagacguacgccaucgcccugaucaacgcccuguuccugaaggcccccgaggacaagcggcaggacauggcgaacgccuucgcccagaagcaccuccgcuccaucauccugaaccacgugauccggggcaaccgccccaucaagaccgagauggcccaccagcuguacgugcugcagguccucaccuucaaccugcuggaggagcggaugaugaccaagauggaccccaacgaccaggcccagcgcgacaucaucuucgagcuccggcgcaucgcguucgacgccgagagcgacccguccaacgcccccgggagcggcacggagaagcggaaggccauguacaccaaggacuacaagaugcugggguucaccaaccacaucaaccccgccauggacuucacccagacgcccccgggcaugcuggcgcucgacaacaugcuguaccuggccaaggugcaccaggacaccuacauccgcaucgugcucgagaacuccagccgggaggacaagcacgagugccccuucggccgcuccgccaucgagcugaccaagaugcugugcgagauccuccaggucggggagcugcccaacgagggccggaacgacuaccaccccauguucuucacccacgaccgcgccuucgaggagcuguucgggaucugcauccagcuccugaacaagacguggaaggagaugcgcgcgaccgccgaggacuucaacaaggugaugcaggucgugcgggagcagaucacccgcgcccugccgagcaagcccaacucccuggaccaguucaagagcaagcuccggucccugagcuacuccgagauccugcgccuccggcagagcgagcgcaugucccaggacgacuuccagagcccgcccaucguggagcugcgggagaagauccagcccgagauccuggagcucaucaagcagcagcgccugaaccggcugugcgagggcuccagcuuccgcaagaucggcaaccggcgccggcaggagcgcuucugguacugccggcucgcccugaaccacaaggugcugcacuacggggaccucgacgacaacccccagggcgaggucaccuucgagucccugcaggagaagauccccguggccgacaucaaggcgaucgucacggggaaggacugcccccacaugaaggagaaguccgcccugaagcagaacaaggaggugcucgagcuggccuucagcauccuguacgacccggacgagacccucaacuucaucgcccccaacaaguacgaguacugcaucuggaucgacggccugagcgcccugcucgggaaggacaugagcuccgagcugaccaagagcgaccuggacacccuccuguccauggagaugaagcugcgccuccuggaccuggagaacauccagauccccgaggcgccgccgcccauccccaaggagcccagcuccuacgacuucguguaccacuacggcuga

SEQ ID NO: 29623 - RNA, 981 nt, Artificial Sequence
  derived and/or modified sequence opt1 from ELMOD1__Homo_sapiens__NP_001123509
augaagcacuuccugcgcaugcucauccaggugugccuguacuucuacugcaaguuccuguggcggugccucaaguucgucaugcgcaagcugaccggccggugcgagcugcagcgcaucugcuacaacaccaagcccggggccagccggacgaugaagaucgagaccucccuccgcgacagcaaguccaagcugcugcagaccagcguguccgugcacccggacgccaucgagaagaccaucgaggacaucauggagcucaagaagaucaaccccgacgucaacccccagcugggcaucagccugcaggcgugccuccugcagaucgugggguaccggaaccugaucgccgacguggagaagcuccgccgggaggccuacgacuccgacaacccccagcacgaggagaugcugcugaagcucuggaaguuccugaagccgaacacgccccuggagagccgcaucuccaagcaguggugcgagaucggcuuccagggggacgaccccaagaccgacuuccggggcaugggccuccuggggcuguacaaccuccaguacuucgccgagcgcgacgccaccgcggcccagcagguccugagcgacucccugcaccccaagugcagcaaguucuccaaggccgagugggagaagaagcggauggacaaggccaucggcuacagcuucgcgaucguggggaucaacaucaccgaccucgccuacaaccugcugguguccggcgcccucaagacgcacuucuacaacaucgccccggaggcccccacccugagccacuuccagcagaccuucugcuaccugaugcacgaguuccacaaguucuggaucgaggaggaccccauggacaucauggaguucaaccgcguccgggagaaguuccgcaagcggaucaucaagcagcuccagaaccccgacauggcgcugugcccgcacuucgccgccuccgaggggcugaucaacauguga

SEQ ID NO: 29624 - RNA, 882 nt, Artificial Sequence
  derived and/or modified sequence opt1 from ELMOD2__Homo_sapiens__NP_714913
auguucaucagccugugggaguucuucuacggccacuucuuccgcuucuggaugaaguggcuccugcggcagaugaccgggaagugcgagcugcagcgcaucuucgacaccuacgugggcgcccagcggacgcaccgcaucgagaacucccucaccuacagcaagaacaagguccugcagaaggccacccacguggugcaguccgaggucgacaaguacguggacgacaucaugaaggagaagaacaucaaccccgagaaggacgcgagcuucaagaucugcaugaagaugugccugcuccagaucaccggguacaagcagcuguaccuggacguggaguccguccggaagcgcccguacgacagcgacaaccuccagcacgaggagcugcugaugaagcucuggaaccugcugaugcccacgaagaagcucaacgcccggaucuccaagcagugggccgagaucggcuuccagggggacgaccccaagaccgacuuccgcggcaugggcauccuggggcugaucaaccucguguacuucagcgagaacuacaccuccgaggcccaccagauccugagccgguccaaccaccccaagcugggcuacagcuacgccaucguggggaucaaccucaccgagauggcguacucccugcucaagagcgaggcccugaaguuccaccuguacaaccuggucccgggcauccccacgauggagcacuuccaccaguucuacugcuaccucguguacgaguucgacaaguucugguucgaggaggagcccgaguccaucauguacuucaaccuguaccgcgagaaguuccacgagaagaucaaggggcugcuccuggacugcaacguggcccugacccucaaggucuga

SEQ ID NO: 29625 - RNA, 1146 nt, Artificial Sequence
  derived and/or modified sequence opt1 from ELMOD3__Homo_sapiens__NP_001128494
augaacgagaagagcugcuccuuccacagcaaggaggagcugcgcgacggccagggggagcggcucuccgccggcuacagccccuccuacgacaaggacaagagcgugcuggccuuccgcgggaucccgaucuccgagcugaagaaccacggcauccuccaggcgcugaccaccgaggccuacgagugggagccccgggucgugagcacggaggugguccgcgcccaggaggagugggaggccguggacaccauccagcccgagaccgggucccaggccagcuccgagcagcccggccagcugaucagcuucuccgaggcgcuccagcacuuccagaccguggaccugagcccguucaagaagcggauccagcccacgauccgccggaccggccuggccgcccuccgccacuaccuguucgggccccccaagcugcaccagcggcuccgcgaggagcgggaccugguccugaccaucgcccagugcggccucgacucccaggacccggugcacgggcgcgugcugcagaccaucuacaagaagcugacgggcagcaaguucgacugcgcgcuccacgggaaccacugggaggaccugggcuuccagggcgccaaccccgccaccgaccugcggggggccggcuuccucgcccugcugcaccuccuguaccuggucauggacuccaagacccuccccauggcgcaggagaucuuccgccugagccggcaccacauccagcaguuccccuucugccugauguccgugaacaucacccacaucgccauccaggcccuccgcgaggagugccugagccgggagugcaaccgccagcagaaggugaucccggucgugaacagcuucuacgccgccacguuccugcaccucgcgcacguguggcggacccagcgcaagaccaucuccgacagcggguucguccugaaggagcuggaggugcucgccaagaaguccccccggcgccugcugaagacccucgagcuguaccuggcccgcgugagcaagggccaggccucccuccugggcgcccagaagugcuacgggcccgaggcgcccccguucaaggaccugacguucaccggcgagagcgaccuccagucccacagcuccgagggggucuggcugaucuga

SEQ ID NO: 29626 - RNA, 3138 nt, Artificial Sequence
  derived and/or modified sequence opt1 from ELMSAN1__Homo_sapiens__NP_919254
augaaccuccaggcccagcccaaggcccagaacaagcgcaagcggugccucuucggcgggcaggagcccgcgcccaaggagcagccgccgccccugcagccgccccagcagagcauccgcgugaaggaggagcaguaccugggccacgaggggcccggcggggccgugagcaccagccagcccguggagcugcccccgcccuccagccuggcccugcucaacuccguggucuacggcccggagcggaccagcgccgccaugcugucccagcaggucgcgagcgugaaguggcccaacuccgucauggcccccggccgcgggcccgagcggggcgggggcgggggcgugagcgacuccagcuggcagcagcagcccggccagccgccgccccacuccacguggaacugccacagccugucccucuacagcgccaccaaggggagcccccaccccggcguggggguccccaccuacuacaaccaccccgaggcccugaagcgcgagaaggcgggcggcccccagcuggaccgguacgugcgccccaugaugccccagaaggugcagcucgaggucgggcggccccaggccccgcugaacuccuuccacgccgccaagaagccgcccaaccagucccugccccuccagcccuuccagcuggccuucggccaccaggugaaccgccagguguuccggcaggggccgcccccgcccaaccccgucgcggccuucccgccccagaagcagcagcagcagcagcagccccagcagcagcagcagcagcagcaggccgcccugccccagaugccccucuucgagaacuucuacagcaugccccagcagcccagccagcagccccaggacuucggccugcagcccgccgggccccugggccagucccaccucgcgcaccacagcauggcccccuaccccuucccgcccaaccccgacaugaaccccgagcugcgcaaggcccugcuccaggacuccgcgccccagcccgcccugccccaggugcagauccccuucccccggcgcagccggcgccuguccaaggagggcauccugccgcccagcgcgcuggacggggccggcacccagcccgggcaggaggccaccggcaaccuguuccuccaccacuggccgcugcagcagcccccgcccgggucccugggccagccccaccccgaggcccucggcuucccccuggagcugcgggagagccagcuccugcccgacggggagcgccuggccccgaacggccgggagcgcgaggcgcccgccaugggguccgaggagggcaugcgggccgugagcaccggggacugcggccaggugcuccgcggcggggugauccaguccacccgccggcgccggcgcgccagccaggaggcgaaccugcugacccucgcccagaaggccguggagcuggccucccugcagaacgccaaggacggcagcggguccgaggagaagcgcaagagcguccucgcguccacgaccaagugcggcguggaguucagcgagcccucccuggccaccaagcgcgcccgggaggacagcggcauggugccccugaucaucccggucagcgugcccguccgcaccguggaccccacggaggccgcccaggccgggggccucgacgaggacgggaagggccccgagcagaacccggccgagcacaagcccuccgugaucgucacccggcgccggagcacccgcauccccgggaccgacgcccaggcccaggccgaggacaugaacgugaagcuggagggcgagcccuccgugcggaagccgaagcagcgcccccggcccgagccccugaucaucccgacgaaggcgggcaccuucaucgccccgcccgucuacagcaacaucacccccuaccagucccaccuccggagccccgugcggcucgccgaccaccccuccgagcgcagcuucgagcugcccccguacacgccgccgcccauccuguccccggugcgggaggggagcggccucuacuucaacgccaucaucuccacgagcaccauccccgcgccgccgcccaucacccccaaguccgcccaccgcacccugcugcgcacgaacagcgccgaggucaccccgcccgugcucuccgugaugggggaggccacccccgucagcaucgagccccggaucaacgugggcucccgcuuccaggccgagaucccccugaugcgggaccgcgcgcuggccgccgccgacccccacaaggccgaccucguguggcagcccugggaggaccuggagagcagccgggagaagcagcgccaggucgaggaccugcucaccgcggccugcuccagcaucuuccccggggccggcacgaaccaggagcuggcccugcacugccuccacgagucccggggcgacauccuggagacccugaacaagcuccugcugaagaagccccuccgcccccacaaccacccgcuggccaccuaccacuacaccgggagcgaccaguggaagauggcggagcggaagcuguucaacaagggcaucgccaucuacaagaaggacuucuuccucgugcagaagcugauccagacgaagaccguggcccagugcgucgaguucuacuacaccuacaagaagcaggucaagaucgggcgcaacggcacccugacguucggggacguggacaccuccgacgagaaguccgcccaggaggaggucgagguggacaucaagaccucccagaaguucccccgggugccccucccccgccgggagagcccguccgaggagcgccuggagcccaagcgggaggucaaggagccccgcaaggagggcgaggaggaggugccggagauccaggagaaggaggagcaggaggagggccgggagcgcagccggcgcgcggccgccgugaaggccacccagacccugcaggccaacgaguccgcgagcgacauccucauccugcggucccacgagagcaacgcccccggguccgccggcgggcaggccagcgagaagccccgcgagggcacggggaagucccgccgggcccugcccuucagcgagaagaagaagaagaccgagaccuucuccaagacccagaaccaggagaacacguucccgugcaagaagugcggccgcuga

SEQ ID NO: 29627 - RNA, 2175 nt, Artificial Sequence
  derived and/or modified sequence opt1 from ELN__Homo_sapiens__NP_000492
auggccggccugaccgccgcggccccgcgcccgggggugcuccugcugcuccugagcauccugcaccccucccggcccggcgggguccccggcgccauccccgggggcgugcccggcgggguguucuaccccggcgccgggcucggcgcccucgggggcggcgcgcuggggcccggcgggaagccgcugaagcccguccccggcggccuggccggggccggccugggggccggccucggggcguuccccgccgugaccuucccgggcgcccuggugcccggcggggucgccgacgccgcggccgccuacaaggccgccaaggcgggcgccgggcugggcggggugcccggcgugggcgggcucggcgucagcgccggggccguggugccccagccgggcgccggggucaagcccggcaaggugcccggcguggggcugcccggcgucuaccccgggggcgugcugcccggcgcgcgcuuccccggggugggcguccuccccggggugccgacgggcgccggggugaagcccaaggcccccggcgucggcggggccuucgccggcauccccggggugggcccguucgggggcccccagcccggcgugccgcugggguaccccaucaaggcgcccaagcugcccggcggguacggccucccguacaccaccgggaagcugcccuacggcuacggccccgggggcgucgccggggccgccggcaaggcgggguaccccaccggcacgggcguggggccgcaggccgccgccgccgcggccgccaaggccgccgcgaaguucggcgccggggccgccggcguccugcccggcgucgggggcgccggggugcccggcgugcccggggcgaucccgggcaucggcgggaucgccggcguggggacccccgccgccgcggccgccgccgccgcggccgccaaggccgccaaguacggcgcggccgccgggcucgugcccggcggccccggguucggcccgggggucgugggcgugcccggggccggcguccccggcgugggggugcccggcgccgggaucccggucgugcccggcgcgggcauccccggggccgccgugcccggcgucguguccccggaggccgcggccaaggccgccgccaaggcggccaaguacggggcccggcccggcgugggggucggcggcauccccaccuacggggugggcgccgggggcuucccgggguucggcgugggcgucgggggcauccccgggguggccggcgugcccggggucggcggcgugcccggggugggcggggucccgggcguggggaucagccccgaggcgcaggccgccgccgccgcgaaggccgccaaguacggcgugggcacccccgccgccgcggccgccaaggccgcggccaaggccgcccaguucgggcugguccccggcguggggguggccccgggcgucggcguggcgcccggggugggcgucgcccccggggugggccuggcccccggggugggcgucgccccgggcguggggguggcccccggcgucgggguggcgcccggcaucgggcccggcggcguggccgccgccgccaaguccgcggccaaggucgccgccaaggcgcagcuccgcgccgccgccgggcugggcgccgggaucccgggccugggggugggcgugggcguccccgggcucggcgugggggcgggcgugcccgggcugggcgucggcgccggggugcccggcuucggggccgucccgggcgcccuggccgcggccaaggccgccaaguacggcgccgcggugcccggggugcucggcgggcugggcgcccucgggggcgucggcauccccgggggcguggugggggccggccccgccgcggccgccgccgccgcgaaggccgccgccaaggccgcgcaguucgggcuggucggcgccgccggccucgggggccugggggugggcgggcugggcgugccgggcgucgggggccucgggggcaucccgcccgccgccgcggccaaggccgccaaguacggcgccgcggggcugggcggggugcugggcggggccggccaguucccccugggcgggguggccgcccggccgggcuucgggcugagccccaucuuccccggcggggcgugccucggcaaggccugcggccgcaagcggaaguga

SEQ ID NO: 29628 - RNA, 252 nt, Artificial Sequence
  derived and/or modified sequence opt1 from ELOF1__Homo_sapiens__NP_115753
augggccgccgcaagagcaagcggaagcccccgcccaagaagaagaugaccgggacccuggagacgcaguucacgugccccuucugcaaccacgagaaguccugcgacgugaagauggaccgggcccgcaacaccggcgucaucagcugcaccgugugccucgaggaguuccagacccccaucaccuaccuguccgagccgguggacgucuacagcgacuggaucgacgccugcgaggcggccaaccaguga

SEQ ID NO: 29629 - RNA, 891 nt, Artificial Sequence
  derived and/or modified sequence opt1 from ELOVL2__Homo_sapiens__NP_060240
auggagcaccugaaggccuucgacgacgagaucaacgccuuccucgacaacauguucggcccccgcgacagccgggugcgcgggugguucaugcuggacuccuaccugccgaccuucuuccucaccgucauguaccugcugagcaucuggcucggcaacaaguacaugaagaaccggcccgcgcugucccugcgcgggauccucacgcuguacaaccugggcaucacccuccugagcgccuacaugcuggccgagcucauccuguccaccugggagggcggguacaaccugcagugccaggaccucaccagcgccggcgaggccgacauccggguggcgaaggugcuguggugguacuacuucuccaagagcgucgaguuccuggacacgaucuucuucgugcuccgcaagaagaccucccagaucaccuuccugcacguguaccaccacgccagcauguucaacaucugguggugcguccugaacuggauccccugcgggcaguccuucuucggccccacccucaacagcuucauccacauccugauguacuccuacuacgggcugagcguguucccguccaugcacaaguaccucugguggaagaaguaccugacgcaggcccagcuggugcaguucguccucaccaucacccacaccaugagcgccguggugaagcccugcggcuuccccuucgggugccugaucuuccaguccagcuacaugcugacgcucgucauccuguuccugaacuucuacgugcagaccuaccggaagaagcccaugaagaaggacaugcaggagccgcccgcgggcaaggaggugaagaacggcuucuccaaggccuacuucaccgccgccaacggggucaugaacaagaaggcccaguga

SEQ ID NO: 29630 - RNA, 945 nt, Artificial Sequence
  derived and/or modified sequence opt1 from ELOVL4__Homo_sapiens__NP_073563
augggccugcucgacagcgagcccggguccgugcugaacgucgugagcaccgcccugaacgacaccguggaguucuaccgcuggacgugguccaucgccgacaagcgggucgagaacuggccgcucaugcagagccccuggcccacccuguccaucagcacccuguaccuccuguucguguggcugggccccaaguggaugaaggaccgcgagccguuccagaugcggcucgugcugaucaucuacaacuucgggaugguccugcucaaccuguucaucuuccgcgagcuguucaugggcuccuacaacgcgggguacagcuacaucugccaguccguggacuacagcaacaacgugcacgagguccggaucgccgccgcccucuggugguacuucguguccaagggcguggaguaccuggacaccgucuucuucauccugcgcaagaagaacaaccaggugagcuuccuccacguguaccaccacugcacgauguucacccugugguggaucggcaucaagugggucgccgggggccaggcguucuucggggcccagcugaacuccuucauccacgugaucauguacagcuacuacggccucaccgccuucgggcccuggauccagaaguaccugugguggaagcgguaccugaccaugcuccagcugauccaguuccacgugacgaucggccacaccgcccugucccucuacaccgacugccccuuccccaaguggaugcacugggcgcugaucgccuacgccaucagcuucaucuuccuguuccucaacuucuacauccgcaccuacaaggagccgaagaagcccaaggccggcaagacggccaugaacgggaucuccgcgaacggcgucagcaaguccgagaagcagcugaugaucgagaacgggaagaagcagaagaacggcaaggccaagggcgacuga

SEQ ID NO: 29631 - RNA, 981 nt, Artificial Sequence
  derived and/or modified sequence opt1 from ELOVL5__Homo_sapiens__NP_001229757
auggagcacuucgacgccagccuguccaccuacuucaaggcccuccugggcccccgcgacacccgggugaaggggugguuccugcucgacaacuacaucccgacguucaucugcagcgucaucuaccugcugaucguguggcucggccccaaguacaugcgcaacaagcagcccuucuccugccgggggauccugguggucuacaaccugggccucacccugcugagccucuacauguucugcgaguccaagcgcgagcagccccggcgcagcgcgugcgccucccggaccgacccgagcacccagcagcagcugcccgagaaccgccuggugacgggggugugggagggcaaguacaacuucuucugccagggcacccggaccgccggggaguccgacaugaagaucauccgcguccucuggugguacuacuucagcaagcugaucgaguucauggacaccuucuucuucauccugcggaagaacaaccaccagaucacggugcuccacguguaccaccacgccuccaugcugaacaucuggugguucgucaugaacugggugcccugcggccacagcuacuucggggccacccugaacuccuucauccacgugcucauguacagcuacuacggccuguccagcguccccuccaugcgcccguaccugugguggaagaaguacaucacccaggggcagcuccugcaguucgugcugaccaucauccagacgagcugcggcgugaucuggcccugcaccuucccccucggcuggcuguacuuccagaucggguacaugaucucccugaucgcccucuucaccaacuucuacauccagaccuacaacaagaagggcgcgagccggcgcaaggaccaccugaaggaccaccagaacgggagcauggccgccgucaacggccacacgaacuccuucagcccccuggagaacaacgugaagccgcggaagcuccgcaaggacuga

SEQ ID NO: 29632 - RNA, 798 nt, Artificial Sequence
  derived and/or modified sequence opt1 from ELOVL6__Homo_sapiens__XP_011530536
augaacaugagcgugcugacccuccaggaguacgaguucgagaagcaguucaacgagaacgaggccauccaguggaugcaggagaacuggaagaaguccuuccuguucagcgcccuguacgcggccuucaucuucggcgggcgccaccucaugaacaagcgggccaaguucgagcugcgcaagccccugguccucuggucccugacccuggccguguucagcaucuucggcgcccuccggacgggggcguacaugguguacauccugaugaccaagggccugaagcaguccgucugcgaccagggguucuacaacggcccggugagcaaguucugggccuacgccuucgugcucuccaaggcccccgagcugggcgacaccaucuucaucauccugcgcaagcagaagcucaucuuccugcacugguaccaccacaucaccguccugcucuacagcugguacuccuacaaggacaugguggccgggggcgggugguucaugacgaugaacuacggcgugcacgcggucauguacagcuacuacgcccugcgggccgccggguuccgcgugucccggaaguucgcgauguucaucacccugagccagaucacccagaugcucaugggcugcguggucaacuaccugguguucugcuggaugcagcacgaccagugccacucccacuuccagaacaucuucuggagcucccugauguaccucagcuaccuggugcuguucugccacuucuucuucgaggccuacaucggcaagaugcgcaagaccacgaaggccgaguga

SEQ ID NO: 29633 - RNA, 846 nt, Artificial Sequence
  derived and/or modified sequence opt1 from ELOVL7__Homo_sapiens__NP_001098028
auggccuucagcgaccugaccucccgcaccgugcaccucuacgacaacuggaucaaggacgccgacccccgggucgaggacuggcugcugaugagcuccccgcucccccagacgauccugcugggcuucuacguguacuucgugaccagccucgggcccaagcugauggagaaccgcaagcccuucgagcugaagaaggcgaugaucaccuacaacuucuucaucguccucuucuccguguacaugugcuacgaguucgugaugagcggcugggggaucggcuacuccuuccggugcgacaucgucgacuacagccgcuccccgaccgcccugcggauggcccgcacgugcuggcuguacuacuucagcaaguucaucgagcuccuggacaccaucuucuucgugcugcggaagaagaacucccaggugaccuuccuccacgucuuccaccacaccaucaugcccuggacguggugguucggggugaaguucgccgccggcggccuggggaccuuccacgcgcugcucaacaccgccgugcacgucgugauguacagcuacuacggccuguccgcccuggggcccgccuaccagaaguaccucugguggaagaaguaccugaccagccugcagcucgugcaguucgucaucguggcgauccacaucucccaguucuucuucauggaggacugcaaguaccaguuccccguguucgccugcaucaucaugagcuacuccuucauguuccugcuccuguuccugcacuucugguaccgcgccuacacgaagggccagcggcugccgaagaccgucaagaacgggaccugcaagaacaaggacaacuga

SEQ ID NO: 29634 - RNA, 2676 nt, Artificial Sequence
  derived and/or modified sequence opt1 from ELP2__Homo_sapiens__NP_001229804
augguggcccccguccuggagaccagccacguguucugcugcccgaaccgcgugcggggcguccucaacugguccagcgggccccgcggccugcuggccuucgggaccuccugcagcguggugcucuacgacccccugaagcgggucguggugacgaaccugaacggccacaccgcgcgcgucaacugcauccaguggaucugcaagcaggacgggucccccagcaccgagcucguguccggcggcagcgacaaccaggugauccacugggagaucgaggacaaccagcugcugaaggccguccaccuccaggggcacgagggcccgguguacgccgugcacgccgucuaccagcggcgcaccuccgaccccgcccugugcacgcugaucgugagcgcggccgccgacuccgccgugcggcucuggagcaagaaggggcccgaggucaugugccugcagacccugaacuucggcaacggguucgcgcucgcccugugccuguccuuccuccccaacaccgacgugaccuggaagacgggccagguggagcgcggccgggccuggaagccgcccgccagccuggcccugugcucccgcagcugcgacuccauggucagcugcuacgcguccauccucugcaaggcccuguggaaggagaagcugcacaccuucuggcaccacaaccggaucagcuuccuccccagcgccuuccgccccaucccgauccuggccugcgggaacgacgacugccggauccacaucuucgcccagcagaacgaccaguuccagaaggugcugucccucugcggccacgaggacuggauccgcgggguggagugggcggccuucggccgggaccuguuccuggccagcugcucccaggacugccucauccgcaucuggaagcuguacaucaagagcaccucccuggagacccaggacgacgacaacauccggcucaaggagaacacguucaccaucgagaacgagagcgucaagaucgccuucgccgugacccuggagaccguccuggcgggccacgagaacugggugaacgccgugcacuggcagcccgucuucuacaaggacggggugcuccagcagcccgugcgccugcuguccgccagcauggacaagacgaugauccucugggcccccgacgaggaguccggcgucuggcuggagcagguccgggugggggaggugggcgggaacacccugggcuucuacgacugccaguucaacgaggacggcagcaugaucaucgcccacgcguuccacggggcccuccaccuguggaagcagaacaccgugaacccgcgcgaguggacccccgagaucgugaucuccggccacuucgacgggguccaggaccuggugugggaccccgagggcgaguucaucaucacgguggggaccgaccagaccacccggcuguucgcccccuggaagcgcaaggaccagagccaggucacguggcacgagaucgcccgcccgcagauccacggcuacgaccugaagugccuggcgaugaucaaccgguuccaguucguguccggcgccgacgagaaggugcuccgcgucuucagcgcgccccggaacuucguggagaacuucugcgccaucaccgggcagucccugaaccacgugcugugcaaccaggacagcgaccugcccgagggcgccaccguccccgcccucgggcuguccaacaaggccguguuccagggcgacaucgccagccagccguccgacgaggaggagcugcucaccagcacgggguucgaguaccagcaggucgccuuccagcccagcauccugaccgagccgcccaccgaggaccaccuccuccagaacacccuguggcccgaggugcagaagcuguacggccacggcuacgagaucuucugcgugacgugcaacuccagcaagacccuccuggccuccgcgugcaaggccgccaagaaggagcacgccgccaucauccuguggaacaccaccagcuggaagcagguccagaaccucguguuccacucccugacggugacccagauggcguucagccccaacgagaaguuccugcucgccgugucccgcgaccggaccuggagccuguggaagaagcaggacaccaucucccccgaguucgagccggucuucagccuguucgccuucaccaacaagaucacguccgugcacagccgcaucaucugguccugcgacuggagccccgacuccaaguacuucuucaccgggagccgggacaagaagguggucguguggggcgagugcgacuccaccgacgacugcaucgagcacaacaucgggcccugcagcagcgugcucgacgucggcggcgccgugaccgcgguguccgucugccccgugcugcacccgagccagcgcuacguggucgccguggggcuggagugcggcaagaucugccucuacacguggaagaagaccgaccaggugcccgagaucaacgacuggacccacugcgucgagaccucccagagccagucccacacgcuggccauccggaagcugugcuggaagaacugcagcgggaagaccgagcagaaggaggccgagggcgccgaguggcuccacuucgcguccugcggggaggaccacaccgugaagauccaccgcgugaacaagugcgcccuguga

SEQ ID NO: 29635 - RNA, 1602 nt, Artificial Sequence
  derived and/or modified sequence opt1 from ELP3__Homo_sapiens__NP_001271151
augaugcugaccaucggcgacgugaucaagcagcucaucgaggcccacgagcaggggaaggacaucgaccugaacaaggucaagaccaagacggccgcgaaguacggccugagcgcccagccccgccucguggacaucaucgccgccgugccgccccaguaccggaagguccugaugcccaagcugaaggccaagcccauccgcaccgcguccgggaucgccgugguggccgucaugugcaagccgcaccggugcccccacaucagcuucaccggcaacaucugcguguacugccccgggggccccgacuccgacuucgaguacagcacccaguccuacacgggcuacgagccgaccagcaugcgcgccauccgggcgcgcuacgaccccuuccuccagacccggcaccgcaucgagcagcugaagcagcuggggcacuccguggacaaggucgaguucaucgugaugggcgggaccuucauggcccuccccgaggaguaccgggacuacuucauccgcaaccugcacgacgcccugagcggccacacguccaacaacaucuacgaggccgugaaguacagcgagcggucccucaccaagugcaucgggaucaccaucgagacccgccccgacuacugcaugaagcggcaccugagcgacaugcugacguacggcugcacccgccucgagaucggcguccaguccguguacgaggacguggcccgggacaccaaccgcgggcacaccgucaaggcggugugcgagagcuuccaccuggccaaggacuccggcuucaagguggucgcccacaugaugccggaccugcccaacguggggcucgagcgggacaucgagcaguucacggaguucuucgagaaccccgccuuccgccccgacggccugaagcuguacccgacccucgugauccggggcaccgggcuguacgagcuguggaaguccggccgcuacaagagcuacagccccuccgaccucgucgagcugguggcccggauccuggcgcucgugccgcccuggacccgcgucuaccgcgugcagcgggacauccccaugccccuggucagcagcgggguggagcacggcaaccugcgcgagcucgcccuggcccggaugaaggaccuggggauccagugccgcgacgugcggacgcgcgaggucggcauccaggagauccaccacaaggugcggcccuaccagguggagcucguccgccgggacuacguggccaacggcgggugggagaccuuccuguccuacgaggaccccgaccaggacauccugaucggccuccugcgccugcggaagugcagcgaggagaccuuccgcuucgagcucgggggcgggguguccaucguccgggagcugcacguguacggcagcguggucccgguguccagccgcgaccccaccaaguuccagcaccagggcuucgggaugcugcucauggaggaggccgagcggaucgcgcgcgaggagcacggcuccgggaagaucgccgugaucagcggcgucgggacgcggaacuacuaccgcaagaucggcuaccggcugcagggccccuacauggugaagaugcugaaguga

SEQ ID NO: 29636 - RNA, 1431 nt, Artificial Sequence
  derived and/or modified sequence opt1 from ELP4__Homo_sapiens__NP_001275654
auggccgccguggcgaccugcggcagcgucgccgccuccaccgggagcgccguggccacggcguccaagagcaacgugaccuccuuccagcgccggggcccccgcgccagcgucaccaacgacuccgggccgcggcuggugagcaucgccggcacccgccccuccgugcggaacgggcagcuccuggucagcacgggccugcccgcccucgaccagcugcugggcgggggccucgcgguggggaccgugcugcugaucgaggaggacaaguacaacaucuacagcccccuccuguucaaguacuuccuggccgagggcaucgucaacgggcacacccuccugguggccuccgccaaggaggacccggccaacauccugcaggagcuccccgcgccccugcuggacgacaagugcaagaaggaguucgacgaggacguguacaaccacaagacccccgaguccaacaucaagaugaagaucgccuggcgcuaccagcuccugccgaagauggagcagaucggccccgucagcuccagccgguucggccacuacuacgacgccuccaagcgcaugccccaggagcugaucgaggccagcaacuggcacggguucuuccuccccgagaagaucuccagcacgcugaagguggagccgugcagccugacccccggcuacaccaagcuccugcaguucauccagaacaucaucuacgaggagggguucgacggcuccaacccccagaagaagcagcggaacauccugcgcaucggcauccagaaccucgggagcccccuguggggcgacgacaucugcugcgccgagaacgggggcaacucccacagccugaccaaguuccucuacgugcugcgggggcugcuccgcacgucccugagcgcgugcaucaucaccaugccgacccaccugauccagaacaaggccaucaucgcccgggucaccacgcucuccgacgugguggucggccuggagagcuucaucggcuccgagcgcgagaccaacccccuguacaaggacuaccacgggcucauccacauccggcagaucccccgccugaacaaccugaucugcgacgagagcgacgugaaggaccucgccuucaagcugaagcggaagcuguucaccaucgagugggugcaggacaacuaccuccgccaggagcggaacaucuacccgcccggcuucuccuaccugcugaagcagaaggacagcgccuggggcgaggggucccuccagcacagcaccuuccugauguccuuccuggcgaaggccacggccuucgccagccgccugguccggcacuccgagccccucaagcagaacgggagcggccgcauccgccaggccgcgggcccccggcuguggcacgacgggcgccggcaggaggcccccggccugcucgggaucccgcccuga

SEQ ID NO: 29637 - RNA, 801 nt, Artificial Sequence
  derived and/or modified sequence opt1 from ELP6__Homo_sapiens__NP_001026873
auguucguggagcugaacaaccuccugaacaccacccccgaccgcgccgagcagggcaagcugacgcuccugugcgacgccaagaccgacgggagcuuccugguccaccacuuccucuccuucuaccugaaggcgaacugcaaggugugcuucguggcccugauccagagcuucucccacuacagcaucgucggccagaagcucggggugucccugaccauggcccgggagcgcggccagcugguguuccucgaggggcucaagagcgccgucgacgugguguuccaggcccagaaggagccgcacccccugcaguuccugcgggaggcgaacgccggcaaccugaagccccuguucgaguucguccgcgaggcccucaagcccguggacuccggcgaggcccgguggaccuacccggugcugcuggucgacgaccucagcgugcugcugucccucgggaugggcgcgguggccguccuggacuucauccacuacugccgcgccacggugugcugggagcugaaggggaacauggugguccucgugcacgacagcggcgacgccgaggacgaggagaacgacauccugcugaacgggcucucccaccagagccaccugauccugcgggccgagggccucgcgaccggcuucugccgcgacgugcacgggcagcugcggauccuguggcgccggcccucccagcccgccguccaccgcgaccagagcuucaccuaccaguacaagauccaggacaaguccgugagcuucuucgccaagggcaugucccccgccgugcucuga

SEQ ID NO: 29638 - RNA, 672 nt, Artificial Sequence
  derived and/or modified sequence opt1 from ELSPBP1__Homo_sapiens__NP_071425
augacccgcuggagcuccuaccugcucggcuggaccacguuccugcuguacagcuacgaguccagcgggggcaugcacgaggagugcguguuccccuucaccuacaagggguccgucuacuucacgugcacccacauccacagccucuccccguggugcgccacccgggccguguacaacggccaguggaaguacugccagagcgaggacuacccccgcugcaucuuccccuucaucuaccgggggaaggcguacaacuccugcaucagccagggcuccuuccugggcagccuguggugcuccgugaccagcgucuucgacgagaagcagcaguggaaguucugcgagaccaacgaguacgggggcaacucccuccgcaagcccugcaucuucccgagcaucuaccggaacaacgugguguccgacugcauggaggacgagagcaacaagcuguggugccccaccacggagaacauggacaaggacgggaagugguccuucugcgccgacacccgcaucagcgcccugguccccggcuuccccugccacuucccguucaacuacaagaacaagaacuacuucaacugcaccaacgaggggagcaaggagaaccucguguggugcgccaccuccuacaacuacgaccaggaccacacguggguguacugcuga

SEQ ID NO: 29639 - RNA, 984 nt, Artificial Sequence
  derived and/or modified sequence opt1 from EMB__Homo_sapiens__NP_940851
augcgcgcccugcccggccuccuggaggcccgggcgcgcaccccgcggcugcuccugcugcagugccuccuggccgccgcccgccccagcuccgccgacgggagcgcgcccgacucccccuucaccagcccgccccugcgggaggagaucauggccaacaacuucucccucgagagccacaacaucucccugacggagcacagcuccaugcccguggagaagaacaucacccuggagcgccccagcaacgucaaccugaccugccaguucaccacguccggcgaccucaacgccgugaacgugaccuggaagaaggacggggagcagcuggagaacaacuaccucgucagcgccaccggcuccacccuguacacgcaguaccgguucaccaucaucaacagcaagcagaugggguccuacagcugcuucuuccgcgaggagaaggagcagcggggcaccuucaacuucaaggugccggagcugcacggcaagaacaagccccucaucuccuacgugggggacagcaccguccugacgugcaagugccagaacugcuucccccugaacuggaccugguacuccagcaacggcagcgugaaggugcccgucggggugcagaugaacaaguacgugaucaacggcaccuacgcgaacgagaccaagcucaagaucacgcagcugcuggaggaggacggggaguccuacuggugccgcgcccucuuccagcugggcgagagcgaggagcacaucgagcuggucgugcucuccuaccuggugccgcugaagcccuuccucgucaucguggccgaggugauccugcuggucgccaccauccuccugugcgagaaguacacccagaagaagaagaagcacagcgacgagggcaaggaguucgagcagaucgagcagcugaaguccgacgacagcaacgggaucgagaacaacgugccccggcaccgcaagaacgagucccucggccaguga

SEQ ID NO: 29640 - RNA, 765 nt, Artificial Sequence
  derived and/or modified sequence opt1 from EMC10__Homo_sapiens__NP_778233
auggccgccgcgagcgccggcgccacccgccugcuccugcugcuccugauggccguggccgcgcccagccgggcccgcgggagcggcugccgggccgggaccggcgcccgcggggcgggcgccgagggccgggagggggaggccugcggcacggucgggcugcuccuggagcacuccuucgagaucgacgacagcgccaacuuccgcaagcggggcucccugcucuggaaccagcaggacgggacccugagccugucccagcgccagcucagcgaggaggagcggggccgccugcgggacguggccgcgcugaacggccucuaccgcgugcggaucccccgccggcccggggcccuggacggccuggaggccgggggcuacgucuccagcuucgugcccgccugcucccucguggagagccaccuguccgaccagcugacccuccacgucgacguggccggcaacguggucggggugagcguggucacccaccccggcgggugccgcggccacgagguggaggacguggaccuggagcuguucaacacguccguccagcuccagccgcccaccaccgcgcccgggcccgagaccgccgccuucaucgagcggcuggagauggagcaggcccagaaggccaagaacccgcaggagcagaaguccuucuucgcgaaguacuggcacaucauccugggcggcgccgugcuccugacggcccugcgccccgccgcccccgggcccgcgccgccgccccaggaggccuga

SEQ ID NO: 29641 - RNA, 894 nt, Artificial Sequence
  derived and/or modified sequence opt1 from EMC2__Homo_sapiens__NP_055488
auggccaaggugagcgagcuguacgacgucaccugggaggagaugcgcgacaagaugcggaaguggcgcgaggagaacucccggaacagcgagcagaucguggaggugggcgaggagcucaucaacgaguacgccuccaagcugggggacgacaucuggaucaucuacgagcaggucaugaucgcggcccuggacuacggccgcgacgaccucgcccuguucugccugcaggagcuccggcgccaguuccccgggagccaccgggugaagcgccugaccggcaugcgguucgaggccauggagcgcuacgacgacgccauccagcuguacgaccggauccuccaggaggacccgacgaacaccgcggcccgcaagcggaagaucgccauccgcaaggcccaggggaagaacguggaggcgauccgggagcugaacgaguaccuggagcaguucgucggcgaccaggaggccuggcacgagcucgccgagcuguacaucaacgagcacgacuacgccaaggccgcguucugccuggaggagcucaugaugaccaacccccacaaccaccuguacugccagcaguacgccgaggugaaguacacccagggcgggcuggagaaccucgagcugucccgcaaguacuucgcccaggcccugaagcucaacaaccggaacaugcgcgcccuguucggccuguacaugagcgcgucccacaucgccagcaaccccaaggccuccgccaagacgaagaaggacaacaugaaguacgccagcugggcggccucccagaucaaccgggccuaccaguucgccgggcgcagcaagaaggagaccaaguacucccucaaggccguggaggacaugcuggagacccugcagaucacccagagcuga

SEQ ID NO: 29642 - RNA, 786 nt, Artificial Sequence
  derived and/or modified sequence opt1 from EMC3__Homo_sapiens__NP_060917
auggccggccccgagcugcuccuggacagcaacauccgccugugggugguccucccgaucgugaucaucaccuucuucguggggaugauccggcacuacgucuccauccugcugcagagcgacaagaagcucacccaggagcaggucuccgacagccaggugcugauccgcucccgggugcugcgcgagaacggcaaguacauccccaagcagagcuuccucacgcggaaguacuacuucaacaaccccgaggacggguucuucaagaagaccaagcgcaagguggugcccccgucccccaugaccgaccccaccaugcugacggacaugaugaagggcaacgucaccaacgugcugcccaugauccucaucgggggcuggaucaacaugaccuucagcggcuucgugaccacgaaggucccguucccccugacccugcgguucaagcccaugcuccagcaggggaucgagcugcugacccucgacgccuccugggugagcuccgcgagcugguacuuccugaacguguucggccugcgcuccaucuacagccucauccuggggcaggacaacgccgccgaccagucccggaugaugcaggagcagaugaccggcgccgccauggcgaugcccgccgacacgaacaaggccuucaagaccgagugggaggcccuggagcucaccgaccaccagugggcgcuggacgacgucgaggaggagcugauggccaaggaccuccacuucgaggggauguucaagaaggagcugcagaccagcaucuucuga

SEQ ID NO: 29643 - RNA, 729 nt, Artificial Sequence
  derived and/or modified sequence opt1 from EMC7__Homo_sapiens__NP_064539
auggccgccgcgcuguggggcuucuuccccgugcuccugcugcuccugcugagcggggacguccaguccagcgaggugccgggcgccgccgccgagggguccggcgggagcggcgugggcaucggggaccgcuucaagaucgagggccgggccgucgugcccggggugaagccccaggacuggaucuccgcggcccgcguccucguggacggcgaggagcacgugggguuccugaagaccgacggcagcuucgucgugcacgacauccccuccggcagcuacguggucgaggugguguccccggccuaccgguucgaccccguccgcguggacaucaccagcaaggggaagaugcgggcccgcuacgugaacuacaucaagacguccgaggucgugcggcugcccuacccccuccagaugaaguccagcggcccgcccagcuacuucaucaagcgcgaguccuggggguggaccgacuuccugaugaaccccauggugaugaugaugguccugccccuccugaucuucgugcugcucccgaagguggucaacaccagcgaccccgacaugcggcgcgagauggagcaguccaugaacaugcugaacagcaaccacgagcugcccgacguguccgaguucaugacccgccucuucagcagcaaguccagcggcaaguccagcuccggcagcuccaagacgggcaagagcggggcggggaagcggcgguga

SEQ ID NO: 29644 - RNA, 381 nt, Artificial Sequence
  derived and/or modified sequence opt1 from EMC8__Homo_sapiens__NP_001135760
augcccggcgugaagcugaccacccaggccuacugcaagaugguccuccacggggccaaguacccgcacugcgcggugaacggccugcugguggccgagaagcagaagccccgcaaggagcaccucccccucgggggccccggggcccaccacacgcuguucgucgacugcaucccgcuguuccacggcacccuggcccuggcccccaugcucgagguggcgcugacccugaucgacagcuggugcaaggaccacuccuacgugaucgccggcuacuaccaggccaacgagcgggucaaggacgccagccccaaccagguggcggagaagguggccucccgcaucgccgagggguucagcgacaccgcccucaucauguga

SEQ ID NO: 29645 - RNA, 747 nt, Artificial Sequence
  derived and/or modified sequence opt1 from EMCN__Homo_sapiens__NP_001153166
auggagcugcuccaggugaccauccuguuccugcuccccagcaucugcuccagcaacuccaccggcguccuggaggccgccaacaacagccugguggugacgaccaccaagccguccaucaccacgcccaacaccgagagccuccagaagaacgucgugacccccaccacggggaccacccccaagggcaccaucacgaacgagcugcugaagaugucccucaugagcaccgcgaccuuccugaccuccaaggacgaggggcugaaggccacgaccaccgacgugcgcaagaacgacagcaucaucuccaacgucaccgugacgagcgugacccucccgaacgccgucuccacccugcagagcuccaagcccaagagcuccgugcugcagcccgacgccagccccuccaagaccggcacgcucaccagcaucccggugaccauccccgagaacaccagccagucccaggucaucgggacggagggcggcaagaacgccagcaccuccgcgaccagccgguccuacagcuccaucauccugcccguggugaucgcccugaucgucaucacccucagcguguucgugcuggucgggcuguaccgcaugugcuggaaggccgaccccggcacgccggagaacgggaacgaccagccccaguccgacaaggagagcgugaagcuccugaccgugaagaccaucucccacgagagcggcgagcacuccgcccaggggaagaccaagaacuga

SEQ ID NO: 29646 - RNA, 765 nt, Artificial Sequence
  derived and/or modified sequence opt1 from EMD__Homo_sapiens__NP_000108
auggacaacuacgccgaccugagcgacaccgagcucaccacgcugcugcgccgguacaacaucccccacggcccgguggucggguccacccgccggcucuacgagaagaagaucuucgaguacgagacccagcgccggcgccugagcccgcccuccagcuccgccgcgagcuccuacagcuucuccgaccugaacagcacccggggcgacgccgacauguacgaccuccccaagaaggaggacgcccugcuguaccaguccaagggguacaacgacgacuacuacgaggagagcuacuucacgacccgcaccuacggcgagcccgaguccgccgggcccagccgggccgugcgccaguccgugaccagcuuccccgacgcggacgccuuccaccaccagguccacgacgacgaccuccuguccagcuccgaggaggagugcaaggaccgggagcgccccauguacggccgggacagcgccuaccagagcaucacgcacuaccgcccgguguccgccagccgguccagccuggaccucuccuacuaccccaccagcuccagcaccuccuucaugagcuccagcuccagcuccagcuccuggcugacccgccgggcgauccgccccgagaaccgggcccccggcgccgggcugggccaggaccgccaggugccgcucugggggcagcugcuccuguuccuggucuucgugaucgugcuguucuucaucuaccacuucaugcaggccgaggagggcaaccccuucuga

SEQ ID NO: 29647 - RNA, 1713 nt, Artificial Sequence
  derived and/or modified sequence opt1 from EME1__Homo_sapiens__NP_689676
auggcccugaagaaguccagccccagccucgacuccggcgacagcgacuccgaggagcugccgaccuucgccuuccugaagaaggagcccagcuccaccaagcgccggcagcccgagcgcgaggagaagaucguggucguggacaucagcgacugcgaggcguccugcccgcccgcccccgagcuguucagcccgcccgugcccgagaucgccgagacggucacccagacccagcccgugcggcuccuguccagcgaguccgaggacgaggaggaguucaucccccucgcccagcgccugaccugcaaguuccugacgcacaagcagcucagccccgaggacuccagcuccccggucaagagcgugcuggaccaccagaacaacgagggggccuccugcgacuggaagaagcccuuccccaagauccccgaggugccgcugcacgacacccccgagcggagcgcggccgacaacaaggaccucauccuggaccccugcugccagcugcccgccuaccucagcacgugcccgggccaguccagcucccuggccgugaccaagaccaacagcgacauccugccgccccagaagaagaccaagcccucccagaagguccaggggcgcggcagccacgggugccggcagcagcgccaggcgcggcagaaggaguccacccuccgccggcaggagcgcaagaacgccgcccuggugacccggaugaaggcccagcgccccgaggagugccugaagcacaucaucgugguccucgaccccgugcugcugcagauggagggcggcgggcagcuccugggcgcccugcagacgauggagugccggugcgugaucgaggcgcaggccguccccugcagcgugaccuggcgccggcgcgccgggcccuccgaggaccgggaggacuggguggaggagccgaccguccucgugcugcugcgcgccgaggccuucgugagcaugaucgacaacggcaagcaggggucccucgacagcaccaugaagggcaaggagacgcugcagggcuucgucaccgacaucaccgcgaagaccgccgggaaggcccugucccucgugaucguggaccaggagaagugcuucagcgcccagaacccgccccggcgcggcaagcagggggccaacaagcagacgaagaagcagcagcagcgccagcccgaggcguccaucggcagcauggucucccggguggacgccgaggaggcccuggucgaccugcagcuccacaccgaggcccaggcccagaucgugcagagcuggaaggagcuggcggacuucacgugcgccuucaccaaggccguggccgaggcgcccuucaagaagcugcgcgacgagaccaccuucuccuucugccucgagagcgacugggccggcggggucaagguggaccuggccggccgggggcuggcccucguguggcgccggcagauccagcagcugaaccgcgucagccuggagauggccuccgcgguggugaacgccuaccccagcccccagcuccugguccaggccuaccagcagugcuucuccgacaaggagcggcagaaccugcucgccgacauccaggugcgccggggcgagggggugaccagcaccucccgccggaucggcccggagcugagccgccggaucuaccugcagaugacgacccugcagccccaccucucccuggacagcgccgacuga

SEQ ID NO: 29648 - RNA, 735 nt, Artificial Sequence
  derived and/or modified sequence opt1 from EMG1__Homo_sapiens__NP_006322
auggccgcccccagcgacggcuucaagccgcgcgagcgguccgggggcgagcaggcgcaggacugggacgcccugccgcccaagcgcccccggcucggggccggcaacaagaucgggggccgccggcugaucgugguccuggagggcgccagccucgagaccgugaagguggggaagaccuacgagcugcugaacugcgacaagcacaaguccauccuccugaagaacggccgcgaccccggggaggcccggcccgacaucacgcaccagagccugcucaugcugauggacagcccccugaaccgcgcgggccuccugcaggucuacauccacacccagaagaacgugcugaucgaggugaacccccagacccggaucccgcgcaccuucgaccgguucugcgggcucaugguccagcugcugcacaagcucuccgugcgcgccgccgacggcccccagaagcugcugaaggugaucaagaaccccgucuccgaccacuuccccgugggcugcaugaagguggggacgagcuucuccaucccggucgugagcgacgugcgggagcucguccccuccagcgaccccaucguguucguggucggcgccuucgcgcacgggaagguguccguggaguacaccgagaagauggucagcaucuccaacuacccccugagcgccgcccugaccugcgccaagcucaccacggccuucgaggagguguggggcgugaucuga

SEQ ID NO: 29649 - RNA, 3051 nt, Artificial Sequence
  derived and/or modified sequence opt1 from EMILIN1__Homo_sapiens__NP_008977
auggcgccccgcacccuguggagcugcuaccucugcugccugcugaccgccgccgccggcgccgccuccuacccgccccggggguucagccucuacacgggcuccagcggggcccugucccccggcgggccccaggcgcagaucgccccgcgccccgccagccggcaccgcaacuggugcgccuacguggucacccggaccguguccugcgugcuggaggacggcgucgagaccuacgugaaguaccagcccugcgcguggggccagccccagugcccgcagagcaucauguaccgccgguuccuccgcccccgguaccgcguggccuacaagacggucaccgacauggaguggcggugcugccagggguacggcggggacgacugcgccgagucccccgcccccgcccugggcccggcgagcuccacgccccgcccccuggcccggcccgcccgcccgaaccucagcggguccagcgccggcagcccccuguccggccucgggggcgaggggcccggcgaguccgagaaggugcagcagcuggaggagcagguccagagccugaccaaggagcugcagggccuccgcgggguccugcagggccuguccgggcggcucgccgaggacgugcagcgggcgguggagaccgccuucaacggccgccagcagcccgccgacgccgccgcgcggccggggguccacgagacccugaacgagauccagcaccagcugcagcuccuggacacccgcgugagcacccacgaccaggagcugggccaccucaacaaccaccacggcgggagcuccagcuccggcgggagccgggcccccgcccccgccuccgcgcccccgggccccagcgaggagcugcugcgccagcucgagcagcgccugcaggaguccugcagcgugugccuggccgggcucgacggcuuccggcgccagcagcaggaggaccgggagcgccugcgggccauggagaagcugcucgccuccgucgaggagcgccagcggcaccuggccggccuggcgguggggcgccggccgccccaggagugcugcagccccgagcucggccgccggcuggccgagcuggagcgccggcucgacgugguggccggguccgugacggugcugagcggccgccgggggaccgagcugggcggcgccgccgggcagggcgggcacccgcccggcuacaccucccucgcgagccgccugucccggcuggaggaccgcuucaacagcacccucggccccuccgaggagcaggaggagagcuggcccggggcccccggcgggcugucccacuggcugcccgccgcccggggccgccucgagcagcucgggggccugcuggccaacgucagcggcgagcucgggggccgccuggaccugcuggaggagcaggucgcgggggccaugcaggccugcggccagcugugcagcggggccccgggcgagcaggacucccaggugagcgagauccuguccgcccucgagcggcgcgugcuggacagcgagggccagcugcggcucgugggguccggccugcacacggucgaggcggccggggaggcccgccaggccacccuggagggccuccaggaggugguggggcggcugcaggaccgcgucgacgcgcaggacgagaccgccgccgaguucacccugcggcucaaccugacggccgcccgccugggccagcucgagggccugcugcaggcgcacggggacgagggcugcggggccugcggcggggugcaggaggagcucggccggcugcgcgacggcguggagcggugcagcugcccccugcucccgccccgcgggcccggcgccgggcccggcgucggcgggcccucccggggcccccuggacggguucagcguguucggcggguccagcggcuccgcccugcaggcccuccagggcgagcugagcgaggugauccuguccuucagcucccucaacgacagccugaacgagcugcagaccaccgucgaggggcagggcgcggaccucgccgaccugggggccaccaaggaccgcaucaucuccgagaucaaccggcugcagcaggaggccacggagcacgccaccgagagcgaggagcgcuuccggggccucgaggaggggcaggcgcaggccggccagugcccgagccuggagggccgccuggggcggcucgagggcgugugcgagcgccuggacaccguggccgggggccugcaggggcuccgggagggccugucccgccacgucgccggccugugggcggggcuccgcgagaccaacacgaccagccagaugcaggccgcccugcuggagaagcucgugggcgggcaggccggccugggccggcgccugggggcccucaacuccagccugcagcugcucgaggaccggcugcaccagcugucccucaaggaccugaccggccccgcgggggaggccggcccgcccgggccgcccggccugcagggcccgcccgggcccgccggcccgcccgggagccccggcaaggacgggcaggagggccccaucggcccgcccgggccccagggcgagcaggggguggagggcgcccccgccgcgcccgucccccagguggccuucuccgccgcccucagccugccccgcuccgagcccgggaccgugcccuucgaccggguccugcucaacgacggcggcuacuacgaccccgagacggggguguucaccgccccgcuggcgggccgcuaccugcucagcgccgugcugaccgggcaccggcacgagaaggucgaggccgugcugucccgcagcaaccagggcguggcccgggucgacuccgggggcuacgagcccgagggccucgagaacaagcccguggccgagagccagcccuccccggggacccugggcguguucagccugauccucccccugcaggcgggggacacggucugcguggaccuggugaugggccagcucgcccacuccgaggagccccugaccaucuucagcggcgcccugcucuacggggaccccgagcuggagcacgccuga

SEQ ID NO: 29650 - RNA, 3162 nt, Artificial Sequence
  derived and/or modified sequence opt1 from EMILIN2__Homo_sapiens__NP_114437
auguggcagccccgccggccguggccccgcgugcccuggcggugggcccuggcccuccuggcgcuggucggcgccgggcucugccacgccggcccccagccgggguaccccgcccgccccagcgcccggaacaagaacuggugcgcguacaucgugaacaagaacguguccugcagcguccuggagggcuccgagagcuucauccaggcccaguacaacugcgccuggaaccagaugcccugcccguccgcccugguguaccgcgugaacuuccggccccgcuacgucacccgguacaagaccgugacgcagcucgaguggcgcugcugccccggguuccggggcggcgacugccaggaggggcccaaggacccggugaagacccugcgccccacccccgcgcggccccgcaacagccugaagaaggccaccgacaacgagccgucccaguucagcgagccccggaagacgcucucccccaccggcaccgcccagcccagcuggggggucgacccgaaggagggcccccaggagcugcaggagaagaagauccaggugcuggaggagaaggugcuccgccugacccggacgguccuggaccuccaguccagccuggccgggguguccgagaaccugaagcacgccacccaggacgacgcgagccgcacccgggcccccggccucuccagccagcaccccaagccggacaccacgguguccggcgacaccgagaccgggcagagccccggcgucuucaacaccaaggaguccgggaugaaggacaucaagagcgagcuggccgaggugaaggacacgcugaagaacaagagcgacaagcucgaggagcuggacggcaaggugaagggcuacgaggggcagcugcgccagcuccaggaggccgcccagggccccaccgucaccaugaccacgaacgagcuguaccaggcguacguggacuccaagaucgacgcccugcgggaggagcucauggaggggauggaccgcaagcuggccgaccugaagaacagcugcgaguacaagcucaccggccugcagcagcagugcgacgacuacggguccagcuaccugggcgugaucgagcucaucggcgagaaggagaccucccugcgcaaggagaucaacaaccugcgggcccgccuccaggagcccagcgcccaggcgaacugcugcgacuccgagaagaacggggacaucggccagcagaucaagacccuggaccagaagaucgagcgggucgccgaggccacgcgcaugcugaacgggcggcucgacaacgaguucgaccgccugaucgugccggagcccgacguggacuucgacgccaaguggaacgagcuggacgcccggaucaacgucaccgagaagaacgcggaggagcacugcuucuacaucgaggagacccuccgcggcgccaucaacggggaggugggcgaccugaagcagcuggucgaccagaagauccagagccucgaggaccggcugggcuccgugcugcuccagaugaccaacaacacgggggccgagcugagccccccgggcgccgcggcccugcccgggguguccggcagcggggacgagcgcgucaugauggagcugaaccaccucaaggacaaggugcagguggucgaggacaucugccugcugaacauccagggcaagccccacggcauggagggggcccuccccaaccgggaggaccgcgccgugcgggacucccugcaccugcucaagagccugaacgacaccaugcaccgcaaguuccaggagaccgagcagaccauccagaagcugcagcaggacuucuccuuccucuacagccagcugaaccacacggagaacgacgugacccaccugcagaaggagauguccaacugccgggccggcgagaacgcggggaugggccgcuucaccaaggucggcgagcaggagcggaccguggacacgcucccgagcccccagcaccccguggcccacugcugcucccagcuggaggagcgcuggcagcggcugcagagccaggucaucagcgagcucgacgccugcaaggagugcacccagggggugcagcgcgagguguccauggucgagggccgcgugagccacauggagaagaccugcuccaagcuggacagcaucuccgggaaccugcagcggaucaaggagggccucaacaagcacgugagcucccuguggaacugcguccgccagaugaacgggacccugcggagccacucccgcgacaucagcggccucaagaacuccgugcagcaguucuacagccacguguuccagaucuccaccgaccugcaggaccuggucaaguuccagcccagcgccaaggccccgucccccccccccccggcggaggcccccaaggagccccuccagcccgagccggcccccccccggcccagcggcccggccacggccgaggaccccgggcgccggcccgugcugccccagcgcccgcccgaggagcggcccccgcagccccccggcuccaccggggugaucgcggagaccggccaggccgggcccccggccggcgccggcgucagcgggcgcggccugccccgggggguggacggccagaccgggagcggcacggugcccggcgcggagggguucgccggcgcccccggguacccgaaguccccccccgucgccagccccggcgccccggugcccucccucgugagcuucuccgcggggcugacccagaagcccuuccccagcgacggcggcgucgugcuguucaacaaggugcucgucaacgacggggacguguacaacccguccaccggcguguucaccgcccccuacgacgggcgcuaccugaucacggccacccugacccccgagcgggacgccuacgucgaggccgugcucagcguguccaacgcgagcgucgcccagcugcacaccgccggcuaccgccgggaguuccuggaguaccaccgccccccgggcgcccuccacacgugcgggggccccggggccuuccaccugaucgugcaccugaaggcgggcgacgccgugaacgucguggugaccgggggcaagcucgcccacaccgacuucgacgagauguacuccaccuucagcggcgucuuccuguaccccuuccugucccaccucuga

SEQ ID NO: 29651 - RNA, 2301 nt, Artificial Sequence
  derived and/or modified sequence opt1 from EMILIN3__Homo_sapiens__NP_443078
augggccgccggcgccugcucguguggcugugcgccgucgccgcgcugcucagcggggcccaggcccggggcacgccccugcuggcccgcccggccccgcccggggcgucccgguacagccucuacaccaccggcuggcgcccccggcugcgccccgggccccacaaggcccugugcgccuacguggugcaccggaacgucacgugcauccuccaggagggcgccgaguccuacgugaaggcggaguaccgccagugccgguggggccccaagugccccgggaccgugaccuaccgcacgguccugcggccgaaguacaaggugggcuacaagaccgugaccgaccuggccuggcgcugcugccccggguucaccggcaagcggugccccgagcaccucacggaccacggggccgccagcccccagcuggagccggagccccagauccccuccggccagcuggaccccggcccgcgcccgcccagcuacucccgggccgcgcccagcccccacgggcgcaagggccccggccucuucggcgagcggcuggagcgccuggagggcgacguccagcggcucgcccagaccuacgggacccuguccggccugguggccagccacgaggaccccaaccgcaugaccgggggcccccgcgccccggccgugcccgucggguucggcgugauccccgagggccucguggggcccggcgaccgggcgcgcgggccgcugacgccgccccuggacgagauccucuccaaggucaccgaggugagcaacacccugcagaccaaggugcagcugcucgacaaggugcacgggcuggcccuggggcacgaggcccaccuccagcggcugcgcgaggccccgcccagcccccugaccucccucgcccugcuggaggaguacguggaccggcgccuccaccggcuguggggcucccugcucgacggcuucgagcagaagcugcagggggugcagagcgagugcgaccugcgcguccaggaggugcggcgccagugcgaggagggccaggcggccucccggcgccuccaccagagccuggacgggcgggagcuggcccuccgccaggagcugucccagcugggcagccagcuccaggggcugagcguguccggccggggcagcugcugcgggcagcuggcccugaucaacgcccgcauggacggccucgagcgggcgcugcaggccgucaccgagacccagcgcgggcccggcgcccccgccggcgacgagcugacccggcucuccgcggccaugcuggagggcgggguggacgggcugcucgagggccuggagacgcugaacgggaccgagggcggcgcccgcgggugcugccuccgccuggacaugggcggguggggcgucgggggcuucggcaccaugcuggaggagcgggugcagagccucgaggagcgccuggccacccuggccggggagcucucccacgacagcgcgucccccggccggagcgcccgcccccuggugcagacggagcuggccguccucgagcagcggcuggugucccuggagaccagcugcacccccuccaccacgagcgccauccucgacucccugguggccgaggucaaggcguggcagagccgcuccgaggcccugcuccgccagguggccagccacgccgcccugcugcagcagcucaacgggaccguggcggagguccagggccagcuggccgaggggaccggcuccagccugcagggcgagaucacccuccugaaggugaaccugaacuccgugagcaagagccucacggggcuguccgacagcgucucccaguacagcgacgccuuccuggccgcgaacaccucccucgacgagcgggagcggaagguggaggccgaggugcaggccauccaggagcaggucagcucccagggcagccgccugcaggccgggcaccgccaggugcugaaccuccggggcgagcuggagcagcugaaggccgggguggcgaaggucgccuccggccucagccggugccaggacaccgcccagaagcugcagcacaccgugggccacuucgaccagcgcguggcccaggucgagggggccugccggcgccugggccuccuggcggccgggcuggacucccucccgacggagccccugcggccccgcgagggccuguggagccacguggaccagcucaaccggacccuggcccagcacacccaggacaucgcccgccugcgggacgaccuccuggacugccaggcccagcuggcggagcagguccgccccggccaggccaacuga

SEQ ID NO: 29652 - RNA, 2505 nt, Artificial Sequence
  derived and/or modified sequence opt1 from EML1__Homo_sapiens__NP_001008707
auggaggacggcuucagcuccuacagcucccuguacgacaccagcucccuccugcaguucugcaacgacgacagcgccuccgccgcgagcuccauggaggugaccgaccgcaucgccagccuggagcagcggguccagaugcaggaggacgacauccagcuccugaaguccgcccuggccgacguggugcgccggcucaacaucacggaggagcagcaggccguccugaaccgcaaggggcccaccaaggcgcggccgcugaugcagacccucccccugcgcaccacggugaacaacggcaccgugcugcccaagaagcccaccgggagccucccgucccccagcggcguccggaaggagaccgccgugcccgccacgaagcgccugaaccgguccgugagccugcucaacgccugcaagcugaaccgcuccacccccagcaacaucaagcggaccuccagcagcgagcgcgucucccccgggggccggcgcgagagcaacggcgacucccgggggaaccgcaaccggaccggcagcacguccagcuccagcuccgggaagaagaacagcgaguccaagccgaaggagcccguguucagcgcggaggagggcuacgugaagauguuccugcgcgggcggcccgucaccauguacaugccgaaggaccagguggacuccuacagccucgaggccaagguggagcugcccaccaagcgccugaagcucgagugggucuacggcuaccggggccgcgacugccgcaacaaccuguaccugcuccccaccggggagacgguguacuucaucgccuccguggucgugcuguacaacguggaggagcagcugcagcggcacuacgccggccacaacgacgacgucaagugccucgccgugcaccccgaccgcaucaccaucgcgaccggccagguggccgggaccagcaaggacggcaagcagcugccgccccacguccggaucugggacuccgugacgcugaacacccuccacgucaucgggaucggcuucuucgaccgcgccgugaccugcaucgccuucagcaaguccaacgggggcaccaaccugugcgccguggacgacagcaacgaccacguccugagcgugugggacuggcagaaggaggagaagcucgcggacgugaagugcuccaacgaggccgucuucgccgccgacuuccaccccacggacaccaacaucaucgugaccugcggcaagagccaccuguacuucuggacccuggagggguccagccucaacaagaagcagggccuguucgagaagcaggagaagcccaaguucgugcugugcgucacguucuccgagaacggggacaccaucaccggcgacagcuccgggaacauccucguguggggcaaggggaccaaccggaucagcuacgccgugcagggcgcgcacgagggcgggaucuucgcccugugcaugcugcgcgacggcacgcucgucuccgggggcgggaaggaccggaagcugaucagcugguccggcaacuaccagaagcugcgcaagaccgagaucccggagcaguucggccccauccggaccguggccgaggggaagggcgacgugauccucaucgggaccacgcgcaacuucguccugcagggcacccugagcggcgacuucacccccaucacccaggggcacaccgacgagcucuggggccuggccauccacgccuccaagagccaguuccugacgugcgggcacgacaagcacgcgacccugugggacgccgugggccaccggcccgugugggacaagaucaucgaggacccggcccaguccagcggguuccaccccuccggcagcgucguggccgugggcacccucaccgggcgcugguucgucuucgacacggagaccaaggaccuggugaccgugcacaccgacggcaacgagcagcugagcgucaugcgguacucccccgacgggaacuuccucgcgaucggcagccacgacaacugcaucuacaucuacgggguguccgacaacggccgcaaguacacgcgggugggcaagugcagcgggcacuccagcuucaucacccaccuggacugguccgucaacagccaguuccugguguccaacagcggcgacuacgagauccucuacugggugcccuccgccugcaagcaggucgugagcguggagaccacccgcgacaucgagugggccacguacacgugcacccugggguuccacgucuucggcguguggccggagggguccgacggcaccgacaucaacgccgugugccgggcccacgagaagaagcugcucagcaccggcgacgacuucgggaagguccaccuguucuccuaccccugcagccaguuccgcgcgcccucccacaucuacggcgggcacagcucccacgugaccaacguggacuuccugugcgaggacagccaccucaucagcaccggcgggaaggacaccuccaucaugcaguggcgggucaucuga

SEQ ID NO: 29653 - RNA, 2553 nt, Artificial Sequence
  derived and/or modified sequence opt1 from EML2__Homo_sapiens__NP_001180197
augcuggagcgccgggcccuccuguggcagcgcgaggccggccccggguggggcgaccgggcgcgcgccgggaccggcggggccggcggcgggugcggcggggccauggccgagcggggcccggcguucugcgggcuguacgacaccagcucccuccugcgcuacugcaacgacgacaaccugagcggcacguccggcauggagguggacgaccgggucagcgcccucgagcagcgccugcagcugcaggaggacgagcucgccgugcugaaggccgcgcuggccgacgcccuccggcgccugcgggccugcgaggagcagggggccgcgcugcgcgcccggggcacccccaaggggcgcgccccgccccggcucggcaccaccgccuccgugugccagcugcugaagggccuccccacgcgcacgccccugaacgggagcggcccgccccggcgcgucgggggcuacgccaccucccccagcucccccaagaaggaggcgaccagcgggcgguccagcgugcgccgguaccugucccccgagcgccucgccagcgugcgccgggaggacccccgcucccggaccaccagcuccagcuccaacugcagcgccaagaaggagggcaagaccaaggaggucaucuucagcguggaggacggcuccgugaagauguuccugcgcgggcggccgguccccaugaugauccccgacgagcuggcccccaccuacagccucgacacgcgcuccgagcugccgagcugccggcugaagcucgaguggguguacggcuaccgcgggcgggacugccgcgccaaccuguaccugcuccccaccggcgagaucguguacuucgucgcguccguggccgugcuguacagcgucgaggagcagcggcagcgccacuaccuggggcacaacgacgacaucaagugccucgccauccaccccgacauggugaccaucgccaccggccagguggccggcacgaccaaggaggggaagccccugccgccccacguccggaucugggacuccgugagccuguccacccuccacgugcugggccugggggucuucgaccgcgcggugugcugcgugggcuucagcaaguccaacgggggcaaccuccugugcgccgucgacgagagcaacgaccacaugcuguccgugugggacugggccaaggagaccaaggucguggacgugaagugcagcaacgaggccguccucguggcgacguuccaccccaccgaccccaccgugcugaucacgugcggcaagucccacaucuacuucuggacccuggagggcgggagccucuccaagcggcaggggcuguucgagaagcacgagaagccgaaguacguccugugcgugaccuuccucgagggcggcgacguggucaccggggacagcggcgggaaccuguacguguggggcaagggcgggaaccgcaucacccaggccgugcugggcgcccacgacgggggcgucuucgggcugugcgcccuccgggacggcacgcugguguccgggggcggccgcgaccggcgcgugguccugugggggagcgacuacagcaagcuccaggagguggaggugcccgaggacuucggccccguccgcaccguggccgaggggcacggcgacacccuguacguggggaccacgcggaacuccauccugcagggcagcguccacaccggcuucucccuccuggugcaggggcacguggaggagcuguggggccucgcgacccaccccagccgcgcccaguucgugaccugcgggcaggacaagcugguccaccugugguccagcgacucccaccagccgcucuggagccggaucaucgaggaccccgcccgcuccgccggcuuccaccccagcggguccgugcuggccgucggcacggugaccggccgguggcugcuccuggacaccgagacccacgaccugguggcgauccacaccgacgggaacgagcagaucagcgucguguccuucagcccggacggcgccuaccucgccguggggucccacgacaaccuggucuacguguacacgguggaccagggcggccgcaaggucagccggcuggggaagugcuccggccacagcagcuucaucacccaccucgacugggcccaggacuccagcugcuucgugaccaacuccggggacuacgagauccuguacugggaccccgcgaccugcaagcagaucacgagcgccgacgccgugcgcaacauggagugggccaccgcgaccugcguccugggcuucgggguguucggcaucugguccgagggcgccgacgggaccgacaucaacgccguggcccggagccacgacggcaagcuccuggccuccgccgacgacuucgggaagguccaccuguucagcuaccccugcugccagccccgcgcgcucucccacaaguacggcgggcacagcucccacgugacgaacguggccuuccugugggacgacagcauggcccugaccaccggcggcaaggacaccuccguccuccaguggcgggugguguga

SEQ ID NO: 29654 - RNA, 2772 nt, Artificial Sequence
  derived and/or modified sequence opt1 from EML4__Homo_sapiens__NP_001138548
auggacggcuucgccgggagccuggacgacuccaucagcgccgcguccaccagcgacgugcaggaccgccucuccgcccuggagagccggguccagcagcaggaggacgagaucaccgugcugaaggccgcccucgccgacgugcugcgccggcuggcgaucuccgaggaccacgucgccagcgugaagaaguccgugagcuccaagggccagcccagcccgcgcgccgucauccccauguccugcaucacgaacgggagcggcgccaaccggaagcccucccacaccagcgcgguguccaucgccgggaaggagacccucagcuccgccgccaagagcaucaagcgccccagcccggccgagaagucccacaacagcugggagaacuccgacgacagccggaacaagcuguccaagauccccagcacccccaagcugauccccaaggugacgaagaccgcggacaagcacaaggacgucaucaucaaccaggagggcgaguacaucaagauguucaugcgcggccggccgaucaccauguucauccccuccgacguggacaacuacgacgacauccgcaccgagcucccgcccgagaagcugaagcuggagugggccuacggguaccggggcaaggacugccgcgccaacguguaccuccugcccacgggggagaucgucuacuucaucgccagcguggugguccuguucaacuacgaggagcggacccagcgccacuaccucggccacaccgacugcgugaagugccuggccauccaccccgacaagauccggaucgcgaccgggcagaucgccggcguggacaaggacggccgcccccugcagccccacguccgggugugggacuccgugacgcucagcacccugcagaucaucgggcugggcaccuucgagcgcggggucggcugccucgacuucuccaaggccgacagcggcgugcaccugugcgugaucgacgacuccaacgagcacaugcugaccgucugggacuggcagaagaaggccaagggggccgagaucaagacgaccaacgaggugguccucgcgguggaguuccacccgaccgacgccaacaccaucaucacgugcggcaagagccacaucuucuucuggaccugguccgggaacagccugacccggaagcagggcaucuucgggaaguacgagaagcccaaguucgugcagugccuggccuuccucggcaacggcgacguccugaccggggacuccggcggggugaugcugaucuggagcaagacgaccguggagcccacccccggcaaggggccgaagggcgucuaccagaucuccaagcagaucaaggcccacgacggcagcguguucacccucugccagaugcgcaacgggaugcugcugacgggcgggggcaaggaccggaagaucauccucugggaccacgaccugaaccccgagcgcgagaucgaggugcccgaccaguacgggaccauccgcgccgucgcggagggcaaggccgaccaguuccuggugggcaccagccggaacuucauccuccgcgggaccuucaacgacggcuuccagaucgaggugcaggggcacacggacgagcuguggggccuggccacccaccccuucaaggaccuccugcugaccugcgcccaggaccggcaggucugccucuggaacuccauggagcaccgccuggaguggacccggcugguggacgagccgggccacugcgcggacuuccaccccagcgggacgguggucgccaucggcacccacuccgggcgcugguucgugcucgacgccgagacccgggaccuggugagcauccacaccgacggcaacgagcagcuguccgucaugcgcuacagcaucgacgggaccuuccucgccgugggcucccacgacaacuucaucuaccuguacguggucagcgagaacggccggaaguacucccgcuacgggcggugcacgggccacagcuccuacaucacccaccuggacuggagccccgacaacaaguacaucauguccaacagcggggacuacgagauccuguacugggacauccccaacggcugcaagcucauccgcaaccgguccgacugcaaggacaucgacuggaccaccuacacgugcgugcugggguuccagguguucggcgucuggccggagggcagcgacgggaccgacaucaacgcccuggugcgcucccacaaccggaaggugaucgcggucgccgacgacuucugcaaggugcaccucuuccaguaccccugcagcaaggccaaggcccccagccacaaguacuccgcccacagcucccacgugaccaacgucagcuucacccacaacgacucccaccugaucagcacgggcgggaaggacauguccaucauccaguggaagcugguggagaagcucagccugccgcagaacgagaccguggcggacaccacccugacgaaggcccccgucuccagcaccgaguccgugauccagagcaacacccccacgcccccgcccucccagccccucaacgagaccgccgaggaggagagccgcaucuccagcucccccacccugcuggagaacagccucgagcagaccguggagccguccgaggaccacagcgaggaggagagcgaggagggcuccggggaccugggcgagccccuguacgaggagcccugcaacgagaucagcaaggagcaggccaaggccacccuccuggaggaccagcaggaccccuccccgagcuccuga

SEQ ID NO: 29655 - RNA, 5934 nt, Artificial Sequence
  derived and/or modified sequence opt1 from EML5__Homo_sapiens__NP_899243
auggccgcccgcagcgcgcccagcugccaccuccgccucgaguggguguacggcuaccgcgggcaccagugccggaacaaccuguacuacaccgccgccaaggagaucgucuacuucguggccggcgugggggucguguacagcccgcgcgagcaccggcagaaguucuaccgcggccacuccgacgacaucaucagccuggcccuccaccccgagcgggugcuggucgccaccggccaggugggcaaggagcccuacaucugcaucugggacuccuacaccgugcagaccaucagcguccugaaggacgugcacacccacggcaucgccugccucgccuucgaccuggacgggcagcgccugguguccgucggccucgacagcaagaacgccgugugcgugugggacuggaagcgggggaagaugcuguccauggcgcccggccacaccgaccgcaucuucgacaucagcugggaccuguaccagccgaacaagcucgucuccugcggggugaagcacaucaaguucuggagccugugcggcaacgcccugacgcccaagcggggcguguucgggaagaccggcgaccuccagaccauccugugccuggccugcgcccgcgacgagcucaccuacuccggggcccugaacggcgacaucuacgucuggaagggcaucaaccugauccggacgauccagggggcgcacgccgccggcaucuucagcaugaacgccugcgaggagggguucgccaccggcgggcgcgacggcugcauccggcucugggaccugaccuucaagcccaucaccgugaucgaccugcgcgagacggaccagggcuacaaggggcucuccgugcggagcgucugcuggcgcggcgaccacauccugguggggacccaggacuccgagaucuucgagaucgugguccaggagcggaacaagcccuuccugaucaugcagggccacugcgagggggagcucugggcgcuggccgugcacccgaccaagccccuggccgucaccggcagcgacgaccgcuccgugcggaucuggagccucguggaccacgcccugaucgcccgcugcaacauggaggagcccauccgcugcgcggccgucaacgccgacggcauccaccuggcccucgggaugaaggacggcagcuucacggugcugcgggugcgcgacaugaccgaggucgugcacaucaaggaccggaaggaggccauccacgagcugaaguacucccccgacgggaccuaccucgcggugggcugcaacgacagcuccgucgacaucuacgggguggcccagcgcuacaagaaggugggcgagugccugggcagccuguccuucaucacccaccucgacuggagcuccgacagccgguaccugcagacgaacgacgggaacggcaagcgccuguucuaccggaugcccggcgggaaggaggucaccuccaccgaggagaucaagggggugcacugggccagcuggaccugcguguccgggcucgaggucaacggcaucuggcccaaguacagcgacaucaacgacaucaacuccguggacgggaacuacaucggccaggugcuggucacggccgacgacuacgggaucaucaagcuguuccgcuaccccugccuccggaagggcgcgaaguuccgcaaguacaucggccacagcgcccacgugaccaacgugcgguggucccacgacuaccagugggucaucagcaucgggggcgccgaccacuccguguuccaguggaaguucauccccgagcgcaagcugaaggacgccgugcacaucgccccgcaggagagccuggcggacucccacagcgacgagagcgacuccgaccucagcgacguccccgagcuggacuccgagaucgagcaggagacccagcugaccuaccggcgccagguguacaaggaggaccugccccagcucaaggagcagugcaaggagaagcagaaguccgccacguccaagcggcgcgagcgggcccccgggaacagcauccgccugcacuucgugcacggcuaccggggguacgacugccgcuccaaccuguucuacacccagaucggcgagaucgucuaccacguggccgccgugggcgucaucuacaaccgccagcagaacacccagcgguucuaccucgggcacgacgacgacauccugugccugaccauccacccgcucaaggacuacguggcgacgggccagguggggcgcgaccccagcauccacaucugggacaccgagaccaucaagccccuguccauccugaagggccaccaccaguacggggucagcgccguggacuucuccgccgacggcaagcggcucgccagcgugggcaucgacgacucccacaccgucgugcugugggacuggaagaagggggagaagcugagcaucgcccgcggcuccaaggacaagaucuucguggucaagaugaaccccuacgugccggacaagcucaucacggcggggaucaagcacaugaaguucuggcggaaggccggcgggggccugaucggccgcaagggguacaucggcacccuggggaagaacgacaccaugaugugcgccguguacggcuggaccgaggagauggccuucagcggcaccuccacgggggacgucugcaucuggcgggacaucuuccucgugaagaccgugaaggcgcacgacggccccgucuucagcaugcacgcccuggagaagggguucgugaccggcgggaaggacggcaucguggcccugugggacgacagcuucgagcgcugccucaagaccuacgccaucaagcgggccgcgcuggcccccggcuccaaggggcugcuccuggaggacaaccccagcauccgcgccaucucccugggccacgggcacauccucgucggcacgaagaacggggagauccuggagguggacaagagcggcccgaucacccugcucgugcagggccacauggagggggaggucuggggccuggccacccaccccuaccugcccaucugcgccaccguguccgacgacaagacgcuccggaucugggaccugagcccgucccacugcaugcuggcgguccgcaagcucaagaagggcgggcggugcugcugcuucagccccgacgggaaggcccuggccgugggccugaacgacggcuccuuccucauggccaacgccgacacccuggaggaccuggugagcuuccaccaccgcaaggacaugaucuccgacauccgguucagccccggguccggcaaguaccucgcggucgccagccacgacuccuucaucgacaucuacaacgugaugagcuccaagcgcguggggaucugcaagggcgccaccagcuacaucacccacaucgacugggacauccggggcaagcugcugcaggucaacacgggggccaaggagcagcuguucuucgaggcgccccgcggcaagaagcagaccaucccguccguggagguggagaagaucgccugggccagcuggaccagcguccuggggcugugcugcgagggcaucuggcccgugaucggggaggugaccgacgucacggccuccugccucaccagcgacaagauggugcuggccaccggcgacgaccugggcuucgugaagcuguuccgguaccccaccaaggggaaguucggcaaguucaagcgcuacgucgcgcacuccacgcacgugaccaacgugcgguggaccuacgacgacagcaugcuggucacccucggcgggacggacaugucccucaugguguggaccaacgagauggagggguaccgcgagaagcgccccugcgacagcgaggaguccgacaucgacagcgaggaggacgggggcuacgacuccgacgugacccgggagaacgagaucagcuacaccauccgcgcccuguccacgaacauccggccgaugcuggggaucaagccccaccuccagcagaaggagcccagcaucgacgagcgccagggcgucgugcgggggucccggccgcccgugagccgggcgccgccccagcccgagaagcugcagaccaacaacgucggcaagaagaagcgcccgaucgaggaccuggugcucgagcugaucuucggguaccggggccgcgacugccggaacaacgugcacuaccugaacgacggcgacgacaucaucuaccacaccgccuccgucgggauccuccacaacguggccaccggcagccaguccuucuaccaggagcacaacgacgacauccugugccugacggugaaccagcaccccaaguucaucaacaucgucgcgaccggccaggugggggacagcgccgacauguccgccaccgcccccagcauccacaucugggacgccaugaacaagcagacccucagcauccugcgcugcuaccacuccaagggggugugcagcgucuccuucagcgcgacgggcaagcugcuccuguccgugggccuggaccccgagcacaccaucaccaucuggcgguggcaggagggggccaagaucgccagccgcgccggccacaaccagcggaucuucguggccgaguuccgcccggacuccgacacccaguucgucagcgugggggugaagcacgucaaguucuggacccucgcgggccgggcccugcuguccaagaagggccuccugagcacgcuggaggacgcccgcaugcagaccaugcucgccaucgcguucggggccaacaaccugaccuucaccggcacgaucuccggggacgugugcguguggaaggaccacauccugugccggaucgucgcccgcgcccacaacggccccguguucgccauguacaccacccuccgcgacgggcugaucgugaccggcggcaaggagcggcccagcaaggagggcggcgcggucaagcugugggaccaggagcuccgccggugccgcgccuuccggcuggagacggggcaggccaccgacugcgugcgcuccgugugccggggcaaggggaagauccuggucggcacccgcaacgccgagaucaucgaggugggcgagaagaacgccgcgugcaacauccucgugaacgggcacgucgacggccccaucugggggcuggccacccacccgagccgggacuucuuccuguccgccgccgaggacggcacggugcgccucugggacaucgccgacaagaagaugcugaacaaggucaaccuggggcacgcggcccggaccgugugcuacagccccgagggcgacaugguggccaucggcaugaagaacggggaguucaucauccuccuggucuccagccugaagaucuggggcaagaagcgcgaccggcgcugcgccauccacgacauccgguucucccccgacagccgcuaccucgcgguggggagcuccgagaacagcguggacuucuacgaccugacccugggcccgacccugaaccggaucuccuacugcaaggacauccccagcuucgucauccagauggacuucuccgccgacagcuccuaccuccaggugagcuccgggugcuacaagcgccacguguacgagguccccagcggcaagcaccugauggaccacgccgccaucgaccggaucacgugggccaccuggaccuccauccugggcgacgaggugcucgggaucuggagccgccacgcggagaaggccgacgugaacugcgccugcgucucccacagcggcaucucccuggugaccggggacgacuucggcauggugaagcuguucgacuuccccugcccggagaaguucgccaagcacaagcgguuccucggccacagcccccacgucacgaacauccgcuucaccuccggggaccgccacguggugagcgccggcggggacgacugcucccuguucgucuggaagugcgugcacacgccccacuga

SEQ ID NO: 29656 - RNA, 5877 nt, Artificial Sequence
  derived and/or modified sequence opt1 from EML6__Homo_sapiens__NP_001034842
auggccgaccgcaccgcgccccggugccagcugcgccucgaguggguguacggcuaccgggggcaccagugccgcaacaaccucuacuacaccgccggcaaggaggugguguacuucguggccggggugggcgugguguacaacacgcgggagcacagccagaaguucuuccuggggcacaacgacgacaucaucucccucgcccugcaccccgacaagacccuggucgccaccggccaggugggcaaggagcccuacaucugcaucugggacagcuacaacgugcagaccgucucccuccugaaggacgugcacacgcacgggguggccugccuggccuucgacagcgacggccagcgccucgccuccgucgggcuggacgccaagaacaccgugugcaucugggacuggcggaagggcaagcugcucgccagcgcgaccgggcacuccgaccgcaucuucgacaucagcugggaccccuaccagcccaaccggguggucuccugcggcgugaagcacaucaaguucuggacccugugcggcaacgcccugacggccaagcgcgggaucuucggcaagaccggggaccuccagaccauccugugccuggccugcgccaaggaggacaucaccuacagcggcgcgcucaacggcgacaucuacguguggaaggggcugaaccugguccggacgauccagggcgcccacuccgccgggaucuucagcauguacgccugcgaggagggcuucgccaccgggggccgcgacggcugcauccggcucugggacaccgacuucaagcccaucaccaagaucgaccugcgcgagacggagcagggguacaagggccuguccauccggagcgugugcuggaaggcggaccgccuccuggccgggacccaggacuccgagaucuucgaggugaucguccgggagcgcgacaagcccaugcugauccuccagggccacugcgagggggagcugugggcccuggcccuccaccccaagaagccccuggccgugaccggcagcgacgaccgguccgugcgccuguggagccucgcggaccacgcccugaucgcccggugcaacauggaggaggccguccgcuccguggccuucagcccggacggcagccagcuggcgcucgggaugaaggacggcuccuucaucguccugcgcgugcgggacaugaccgaggugguccacaucaaggaccgcaaggaggugauccacgagaugaaguucagccccgacggguccuaccuggccgugggcagcaacgacgggcccgucgacguguacgccguggcccagcgguacaagaagaucggcgagugcuccaagagccucuccuucaucacgcacaucgacuggagccuggacuccaaguaccugcagaccaacgacggcgcgggggagcgccucuucuaccggaugcccagcggcaagccgcugaccuccaaggaggagaucaaggggauccccugggccagcuggaccugcgucaagggccccgagguguccggcaucuggcccaaguacacggaggugaccgacaucaacagcgucgacgccaacuacaacuccagcgugcugguguccggggacgacuucggccucgucaagcuguucaaguucccgugccugaagcgcggggccaaguuccggaaguacgugggccacagcgcccacgugaccaacguccgcuggucccacgacuuccagugggugcucagcaccgggggcgcggaccacagcguguuccaguggcgguucauccccgagggcgucuccaacgggaugcuggagacggcgccccaggagggcggggccgacagcuacuccgaggagagcgacuccgaccugagcgacgugcccgagcuggacuccgacaucgagcaggaggcccagaucaacuacgaccgccagguguacaaggaggaccucccgcagcugaagcagcagagcaaggagaagaaccacgccguccccuuccugaagcgggagaaggcgcccgaggacucccucaagcugcaguucauccacggcuaccgcggguacgacugccggaacaaccuguucuacacccaggccggcgaggugguguaccacaucgccgccgucgccgugguguacaaccgccagcagcacagccagcggcucuaccugggccacgacgacgacauccugucccucaccauccaccccgucaaggacuacguggcgaccggccaggugggccgcgacgccgccauccacgucugggacacgcagacccugaagugccugagccuccugaaggggcagcaccagcggggcgugugcgcccuggacuucuccgcggacgggaagugccucgugagcgucggccuggacgacuuccacuccaucguguucugggacuggaagaagggcgagaagaucgccaccacccgcgggcacaaggacaagaucuucguggucaagugcaacccgcaccacguggacaagcuggugacggucggcaucaagcacaucaaguucuggcagcaggccgggggcggguucaccagcaagcggggcaccuucggcuccguggggaagcucgagaccaugaugugcgugagcuacggccgcauggaggaccuggucuucagcggggccgccaccggcgacaucuucaucuggaaggacauccugcuccugaagacggugaaggcgcacgacggccccguguucgccauguacgcccuggacaagggguucgucaccggcgggaaggacggcaucguggagcucugggacgacauguucgagcgcugccugaagaccuacgccaucaagcgguccgcccugagcaccuccagcaaggggcuccugcuggaggacaaccccuccauccgcgcgaucacgcucggccacggccacauccugguggggaccaagaacggcgagauccuggagaucgacaagagcgggcccaugacccuccugguccagggccacauggagggggagguguggggccuggccgcccacccgcuccugcccaucugcgccaccgucuccgacgacaagacgcugcggaucugggagcucagcgcccagcaccgcaugcuggcggugcggaagcugaagaagggcgggcgcugcugcgccuucucccccgacggcaaggcccucgccguggggcugaacgacggcagcuuccuggucgugaacgcggacaccguggaggacauggucuccuuccaccaccggaaggagaugaucagcgacaucaaguucuccaaggacaccgggaaguaccucgccguggccagccacgacaacuucguggacaucuacaacguccugaccuccaagcgcgugggcaucugcaagggcgccagcuccuacaucacgcacaucgacugggacagccgggggaagcugcuccaggugaacuccggcgcccgcgagcagcuguucuucgaggcgccgcgggggaagcgccacaucauccggcccagcgagaucgagaagaucgagugggacaccuggaccugcguccugggcccgaccugcgagggcaucuggcccgcccacagcgacaucacggacgugaacgccgccucccucaccaaggacugcagccugcuggccaccggggacgacuucggcuucgugaagcuguucuccuacccggucaaggggcagcacgcgcgcuucaagaaguacgugggccacagcgcccacgugaccaacguccgguggcugcacaacgacuccgugcugcucacggucggcggggccgacaccgcccugaugaucuggacccgcgaguucgucgggacccaggagagcaagcugguggacuccgaggagagcgacacggacguggaggaggacgggggcuacgacuccgacgucgcccgggagaaggcgaucgacuacaccaccaagaucuacgccgugagcauccgcgagauggaggggaccaagccccaccagcagcucaaggagguguccgucgaggagcggccgcccgugagccgcgccgccccgcagcccgagaagcugcagaagaacaacaucacgaagaagaagaagcugguggaggagcucgcccuggaccacgucuucggcuaccggggguucgacugccgcaacaaccugcacuaccucaacgacggcgcggacaucaucuuccacaccgccgccgccggcaucgugcagaaccuguccaccgggagccaguccuucuaccuggagcacaccgacgacauccucugccugacggugaaccagcaccccaaguaccgcaacgucguggcgaccagccagaucggcaccacccccuccauccacaucugggacgccaugacgaagcacacccugagcaugcuccggugcuuccacuccaagggggugaacuacaucaacuucagcgccaccggcaagcugcuggucagcguggggguggacccggagcacaccaucaccgucuggcgcuggcaggagggcgccaagguggccucccggggcgggcaccucgagcgcaucuucguggucgaguuccggcccgacagcgacacgcaguucguguccgugggcgucaagcacaugaaguucuggacccuggcggggagcgcccugcucuacaagaagggcgugaucgggucccugggcgccgccaagaugcagaccaugcugagcguggccuucggcgcgaacaaccucaccuucacgggggccaucaacggcgacgucuacguguggaaggaccacuuccugauccgccugguggccaaggcccacaccgggcccgucuucaccauguacaccacgcuccgggacggccugaucgugaccggcgggaaggagcgccccaccaaggagggcggggccgucaagcugugggaccaggagaugaagcggugccgcgcguuccagcucgagaccggccagcugguggagugcgugcgguccgucugccgcgggaagggcaagauccuggugggcacgaaggacggggagaucaucgaggugggcgagaagaacgccgccagcaacauccucaucgacgggcacauggagggcgagaucugggggcuggccacccacccguccaaggaccuguucaucagcgcguccaacgacggcaccgcccggaucugggaccucgccgacaagaagcugcugaacaaggucagccugggccacgccgcccgcugcgcggccuacucccccgacggggagaugguggccaucggcaugaagaacggggaguucgugauccuccuggucaacagccugaagguguggggcaagaagcgggaccgcaaguccgccauccaggacauccggaucagccccgacaaccgcuuccucgccgugggguccagcgagcacaccgucgacuucuacgaccugacgcagggcaccaaccugaaccggaucggcuacugcaaggacauccccuccuucgugauccagauggacuucagcgcggacgggaaguacauccaggugagcaccggcgccuacaagcgccagguccacgaggugccgcucgggaagcaggucaccgaggccgucgugaucgagaagaucacgugggccuccuggaccagcgugcugggcgacgaggucaucgggaucuggccccgcaacgccgacaaggcggacgugaacugcgccugcgugacccacgccggccugaacaucgucaccggcgacgacuucgggcucgugaagcuguucgacuuccccugcacggagaaguucgccaagcacaagcgguacuucggccacuccgcgcacgugaccaacauccgcuucagcuacgacgacaaguacgucguguccaccgggggcgacgacugcagcguguucgucuggcggugccuguga

SEQ ID NO: 29657 - RNA, 474 nt, Artificial Sequence
  derived and/or modified sequence opt1 from EMP1__Homo_sapiens__NP_001414
augcuggugcuccuggccggcaucuucgucgugcacaucgccaccgugaucaugcuguucgucagcaccaucgcgaacguguggcucguguccaacacggucgacgccagcguggggcuguggaagaacugcaccaacaucuccugcagcgacucccugagcuacgccuccgaggacgcccucaagaccgugcaggccuucaugauccugagcaucaucuucugcgucaucgcgcugcucguguucguguuccagcuguucaccauggagaagggcaaccgcuucuuccuguccggggccacgacccucgucugcuggcugugcauccuggugggcgugagcaucuacaccucccacuacgccaaccgggacgggacccaguaccaccacggcuacagcuacauccucggcuggaucugcuucugcuucuccuucaucaucgggguccuguaccuggugcuccgcaagaaguga

SEQ ID NO: 29658 - RNA, 504 nt, Artificial Sequence
  derived and/or modified sequence opt1 from EMP2__Homo_sapiens__XP_006720927
augcuggugcuccuggccuucaucaucgccuuccacaucaccagcgcggcccuccuguucaucgccaccgucgacaacgccuggugggugggcgacgaguucuucgccgacguguggcgcaucugcacgaacaacaccaacugcaccgucaucaacgacuccuuccaggaguacagcacccugcaggcggugcaggccacgaugauccuguccaccauccucugcugcaucgccuucuucaucuucgugcugcagcuguuccggcucaagcagggggagcgcuucguccugaccagcaucauccagcugauguccugccucugcgugaugaucgccgcgagcaucuacaccgaccggcgcgaggacauccacgacaagaacgccaaguucuaccccgugacgcgggagggcuccuacggguacagcuacauccuggccugggucgccuucgccugcaccuucaucuccggcaugauguaccugauccuccgcaagcggaaguga

SEQ ID NO: 29659 - RNA, 873 nt, Artificial Sequence
  derived and/or modified sequence opt1 from EMX1__Homo_sapiens__NP_004088
augugccuggccggcugcacgccccgcaaggccgcggccccggggcggggcgcccucccccgcgcccggcugccccgcaccgcccccgcggccgccaccauguuccagccggccgcgaagcggggguucaccaucgagagccugguggccaaggacggcgggaccggcggcgggaccggcgggggcggggccggcucccaccuccuggccgccgcggccagcgaggagccccugcgccccacggcccucaacuacccccacccguccgccgccgaggcggccuucgucagcggcuuccccgccgccgccgcggccggggccggccggucccuguacgggggccccgagcugguguuccccgaggccaugaaccacccggcccucaccgugcaccccgcgcaccagcugggcgccagcccccugcagcccccgcacuccuucuucggggcccagcaccgcgacccccuccacuucuaccccuggguccugcggaaccgcuucuucggccaccgguuccaggccagcgacgugccccaggacgggcugcuccugcacggcccguucgcgcgcaagcccaagcggauccgcaccgccuucucccccagccagcugcuccggcuggagcgcgccuucgagaagaaccacuacguggucggggccgagcggaagcagcuggccggcucccucagccuguccgagacccaggugaaggugugguuccagaaccgccggacgaaguacaagcgccagaagcuggaggaggagggccccgagagcgagcagaagaagaaggggucccaccacaucaaccgguggcgcaucgcgaccaagcaggccaacggcgaggacaucgacgucaccagcaacgacuga

SEQ ID NO: 29660 - RNA, 510 nt, Artificial Sequence
  derived and/or modified sequence opt1 from EMX2__Homo_sapiens__NP_001159396
auguuccagcccgccccgaagcgcugcuucaccaucgagagccugguggccaaggacagcccccuccccgcgucccgguccgaggaccccauccgcccggccgcccugagcuacgccaacuccagccccaucaaccccuuccugaacggcuuccacuccgccgcggccgccgccgcggggcggggcgucuacagcaaccccgaccucguguucgccgaggccgugucccacccgcccaaccccgccguccccgugcacccggugcccccgccccacgcccuggcggcccacccccugcccagcucccacagcccccacccccucuucgccucccagcagcgcgacccgagcaccuucuaccccuggcugauccaccgguaccgcuaccuggggcaccgguuccagggcaaguccauggucagcgagcccaagaacaaggugcagaaggccgaggccgggggccgccggcuccgcuucgcgacgaaggagaagcgggacgcccccuacuga

SEQ ID NO: 29661 - RNA, 1179 nt, Artificial Sequence
  derived and/or modified sequence opt1 from EN1__Homo_sapiens__NP_001417
auggaggagcagcagcccgagcccaagagccagcgcgacuccgcccugggcgccgcggccgccgccacccccgggggccucagccugucccugagccccggggccuccggcagcuccgggagcggcuccgacggcgacagcgugcccgucuccccgcagcccgcgccgcccagcccgcccgccgcccccugccugcccccgcucgcccaccacccccaccucccgccccacccgcccccgccgccgccccagcaccuggcggcccccgcccaccagccccagcccgccgcccagcugcaccggaccacgaacuucuucaucgacaacauccugcgccccgacuucgggugcaagaaggagcagcccccgccccagcuccugguggcggccgccgcccggggcggggccggcgggggcggccgcguggagcgggaccgcgggcagaccgcggccggccgggaccccguccacccccuggggacccgcgcccccggcgccgccucccuccugugcgcgcccgacgccaacugcggcccgcccgacgggagccagcccgccgccgccggcgcgggggccuccaaggccggcaaccccgccgcggccgccgccgccgcggccgccgccguggccgcggccgccgccgccgcggccgccaagcccagcgacaccgggggcggcggguccggcgggggcgccgggagccccggcgcgcagggcacgaaguaccccgagcacgggaaccccgccauccugcucaugggcuccgccaacgggggccccguggucaagaccgacagccagcagccccugguguggccggccuggguguacugcacccgguacagcgaccgccccuccagcgggccccggacccgcaagcugaagaagaagaagaacgagaaggaggacaagcggccccgcacggccuucaccgcggagcagcuccagcggcugaaggccgaguuccaggccaaccgcuacaucaccgagcagcggcgccagacccuggcccaggagcucucccugaacgagagccagaucaagaucugguuccagaacaagcgggccaagaucaagaaggcgacgggcaucaagaacggccuggcccuccaccugauggcccaggggcuguacaaccacuccaccaccaccguccaggacaaggacgagagcgaguga

SEQ ID NO: 29662 - RNA, 1002 nt, Artificial Sequence
  derived and/or modified sequence opt1 from EN2__Homo_sapiens__NP_001418
auggaggagaacgaccccaagccgggcgaggccgccgcggccguggaggggcagcgccagcccgagagcucccccggcgggggcagcgggggcggcgggggcuccagccccggggaggccgacaccggccggcgccgggcccugaugcucccggccguccugcaggcgcccgggaaccaccagcacccccaccgcaucaccaacuucuucaucgacaacauccugcggcccgaguucggccgccggaaggacgccggcacgugcugcgccggggccggcgggggccgcggcgggggcgccgggggcgagggcggggcguccggcgccgagggcgggggcggggccgggggcagcgagcagcuccugggcuccgggagccgggagccgcgccagaacccgcccugcgcccccggcgccgggggcccccugcccgcggccggguccgacagccccggcgacggcgagggcggguccaagacccucagccugcacgggggcgccaagaagggcggggaccccggcgggccgcuggacggcucccucaaggcccgggggcugggcggcggggaccugagcguguccagcgacuccgacagcucccaggcgggcgccaaccucggggcccagcccaugcuguggcccgccuggguguacugcacccgcuacagcgaccggcccagcuccggcccgcgcagccggaagcccaagaagaagaaccccaacaaggaggacaagcgcccccggaccgccuucacggcggagcagcugcagcgccucaaggccgaguuccagaccaaccgguaccugaccgagcagcgccggcagucccuggcccaggagcucagccugaacgagucccagaucaagaucugguuccagaacaagcgcgccaagaucaagaaggccaccgggaacaagaacacgcuggcgguccaccucauggcccagggccuguacaaccacagcaccaccgccaaggagggcaaguccgacagcgaguga

SEQ ID NO: 29663 - RNA, 1776 nt, Artificial Sequence
  derived and/or modified sequence opt1 from ENAH__Homo_sapiens__NP_001008493
augagcgagcaguccaucugccaggcccgcgccgcggugauggucuacgacgacgccaacaagaagugggugcccgccggcgggagcaccggcuucucccgggugcacaucuaccaccacaccgggaacaacacguuccgcgucgugggccggaagauccaggaccaccagguggucaucaacugcgccaucccgaaggggcugaaguacaaccaggccacccagaccuuccaccaguggcgcgacgcgcggcagguguacggccucaacuucggcagcaaggaggacgccaacguguucgccuccgccaugaugcacgcgcuggagguccugaacagccaggagaccgggcccacgcucccccgccagaacucccagcugcccgcccaggugcagaacggcccgagccaggaggagcuggagauccagcggcgccagcuccaggagcagcagcggcagaaggagcuggagcgcgagcggcuggagcgcgagcggauggagcgcgagcggcucgagcgcgagcggcuggagcgcgagcggcuggagcgcgagcggcucgagcaggagcagcuggagcgcgagcgccaggagcgggagcgccaggagcggcuggagcgccaggagcggcucgagcgccaggagcggcuggagcgccaggagcggcuggaccgcgagcggcaggagcgccaggagcgggagcgccucgagcggcuggagcgcgagcggcaggagcgcgagcggcaggagcagcuggagcgcgagcagcucgagugggagcgcgagcggcgcaucuccagcgccgccgcccccgcguccguggagaccccccugaacagcguccugggggacuccagcgccuccgagcccggccuccaggccgccagccagccggccgagacccccucccagcaggggaucgugcugggcccccuggcgcccccgcccccccccccgcucccccccggccccgcccaggccagcguggcccugccgcccccccccgggccgcccccccccccgccccugcccuccaccggcccgcccccccccccgcccccccccccgcuccccaaccaggucccccccccgcccccccccccgcccgcccccccccugccggcgagcggguucuuccuggccagcauguccgaggacaaccggccccucacgggccuggccgccgccaucgcgggcgccaagcugcgcaaggugagccggauggaggacaccuccuuccccagcgggggcaacgccaucggggugaacuccgccagcuccaagaccgacaccggccgcgggaacggcccccucccgcugggcgggagcggccugauggaggagauguccgcgcuccuggcccggcgccggcgcaucgccgagaaggggagcacgaucgagaccgagcagaaggaggacaagggcgaggacuccgagcccgucaccagcaaggccuccagcaccuccacgcccgagccgacccggaagcccugggagcgcaccaacaccaugaacgggagcaagucccccgugaucagccggcgcgacuccccccggaagaaccagaucguguucgacaaccgcagcuacgacagccugcaccggccgaaguccacgccccucagccagcccuccgccaacggcguccagaccgagggccuggacuacgaccgccugaagcaggacauccucgacgagaugcggaaggagcugaccaagcugaaggaggagcucaucgacgcgauccgccaggagcugagcaaguccaacaccgccuga

SEQ ID NO: 29664 - RNA, 3429 nt, Artificial Sequence
  derived and/or modified sequence opt1 from ENAM__Homo_sapiens__NP_114095
augcuggugcuccgcugccggcugggcaccagcuuccccaagcuggacaaccucgucccgaaggggaagaugaagauccugcugguguuccucggccugcuggggaacuccguggccaugcccaugcacaugccccgcaugcccggcuucagcuccaagagcgaggagaugaugcgguacaaccaguucaacuucaugaacgggccgcacauggcccaccucggccccuucuucggcaacgggcugccccagcaguucccccaguaccagaugccgauguggccccagcccccgcccaacaccuggcacccccgcaaguccagcgcgcccaagcggcacaacaagacggaccagacccaggagacccagaagcccaaccagacccaguccaagaagccgccccagaagcgcccccugaagcagcccagccacaaccagccgcagcccgaggaggaggcccagccgccccaggccuucccgcccuucggcaacggccucuuccccuaccagcagccgcccuggcagaucccccagcggcugcccccgcccggcuacgggcgcccgcccaucuccaacgaggagggcggcaaccccuacuucggguacuucggcuaccacggguucggcggccggccgcccuacuacagcgaggagauguucgagcaggacuucgagaagcccaaggaggaggacccgcccaaggccgagucccccgggacggagcccaccgccaacagcaccgucaccgagacgaacuccacccagcccaaccccaagggcagccagggcgggaacgacaccucccccaccgggaacagcacgcccggccugaacaccggcaacaacccgcccgcgcagaacgggaucggcccccuccccgccgugaacgccuccgggcagggcgggcccggcagccagauccccuggcgccccucccagcccaacauccgggagaaccacccguaccccaacauccgcaacuuccccagcggccggcagugguacuucaccgggaccgugaugggccaccgccagaaccggccguucuaccgcaaccagcagguccagcgggggccccgcuggaacuucuucgccugggagcggaagcaggucgcgcgccccggcaaccccguguaccacaaggccuacccgcccacgagccgggggaacuaccccaacuacgccgggaaccccgccaaccugcgccgcaagccgcagggccccaacaagcaccccguggggaccaccguggcgccccugggcccgaagcccgggcccgugguccggaacgagaagauccagaaccccaaggagaagccgcucggccccaaggagcagaucaucgugcccaccaagaaccccacguccccguggcgcaacagccagcaguacgaggugaacaaguccaacuacaagcugccccacagcgagggcuacaugcccguccccaacuucaacuccguggaccagcacgagaacagcuacuacccgcgcggggacucccgcaaggugcccaacagcgacggccagacccagucccagaaccugcccaaggggaucguccucggcagccggcgcaugcccuacgaguccgagaccaaccagagcgagcugaagcacuccagcuaccagccggccguguaccccgaggagauccccuccccggccaaggagcacuuccccgccgggcggaacaccugggaccaccaggagaucagcccgcccuucaaggaggaccccggccgccaggaggagcaccucccccaccccucccacggcagccggggguccguguucuaccccgaguacaacccguacgacccccgcgagaacagccccuaccugcggggcaacacgugggacgagcgcgacgacagccccaacaccauggggcagaaggaguccccgcuguaccccaucaacacccccgaccagaaggagaucguccccuacaacgaggaggacccgguggaccccaccggcgacgagguguuccccgggcagaaccgguggggcgaggagcugagcuucaagggcgggcccacgguccgccacuacgagggcgagcaguacaccuccaaccagccgaaggaguaccuccccuacagccuggacaaccccuccaagccccgggaggacuucuacuacagcgaguucuacccguggucccccgacgagaacuuccccagcuacaacaccgccuccaccaugcccccgcccaucgagagccgcggguacuacgugaacaacgccgcgggccccgaggaguccacgcuguucccgagccggaacuccugggaccaccgcauccaggcccaggggcagcgggagcgccgccccuacuucaaccggaacaucugggaccaggccacccaccuccagaaggcccccgcccggcccccggaccagaagggcaaccagcccuacuacagcaacacccccgcgggccugcagaagaaccccaucuggcacgagggggagaaccugaacuacggcaugcagaucacccggaugaacuccccggagcgcgagcacagcuccuuccccaacuucaucccgcccagcuaccccagcgggcagaaggaggcccaccucuuccaccugucccagcggggcagcugcugcgccggguccagcacgggccccaaggacaacccccuggcccuccaggacuacacccccuccuacggccuggccccgggggagaaccaggacaccagcccccuguacaccgacggcucccacaccaagcagacgcgcgacaucaucagccccaccuccauccuccccgggcagcggaacagcuccgagaagcgcgagagccagaacccguuccgggacgacgucuccacccugcgccggaacacccccugcagcaucaagaaccagcugggccagaaggagaucaugcccuuccccgaggcguccagccuccaguccaagaacacgccgugccugaagaacgaccugggcggggacggcaacaacauccucgagcaggucuucgaggacaaccagcugaacgagcgcaccguggaccugacccccgagcagcucgugaucgggacccccgacgagggcagcaacccggaggggauccagucccaggugcaggagaacgagagcgagcggcagcagcagcgccccagcaacauccugcaccuccccugcuucggcuccaagcuggccaagcaccacagcuccacgaccggcacccccagcuccgacgggcggcagagcccguucgacggcgacuccaucacccccacggagaaccccaacacccugguggagcuggccaccgaggagcaguucaagagcaucaacgucgacccccuggacgccgacgagcacuccccguucgaguuccuccagcgcgggaccaacgugcaggaccaggugcaggacugccugcugcuccaggcguga

SEQ ID NO: 29665 - RNA, 1770 nt, Artificial Sequence
  derived and/or modified sequence opt1 from ENC1__Homo_sapiens__XP_011541999
augagcguguccguccacgagaaccgcaagagccgggccuccagcggcuccaucaacaucuaccuguuccacaagagcuccuacgccgacagcgugcugacccaccugaaccugcuccgccagcagcggcuguucaccgacgugcugcuccacgcggggaaccgcacguuccccugccaccgggccguccuggccgccugcucccgcuacuucgaggccauguucagcggcgggcugaaggagucccaggacagcgaggugaacuucgacaacuccauccacccggaggugcucgagcugcugcucgacuacgcguacagcucccgggucaucaucaacgaggagaacgccgagagccugcuggaggccggcgacaugcucgaguuccaggacauccgcgacgccugcgcggaguuccuggagaagaaccugcaccccaccaacugccucgggaugcugcugcucuccgacgcccaccagugcaccaagcuguacgagcugagcuggcggaugugccucuccaacuuccagaccauccgcaagaacgaggacuuccugcagcugccccaggacaugguggugcagcuccugagcagcgaggagcuggagacggaggacgagcggcucgucuacgaguccgccaucaacuggaucagcuacgaccugaagaagcgcuacugcuaccugcccgagcuccugcagaccgugcggcuggcccuccugccggccaucuaccugauggagaacguggcgauggaggagcucaucaccaagcagcgcaaguccaaggagaucgucgaggaggccauccggugcaagcugaagauccugcagaacgacggcguggugaccagccucugcgcccgcccccggaagacgggccacgcccuguuccugcucgggggccagaccuucaugugcgacaagcuguaccuggucgaccagaaggccaaggagaucauccccaaggcggacauccccuccccgcgcaaggaguucagcgccugcgccaucgggugcaagguguacaucaccggcgggcggggcuccgagaacggcgugagcaaggacgucuggguguacgacacccuccacgaggagugguccaaggccgcccccaugcugguggcgcgcuucgggcacggcagcgccgagcugaagcacugccuguacgucgugggcgggcacacggccgccaccggcugccuccccgccucccccagcgugucccugaagcaggucgagcacuacgacccgaccaucaacaaguggaccaugguggcgccccugcgggagggggucagcaacgccgccgugguguccgccaagcucaagcuguucgcguucggcgggacgagcgucucccacgacaagcugcccaaggugcagugcuacgaccagugcgagaaccgcuggaccgugcccgcgaccugcccgcagcccuggcgcuacaccgccgccgccguccucggcaaccagaucuucaucaugggcggggacacggaguucagcgccugcuccgccuacaaguucaacagcgagaccuaccaguggaccaaggugggcgacgugaccgccaagcggaugagcugccacgccgucgccuccgggaacaagcuguacguggugggcggguacuucggcauccagcgcugcaagacgcuggacugcuacgaccccacccucgacgucuggaacagcaucaccaccgugcccuacucccugaucccgacggcguucgugagcaccuggaagcaccuccccuccuga

SEQ ID NO: 29666 - RNA, 894 nt, Artificial Sequence
  derived and/or modified sequence opt1 from ENDOG__Homo_sapiens__NP_004426
augcgcgcccugcgggccggccucacccuggcgagcggggccggccugggggccguggucgagggcuggcgccggcgccgggaggacgcccgcgccgcgcccgggcuccugggccggcugccggugcuccccguggccgccgccgcggagcugccgcccgucccgggcgggccccgcggccccggggagcuggccaaguacggccuccccgggcuggcccagcugaagucccgggagagcuacgugcucugcuacgacccgcgcacccggggcgcccuguggguggucgagcagcugcgccccgagcggcuccgcggcgacggggaccggcgcgagugcgacuuccgggaggacgacuccgugcacgccuaccaccgcgcgacgaacgccgacuaccggggcagcggguucgaccgcggccaccuggccgccgccgcgaaccaccgguggucccagaaggccauggacgacaccuucuaccugagcaacguggcgccccaggucccccaccucaaccagaacgccuggaacaaccuggagaaguacucccgcagccugacccgcuccuaccagaacguguacgugugcaccggcccccucuuccugccccggacggaggccgacggcaagagcuacgucaaguaccaggugaucgggaagaaccacguggccguccccacccacuucuucaaggugcugauccucgaggccgccgggggccagaucgagcugcgcaccuacgugaugcccaacgccccggucgacgaggccaucccccuggagcgguuccucgugcccaucgaguccaucgagcgcgcgagcgggcugcuguucgugcccaacauccucgcccgggccggcucccugaaggccaucaccgcgggcagcaaguga

SEQ ID NO: 29667 - RNA, 1233 nt, Artificial Sequence
  derived and/or modified sequence opt1 from ENDOU__Homo_sapiens__NP_001165910
augcgcgccugcaucagccuggugcucgccguccugugcggccuggcgugggccgggaagaucgaguccugcgccagccggugcaacgagaaguucaaccgcgacgccgccugccagugcgaccggcgcugccucuggcacggcaacugcugcgaggacuacgagcaccugugcaccgaggaccacaaggaguccgagccccugccgcagcucgaggaggagaccgaggaggcgcuggccagcaaccuguacuccgcccccacgagcugccaggggcggugcuacgaggccuucgacaagcaccaccagugccacugcaacgcgcgcugccaggaguucggcaacugcugcaaggacuucgagucccucugcagcgaccacgaggugucccacagcuccgacgccaucaccaaggaggagauccagagcaucuccgagaagaucuaccgggccgacaccaacaaggcccagaaggaggacaucgugcugaacagccagaacugcaucucccccagcgagacccgcaaccaggucgaccggugccccaagccgcuguucacguacgugaacgagaagcuguucuccaagcccaccuacgccgcguucaucaaccuccugaacaacuaccagcgcgccaccgggcacggcgagcacuucagcgcccaggagcucgccgagcaggacgccuuccugcgggagaucaugaagaccgcggugaugaaggagcuguacuccuuccuccaccaccagaaccgcuacggcagcgagcaggaguucgucgacgaccugaagaacaugugguucgggcuguacagccggggcaacgaggagggggacuccagcggcuucgagcacguguucuccggggaggugaagaagggcaaggucacgggcuuccacaacuggauccgcuucuaccucgaggagaaggaggggcugguggacuacuacagccacaucuacgacggccccugggacuccuaccccgacgugcuggccaugcaguucaacugggacggguacuacaaggaggucggcagcgccuucaucggcuccagcccggaguucgaguucgcccucuacucccugugcuucaucgcccggcccgggaaggugugccagcugagccucggcggguacccccuggcggugcgcaccuacaccugggacaaguccaccuacggcaacgggaagaaguacaucgccacggccuacaucgucagcuccaccuga

SEQ ID NO: 29668 - RNA, 714 nt, Artificial Sequence
  derived and/or modified sequence opt1 from ENDOV__Homo_sapiens__NP_001158109
auggcccuggaggccgcgggcgggcccccggaggagacccucagccuguggaagcgcgagcaggcccggcugaaggcccacguggucgaccgcgacaccgaggccuggcagcgggaccccgccuucuccggccuccagcgcgucgggggcguggacgugagcuucgugaagggggacuccgugcgggcgugcgccagccuggucgugcuguccuuccccgagcucgaggugcugcuggucgacggcaacggcgugcuccaccaccgcggguucggcguggccugccaccuggggguccugaccgaccuccccugcgugggcguggccaagaagcugcugcaggucgacgggcucgagaacaacgcgcugcacaaggagaagauccggcugcuccagacccgcggcgacagcuucccgcugcugggcgacuccgggaccgugcucggcauggcccugcggagccacgaccgcuccacccggccccuguacaucagcguggggcaccgcaugucccucgaggccgccguccggcugacgugcugcugcugccgcuuccggauccccgagcccgugcgccaggccgacaucugcagccgggagcacauccgcaagucccugggccucccgggcccgcccacgccccggagccccaaggcgcagcgccccguggccugccccaagggggacuccggcgagagcuccgcccugugcuga

SEQ ID NO: 29669 - RNA, 2232 nt, Artificial Sequence
  derived and/or modified sequence opt1 from ENGASE__Homo_sapiens__NP_001036038
auggaggccgccgcggugaccgucacccgcagcgccacgcggcgccggcgccggcagcugcagggccucgccgcccccgaggccgggacccaggaggagcaggaggaccaggagccgcgcccccggcgccggcgccccggccgguccaucaaggacgaggaggaggagaccguguuccgcgagguggucagcuucucccccgacccgcugcccgugcgguacuacgacaaggacaccacgaagcccaucagcuucuaccuguccagccucgaggagcugcuggcguggaagccccgccucgaggacggguucaacguggcccuggagccgcuggccugccggcagccgccccucuccagccagcgcccccggacccugcugugccacgacaugaugggcggguaccucgacgaccgcuucauccagggcuccgucgugcagaccccguacgccuucuaccacuggcagugcaucgacguguucgucuacuucagccaccacaccgugacgaucccgcccgugggcuggaccaacaccgcgcaccggcacggggucugcgugcugggcaccuucaucacggaguggaacgagggcgggcgccugugcgaggccuuccucgccggggacgagcgguccuaccaggccguggccgaccgccugguccagaucacccaguucuuccgcuucgacggcuggcugaucaacaucgagaacagccucucccuggcggccgugggcaacaugccgcccuuccugcgguaccucaccacccagcugcaccgccaggugcccgggggccugguccucugguacgacagcguggugcaguccgggcagcugaaguggcaggacgagcugaaccagcacaaccgggucuucuucgacagcugcgacggcuucuucacgaacuacaacuggcgcgaggagcaccucgagcggaugcugggccaggccggggagcgccgggccgacguguacgugggcgucgacguguucgcccgcgggaacgucgugggcgggcgguucgacaccgacaagucccuggagcucauccgcaagcacggcuucagcguggcgcuguucgcccccggcugggucuacgagugccuggagaagaaggacuucuuccagaaccaggacaaguucugggggcggcucgagcgcuaccugcccacccacuccaucugcagccugcccuucgugaccagcuucugccucggcaugggggcccggcgcgugugcuacggccaggaggaggccgucgggcccugguaccaccuguccgcccaggagauccagccccuguucggcgagcaccggcucggcggggacggccgcgggugggugcggacgcacugcugccuggaggacgcguggcacggcgggagcucccugcucgugcgcggcgucaucccgcccgaggugggcaacguggccguccggcuguucagccugcaggcccccgugccgcccaagaucuaccucuccaugguguacaagcuggaggggcccaccgacgucaccguggcccuggagcucaccacgggcgacgccgggagcugccacaucggcggcaucuccgugcugaacgcggagaccagcucccgccacagccugcgcccccugcgggugcccccgaccaagcucgcccgcugggucgggcggugcggccgccagcuguccgggggcugggugcagcacugcuacgaggucagccugcgggggugccuccugcuggaccuccuggugugcuucucccgcccgcccggcagccgggaggaggaguccuucacgugccgccugggcgagauccagguggucgacgccgccagccuccuggcgccccugccccaggugcaggccgugaccaucucccacauccgguggcagcccagcgccuccgagcgcgaggggccgcccgcccuccugcagcugagcugcacccuccacuggagcuuccugcugucccagguccggugcuuccgcauccacugcuggggcgggaugagcgacgacucccccggccgggagcucccccgccccgagaugcccauguuccuggggcuggccuucgcgacccaguaccggaucguggaccuccugguggaggccgccggccccggccaggaccgccggauggaguuccuggucgagcccgugcccaaggagggguuccgcgugccccaggccgaguggggccgggccguccuccuguacagcgcgccggccuga

SEQ ID NO: 29670 - RNA, 1878 nt, Artificial Sequence
  derived and/or modified sequence opt1 from ENG__Homo_sapiens__NP_000109
auggaccgcggcacccugccccucgccguggcccugcugcucgcgagcugcucccugagccccaccucccuggccgagacgguccacugcgaccuccagcccguggggcccgagcggggcgaggugaccuacaccaccagccaggucuccaaggggugcguggcccaggcccccaacgccauccuggaggugcacguccuguuccucgaguucccgacgggccccagccagcuggagcugacccuccaggcguccaagcagaacgggaccuggccccgcgaggugcugcuggugcucagcgucaacuccagcguguuccugcaccuccaggcccugggcaucccccugcaccuggccuacaacuccagccucgugaccuuccaggagccgcccggcgucaacacgaccgagcugcccuccuuccccaagacccagauccuggagugggccgcggagcgggggccgaucaccagcgccgccgagcucaacgacccccaguccauccugcugcgccucggccaggcccaggggagccuguccuucugcaugcuggaggccagccaggacaugggccggacgcucgaguggcgcccccggacccccgcgcuggugcgcgggugccaccuggagggcguggccggccacaaggaggcccacauccuccggguccugccggggcacuccgccggcccccgcaccgugaccgugaaggucgagcugagcugcgcccccggggaccucgacgcggugcugauccugcaggggcccccguacgugagcuggcucaucgacgccaaccacaacaugcagaucuggacgaccggcgaguacuccuucaagaucuuccccgagaagaacauccggggguucaagcugcccgacacgccccagggccugcucggggaggcccgcaugcugaacgccagcaucgucgccuccuucguggagcugccgcucgcgagcaucgugucccugcacgccagcuccugcggcgggcggcugcagaccagccccgcccccauccagaccacgcccccgaaggacacgugcucccccgagcuccugaugagccugauccagaccaagugcgccgacgacgccaugacccugguccucaagaaggagcugguggcgcaccugaagugcaccaucaccggccucaccuucugggaccccuccugcgaggccgaggaccgcggcgacaaguucguccugcggagcgccuacuccagcugcgggaugcaggucuccgccagcaugaucuccaacgaggcgguggugaacauccugagcuccagcagcccgcagcgcaagaaggugcacugccucaacauggacucccugagcuuccagcugggccucuaccugagcccccacuuccugcaggccuccaacaccaucgagcccgggcagcaguccuucgugcagguccgggugagccccuccgugagcgaguuccuccugcagcuggacuccugccaccucgaccugggcccggagggcggcaccgucgagcugauccagggccgcgccgccaaggggaacugcgugagccuccugucccccagccccgagggcgacccccgguucuccuuccugcuccacuucuacaccgugccgauccccaagaccgggacgcugagcugcaccgucgcccugcgccccaagaccggcucccaggaccaggaggugcaccggaccguguucaugcgccucaacaucaucagccccgaccuguccgggugcacgagcaagggccugguccucccggcggugcugggcaucaccuucggggccuuccugaucggcgcccuccugaccgccgcccugugguacaucuacagccacacccgcgaguacccccggccgccccaguga

SEQ ID NO: 29671 - RNA, 231 nt, Artificial Sequence
  derived and/or modified sequence opt1 from ENHO__Homo_sapiens__NP_940975
augggcgccgccaucagccagggggcccugaucgccaucgugugcaacggccucgucggguuccugcugcuccugcugugggugauccucugcugggccugccacucccgcagcgccgacguggacucccugagcgaguccagccccaacuccagcccgggccccugccccgagaaggcgcccccgccccagaagcccucccacgaggggagcuaccugcuccagcccuga

SEQ ID NO: 29672 - RNA, 1305 nt, Artificial Sequence
  derived and/or modified sequence opt1 from ENO2__Homo_sapiens__NP_001966
augagcaucgagaagaucugggcccgcgagauccuggacucccggggcaaccccaccguggaggucgaccucuacaccgccaaggggcuguuccgcgcggccgugccgagcggcgccuccacggggaucuacgaggcccuggagcuccgggacggcgacaagcagcgcuaccuggggaagggcgugcugaaggccgucgaccacaucaacagcaccaucgcgcccgcccucaucuccagcggccuguccgugguggagcaggagaagcuggacaaccucaugcuggagcuggacgggaccgagaacaagagcaaguucggcgccaacgccauccucggggucucccuggcggugugcaaggccggcgccgccgagcgggagcugccccucuaccgccacaucgcccagcuggcggggaacagcgaccugauccuccccgugccggccuucaacgucaucaacggcggcucccacgccgggaacaagcuggccaugcaggaguucaugauccugcccgugggcgccgagagcuuccgggacgcgaugcgccucggggccgagguguaccacacccugaagggcgucaucaaggacaaguacggcaaggacgccacgaacgugggggacgagggcggguucgcccccaacauccuggagaacuccgaggcccucgagcuggugaaggaggcgaucgacaaggccggcuacaccgagaagaucgucaucgggauggacguggccgccagcgaguucuaccgggacggcaaguacgaccuggacuucaagucccccaccgacccgagccgcuacaucaccggcgaccagcucggggcccuguaccaggacuucgugcgggacuaccccgucguguccaucgaggaccccuucgaccaggacgacugggcggccuggagcaaguucacggccaacgugggcauccagaucgucggggacgaccugaccgugaccaaccccaagcgcaucgagcgggccguggaggagaaggcgugcaacugccuccugcugaaggucaaccagaucggcuccgugaccgaggccauccaggccugcaagcucgcccaggagaacggguggggcgucauggugagccaccgcagcggcgagacggaggacaccuucaucgccgaccugguggucgggcugugcaccggccagaucaagaccggggcgccgugccgguccgagcgccucgccaaguacaaccagcugaugcggaucgaggaggagcugggcgacgaggcccgcuucgccgggcacaacuuccggaaccccagcgugcucuga

SEQ ID NO: 29673 - RNA, 1176 nt, Artificial Sequence
  derived and/or modified sequence opt1 from ENO3__Homo_sapiens__NP_001180432
auggccaugcagaagaucuucgcccgcgagauccuggacagccggggcaaccccaccguggaggucgaccuccacaccgcgaaggggcgcuuccgggccgccgugccguccggcgccagcacggggaucuacgaggcccuggagcugcgcgacggcgacaaggggcgguaccucggcaaggcgaaguucggcgccaacgccauccugggggugucccuggccgucugcaaggcgggcgccgccgagaagggggugccccucuaccgccacaucgccgaccuggccggcaaccccgaccugauccuccccgugccggcguucaacgucaucaacgggggcagccacgccggcaacaagcuggccaugcaggaguucaugauccugcccgugggggccuccagcuucaaggaggccaugcggaucggcgcggagguguaccaccaccucaagggggucaucaaggccaaguacggcaaggacgccaccaacgugggcgacgagggcggguucgcccccaacauccuggagaacaacgaggcccuggagcuccugaagaccgcgauccaggccgccggguaccccgacaagguggucaucggcauggacguggccgccuccgaguucuaccgcaacgggaaguacgaccuggacuucaagagcccggacgaccccgcgcggcacaucaccggcgagaagcucggcgagcuguacaaguccuucaucaagaacuaccccguggucagcaucgaggaccccuucgaccaggacgacugggccacguggaccuccuuccugagcggggugaacauccagaucgugggcgacgaccucaccgucaccaacccgaagcgcaucgcccaggccguggagaagaaggcgugcaacugccugcugcucaaggugaaccagaucggguccgucacggagagcauccaggccugcaagcuggcccaguccaacggcuggggcgugauggugagccaccgguccggggagaccgaggacaccuucaucgccgaccuggucgugggccucugcaccgggcagaucaagacgggcgcccccugccgcagcgagcggcuggcgaaguacaaccagcugaugcgcaucgaggaggcccucggggacaaggccaucuucgccggccggaaguuccgcaaccccaaggccaaguga

SEQ ID NO: 29674 - RNA, 1878 nt, Artificial Sequence
  derived and/or modified sequence opt1 from ENO4__Homo_sapiens__NP_001229628
auggaggaggagggcgggggccgcagcugcgggaccacccgggagcugcagaagcucaagcagcaggccauggaguacuaccgcgagaacgacgugccccggcgccuggaggagcugcucaacuccacguucuaccugcagccggccgacgucuacggccaccuggcgaacugcuucagcaagcucgccaagccgcccaccaucugcaagaucguggggaaggacgugcuggacggccugggccuccccacccugcaggucgacaucuucugcaccauccagaacuuccccaagaacgugugcuccguggucaucagcacgcacuucgaggugcacgagaacgcccugcccgagcucgccaaggccgaggaggcggagcgggccuccgccgugagcaccgccguccagugggugaacuccaccaucacccacgagcugcaggggauggcgcccagcgaccaggccgagguggaccaccuccugcgcaucuucuucgccuccaagguccaggaggacaagggccggaaggagcuggagaagucccuggaguacagcacggugcccaccccgcucccgcccgugcccccgcccccgcccccgcccccgcccaccaagaagaaggggcagaagcccggccgcaaggacaccaucacggagaagcccaucgcccccgccgagcccgucgagcccgugcugagcggguccauggcgaucggcgccgugagccuggccgucgccaaggccugcgcgaugcuccugaacaagccccuguaccucaacaucgcccugcugaagcacaaccaggagcagcccaccacccucuccaugccccugcugauggugagccucguguccugcggcaagagcuccagcgggaagcugaaccugaugaaggaggucaucugcaucccccaccccgagcucaccacgaagcagggcguggagaugcugauggagaugcagaagcacaucaacaagaucaucgagaugcccagcccgcccaaggccgagaccaagaaggggcacgacggcuccaagcggggccagcagcagaucaccgggaagaugagccaccugggcugccucaccaucaacugcgacuccaucgagcagccccugcugcucauccaggagaucugcgccaaccuggggcuggagcucggcacgaaccugcaccuggccaucaacugcgcggggcacgagcucauggacuacaacaagggcaaguacgaggugaucaugggcaccuacaagaacgccgccgagauggucgaccuguacguggaccugaucaacaaguaccccagcaucaucgcccucaucgacccguuccgcaaggaggacuccgagcagugggacagcaucuaccacgcccuggggucccggugcuacaucaucgcgggcaccgccagcaaguccaucagcaagcugcuggagcaggggaacaucuccauccccaagagcaacggccucaucaucaagcacaccaaccagacgaccauguccgaccuggucgagaucaccaaccugaucgacagcaagaagcacaucaccguguucggguccacggagggcgagagcuccgacgacagccucguggaccuggccgucggccugggggugcgcuucaucaagcucggcgggcugucccggggcgagcgcgugaccaaguacaaccggcugcucaccaucgaggaggagcugguccagaacgggacccugggcuucaaggaggagcacacguucuucuacuucaacgaggaggccgagaaggcggccgaggcccucgaggccgccgcggcccgcgagccccuggugcccaccuucccgacccagggcguggaggagagcgccgagaccggggccagcuccggcuga

SEQ ID NO: 29675 - RNA, 786 nt, Artificial Sequence
  derived and/or modified sequence opt1 from ENOPH1__Homo_sapiens__NP_067027
auggugguccugagcgugcccgccgaggugaccgucauccuccuggacaucgagggcaccacgaccccgaucgccuucgugaaggacauccuguuccccuacaucgaggagaacgugaaggaguaccuccagacccacugggaggaggaggagugccagcaggacgucucccugcugcgcaagcaggcggaggaggacgcccaccucgacggggccgugcccauccccgccgccagcggcaacgggguggacgaccugcagcagaugauccaggcggucguggacaacgugugcuggcagaugucccuggaccggaagaccacggcccucaagcagcugcagggccacauguggcgcgccgccuucaccgcggggcggaugaaggccgaguucuucgccgacgucgugccggccgugcgcaaguggcgggaggccggcaugaaggucuacaucuacagcuccggcagcguggaggcgcagaagcuccuguucgggcacuccaccgagggcgacauccuggagcugguggacgggcacuucgacaccaagaucggccacaaggucgagagcgaguccuaccgcaagaucgccgacagcaucgggugcuccacgaacaacauccucuuccugaccgacgugacccgggaggccagcgccgccgaggaggcggacgugcacgucgccguggugguccgccccggcaacgccggccugaccgacgacgagaagacguacuacucccucaucaccagcuucuccgagcuguaccugcccagcuccaccuga

SEQ ID NO: 29676 - RNA, 1086 nt, Artificial Sequence
  derived and/or modified sequence opt1 from ENOSF1__Homo_sapiens__NP_001119595
augcagaagauggagagccgcggcguggagcugcccucccucugggagaaggcccugaagcugaucgggccggagaagggcgucgugcaccucgccaccgcggccgugcugaacgccgucugggaccugugggccaagcaggaggggaagcccguguggaagcuccugguggacauggacccccggaugcuggucagcugcaucgacuuccgcuacaucaccgacgugcucacggaggaggacgcccuggagauccugcagaagggccagaucgggaagaaggagcgggagaagcagaugcucgcgcagggcuaccccgccuacaccaccuccugcgccuggcugggcuacagcgacgacacccugaagcagcucugcgcccaggcgcugaaggacggguggacgcgcuucaaggugaaggucggcgccgaccugcaggacgacaugcggcgcugccagaucauccgggacaugaucgggccggagaagacccucaugauggacgccaaccagcgcugggacgugcccgaggccguggaguggauguccaagcuggccaaguucaagccccuguggaucgaggagcccaccagcccggacgacauccucggccacgcgaccaucuccaaggcccuggucccccuggggaucggcaucgccacgggcgagcagugccacaaccgggugaucuucaagcagcuccugcaggccaaggcccugcaguuccuccagaucgacagcugccgccugggguccgugaacgagaaccugagcguccuccugauggcgaagaaguucgagauccccgugugcccccacgccggcggggugggccugugcgagcucguccagcaccugaucaucuucgacuacaucuccgugagcgccucccuggagaaccgggugugcgaguacgucgaccaccuccacgagcacuucaaguacccggugaugauccagcgcgccagcuacaugccgcccaaggaccccggcuacuccaccgagaugaaggaggagagcgugaagaagcaccaguaccccgacggggaggucuggaagaagcugcugcccgcccaggagaacuga

SEQ ID NO: 29677 - RNA, 1932 nt, Artificial Sequence
  derived and/or modified sequence opt1 from ENOX1__Homo_sapiens__NP_001121087
augguggacgccggcggggucgagaacaucacccagcugccccaggagcucccccagaugauggccgcggccgccgacggccuggggagcaucgccaucgacaccacgcagcugaacauguccgugaccgaccccaccgccugggcgaccgccaugaacaaccucggcauggugcccgucgggcugcccggccagcagcuggugagcgacuccaucugcgugcccggcuucgaccccagccucaacaugaugacggggaucacccccaucaaccccaugauccccggccuggggcuggucccgccgccgccgcccaccgagguggccguggucaaggagaucauccacugcaaguccugcacccucuucccccagaaccccaaccugcccccgcccagcacgcgcgagcggccgcccggcugcaagaccguguucgucgggggccugcccgagaacgccaccgaggagaucauccaggagguguucgagcagugcggcgacaucaccgcgauccgcaaguccaagaagaacuucugccacauccgguucgccgaggaguucaugguggacaaggccaucuaccucagcggguaccgcaugcggcugggcuccagcacggacaagaaggacuccgggcgccugcacguggacuucgcccaggcccgggacgacuucuacgagugggagugcaagcagcgcaugcgggcgcgcgaggagcggcaccgccggaagcucgaggaggaccgccugcggccgcccagcccgcccgccaucaugcacuacuccgagcacgaggccgcccugcucgccgagaagcugaaggacgacagcaaguucuccgaggcgaucaccguccugcucagcuggaucgagcgcggcgaggugaaccggcgcuccgccaaccaguucuacagcauggugcaguccgccaacagccacguccggcgccugaugaacgagaaggccacccacgagcaggagauggaggaggccaaggagaacuucaagaacgcgcugaccggcauccucacgcaguucgagcagaucguggccguguucaacgccagcacccggcagaaggccugggaccacuucuccaaggcccagcgcaagaacaucgacaucuggcgcaagcacagcgaggagcugcggaacgcgcaguccgagcagcugauggggauccgccgggaggaggagauggagaugagcgacgacgagaacugcgacucccccaccaagaagaugcgcgucgacgagagcgcccucgccgcccaggcguacgcccugaaggaggagaacgacucccugcgguggcagcucgacgccuaccgcaacgagguggagcugcugaagcaggagaaggagcagcuguuccggaccgaggagaaccucacgaaggaccagcagcugcaguuccuccagcagaccaugcagggcaugcagcagcagcugcugaccauccaggaggagcucaacaacaagaaguccgagcuggagcaggccaaggaggagcagagccacacccaggcccugcucaaggugcugcaggagcagcugaaggggacgaaggagcucgucgagaccaacggccacagccacgaggacuccaacgagaucaacgugcugaccgucgcgcuggugaaccaggaccgcgagaacaacaucgagaagcggagccaggggcucaaguccgagaaggaggcccugcugaucggcaucaucagcaccuuccugcacgugcaccccuucggcgccaacaucgaguaccucugguccuacaugcagcagcuggacagcaagaucuccgccaacgagaucgagaugcugcucaugcgccugccccggauguucaagcaggaguucacgggggucggcgccacccuggagaagcgcuggaagcucugcgcguucgaggggaucaagaccaccuga

SEQ ID NO: 29678 - RNA, 2022 nt, Artificial Sequence
  derived and/or modified sequence opt1 from ENOX2__Homo_sapiens__XP_011529546
augcugcacaucaaccagcuccugcugugcaacggcaccgccagcgccgcgaccaacaaggacgagacgaacugcaacuuccucaucuccagcgggcugaaccagcugcccuucgaccccgccaacaacaacgagccccuccaguucggcuccgccagcgggccccuggugaccgagggccugaucgagaacgggggcgaguccagcaagaagcgcaagcggaccaacacccccuccgccgacaacagccgcacgcucaacgucgacuccaccgccaugacccugcccaugagcgaccccaccgcgugggccacggccaugaacaaccugggcauggcgccccucgggaucgccggccagcccauccugccggacuucgaccccgcccuggggaugaugaccggcaucccgcccaucacccccaugaugcccgggcucggcaucgugcccccgcccaucccgcccgacaugcccguggucaaggagaucauccacugcaaguccugcacccuguucccgcccaaccccaaccugcccccgcccgccacgcgggagcgcccgcccggcugcaagaccguguucgucgggggccuccccgagaacgggaccgagcagaucaucguggagguguucgagcagugcggcgagaucaucgccauccgcaagagcaagaagaacuucugccacauccgguucgccgaggaguacaugguggacaaggcgcuguaccuguccggcuaccggauccgccucgggagcuccaccgacaagaaggacacgggccggcugcacgucgacuucgcccaggcccgcgacgaccuguacgagugggagugcaagcagcggaugcucgcccgcgaggagcggcaccgccggcgcauggaggaggagcggcugcgcccgcccagcccgccgcccguggugcacuacuccgaccacgagugcagcaucgucgccgagaagcugaaggacgacuccaaguucagcgaggcggugcagacccuccugaccuggaucgagcgcggggaggugaaccggcggagcgccaacaacuucuacuccaugauccagagcgccaacucccacguccgccgccuggugaacgagaaggccgcccacgagaaggacauggaggaggcgaaggagaaguucaagcaggcccucagcggcauccugauccaguucgagcagaucguggccgucuaccacuccgccagcaagcagaaggccugggaccacuucaccaaggcgcagcggaagaacaucuccguguggugcaagcaggccgaggagauccgcaacauccacaacgacgagcugauggggauccggcgcgaggaggagauggagaugagcgacgacgagaucgaggagaugacggagaccaaggagaccgaggaguccgcccucgugagccaggccgaggcgcugaaggaggagaacgacucccugcgguggcagcucgacgccuaccgcaacgaggucgagcugcugaagcaggagcagggcaaggugcaccgggaggacgaccccaacaaggagcagcagcucaagcugcugcagcaggcccuccagggcaugcagcagcaccuccugaaggugcaggaggaguacaagaagaaggaggccgagcuggagaagcugaaggacgacaagcugcaggucgagaagaugcucgagaaccugaaggagaaggagagcugcgccucccgccugugcgcgagcaaccaggacuccgaguacccccuggagaagaccaugaacagcucccccaucaagagcgagcgggaggcccuccugguggggaucaucuccacguuccugcacguccaccccuucggcgccagcaucgaguacaucugcagcuaccuccaccgccuggacaacaagaucugcaccuccgacguggagugccugauggggcggcuccagcacaccuucaagcaggagaugaccggcgugggggccagccuggagaagcgcuggaaguucugcggcuucgagggccugaagcucacguga

SEQ ID NO: 29679 - RNA, 2874 nt, Artificial Sequence
  derived and/or modified sequence opt1 from ENPEP__Homo_sapiens__NP_001968
augaacuucgccgagcgcgagggcagcaagcgguacugcauccagaccaagcacguggccauccugugcgcggucguggugggggucggccucaucguggggcuggccgugggccugacccgcuccugcgacagcuccggggacggcggccccgggacggccccggcccccagccaccuccccuccagcaccgccucccccagcggcccgcccgcgcaggaccaggacaucugccccgccuccgaggacgagagcgggcaguggaagaacuuccggcugcccgacuucgucaacccggugcacuacgaccugcacgugaagccccuccuggaggaggacaccuacaccggcacggucuccaucagcaucaaccuguccgcccccacccgcuaccucuggcugcaccuccgggagacccgcaucacccggcuccccgagcugaagcgcccgagcggggaccagguccaggugcggcgcugcuucgaguacaagaagcaggaguacguggugguggaggccgaggaggagcugacgcccuccagcggcgacggccucuaccugcugaccauggaguucgcgggguggcucaacggcucccuggucggguucuaccggaccaccuacacggagaacggccaggucaagagcaucguggccaccgaccacgagcccaccgacgcccgcaaguccuuccccugcuucgacgagccgaacaagaaggccaccuacacgaucagcaucacccaccccaaggaguacggcgcccugagcaacaugcccguggcgaaggaggaguccguggacgacaaguggacccggaccacguucgagaaguccgugcccaugagcaccuaccucgucugcuucgccgugcaccaguucgacagcgugaagcgcaucuccaacagcgggaagccgcugaccaucuacguccagcccgagcagaagcacaccgccgaguacgccgccaacaucacgaaguccguguucgacuacuucgaggaguacuucgcgaugaacuacagccugcccaagcucgacaagaucgccauccccgacuucggcaccggggccauggagaacuggggccugaucaccuaccgggagaccaaccugcucuacgacccgaaggaguccgccagcuccaaccagcagcgcgucgccacggugguggcgcacgagcugguccaccagugguucgggaacaucgugaccauggacuggugggaggaccuguggcucaacgagggcuucgccagcuucuucgaguuccugggcgugaaccacgccgagaccgacuggcagaugcgggaccagaugcugcucgaggacguccugcccgugcaggaggacgacucccugaugagcucccaccccaucaucgugaccgucacgacccccgacgagaucaccagcguguucgacgggaucuccuacagcaagggcuccagcauccuccgcaugcuggaggacuggaucaagccggagaacuuccagaaggggugccagauguaccuggagaaguaccaguucaagaacgccaagaccagcgacuucugggccgcgcucgaggaggccucccggcugcccgugaaggaggucauggacacguggacccgccagaugggcuaccccgugcugaacgugaacggggucaagaacaucacccagaagcgguuccuccuggacccgcgcgccaaccccagccagccgcccuccgaccugggcuacaccuggaacauccccgugaaguggaccgaggacaacaucacgagcuccgugcuguucaaccgcagcgagaaggagggcaucacccugaacuccagcaaccccuccgggaacgccuuccugaagaucaaccccgaccacaucggcuucuaccgggucaacuacgagguggcgaccugggacagcaucgccaccgcccucucccugaaccacaagacguucagcuccgccgaccgcgccagccugaucgacgacgcguucgcccuggcccgggcccagcuccuggacuacaagguggcccugaaccucaccaaguaccugaagcgcgaggagaacuuccugcccuggcagcgggucaucuccgcggugaccuacaucaucagcauguucgaggacgacaaggagcucuacccgaugaucgaggaguacuuccagggccaggugaagcccaucgccgacucccugggguggaacgacgccggggaccacgucaccaagcugcuccgcagcagcgugcugggcuucgccugcaagaugggcgaccgggaggcccugaacaacgcguccagccucuucgagcaguggcugaacgggacggugucccugcccgucaaccuccgccugcugguguaccgguacggcaugcagaacagcgggaacgagaucuccuggaacuacacccucgagcaguaccagaagaccagccuggcccaggagaaggagaagcugcucuacggccuggccuccgugaagaacgucacccugcucagccgcuaccuggaccugcucaaggacacgaaccugaucaagacccaggacguguucaccgugauccgguacaucuccuacaacagcuacggcaagaacauggccuggaacuggauccagcugaacugggacuaccucgucaaccgcuacacccugaacaaccggaaccuggggcgcaucgugacgaucgcggagcccuucaacaccgagcuccagcuguggcagauggaguccuucuucgccaaguacccgcaggccggcgccggggagaagccccgggagcagguccuggagaccgugaagaacaacaucgaguggcucaagcagcaccgcaacaccauccgggagugguucuucaaccugcuggagagcggcuga

SEQ ID NO: 29680 - RNA, 2778 nt, Artificial Sequence
  derived and/or modified sequence opt1 from ENPP1__Homo_sapiens__NP_006199
auggagcgcgacggcugcgccgggggcgggagccggggcggggagggcggccgcgcgccccgggaggggccggccggcaacgggcgcgaccggggccgcucccacgccgccgaggcccccggggacccccaggccgcggccagccugcuggcccccauggacgugggcgaggagccgcuggagaaggccgcgcgggcccgcaccgccaaggaccccaacaccuacaagguccugucccucgugcugagcgugugcguccugacgaccauccucggcugcaucuucgggcugaagcccuccugcgccaaggaggucaagagcugcaagggccggugcuucgagcgcaccuucgggaacugccggugcgacgccgcgugcguggagcugggcaacugcugccucgacuaccaggagaccugcaucgagcccgagcacaucuggacgugcaacaaguuccgcugcggcgagaagcggcugacccgcucccugugcgccugcagcgacgacugcaaggacaagggggacugcugcaucaacuacuccagcgugugccagggcgagaaguccuggguggaggagccgugcgagagcaucaacgagccccagugccccgccggguucgagacgcccccgacccuccuguucucccuggacggcuuccgggccgaguaccuccacaccuggggcgggcugcugcccgugaucagcaagcucaagaagugcggcaccuacaccaagaacaugcgccccgucuaccccaccaagacguucccgaaccacuacuccaucgugaccgggcuguaccccgagagccacggcaucaucgacaacaagauguacgaccccaagaugaacgccuccuucagccugaaguccaaggagaaguucaaccccgagugguacaagggggagccgaucugggugaccgcgaaguaccagggccucaagagcgggaccuucuucuggcccggcagcgacgucgagaucaacggcaucuuccccgacaucuacaagauguacaacggguccgugcccuucgaggagcggauccuggccgugcugcaguggcuccagcugccgaaggacgagcgcccccacuucuacacgcuguaccucgaggagcccgacagcuccggccacagcuacgggcccgucuccagcgaggugaucaaggcccugcagcggguggacggcauggucgggaugcugauggacggccucaaggagcugaaccugcaccgcugccucaaccugauccugaucuccgaccacggcauggagcaggggagcugcaagaaguacaucuaccucaacaaguaccugggcgacgugaagaacaucaaggugaucuacgggccggccgcccggcugcgccccuccgacguccccgacaaguacuacagcuucaacuacgagggcaucgcgcgcaaccucuccugccgggagccgaaccagcacuucaagcccuaccugaagcacuuccugcccaagcgccuccacuucgccaagagcgaccggaucgagccccugaccuucuaccuggacccgcaguggcagcucgcccugaaccccuccgagcgcaaguacugcggcagcggguuccacggcuccgacaacguguucagcaacaugcaggcccuguucgugggguacggccccggguucaagcacggcaucgaggccgacaccuucgagaacaucgaggucuacaaccucaugugcgaccugcugaaccugacccccgcgccgaacaacggcacgcacgggucccucaaccaccuccugaagaaccccguguacacccccaagcaccccaaggagguccacccgcuggugcagugccccuucacccggaacccccgcgacaaccugggcugcagcugcaaccccuccauccugccgaucgaggacuuccagacccaguucaaccucacgguggccgaggagaagaucaucaagcacgagacccugcccuacgggcggccccgcguccugcagaaggagaacaccaucugccuccugagccagcaccaguucaugagcggcuacucccaggacauccugaugccccucuggaccagcuacacgguggaccggaacgacuccuucagcaccgaggacuucuccaacugccuguaccaggacuuccgcaucccgcugagccccgugcacaagugcuccuucuacaagaacaacaccaaggucagcuacggguuccucuccccgccccagcugaacaagaacagcuccggcaucuacagcgaggcccugcucaccacgaacaucgugcccauguaccaguccuuccaggugaucuggcgguacuuccacgacacccugcugcgcaaguacgccgaggagcggaacggcgucaacguggugagcgggcccgucuucgacuucgacuacgacggccgcugcgacucccucgagaaccugcggcagaagcgccgggugauccgcaaccaggagauccugauccccacccacuucuucaucgugcucaccagcugcaaggacacgucccagaccccgcugcacugcgagaaccuggacacccucgcguucauccugccccaccggaccgacaacagcgagagcugcguccacgggaagcacgacuccagcuggguggaggagcugcucaugcugcaccgcgcccgcaucaccgacguggagcacaucacgggccuguccuucuaccagcagcggaaggagcccgucagcgacauccucaagcugaagacccaccuccccaccuucucccaggaggacuga

SEQ ID NO: 29681 - RNA, 2592 nt, Artificial Sequence
  derived and/or modified sequence opt1 from ENPP2__Homo_sapiens__NP_001035181
auggcccgccggagcuccuuccagagcugccagaucaucucccuguucaccuucgccgugggcgucaacaucugccucggguucaccgcgcaccgcaucaagcgggccgagggcugggaggaggggcccccgacggugcugagcgacucccccuggaccaacaucagcggcuccugcaaggggcgcugcuucgagcugcaggaggccggcccgcccgacugccggugcgacaaccucugcaagagcuacaccuccugcugccacgacuucgacgagcugugccugaagaccgcccgcggcugggagugcacgaaggaccggugcggggaggugcgcaacgaggagaacgccugccacugcagcgaggacugccucgcgcggggcgacugcugcaccaacuaccaggucgugugcaagggggagucccacuggguggacgacgacugcgaggagaucaaggccgccgagugccccgccggcuucguccgcccgccccugaucaucuucagcguggacggguuccgggcguccuacaugaagaagggcagcaaggugaugcccaacaucgagaagcugcgcuccugcggcacccacagccccuacaugcggcccgucuaccccaccaagacguuccccaaccucuacacccuggccaccgggcuguacccggagucccacggcaucguggggaacagcauguacgaccccguguucgacgccaccuuccaccuccgcggccgggagaaguucaaccaccgcugguggggcgggcagccccuguggaucacggccaccaagcagggcgucaaggccgggaccuucuucugguccguggugaucccccacgagcggcgcauccugaccauccuccaguggcugacgcugccggaccacgagcggcccagcgucuacgcguucuacagcgagcagcccgacuucuccggccacaaguacgggcccuucggcccggagaugaccaacccccuccgcgagaucgacaagaucgugggccagcugauggacgggcugaagcagcucaagcugcaccggugcgugaacgucaucuucgugggcgaccacgggauggaggacgugaccugcgaccgcaccgaguuccugagcaacuaccucacgaacgucgacgacaucacccuggugcccggcacccuggggcgcauccgguccaaguucagcaacaacgccaaguacgaccccaaggccaucaucgccaaccugaccugcaagaagccggaccagcacuucaagcccuaccugaagcagcaccuccccaagcgccuccacuacgccaacaaccggcgcaucgaggacauccaccuccugguggagcggcgcuggcacgucgcgcggaagccccuggacguguacaagaagccguccggcaagugcuucuuccagggcgaccacggguucgacaacaaggucaacagcaugcagacgguguucgugggcuacggguccaccuucaaguacaagaccaaggucccgcccuucgagaacaucgagcuguacaacgugaugugcgaccugcucggccugaagcccgcccccaacaacgggacccacggcagccugaaccaccuccugcgcacgaacaccuuccggcccaccaugcccgaggaggugacccgcccgaacuaccccggcaucauguaccugcaguccgacuucgaccucgggugcacgugcgacgacaaggucgagcccaagaacaagcuggacgagcugaacaagcggcuccacaccaagggcagcaccgaggagcgccaccuccuguacgggcggcccgccgugcuguaccgcacccgguacgacauccuguaccacacggacuucgaguccggcuacagcgagaucuuccugaugccgcuguggaccuccuacaccgugagcaagcaggccgaggucuccagcgugcccgaccaccucaccuccugcgugcgccccgacguccgggugagccccuccuucagccagaacugccuggccuacaagaacgacaagcagaugagcuacggcuuccuguucccgcccuaccucuccagcucccccgaggcgaaguacgacgccuuccuggugaccaacaugguccccauguacccggccuucaagcgcguguggaacuacuuccagcgggugcuggucaagaaguacgccagcgagcgcaacggggugaacgugaucuccggccccaucuucgacuacgacuacgacgggcuccacgacacggaggacaagaucaagcaguacgucgagggcagcuccauccccgugcccacccacuacuacagcaucaucaccuccugccuggacuucacccagccggccgacaagugcgacgggccccugagcguguccagcuucauccucccccaccgccccgacaacgaggaguccugcaacagcuccgaggacgagagcaagugggucgaggagcugaugaagaugcacacggcgcgggugcgcgacaucgagcaccugaccucccucgacuucuuccggaagaccagccgcagcuacccggagauccugacccugaagacguaccuccacaccuacgaguccgagaucuga

SEQ ID NO: 29682 - RNA, 2628 nt, Artificial Sequence
  derived and/or modified sequence opt1 from ENPP3__Homo_sapiens__NP_005012
auggagagcacccugacccucgccacggagcagcccgugaagaagaacacccugaagaaguacaagaucgccugcaucguccugcucgcgcugcuggugaucaugucccucggccuggggcugggccucgggcugcgcaagcuggagaagcagggcagcugccggaagaagugcuucgacgccuccuuccgcgggcucgagaacugccggugcgacguggccugcaaggaccgcggcgacugcugcugggacuucgaggacacgugcgucgagagcacccggaucuggaugugcaacaaguuccgcugcggcgagacccggcuggaggccucccugugcagcugcuccgacgacugccuccagcgcaaggacugcugcgccgacuacaagagcgugugccagggggagaccuccuggcuggaggagaacugcgacaccgcgcagcagagccagugcccggagggcuucgaccugccgcccgugauccucuucuccauggacggguuccgggccgaguaccuguacaccugggacacgcugaugcccaacaucaacaagcucaagaccugcggcauccacagcaaguacaugcgcgccauguaccccaccaagaccuuccccaaccacuacacgaucgucaccgggcuguaccccgagucccacggcaucaucgacaacaacauguacgacgugaaccugaacaagaacuucagccucuccagcaaggagcagaacaaccccgccugguggcacggccagccgauguggcugaccgcgauguaccaggggcugaaggccgccaccuacuucuggcccggcuccgagguggccaucaacgggagcuuccccuccaucuacaugcccuacaacggcagcgucccguucgaggagcggaucagcacgcuccugaaguggcuggaccuccccaaggccgagcgcccccgguucuacaccauguacuucgaggagcccgacuccagcggccacgccgggggcccgguguccgcgcgcgugaucaaggcccugcaggucguggaccacgccuucgggaugcugauggagggccucaagcagcggaaccugcacaacugcgugaacaucauccugcucgccgaccacgggauggaccagaccuacugcaacaagauggaguacaugaccgacuacuucccccgcaucaacuucuucuacauguacgagggccccgcgccccggauccgcgcccacaacaucccgcacgacuucuucagcuucaacuccgaggagaucguccggaaccugagcugccgcaagcccgaccagcacuucaagcccuaccugacgcccgaccucccgaagcggcugcacuacgccaagaacgugcgcaucgacaaggugcaccuguucgucgaccagcaguggcucgccgugcgcuccaagagcaacaccaacugcggcgggggcaaccacggguacaacaacgaguuccgguccauggaggccaucuuccuggcgcacggccccagcuucaaggagaagaccgagguggagcccuucgagaacaucgaggucuacaaccugaugugcgaccuccugcgcauccagcccgccccgaacaacgggacccacggcucccugaaccaccuccugaaggugcccuucuacgagcccagccacgccgaggagguguccaaguucagcgucugcggcuucgccaacccgcugcccacggagucccuggacugcuucugcccccaccuccagaacagcacccagcuggagcaggucaaccagaugcugaaccucacccaggaggagaucaccgccacggugaaggugaaccugcccuucgggcggccgcgcgugcugcagaagaacgucgaccacugccuccuguaccaccgggaguacguguccggcuucgggaaggcgaugcgcaugcccauguggagcuccuacaccgugccccagcugggcgacaccagcccccucccgcccaccguccccgacugccugcgggccgacgugcgcgugcccccgagcgagucccagaagugcagcuucuaccuggccgacaagaacaucacgcacggguuccucuacccgcccgccuccaaccggaccagcgacucccaguacgacgcgcugaucaccagcaaccugguccccauguacgaggaguuccgcaagaugugggacuacuuccacuccgugcuccugaucaagcacgccaccgagcggaacggcgugaacgucgugagcggccccaucuucgacuacaacuacgacgggcacuucgacgcccccgacgagaucacgaagcaccuggccaacaccgacgugcccauccccacccacuacuucgucgugcucaccuccugcaagaacaagagccacaccccggagaacugccccggcuggcuggacgugcugcccuucaucaucccccaccgcccgacgaacgucgaguccugccccgaggggaagcccgaggcccucuggguggaggagcgguucaccgcgcacaucgcccgcgugcgggacgucgagcugcugaccggccucgacuucuaccaggacaaggugcagccggugagcgagauccugcagcugaagaccuaccuccccacguucgagaccaccaucuga

SEQ ID NO: 29683 - RNA, 1434 nt, Artificial Sequence
  derived and/or modified sequence opt1 from ENPP5__Homo_sapiens__XP_005249317
augaccagcaaguuccugcucguguccuucauccuggccgcccugagccucuccaccacguucagccugcagcccgaccagcagaagguccugcucguguccuucgacggcuuccgcugggacuaccuguacaaggugccgacgccccacuuccacuacaucaugaaguacgggguccacgugaagcaggucaccaacguguucaucaccaagaccuaccccaaccacuacacccuggugaccggccucuucgcggagaaccacgggaucguggccaacgacauguucgaccccauccggaacaagagcuucucccuggaccacaugaacaucuacgacagcaaguucugggaggaggccaccccgaucuggaucacgaaccagcgcgccggccacaccuccggggccgcgauguggcccggcaccgacgucaagauccacaagcgguuccccacccacuacaugcccuacaacgagagcguguccuucgaggaccgcguggccaagaucaucgagugguucacgagcaaggagccgaucaaccugggccuccuguacugggaggaccccgacgacauggggcaccaccugggccccgacagcccccucauggggccggucaucuccgacaucgacaagaagcugggcuaccugauccagaugcucaagaaggccaagcuguggaacacccugaaccucaucaucaccuccgaccacgggaugacccagugcagcgaggagcggcugaucgagcuggaccaguaccucgacaaggaccacuacacgcugaucgaccagucccccguggccgcgauccugcccaaggagggcaaguucgacgagguguacgaggcccucacccacgcccaccccaaccugaccgucuacaagaaggaggacgugccggagcgcuggcacuacaaguacaacagccggauccagcccaucaucgccguggccgacgagggcuggcacauccugcagaacaaguccgacgacuuccuccuggggaaccacggcuacgacaacgcgcuggccgacaugcaccccaucuuccucgcccacgggcccgccuuccgcaagaacuucagcaaggaggccaugaacagcaccgaccuguacccgcugcucugccaccuccugaacaucacggcgaugccccacaacggcuccuucuggaacguccaggaccugcugaacagcgccaugccccggguggugcccuacacccaguccaccauccugcucccgggcagcgucaagcccgccgaguacgaccaggagggguccuaccccuacuucaucggcgugagccugggguccaucaucgugaucgucuucuucgugaucuucaucaagcaccugauccacagccagauccccgcccuccaggacaugcacgccgagaucgcgcagccgcugcugcaggccuga

SEQ ID NO: 29684 - RNA, 1377 nt, Artificial Sequence
  derived and/or modified sequence opt1 from ENPP7__Homo_sapiens__NP_848638
augcgcggccccgccgugcugcucaccgucgcccuggcgacccugcucgccccgggggccggcgcccccgugcagagccaggggucccagaacaagcugcugcucgugagcuucgacggcuuccgguggaacuacgaccaggacgucgacacgcccaaccuggacgccauggcgcgcgacggggugaaggcccgguacaugacccccgccuucgugaccaugaccuccccgugccacuucacgcuggucaccggcaaguacaucgagaaccacggcguggugcacaacauguacuacaacaccaccagcaaggucaagcuccccuaccacgccacgcuggggauccagcgcuggugggacaacggcuccgugcccaucuggaucaccgcgcagcggcaggggcugcgcgccggcagcuucuucuaccccgggggcaacgugaccuaccagggcgucgccgugacccggucccgcaaggaggggaucgcccacaacuacaagaacgagacggaguggcgggccaacaucgacaccgugauggcgugguucaccgaggaggaccucgaccuggucacccuguacuucggcgagccggacagcacggggcaccgcuacggccccgagucccccgagcggcgcgagauggugcgccagguggaccggaccgucggcuaccuccgggagagcaucgcccgcaaccaccugaccgaccggcugaaccucaucaucaccuccgaccacgggaugacgaccguggacaagcgcgccggcgaccugguggaguuccacaaguuccccaacuucaccuuccgggacaucgaguucgagcugcucgacuacgggccgaacggcaugcugcugcccaaggaggggcgccucgagaaggucuacgacgcccugaaggacgcccaccccaagcugcacguguacaagaaggaggcguuccccgaggccuuccacuacgccaacaacccgcgggugacgccccuccugauguacagcgaccugggcuacgucauccacggccgcaucaacgugcaguucaacaacggggagcacggcuucgacaacaaggacauggacaugaagaccaucuuccgcgccgucgggcccuccuuccgggccggccucgagguggagcccuucgagagcgugcacgucuacgagcugaugugccgccugcucgggaucgugccggaggcgaacgacggccaccuggccacccugcuccccaugcugcacaccgaguccgcccugccgcccgacggccggcccacccuccugcccaaggggcgcagcgcccugccgcccuccagccggccccuccuggugaugggccugcucgggacggucauccugcuguccgagguggccuga

SEQ ID NO: 29685 - RNA, 1578 nt, Artificial Sequence
  derived and/or modified sequence opt1 from ENTHD2__Homo_sapiens__NP_653280
auggccgccgcgcccccgcugcgcgaccggcucagcuuccugcaccgccugcccauccuccugaagggcaccuccgacgacgacgugcccugccccggguaccuguucgaggagaucgccaagaucagccacgaguccccgggcagcucccagugccuccuggaguaccugcucagccggcugcacuccagcuccgggcacggcaagcugaagguccucaagauccugcuguaccucugcagccacggguccagcuucuuccugcugauccucaagcgcaacuccgccuucauccaggaggccgccgcguucgccggcccgcccgacccccugcacggcaacagccuguaccagaaggugcgggccgccgcgcaggaccucggguccacccuguucagcgacacggugcugccccucgcccccucccagccccugggcacgcccccggccaccgggaugggcagccaggcccgcccccacuccacccugcagggguucggcuacagcaaggagcacggccggaccgccguccgccaccagcccgggcaggcgggcgggggcugggacgagcucgacagcggccccuccagccagaacuccagccagaacuccgaccugagccggguguccgacagcgggucccacagcggcuccgacagccacuccggggccagccgcgagcccggcgaccuggccgagcggguggaggucguggcccucuccgacugccagcaggagcugagccuggugcgcaccgucacccgggggccccgcgccuuccucucccgggaggaggcgcagcacuucaucaaggccugcggccugcugaacugcgaggccgugcuccagcugcugaccugccaccuccgcggcacgagcgagugcacccagcugcgggcccugugcgccaucgcgucccucgggagcagcgaccugcugccccaggagcacauccuccugcgcacccggcccuggcugcaggagcucuccaugggcagcccggggcccgugaccaacaaggccacgaagauccugcgccacuucgaggccuccugcggccagcugagccccgcccgggggaccuccgccgagcccggcccgaccgcggcccugcccggccccagcgaccuccugaccgacgccgucccccugccggggucccagguguuccuccagccccugagcuccacgcccgugagcucccgcagcccggcccccuccagcggcaugcccuccagccccgucccgaccccgccgcccgacgcgucccccauccccgcccccggggaccccagcgaggccgaggcccgccuggccgagagccggcgcuggcggcccgagcgcauccccggcgggaccgacucccccaagcggggccccagcuccugcgcguggagccgcgacucccucuucgccggcauggagcugguggccugcccgcggcuggugggggccggcgccgcggccggggagagcugccccgacgccccgcgcgcgccccagaccuccagccagcggacggccgccaaggagccgcccggcuccgagcccagcgccuucgccuuccucaacgccuga

SEQ ID NO: 29686 - RNA, 1554 nt, Artificial Sequence
  derived and/or modified sequence opt1 from ENTPD1__Homo_sapiens__NP_001091645
augaagggcaccaaggaccugaccagccagcagaaggaguccaacgugaagacguucugcagcaagaacauccucgccauccugggguucuccagcaucaucgccgucaucgcgcugcucgccgugggccugacccagaacaaggcccugcccgagaacgugaaguacgggaucguccucgacgccggcuccagccacaccucccuguacaucuacaaguggccggccgagaaggagaacgacaccgggguggugcaccaggucgaggagugccgcgugaagggccccggcaucagcaaguucgugcagaaggucaacgagaucgggaucuaccugacggacugcauggagcgggcgcgcgaggugaucccccggucccagcaccaggagacccccguguaccucggcgccaccgccgggaugcgccugcugcggauggagagcgaggagcucgccgaccgcguccuggacgugguggagcggucccugagcaacuacccguucgacuuccagggcgcgcgcaucaucaccgggcaggaggagggcgccuacggcuggaucacgaucaacuaccuccuggggaaguucucccagaagacccggugguucagcaucguccccuacgagaccaacaaccaggagaccuucggcgcccuggaccucgggggcgccuccacccaggugaccuucgugccccagaaccagaccaucgagagccccgacaacgcccugcaguuccgccuguacggcaaggacuacaacgucuacacccacuccuuccucugcuacgggaaggaccaggcgcuguggcagaagcuggccaaggacauccagguggccagcaacgagauccuccgggacccgugcuuccaccccggcuacaagaagguggucaacguguccgaccuguacaagacgcccugcaccaagcgcuucgagaugacccugcccuuccagcaguucgagauccaggggaucggcaacuaccagcagugccaccagagcauccucgagcuguucaacaccagcuacugcccguacucccagugcgccuucaacgggaucuuccugccgccccuccagggcgacuucggcgccuucagcgcguucuacuucgugaugaaguuccugaaccugacguccgagaaggucagccaggagaaggugaccgagaugaugaagaaguucugcgcccagcccugggaggagaucaagaccuccuacgccggggucaaggagaaguaccucagcgaguacugcuucuccggcaccuacauccugagccugcuccugcagggguaccacuucacggccgacuccugggagcacauccacuucaucggcaagauccaggggagcgacgccggcuggacccugggcuacaugcucaaccugaccaacaugauccccgcggagcagccccuguccacgccccucagccacuccacguacguguuccugauggugcuguucagccucguccuguucaccguggccaucaucgggcugcucaucuuccacaagcccuccuacuucuggaaggacaugguguga

SEQ ID NO: 29687 - RNA, 1419 nt, Artificial Sequence
  derived and/or modified sequence opt1 from ENTPD2__Homo_sapiens__NP_001237
auggccggcaaggugcgcagccugcugcccccgcuccugcucgccgcggccgggcuggccggccugcuccugcugugcguccccacccgggacgugcgcgagccgcccgcccucaaguacgggaucgugcuggacgccggcuccagccacaccuccauguucaucuacaaguggcccgcggacaaggagaacgacacggggaucgucggccagcacagcuccugcgacgugcccggcgggggcaucagcuccuacgccgacaaccccagcggggccucccagagccuggugggcugccucgagcaggcccugcaggacguccccaaggagcggcacgcggggaccccgcuguaccucggcgccaccgccggcaugcgccugcugaaccucaccaaccccgaggccuccacgagcgugcugauggccgugacccacacccugacccaguaccccuucgacuuccgcggggcgcggauccucuccggccaggaggagggggucuucggcugggugacggccaacuaccugcuggagaacuucaucaaguacggcuggguggggcggugguuccgcccccggaagggcacccucggggccauggaccugggcggggccagcacccagaucaccuucgagacgaccuccccggccgaggaccgcgcgagcgagguccagcugcaccucuacggccagcacuaccggguguacacccacuccuuccugugcuacggccgcgaccaggugcugcagcggcuccuggccagcgcccugcagacccacggguuccaccccugcuggccccgcggcuucuccacgcagguccuccugggggacguguaccagagccccugcaccauggcccagcggccgcagaacuucaacagcuccgcccgcgugagccuguccggcagcuccgacccccaccucugccgggaccuggucagcgggcuguucuccuucagcuccugccccuucagccgcugcuccuucaacggcguguuccagcccccgguggcgggcaacuucgucgccuucagcgccuucuucuacaccguggacuuccuccggaccuccauggggcugcccguggccacgcugcagcagcucgaggccgcggccgucaacgugugcaaccagaccugggcccagcagcugcugagccgcggcuacggguucgacgagcgggccuucggcggggucaucuuccagaagaaggcggccgacaccgccgugggcugggcccucggcuacaugcugaaccugaccaaccucauccccgccgacccgcccgggcugcgcaagggcacggacuucuccagcugggugguccugcugcuccuguucgcguccgcccugcucgccgcccuggugcugcuccugcgccaggugcacagcgccaagcugcccuccaccaucuga

SEQ ID NO: 29688 - RNA, 1827 nt, Artificial Sequence
  derived and/or modified sequence opt1 from ENTPD4__Homo_sapiens__NP_001122402
augggccgcaucgggaucagcugccuguuccccgccuccuggcacuucagcaucuccccggugggcugcccccggauccucaacaccaaccugcgccagaucauggucaucagcgugcuggccgcggccgugucccuccuguacuucagcgucgugaucauccggaacaaguacgggcgccugacccgggacaagaaguuccagcgcuaccucgcccgggugacggacaucgaggccaccgacaccaacaaccccaacgucaacuacggcaucgugguggacugcggguccagcggcucccgcgucuucguguacugcuggccccggcacaacggcaacccgcacgaccugcuggacauccgccagaugcgggacaagaaccgcaagcccguggucaugaagaucaagcccgggaucagcgaguucgccaccucccccgagaaggugagcgacuacaucuccccgcuccugaacuucgcggccgagcacgugccccgggccaagcacaaggagacgccccuguacauccucugcaccgccggcaugcgcauccugcccgagagccagcagaaggcgauccuggaggaccuccugaccgacaucccgguccacuucgacuuccuguucuccgacagccacgccgaggugaucuccgggaagcaggagggcguguacgccuggaucgggaucaacuucguccucggccgguucgagcacaucgaggacgacgacgaggccgugguggaggucaacauccccggcagcgaguccagcgaggccaucgugcgcaagcggaccgcggggauccuggacaugggcggggugagcacgcagaucgccuacgagguccccaagaccgaggagguggccaagaaccugcucgccgaguucaaccugggcugcgacguccaccagaccgagcacguguaccgcguguacgucgccaccuuccugggcuucgggggcaacgcggcccggcagcgcuacgaggaccggaucuucgccaacacgauccagaagaaccgccuccuggggaagcagaccggccugacccccgacaugccguaccucgaccccugccugccccuggacaucaaggacgagauccagcagaacgggcagaccaucuaccuccgcggcacgggcgacuucgaccugugccgggagaccauccagcccuucaugaacaagaccaacgagacccagacgucccugaacgggguguaccagccgcccauccacuuccagaacagcgaguucuacggcuucuccgaguucuacuacugcaccgaggacgugcuccgcaugggcggggacuacaacgccgccaaguucaccaaggcggccaaggacuacugcgccaccaaguggagcauccugcgggagcgcuucgaccgggggcuguacgccucccacgccgaccuccaccgccugaaguaccagugcuucaagagcgcguggauguucgaggucuuccaccggggcuucuccuuccccgugaacuacaagagccugaagacggcccuccagguguacgacaaggagguccaguggacccugggcgccauccuguaccgcacccgguuccucccccugcgcgacauccagcaggaggccuuccgggcgucccacacccacuggcgcggggugagcuucguguacaaccacuaccuguucuccggcugcuuccucgucgugcugcuggccauccuccuguaccugcugcggcuccgccggauccaccgccggacgccgcgcagcuccagcgccgccgcccuguggauggaggaggggcugcccgcgcagaacgcccccggcacccucuga

SEQ ID NO: 29689 - RNA, 1287 nt, Artificial Sequence
  derived and/or modified sequence opt1 from ENTPD5__Homo_sapiens__XP_006720387
auggccaccagcuggggcaccguguucuucaugcuggucguguccugcgugugcagcgccgucucccaccgcaaccagcagacgugguucgaggggaucuuccucagcuccaugugccccaucaacgugagcgcguccacccuguacggcaucauguucgacgccgggagcaccggcacccggauccacguguacacguucguccagaagaugccggggcagcugcccauccucgagggcgagguguucgacuccgugaagcccggccugagcgccuucgucgaccagcccaagcagggggccgagaccgugcagggccugcucgagguggccaaggacuccaucccgcgcagccacuggaagaagacccccgucgugcugaaggcgaccgccgggcugcggcuccugcccgagcacaaggccaaggcccugcuguucgaggugaaggagaucuuccgcaagucccccuuccuggucccgaagggcagcguguccaucauggacgggagcgacgagggcauccuggcgugggugacggucaacuuccucaccggccagcugcacgggcaccggcaggagaccgugggcacccuggaccucgggggcgccuccacgcagaucaccuuccugccccaguucgagaagacccuggagcagacgccccgcggcuaccucaccagcuucgagauguucaacuccaccuacaagcuguacacccacagcuaccugggguucggccucaaggccgcccggcuggccacccugggggcgcucgagacggagggcaccgacgggcacaccuuccgcagcgccugccugccccgguggcuggaggccgaguggaucuucggcggcgugaaguaccaguacgggggcaaccaggagggggaggucggcuucgagccgugcuacgccgaggugcuccgcgugguccgggggaagcugcaccagcccgaggaggugcagcgcggcuccuucuacgccuucagcuacuacuacgaccgggcggucgacaccgacaugaucgacuacgagaagggcgggauccugaagguggaggacuucgagcgcaaggcccgggaggugugcgacaaccucgagaacuucacguccggcagccccuuccugugcauggaccuguccuacaucaccgcccuccugaaggacggguucggcuucgccgacagcaccguccugcagcucaccaagaaggugaacaacaucgagacggggugggcccugggcgcgaccuuccaccuccuccagucccugggcaucagccacuga

SEQ ID NO: 29690 - RNA, 1404 nt, Artificial Sequence
  derived and/or modified sequence opt1 from ENTPD6__Homo_sapiens__NP_001107561
augcagccccagcacggcccguggcagacccgcaugcggaagaucagcaaccacgggucccugcgcguggccaaggucgccuacccccucggccugugcguggggguguucaucuacgucgcguacaucaaguggcaccgggccaccgccacgcaggccuucuucagcaucacccgcgccgcgcccggcgcccggugggggcagcaggcccacagcccccugggcaccgccgcggacggccacgagguguucuacgggaucauguucgacgccggcagcaccgggacgcgcgugcacgucuuccaguucacccggccgccccgcgagacccccacccucacgcacgagaccuucaaggcccugaagcccggccuguccgccuacgccgacgacguggagaaguccgcgcaggggauccgggagcuccuggacguggccaagcaggacaucccguucgacuucuggaaggccacgccccugguccucaaggccaccgccggccugcgccugcuccccggcgagaaggcgcagaagcugcugcagaaggugaaggagguguucaaggccucccccuuccucgucggggacgacugcgugagcaucaugaacggcaccgacgaggggguguccgccuggaucaccaucaacuuccugaccggcagccugaagaccccgggcggguccagcgucggcaugcucgaccucgggggcggguccacgcagaucgccuuccugccccggguggagggcacccugcaggccagcccgcccggcuaccugaccgcgcugcgcauguucaaccggaccuacaagcucuacuccuacagcuaccuggggcugggccucauguccgcccgccuggccauccucgggggcguggaggggcagcccgccaaggacggcaaggagcuggucagccccugccugucccccagcuucaagggcgagugggagcacgccgaggugacguaccgggugagcgggcagaaggcggccgccucccugcacgagcucugcgccgcgcgcgucagcgaggugcugcagaaccgggugcaccgcaccgaggaggucaagcacguggacuucuacgccuucuccuacuacuacgaccuggccgccggcgucgggcucaucgacgccgagaagggcgggagccugguggugggcgacuucgagaucgcggccaaguacgucugccggacccuggagacccagccccaguccagcccguucuccugcauggaccucacguacgugagccugcugcuccaggaguucggcuucccccgcuccaaggugcugaagcugacccggaagaucgacaacgucgagaccagcugggcccucggggccaucuuccacuacaucgacucccugaaccgccagaagucccccgccagcuga

SEQ ID NO: 29691 - RNA, 1815 nt, Artificial Sequence
  derived and/or modified sequence opt1 from ENTPD7__Homo_sapiens__NP_065087
auggcccgcaucagcuucuccuaccugugccccgccagcugguacuucaccgugccgaccgugucccccuuccuccggcagcgcguggccuuccugggccuguucuucaucagcugccuccugcugcucaugcugaucaucgacuuccggcacugguccgccagccugccccgcgaccggcaguacgagcgcuaccucgcccgggugggggagcuggaggccacggacaccgaggaccccaaccugaacuacggccucgucguggacugcggguccagcggcucccgcaucuucguguacuucuggccgcggcacaacgggaacccccacgaccugcuggacaucaagcagaugcgcgaccggaacagccagcccgucgugaagaagaucaagcccggcaucuccgccauggcggacaccccggagcacgccagcgacuaccuccgcccccugcuguccuucgccgccgcgcacgugcccgucaagaagcacaaggagacgccccucuacauccugugcaccgccggcaugcggcugcucccggagcgcaagcagcuggccauccuggccgaccucgugaaggaccugccccuggaguucgacuuccucuucagccagucccaggccgaggugaucagcgggaagcaggagggcgucuacgcguggaucgggaucaacuucgugcugggccgguucgaccacgaggacgaguccgacgccgaggccacccaggagcuggccgccgggcgccggcgcaccgugggcauccucgacaugggcggggcgagccugcagaucgccuacgagguccccaccuccacgagcgugcugcccgccaagcaggaggaggccgccaagauccuccuggcggaguucaaccugggcugcgacgugcagcacaccgagcacgucuaccggguguacgugaccaccuuccucggguucggcggcaacuucgcccgccagcgguacgaggaccugguccugaacgagacgcucaacaagaaccgccugcuggggcagaagaccggccucagcccggacaaccccuuccuggaccccugccugcccguggggcucaccgacguggucgagcgcaacucccaggugcugcacguccggggccgcggggacugggugagcugcggcgccaugcuguccccgcuccuggcccggagcaacaccucccaggccagccugaacggcaucuaccagucccccaucgacuucaacaacagcgaguucuacggguucuccgaguucuucuacugcacggaggacgugcugcgcaucggcgggcgguaccacggccccaccuucgcgaaggccgcccaggacuacugcgggauggccuggagcguccucacccagcgcuucaagaacggccuguucuccagccacgcggacgagcaccggcugaaguaccagugcuucaaguccgccuggauguaccaggugcuccacgagggcuuccacuuccccuacgacuacccgaaccugcgcaccgcccagcugguguacgaccgggagguccaguggacgcucggggccauccuguacaagacccgcuuccugccccuccgggaccugcgccaggagggcgugcggcaggcccacgggagcugguuccgccuguccuucguguacaaccacuaccucuucuucgcgugcauccuggucgugcugcucgccaucuuccuguaccugcuccggcugcgccggauccaccaccgccagacccgggccagcgcgccccuggaccuccuguggcuggaggaggugguccccaugaugggcguccagguggggccguga

SEQ ID NO: 29692 - RNA, 1584 nt, Artificial Sequence
  derived and/or modified sequence opt1 from EOGT__Homo_sapiens__NP_001265618
augcugaugcuguucguguucggcguccuccugcacgaggugagccucuccgggcagaacgaggcgcccccgaacacccacagcauccccggcgagccccuguacaacuacgccuccauccgccugcccgaggagcacaucccguucuuccuccacaacaaccggcacaucgccaccgugugccgcaaggacagccugugccccuacaagaagcaccuggagaagcucaaguacugcuggggguacgagaaguccugcaagcccgaguuccgguucggcuaccccgucugcagcuacguggacaugggguggacggacacccuggaguccgccgaggacaucuucuggaagcaggccgacuucggcuacgcccgcgagcggcuggaggagaugcacgugcucugccagccgaaggagaccagcgacuccagccuggucugcucccgcuaccugcaguacugccgggccaccaaccucuaccuggaccugcgcaacaucaagcggaaccacgaccgcuucaaggaggacuucuuccagagcggcgagaucgggggccacugcaagcucgacauccggacgcugaccuccgaggggcagcgcaagagcccccugcaguccugguucgcggagcuccagagcuacacccagcugaacuuccggcccaucgaggacgccaagugcgacaucgugaucgagaagcccaccuacuucaugaagcuggacgccggcgugaacauguaccaccacuucugcgacuucaucaaccucuacaucacgcagcacgucaacaacuccuucagcaccgacguguacaucgugaugugggacaccuccagcuacggguacggcgaccuguucagcgacaccuggaacgccuucacggacuacgacgucauccaccugaagaccuacgacuccaagcgcgugugcuucaaggaggcgguguucagccuccugccgcggaugcgcuacggccuguucuacaacacgccccucaucuccgggugccagaacaccggccuguuccgggccuucgcccagcacguccugcaccgccucaacaucacccaggaggggcccaaggacggcaagauccgggugaccauccuggcccgcagcaccgaguaccggaagauccugaaccagaacgagcucgugaacgcccugaagaccgucuccacguucgaggugcagaucguggacuacaaguaccgcgagcugggcuuccucgaccagcugcgcaucacccacaacaccgacaucuucaucgggaugcacggcgcggggcugacccaccuccuguuccugcccgacugggccgccgucuucgagcucuacaacugcgaggacgagcggugcuaccuggaccuggcccgccuccggggcgugcacuacaucacguggcgccggcagaacaagguguucccgcaggacaaggggcaccaccccacccugggcgagcaccccaaguucaccaacuacagcuucgacgucgaggaguucauguaccuggugcugcaggccgcggaccacguccuccagcaccccaaguggccguucaagaagaagcacgacgagcuguga

SEQ ID NO: 29693 - RNA, 2118 nt, Artificial Sequence
  derived and/or modified sequence opt1 from EOMES__Homo_sapiens__NP_001265111
augcagcugggcgagcagcuccuggugagcuccgucaaccugcccggggcccacuucuacccgcucgagagcgcccgcggcggguccggcgggagcgcgggccaccuccccuccgccgcccccagcccccagaagcuggaccuggacaaggccuccaagaaguucagcggcucccugagcugcgaggccguguccggggagccggcggccgccagcgccggcgcgcccgccgccaugcuguccgacaccgacgccggggacgccuucgcgagcgccgccgccguggccaagcccgggcccccggacgggcggaagggcucccccugcggcgaggaggagcuccccagcgcggccgccgccgccgcggccgccgccgccgcggccgccgccaccgcgcgcuacuccauggacagccuguccagcgagcgguacuaccugcagagccccgggccgcagggcuccgagcucgccgcccccugcagccuguuccccuaccaggccgccgcgggggcgccccacggcccggucuaccccgcccccaacggcgcccgcuaccccuacggguccaugcugccgcccggcggguuccccgccgccgugugcccgcccggccgggcccaguucgggcccggcgccggcgccgggagcggcgccgggggcuccagcgggggcggcgggggccccgggacguaccaguacucccagggcgcgccccucuacgggccguaccccggcgccgccgccgcgggcagcugcgggggccucgggggccugggcgugcccggguccggcuuccgcgcccacgucuaccugugcaaccggccgcuguggcugaaguuccaccgccaccagaccgagaugaucaucaccaagcaggggcggcgcauguuccccuuccucagcuucaacaucaacggccugaaccccaccgcccacuacaacguguucguggaggucgugcuggccgaccccaaccacuggcgguuccagggcggcaagugggugacgugcggcaaggccgacaacaacaugcaggggaacaagauguacguccacccggagucccccaacaccggcagccacuggaugcgccaggagaucuccuucgggaagcucaagcugaccaacaacaagggcgcgaacaacaacaacacccagaugaucgugcugcagagccuccacaaguaccagccccggcugcacaucguggaggucacggaggacgggguggaggaccugaacgagcccuccaagacccagaccuucaccuucagcgagacgcaguucaucgccgugaccgccuaccagaacaccgacaucacccagcucaagaucgaccacaacccguucgccaagggcuuccgcgacaacuacgacuccauguacacggccagcgagaacgaccggcugacccccucccccaccgacagcccccgcagccaccagaucgucccgggcgggcgguacggcgugcaguccuucuuccccgagcccuucgugaacacccugccccaggcgcgcuacuacaacggggagcggacggucccgcagaccaacggccuccugagcccccagcaguccgaggagguggccaacccgccccagcgcuggcuggugacccccguccagcagcccgggaccaacaagcucgacaucagcuccuacgagagcgaguacacguccagcacccugcugcccuacggcaucaagucccucccccugcagaccagccacgcccugggcuacuacccggaccccaccuuccccgccauggccggguggggcgggcggggcuccuaccagcgcaagauggcggccgggcucccguggacgagccgcaccucccccaccguguucagcgaggaccagcuguccaaggagaaggucaaggaggagaucggcagcuccuggaucgagaccccgcccagcaucaagagccuggacuccaacgacagcggcguguacacguccgccugcaagcggcgccggcucagccccuccaacagcuccaacgagaacagccccuccaucaagugcgaggacaucaacgccgaggaguacagcaaggacaccuccaaggggaugggcggguacuacgcguucuacaccacccccuga

SEQ ID NO: 29694 - RNA, 7245 nt, Artificial Sequence
  derived and/or modified sequence opt1 from EP300__Homo_sapiens__NP_001420
auggccgagaacgugguggagcccggcccgcccuccgccaagcgccccaagcuguccucccccgcccucuccgccagcgccuccgacgggaccgacuucggcagccuguucgaccuggagcacgaccuccccgacgagcugaucaacuccaccgagcuggggcucaccaacggcggggacaucaaccagcugcagaccagccugggcauggugcaggacgccgccuccaagcacaagcagcucagcgagcugcugcgguccggcagcucccccaaccucaacaugggggugggcgggcccggccaggugauggccagccaggcccagcaguccagccccgggcugggccugaucaacuccauggugaagucccccaugacccaggccggccucaccucccccaacauggggaugggcaccagcgggcccaaccagggccccacccagagcaccggcaugaugaacucccccgugaaccagcccgccauggggaugaacaccggcaugaacgccgggaugaaccccggcaugcuggccgccgggaacggccagggcaucaugcccaaccaggucaugaacgggagcaucggcgccgggcgcggccggcagaacaugcaguaccccaaccccgggaugggcuccgccggcaaccugcucaccgagccccugcagcaggggagcccccagaugggcgggcagaccggccugcgcgggccccagccccucaagaugggcaugaugaacaaccccaaccccuacggcucccccuacacccagaaccccgggcagcagaucggcgcgagcgggcugggccugcagauccagaccaagaccgugcucuccaacaaccugagccccuucgccauggacaagaaggccgugcccggcgggggcaugccgaacauggggcagcagcccgcgccccagguccagcagccgggccuggugacccccguggcccaggggaugggcuccggcgcgcacaccgccgaccccgagaagcggaagcucauccagcagcagcugguccugcuccugcacgcccacaagugccagcgccgggagcaggccaacggggaggugcgccagugcaaccugccccacugccggaccaugaagaacgugcucaaccacaugacccacugccagagcggcaaguccugccaggucgcccacugcgcgagcucccgccagaucaucagccacuggaagaacugcacccggcacgacugcccggugugccugccccugaagaacgccggggacaagcgcaaccagcagcccauccucaccggcgcccccguggggcugggcaacccguccagccugggcgucgggcagcaguccgcccccaaccucagcaccgugucccagaucgaccccagcagcaucgagcgggccuacgcggcccugggccugcccuaccaggugaaccagaugccgacccagccccagguccaggccaagaaccagcagaaccagcagcccgggcagagcccccagggcaugcgcccgaugagcaacauguccgccagccccaugggggugaacggcggcguggggguccagacccccucccuccugagcgacuccaugcugcacagcgcgaucaacucccagaaccccaugaugagcgagaacgccuccgugccgagccucggccccaugcccaccgccgcccagcccuccaccaccgggauccggaagcaguggcacgaggacaucacccaggaccugcgcaaccaccugguccacaagcucgugcaggccaucuucccgacccccgaccccgcggcccugaaggaccggcgcauggagaaccugguggccuacgcccggaaggucgagggcgacauguacgagagcgccaacaaccgcgcggaguacuaccaccuccuggccgagaagaucuacaagauccagaaggagcuggaggagaagcggcgcacccgccugcagaagcagaacaugcucccgaacgccgccgggauggugcccguguccaugaaccccggccccaacaugggccagccgcagcccgggaugacgagcaacggcccccugcccgacccguccaugauccgggggagcguccccaaccagaugaugccccgcaucacgccccagagcggccugaaccaguucggccagauguccauggcccagccgcccaucgugccccggcagacgccgccccuccagcaccacgggcagcuggcgcagcccggcgcccugaacccgcccaugggguacggcccccgcaugcagcagcccagcaaccaggggcaguuccucccccagacccaguuccccucccagggcaugaacgugacgaacaucccgcuggcccccagcuccggccaggcccccgucagccaggcgcagauguccagcuccagcugccccgugaacuccccgaucaugccgcccgggagccagggcucccacauccacugcccgcagcugccccagcccgcccuccaccagaacagccccuccccggugcccagccggacccccacgccccaccacaccccgcccuccaucggggcccagcagccgcccgccacgaccaucccggcccccguccccacgccgcccgcgaugccgcccggcccccagagccaggcccugcacccgccgccccgccagacccccaccccgcccacgacccagcugccccagcagguccagcccucccuccccgccgcccccagcgccgaccagccccagcagcagccgcggagccagcaguccaccgcggccagcgugcccacccccacggcgccccugcugccgccccagcccgccacgccccugucccagccggccgucagcaucgagggccagguguccaacccgcccagcaccuccagcaccgaggugaacucccaggcgaucgccgagaagcagcccagccaggaggucaagauggaggccaagauggagguggaccagccggagcccgccgacacgcagcccgaggacaucuccgagagcaagguggaggacugcaagauggaguccaccgagaccgaggagcgcagcaccgagcugaagacggagaucaaggaggaggaggaccagcccuccaccagcgcgacccaguccagcccggcccccggccaguccaagaagaagaucuucaagcccgaggagcugcggcaggcccucaugcccacccuggaggcccuguaccgccaggacccggagagccuccccuuccggcagcccgucgacccccagcugcugggcaucccggacuacuucgacaucgugaagucccccauggaccucuccacgaucaagcgcaagcuggacaccgggcaguaccaggagcccuggcaguacguggacgacaucuggcugauguucaacaacgccuggcucuacaaccggaagaccagccgcgucuacaaguacugcuccaagcugagcgagguguucgagcaggagaucgacccggugaugcagucccugggcuacugcugcgggcggaagcucgaguucagcccccagacccugugcugcuacggcaagcagcugugcacgaucccccgcgacgcgaccuacuacuccuaccagaaccgguaccacuucugcgagaagugcuucaacgagauccagggggagagcgucucccucggcgacgaccccagccagccgcagaccaccaucaacaaggagcaguucuccaagcgcaagaacgacacgcuggaccccgagcuguucguggagugcaccgagugcggccggaagaugcaccagaucugcgugcuccaccacgagaucaucuggcccgccggguucgucugcgacggcugccugaagaaguccgcccgcacccgcaaggagaacaaguucuccgccaagcggcugcccagcacccgccucgggacguuccuggagaaccgggugaacgacuuccugcgccggcagaaccacccggaguccggcgaggugaccguccgcguggugcacgccagcgacaagaccgucgaggugaagcccggcaugaaggcgcgguucguggacuccggggagauggccgagagcuuccccuaccgcaccaaggcccucuucgccuucgaggagaucgacggcgucgaccugugcuucuucgggaugcacgugcaggaguacggcuccgacugcccgccgcccaaccagcggcgcguguacaucagcuaccuggacagcguccacuucuuccggcccaagugccuccgcacggccguguaccacgagauccugaucggguaccuggaguacgugaagaagcucggcuacaccaccggccacaucugggcgugcccgcccuccgagggggacgacuacaucuuccacugccacccgcccgaccagaagauccccaagcccaagcggcugcaggagugguacaagaagaugcuggacaaggccgucagcgagcgcaucgugcacgacuacaaggacaucuucaagcaggccaccgaggaccggcucacguccgccaaggagcugcccuacuucgagggcgacuucuggcccaacgugcuggaggagagcaucaaggagcucgagcaggaggaggaggagcgcaagcgggaggagaacaccuccaacgagagcaccgacgucaccaagggggacuccaagaacgccaagaagaagaacaacaagaagaccagcaagaacaaguccagccugucccgcggcaacaagaagaagcccgggaugcccaacgugagcaacgaccugucccagaagcucuacgcgacgauggagaagcacaaggagguguucuucgucauccggcugaucgccggccccgccgccaacagccugccgcccaucguggaccccgacccccucauccccugcgaccugauggacggccgcgacgcguuccugacccucgcccgggacaagcaccuggaguucuccagccugcgccgcgcccagugguccaccaugugcaugcucgucgagcugcacacccagagccaggaccgguucguguacacgugcaacgagugcaagcaccacguggagacccgcuggcacugcaccgucugcgaggacuacgaccugugcaucacgugcuacaacacgaagaaccacgaccacaagauggagaagcucgggcugggccuggacgacgaguccaacaaccagcaggccgccgcgacccagagcccgggggacagccggcgccucuccauccagcggugcauccagagccuggugcacgccugccagugccgcaacgccaacugcucccugcccagcugccagaagaugaagcgggugguccagcacaccaagggcugcaagcgcaagaccaacgggggcugccccaucugcaagcagcucaucgcccugugcugcuaccacgccaagcacugccaggagaacaagugccccgugccguucugccugaacaucaagcagaagcuccggcagcagcagcugcagcaccgccugcagcaggcgcagaugcuccggcgccggauggccuccaugcagcgcacgggcguggucgggcagcagcagggccugcccagccccacccccgccaccccgaccacgcccaccgggcagcagcccaccacgccccagacgccgcagcccaccucccagccccagcccaccccgcccaacagcaugccgcccuaccugccccggacccaggccgccggccccgugucccaggggaaggcggccggccaggugacgccgcccaccccgccccagaccgcccagccgccccucccggggccgccgcccgccgcggucgagauggccaugcagauccagcgcgccgccgagacccagcggcagauggcccacgugcagaucuuccagcgccccauccagcaccagaugccgcccaugacgcccauggcgcccauggggaugaacccgccgcccaugacccggggccccagcgggcaccuggagcccggcaugggccccaccgggaugcagcagcagccgcccuggucccagggcgggcugccccagccccagcagcuccagagcggcaugccccgccccgccaugauguccguggcccagcacgggcagccccugaacauggcgccccagccgggccugggccaggucgggaucagcccccucaagcccggcaccgugucccagcaggcccugcagaaccugcugcgcacgcuccggagccccuccagcccgcugcagcagcagcagguccuguccauccuccacgcgaacccccagcugcuggccgccuucaucaagcagcgcgccgccaaguacgcgaacagcaacccccagcccaucccggggcagcccggcaugccccaggggcagccgggccuccagccgcccaccaugcccggccagcaggggguccacagcaaccccgccaugcagaacaugaaccccaugcaggccggcgugcagcgggccgggcugccccagcagcagccccagcagcagcugcagccgcccaugggcgggaugagcccccaggcgcagcagaugaacaugaaccacaacaccaugcccagccaguuccgcgacauccuccggcgccagcagaugaugcagcagcagcagcagcagggcgccggcccggggaucggccccgggauggccaaccacaaccaguuccagcagccccagggcgugggguacccgccccagcagcagcagcggaugcagcaccacaugcagcagaugcagcagggcaacaugggccagaucgggcagcugccccaggcccugggcgccgaggcgggggccucccuccaggccuaccagcagcgccugcugcagcagcagaugggcagccccguccagcccaaccccaugagcccccagcagcacaugcuccccaaccaggcccagagcccccaccuccagggccagcagaucccgaacucccugagcaaccaggugcggagcccccagcccgugccgagcccccgcccccagucccagcccccgcacagcucccccagcccccggaugcagccccagccgagcccccaccacgucagcccccagaccuccagcccccacccggggcucguggccgcgcaggccaaccccauggagcagggccacuucgccagccccgaccagaacuccaugcugagccagcuggccuccaaccccgggauggccaaccuccacggcgcgagcgccacggaccuggggcuguccaccgacaacagcgaccucaacuccaaccugagccaguccacccuggacauccacuga

SEQ ID NO: 29695 - RNA, 9372 nt, Artificial Sequence
  derived and/or modified sequence opt1 from EP400__Homo_sapiens__NP_056224
augcaccacggcaccggcccccagaacgugcagcaccagcugcagcgcagccgggccugccccggcuccgagggcgaggagcagcccgcccaccccaacccgccgcccagccccgccgcccccuucgcccccuccgccagccccuccgcgccccagagccccuccuaccagauccagcagcucaugaaccgcagccccgccaccggccagaacgugaacaucacccugcaguccguggggcccguggugggcggcaaccagcagaucacccuggcgccccucccccugcccagccccaccucccccggguuccaguucagcgcccagccccggcgcuucgagcacggcucccccagcuacauccaggugaccagcccccucagccagcagguccagacgcagucccccacccagcccagcccggggcccggccaggcccuccagaacguccgggccggggcccccggccccggccuggggcugugcuccagcagccccaccggcggguucguggacgccuccgugcucgugcgccagaucagccugucccccagcuccggcggccacuucguguuccaggacgggagcggccugacccagaucgcccagggggcccaggugcagcuccagcaccccggcacccccaucaccgugcgggagcgccggcccucccagccccacacccagagcgggggcaccauccaccaccugggcccccagucccccgccgccgccgggggcgccgggcugcagccccucgccagccccucccacaucacgaccgccaaccugccgccccagaucagcuccaucauccagggccagcuggugcagcagcagcagguccuccaggggccgccccucccccgcccccugggcuucgagcggacccccggcgugcuccugcccggggccggcggggccgccggcuucgggaugaccuccccgcccccgcccacgucccccagccgcaccgccgugccgcccggccuguccagccucccccugaccuccgugggcaacaccgggaugaagaaggugcccaagaagcuggaggagaucccgcccgccagccccgagauggcccagaugcggaagcagugccucgacuaccacuaccaggagaugcaggcccugaaggagguguucaaggaguaccugaucgagcuguucuuccugcagcacuuccagggcaacaugauggacuuccuggccuucaagaagaagcacuacgcgccccuccaggccuaccugcgccagaacgaccuggacaucgaggaggaggaggaggaggaggaggaggaggaggagaaguccgaggugaucaacgacgagcagcaggcccucgccgggucccugguggccggcgccggcagcacgguggagaccgaccuguucaagcggcagcaggccaugcccuccaccgggauggccgagcagagcaagcgcccccggcucgaggugggccaccagggggugguguuccagcaccccggcgccgacgccggggucccccugcagcagcugaugcccaccgcgcagggcggcaugccgcccacgccccaggccgcccagcucgccgggcagcgccagucccagcagcaguacgaccccagcaccgggccgcccgugcagaacgccgcgucccugcacacgccccugccccagcuccccgggcggcugccgcccgccggcgugcccaccgccgcccugagcuccgcccuccaguucgcgcagcagccccaggucguggaggcccagacccagcugcagauccccgugaagacccagcagcccaacguccccauccccgcgccgcccagcucccagcugcccaucccgcccagccagcccgcccagcuggcgcuccacgugcccacccccgggaaggugcagguccaggccucccagcugagcucccugccccagaugguggccagcacccgccuccccguggaccccgcgccgcccugcccccggccccugcccacguccagcaccagcucccuggcccccgucagcggcuccggccccgggcccagccccgcgcgcuccagccccgugaaccgccccuccagcgccaccaacaaggcccucucccccgugaccagccggacgcccggcgucguggccuccgcccccaccaagccccagagccccgcgcagaacgccaccuccagccaggacuccagccaggacacccugaccgagcagaucacgcuggagaaccaggugcaccagcgcaucgccgagcuccggaaggccgggcuguggucccagcgccggcugcccaagcuccaggaggcgccccgccccaagagccacugggacuaccugcuggaggagaugcaguggauggccaccgacuucgcccaggagcggcgcuggaaggucgccgccgcgaagaagcucgugcggaccgugguccgccaccacgaggagaagcagcugcgggaggagcgcggcaagaaggaggagcagucccggcugcgccggaucgccgccagcaccgcccgcgagaucgagugcuucuggagcaacaucgagcaggucguggagaucaagcuccgggucgagcuggaggagaagcgcaagaaggcccugaaccuccagaaggugucccggcgcgggaaggagcugcgccccaagggcuucgacgcgcugcaggagagcucccucgacagcggcauguccgggcggaagcgcaaggccagcaucucccugacggacgacgagguggacgacgaggaggagaccaucgaggaggaggaggccaacgagggcgucguggaccaccagaccgagcugagcaaccucgccaaggaggccgagcugccccugcucgaccugaugaagcuguacgagggggcguuccucccguccagccaguggccccggcccaagcccgacggcgaggacaccuccggggaggaggacgccgacgacugcccgggcgaccgcgagagccggaaggaccuggugcugaucgacucccucuucaucauggaccaguucaaggccgccgagcgcaugaacaucggcaagcccaacgccaaggacaucgcggacgucacggccguggccgaggccauccugcccaaggggagcgcccgggugaccaccuccgugaaguucaacgcgccgagccuccucuacggcgcccugcgcgacuaccagaagaucgggcuggacuggcucgccaagcuguaccggaagaaccugaacggcauccucgccgacgaggcgggccuggggaagaccgugcagaucaucgccuucuucgcccaccuggccugcaacgagggcaacugggggccccaccucguggucgugcgcuccugcaacauccugaagugggagcuggagcucaagcgguggugccccggccugaagauccugagcuacaucgggucccaccgcgagcucaaggccaagcggcaggagugggcggagcccaacagcuuccacgugugcaucacgagcuacacccaguucuuccgcggccugaccgccuucacccggguccgcuggaagugccuggugaucgacgagaugcagcgggugaagggcaugacggagcgccacugggaggccgucuucacccuccagucccagcagcggcugcugcucaucgacagcccgcugcacaacaccuuccuggagcucuggaccauggugcacuuccuggugcccgggaucucccgccccuaccugagcagcccccugcgggccccgagcgaggagucccaggacuacuaccacaaggucgugauccgccugcaccgcgugacgcagcccuucauccugcggcgcaccaagcgggacgucgagaagcagcucaccaagaaguacgagcacgugcugaagugccgccugagcaaccggcagaaggcccucuacgaggacgugauccugcagcccggcacccaggaggcgcugaaguccgggcacuucgucaacgugcucagcauccugguccgccugcagcggaucugcaaccaccccggccucguggagccgcgccaccccggguccagcuacguggccggcccccuggaguaccccuccgccagccugauccucaaggcccuggagcgggacuucuggaaggaggccgaccuguccauguucgaccucaucggccuggagaacaagaucacgcgccacgaggcggagcugcucagcaagaagaagaucccgcggaagcugauggaggagaucuccaccagcgccgcccccgccgcgcgccccgccgccgccaagcugaaggccucccgccuguuccagcccguccaguacgggcagaagccggagggccgcaccguggcguuccccagcacccacccgccccggacggccgccccgaccaccgccagcgccgcgccccaggggccccugcgcggccggccgcccaucgccaccuucuccgccaaccccgaggccaaggccgcggccgcccccuuccagacgagccaggccuccgcgagcgccccgcgccaccagcccgccuccgccagcuccaccgccgcgagccccgcccaccccgccaagcugcgggcccagaccaccgcccaggcguccacgccggggcagccgccgccccagccgcaggcccccagccacgccgccggccaguccgcccucccccagcgccuggugcugcccagccaggcgcaggcccgccugccguccggcgaggucgugaagaucgcccagcucgccagcaucaccgggccccagucccggguggcccagcccgagacccccgucacccugcaguuccagggcagcaaguucacccugucccacagccagcuccgccagcugacggcggggcagccgcugcagcuccagggcuccgugcugcagaucgugagcgcccccggccagcccuaccugcgggcccccgggccggucgugaugcagaccgugagccaggccggcgcgguccacggggcccucggcuccaagccgcccgccgggggccccagcccggcgccccugacgccccaggugggcgugccggggcgcgucgccgugaacgcgcuggccgugggcgagcccgggaccgccuccaagcccgccagccccaucggcgggccgacgcaggaggagaagacccggcuccugaaggagcgccuggaccagaucuaccucgucaacgagcggcgcugcucccaggcccccguguacggccgggaccugcugcgcaucugcgcgcuccccagccacggccgggugcaguggcgcgggucccuggacggccggcgcgggaaggaggccggccccgcccacagcuacaccuccagcuccgagagcccguccgagcugaugcucacccugugccggugcggggagagccugcaggacgucaucgaccgcguggccuucgugaucccgcccgucguggccgcgcccccgucccuccgggugccccgcccgccgccccuguacagccaccggaugcgcauccugcggcagggccuccgcgagcacgccgcccccuacuuccagcagcugcgccagacgaccgcgccccgccugcuccaguuccccgagcugcgccugguccaguucgacuccggcaagcucgaggcccuggccauccugcuccagaagcugaaguccgaggggcggcgcgugcugauccucucccagaugauccugaugcuggacauccucgagauguuccugaacuuccacuaccugaccuacgugcggaucgacgagaacgccagcagcgagcagcgccaggagcucaugcgguccuucaaccgcgaccggcgcaucuucugcgccauccugagcacccacucccggacgaccggcaucaaccuggucgaggccgacaccgugguguucuacgacaacgaccucaaccccgucauggacgcgaaggcccaggaguggugcgaccgcaucgggcggugcaaggacauccacaucuaccgccuggugagcggcaacuccaucgaggagaagcugcucaagaacgggaccaaggaccugauccgggagguggccgcccagggcaacgacuacagcauggccuuccugacgcagcgcaccauccaggagcuguucgaggucuacucccccauggacgacgcgggcuuccccgugaaggccgaggaguucgugguccugagccaggagcccuccgugaccgagaccaucgccccgaagaucgcccggcccuucaucgaggcccucaagagcaucgaguaccucgaggaggacgcgcagaaguccgcccaggagggggugcugggcccccacacggacgcccugagcuccgacagcgagaacaugcccugcgacgaggagccgucccagcucgaggagcuggccgacuucauggagcagcugacccccaucgagaaguacgcgcucaacuaccuggagcuguuccacaccagcaucgagcaggagaaggagcgcaacuccgaggacgccgucaugaccgccgugcgggccugggaguucuggaaccucaagacgcugcaggagcgcgaggcccgccugcggcucgagcaggaggaggcggagcugcugaccuacacccgcgaggacgccuacagcauggaguacguguacgaggacgucgacgggcagaccgaggugaugccccucuggacgccgcccacgccgccccaggacgacagcgacaucuaccuggacuccgugaugugccugauguacgaggccaccccgauccccgaggccaagcugccgcccgucuacgugcggaaggagcgcaagcggcacaagaccgacccgagcgccgcgggccgcaagaagaagcagcggcacggcgaggccgucgugccgccccggucccuguucgaccgggccacgcccgggcugcucaagauccgccgggagggcaaggagcagaagaagaacauccugcugaagcagcaggucccguucgccaagccccuccccaccuucgccaagcccaccgcggagccggggcaggacaaccccgaguggcugaucagcgaggacugggcccugcuccaggccgucaagcagcugcuggagcucccccugaaccugaccaucgugucccccgcccacacgccgaacugggaccucgugagcgacgucgugaacuccugcagccgcaucuaccgguccagcaagcagugccgcaaccgguacgagaacgugaucaucccccgcgaggagggcaaguccaagaacaaccggccccugcgcaccagccagaucuacgcccaggacgagaacgcgacccacacccagcuguacaccucccacuucgaccucaugaagaugacggccgggaagcggagcccgcccaucaagccccugcugggcaugaaccccuuccagaagaaccccaagcacgccuccguccucgccgagagcggcaucaacuacgacaagccccugccgcccauccagguggcgucccugcgcgccgagcggaucgccaaggagaagaaggcccucgccgaccagcagaaggcgcagcagccggccguggcccagccgccgccgccccagccccagcccccgcccccgccccagcagcccccgccgccccugccccagccccaggccgccgggagccagccgcccgcggggccgcccgccguccagccccagccccagccccagccccagacccagccccagcccgugcaggccccggccaaggcccagcccgcgaucaccaccgggggcuccgccgccgugcuggccgggacgaucaagaccagcgucaccggcaccagcaugcccacgggcgcgguguccgggaacgugaucgucaacaccaucgccggcgugcccgccgccaccuuccagagcaucaacaagcgccuggccuccccgguggcgcccggggcccucaccacgcccggcgggagcgcccccgcccaggucgugcacacccagccgccgccccgggccgugggcucccccgcgaccgccaccccggaccuggucagcauggccacgacccagggcgugcgggccgugaccuccgucaccgccagcgcgguggugacgaccaaccugacccccguccagacccccgcccgcucccucgugccccaggugagccaggccacggggguccagcugccgggcaagaccaucacccccgcccacuuccagcugcuccggcagcagcagcagcagcagcagcagcagcagcagcagcagcagcagcagcagcagcagcagcagcagcagcagcagcagcagcagcagaccacgaccaccucccagguccaggugccccagauccaggggcaggcccagagccccgcgcagaucaaggccgucggcaagcugaccccggagcaccugaucaagaugcagaagcagaagcuccagaugccgccccagcccccgccgccccaggcccaguccgcgccgccccagcccacggcccagguccaggugcagaccagccagccgccccagcagcagagcccccagcugaccaccgucacggcgccccgccccggggcccugcucaccggcaccaccguggccaaccuccagguggcccggcugacgcgcguccccaccagccagcuccaggcgcagggccagaugcagacccaggcgccccagcccgcccagguggcccuggccaagcccccgguggucuccgugcccgcggccguggucagcucccccggggugaccacccugcccaugaacguggccggcaucagcgucgccaucgggcagccgcagaaggccgcgggccagacgguggucgcccagcccgugcacaugcagcagcuccugaagcugaagcagcaggccgugcagcagcagaaggccauccagccccaggcggcccagggccccgccgccguccagcagaagaucaccgcccagcagaucaccaccccgggggcgcagcagaagguggccuacgccgcccagcccgcccucaagacgcaguuccugaccacccccaucagccaggcgcagaagcuggccggcgcccagcagguccagacccagauccaggucgccaagcucccccagguggugcagcagcagacgccggucgccuccauccagcaggucgcgagcgccucccagcaggccagcccccagaccguggcccugacccaggcgaccgccgccgggcagcagguccagaugauccccgccgugacggccaccgcccaggugguccagcagaagcugauccagcagcaggucgugaccaccgccuccgcgccccuccagacgccgggcgcccccaaccccgcccagguccccgcgagcuccgacagcccgucccagcagcccaagcugcagaugcgggugcccgccgugcgccugaagaccccgaccaagccgcccugccaguga

SEQ ID NO: 29696 - RNA, 2613 nt, Artificial Sequence
  derived and/or modified sequence opt1 from EPAS1__Homo_sapiens__NP_001421
augaccgccgacaaggagaagaagcgcagcuccagcgagcggcgcaaggagaagucccgggacgccgcgcgcugccggcgcagcaaggagaccgagguguucuacgagcuggcccacgagcucccccugccgcacuccgucagcucccaccuggacaaggccagcaucaugcggcucgccaucuccuuccugcgcacgcacaagcugcucagcuccgugugcagcgagaacgaguccgaggccgaggcggaccagcagauggacaaccuguaccugaaggcccucgagggcuucaucgccguggucacccaggacggggacaugaucuuccugagcgagaacaucuccaaguucaugggccugacccagguggagcucaccgggcacagcaucuucgacuucacgcaccccugcgaccacgaggagauccgggagaaccugucccugaagaacggcagcggguucggcaagaaguccaaggacaugagcaccgagcgcgacuucuucaugcggaugaagugcaccgugaccaaccgcggccggacggucaaccucaagagcgccaccuggaaggugcugcacugcaccgggcaggugaaggucuacaacaacugccccccccacaacucccugugcggcuacaaggagccgcuccugagcugccugaucaucaugugcgagcccauccagcaccccucccacauggacaucccccucgacagcaagaccuuccugucccgccacagcauggacaugaaguucacguacugcgacgaccggaucaccgagcugaucggguaccacccggaggagcuccugggccgcuccgcguacgaguucuaccacgcccuggacagcgagaacaugaccaagucccaccagaaccucugcaccaaggggcagguggugagcggccaguaccggaugcuggccaagcacggcggguacgucuggcuggagacgcagggcaccgugaucuacaacccccgcaaccuccagccccagugcaucaugugcgugaacuacguccuguccgagaucgagaagaacgacgugguguucagcauggaccagaccgagucccuguucaagccccaccucauggccaugaacagcaucuucgacuccagcgggaagggcgccgucuccgagaagagcaacuuccuguucaccaagcugaaggaggagccggaggagcucgcgcagcuggcccccacgcccggcgacgccaucaucucccuggacuucgggaaccagaacuucgaggagagcagcgccuacggcaaggccauccuccccccgucccagcccugggcgaccgagcugcggagccacuccacccagagcgaggccgggucccugcccgccuucaccgugccccaggccgccgcgccgggcagcacgacccccuccgccaccagcuccagcuccagcugcuccacccccaacagccccgaggacuacuacacgucccucgacaacgaccugaagaucgaggugaucgagaagcuguucgccauggacaccgaggccaaggaccagugcagcacccagaccgacuucaacgagcucgaccuggagacgcuggccccguacauccccauggacggggaggacuuccagcucucccccaucugccccgaggagcgccugcuggcggagaacccgcagagcaccccccagcacugcuucagcgccaugaccaacaucuuccagccccuggccccggucgccccccacucccccuuccuccuggacaaguuccagcagcagcuggagagcaagaagaccgagcccgagcaccggccgauguccagcaucuucuucgacgcgggcuccaaggccagccucccccccugcugcggccaggccuccacgccccugagcuccauggggggccgcagcaacacccaguggccgcccgaccccccccugcacuucgggccgaccaagugggccgugggcgaccagcgcaccgaguuccucggggccgcgccccugggcccccccguguccccgccccacgucagcaccuucaagacgcgguccgccaagggcuucggggcccgcggccccgacgugcugagccccgccauggucgcccucuccaacaagcugaagcugaagcggcagcucgaguacgaggagcaggcguuccaggaccugagcgggggcgacccgcccgggggcuccaccagccaccugauguggaagcgcaugaagaaccuccggggcggguccugcccccugaugcccgacaagccgcugagcgccaacgugcccaacgacaaguucacccagaaccccaugcgcggccucgggcacccgcugcggcaccugccccucccccagcccccgagcgccaucucccccggcgagaacagcaagucccgcuuccccccccagugcuacgccacccaguaccaggacuacagccuguccagcgcccacaagguguccggcauggcgagccggcugcucgggccguccuucgagagcuaccugcugcccgagcucacgcgcuacgacugcgaggucaacgugcccgugcugggcuccagcacccugcuccaggggggcgaccugcugcgggcccucgaccaggccaccuga

SEQ ID NO: 29697 - RNA, 2643 nt, Artificial Sequence
  derived and/or modified sequence opt1 from EPB41L1__Homo_sapiens__NP_001245258
augaccaccgagacgggccccgacagcgaggugaagaaggcccaggaggaggccccgcagcagcccgaggcggccgccgccgucaccacccccgugacccccgccgggcacggccacccggaggcgaacuccaacgagaagcaccccagccagcaggacacgcgccccgccgagcagucccuggacauggaggagaaggacuacagcgaggccgacgggcucuccgagcggaccacccccagcaaggcccagaaguccccgcagaagaucgcgaagaaguacaagagcgccaucugccgcgugacccugcuggacgccuccgaguacgagugcgaggucgagaagcacggccgggggcagguccucuucgaccuggugugcgagcaccugaaccuccuggagaaggacuacuucggccugacguucugcgacgccgacagccagaagaacuggcucgaccccuccaaggagaucaagaagcagauccgcagcucccccuggaacuucgccuucaccgugaaguucuacccgcccgaccccgcgcagcugaccgaggacaucacccgguacuaccugugccuccagcugcgcgccgacaucaucacgggccggcugcccugcagcuucgugacccacgcccuccugggguccuacgccgugcaggccgagcugggcgacuacgacgcggaggagcacgucgggaacuacgugagcgagcuccgcuucgcccccaaccagacccgggagcuggaggagcgcaucauggagcugcacaagaccuaccggggcaugacgccgggggaggccgagauccacuuccucgagaacgccaagaagcuguccauguacggcguggaccugcaccacgccaaggacagcgagggcaucgacaucaugcucggggucugcgcgaacggccugcugaucuaccgcgaccggcuccgcaucaaccgguucgccuggcccaagauccugaagaucuccuacaagcgcagcaacuucuacaucaagauccggcccggggaguacgagcaguucgagagcaccaucggcuucaagcugcccaaccaccgcuccgccaagcggcucuggaaggugugcaucgagcaccacaccuucuuccgccuggugagcccggagcccccgcccaagggcuuccuggucaugggguccaaguuccgguacagcggccgcacccaggcccagacgcgccaggccuccgcgcucaucgaccggcccgcccccuucuucgagcgcagcuccagcaagcgguacaccaugucccgcagccuggacggggccgaguucucccggcccgccagcguguccgagaaccacgacgcgggccccgacggggacaagcgcgacgaggacggcgagagcggcgggcagcgguccgaggccgaggagggcgaggugcgcaccccgaccaagaucaaggagcugaagcccgagcaggagacgacgccccggcacaagcaggaguuccucgacaagccggaggacguccugcugaagcaccaggccagcaucaacgagcucaagcgcacccugaaggagcccaacuccaagcugauccaccgggaccgcgacugggagcgggagcgccggcuccccagcucccccgccagcccgagccccaaggggacccccgagaaggccaacgagcgcgcgggccugcgggagggguccgaggagaaggugaagcccccgcgcccccgggcccccgagagcgacaccggcgacgaggaccaggaccaggagcgcgacaccguguuccugaaggacaaccaccucgccaucgagcgcaagugcuccagcaucaccgucuccagcaccuccagccuggaggccgagguggacuucacggugaucggcgacuaccacggguccgccuucgaggacuucagccggucccugcccgagcucgaccgcgacaagagcgacuccgacaccgagggccugcuguucagccgggaccugaacaagggggcgccgucccaggacgacgagagcggcgggaucgaggacucccccgaccgcggcgccugcagcacccccgacaugccccaguucgagccggucaagaccgagacgaugaccgugagcucccucgccauccggaagaagaucgagcccgaggccguccugcagacccgcgugagcgccauggacaacacccagguggacggcuccgcgagcgucgggcgggaguucaucgccaccacgcccuccaucaccaccgagaccaucagcacgaccauggagaacucccucaagagcggcaagggggccgccgcgaugauccccggcccgcagaccguggccaccgagauccgcucccugagccccaucaucggcaaggacgugcugacguccaccuacggggccaccgccgagacccugagcacguccaccaccacccacgucacgaagaccgugaagggcggguucagcgagacccggaucgagaagcgcaucaucaucaccggcgacgaggacguggaccaggaccaggcccucgcgcuggccaucaaggaggccaagcugcagcaccccgacaugcucgucacgaaggccgugguguaccgggagaccgaccccuccccggaggagcgcgacaagaagccccaggagagcuga

SEQ ID NO: 29698 - RNA, 2022 nt, Artificial Sequence
  derived and/or modified sequence opt1 from EPB41L2__Homo_sapiens__NP_001129026
augaccaccgaggugggcagcgucuccgaggugaagaaggacagcucccagcuggggacggacgccaccaaggagaagcccaaggagguggccgagaaccagcagaaccagagcuccgacccggaggaggagaagggcagccagcccccgcccgcggccgagucccagagcucccuccgccggcagaagcgcgagaaggagaccagcgagucccgggggaucagccgcuucaucccgcccuggcugaagaagcagaaguccuacacccuggucguggccaaggacggcggggacaagaaggagcccacgcaggccguggucgaggagcagguccucgacaaggaggagccccugcccgaggagcagcggcaggccaagggcgacgcggaggagauggcccagaagaagcaggagaucaagguggaggugaaggaggagaagcccagcguguccaaggaggagaagcccagcguguccaaggucgagaugcagcccaccgagcuggugagcaaggagcgcgaggagaaggugaaggagacccaggaggacaagcucgagggcggggccgccaagcgggagaccaaggagguccagacgaacgagcugaaggcggagaaggccucccagaaggugaccaagaagaccaagaccgugcagugcaaggucacgcugcucgacggcaccgaguacagcugcgaccuggagaagcacgccaagggccaggugcuguucgacaaggugugcgagcaccucaaccugcuggagaaggacuacuucgggcuccuguuccaggagagcccggagcagaagaacuggcuggaccccgccaaggagaucaagcgccagcuccggaaccugcccuggcuguucaccuucaacgucaaguucuacccgcccgaccccucccagcucaccgaggacaucacgcgcuacuuccugugccugcagcuccggcaggacaucgccagcgggcgccugcccugcuccuucgugacccacgcgcugcucggcagcuacacccugcaggccgagcugggcgacuacgaccccgaggagcacggguccaucgaccucagcgaguuccaguucgccccgacccagacgaaggagcuggaggagaagguggccgagcugcacaagacccaccggggccucucccccgcccaggcggacagccaguuccuggagaacgccaagcgccuguccauguacggggucgaccuccaccacgccaaggacagcgagggcguggacaucaagcugggcgucugcgccaacgggcugcucaucuacaaggaccggcugcgcaucaaccgguucgccuggcccaagauccugaagaucuccuacaagcgcagcaacuucuacaucaaggugcggcccgcggagcucgagcaguucgaguccaccaucggcuucaagcugccgaaccaccgcgccgccaagcggcuguggaaggugugcgucgagcaccacaccuucuaccgccucgugagccccgagcagccgcccaaggccaaguuccugacgcugggguccaaguuccgcuacagcggccggacccaggcccagacccgccaggcguccacccucaucgaccggcccgcgccccacuucgagcgcacgagcuccaagcgggugagccgcagccuggacggggcccccaucggcgucauggaccagucccugaugaaggacuucccgggcgccgccggggagaucagcgccuacggccccgggcugguguccaucgccgugguccaggacggcgacgggcggcgcgaggugcggagccccaccaaggcgccccaccuccagcugaucgagggcaagaccgugaagggcgggaucuccgagacccgcaucgagaagcggaucgucaucacgggcgacggggacaucgaccacgaccaggcccuggcccaggccauccgcgaggcccgggagcagcacccggacaugagcgugacccgcguggucgugcacaaggagaccgagcucgccgaggagggcgaggacuga

SEQ ID NO: 29699 - RNA, 2652 nt, Artificial Sequence
  derived and/or modified sequence opt1 from EPB41L3__Homo_sapiens__NP_001268462
augaccaccgagagcggcuccgacagcgaguccaagcccgaccaggaggccgagccgcaggaggccgcgggggcccagggccgcgccggggcccccgugcccgagcccccgaaggaggagcagcagcaggcccuggagcaguucgcggccgccgccgcgcacagcacgcccguccggcgcgaggugaccgacaaggagcaggaguucgccgcccgggccgccaagcagcucgaguaccagcagcuggaggacgacaagcugucccagaaguccuccagcuccaagcucagccgcagcccccugaagaucgugaagaagcccaagagcaugcagugcaaggucauccugcucgacggcuccgaguacacgugcgacguggagaagcggagccgcggccaggugcuguucgacaaggucugcgagcaccugaaccuccuggagaaggacuacuucgggcugaccuaccgggacgcggagaaccagaagaacuggcucgacccggccaaggagaucaagaagcagguccgcuccggcgccuggcacuucagcuucaacgugaaguucuacccgcccgaccccgcccagcuguccgaggacaucacccgguacuaccugugccuccagcugcgcgacgacaucgugagcgggcggcugccgugcuccuucgugacccucgcccugcugggcagcuacaccgugcagagcgagcucggggacuacgaccccgacgagugcggcuccgacuacaucagcgaguuccgcuucgcgcccaaccacaccaaggagcuggaggacaaggucaucgagcugcacaagucccaccgggggaugacgcccgccgaggccgagaugcacuuccucgagaacgccaagaagcugagcauguacggcguggaccugcaccacgccaaggacuccgagggcguggagaucaugcucggggucugcgcgagcggccugcugaucuaccgcgaccggcuccgcaucaaccgguucgccuggccgaaggugcugaagaucuccuacaagcgcaacaacuucuacaucaagauccggcccggggaguucgagcaguucgagagcaccaucggcuucaagcugcccaaccaccgcgccgccaagcggcucuggaaggugugcgucgagcaccacaccuucuuccgccugcugcuccccgaggccccgcccaagaaguuccugacccugggcuccaaguuccgcuacagcgggcggacgcaggcgcagacccgccgggccuccgcccucaucgaccgccccgcccccuacuucgagcggagcuccagcaagcgcuacaccaugucccggagccuggacggcgcguccgugaacgagaaccacgagaucuacaugaaggacagcauguccgccgccgagguggggaccggccaguacgccacgaccaaggggaucagccagaccaaccugaucaccacggucaccccggagaagaaggccgaggaggagcgcgacgaggaggaggacaagcggcgcaagggcgaggaggugacccccaucagcgcgauccggcacgagggcaagaccgacuccgagcgcacggacaccgccgccgacggggagaccaccgccacggagagcgaccaggaggaggacgccgagcucaaggcgcaggagcuggagaagacccaggacgaccugaugaagcaccagaccaacaucuccgagcucaagcggaccuuccuggagacgagcaccgacaccgccgugaccaacgagugggagaagcgccuguccacgagccccguccggcucgccgcccgccaggaggacgcccccaugaucgagccgcuggugcccgaggagaccaagcaguccagcggcgagaagcugauggacggguccgagaucuucagccugcucgaguccgcgcggaagcccaccgaguucaucggcggggucaccagcaccucccagagcugggugcagaagauggagacgaagaccgaguccagcggcaucgagaccgagccgaccgugcaccaccucccccuguccacggagaaggucgugcaggagaccgugcuggucgaggagcgccggguggugcacgccagcggcgacgccagcuacuccgccggggacagcggcgacgcggccgcccagcccgccuucaccgggaucaagggcaaggagggguccgcccugaccgagggcgcgaaggaggagggcggggaggaggucgccaaggccgugcuggagcaggaggagacggccgccgcgagccgcgagcgccaggaggagcaguccgccgccauccacaucagcgagacccucgagcagaagccccacuucgaguccagcaccgugaagaccgagacgaucuccuucggcagcgucucccccgggggcgugaagcuggagaucagcaccaaggaggugcccgucgugcacaccgagaccaagacgaucaccuacgaguccagccagguggaccccggcaccgaccuggagcccgggguccucauguccgcccagaccaucacgagcgagaccaccuccaccacgaccaccacccacaucacgaagaccgugaagggcgggaucagcgagacccggaucgagaagcgcaucgugaucaccggcgacgccgacaucgaccacgaccaggaguga

SEQ ID NO: 29700 - RNA, 2061 nt, Artificial Sequence
  derived and/or modified sequence opt1 from EPB41L4A__Homo_sapiens__NP_071423
augggcugcuucugcgccgugcccgaggaguucuacugcgagguccugcuccuggacgagagcaagcugacccucaccacgcagcagcaggggaucaagaaguccaccaagggcagcguggugcuggaccacgucuuccaccacgugaaccugguggagaucgacuacuucgggcuccgcuacugcgaccggucccaccagaccuacuggcuggacccggccaagacccuggcggagcacaaggagcucaucaacacgggcccgcccuacacccuguacuucgggaucaaguucuacgccgaggaccccugcaagcugaaggaggagaucacccgcuaccaguucuuccuccaggucaagcaggacgugcugcagggccggcugcccugccccgugaacaccgccgcccagcucggcgccuacgcgauccagagcgagcugggggacuacgaccccuacaagcacacggccggcuacgucuccgaguaccgcuucgugcccgaccagaaggaggagcuggaggaggccaucgagcggauccacaagacccucauggggcagaucccgagcgaggccgagcugaacuaccugcgcaccgcgaagucccucgagauguacggcguggaccugcaccccgucuacggggagaacaagagcgaguacuuccugggccucacccccgugggcguggucguguacaagaacaagaagcaggucgggaaguacuucuggccccggaucacgaaggugcacuucaaggagacccaguucgagcugcgcgugcugggcaaggacugcaacgagaccuccuucuucuucgaggcccggagcaagaccgccugcaagcaccucuggaagugcuccguggagcaccacacguucuuccgcaugccggagaacgagagcaacucccugagccggaagcuguccaaguucgggagcauccgcuacaagcaccgguacuccggccgcaccgcccuccagaugagccgggaccuguccauccagcugccccgccccgaccagaacgucacccggagccgcagcaagaccuaccccaagcggaucgcccagacgcagccggcggaguccaacagcaucucccgcaucaccgccaacauggagaacggcgagaacgaggggaccaucaagaucaucgcccccagccccgugaaguccuucaagaaggccaagaacgagaacagccccgacacccagcgguccaagagccacgccccgugggaggagaacggcccccaguccgggcucuacaacagccccuccgaccgcaccaagagccccaaguucccguacacgcgccggcgcaaccccuccugcggcagcgacaacgacuccgugcagcccguccggcgccggaaggcgcacaacagcggggaggacuccgaccugaagcagcgccggcgcagccggucccgcugcaacaccagcagcggcuccgagagcgagaacuccaaccgggaguaccgcaagaagcggaaccgcauccggcaggagaacgacaugguggacagcgcgccccagugggaggccguccugcgccggcagaaggagaagaaccaggccgacccgaacaaccgccggucccgccaccgcagccggucccgcagccccgacauccaggccaaggaggagcucuggaagcacauccagaaggagcugguggaccccuccggccugagcgaggagcagcucaaggagaucccguacaccaagaucgagacgcagggggaccccauccggauccgccacucccacagcccccgguccuaccgccaguaccggcgcagccagugcuccgacggcgagcggagcgugcuguccgaggucaacagcaagaccgaccuggugcccccgcuccccgugacccacagcuccgacgcccaggggagcggcgacgccaccguccaccagcgccggaacggguccaaggacagccugauggaggagaagccccagacguccaccaacaaccuggccggcaagcacaccgccaagaccaucaagacgauccaggccagccgccucaagaccgagaccuga

SEQ ID NO: 29701 - RNA, 1557 nt, Artificial Sequence
  derived and/or modified sequence opt1 from EPB41L4B__Homo_sapiens__NP_060894
augcugcgcuuccuccggcgcaccuucggccggcgcagcaugcagcgguacgcccgcggggccgcgggccgcggggccgccggccugggggacgagcgggacggcggcccccgcgggggcccggccgccgcggccuccagcuccgcccugcccgccgcgcccgggggcagcguguuccccgccgggggcggcccgcuccugaccgggggcgccgccguccacaucuccgccgcgggggccgccaaggccacgcuguacugccggguguuccuccuggacggcaccgaggugagcgucgaccugcccaagcacgccaagggccaggaccucuucgaccagaucguguaccaccuggaccugguggagaccgacuacuucgggcuccaguuccuggacuccgcgcaggucgcccacuggcuggaccacgccaagcccaucaagaagcagaugaagaucggccccgccuacgcccuccacuuccgggugaaguacuacagcuccgagccgaacaaccugcgcgaggaguucacccgguaccuguucgugcuccagcugcgccacgacauccugagcgggaagcucaagugccccuacgagacggcggucgagcuggccgcccugugccuccaggccgagcugggcgagugcgagcugcccgagcacacccccgagcucguguccgaguuccgguucaucccgaaccagaccgaggccauggaguucgacaucuuccagcgcuggaaggagugccggggcaagagccccgcgcaggccgagcuguccuaccugaacaaggccaaguggcucgagauguacgggguggacaugcacgucgugcgcggccgggacgggugcgaguacagccugggccugacccccacggggauccucaucuucgagggcgccaacaagaucgggcuguucuucuggcccaagaucaccaagauggacuucaagaaguccaagcugacccucguggucguggaggacgacgaccagggccgcgagcaggagcacaccuucguguuccggcuggacagcgcgcgcacgugcaagcaccuguggaagugcgccgucgagcaccacgccuucuuccgccuccggaccccgggcaacuccaagagcaaccgcuccgacuucauccggcuggggagccgcuuccgguucagcggccgcaccgaguaccaggccacccacgggucccggcugcgccggacgagcaccuucgagcgcaagcccuccaagcgguaccccagccgccggcacuccaccuucaaggccagcaaccccgugaucgcggcccagcucugcuccaagaccaacccggaggugcacaacuaccagccccaguaccaccccaacauccaccccagccagccgcgcuggcacccccacucccccaacguccggcccagcuuccaggacgaccgcucccacuggaaggccagcgccuccggcgacgacagccacuucgacuacgugcacgaccagaaccagaagaaccucgggggcaugcaguccaugauguaccgggacaagcugaugacggcccuguga

SEQ ID NO: 29702 - RNA, 2076 nt, Artificial Sequence
  derived and/or modified sequence opt1 from EPB42__Homo_sapiens__NP_001107606
augggccaggcccuggggaucaagagcugcgacuuccaggccgcgcgcaacaacgaggagcaccacaccaaggcccucuccagccggcgccuguucgugcggcgcggccagcccuucaccaucauccuguacuuccgggccccgguccgcgccuuccuccccgcccugaagaagguggcgcugacggcccagaccggggagcagcccuccaagaucaaccggacccaggccaccuuccccaucagcucccucggcgaccgcaagugguggagcgccguggucgaggagcgggacgcgcaguccuggacgaucagcgugaccaccccggccgacgccgugaucgggcacuacucccugcugcuccaggucagcggccgcaagcagcugcugcucggccaguucacccugcuguucaaccccuggaaccgggaggacgccguguuccucaagaacgaggcccagcgcauggaguaccugcugaaccagaacgggcucaucuaccugggcacggcggacugcauccaggccgaguccugggacuucgggcaguucgagggcgacgugaucgaccugagccuccggcugcuguccaaggacaagcaggucgagaaguggagccagcccgugcacguggcccgcguccucggggcccugcugcacuuccucaaggagcagcgggugcugcccaccccgcagacccaggccacccaggagggcgcgcugcucaacaagcgccggggcuccgugcccauccugcgccaguggcugacggggcggggccgccccgucuacgacgggcaggccugggugcucgccgccguggccugcaccguccugcggugccugggcauccccgcgcgcguggugaccaccuucgccagcgcccagggcaccgggggccgccuccugaucgacgaguacuacaacgaggaggggcugcagaacggcgaggggcagcggggccgcaucuggaucuuccagacguccaccgagugcuggaugacccggccggcccucccccagggcuacgacggguggcagauccugcaccccagcgcccccaacggcgggggcguccugggguccugcgaccucgugccggugcgcgcggucaaggagggcacgcugggccugacccccgccgugagcgaccucuucgccgccaucaacgcgagcugcgucguguggaagugcugcgaggacgggacccuggagcugaccgacuccaacacgaaguacgugggcaacaacaucagcaccaagggggucggcuccgaccggugcgaggacaucacccagaacuacaaguaccccgaggggagccuccaggagaaggaggugcuggagcgcguggagaaggagaagauggagcgggagaaggacaacggcauccggcccccgucccuggagaccgccagcccccuguaccuccugcugaaggcccccuccagccucccccugcgcggcgacgcccagaucuccgucacgcuggugaaccacagcgagcaggagaaggccgugcagcucgcgaucgggguccaggccgugcacuacaacggcgugcuggccgccaagcuguggcgcaagaagcuccaccugacccuguccgccaaccucgagaagaucaucaccaucgggcuguucuucagcaacuucgagcggaacccgcccgagaacaccuuccugcgccucacggcgauggccacccacuccgagagcaaccuguccugcuucgcccaggaggacaucgccaucugccggccccaccuggccaucaagaugcccgagaaggcggagcaguaccagccgcucaccgccagcgucucccugcagaacagccuggacgcccccauggaggacugcgugaucuccauccucggccgcggccugauccaccgggagcgcagcuaccgguuccgcagcguguggcccgagaacaccaugugcgccaaguuccaguucacgccgacccacgucgggcugcagcggcucaccguggagguggacugcaacauguuccagaaccugaccaacuacaaguccgucaccgugguggcgcccgagcugagcgccuga

SEQ ID NO: 29703 - RNA, 2442 nt, Artificial Sequence
  derived and/or modified sequence opt1 from EPC1__Homo_sapiens__NP_001258933
augagcaagcuguccuuccgcgcccgggcccucgacgcgagcaagccccugccgguguuccgcugcgaggaccugcccgaccuccacgaguacgccuccaucaaccgggccgucccccagaugcccaccggcauggagaaggaggaggagagcgagcaccaccuccagcgcgccaucuccgcccagcaggucuacggggagaagcgggacaacauggugaucccggugcccgaggcggagagcaacaucgccuacuacgaguccaucuaccccggcgaguucaagaugcccaagcagcugauccacauccagccguucagccuggacgccgagcagcccgacuacgaccuggacuccgaggacgagguguucgugaacaagcugaagaagaagauggacaucugcccccuccaguucgaggagaugaucgaccgccuggagaaggggagcggccagcagcccgucucccugcaggaggccaagcuccugcugaaggaggacgacgagcucauccgggagguguacgaguacuggaucaagaagcgcaagaacugccgggggccgagccugauccccuccgugaagcaggagaagcgcgacggcagcuccaccaacgaccccuacgucgcguuccggcgccggacggagaagaugcagacccgcaagaaccggaagaacgacgaggccagcuacgagaagaugcugaagcuccgccgggaccugucccgcgccgugaccauccuggagaugaucaagcggcgcgagaaguccaagcgggagcuccugcaccugacccucgagaucauggagaagcgcuacaaccugggcgacuacaacggggagaucaugagcgaggugauggcccagcgccagcccaugaagccgacguacgccauccccaucauccccaucaccaacagcagccaguucaagcaccaggaggcgauggacgucaaggaguucaaggugaacaagcaggacaaggccgaccugauccggcccaagcgcaaguacgagaagaagccgaaggugcuccccuccagcgccgccgccacgccccagcagaccucccccgcggcccugccggucuucaacgccaaggaccugaaccaguacgacuuccccagcuccgacgaggagccccucagccaggugcuguccggcagcuccgaggccgaggaggacaacgaccccgacgggccguucgccuuccggcgcaaggcgggcugccaguacuacgcgccccaccuggaccagaccgggaacuggcccuggaccagcccgaaggacggcggccucggggacgugcgguaccgcuacugccugaccacccugacggucccccagcggugcaucggcuucgcccgccggcgcguggggcggggcggccgcgugcuccuggaccgggcccacuccgacuacgacagcgucuuccaccaccuggaccucgagaugcuguccagcccccagcacucccccgugaaccaguucgccaacaccagcgagaccaacaccuccgacaagagcuucuccaaggaccugagccagauccucgugaacaucaagagcugccgcuggcggcacuuccgcccgcggacgcccucccugcacgacagcgacaacgacgagcuguccugccgcaagcucuaccggagcaucaaccgcaccgggaccgcccagcccggcacccagacgugcuccaccagcacccaguccaagagcuccagcggguccgcccacuucgccuucaccgccgagcaguaccagcagcaccagcagcagcuggcgcugaugcagaagcagcagcucgcccagauccagcagcagcaggccaacagcaacuccagcacgaacaccucccagggcuucgucagcaagacccuggacuccgccagcgcccaguucgcggccagcgcccuggugaccuccgagcagcugaugggguucaagaugaaggacgacgucgugcucggcaucggcgugaacgggguccugcccgccagcggcguguacaaggggcugcaccucuccagcacgaccccgaccgcccuggugcacaccucccccagcacggcgggcuccgcccugcuccagcccagcaacaucacccagaccuccagcucccacagcgcccugucccaccaggucaccgccgccaacagcgcgacgacccaggugcugaucgggaacaacauccgccucaccgugcccuccagcgucgccaccgugaacuccaucgccccgaucaacgcccggcacaucccccgcacccugagcgcggugcccuccagcgcccugaagcucgccgccgccgcgaacugccaggucagcaaggugcccuccagcuccagcguggacuccgucccgcgggagaaccacgagagcgagaagcccgcccugaacaacaucgccgacaacacgguggccauggaggugaccuga

SEQ ID NO: 29704 - RNA, 2424 nt, Artificial Sequence
  derived and/or modified sequence opt1 from EPC2__Homo_sapiens__NP_056445
augagcaagcuguccuuccgcgcccgggcccucgacgcggccaagccccugccgaucuaccgcggcaaggacaugcccgaccugaacgacugcgugagcaucaaccgggccgucccccagaugcccaccgggauggagaaggaggaggaguccgagcaccaccuccagcgcgccaucagcgcccagcaggucuuccgggagaagaaggaguccauggugaucccggugcccgaggcggagagcaacgugaacuacuacaaccgccuguacaagggcgaguucaagcagcccaagcaguucauccacauccagcccuucaaccuggacaacgagcagccggacuacgacauggacuccgaggacgagacccuccugaaccggcugaaccgcaagauggagaucaagccccuccaguucgagaucaugaucgaccggcuggagaaggccagcuccaaccagcuggugacgcuccaggaggccaagcugcugcucaacgaggacgacuaccugaucaaggccgucuacgacuacugggugcgcaagcggaagaacugccgcgggcccagccugaucccccagaucaagcaggagaagcgggacggcuccaccaacaacgacccguacguggcguuccgccggcgcaccgagaagaugcagacccggaagaaccgcaagaacgacgaggccagcuacgagaagaugcucaagcugcggcgcgaguucucccgggccaucacgauccuggagaugaucaagcgccgcgagaagaccaagcgggagcuccugcaccugacccucgaggucguggagaagcgcuaccaccugggggacuacggcggcgagauccugaacgaggugaagaucagccgguccgagaaggagcucuacgccacccccgccacgcugcacaacgggaaccaccacaagguccaggagugcaagaccaagcacccccaccaccugagccucaaggaggaggcguccgacguggugcgccagaagaagaaguaccccaagaagccgaaggccgaggcccugaucaccagccagcagcccacccccgagacgcugcccgucaucaacaaguccgacaucaagcaguacgacuuccacagcagcgacgaggacgaguucccccaggugcucuccccggugagcgagcccgaggaggagaacgaccccgacggcccgugcgccuuccggcgccgggccgggugccaguacuacgcgccccgccuggaccaggccaaccacuccugcgagaacagcgagcuggccgaccucgacaagcugcgguaccgccacugccugaccacccucaccgucccccggcgcugcaucggcuucgcccggcgccggaucgggcgcggcggccgggugaucauggaccgcaucuccacggagcacgaccccgugcugaagcagaucgacccggagaugcugaacagcuucuccagcuccagccagaccaucgacuucuccagcaacuucucccggaccaacgccagcuccaagcacugcgagaaccgccucagccuguccgagauccugagcaacauccgcuccugccggcuccagugcuuccagccccgccugcugaaccuccaggacagcgacagcgaggagugcaccucccggaagcccgggcagacggucaacaacaagcgcgugagcgcggccuccguggcccugcugaacaccagcaagaacggcaucuccgucaccgggggcaucaccgaggagcaguuccagacgcaccagcagcagcuggugcagaugcagcggcagcagcucgcccagcugcagcagaagcagcagagccagcacuccagccagcagacccacccgaaggcccagggcuccagcaccuccgacugcaugagcaagacccuggacuccgcgagcgcccacuucgccgccuccgcggucgugagcgcccccgugcccucccgcagcgaggucgccaaggagcagaacacggggcacaacaacaucaacggcguggugcagcccagcgggaccuccaagacccucuacagcaccaacauggcccuguccagcuccccgggcaucagcgccguccagcuggugcggacgguggggcacaccaccaccaaccaccucauccccgcgcugugcacguccagcccccagacccugcccaugaacaacuccugccucaccaacgccguccaccugaacaacgugagcguggucuccccggugaacgugcacaucaacacccgcaccagcgcccccucccccacggcccugaagcucgccaccgucgcggccagcauggaccgggugcccaaggugaccccguccagcgccaucuccagcaucgcccgcgagaaccacgagcccgagcggcugggccugaacggcaucgccgagaccacggucgcgauggaggugaccuga

SEQ ID NO: 29705 - RNA, 945 nt, Artificial Sequence
  derived and/or modified sequence opt1 from EPCAM__Homo_sapiens__NP_002345
auggccccgccccaggugcuggccuucggccuccugcuggcggccgccaccgccaccuucgccgcggcccaggaggagugcgucugcgagaacuacaagcucgccgugaacugcuucgugaacaacaaccgccagugccagugcacgagcgucggggcccagaacaccgugaucugcuccaagcuggcggccaagugccuggugaugaaggccgagaugaacggcagcaagcucgggcggcgcgccaagcccgagggcgcccugcagaacaacgacgggcuguacgaccccgacugcgacgaguccggccucuucaaggcgaagcagugcaacggcaccagcaugugcuggugcgucaacaccgccggggugcggcgcacggacaaggacaccgagaucacgugcuccgagcgggugcgcaccuacuggaucaucaucgagcugaagcacaaggcccgggagaagcccuacgacagcaagucccugcgcaccgcccuccagaaggagaucaccacccgguaccagcuggacccgaaguucaucaccagcauccuguacgagaacaacgucaucacgaucgaccucgugcagaacuccagccagaagacccagaacgacguggacaucgccgacgucgcguacuacuucgagaaggacgugaagggcgagucccuguuccacagcaagaagauggaccugaccgugaacggggagcagcucgaccuggaccccggccagacccugaucuacuacgucgacgagaaggcccccgaguucuccaugcaggggcucaaggccggcgugaucgccgugaucgucgugguggucaucgccgugguggcgggcaucgucgugcuggucaucagccgcaagaagcggauggccaaguacgagaaggccgagaucaaggagaugggggagaugcaccgcgagcugaacgccuga

SEQ ID NO: 29706 - RNA, 675 nt, Artificial Sequence
  derived and/or modified sequence opt1 from EPDR1__Homo_sapiens__NP_060019
augcccggccgcgccccgcugcggaccgugcccggggcccucggcgcguggcugcucgggggccucugggccuggacccugugcgggcugugcagccucggcgccgucggcgcgccccgccccugccaggccccgcagcagugggaggggcgccaggugauguaccagcaguccagcggccggaacucccgggcccugcugagcuacgacgggcucaaccagcgcgugcggguccuggacgagcgcaaggcccugauccccugcaagcggcuguucgaguacauccugcuguacaaggacggcgugauguuccagaucgaccaggccaccaagcagugcuccaagaugacccucacccagcccugggacccccuggacaucccgcagaacagcaccuucgaggaccaguacuccaucgggggcccccaggagcagaucacggugcaggaguggagcgaccgcaaguccgcccggagcuacgagaccuggaucggcaucuacaccgucaaggacugcuaccccgugcaggagaccuucacgaucaacuacuccgugauccugagcacccgcuucuucgacauccagcucgggaucaaggaccccuccgucuucaccccgcccagcacgugccagauggcgcagcuggagaagauguccgaggacugcagcugguga

SEQ ID NO: 29707 - RNA, 7740 nt, Artificial Sequence
  derived and/or modified sequence opt1 from EPG5__Homo_sapiens__NP_066015
auggccgaggccgugaagccccagcgccgggccaaggccaaggccucccgcaccaagaccaaggagaagaagaaguacgagacgccccagcgggaggaguccagcgaggugucccugcccaagaccagccgcgagcaggagauccccucccuggccugcgaguucaagggcgaccaccugaagguggugaccgacagccagcugcaggacgacgccuccgggcagaacgagagcgagauguucgacgugccccugaccucccugaccaucagcaacgaggagucccugaccugcaacaccgagccgcccaaggagggcggggaggcccggcccugcgugggcgacagcgccgugacccccaaggugcaccccggggacaacgugggcacgaagguggagacccccaagaacuucaccgagguggaggagaacauguccgugcagggcgggcugagcgaguccgcgccccagagcaacuucuccuacacccagcccgccauggagaacauccaggugcgcgagacgcagaacagcaaggaggacaagcagggccuggugugcuccagcgaggugccccagaacguggggcugcagagcuccugccccgcgaagcacggcuuccagacgccccgggucaagaagcucuacccccagcugcccgccgagaucgccggggaggcccccgcccugguggcggugaagccccuccugcgcagcgagcggcuguaccccgagcuccccucccagcuggagcugguccccuucaccaaggagcagcucaagauccuggagcccggcagcuggcuggagaacguggaguccuaccucgaggaguucgacagcauggcccaccaggaccgccacgaguucuacgagcugcugcucaacuacucccggugccgcaagcagcugcugcucgccgaggccgagcugcugacccucacgagcgacugccagaacgccaagucccggcuguggcaguucaaggaggagcagaugagcgugcagggcaucugcgcggaccaggucaagguguucuccuaccaccgcuaccagcggguggagaugaacgagaacgcccuggucgagcucaagaagcuguucgacgccaagagcgagcaccuccaccagacccucgcccugcacuccuacaccagcgugcugucccgccuccaggucgagagcuacaucuacgcccugcuguccagcuccgcggugcuccggagcagcgccauccaccagcaggggcgcgccuccaagcagaccgagagcauccccuccgaccugugccagcugaaggagugcaucagcguccuguucauguucacgcggcgcgucaacgaggacacccaguuccacgacgacauccugcuguggcuccagaagcugguguccgugcugcagcgggucggcugcccgggggaccaccuguuccuccugaaccacauccugcgcugccccgccggcgugagcaagugggccgugcccuucauccagaucaagguccuccacaaccccuccggcguguuccacuucaugcagagccuggcgcugcucauguccccggugaagaaccgcgccgaguucaugugccacaugaagcccagcgagcggaagcccuccagcuccgggccgggcagcgggaccuggacccuggucgacgagggcggggaggaggacgaggaccccgagacguccuggauccugcucaacgaggacgaccuggugaccauccuggcccaguuccccuuccacgagcuguuccagcaccuccugggcuucaaggccaagggcgacuaccuccccgagaccacccgcccgcaggagaugaugaagaucuucgcguucgccaacagccugguggagcugcucgccgucgggcuggagacguucaaccgggcccgcuaccggcaguucgugaagcgcaucggcuacaugauccggaugacccugggguacguguccgaccacugggcccaguacgucagccacaaccagggcagcgggcucgcgcagcagcccuacuccauggagaagcuccagguggaguucgacgagcuguuccuccgcgccgugcugcacguccugaaggccaagcggcucggcaucuggcuguucaugagcgagaugcccuucggcacccuguccgugcagaugcucuggaagcuguucuaccugaugcaccagguggagagcgagaaccuccagcagcuguccagcucccugcagcccgcccagugcaagcagcagcuccaggacccggagcacuucaccaacuucgagaagugccugagcuccaugaacagcuccgaggagaucugccugcucacgaccuucgcccagauggcgcaggcccgccggaccaacgucgacgaggacuucaucaagaucaucgugcuggagaucuacgaggugagcuacgucacccuguccacgcgcgagaccuucagcaagguggggcgggagcuccugggcaccaucaccgccgugcaccccgagaucaucuccguccugcucgaccgcgugcaggagaccaucgaccagguggggauggucagccuguaccuguucaaggagcucccccuguaccuguggcagcccuccgccagcgagaucgccgugauccgggacuggcuccugaacuacaaccugacgguggucaagaacaagcucgcgugcgugauccuggagggccugaacuggggguucgccaagcaggccacccuccaccuggaccaggccgugcacgcggaggucgcccugauggugcucgaggccuaccagaaguaccuggcccagaagccguacgccggcauccuguccgagagcaugaagcaggucagcuaccucgcguccaucguccgcuacggcgagacccccgagaccagcuucaaccagugggccuggaaccugauccugcggcucaagcugcacaagaacgacuacgggauccagcccaacugccccgccgugccguucuccgugacgguccccgacaugaccgagagccccaccuuccacccccugcucaaggccgugaaggccggcaugccgaucgggugcuaccuggcgcuguccaugaccgccgugggccacagcaucgagaaguucugcgccgagggcaucccccuccuggggauccugguccagucccgccaccuccggacgguggugcacguccuggacaagauccugccccucuucuaccccugccaguacuaccugcugaagaacgagcaguuccucagccaccuccuccuguuccugcaccuggacuccggcgugccgcagggggucacccagcaggucacccacaagguggcccagcaccucaccggcgccagccacggggacaacgucaagcugcugaacuccaugauccaggcgcacaucagcguguccacgcagcccaacgaggugggccccgucgccgugcucgaguucugggugcaggcccugaucagccagcaccugugguaccgcgagcagccgauccucuuccugauggaccaccugugcaaggccgcguuccagcugaugcaggaggacugcauccagaagcuccuguaccagcagcacaagaacgcccugggcuaccacugcgaccgcucccuccugagcucccuggucagcuggaucguggccgggaacaucacccccuccuucguggagggccucgccacccccacccaggucugguucgccuggacggugcugaacauggagagcaucuucgaggaggacagccagcugcggcgcgugaucgagggggagcucgucaucaacuccgcguucacccccgaccaggcccugaagaaggcccagacccagcugaagcucccgaucgugcccagccugcagcggcugcucaucuaccgcugggcccaccaggcccuggugacccccuccgaccacccccugcucccgcugaucuggcagaaguucuuccugcucuaccugcaccggcccggcccccaguacgggcugcccaucgacggcugcaucggccgccgguucuuccagagcccggcgcacaucaaccuccugaaggagaugaagcgccggcugacggaggucgccgacuuccaccacgccgccuccaaggcccuccgcgugcccgcggaggggagcgagggccugcccgagucccacagcgggacccccggcuaccugaccuccccggagcuccacaaggagcuggugcggcuguucaacgucuacauccucuggcuggaggacgagaacuuccagaagggggacaccuacauccccagccugcccaagcacuacgacauccaccgccucgccaaggugaugcagaaccagcaggaccuguggauggaguaccugaacauggagcggaucuaccacgaguuccaggagacggugggccucuggacccaggccaagcuggagucccacagcacccccugcucccugagcguccagcucgacuucaccgacccgcugcuggccaaggagcgcgugcucuccaaccugcggaagcacgaggcgccccagccgccccuggcgcuccacccgacgaagccgcccgugcccgucaucagcuccgccgugcugcugagccagaaggacgccacccagcucgugugcaccgaccugaaccugcuccagcagcaggcccgcaccgcggcccugcgggagucccagcaggucgcccuggacggcgagcuccuggacacgaugccgaagcaguacgugaaccgcgaggagcagaccacccugcaccucgagugccgggggagcagcggcaagaagugccagggggccgccguggucaccgugcaguucgagggcaugcacaagaacgaggcgaucucccagcagcugcacgugcugcgcaaggaggucaagcagcuccaggccgaggccgccaagccgcccagccugaacaucguggaggccgcggugcacgccgagaaccugaucacggcccucgucaacgccuacaagcugcagccgacccccgggauccagaaggugggcaucucccuguucuucaccaucguggacuacgucagcgacgagacccagcggcacccgcccacccgccaguucuucacguccugcaucgagauccucggccagguguucaucagcgggaucaaguccgagugccgcaaggugcuggagaccauccugaagaacagccggcucugcucccugcugagcccguucuucacccccaacgccgcgcccgccgaguucauccagcucuacgagcaggucgugaaguuccuguccgaggacaacagcgacaugaucuucaugcugcucaccaaguucgaccugaagcaguggcuguccgccacgaagcccccgcucagcgaccgcacccggcugcuggaguccauccaccucgcccugaccgcguggggccuggagcccgacgaggacauccucaugcccuucaaccuguucugcaagcacuggaccuaccugcuccuguaccaguuccccgaccaguacagcgacauccugcgccuccugaugcaguccagcgccgagcagcugcucuccccggagugcuggaaggccacgcugcgggcccuggggugcugcgcccccagcugccagcagggcgcggccagcaccgagggcgccgugcuccccuccagcuccgacgcccugcugagcgacaagcaggucauggagaccauccaguggcuguccgacuucuucuacaagcuccgccugagcaagauggacuucaaguccuucgggcuguucagcaaguggucccccuacauggccgacgugaagaccuuccucggcuaccuggugaagcggcugaucgaccucgagaugacgugccuggcgcaggacccgaccgccagccgcaagaccguccugaagucccuccacagcgugaucauccagcuguucaagcccuggauccugguccucgaggacaacgaguccagccagcagcggcacuaccccuggcuggaguccgacaccgugguggccagcuccaucguccagcuguucacggacugcaucgacagccuccacgaguccuucaaggacaagcugcugcccggggacgccggcgcccucuggcugcaccugaugcacuacugcgaggcgugcaccgccccgaagaugcccgaguucauccucuacgccuuccacagcaccuaccgcaagcugcccuggaaggaccugcaccccgaccagaugcucauggaggccuucuucaagguggagcgggggagcccgaaguccugcuuccuguuccugggcagcgugcucugcgaggucaacuggguguccgugcugagcgacgcguggaacuccagcccccaccccgagacccgcuccaugaucgucugccuccuguucaugaugauccugcuggccaaggaggugcagcucguggaccagacggacagcccccugcugucccuccugggccagaccagcucccugagcuggcaccucgucgacaucguguccuaccagagcgugcuguccuacuucagcucccacuacccgcccagcaucauccuggccaaggagagcuacgccgagcucaucaugaagcugcugaaggucuccgccgggcucagcauccccaccgacucccagaagcaccuggacgcggugccgaagugccaggccuucacccaccagauggugcaguuccugagcacgcucgagcagaacggcaagaucacccuggccguccuggagcaggagauguccaagcuccuggacgacaucaucguguucaacccgcccgacauggacagccagacccggcacauggcccuguccagccucuucauggaggugcugaugaugaugaacaacgccaccauccccacggcggaguuccugcgcggguccauccggaccuggaucggccagaagaugcacgggcucgucgugcugccgcugcucaccgccgccugccagagccuggccuccgugcgccacauggccgagaccacggaggcgugcaucaccgccuacuucaaggagagcccccugaaccagaacuccggcuggggccccauccucgucagccuccaggugcccgagcugaccauggaggaguuccuccaggagugccugacccugggguccuaccucacgcuguacguguaccugcuccagugccugaacagcgagcagacccugcggaacgagaugaagguccuccugauccuguccaaguggcucgagcaggucuacccgagcuccguggaggaggaggccaagcuguuccugugguggcaccagguccuccagcugagccugauccagaccgagcagaacgacagcgugcucaccgaguccgugauccgcauccugcugcucguccagagccggcagaaccugguggccgaggagcgccuguccagcggcauccucggggccaucggcuucgggcgcaagagcccccugagcaaccgguuccgcguggucgcgcgguccauggccgccuuccugagcguccaggugcccauggaggaccagauccgccuccggcccggcuccgagcugcaccugaccccgaaggcccagcaggcgcucaacgcccuggagagcauggccuccagcaagcaguacgucgaguaccaggaccagauccugcaggccacgcaguucauccgccaccccggccacugccugcaggacgggaaguccuuccucgcccugcuggugaacugccucuaccccgaggugcacuaccuggaccacauccgguga

SEQ ID NO: 29708 - RNA, 465 nt, Artificial Sequence
  derived and/or modified sequence opt1 from EPGN__Homo_sapiens__NP_001257918
auggcccugggcgugcccaucagcgucuaccuccuguucaacgccaugaccgcgcugaccgaggaggccgccgugacggugaccccgcccaucaccgcccagcaggggaacuggaccgucaacaagacggaggccgacaacaucgagggccccaucgcgcucaaguucucccaccugugccuggaggaccacaacagcuacugcaucaacggggccugcgccuuccaccacgagcucgagaaggccaucugccgcugcuucaccggcuacaccggggagcggugcgagcaccugacccugacguccuacgcgguggacagcuacgagaaguacaucgccaucggcaucggcguggggcuccugcuguccggcuuccucgucaucuucuacugcuacauccgcaagcggugccugaagcucaagagccccuacaacgugugcuccggggagcgccggccgcuguga

SEQ ID NO: 29709 - RNA, 2931 nt, Artificial Sequence
  derived and/or modified sequence opt1 from EPHA1__Homo_sapiens__NP_005223
auggagcgccgguggccccugggccucgggcuggugcugcuccugugcgccccgcugccgcccggcgcccgcgcgaaggaggucacccucauggacaccagcaaggcccagggggagcugggcuggcugcucgacccgcccaaggacgggugguccgagcagcagcagauccugaacggcacgccccuguacauguaccaggacugccccaugcagggccggcgcgacaccgaccacuggcuccggagcaacuggaucuaccgcggggaggaggccucccgggugcacguggagcugcaguucaccguccgcgacugcaagagcuuccccggcggggccggcccccuggggugcaaggagaccuucaaccuccuguacauggaguccgaccaggacgugggcauccagcugcggcgcccccucuuccagaaggugacgaccgucgccgcggaccagagcuucaccauccgggaccugguguccggcagcgugaagcugaacgucgagcgcugcucccucgggcggcugacccgccggggccuguaccucgccuuccacaaccccggggccugcguggcccuggugagcguccgcguguucuaccagcggugccccgagacgcugaacggccucgcgcaguucccggacacccugcccggccccgccgggcugguggaggucgccgggaccugccucccccacgcccgcgccuccccgcggcccagcggcgcgccccgcaugcacugcucccccgacggcgaguggcuggugccgguggggcggugccacugcgagcccggcuacgaggagggcgggagcggcgaggccugcgucgccugccccuccgggagcuaccgcauggacauggacacgccccacugccugaccugcccgcagcaguccaccgccgagagcgagggcgccaccaucugcacgugcgaguccgggcacuaccgcgcgcccggcgagggcccccagguggccugcaccgggcccccgagcgcgccccggaaccucagcuucuccgccagcggcacccagcugucccugcgcugggagcccccggccgacaccgggggccggcaggacgugcgcuacagcguccggugcucccagugccaggggaccgcccaggacggcggccccugccagcccugcggggugggcgugcacuucagccccggggcccgcggccucacgaccccggccguccacgugaacggccuggagcccuacgccaacuacaccuucaacgucgaggcccagaacgggguguccggccuggggagcuccggccacgcgagcaccuccgugagcaucuccauggggcacgccgagagccucuccggccugagccugcggcucgucaagaaggagccccgccagcuggagcugacgugggccggcucccggccccgcagcccgggggccaaccucaccuacgagcugcacgugcugaaccaggacgaggagcgguaccagauggugcucgagccccgcguccugcugaccgagcugcagcccgacaccacguacaucgugcgggugcgcaugcucacgccccugggcccggggcccuucucccccgaccacgaguuccggaccagcccgcccgucagccgcggccugaccgggggcgagaucguggcggugaucuucggccuccugcugggggccgcccuccugcugggcauccucgucuuccggucccgccgggcccagcgccagcgccagcagcggcagcgcgaccgggccaccgacguggaccgcgaggacaagcuguggcugaagcccuacguggaccuccaggcguacgaggaccccgcccagggggcccuggacuucacccgggagcuggaccccgccuggcucauggucgacaccgugaucggcgagggggaguucggcgagguguaccgcggcacccugcggcugccgagccaggacugcaagacggucgccaucaagacccucaaggacaccucccccgggggccagugguggaacuuccugcgcgaggcgaccaucauggggcaguucagccacccccacauccugcaccucgagggcguggugaccaagcggaagcccaucaugaucaucacggaguucauggagaacggggcccuggacgccuuccugcgcgagcgggaggaccagcucgucccgggccagcugguggccaugcugcagggcaucgccuccgggaugaacuaccucagcaaccacaacuacgugcaccgcgaccuggcggcccggaacauccuggucaaccagaaccucugcugcaagguguccgacuucggccugacccgccugcucgacgacuucgacgggaccuacgagacccagggcggcaagauccccauccgguggacggcccccgaggccaucgcgcaccgcaucuucaccaccgccagcgacgugugguccuucgggaucgucaugugggaggugcugagcuucggcgacaagccguacggggagauguccaaccaggaggugaugaaguccaucgaggacggcuaccggcugcccccgcccgucgacugccccgcgccccucuacgagcugaugaagaacugcugggccuacgaccgcgcccggcgcccccacuuccagaagcugcaggcccaccucgagcagcugcuggccaacccccacagccuccggaccaucgccaacuucgacccgcgcaugacgcugcgccugcccagccucuccgggagcgacggcauccccuaccggaccguguccgaguggcuggagagcauccgcaugaagcgguacauccugcacuuccacagcgccggccucgacaccauggagugcgugcuggagcugaccgccgaggaccucacgcagauggggaucacccugcccggccaccagaagcgcauccugugcuccauccagggguucaaggacuga

SEQ ID NO: 29710 - RNA, 2952 nt, Artificial Sequence
  derived and/or modified sequence opt1 from EPHA3__Homo_sapiens__NP_005224
auggacugccagcugagcauccuccugcugcucuccugcagcgugcuggacuccuucggcgagcugaucccccagccgagcaacgaggucaaccuccuggacuccaagaccauccagggggagcugggcuggaucagcuaccccucccacgggugggaggagaucagcggcguggacgagcacuacacccccauccgcacguaccaggugugcaacgucauggaccacucccagaacaacuggcuccggaccaacugggugccccgcaacagcgcccagaagaucuacguggagcugaaguucacccugcgggacugcaacuccaucccgcucguccuggggaccugcaaggagacguucaaccuguacuacauggagagcgacgacgaccacggcgugaaguuccgcgagcaccaguucaccaagaucgacaccaucgccgcggacgaguccuucacccagauggaccucggcgaccggauccugaagcugaacacggagauccgcgagguggggcccgucaacaagaagggcuucuaccucgccuuccaggacgugggggccugcguggcccuggucagcgugcggguguacuucaagaagugccccuucaccgucaagaaccuggccauguuccccgacaccgugccgauggacucccagagccucguggagguccgcggcuccugcgugaacaacagcaaggaggaggacccgccccggauguacugcuccaccgagggggaguggcuggugcccaucggcaagugcagcugcaacgcgggcuacgaggagcgcggguucaugugccaggccugccggcccggcuucuacaaggcccuggacgggaacaugaagugcgccaagugcccgccccacagcuccacgcaggaggacggcagcaugaacugccgcugcgagaacaacuacuuccgggcggacaaggacccgcccuccauggccugcacccgcccgcccagcagcccccggaacgucaucuccaacaucaacgagaccuccgugauccucgacuggagcuggccccuggacaccggcgggcgcaaggacgugacguucaacaucaucugcaagaagugcggcuggaacaucaagcagugcgagcccugcucccccaacguccgguuccugccccgccaguucgggcucaccaacaccaccgugacggucaccgaccugcuggcccacaccaacuacaccuucgagaucgacgccgugaacggcgugagcgagcucuccagcccgccccggcaguucgccgcggucuccaucacgaccaaccaggccgcccccagccccgugcugaccaucaagaaggaccgcaccucccggaacagcaucucccugagcuggcaggagcccgagcaccccaacgggaucauccucgacuacgaggugaaguacuacgagaagcaggagcaggagacguccuacaccauccugcgcgcccgcggcaccaacgucaccaucagcagccugaagcccgacacgaucuacguguuccagauccgggcccgcaccgcggccggcuacgggaccaacucccggaaguucgaguucgagaccagcccggacuccuucagcaucuccggcgagagcucccagguggucaugaucgccaucagcgccgccguggcgaucauccuccugacgguggucaucuacgugcugaucgggcgcuucugcggcuacaaguccaagcacggggccgacgagaagcggcuccacuucggcaacggccaccugaagcugcccgggcuccgcaccuacguggacccccacaccuacgaggaccccacccaggccguccacgaguucgccaaggagcuggacgccaccaacaucagcaucgacaagguggugggcgcgggggaguucggcgaggucugcuccgggcggcugaagcucccgagcaagaaggagaucuccguggccaucaagacgcugaaggugggcuacaccgagaagcagcgccgggacuuccugggcgaggccagcaucauggggcaguucgaccaccccaacaucauccgccucgagggcgucgugaccaaguccaagcccgugaugaucgucaccgaguacauggagaacgggagccuggacuccuuccugcggaagcacgacgcccaguucacggugauccagcuggugggcaugcuccgcggcaucgcgagcgggaugaaguaccugagcgacaugggcuacguccaccgggaccuggccgcccgcaacauccucaucaacuccaaccuggugugcaaggugagcgacuucgggcugucccggguccucgaggacgaccccgaggccgccuacaccacccgcggcgggaagaucccgauccgguggaccagccccgaggcgaucgccuaccgcaaguucacguccgccagcgacgugugguccuacggcaucgugcugugggaggucaugagcuacggcgagcggcccuacugggagauguccaaccaggacgugaucaaggccguggacgagggguaccgccugcccccgcccauggacugccccgccgcgcucuaccagcugaugcuggacugcuggcagaaggaccgcaacaaccggcccaaguucgagcagaucgucagcauccucgacaagcugauccgcaacccgggcucccugaagaucaucaccagcgccgccgcccggcccuccaaccuccugcuggaccagagcaacguggacaucaccaccuuccgcacgaccggggacuggcucaacggcguguggaccgcccacugcaaggagaucuucaccggggucgaguacuccagcugcgacacgaucgcgaagaucuccaccgacgacaugaagaaggugggcgugaccgucgugggcccccagaagaagaucaucagcuccaucaaggcccuggagacccagagcaagaacgggcccgugccggucuga

SEQ ID NO: 29711 - RNA, 2961 nt, Artificial Sequence
  derived and/or modified sequence opt1 from EPHA4__Homo_sapiens__NP_001291465
auggccggcaucuucuacuucgcccuguucagcugccucuucgggaucugcgacgcggugaccggcucccgcgucuaccccgccaacgaggugacccugcuggacagccgguccgugcagggggagcucggcuggaucgccagcccgcuggagggcggcugggaggaggucuccaucauggacgagaagaacacgcccauccgcaccuaccaggugugcaacgugauggagcccagccagaacaacuggcugcggaccgacuggaucacccgcgagggcgcccagcgggucuacaucgagaucaaguucacgcuccgcgacugcaacucccugcccggggugauggggaccugcaaggagaccuucaaccuguacuacuacgagagcgacaacgacaaggagcgguucauccgcgagaaccaguucgugaagaucgacaccaucgccgcggacgaguccuucacgcaggucgacaucggggaccggaucaugaagcucaacaccgagauccgcgacgugggcccgcugagcaagaagggguucuaccuggccuuccaggacgugggcgccugcaucgcccucgucuccgugcggguguucuacaagaagugcccccugaccguccgcaaccuggcgcaguuccccgacaccaucacgggcgccgacaccagcucccucguggaggugcgggggagcugcgucaacaacuccgaggagaaggacgugcccaagauguacugcggcgccgacggggaguggcuggugccgaucggcaacugccugugcaacgccggccacgaggagcgcagcggggagugccaggccugcaagaucggcuacuacaaggcgcucuccaccgacgcgaccugcgccaagugcccgccccacagcuacuccgucugggagggggccacgagcugcacgugcgaccggggcuucuuccgcgccgacaacgacgccgccagcaugcccugcacccggccgcccuccgcgccccugaaccugaucagcaacgugaacgagaccuccgugaaccucgaguggagcagcccccagaacaccgggggccgccaggacaucuccuacaacgucgugugcaagaagugcggcgccggggaccccuccaagugccggcccugcggcagcgggguccacuacacgccccagcagaacggccugaagaccaccaagguguccaucaccgaccugcucgcccacaccaacuacaccuucgagaucugggccgugaacggggucagcaaguacaaccccaacccggaccaguccgugagcgugaccgucacgaccaaccaggccgcccccuccagcaucgcccuggugcaggccaaggaggugacccgcuacuccgucgcgcuggccuggcucgagcccgaccggcccaacggcgugauccuggaguacgaggugaaguacuacgagaaggaccagaacgagcgcagcuaccgcaucguccggaccgccgcccgcaacacggacaucaagggccugaacccgcucaccuccuacguguuccacgugcgggcgcgcaccgccgccggguacggcgacuucagcgagccccuggaggucaccacgaacaccgugcccucccggaucaucggggacggcgccaacagcaccgugcugcucgucagcguguccgggagcgugguccugguggugauccugaucgccgcguucgucaucucccgccggcgcagcaaguacuccaaggccaagcaggaggccgacgaggagaagcaccucaaccagggcgugcggaccuacguggaccccuucaccuacgaggacccgaaccaggccguccgcgaguucgccaaggagaucgacgcgagcugcaucaagaucgagaaggugaucggcgugggggaguucggcgaggucugcuccgggcggcugaaggugcccggcaagcgcgagaucugcguggccaucaagacgcugaaggccggcuacaccgacaagcagcggcgcgacuuccucagcgaggccuccaucauggggcaguucgaccaccccaacaucauccaccuggagggcgucgugaccaagugcaagccggugaugaucaucaccgaguacauggagaacgggagccuggacgccuuccuccggaagaacgacggccgcuucacggucauccagcugguggggaugcugcggggcaucggcuccgggaugaaguaccucagcgacauguccuacgugcaccgcgaccuggcggcccggaacauccuggucaacagcaaccucgugugcaagguguccgacuucggcaugagccgcguccuggaggacgaccccgaggccgccuacaccacccgcgggggcaagauccccauccgguggaccgcgcccgaggccaucgccuaccgcaaguucacguccgccagcgacguguggagcuacgggaucgugaugugggaggucauguccuacggcgagcggccguacugggacaugagcaaccaggacgugaucaaggccaucgaggagggcuaccgccugcccccgcccauggacugccccaucgcgcugcaccagcucaugcuggacugcuggcagaaggagcgguccgaccgccccaaguucgggcagaucgugaacaugcuggacaagcucauccggaaccccaacagccugaagcgcaccggcaccgaguccagccggcccaacaccgcccugcucgacccguccagccccgaguucuccgccgucgugagcgugggggacuggcugcaggccaucaagauggaccgcuacaaggacaacuucacggccgcgggcuacaccacccuggaggccgucgugcacgucaaccaggaggaccucgcccggaucgggaucaccgccaucacgcaccagaacaagauccuguccagcgugcaggccaugcgcacccagaugcagcagaugcacggccggauggugcccgucuga

SEQ ID NO: 29712 - RNA, 3117 nt, Artificial Sequence
  derived and/or modified sequence opt1 from EPHA5__Homo_sapiens__NP_001268694
augcgcggcagcgggccccggggcgccgggcgccggcgcccgcccuccggcgggggcgacacccccaucacccccgccagccuggcgggcugcuacuccgccccgcggcgcgcgccccucuggacgugccugcugcucugcgccgcccugcggacccugcucgccagccccuccaacgaggugaaccugcuggacagccgcaccgucaugggggaccucggcuggaucgccuuccccaagaacgggugggaggagaucggcgagguggacgagaacuacgccccgauccacaccuaccaggugugcaaggucauggagcagaaccagaacaacuggcugcugacguccuggaucagcaacgagggggccucccggaucuucaucgagcucaaguucacccugcgcgacugcaacagccugcccggcggccucgggaccugcaaggagaccuucaacauguacuacuucgaguccgacgaccagaacggccggaacaucaaggagaaccaguacaucaagaucgacacgaucgcggccgacgagagcuucaccgagcuggaccugggggaccgcgugaugaagcucaacaccgaggugcgggacgucggcccccuguccaagaagggcuucuaccuggccuuccaggacgugggggccugcaucgcccucgugagcguccgcguguacuacaagaagugccccuccgugguccggcaccuggcgguguucccggacaccaucacgggcgccgacagcucccagcugcucgaggugagcggguccugcgucaaccacagcgugaccgacgagccgcccaagaugcacugcagcgccgagggcgaguggcuggugcccaucgggaagugcaugugcaaggccggcuacgaggagaagaacgggaccugccaggucugccgccccggcuucuucaaggccagcccccacauccaguccugcggcaagugcccgccccacuccuacacccacgaggaggcgagcacguccugcgugugcgagaaggacuacuuccggcgcgagagcgacccgcccaccauggccugcacccggccgcccuccgcgccccgcaacgccaucagcaacgugaacgagaccuccgucuuccuggaguggaucccgcccgccgacaccgggggccggaaggacgugagcuacuacaucgccugcaagaagugcaacucccacgccggggugugcgaggagugcggcggccacguccgcuaccucccccgccagagcgggcugaagaacacguccgugaugauggucgaccugcucgcccacaccaacuacaccuucgagaucgaggccgugaacggcgugagcgaccugucccccggggcccggcaguacgucagcgugaacgugacgaccaaccaggcggcccccucccccgucaccaacgugaagaagggcaagaucgccaagaacagcaucucccugagcuggcaggagcccgaccgccccaacgggaucauccucgaguacgagaucaaguacuucgagaaggaccaggagaccagcuacacgaucaucaaguccaaggagaccaccaucaccgccgagggccugaagcccgcgagcguguacgucuuccagauccgggcccgcacggccgccggcuacgggguguucucccggcgcuucgaguucgagaccacccccgugagcgucgccgcguccagcgaccagucccagaucccggugaucgccgugagcgucaccgugggcgugauccugcucgccgucgugaucggggugcugcuguccggcagcugcugcgagugcggcugcgggcgggccuccagccucugcgccgucgcgcaccccucccugaucuggcgcugcggcuacagcaaggccaagcaggaccccgaggaggagaagaugcacuuccacaacgggcacaucaagcugcccggcgugcggacguacaucgacccgcacaccuacgaggaccccaaccaggccgugcacgaguucgccaaggagaucgaggccuccugcaucaccaucgagcgcgucaucggggcgggcgaguucggcgaggugugcagcgggcggcucaagcugcccggcaagcgcgagcugcccguggccaucaagacccucaaggucggguacaccgagaagcagcggcgcgacuuccugggcgaggccuccaucauggggcaguucgaccacccgaacaucauccaccuggagggcguggugaccaagagcaagcccgucaugaucgugacggaguacauggagaacggcagccucgacaccuuccugaagaagaacgacgggcaguucaccgugauccagcuggucggcaugcugcgggggaucuccgccggcaugaaguaccucagcgacaugggguacgugcaccgcgaccuggcggcccggaacauccugaucaacuccaaccucgugugcaaggucagcgacuucggccugucccgcgugcuggaggacgaccccgaggccgccuacacgacccggggcgggaagauccccauccgcuggaccgccccggaggcgaucgccuuccgcaaguucaccagcgccuccgacguguggagcuacggcaucgucaugugggaggugguguccuacggggagcggcccuacugggagaugacgaaccaggacgucaucaaggccguggaggagggcuaccgccuccccagccccauggacugcccggccgcgcuguaccagcugaugcucgacugcuggcagaaggagcggaacucccgccccaaguucgacgagaucgugaacaugcuggacaagcugauccggaaccccagcucccucaagacccuggucaacgccagcugccgcguguccaaccugcucgccgagcacagcccccugggguccggcgccuaccggagcgugggcgaguggcuggaggccaucaagauggggcgcuacaccgagaucuucauggagaacggcuacuccagcauggacgcggucgcccaggugacccucgaggaccugcggcgccugggggugacgcucgucggccaccagaagaagaucaugaacagccugcaggagaugaaggugcagcuggucaacggcauggugccgcucuga

SEQ ID NO: 29713 - RNA, 3393 nt, Artificial Sequence
  derived and/or modified sequence opt1 from EPHA6__Homo_sapiens__NP_001073917
augcaguuccccagcccgcccgccgcccgcuccagccccgcgccccaggccgccuccagcuccgaggccgccgcgccggccaccggccagcccgggcccagcugccccgugccgggcaccucccggcgcgggcggcccggcacgccgcccgccgggcgcgucgaggaggaggaggaggaggaggaggaggacguggacaaggacccccaccccacccagaacacgugccugcggugccgccacuucagccuccgggagcgcaagcgggagccccgccggaccaugggcggcugcgaggugcgcgaguuccugcugcaguucggguucuuccucccccugcugaccgccuggccgggcgacugcucccacgucagcaacaaccagguggugcuccuggacaccaccaccguccugggggagcucggcuggaagacguacccccugaacgggugggacgcgaucaccgagauggacgagcacaaccggcccauccacaccuaccaggugugcaacgugauggagcccaaccagaacaacuggcugcgcaccaacuggaucucccgggacgccgcccagaagaucuacgucgagaugaaguucacgcuccgcgacugcaacagcaucccgugggugcuggggaccugcaaggagaccuucaaccuguucuacauggaguccgacgagagccacggcaucaaguucaagcccaaccaguacaccaagaucgacacgaucgccgccgacgaguccuucacccagauggaccucggggaccggauccugaagcugaacaccgagauccgcgaggugggccccaucgagcggaagggguucuaccucgcguuccaggacaucggcgccugcaucgcccuggucagcgugcgcguguucuacaagaagugccccuucaccguccggaaccuggccauguucccggacacgaucccccgcguggacuccagcucccucguggagguccgcggcagcugcgucaagagcgccgaggagcgggacacccccaagcuguacugcggggcggacggcgacuggcuggugccccucgggcgcugcaucugcuccaccggcuacgaggagaucgaggggagcugccacgccugccggccgggcuucuacaaggccuucgccggcaacaccaagugcuccaagugcccgccccacagccugacguacauggaggccaccuccgugugccagugcgagaagggguacuuccgcgcggagaaggacccgcccagcauggccugcacccggccgcccuccgcgccccgcaacgugguguucaacaucaacgagaccgcccugauccucgaguggagcccgcccuccgacacgggcgggcggaaggaccugaccuacagcgucaucugcaagaagugcggccuggacaccucccagugcgaggacugcgggggcggccuccgcuucaucccccggcacaccgggcugaucaacaacagcgugaucguccuggacuucgugucccacgugaacuacacguucgagaucgaggccaugaacggcgucagcgagcucuccuucagccccaagcccuucaccgccaucaccgugaccacggaccaggacgcccccucccugaucggggugguccgcaaggacugggccagccagaacuccaucgcccugagcuggcaggcgcccgccuucagcaacggcgccauccucgacuacgagaucaaguacuacgagaaggagcacgagcagcugaccuacuccagcacccgguccaaggcccccagcgugaucaucaccgggcugaagcccgccaccaaguacguguuccacauccgcguccggacggcgaccggcuacuccggcuacagccagaaguucgaguucgagaccggggacgagaccuccgacauggccgccgagcagggccagauccucgugaucgccacggccgcggucgggggcuucacccugcuggugauccucacccuguucuuccugaucaccggccgcugccagugguacaucaaggccaagaugaaguccgaggagaagcggcgcaaccaccuccagaacgggcaccuccgguuccccggcaucaagacguacaucgaccccgacaccuacgaggacccgagccuggccgugcacgaguucgccaaggagaucgaccccagccgcauccggaucgagcgcgugaucggggccggcgaguucggggaggucugcuccggccgccugaagacccccggcaagcgggagauccccguggcgaucaagacccugaagggcggccacauggaccgccagcggcgcgacuuccugcgggaggccagcaucauggggcaguucgaccacccgaacaucauccgccuggagggcguggucacgaagcgguccuuccccgccaucgggguggaggccuucugccccagcuuccuccgcgcgggcuuccugaacuccauccaggcgccccacccggugcccggcgggggcagccugcccccgcggauccccgccgggcgccccgucaugaucgugguggaguacauggagaacggcucccucgacagcuuccugcggaagcacgacgggcacuucaccgucauccagcuggugggcaugcuccgcggcaucgccagcgggaugaaguaccuguccgacaugggcuacgugcaccgggaccuggccgcccgcaacauccucgucaacagcaaccuggugugcaagguguccgacuucgggcugagccggguccucgaggacgaccccgaggccgccuacaccaccacgggcgggaagaucccgauccgcuggaccgcccccgaggccaucgcguaccggaaguucuccagcgccuccgacgccuggagcuacggcaucgugaugugggaggugauguccuacggcgagcgccccuacugggagaugagcaaccaggacgucauccuguccaucgaggagggguaccggcugcccgccccgaugggcugccccgccagccuccaccagcugaugcugcacugcuggcagaaggagcgcaaccaccggcccaaguucaccgacaucguguccuuccucgacaagcugauccgcaaccccagcgcgcugcacacccucguggaggacauccuggucaugccggagucccccggggaggugcccgaguacccccuguucgugacggucggcgacuggcucgacagcaucaagaugggccaguacaagaacaacuucguggccgccggguucaccaccuucgaccugaucucccgcaugagcaucgacgacauccggcgcaucggcgugauccugaucgggcaccagcggcgcaucgucuccagcauccagacccuccggcugcacaugaugcacauccaggagaagggcuuccacguguga

SEQ ID NO: 29714 - RNA, 840 nt, Artificial Sequence
  derived and/or modified sequence opt1 from EPHA7__Homo_sapiens__NP_001275559
augguguuccagacccgcuaccccagcuggaucauccugugcuacaucuggcuccugcgguucgcccacaccggcgaggcccaggcggccaaggagguccugcuccuggacuccaaggcccagcagaccgagcuggaguggaucagcuccccgcccaacgggugggaggagaucagcggccucgacgagaacuacacccccauccgcaccuaccaggugugccaggugauggagcccaaccagaacaacuggcugcggaccaacuggaucuccaaggggaacgcccagcgcaucuucgucgagcugaaguucacgcuccgggacugcaacagccugccgggcgugcuggggaccugcaaggagaccuucaaccucuacuacuacgagaccgacuacgacacgggccgcaacauccgggagaaccuguacgugaagaucgacaccaucgccgcggacgaguccuucacccagggcgaccugggggagcgcaagaugaagcucaacaccgagguccgggagaucggcccccugagcaagaagggguucuaccuggccuuccaggacgugggcgccugcaucgcccucguguccgucaagguguacuacaagaagugcuggagcaucaucgagaaccuggcgaucuuccccgacacggugaccggguccgaguucagcucccuggucgaggugcgcgggaccugcgugagcuccgccgaggaggaggccgagaacgcgccccggaugcacugcagcgccgagggcgaguggcucgucccgaucggcaagugcaucugcaaggccggcuaccagcagaagggggacacgugcgagcgcaaguga

SEQ ID NO: 29715 - RNA, 2955 nt, Artificial Sequence
  derived and/or modified sequence opt1 from EPHB1__Homo_sapiens__NP_004432
auggcccuggacuaccuccugcugcuccugcuggccagcgcgguggccgccauggaggagacccucauggacacccgcacggccaccgccgagcugggcuggaccgcgaaccccgccuccgggugggaggaggucagcggcuacgacgagaaccugaacaccauccggacguaccaggugugcaacguguucgagccgaaccagaacaacuggcuccugaccaccuucaucaaccgccggggcgcccaccgcaucuacaccgagaugcgguucacgguccgcgacugcuccagccugcccaacgugcccggcuccugcaaggagaccuucaaccucuacuacuacgagaccgacagcgugaucgccaccaagaaguccgcguucuggagcgaggcccccuaccugaaggucgacacgaucgccgccgacgaguccuucagccagguggacuucgggggccggcugaugaaggugaacaccgagguccgcuccuucggcccgcucacccggaacggguucuaccuggccuuccaggacuacggcgcgugcaugagccugcucuccgugcgcguguucuucaagaagugccccagcaucguccagaacuucgccguguuccccgagaccaugacgggggccgaguccaccagccuggugaucgcccgggggaccugcauccccaacgccgaggaggucgacgugccgaucaagcuguacugcaacggggacggcgaguggauggugcccaucggccgcugcacgugcaagcccggguacgagcccgagaacuccgucgcgugcaaggccugcccggccggcaccuucaaggccagccaggaggccgaggggugcucccacugccccagcaacagccggucccccgcggaggccagccccaucugcacgugccgcaccggcuacuaccgggccgacuucgacccgcccgagguggccugcaccuccgugcccagcggcccccgcaacgucaucuccaucgugaacgagaccagcaucauccucgaguggcacccgccccgggagaccgggggccgcgacgacgugaccuacaacaucaucugcaagaagugccgggccgaccgccgguccugcagccgcugcgacgacaacgucgaguucgugccccgccagcuggggcugaccgagugccgggucuccaucagcucccucugggcgcacacgcccuacaccuucgacauccaggccaucaacggcgugagcuccaagagcccguucccgccccagcacguguccgucaacaucaccaccaaccaggccgcccccagcacggugcccaucaugcaccagguguccgcgaccaugcgcagcaucacccuguccuggccccagcccgagcagccgaacgggaucauccuggacuacgagauccgguacuacgagaaggagcacaacgaguucaacagcagcauggcccgcucccagaccaacacggcccggaucgacggccuccgccccggcauggucuacguggugcagguccgggcccgcaccguggccggguacggcaaguucagcgggaagaugugcuuccagacccugaccgacgacgacuacaaguccgagcugcgggagcagcucccccugaucgcgggcagcgccgccgccgggguggucuucguggugucccuggucgccaucagcaucgugugcucccgcaagcgggcguacagcaaggaggccguguacuccgacaagcuccagcacuacagcaccggccgcggcucccccgggaugaagaucuacaucgacccguucacguacgaggaccccaacgaggccguccgggaguucgccaaggagaucgacgugagcuucgugaagaucgaggaggucaucggcgccggggaguucggcgagguguacaaggggcgccugaagcugcccggcaagcgggagaucuacguggcgaucaagacccucaaggccggcuacuccgagaagcagcgccgggacuuccugagcgaggccuccaucauggggcaguucgaccaccccaacaucauccgccuggagggcgucgugaccaagagccggccggugaugaucaucaccgaguucauggagaacggggcccucgacuccuuccugcgccagaacgacggccaguucacggucauccagcuggugggcaugcuccgcgggaucgcggccggcaugaaguaccuggccgagaugaacuacgugcaccgggaccuggccgcccgcaacauccucgucaacagcaaccuggugugcaaggugagcgacuucgggcugucccgguaccuccaggacgacaccagcgaccccaccuacaccuccagccugggcgggaagauccccguccgcuggacggcgcccgaggccaucgccuaccggaaguucaccuccgccagcgacgugugguccuacggcaucgugaugugggaggucaugagcuucggcgagcgcccguacugggacauguccaaccaggacgugaucaacgccaucgagcaggacuaccggcugcccccgcccauggacugccccgcggcccugcaccagcucaugcuggacugcuggcagaaggaccgcaacagccggccccgcuucgccgagaucgugaacacccuggacaagaugauccggaaccccgccucccucaagaccgucgccacgaucaccgcggugcccagccagccgcugcuggaccgcuccauccccgacuucaccgccuucaccacgguggacgacuggcucagcgccaucaagaugguccaguaccgggacuccuuccugaccgccggguucaccagccugcagcucgugacccagaugacguccgaggaccugcugcgcaucggcaucacccucgcggggcaccagaagaagauccugaacagcauccacuccaugcgggugcagaucagccagagccccaccgccauggccuga

SEQ ID NO: 29716 - RNA, 2997 nt, Artificial Sequence
  derived and/or modified sequence opt1 from EPHB3__Homo_sapiens__NP_004434
auggcccgcgcccggcccccgcccccccccagcccgccccccggccugcucccccugcugccgccccuccugcugcucccccugcugcuccugcccgcggggugccgcgcccuggaggagacccucauggacaccaagugggugacguccgagcuggccuggaccagccacccggaguccggcugggaggaggucagcggguacgacgaggccaugaaccccauccggaccuaccaggugugcaacgugcgcgaguccagccagaacaacuggcugcggaccggcuucaucuggcgccgggacguccagcgcguguacguggagcucaaguucacgguccgggacugcaacuccauccccaacauccccgggagcugcaaggagaccuucaaccuguucuacuacgaggccgacuccgacguggcgagcgccuccagcccguucuggauggagaaccccuacgugaaggucgacaccaucgcccccgacgaguccuucagccgccuggacgccggccgggugaacaccaaggugcgcuccuucggcccccucagcaaggcgggguucuaccuggccuuccaggaccagggcgccugcaugucccugaucagcguccgggccuucuacaagaagugcgccuccacgaccgcgggguucgcccucuucccggagacccugaccggcgccgagcccacgagccuggugaucgcccccgggaccugcauccccaacgccguggaggucagcgugccgcucaagcuguacugcaacggcgacggcgaguggauggugcccgucggggcgugcaccugcgccaccggccacgagcccgccgccaaggagucccagugccgccccugcccgcccgggagcuacaaggccaagcagggcgagggccccugccugccgugcccccccaacucccggacgaccagccccgcggccuccaucugcaccugccacaacaacuucuaccgcgccgacagcgacuccgccgacagcgccugcaccacggugccgucccccccccggggggugaucagcaacgucaacgagaccucccucauccuggaguggagcgagccccgcgaccugggcgggcgggacgaccuccuguacaacgugaucugcaagaagugccacggcgcggggggcgccuccgccugcagccgcugcgacgacaacguggaguucgucccgcggcagcugggccucaccgagcgccgcgugcacaucucccaccugcuggcccacacccgguacacguucgagguccaggcggugaacggggugagcggcaaguccccccuccccccccgcuacgccgccgucaacaucaccaccaaccaggccgccccgagcgaggugcccacccugcggcugcacuccagcagcggguccagccucacgcuguccugggcgccccccgagcgcccgaacggcgugauccuggacuacgagaugaaguacuucgagaagagcgaggggaucgccuccaccgucaccagccagaugaacuccgugcagcucgacggccugcggcccgacgcccgcuacgugguccaggugcgggcccgcaccguggccggcuacgggcaguacagccggcccgcggaguucgagacgaccuccgagcgcggcagcggggcccagcagcugcaggagcagcucccccugaucgucggcuccgccaccgccgggcugguguucguggucgccgugguggucaucgcgaucgugugccuccggaagcagcgccacggcagcgacuccgaguacaccgagaagcugcagcaguacaucgccccgggcaugaagguguacaucgaccccuucacguacgaggaccccaacgaggccguccgggaguucgccaaggagaucgacgugagcugcgugaagaucgaggaggucaucggggcgggcgaguucggggaggugugccgcggccggcugaagcagcccggccgccgggagguguucgucgccaucaagacccugaaggugggguacaccgagcgccagcggcgcgacuuccucuccgaggccagcaucaugggccaguucgaccacccgaacaucauccgccuggaggggguggucaccaagucccggcccgugaugauccugaccgaguucauggagaacugcgcccucgacagcuuccugcgccugaacgacggccaguucacggugauccagcucgucgggaugcugcggggcaucgccgcgggcaugaaguaccugagcgagaugaacuacgugcaccgcgaccucgccgcccggaacauccuggugaacuccaaccuggucugcaaggugagcgacuucgggcucucccgcuuccuggaggacgaccccagcgacccgaccuacaccuccagccugggcgggaagauccccauccgguggaccgcccccgaggccaucgcguaccgcaaguucacguccgccagcgacgugugguccuacggcaucgucaugugggaggugaugagcuacggggagcggcccuacugggacauguccaaccaggacgugaucaacgccgucgagcaggacuaccgccucccgccccccauggacugccccaccgcccugcaccagcugaugcucgacugcugggugcgggaccgcaaccugcggccgaaguucagccagaucgugaacacccuggacaagcucauccgcaacgccgcgucccugaaggucaucgccagcgcccaguccggcaugagccagccccugcucgaccggaccgugcccgacuacacgaccuucaccaccgugggcgacuggcuggacgccaucaagauggggcgcuacaaggaguccuucgucagcgcgggcuucgccuccuucgaccugguggcccagaugacggccgaggaccuccugcggaucggggugacccuggccggccaccagaagaagauccucagcagcauccaggacaugcgccugcagaugaaccagacccugcccguccagguguga

SEQ ID NO: 29717 - RNA, 2964 nt, Artificial Sequence
  derived and/or modified sequence opt1 from EPHB4__Homo_sapiens__NP_004435
auggagcugcgcgugcuccugugcugggccagccuggccgcggcccucgaggagacccugcugaacaccaagcucgagacggccgaccugaagugggucaccuucccccagguggacggccagugggaggagcuguccgggcucgacgaggagcagcacagcgugcggaccuacgaggucugcgacgugcagcgcgccccgggccaggcccacuggcugcggaccgggugggugccccgccggggcgcgguccacguguacgccacgcugcgcuucaccaugcucgagugccugucccugccccgggccgggcgcagcugcaaggagaccuucaccguguucuacuacgaguccgacgccgacacggcgaccgcccucacccccgccuggauggagaacccguacaucaaggucgacaccguggccgccgagcaccugacgcggaagcgccccggcgcggaggccaccggcaaggugaacgucaagacccugcggcucgggccccugagcaaggccggcuucuaccuggccuuccaggaccagggggccugcauggcgcuccugucccugcaccucuucuacaagaagugcgcccagcugaccgugaaccugacgcgcuuccccgagaccgugccgcgggagcucgucgugcccguggccggcagcugcgucguggacgccgugcccgcccccgggccgucccccagccuguacugccgcgaggacggccagugggcggagcagcccgucaccggcugcuccugcgcccccggguucgaggccgccgagggcaacaccaagugccgggccugcgcgcaggggacguucaagccgcugagcggcgagggcuccugccagcccugccccgccaacagccacuccaacaccaucgggagcgccgugugccagugccgcgugggcuacuuccgggcccgcaccgacccccgcggggcgccgugcaccacgccgcccuccgcgccccggagcgucgugucccggcucaacggcagcagccugcaccuggagugguccgcgccccucgagagcgggggccgcgaggaccugaccuacgcccugcgcugccgggagugccgccccggcggguccugcgcccccugcggcggggaccucaccuucgaccccggcccgcgggaccuggucgagcccuggguggugguccgcgggcugcggcccgacuucaccuacacguucgaggugaccgcccucaacggcgugagcucccuggccaccggcccgguccccuucgagcccgugaacgugaccacggaccgcgaggugcccccggccgugagcgacauccgggugacccgcuccagccccuccagccugucccucgccugggccgucccccgggcccccagcggggccgugcuggacuacgaggugaaguaccacgagaagggcgccgaggggccguccagcguccgcuuccugaagaccuccgagaaccgggccgagcuccgcggccugaagcgcggggccagcuaccugguccaggugcgggcgcgguccgaggccggcuacggccccuucgggcaggagcaccacagccagacccagcucgacgaguccgagggcuggcgcgagcagcuggcccugaucgccgggacggcggucgugggcgugguccuggugcucguggucaucgugguggccguccugugccugcggaagcagagcaacggccgcgaggccgaguacagcgacaagcacgggcaguaccucaucggccacgggaccaagguguacaucgaccccuucaccuacgaggaccccaacgaggccgugcgggaguucgccaaggagaucgacgucuccuacgugaagaucgaggaggugaucggcgcgggggaguucggcgaggucugccgcggccgccugaaggccccggggaagaaggagagcugcguggccaucaagacccugaagggcggguacaccgagcggcagcgccgggaguuccucuccgaggccagcaucaugggccaguucgagcaccccaacaucauccgccuggaggggguggucacgaacuccaugcccgugaugauccugaccgaguucauggagaacggcgcccucgacagcuuccugcggcugaacgacggccaguucaccgugauccagcucgucgggaugcugcgcggcaucgcguccgggaugcgguaccuggccgagaugagcuacgugcaccgcgaccucgccgcccggaacauccuggugaacuccaaccuggucugcaaggugagcgacuucggccucucccgcuuccuggaggagaacagcuccgaccccaccuacacgagcucccucgggggcaagaucccgauccgguggaccgcccccgaggcgaucgccuuccgcaaguucaccagcgccuccgacgccuggagcuacggcaucgugaugugggaggucaugagcuucggggagcggcccuacugggacauguccaaccaggacgugaucaacgcgaucgagcaggacuaccgccugcccccgccgcccgacugccccaccagccugcaccagcugaugcucgacugcuggcagaaggaccggaacgcccgcccccgguucccccagguggucuccgcccuggacaagaugauccgcaaccccgccagccugaagaucguggcccgggagaacggcggggcgucccacccgcuccuggaccagcgccagccccacuacagcgccuucggcuccgugggggaguggcugcgggccaucaagaugggccgcuacgaggagagcuucgccgccgcgggcuucggguccuucgagcucgucagccagaucuccgccgaggaccugcugcgcaucggcgugacgcucgccgggcaccagaagaagauccuggccagcguccagcacaugaagucccaggccaagcccggcacccccggcgggaccggcgggccggcgccccaguacuga

SEQ ID NO: 29718 - RNA, 2190 nt, Artificial Sequence
  derived and/or modified sequence opt1 from EPHB6__Homo_sapiens__NP_001267724
augguggccgucggcgggugccgcugccagcccggcuaccagccggcccgcggggacaaggcgugccaggccugcccccggggccuguacaaggccagcgccgggaacgcccccugcucccccugcccggcgcggagccacgcccccaaccccgccgcccccgugugcccgugccuggagggcuucuaccgcgcguccagcgacccgcccgaggcccccugcaccggcccgcccuccgcgccccaggagcugugguucgaggugcaggggagcgcccugaugcuccacuggcggcugccccgcgagcugggcgggcggggcgaccuccuguucaacgucgugugcaaggagugcgaggggcgccaggagcccgccuccggcggcgggggcacgugccaccggugccgcgacgaggugcacuucgacccccggcagcgcgggcugaccgagagccggguccucgugggcggccugcgcgcccacgugcccuacauccuggagguccaggccgugaacgggguguccgagcucagccccgacccgccccaggccgccgccaucaacgucuccaccagccacgaggugcccuccgcggugcccgucgugcaccaggugagccgggccuccaacagcaucaccgucuccuggccgcagcccgaccagaccaacggcaacauccuggacuaccagcugcgcuacuacgaccaggccgaggacgagagccacuccuucacgcucaccagcgagaccaacaccgccacggugacccagcugagccccgggcacaucuacggcuuccaggugcgggcccgcaccgcggccgggcacggccccuacggcgggaaggucuacuuccagacccugccgcagggcgagcucuccagccagcugcccgagcggcugucccucgugaucgggagcauccugggcgcccuggccuuccuccugcuggccgcgaucacggugcucgccgucguguuccagcgcaagcggcgcgggaccggcuacaccgagcagcugcagcaguacuccagccccggccugggggucaaguacuacaucgacccguccaccuacgaggaccccugccaggccauccgcgagcucgcccgggagguggaccccgcguacaucaagaucgaggaggugaucggcacggggagcuucggcgagguccgccaggggcggcugcagccccgcggccggcgcgagcagaccguggccauccaggcccugugggccggcggggccgagucccuccagaugaccuuccugggccgggcggccgugcuggggcaguuccagcacccgaacauccuccgccuggagggcgucgugaccaagagccggccccugauggugcucacggaguucauggagcugggcccccuggacuccuuccuccgccagcgggaggggcaguucagcucccugcagcuggucgccaugcagcgcggcguggccgccgcgaugcaguaccucagcuccuucgccuucgugcaccggagccuguccgcccacagcguccuggugaacucccaccucgugugcaaggucgcccgccuggggcacagcccccagggcccgagcugccugcugcggugggccgcgcccgaggugaucgcccacgggaagcacaccaccuccagcgacgugugguccuucggcauccucaugugggaggucaugagcuacggcgagcgccccuacugggacauguccgagcaggaggugcugaacgccaucgagcaggaguuccggcugcccccgccgcccgggugcccgcccggccuccaccuccugaugcuggacaccuggcagaaggaccgcgcccggcgcccccacuucgaccagcugguggcggccuucgacaagaugauccgcaagcccgacacgcugcaggccgggggcgaccccggggagcggcccagccaggcccuccugacccccgucgcccuggacuuccccugccucgacagcccccaggcguggcuguccgccaucggccuggagugcuaccaggacaacuucuccaaguucggccucugcaccuucagcgacguggcccagcugucccuggaggaccucccggcccuggggaucacccuggccggccaccagaagaagcuccugcaccacauccagcugcuccagcagcaccuccgccagcaggggagcguggaggucuga

SEQ ID NO: 29719 - RNA, 1368 nt, Artificial Sequence
  derived and/or modified sequence opt1 from EPHX1__Homo_sapiens__NP_000111
auguggcuggagauccuccugaccagcgugcugggcuucgccaucuacugguucaucucccgcgacaaggaggagacccucccccuggaggacgggugguggggcccggggacgcggagcgccgcgcgcgaggacgacuccauccggcccuucaaggucgagaccagcgacgaggagauccacgaccugcaccagcgcaucgacaaguuccgguucaccccgccccucgaggacuccugcuuccacuacggcuucaacagcaacuaccugaagaaggugaucuccuacuggcgcaacgaguucgacuggaagaagcaggucgagauccugaaccgguacccccacuucaagaccaagaucgaggggcucgacauccacuucauccacgugaagccgccccagcugcccgccggccacacgcccaagccccugcucauggugcacggcuggcccgggagcuucuacgaguucuacaagaucaucccccugcugaccgacccgaagaaccacggccucuccgacgagcacguguucgaggucaucugccccagcauccccggguacggcuucuccgaggccagcuccaagaagggguucaacagcguggccaccgcccgcaucuucuacaagcugaugcugcggcucggcuuccaggaguucuacauccagggcggggacuggggcucccugaucugcaccaacauggcgcagcuggugcccagccacgucaaggggcuccaccugaacauggcccuggugcucuccaacuucagcacgcugacccugcuccugggccagcgcuucggccgguuccuggggcucaccgagcgcgacguggagcugcuguacccggucaaggagaagguguucuacucccucaugcgggagagcggcuacaugcacauccagugcaccaagcccgacacgguggggagcgcccugaacgacucccccgucggccuggccgcguacauccucgagaaguucagcaccuggaccaacaccgaguuccgcuaccuggaggacgggggccuggagcggaaguucucccucgacgaccugcugacgaacgugaugcucuacuggaccaccggcaccaucaucagcucccagcgcuucuacaaggagaaccuggggcagggcuggaugacgcagaagcacgagcggaugaagguguacguccccaccggguucagcgccuucccguucgagcugcuccacacccccgagaagugggugcgcuucaaguaccccaagcugaucuccuacagcuacauggugcggggcgggcacuucgccgccuucgaggagcccgagcugcucgcccaggacauccgcaaguuccuguccguccuggagcggcaguga

SEQ ID NO: 29720 - RNA, 1509 nt, Artificial Sequence
  derived and/or modified sequence opt1 from EPHX2__Homo_sapiens__NP_001243411
augaagggcgagaucacccugagccaguggaucccccucauggaggagaacugccgcaagugcuccgagaccgccaaggugugccugccgaagaacuucagcaucaaggagaucuucgacaaggccaucuccgcgcggaagaucaaccgccccaugcugcaggccgcccucaugcugcggaagaagggguucacgaccgccauccugaccaacaccuggcucgacgaccgcgccgagcgggacggccuggcgcagcugaugugcgagcucaagaugcacuucgacuuccugaucgagagcugccaggucgggauggugaagcccgagccccagaucuacaaguuccugcucgacacgcugaaggccuccccgagcgagguggucuuccuggacgacaucggcgccaaccucaagcccgcccgcgaccuggggauggugaccauccuggugcaggacaccgacaccgcgcucaaggagcuggagaaggucacgggcauccagcugcucaacacccccgcgccccugccgaccuccugcaaccccagcgacaugucccacggcuacgugaccgugaagccccggguccgccugcacuucguggagcucgggagcggccccgccgugugccugugccacggguucccggaguccugguacagcuggcgguaccagauccccgcccuggcccaggccggcuaccgcguccucgccauggacaugaagggguacggcgaguccagcgccccgcccgagaucgaggaguacugcauggaggugcugugcaaggagauggugacguuccuggacaagcucggccugucccaggccgucuucaucgggcacgacuggggcgggaugcuggugugguacauggcccucuucuaccccgagcgggugcgcgcggucgccagccugaacacccccuucauccccgccaaccccaacauguccccgcuggagagcaucaaggccaaccccguguucgacuaccagcucuacuuccaggagcccggcguggccgaggcggagcuggagcagaaccugucccggaccuucaagagccucuuccgcgccagcgacgaguccguccugagcaugcacaaggugugcgaggccggcgggcuguucgugaacucccccgaggagccgagccucucccggauggucaccgaggaggagauccaguucuacgugcagcaguucaagaaguccggcuuccgcgggccccugaacugguaccggaacauggagcgcaacuggaagugggccugcaagagccugggccggaagauccucauccccgcccugauggucacggcggagaaggacuucgugcuggugccccagaugagccagcacauggaggacuggaucccgcaccucaagcgcgggcacaucgaggacugcggccacuggacccagauggacaagcccaccgaggucaaccagauccugaucaaguggcuggacuccgacgcccggaacccgcccguggugagcaagauguga

SEQ ID NO: 29721 - RNA, 1083 nt, Artificial Sequence
  derived and/or modified sequence opt1 from EPHX3__Homo_sapiens__NP_001136358
augcccgagcugguggucaccgcccuccuggccccgagccgccugucccucaagcugcugcgggcguucauguggagccucguguucuccguggcccuggucgccgccgccguguacggcugcaucgcgcugacccacgugcucugccgcccccggcgcgggugcugcggccggcgccggagcgccucccccgccugccugagcgaccccucccugggggagcacggcuuccucaaccucaagagcuccgggcugcgccugcacuacgucagcgccggccggggcaacgggccgcugaugcuguuccuccacggcuuccccgagaacugguucuccuggcgcuaccagcugcgggaguuccagagccgcuuccacgugguggcggucgaccugcggggguacggccccuccgacgcgccccgcgacguggacugcuacacgaucgaccuccugcugguggacaucaaggacgucauccucgggcugggcuacagcaagugcauccugguggcccacgacuggggcgcccuccuggccuggcacuucuccaucuacuacccgagccugguggagcggauggucgugguguccggggcccccaugagcgucuaccaggacuacucccuccaccacaucagccaguucuuccgcagccacuacauguuccuguuccagcugcccuggcuccccgagaagcugcuguccaugagcgacuuccagauccucaagaccacccugacccaccggaagacgggcaucccgugccugacccccuccgagcucgaggccuuccuguacaacuucagccagcccgggggccugaccggcccccucaacuacuaccgcaaccuguuccggaacuucccgcuggagccccaggagcucaccacgcccacccugcugcucuggggcgagaaggacaccuaccuggagcuggggcugguggaggccaucgggucccgcuucgugcccggccggcucgaggcccacauccugccggggaucggccacuggaucccccagagcaacccccaggagaugcaccaguacaugugggccuuccugcaggaccuccuggacuga

SEQ ID NO: 29722 - RNA, 954 nt, Artificial Sequence
  derived and/or modified sequence opt1 from EPM2A__Homo_sapiens__NP_001018051
augcgcuuccgguucggcguggucgugcccccggccguggccggggcgcgccccgagcugcucgucgugggcagccggcccgagcuggggcgcugggagccccggggcgccgugcgccugcggccggccgggaccgccgccggcgacggcgcgcucgcccugcaggagcccgggcuguggcucggcgaggucgagcuggccgccgaggaggcggcccaggacggggccgagcccggccgcguggacaccuucugguacaaguuccugaagcgggagcccgggggcgagcucuccugggagggcaacgggccgcaccacgaccgcugcugcacguacaacgagaacaaccugguggacggcgucuacugccugcccaucgggcacuggaucgaggccaccggccacaccaacgagaugaagcacaccacggacuucuacuucaacaucgccggccaccaggcgaugcacuacagccggauccuccccaacaucuggcugggguccugcccccgccagguggagcacgugaccaucaagcugaagcacgagcucggcaucaccgccgucaugaacuuccagaccgagugggacaucgugcagaacagcuccgggugcaaccgguacccggagcccaugacgcccgacaccaugaucaagcuguaccgcgaggagggccuggccuacaucuggaugcccaccccggacaugagcaccgaggggcgggugcagaugcucccccaggccgucugccugcugcacgcccuccuggagaagggccacaucguguacgugcacugcaacgcgggcgucgggcgcuccacggccgccgugugcggcuggcugcaguacgugaugggguggaaccuccggaagguccaguacuuccugauggccaagcgccccgccguguacaucgacgaggaggcggccagccaggacaccuucccccuguga

SEQ ID NO: 29723 - RNA, 1824 nt, Artificial Sequence
  derived and/or modified sequence opt1 from EPM2AIP1__Homo_sapiens__NP_055620
auguggaugacccccaagcgcagcaagauggagguggacgaggcccuggucuuccggccggaguggacccagcgcuaccuggugguggagccgcccgagggcgacggggcccugugccuggucugccggcgccucaucguggcgacgcgggagcgcgacgugcggcgccacuacgaggccgagcacgaguacuacgagcgguacgucgccgacggcgagcgcgccgcccugguggagcggcugcgccagggggaccuccccguggcguccuucacccccgaggagcgggccgcccgcgccggccuggggcugugccggcuccuggcgcugaagggccgcggcuggggcgagggggacuucgucuaccagugcauggaggugcuccugcgggaggugcugcccgagcacgucagcgugcuccaggggguggaccugucccccgacaucacccgccagcggauccugagcaucgaccgcaaccuccggaaccagcuguucaaccgcgcccgcgacuucaaggccuacucccuggcccucgacgaccaggccuucgucgcguacgagaacuaccugcugguguucauccggggcguggggcccgagcucgagguccaggaggaccugcugaccaucaucaaccucacgcaccacuucagcgugggcgcccugauguccgccauccuggagagccuccagaccgccggccugucccugcagcgcaugguggggcucaccaccacgcacacccugcggaugaucggcgagaacagcgggcuggucuccuacaugcgcgagaaggccgugagcccgaacugcuggaacgugauccacuacuccggcuuccuccaccuggagcugcucagcuccuacgacgucgacgugaaccagaucaucaacaccaucagcgaguggaucguccugaucaagacccggggcgugcgccggcccgaguuccagacgcugcucaccgaguccgagagcgagcacggggagcgcgugaacggccggugccugaacaacuggcugcgccgggggaagacccucaagcugaucuucucccugcgcaaggagauggaggcguuccucgucagcgugggcgccaccacggugcacuucagcgacaagcaguggcugugcgacuucggguuccuggucgacaucauggagcaccuccgggagcucuccgaggagcugcgcgugagcaagguguucgccgccgccgcguucgaccacaucugcaccuucgaggucaagcugaaccucuuccagcggcacaucgaggagaagaaccugaccgacuuccccgcccugcgcgaggugguggacgagcucaagcagcagaacaaggaggacgagaagaucuucgaccccgaccgguaccagauggucaucugccgccugcagaaggaguucgagcggcacuucaaggaccugcgcuucaucaagaaggaccucgagcuguucuccaacccguucaacuucaagcccgaguacgcccccaucagcgugcgcguggagcugaccaagcuccaggccaacacgaaccuguggaacgaguaccggaucaaggaccugggccaguucuacgccggccucuccgcggagagcuaccccaucaucaagggggucgccugcaagguggccucccuguucgacagcaaccagaucugcgagaaggccuucuccuaccugacccgcaaccagcacacccucagccagccgcugaccgacgagcaccuccaggcgcuguuccggguggccacgaccgagauggagcccggcugggacgaccugguccgcgagcggaacgaguccaaccccuga

SEQ ID NO: 29724 - RNA, 1989 nt, Artificial Sequence
  derived and/or modified sequence opt1 from EPN1__Homo_sapiens__NP_001123543
augggcgaccagagcuggcuguggaaccaggccgcccccggggugcgcucccccgucuucgcgugcagcguggagaagggcaacgugccccucguccuguccgagcaccuggcccacagccgggaccccggguccggcgccgugcgcuuccucaucagccccgagccgugggccuccgccauccuggggaccagcggccugcucgcgucccccgugcugcccgccgcccuggacgccgugaccugccagcaccucccccagccgagcuccggcagccggcccaucagcccccgcaucggggcgcugugcccccugcuccugcagccgggcacgauguccaccuccagccugcggcgccagaugaagaacaucguccacaacuacuccgaggccgagaucaaggugcgggaggccaccagcaacgaccccugggggcccuccagcagccucauguccgagaucgccgaccugaccuacaacgucguggccuucagcgagaucauguccaugaucuggaagcgccugaacgaccacggcaagaacuggcggcacguguacaaggcgaugacgcucauggaguaccugaucaagaccgggagcgagcgcgucucccagcagugcaaggagaacauguacgccgugcagacccugaaggacuuccaguacguggaccgggacggcaaggaccagggcgucaacgugcgcgagaaggccaagcagcucguggcccugcugcgggacgaggaccgccuccgggaggagcgcgcccacgcgcugaagaccaaggagaagcuggcccagacggccaccgccagcuccgccgcggucgggagcgggcccccgcccgaggccgagcaggccuggccccaguccagcggggaggaggagcuccagcugcagcuggcccucgccauguccaaggaggaggcggaccaggaggagcggauccgccggggcgacgaccugcgccugcagauggccaucgaggagagcaagcgggagaccggcgggaaggaggaguccagccucauggaccuggccgacguguucaccgcccccgcgccggcccccacgaccgaccccuggggcgggcccgccccgauggccgccgcggugcccaccgccgcccccaccuccgaccccuggggcgggccgcccgugcccccggccgccgaccccuggggcggccccgcgcccacgccggccagcggggaccccuggcgccccgccgcccccgccggcccguccgucgaccccuggggcggcacccccgcgcccgccgccggggagggcccgacccccgaccccuggggcagcuccgacgggggcgugcccgucagcgggccgagcgccuccgaccccuggacccccgcgcccgccuucagcgacccguggggcgggucccccgccaagcccagcacgaacggcaccaccgccgccggcggguucgacaccgagcccgacgaguucuccgacuucgaccgccugcggacggcgcucccgaccagcggcuccagcgccggggagcuggagcugcucgccggcgaggugcccgcccgcucccccggcgccuucgacaugagcgggguccggggcucccuggcggaggccguggggagcccgccgcccgccgccacccccacccccacgccgcccacccgcaagacccccgaguccuuccugggccccaacgccgcgcucguggaccuggacagccuggucucccggcccgggcccacgcccccgggcgccaaggccagcaaccccuuccuccccggcgggggccccgccaccgggccguccgugaccaaccccuuccagcccgcgcccccggccacccugacccugaaccagcuccgccugagccccgugccgcccguccccggcgccccgcccacguacaucagcccccucgggggcggccccgggcugccgcccaugaugccgcccggcccgcccgcccccaacaccaaccccuuccugcuguga

SEQ ID NO: 29725 - RNA, 582 nt, Artificial Sequence
  derived and/or modified sequence opt1 from EPO__Homo_sapiens__NP_000790
augggcgugcacgagugccccgccuggcuguggcuccugcugagccuccugucccugccgcucgggcugcccguccugggcgccccgccccgccucaucugcgacagccgggugcuggagcgcuaccugcucgaggccaaggaggccgagaacaucaccaccgggugcgccgagcacugcucccugaacgagaacaucacggugcccgacaccaaggucaacuucuacgccuggaagcggauggaggugggccagcaggccguggaggucuggcaggggcuggcgcuccugagcgaggccgugcugcgcggccaggcccuccuggugaacuccagccagcccugggagccccugcagcuccacgucgacaaggccguguccggccugcggagccugaccacccuccugcgcgcgcugggggcccagaaggaggccaucuccccgcccgacgccgccagcgcggcgccccuccggacgaucaccgccgacaccuuccgcaagcuguuccggguguacuccaacuuccugcgcggcaagcucaagcuguacaccggggaggccugccggacgggcgaccgcuga

SEQ ID NO: 29726 - RNA, 1527 nt, Artificial Sequence
  derived and/or modified sequence opt1 from EPOR__Homo_sapiens__NP_000112
auggaccaccugggcgccagccucuggccccagguggggucccugugccugcuccuggccggcgcggccugggcgcccccgcccaaccugcccgacccgaaguucgagagcaaggccgcccuccuggccgcccgcgggcccgaggagcugcucugcuucaccgagcggcuggaggaccuggucugcuucugggaggaggccgccuccgcgggcguggggcccggcaacuacagcuucuccuaccagcucgaggacgagcccuggaagcugugccgccugcaccaggccccgaccgcccggggcgccgugcgcuucuggugcagccuccccacggccgacaccuccagcuucgucccccuggagcugcgggugaccgcggccuccggggcgccccgcuaccaccgggugauccacaucaacgaggucgugcuccuggacgccccggugggccuggucgcccgccucgccgacgagagcgggcacguggugcugcgguggcugcccccgcccgagacccccaugacgucccacauccgcuacgaggucgacgugagcgccggcaacggggccggcuccgugcagcgggucgagauccucgagggccgcaccgagugcgugcugagcaaccugcgggggcgcacccgguacaccuucgccgugcgcgcccggauggcggagcccuccuucggcggguucuggagcgccugguccgagcccgucagccuccugacgcccuccgaccuggacccgcucauccugacccugagccucauccugguggugauccugguccuccugaccgugcuggcccuccugagccaccgccgggcccugaagcagaagaucuggcccggcauccccucccccgagagcgaguucgagggccucuucaccacgcacaaggggaacuuccagcuguggcuguaccagaacgacggcugccucuggugguccccgugcacccccuucaccgaggacccgcccgccagccuggaggugcuguccgagcgcugcugggggaccaugcaggcggucgagcccggcacggacgacgaggggccccuccuggagcccgugggcagcgagcacgcccaggacaccuaccugguccuggacaaguggcuccugccgcggaacccgcccuccgaggaccugcccggccccgggggcagcguggacaucguggccauggacgagggguccgaggccagcuccugcagcuccgcgcucgccagcaagcccucccccgagggcgccagcgccgccuccuucgaguacaccauccuggaccccagcucccagcugcuccgccccuggacccugugccccgagcugccgcccacgccgccccaccucaaguaccuguaccuggucgugagcgacagcgggaucuccaccgacuacagcuccggcgacagccagggcgcgcagggcgggcucuccgacgggcccuacagcaaccccuacgagaacucccugauccccgccgccgagccccugccgcccagcuacguggccugcuccuga

SEQ ID NO: 29727 - RNA, 384 nt, Artificial Sequence
  derived and/or modified sequence opt1 from EPPIN__Homo_sapiens__NP_001289790
augggcagcuccgggcugcucagccugcugguccucuucgugcugcuggccaacgugcagggccccgggcucaccgacuggcuguucccgcgccggugccccaagauccgcgaggagugcgaguuccaggagcgggacgugugcaccaaggaccgccagugccaggacaacaagaagugcugcguguucuccugcggcaagaagugccuggaccucaagcaggucagccugcagauguacgccaagugccagaagaagcuggcgcccgccuggcucaucuucuucaucgggggcaugacgcggaagaucauccuggcccccugccuguccaugguggccgcccgcgagaccaucaccaccagcaacccgaagcccacggcguga

SEQ ID NO: 29728 - RNA, 540 nt, Artificial Sequence
  derived and/or modified sequence opt1 from EPPIN-WFDC6__Homo_sapiens__NP_001185915
augggcagcuccgggcugcucagccugcugguccucuucgugcugcuggccaacgugcagggccccgggcucaccgacuggcuguucccgcgccggugccccaagauccgcgaggagugcgaguuccaggagcgggacgugugcaccaaggaccgccagugccaggacaacaagaagugcugcgucuucuccugcggcaagaagugccuggaccucaagcaggacgugugcgagaugcccaaggagaccgggcccugccuggccuacuuccugcacuggugguacgacaagaaggacaacacgugcagcauguucguguacggcggcugccaggggaacaacaacaacuuccaguccaaggcgaacugccucaacacgugcaagaacaagcagccgugccccaagaucaaggucgagugcgagguggaggagaucgaccagugcaccaagccccgggacugccccgagaacaugaagugcugcccguucagccgcggcaagaagugccuggacuuccggaaggccucccugagcaccuga

SEQ ID NO: 29729 - RNA, 15267 nt, Artificial Sequence
  derived and/or modified sequence opt1 from EPPK1__Homo_sapiens__XP_011515627
augagcggccacacccugcccccgcuccccgugcccgggaccaacuccacggagcaggcgagcgugccccgggccauggcggccacccugggcgccgggaccccgccccggccccaggcccgguccaucgccggcguguacguggaggcgagcgggcaggcccaguccguguacgccgccauggagcagggccugcuccccgcgggccuggggcaggcccugcucgaggcccaggccgccaccggcgggcugguggaccuggcgcggggccagcuccugccggugagcaaggcccugcagcaggggcucgugggccuggagcugaaggagaagcuccuggccgccgagcgggccacgaccggcuaccccgaccccuacgggggcgagaagcuggcccuguuccaggccaucgggaaggaggugguggaccgggcccugggccaguccuggcuggaggugcagcucgccaccggcgggcugguggaccccgcccagggcgugcugguggcgccggagcccgccugccaccaggggcuccuggaccgcgagaccuggcacaagcugagcgagcucgagcccggcacgggggaccugcgguuccuggaccccaacacccucgagcgccugaccuaccaccagcugcucgagcggugcgugcgcgccccgggcuccggccuggcccugcucccccugaagaucaccuuccggagcaugggcggggccguguccgcggccgagcugcucgaggucgggauccuggacgagcaggccgugcagggccugcgcgaggggcggcucgccgcgguggacgucagcgcccgcgccgaggugcggcgcuaccuggagggcacgggcuccguggccggggucgugcugcuccccgagggccacaagaaguccuucuuccaggccgcgaccgagcaccuccugcccauggggaccgcccucccgcugcuggaggcccaggccgccacccacacgcugguggaccccaucaccggccagcggcucugggucgacgaggcggugcgcgccgggcuggucucccccgagcugcacgagcagcuccugguggccgagcaggccgugaccggccaccacgaccccuucagcggcucccagaucccgcuguuccaggccaugaagaaggggcucgucgaccggccccuggcgcugcgccuccuggacgcccagcuggccaccggcgggcucgugugccccgcccggcgccugcgccugccccucgaggcggcccugcggugcggcugccuggacgaggacacgcagcgccagcucagccaggccggcuccuucagcgacgggacccacggcgggcugcgguacgagcagcugcucgcccugugcgugaccgacccggagaccggccuggccuuccucccccugagcgggggcccccgcggcggggagccgcaggggccgcccuucaucaaguacuccacgcggcaggcgcugagcaccgccaccgccaccgucuccguggggaaguuccgcggccggcccgugagccucugggagcugcuguucuccgaggccaucagcuccgagcagcgcgccaugcucgcgcagcaguaccaggaggggacgcugagcgucgagaagcuggccgccaagcucuccgccacccuggagcaggccgcggccaccgcccgggugaccuucagcggccugcgcgacacggugaccccgggcgagcuccugaaggccgagaucaucgaccaggaccuguacgagcggcucgagcacgggcaggcgaccgccaaggacgucggcucccuggccagcgugcagcgcuaccugcaggggaccggcugcaucgccgggcuccugcugcccggcucccaggagcggcucagcaucuacgaggcccgcugcaagggccugcugcggcccgggacggcgcucauccugcuggaggcccaggccgccaccggcuucaucaucgaccccaaggccaacaaggggcacuccguggaggaggcgcuccgcgccgccgucaucggcccggacguguucgccaagcugcugagcgccgagcgggcggugaccggguacaccgaccccuacaccggccagcagaucucccucuuccaggccaugcagaagggccugaucguccgcgagcacgggauccggcugcucgaggcccagaucgccacgggcggggugaucgaccccgugcacagccaccgcguccccguggacguggccuaccgccggggcuacuucgaccagaugcugaaccugauccuccuggacccguccgacgacaccaagggcuucuucgaccccaacacccacgagaaccugaccuaccuccagcugcuggagcgcugcguccgggaccccgagacggggcucuaccugcugccccucagcagcacccaguccccgcugguggacagcgcgacccagcaggccuuccagaaccugcuccuguccgugaaguacggccgcuuccaggggcagcgggucagcgccugggagcugaucaacuccgaguacuucagcgagggccgccggcgccagcuccugcggcgcuaccggcagcgcgaggugacccugggccagguggccaagcuccuggaggcggagacgcagcggcaggccgacaucaugcugcccgcccuccgcucccgggucaccgugcaccagcugcuggaggccggcaucaucgaccagcagcuccuggaccaggugcuggccggcaccaucagccccgaggcgcuccugcugauggacgggguccgccgguaccucugcggccugggggccgugggcggggugcgccugcuccccuccggccagcggcugagccuguaccaggccaugcgccagaagcugcucggcccgcgggucgcccuggcccugcucgaggcgcaggccgccaccgggacgaucauggacccccacucccccgagagccuguccguggacgaggccgugcgccgcggcgucguggggcccgagcuguacggccggcucaagcgcgccgagggggcgaucgccggcuuccgggacccguucagcggcaagcaggucuccgucuuccaggccaugaagaaggggcugauccccugggagcaggccgcgcgccugcucgaggcccagguggccaccggcgggaucaucgaccccaccagccaccaccaccuccccaugcccguggccauccagcggggcuacgucgaccaggagauggagaccgcccuguccagcagcuccgagacguuccccacccccgacggccaggggcgcaccagcuacgcgcagcugcuggaggagugcccgcgggacgagaccuccggccugcaccuccugccccugcccgagagcgcccccgcccucccgacggaggagcagguccagcgcucccugcaggccgugcccggggccaaggacggcaccagccugugggaccuccuguccagcugccacuucaccgaggagcagcggcgcgggcugcucgaggacguccaggagggccggaccacggugccccagcugcuggcguccgugcagcgcuggguccaggagaccaagcuccuggcccaggcccgggugaugguccccggcccgcgcggggaggugcccgccguguggcugcucgacgccggcaucaucacccaggagacccuggaggcgcuggcccaggggacgcagagccccgcccaggucgccgagcagcccgcggugaaggccugccucuggggcaccgggugcguggccggcguccugcugcagccguccggcgccaaggccagcaucgcgcaggccgugcgggacgggcuccugcccaccggccuggggcagcgccuccuggaggcccagguggccuccggcuuccuggucgacccccucaacaaccagcggcugagcguggaggacgccgugaaggucgggcuggugggccgcgagcucuccgagcagcugggccaggcggagcgggccgccgccggguaccccgacccguacagccgcgccucccugagccucuggcaggcgauggagaagggccuggugccccagaacgaggggcugccccuccugcagguccagcuggccaccggcggggugguggaccccguccacggcgugcaccucccgcaggccgccgccugccgccugggccugcucgacacgcagaccucccaggugcugaccgcggucgacaaggacaacaaguucuucuucgaccccagcgcccgggaccaggugaccuaccagcagcugcgcgagcggugcgugugcgacagcgagacggggcuccugcugcucccccugcccuccgacaccguccuggagguggacgaccacaccgccguggcccuccgcgcgaugaaggucccggugagcaccggccgguucaaggggugcuccgugagccugugggaccugcuccuguccgaguacgucggcgccgacaagcgccgggagcugguggcccucugccgcagcggccgggccgccgcgcugcgccagguggucuccgccgugaccacgcugguggaggccgccgagcggcagccccuccaggccaccuuccgcgggcugcggaagcaggucagcgcgcgcgaccuguuccgggcccagcucaucucccgcaagacccuggacgagcugagccagggcaccacgaccgugaaggagguggccgagauggacuccgucaagcggagccucgagggcgggaacuucaucgccggggugcugauccagggcacccaggagcgcauguccauccccgaggcccugcggcgccacauccuccggccgggcaccgcgcuggugcugcucgaggcccaggccgccacgggguucaucaucgaccccgucgagaaccgcaagcugaccguggaggaggcguucaaggccggcauguucgggaaggagaccuacgugaagcugcucagcgccgagcgcgccgucaccggcuacacggaccccuacaccgggcagcagaucucccuguuccaggccaugcagaaggaccugaucgugcgggagcacggcauccgccuccuggaggcgcagaucgccaccggcgggaucaucgaccccgugcacagccaccgggucccgguggacguggccuaccgcugcggcuacuucgacgaggagaugaaccggauccuggccgaccccuccgacgacaccaagggguucuucgaccccaacacgcacgagaaccucaccuaccugcagcugcucgagcgcugcgucgaggaccccgagaccggccuguaccugcugcagaucaucaagaagggggagaacuacguguacaucaacgaggccacccggcacguccuccagagccgcacggcgaagaugcgggugggccgcuucgccgaccagguggucuccuucugggaccugcugagcagcccguacuucaccgaggaccggaagcgcgagcucauccaggaguacggcgcccaguccgggggccuggagaagcugcucgagaucaucaccaccacgaucgaggagaccgagacccagaaccaggggaucaagguggccgccauccggggcgaggugaccgcggccgaccuguucaacagccgcgucaucgaccagaagacgcugcacacccuccggguggggcgcaccggcggccaggcccuguccacccuggagugcgugaagcccuaccucgaggggagcggcugcaucgccggggucacggugcccuccacccgggaggugaugagccugcacgaggcgucccgcaaggagcugauccccgccgccuucgccaccuggcuccuggaggcccaggcggccaccggcuuccugcucgacccgugcacgcggcagaagcugagcgucgacgaggccguggacgugggccuggucaacgaggagcuccgcgagcgccugcugaaggccgagcgggccgcgaccggguaccgcgaccccgccaccggcgacaccaucccccucuuccaggccaugcagaagcagcugaucgagaaggccgaggcccugcggcuccuggagguccagguggcgaccgggggcgucaucgacccccagcaccaccaccgccugccgcucgagacggccuaccggcgcgggugccugcacaaggacaucuacgcccugaucuccgaccagaagcacaugcggaagcgcuucguggaccccaacacccaggagaaggugagcuaccgggagcuccaggagcgcugccggccccaggaggacaccggcuggcugcuguuccccgucaacaaggccgcccgcgacuccgagcacaucgacgacgagacccggcgcgcgcucgaggccgagcaggucgagaucacggugggccgguuccgcgggcagaagccgacccugugggcccugcucaacagcgaguacgucaccgaggagaagaagcugcagcuggugcggauguaccgcacccacacgcggcgcgcccuccagaccguggcgcagcugauccuggagcucaucgagaagcaggagaccuccaacaagcaccugugguuccagggcauccggcgccagaucaccgccagcgagcugcucuccagcgccaucaucacggaggagaugcugcaggaccuggagaccgggcgcuccaccacccaggagcucauggaggacgaccgggucaagcgcuaccuggagggcacgagcugcaucgccggggugcuggugcccgccaaggaccagcccggccggcaggagaagauguccaucuaccaggcgauguggaagggcguccuccgccccgggaccgcccuggugcugcucgaggcccaggccgccaccggcuucgugaucgacccgguccggaaccugcgccugagcguggaggaggcgguggccgccggggucgugggcggggagauccaggagaagcuccugagcgccgagcgggccgugaccggcuacacggaccccuacaccggccagcagaucucccuguuccaggcgaugcagaaggaccucaucguccgcgagcacgggauccggcugcuggaggcccagaucgccaccggcggggugaucgaccccgugcacagccaccgcguccccguggacguggccuaccggcgcggcuacuucgacgaggagaugaaccggguccucgcggacccguccgacgacaccaagggcuucuucgaccccaacacgcacgagaaccugaccuacgugcagcugcuccgccggugcgugcccgacccggacaccgggcuguacaugcugcagcucgccggccgcgggagcgccguccaccagcuguccgaggagcugcggugcgcccuccgcgacgcccgggugacccccggcagcggggcgcugcagggccaguccgugagcgucugggagcuccuguucuaccgcgagguguccgaggaccgccggcaggaccugcugagccgcuaccgggccggcacgcucaccgucgaggagcugggggccacccugaccucccuccuggcccaggcccaggcgcaggcccgcgccgaggccgaggccggcagcccccggcccgacccgcgcgaggcgcugcgggccgccacgauggaggugaagguggggcgccuccggggccgcgccguccccgugugggacgugcuggccuccggguacgucagccgggcggcccgcgaggagcugcucgccgaguucggcuccggcacccuggaccugcccgcccucacccggcgccugaccgcgaucaucgaggaggccgaggaggcccccggggcccggccgcagcugcaggacgccuggcgcggcccccgggagcccgggcccgcgggccgcggggacggcgacagcggccggucccagcgcgaggggcagggcgagggggagacgcaggaggccgccgccgccgcggccgccgccgccgcgcggcgccaggagcagacccuccgcgacgccaccauggaggugcagcggggccaguuccaggggcgcccggugagcgucugggacgugcuguucuccagcuaccugagcgaggcccggcgcgacgagcugcucgcccagcacgcggccggcgcccugggccugcccgaccucguggccguccugacccgggugaucgaggagacggaggagcgccuguccaaggugagcuuccgggggcuccgccggcaggucuccgccagcgagcugcacaccuccggcauccuggggcccgagacccuccgcgaccuggcgcagggcaccaagacccugcaggaggugacggagauggacagcgugaagcgguaccucgagggcaccuccugcaucgccgggguccuggugcccgccaaggaccagccgggccgccaggagaagaugagcaucuaccaggccauguggaagggggugcugcggcccggcaccgcccucguccugcuggaggcgcaggccgccaccggguucgugaucgaccccgugcgcaaccuccggcuguccgucgaggaggccguggccgcgggcguggucggcggggagauccaggagaagcugcucagcgccgagcgcgccgugacgggcuacaccgaccccuacaccgggcagcagaucucccuguuccaggccaugcagaaggaccugaucgugcgggagcacggcauccgccuccuggaggcgcagaucgccaccgggggcgucaucgacccggugcacagccaccgggugcccgucgacguggccuaccagcgcggcuacuucgacgaggagaugaaccgcgugcuggccgaccccuccgacgacacgaagggguucuucgaccccaacacccacgagaaccucaccuacguccagcugcugcggcgcugcgugccggaccccgacaccggccucuacaugcugcagcuggccgggcggggcagcgcggugcaccagcucuccgaggagcugcgcugcgcccugcgggacgcccgcgucacgcccgggagcggcgcccuccagggccaguccgugagcgugugggagcugcuguucuaccgggaggucuccgaggaccgccggcaggaccuccugagccgcuaccgggccgggacccugaccguggaggagcucggcgcgacccugacgagccugcucgcccaggcccaggcccaggcccgcgcggaggccgaggccggguccccgcggcccgacccccgcgaggcccugcgggccgcgaccauggaggugaaggucggccgccugcggggccgcgccgugcccgugugggacguccucgccagcggguacgugucccgggccgcgcgcgaggagcugcuggccgaguucggcagcgggacccucgaccugccggcccugacccggcgccucacggccaucaucgaggaggccgaggaggcgcccggcgcccgcccccagcugcaggacgccuggcgggggccccgcgagccgggccccgccggccgcggggacggcgacuccgggcgcagccagcgggagggccagggggagggcgagacccaggaggccgcggccgccgcccgccggcaggagcagacccugcgcgacgccaccauggaggugcagcggggccaguuccaggggcgccccgucuccgugugggacguccucuucagcuccuaccugagcgaggcgcggcgcgacgagcugcucgcccagcacgccgccggcgcgcuggggcugcccgaccucguggccgugcugacgcgggucaucgaggagaccgaggagcgccuguccaaggugagcuuccggggccuccgcugccagguguccgccagcgagcugcacaccuccgggauccugggcccggagacccuccgggaccuggcccagggcacgaagacccugcaggaggucaccgagauggacagcgugaagcgcuaccucgaggggaccuccugcaucgccggcgugcugguccccgcgaaggaccagcccgggcggcaggagaagaugagcaucuaccaggccauguggaagggcgugcugcgccccgggacggcccucgugcugcuggaggcccaggccgcgaccggcuucgucaucgacccggugcgcaaccuccggcugagcguggaggaggccgucgccgccggcguggucgggggcgagauccaggagaagcugcucuccgccgagcgcgcggucaccggguacaccgaccccuacacgggccagcagaucagccuguuccaggccaugcagaaggaccugaucgugcgggagcacggcauccgccuccuggaggcccagaucgccaccgggggcgugaucgaccccguccacucccaccgggugcccguggacgucgcguaccgccggggguacuucgacgaggagaugaaccgcgugcuggccgacccgagcgacgacaccaagggcuucuucgaccccaacacccacgagaaccucaccuacgugcagcugcugcggcgcugcguccccgaccccgacacggggcucuacaugcugcagcuggccggccggggcuccgccgugcaccagcucagcgaggagcugcgcugcgcccugcgggacgcgcgcgugaccccgggguccggcgcccugcaggggcagagcgucuccgugugggagcuccuguucuaccgggaggugagcgaggaccgccggcaggaccugcucucccgcuaccgggccggcacccugaccgucgaggagcugggggccacgcucaccagccugcuggcccaggcgcaggcccaggcccgcgccgaggccgaggcgggcagcccccggcccgacccccgcgaggcccuccgcgccgccaccauggaggugaaggugggccggcugcgcgggcgggccgucccggugugggacgugcuggcgagcggcuacgucucccgcgccgcccgggaggagcuccuggccgaguucgggagcggcacccuggaccuccccgcgcugacgcgccggcugaccgccaucaucgaggaggccgaggaggcccccggggcccgcccgcagcuccaggacgcguggcggggcccccgcgagcccggccccgccgggcggggcgacggggacuccggccgcagccagcgggagggccagggggagggcgagacccaggaggccgccgccgcgaccgccgccgcccgccggcaggagcagacgcugcgcgacgccaccauggaggugcagcgggggcaguuccagggccgcccgguguccgucugggacgugcuguucagcagcuaccucuccgaggcgcggcgcgacgagcugcuggcccagcacgccgccggggcgcucggccugcccgaccugguggccguccucacccgcgugaucgaggagaccgaggagcggcugagcaagguguccuuccgcggccugcggcgccaggucagcgccuccgagcuccacacgagcgggauccugggccccgagacccugcgggaccucgcccaggggaccaagacccugcaggaggugacggagauggacuccgugaagcgcuaccuggagggcaccagcugcaucgccgggguccucgugcccgcgaaggaccagccgggccggcaggagaagauguccaucuaccaggccauguggaagggcguccugcgccccgggaccgcccuggugcuccuggaggcccaggccgcgaccggcuucgugaucgaccccguccggaaccugcgccucagcguggaggaggccguggccgccggggucgugggcggggagauccaggagaagcugcuguccgccgagcgggcggugacgggcuacaccgaccccuacaccggccagcagaucagccucuuccaggccaugcagaaggaccugaucguccgcgagcacgggauccggcugcucgaggcccagaucgccaccggcggggugaucgacccggugcacucccaccgcguccccguggacguggccuaccggcgcggcuacuucgacgaggagaugaaccggguccuggcggaccccagcgacgacacgaagggguucuucgaccccaacacccacgagaaccugaccuacgugcagcuccugcgccggugcgugccggaccccgacaccggccuguacaugcuccagcuggccggccgcggguccgccguccaccagcugagcgaggagcuccggugcgcccugcgcgacgcgcgcgugacgcccggcuccggggcccugcagggccagagcguguccgucugggagcuccuguucuaccgggaggugagcgaggaccgccggcaggaccugcucagccgcuaccgggccggcacccugaccguggaggagcugggggccacccucacgucccugcuggcccaggcgcaggcccaggcccgcgccgaggccgaggcgggcagcccccggccggacccccgcgaggcccuccgggccgccaccauggaggucaagguggggcgccugcggggccgcgccgugcccgucugggacgugcuggcguccggguacgugagccgggccgcccgcgaggagcuccuggccgaguucggcuccggcacccuggaccuccccgcgcugacccggcgccugaccgccaucaucgaggaggccgaggaggccccgggggcccggccccagcuccaggacgcguggcgcggcccccgggagcccgggccggccggccgcggggacggcgacagcggccgcucccagcgggaggggcagggcgagggggagacgcaggaggccgccgccgcgaccgccgccgcccgccggcaggagcagacccugcgcgacgccaccauggagguccagcggggccaguuccaggggcgccccgugagcgugugggacguccuguucuccagcuaccucuccgaggcgcggcgcgacgagcugcuggcccagcacgccgccggcgcgcucggccugcccgaccugguggccgugcucacgcgggucaucgaggagaccgaggagcgccugagcaagguguccuuccgggggcugcgccgccaggugagcgccuccgagcuccacaccagcggcauccuggggccggagacccugcgcgaccucgcccagggcacgaagacccugcaggaggucaccgagauggacuccgugaagcgguaccuggaggggaccagcugcaucgccggcgugcucguccccgcgaaggaccagcccggccaccaggagaagauguccaucuaccaggccauguggaagggggugcugcgccccggcacggcccuggugcugcucgaggcccaggccgcgaccggguucgucaucgacccggugcggaaccugcgccugagcguggaggaggccgucgccgccggcguggugggcggggagauccaggagaagcuccugagcgccgagcgggcggucaccggcuacaccgaccccuacacggggcagcagaucucccuguuccaggccaugcagaaggaccucaucgugcgcgagcacggcauccggcugcuggaggcccagaucgccaccgggggcgucaucgaccccgugcacagccaccgcgugcccgucgacguggccuaccgccggggcuacuucgacgaggagaugaaccgcgugcucgcgcacccguccgacgacaccaagggguucuucgaccccaacacccacgagaaccugacguacguccagcugcuccggcgcugcgugcccgaccccgacaccggccuguacaugcugcagcucgccgggcggggcagcgccgugcaccagcuguccgaggagcugcgcugcgcccuccgggacgcgcgcgucaugccggggagcggcgcccugcagggccaguccgugagcgugugggagcuccuguucuaccgggaggucuccgaggaccgccggcaggaccugcugagccgcuaccgggccgggacccucaccguggaggagcugggcgccacgcugaccucccuccuggcccaggcgcaggcccaggcccgcgccgaggccgaggcggaggccgggagcccccggcccgacccccgcgaggcccugcgggccgccaccauggaggugaaggucggccgccuccgggggcgcgcggugccggugugggacguccuggccuccggcuacgugagcggcgccgcccgcgaggagcugcucgcggaguucggguccggcacccuggaccugcccgcccucacgcggcgccugaccgccaucaucgaggaggccgaggaggcccccggggcgcggccccagcugcaggacgccuggcgcggcccgcgggagcccggccccgccgggcgcggcgacggggacagcggccggucccagcgcgaggggcagggcgagggcgagacccaggaggccgccgcggccgcccggcgccaggagcagacccuccgggacgccacgauggaggugcagcgcgggcaguuccagggccggcccgucagcgugugggacgugcuguucuccagcuaccugagcgaggcccaccgcgacgagcuccuggcgcagcacgccgccggggcccugggccucccggaccuggucgcggugcugacccgggugaucgaggagaccgaggagcgccucuccaaggucagcuuccgggggcugcgccgccagguguccgccagcgagcugcacaccuccggcauccucggccccgagacgcugcgcgaccuggcccaggggaccaagacccuccaggaggugaccgagauggacagcgucaagcgguaccuggagggcaccuccugcaucgccggggugcuggugcccgccaaggaccagcccggccgccaggagaagaugagcaucuaccaggcgauguggaaggggguccuccgcccgggcacggcccuggugcugcucgaggcccaggccgccaccggcuucgugaucgaccccguccggaaccugcgccuguccguggaggaggcgguggccgccggggucgugggcggggagauccaggagaagcuccugagcgccgagcgggccgugaccggcuacaccgaccccuacacggggcagcagaucucccuguuccaggcgaugcagaaggaccucaucguccgcgagcacggcauccggcugcuggaggcccagaucgccaccggcggggugaucgacccggugcacagccaccgcguccccguggacguggccuaccggcgcggcuacuucgacgaggagaugaaccggguccucgccgaccccuccgacgacaccaagggguucuucgaccccaacacccacgagaaccugacguaccugcagcuccugcagcgcgcgacccuggacccggagaccggccuccuguuccugagccucucccugcaguga

SEQ ID NO: 29730 - RNA, 4539 nt, Artificial Sequence
  derived and/or modified sequence opt1 from EPRS__Homo_sapiens__NP_004437
auggccacccugagccucaccgugaacuccggcgacccgccccugggggcccugcucgcggucgagcacgugaaggacgacgugagcaucuccgucgaggagggcaaggagaacauccugcacgugagcgagaacgugaucuucacggacgucaacuccauccugcgcuaccucgcccggguggccaccaccgccgggcuguacggcagcaaccugauggagcacaccgagaucgaccacuggcucgaguucuccgccacgaagcugagcuccugcgacagcuucaccuccaccaucaacgagcugaaccacugccucagccugcgcaccuaccugguggggaacucccucagccuggcggaccugugcgucugggccacgcucaagggcaacgccgccuggcaggagcagcugaagcagaagaaggcgcccgugcacgugaagcggugguucggcuuccuggaggcccagcaggccuuccaguccgucgggaccaagugggacgugagcaccaccaaggcccgcguggcccccgagaagaagcaggacgucggcaaguucguggagcuccccggggcggagaugggcaaggugacgguccgguucccgcccgaggccuccggguaccugcacaucggccacgccaaggccgcccugcucaaccagcacuaccaggugaacuucaagggcaagcugaucaugcgcuucgacgacaccaaccccgagaaggagaaggaggacuucgagaaggugauccuggaggacgucgcgaugcuccacaucaagcccgaccaguucaccuacaccagcgaccacuucgagacgaucaugaaguacgccgagaagcugauccaggaggggaaggccuacguggacgacaccccggccgagcagaugaaggccgagcgggagcagcgcaucgacuccaagcaccggaagaaccccaucgagaagaaccugcagaugugggaggagaugaagaagggcagccaguucgggcagagcugcugccuccgcgcgaagaucgacauguccagcaacaacggcugcaugcgggaccccacccuguaccgcugcaagauccagccccacccgcggaccggcaacaaguacaacguguaccccacguacgacuucgccugccccaucgucgacuccaucgagggggugacccacgcccugcgcaccaccgaguaccacgaccgggacgagcaguucuacuggaucaucgaggcccucggcauccgcaagcccuacaucugggaguacagccggcugaaccugaacaacacgguccucuccaagcgcaagcugaccugguucgugaacgaggggcugguggacggcugggacgacccgcgguuccccaccguccgcggggugcuccggcgcggcaugaccguggagggccugaagcaguucaucgccgcgcaggggagcucccgcagcgucgugaacauggagugggacaagaucugggccuucaacaagaaggugaucgaccccgucgcgccccgguacguggcccugcucaagaaggaggugaucccggucaacgugcccgaggcccaggaggagaugaaggagguggccaagcaccccaagaaccccgaggucggccugaagccggugugguacucccccaagguguucaucgagggggccgacgccgagacguucagcgagggcgagauggucaccuucaucaacugggggaaccugaacaucaccaagauccacaagaacgccgacggcaagaucaucucccucgacgcgaagcugaaccuggagaacaaggacuacaagaagaccacgaaggugaccuggcucgccgagaccacccacgcccugcccauccccgugaucugcgucacguacgagcaccugaucaccaagccggugcugggcaaggacgaggacuucaagcaguacgugaacaagaacagcaagcacgaggagcucaugcugggggaccccugccugaaggaccucaagaagggcgacaucauccagcugcagcgccggggguucuucaucugcgaccagcccuacgagccggucucccccuacagcugcaaggaggcccccugcgugcugaucuacauccccgacggccacaccaaggagaugccgaccuccgggagcaaggagaagaccaagguggaggccacgaagaacgagaccuccgcgcccuucaaggagcgccccacccccagccucaacaacaacugcaccacguccgaggacagccugguccuguacaaccggguggccgugcagggcgacgucgugcgcgagcucaaggccaagaaggccccgaaggaggacguggacgccgcggucaagcagcugcugagccucaaggccgaguacaaggagaagaccggccaggaguacaagcccgggaacccgcccgccgagaucggccagaacaucuccagcaacuccagcgccuccauccuggagagcaagucccuguacgacgagguggcggcccagggggaggugguccggaagcucaaggccgagaagucccccaaggccaagaucaacgaggccguggagugccugcugagccucaaggcgcaguacaaggagaagaccggcaaggaguacauccccggccagccgccccugagccaguccagcgacuccagccccacccgcaacuccgagcccgccgggcuggagacgcccgaggccaagguccucuucgacaagguggccagccagggcgagguggugcggaagcugaagaccgagaaggcccccaaggaccaggucgacaucgcggugcaggagcugcuccagcugaaggcccaguacaagucccugaucgggguggaguacaagccggucagcgccaccggcgccgaggacaaggacaagaagaagaaggagaaggagaacaagagcgagaagcagaacaagccccagaagcagaacgacgggcagcgcaaggaccccuccaagaaccagggcggcgggcucagcuccagcggcgccggggagggccaggggcccaagaagcagacccggcugggccuggaggcgaagaaggaggagaaccucgccgacugguacucccaggugaucaccaagagcgagaugaucgaguaccacgacaucuccggcugcuacauccugcgcccgugggccuacgccaucugggaggcgaucaaggacuucuucgacgccgagaucaagaagcuggggguggagaacugcuacuuccccauguucgucagccaguccgcccucgagaaggagaagacgcacguggccgacuucgcccccgagguggcgugggucacccggagcggcaagaccgagcuggccgagccgaucgccauccgccccacguccgagaccgugauguaccccgccuacgccaaguggguccagagccaccgggaccugcccaucaagcucaaccaguggugcaacguggugcgcugggaguucaagcacccgcagcccuuccugcggacccgcgaguuccuguggcaggaggggcacuccgcguucgccaccauggaggaggccgccgaggagguccuccagauccuggaccuguacgcccagguguacgaggagcuccuggcgauccccguggucaagggccggaagacggagaaggagaaguucgccgggggcgacuacaccaccaccaucgaggccuucaucagcgccuccggccgcgccauccagggcgggacgagccaccaccuggggcagaacuucuccaagauguucgagaucguguucgaggaccccaagaucccgggcgagaagcaguucgcguaccagaacagcugggggcucaccacccgcaccaucggcgugaugacgaugguccacggcgacaacauggggcuggugcugccgccccggguggccugcguccagguggugaucauccccugcggcaucaccaacgcccucuccgaggaggacaaggaggcccugaucgcgaagugcaacgacuaccgccggcgccugcucagcgucaacauccgggugcgcgccgaccugcgggacaacuacagccccggguggaaguucaaccacugggagcugaagggcgugcccauccgccucgaggucggcccccgggacaugaaguccugccaguucguggccgugcgccgggacaccggggagaagcugaccgucgccgagaacgaggccgagacgaagcugcaggcgauccucgaggacauccaggugacccuguucacccgcgccagcgaggaccugaagacccacaugguggucgccaacacgauggaggacuuccagaagauccucgacuccggcaagaucgugcagauccccuucugcggggagaucgacugcgaggacuggaucaagaagaccaccgcccgggaccaggaccuggagccgggcgcccccagcaugggggcgaagucccugugcauccccuucaagccccucugcgagcugcagccgggcgccaagugcgugugcggcaagaaccccgccaaguacuacacccuguucgggcgcagcuacuga

SEQ ID NO: 29731 - RNA, 2733 nt, Artificial Sequence
  derived and/or modified sequence opt1 from EPS15L1__Homo_sapiens__NP_001245303
auggccgcgccccugaucccgcucagccagcagauccccaccggcaacucccuguacgagagcuacuacaagcaggucgaccccgccuacaccgggcgcgucggcgccuccgaggccgcccuguuccucaagaaguccgggcuguccgacaucauccugggcaagaucugggaccucgccgaccccgaggggaagggcuuccuggacaagcagggcuucuacguggcgcugcggcucguggccugcgcccagagcgggcacgaggucacgcuguccaaccugaaccucagcaugccgccgcccaaguuccacgacaccuccagcccccugauggugaccccgcccuccgccgaggcgcacugggccgugcgcgucgaggagaaggccaaguucgacggcaucuucgagagccugcuccccaucaacgggcugcuguccggcgacaaggugaagcccgugcucaugaacagcaagcugccgcuggacguccucgggcgggugugggaccuguccgacaucgacaaggacggccaccuggaccgcgacgaguucgccguggccaugcaccucgucuaccgggcgcuggagaaggagcccgugcccagcgcccugcccccgucccucaucccgcccagcaagcgcaagaagaccguguuccccggcgccguccccgugcugcccgccuccccgccgcccaaggacagccugcggagcacgcccucccacgggagcguguccagccucaacuccaccggcagccugucccccaagcacagccugaagcagacccagcccaccgucaacuggguggugcccgucgccgacaagaugcgcuucgacgagaucuuccucaagacggaccuggaccuggacggguacguguccggccaggaggugaaggagaucuucaugcacagcggccucacccagaaccugcuggcgcacaucugggcccucgccgacacccggcagaccgggaagcugagcaaggaccaguucgcccuggccauguacuucauccagcagaaggugagcaagggcaucgacccgccccaggugcucucccccgacauggucccgcccagcgagcgcgggacgcccggccccgacuccagcgggucccugggcagcggcgaguucaccggggugaaggagcuggacgacaucucccaggagaucgcgcagcuccagcgggagaaguacagccuggagcaggacauccgcgagaaggaggaggccauccggcagaagaccagcgaggugcaggagcugcagaacgaccucgaccgcgagaccuccagccugcaggagcuggaggcccagaagcaggacgcccaggaccggcuggacgagauggaccagcagaaggccaagcuccgcgacaugcuguccgacguccggcagaagugccaggacgagacgcagaugaucagcucccugaagacccagauccagagccaggaguccgaccucaagagccaggaggacgaccugaaccgcgcgaaguccgagcugaaccggcuccagcaggaggagacccagcuggagcagagcauccaggccggccgcgugcagcuggagaccaucaucaagucccucaagagcacgcaggacgagaucaaccaggcccgguccaagcugagccagcugcacgagucccgccaggaggcccaccgcagccucgagcaguacgaccaggugcuggacggggcgcacggcgccucccugaccgaccucgccaaccugagcgagggggucagccuggccgagcggggcuccuucggcgccauggacgaccccuucaagaacaaggcgcuccuguucagcaacaacacccaggagcugcaccccgaccccuuccagaccgaggaccccuucaaguccgaccccuucaagggggccgaccccuucaagggcgaccccuuccagaacgacccguucgccgagcagcagacgaccagcaccgaccccuucgggggcgaccccuucaaggaguccgaccccuuccgcgggagcgccaccgacgacuucuucaagaagcagacgaagaacgacccguucaccuccgaccccuucaccaagaaccccagccuccccuccaagcuggacccguucgagagcuccgaccccuucagcuccagcuccgugagcuccaagggcagcgaccccuucggcacccuggaccccuucggguccggcagcuucaacagcgccgagggguucgcggacuucucccagaugagcaagccgccgcccuccggccccuucacgagcucccucggcggggccggcuucagcgacgaccccuucaaguccaagcaggacacccccgcccugcccccgaagaagcccgccccgccccggcccaagccgcccagcgggaaguccacccccgugagccagcugggcuccgccgacuuccccgaggcgcccgaccccuuccagccccucggggccgacagcggcgacccguuccaguccaagaagggcuucggggaccccuucagcggcaaggaccccuucguccccuccagcgccgccaagccguccaaggcgagcgccuccggguucgccgacuucaccagcuucggcaacgaggagcagcagcuggccugggccaagcgcgagagcgagaaggcggagcaggagcggcuggcccgccuccggcgccaggagcaggaggaccuggagcuggccaucgcccucuccaaggccgacaugcccgcggccuga

SEQ ID NO: 29732 - RNA, 2502 nt, Artificial Sequence
  derived and/or modified sequence opt1 from EPS8__Homo_sapiens__XP_005253396
augagcaaccugaacacccaggugaaggacaccaugaacggccacaucuccaaccaccccagcuccuucgggauguacccgagccagaugaacggcuacggguccagccccacguucucccagaccgaccgcgagcacggcagcaagaccuccgccaaggcccucuacgagcagcggaagaacuacgcgcgcgacagcgucuccagcguguccgacaucagccaguaccggguggagcaccugaccacguucguccuggaccgcaaggacgccaugaucaccguggacgacgggauccggaagcucaagcugcuggacgccaagggcaagguguggacccaggacaugauccuccaggucgacgaccgcgccgugucccugaucgaccuggagagcaagaacgagcucgagaacuucccccugaacaccauccagcacugccaggccgugaugcacuccugcagcuacgacuccguccuggcgcucgugugcaaggagcccacgcagaacaagccggaccugcaccuguuccagugcgacgaggugaaggccaaccucaucagcgaggacaucgagagcgccaucuccgacagcaagggcgggaagcagaagcggcgccccgacgcccugcggaugaucuccaacgcggaccccagcaucccgcccccgccccgcgcccccgcccccgccccgcccggcaccgucacccagguggacgugcggucccgcgucgccgcguggagcgccugggccgccgaccagggggacuucgagaagccccggcaguaccacgagcaggaggagacccccgagaugauggccgcgcgcaucgaccgggacgugcagauccugaaccacauccucgacgacaucgaguucuucaucacgaagcugcagaaggccgccgaggccuucuccgagcugagcaagcgcaagaagaacaagaagggcaagcggaaggggcccggcgagggcgugcucacccugcgcgccaagccgccgccgcccgacgaguuccuggacugcuuccagaaguucaagcacggguucaaccuccuggcgaagcugaagucccacauccagaaccccagcgccgccgaccucguccacuuccuguucacgccccugaacaugguggugcaggccaccggcgggcccgagcucgccuccagcguccugagcccccugcucaacaaggacaccaucgacuuccugaacuacaccgugaacggcgacgagcggcagcuguggaugucccucggcgggaccuggaugaaggcgcgcgccgaguggcccaaggagcaguucaucccgcccuacgugccccgguuccgcaacggcugggagccgcccaugcugaacuucaugggggccaccauggagcaggaccuguaccagcucgccgaguccgucgcgaacguggccgagcaccagcgcaagcaggagaucaagcggcugagcacggagcacuccagcgucuccgaguaccaccccgccgacggcuacgccuucagcagcaacaucuacacccgcgggucccaccuggaccagggcgaggccgcgguggccuucaagcccaccagcaaccggcacaucgaccgcaacuacgagccccucaagacccagcccaagaaguacgccaaguccaaguacgacuucguggcccggaacaacagcgagcuguccguccugaaggacgacauccucgagauccuggacgaccgcaagcagugguggaaggugcggaacgccagcggcgacuccggguucgugcccaacaacauccuggacaucguccgcccgcccgagagcggccucgggcgggcggacccgcccuacacgcacaccauccagaagcagcgcauggaguacggcccccggcccgccgacaccccgcccgcccccagcccgccgcccacccccgcccccgugcccgugccccugccgcccuccacgcccgcccccguccccguguccaaggugcccgcgaacaucacccgccagaacagcuccagcuccgacagcgggggcuccaucguccgggacagccagcgccacaagcagcugcccguggaccggcgcaagagccagauggaggaggugcaggacgagcugauccaccggcucaccaucggccgcuccgccgcccagaagaaguuccacgucccccggcagaacgugcccgugaucaacaucaccuacgacagcacgccggaggacgucaagaccuggcugcaguccaagggguucaaccccgugaccgugaacagccugggcguccucaacggggcccagcuguucucccugaacaaggacgagcuccgcaccgugugccccgagggcgcgcgcguguacagccagaucacgguccagaaggccgcccuggaggacuccagcggguccagcgagcugcaggagaucaugcggcgccggcaggagaagaucuccgccgccgcgagcgacuccggcguggagagcuucgacgagggcuccagccacuga

SEQ ID NO: 29733 - RNA, 2148 nt, Artificial Sequence
  derived and/or modified sequence opt1 from EPS8L2__Homo_sapiens__NP_073609
augagccaguccggcgccgugagcugcugccccggggccaccaacggcucccuggggcgcagcgacggcgucgcgaagauguccccgaaggaccucuucgagcagcggaagaaguacagcaacuccaacgugaucaugcacgagaccagccaguaccacgugcagcaccuggccacguucaucauggacaaguccgaggccaucaccagcgucgacgacgccauccgcaagcuggugcagcucuccagcaaggagaagaucuggacccaggagaugcugcuccaggugaacgaccagucccuccggcugcuggacaucgagagccaggaggagcucgaggacuucccccugcccaccguccagcgcucccagacggugcugaaccagcuccgguaccccagcgugcugcugcucgucugccaggacuccgagcagagcaagccggacgugcacuucuuccacugcgacgagguggaggccgagcugguccacgaggacaucgaguccgcgcuggccgacugccgccucgggaagaagaugcggccccagacccugaagggccaccaggagaagauccgccagcggcagagcauccugccgccgccccagggccccgcccccauccccuuccagcaccgcgggggcgacagccccgaggccaagaaccggguggggccccaggugccccucuccgagcccggcuuccgccggcgcgagagccaggaggagccgcgggcgguccuggcccagaagaucgagaaggagacccagauccugaacugcgcccucgacgacaucgagugguucguggcccgccugcagaaggccgcggaggccuucaagcagcugaaccagcggaagaaggggaagaagaagggcaagaaggcccccgccgagggcgugcucacccugcgcgcccggccgcccuccgagggggaguucaucgacugcuuccagaagaucaagcuggcgaucaaccuccuggccaagcugcagaagcacauccagaaccccagcgccgccgagcucguccacuuccuguucggcccccuggaccucaucgugaacacgugcuccgggcccgacaucgcccgcagcguguccugcccccugcugagccgggacgcggucgacuuccuccgcggccaccuggugccgaaggagaugucccugugggagagccucggcgaguccuggaugcgcccccggagcgaguggccccgcgagccccaggugccgcuguacguccccaaguuccacuccgggugggagcccccgguggacguccugcaggaggcccccugggagguggagggccucgccagcgcccccaucgaggaggugucccccgucagccggcaguccauccgcaacagccagaagcacuccccgaccagcgagcccaccccgcccggggacgcccugccgcccgugagcagcccccacacccaccggggcuaccagcccacgcccgcgauggccaaguacgugaagauccuguacgacuucaccgcccgcaacgccaacgagcucuccguccugaaggacgaggugcuggaggugcuggaggacgggcggcagugguggaagcuccgcucccggagcggccaggcgggcuacguccccugcaacauccugggggaggcccgccccgaggacgccggcgcccccuucgagcaggccgggcagaaguacuggggcccggcgucccccacccacaagcugccgcccagcuuccccgggaacaaggacgagcucaugcagcacauggacgaggugaacgacgagcugauccggaagaucuccaacauccgcgcccagccccagcggcacuuccgcguggagcggagccagcccgucucccagccccugaccuacgagagcggcccggacgaggugcgcgccuggcucgaggccaaggccuucagcccccggaucguggagaaccugggcauccugacggggccccagcuguucucccugaacaaggaggagcugaagaaggucugcggcgaggagggggugcgcguguacucccagcucaccaugcagaaggcguuccuggagaagcagcagagcggcuccgagcuggaggagcucaugaacaaguuccacagcaugaaccagcggcgcggggaggacuccuga

SEQ ID NO: 29734 - RNA, 1233 nt, Artificial Sequence
  derived and/or modified sequence opt1 from EPSTI1__Homo_sapiens__NP_001002264
augaacacccgcaaccggguggucaacagcggccugggggccucccccgccagccgcccgacccgggacccccaggaccccuccggccgccagggggagcucagccccguggaggaccagcgggagggccuggaggcggccccgaaggggcccucccgcgagagcgugguccacgccggccagcggcgcacguccgccuacacccugaucgcccccaacaucaaccggcgcaacgagauccagcggaucgcggagcaggagcucgccaaccuggagaaguggaaggagcagaaccgcgccaagcccgugcaccuggugccgcggcgccucggcgggagccaguccgagaccgagguccggcagaagcagcagcugcagcugaugcagagcaaguacaagcagaagcucaagcgcgaggaguccgugcggaucaagaaggaggccgaggaggcggagcugcagaagaugaaggccauccagcgcgagaaguccaacaagcuggaggagaagaagcggcuccaggagaaccugcgccgggaggccuuccgcgagcaccagcaguacaagaccgccgaguuccugagcaagcucaacacggagagccccgaccgcuccgccugccagagcgcggugugcggcccccaguccagcaccuggaagcugcccauccugccgcgggaccacuccugggcccgcagcugggccuaccgggacagccucaaggccgaggagaaccgcaagcugcagaagaugaaggacgagcagcaccagaaguccgagcugcucgagcugaagcggcagcagcaggagcaggagcgcgccaagauccaccagaccgagcaccggcgcgucaacaacgcguuccuggaccggcuccaggggaagucccagcccggcgggcuggagcagagcggcggcugcuggaacaugaacagcgggaacuccuggggcagccugcucguguucucccgccaccuccggguguacgagaagauccugacccccaucuggcccagcuccacggaccuggagaagccgcacgagaugcuguuccugaacgucauccucuucagccugaccguguucacccugaucuccaccgcccacacgcucgaccgcgccgugcggagcgacuggcugcugcucguccugaucuacgccugccuggaggagcucauccccgagcugaucuucaaccuguacugccaggggaacgccacccucuucuucuga

SEQ ID NO: 29735 - RNA, 2148 nt, Artificial Sequence
  derived and/or modified sequence opt1 from EPX__Homo_sapiens__NP_000493
augcaccuccugcccgcccuggccggcgugcuggcgacccucguccuggcccagccgugcgaggggaccgaccccgccagccccggcgccguggagacguccgugcugcgcgacugcaucgccgaggcgaagcuccuggucgacgccgccuacaacuggacccagaaguccaucaagcagcggcugcgcagcgggagcgccucccccauggaccuccugagcuacuucaagcagccgguggcggccacccggaccgugguccgcgccgccgacuacaugcacguggcccugggccuccuggaggagaagcugcagccccagcgguccgggcccuucaacgugacggacguccucaccgagccccagcugcgccugcucagccaggcguccggcugcgcccugcgggaccaggccgagcgcugcagcgacaaguaccggaccaucaccggccgcugcaacaacaagcggcgcccgcugcucggggccuccaaccaggcccuggcgcgguggcugcccgccgaguacgaggacggccucagccugcccuucggguggacgcccucccgccggcgcaacggcuuccugcucccgcuggugcgggccgugagcaaccagaucguccgcuuccccaacgagcggcugaccuccgaccgcgggcgggcccucauguucaugcaguggggccaguucaucgaccacgaccuggacuucagccccgagucccccgcccgcguggcguucaccgccggcguggacugcgagcggaccugcgcccagcugccgcccugcuuccccaucaagaucccgcccaacgacccccggaucaagaaccagcgcgacugcauccccuucuuccggagcgcccccuccugcccgcagaacaagaaccgcguccggaaccagaucaacgcccucacgagcuucguggacgcgagcaugguguacggguccgaggucagccugucccugcgccuccggaaccgcaccaacuaccugggccugcucgccaucaaccagcgguuccaggacaacgggcgcgcccugcugcccuucgacaaccuccacgacgaccccugccugcugaccaaccggagcgcccgcauccccugcuuccucgcgggcgacacccgguccacggagaccccgaagcuggccgccaugcacacccuguucaugcgcgagcacaaccggcucgccaccgagcugcgccggcugaacccccgcuggaacggcgacaagcuguacaacgaggcccggaagaucaugggggcgauggugcagaucaucacguaccgcgacuuccucccccuggugcugggcaaggcccgcgcccggcgcacccucgggcacuaccggggcuacugcagcaacgucgacccgcgcguggccaacguguucacccuggccuuccgguucgggcacaccaugcugcagcccuucauguuccgccucgacucccaguaccgggcgagcgcccccaacucccacgucccccugagcuccgccuucuucgccagcuggcgcaucguguacgagggcggcaucgacccgauccugcgggggcucauggccacgcccgcgaagcugaaccgccaggacgccaugcuggucgacgagcuccgggaccgccuguuccgccaggugcgccggaucggccuggaccucgccgcccugaacaugcagcgcucccgggaccacgggcugcccggcuacaacgcguggcgccgguucugcgggcucagccagccccgcaaccuggcccagcugucccgggugcucaagaaccaggaccuggcccgcaaguuccugaaccucuacggcaccccggacaacaucgacaucuggaucggcgccaucgccgagccccugcugcccggggcgcgcgucggcccccuccuggccugccuguucgagaaccaguuccggcgcgcccgggacggggaccgcuucugguggcagaagcggggcguguucaccaagcgccagcggaaggcccucagccgcaucucccugagccggaucaucugcgacaacaccgggaucacgaccgugucccgcgacaucuuccgggccaacaucuacccgcgcggcuucgucaacugcagccggaucccccgccugaaccucagcgcguggcggggcaccuga

SEQ ID NO: 29736 - RNA, 969 nt, Artificial Sequence
  derived and/or modified sequence opt1 from EPYC__Homo_sapiens__NP_004941
augaagacccuggccggccucgugcuggggcuggucaucuucgacgccgcggugaccgcccccacgcucgagagcaucaacuacgacuccgagaccuacgacgccacccuggaggaccuggacaaccucuacaacuacgagaacaucccgguggacaaggucgagaucgagaucgccaccgugaugcccagcggcaaccgcgagcugcugacgcccccgccccagcccgagaaggcccaggaggaggaggaggaggaggaguccaccccgcggcucaucgacgggagcagcccccaggagcccgaguucaccggcgugcuggggccccacaccaacgaggacuuccccacgugccugcucugcacgugcaucuccaccaccgucuacugcgacgaccacgagcuggacgcgaucccgccccugcccaagaacaccgccuacuucuacucccgcuucaaccggaucaagaagaucaacaagaacgacuucgccagccucuccgaccugaagcgcaucgaccugaccagcaaccucaucuccgagaucgacgaggacgccuuccggaagcugccccagcugcgcgagcucgugcugcgggacaacaagauccgccagcugcccgagcucccgaccacccugacguucaucgacaucagcaacaaccggcugggccgcaagggcaucaagcaggaggcguucaaggacauguacgaccuccaccaccuguaccugaccgacaacaaccucgaccacaucccccugccccugcccgagaaccuccgggcccugcaccuccagaacaacaacauccuggagaugcacgaggacaccuucugcaacgugaagaaccugaccuacauccgcaaggcccuggaggacauccggcucgacgggaacccgaucaaccuguccaagacgccccaggccuacaugugccugccccgccuccccgucggcagccugguguga

SEQ ID NO: 29737 - RNA, 1314 nt, Artificial Sequence
  derived and/or modified sequence opt1 from ERAL1__Homo_sapiens__NP_005693
auggccgcccccagcuggcgcggcgcgcggcuggugcaguccguccuccgcguguggcaggucgggccgcacguggcccgggagcgcgugauccccuucagcucccugcugggcuuccagcggcgcugcgugagcugcgucgccggguccgccuucagcggcccccggcucgccuccgcgagccgcuccaacgggcagggcagcgcccuggaccacuuccugggcuucucccagcccgacagcuccgugaccccgugcgugcccgccgucagcaugaaccgggacgagcaggacgugcuccuggugcaccaccccgacaugcccgagaacucccgcguccugcggguggugcuccugggggccccgaacgcgggcaagagcacccuguccaaccagcuccuggggcgcaaggucuuccccgugagccggaaggugcacacgacccgcugccaggcccugggcgucaucaccgagaaggagacccaggugauccuccuggacacgcccgggaucaucucccccggcaagcagaagcggcaccaccuggagcucagccugcuggaggacccguggaaguccauggaguccgccgaccucguggucgugcugguggacgucagcgacaaguggacccgcaaccagcugagcccccagcuccugcggugccugaccaaguacagccagauccccuccgugcucgucaugaacaagguggacugccugaagcagaaguccgugcugcucgagcugaccgccgcccugacggagggcgucgugaacgggaagaagcucaagaugcgccaggcguuccacagccaccccggcacccacugcccgagccccgccgugaaggaccccaacacccaguccgucgggaacccccagcggaucggcuggccgcacuucaaggagaucuucaugcugagcgcccugucccaggaggacgugaagacccucaagcaguaccugcugacgcaggcccagcccggccccugggaguaccacagcgccgugcucaccucccagacccccgaggagaucugcgcgaacaucauccgcgagaagcugcuggagcaccucccgcaggagguccccuacaacgugcagcagaagaccgccgugugggaggaggggcccggcggggagcuggucauccagcagaagcugcucgugcccaaggagagcuacgugaagcugcugaucggcccgaaggggcacgucaucucccagaucgcccaggaggccggccacgaccucauggacaucuuccugugcgacguggacauccggcugagcgugaagcugcucaaguga

SEQ ID NO: 29738 - RNA, 2826 nt, Artificial Sequence
  derived and/or modified sequence opt1 from ERAP1__Homo_sapiens__NP_001185470
augguguuccugccccucaaguggagccuggccaccauguccuuccugcucagcucccugcuggcccuccugaccgucagcacgccguccuggugccagagcaccgaggcgucccccaagcgcagcgacggcacccccuuccccuggaacaagauccggcugccggaguacgugauccccgugcacuacgaccuccugauccacgccaaccugaccacgcucaccuucugggggaccaccaaggucgagaucacggccucccagcccaccagcaccaucauccugcacucccaccaccuccagaucagccgcgccacccugcggaagggcgccggggagcgccuguccgaggagccccuccaggugcuggagcacccgcggcaggagcagaucgcgcugcuggcccccgagccccuccuggugggccugcccuacacggucgugauccacuacgccgggaaccucagcgagaccuuccacggcuucuacaaguccaccuaccgcaccaaggagggcgagcugcggauccuggccagcacgcaguucgagccgaccgcggcccgcauggccuuccccugcuucgacgagcccgccuucaaggccuccuucagcaucaagauccggcgcgagccccggcaccucgcgaucuccaacaugccgcuggucaagagcgugaccguggccgaggggcugaucgaggaccacuucgacgugaccgucaagaugagcacguaccucguggccuucaucaucuccgacuucgagagcguguccaagaucaccaagagcggcgucaagguguccguguacgccguccccgacaagaucaaccaggccgacuacgcgcuggacgccgccgugacccugcucgaguucuacgaggacuacuucagcauccccuacccccugccgaagcaggaccuggccgccauccccgacuuccaguccggggcgauggagaacuggggccucaccacguaccgcgagagcgcccugcuguucgacgccgagaaguccagcgccuccagcaagcucgggaucaccaugaccguggcccacgagcuggcgcaccagugguucggcaaccuggucaccauggagugguggaacgaccucuggcugaacgagggcuucgccaaguucauggaguucguguccgugagcgucacgcaccccgagcugaaggugggggacuacuucuucggcaagugcuucgacgccauggaggucgacgcccucaacuccagccaccccguguccaccccgguggagaaccccgcgcagauccgggagauguucgacgacgucagcuacgacaagggggccugcauccugaacaugcugcgcgaguaccucuccgccgacgccuucaagagcggcaucgugcaguaccugcagaagcacagcuacaagaacaccaagaacgaggaccugugggacuccauggccagcaucugccccaccgacggcgugaaggggauggacggcuucugcucccggagccagcacuccagcuccagcucccacuggcaccaggagggggucgacgugaagacgaugaugaacaccuggacccugcagaagggcuucccccucaucaccaucacggugcgcgggcggaacguccacaugaagcaggagcacuacaugaagggcagcgacggcgcgccggacaccggguaccuguggcacgugccccugaccuucaucaccuccaagagcgacauggugcaccgcuuccuccugaagaccaagacggacguccugauccuccccgaggagguggaguggaucaaguucaacgugggcaugaacggguacuacaucguccacuacgaggacgacggcugggacucccugaccgggcugcucaagggcacccacaccgccgugagcuccaacgaccgggccagccugaucaacaacgccuuccagcugguguccaucggcaagcucagcaucgagaaggcccuggaccugagccucuaccugaagcacgagacggagaucaugccggucuuccaggggcugaacgagcucauccccauguacaagcugauggagaagcgcgacaugaacgagguggagacccaguucaaggcguuccugauccggcuccugcgcgaccugaucgacaagcagaccuggaccgacgagggcuccgugagcgagcgcaugcuccggucccagcugcugcuccuggccugcguccacaacuaccagcccugcgugcagcgcgccgagggguacuuccggaaguggaaggagagcaacggcaaccugucccuccccguggacgucacgcuggccguguucgccgugggggcgcagagcaccgagggcugggacuuccuguacuccaaguaccaguucagccucuccagcaccgagaagucccagaucgaguucgcccugugccgcacccagaacaaggagaagcugcaguggcuccuggacgagagcuucaagggcgacaagaucaagacgcaggaguucccgcagauccugacccucaucgggcggaaccccgucggcuacccccuggccuggcaguuccugcgcaagaacuggaacaagcucgugcagaaguucgagcugggguccagcuccaucgcccacauggugaugggcaccaccaaccaguucagcacgcggacccgccuggaggaggucaagggcuucuucuccagccucaaggagaacgggucccagcugcggugcgugcagcagaccaucgagaccaucgaggagaacaucggcuggauggacaagaacuucgacaagauccgcguguggcugcagagcgagaagcucgagcggauguga

SEQ ID NO: 29739 - RNA, 2883 nt, Artificial Sequence
  derived and/or modified sequence opt1 from ERAP2__Homo_sapiens__NP_001123612
auguuccacagcuccgccauggugaacagccaccgcaagcccauguucaacauccaccggggcuucuacugccugaccgccauccucccgcagaucugcaucugcucccaguucagcguccccuccagcuaccacuucaccgaggaccccggggcguuccccguggccacgaacggcgagcgcuucccguggcaggagcugcggcugcccuccguggucaucccccuccacuacgaccuguucgugcaccccaaccugaccagccucgacuucguggccuccgagaagaucgagguccuggugagcaacgccacccaguucaucauccugcacuccaaggaccucgagaucaccaacgccacgcugcagagcgaggaggacucccgcuacaugaagccggggaaggagcugaaggugcucagcuaccccgcgcacgagcagaucgcccugcugguccccgagaagcucacgccccaccugaaguacuacguggccauggacuuccaggccaagcugggcgacggguucgagggcuucuacaaguccaccuaccggacccucggcggggagacccgcauccuggcggugaccgacuucgagccgacccaggcccggauggccuuccccugcuucgacgagccccuguucaaggccaacuucagcaucaagauccgccgggagucccgccacaucgcccucagcaacaugcccaaggucaagaccaucgagcuggagggcgggcugcucgaggaccacuucgagacgaccgugaagauguccaccuaccugguggcguacaucgucugcgacuuccacagccugagcggcuucaccuccagcggggugaagguguccaucuacgccagcccggacaagcggaaccagacgcacuacgcccuccaggccucccugaagcugcucgacuucuacgagaaguacuucgacaucuacuacccccugagcaagcuggaccucaucgccauccccgacuucgcgcccggcgccauggagaacuggggccugaucaccuaccgcgagaccucccuccucuucgacccgaagaccagcuccgccagcgacaagcugugggucacgcgggugaucgcccacgagcuggcccaccagugguucgggaaccucgugaccauggagugguggaacgacaucuggcugaaggagggcuucgcgaaguacauggagcugaucgccgucaacgccaccuaccccgagcuccaguucgacgacuacuuccugaacgugugcuucgaggugaucaccaaggacucccugaacagcucccgccccaucagcaagcccgccgagacgccgacccagauccaggagauguucgacgaggucuccuacaacaagggggccugcauccucaacaugcugaaggacuuccugggcgaggagaaguuccagaagggcaucauccaguaccucaagaaguucagcuaccggaacgcgaagaacgacgaccugugguccagccuguccaacagcugccuggagagcgacuucaccuccgggggcgugugccacagcgaccccaagaugaccuccaacaugcucgccuuccugggggagaacgccgaggucaaggagaugaugacgaccuggacccugcagaagggcaucccccuccugguggugaagcaggacgggugcagccugcgccuccagcaggagcgguuccugcagggcgucuuccaggaggaccccgaguggcgcgcccugcaggagcgguaccucuggcacaucccgcugaccuacuccacgagcuccagcaacgugauccaccgccacauccugaaguccaagaccgacacccucgaccugcccgagaagaccagcugggugaaguucaacgucgacuccaacggcuacuacaucgugcacuacgaggggcacggcugggaccagcugaucacgcagcucaaccagaaccacacccugcugcggcccaaggaccgcguggggcucauccacgacgucuuccagcuggugggcgcggggcgccugacccucgacaaggcccuggacaugaccuacuaccugcagcacgagaccagcuccccggcccuccuggagggccugagcuaccucgaguccuucuaccacaugauggaccggcgcaacaucagcgacaucuccgagaaccugaagcgguaccugcuccaguacuucaagcccgugaucgaccgccagagcuggagcgacaagggcuccgucugggaccggaugcugcgcagcgcccugcucaagcuggccugcgaccugaaccacgcgcccugcauccagaaggccgccgagcuguucucccaguggauggagagcuccgggaagcugaacauccccacggacgugcugaagaucguguacagcgucggcgcccagaccaccgccggguggaacuaccuccuggagcaguacgagcuguccaugagcuccgcggagcagaacaagauccucuacgcccugagcaccuccaagcaccaggagaagcugcucaagcugaucgagcugggcauggaggggaaggugaucaagacgcagaaccucgccgcccugcugcacgccaucgcgcggcgcccgaagggccagcagcucgccugggacuucgugcgggagaacuggacccaccuccugaagaaguucgaccugggcagcuacgacauccgcaugaucaucuccgggaccaccgcccacuucagcuccaaggacaagcugcaggaggucaagcuguucuucgagagccucgaggcccagggcucccaccuggacaucuuccagacggugcuggagaccaucaccaagaacaucaaguggcucgagaagaaccugcccacccugcggacguggcucauggugaacaccuga

SEQ ID NO: 29740 - RNA, 702 nt, Artificial Sequence
  derived and/or modified sequence opt1 from ERAS__Homo_sapiens__NP_853510
auggagcugcccaccaagccgggcaccuucgaccucgggcuggccacguggagccccuccuuccagggcgagacccaccgcgcccaggcgcggcgccgggacguggggcgccagcugcccgaguacaaggccgucguggugggcgccagcggggucggcaaguccgcccucaccauccagcugaaccaccagugcuucguggaggaccacgaccccaccauccaggacagcuacuggaaggagcugacgcucgacuccggcgacugcauccugaacgugcuggacaccgccgggcaggcgauccaccgggcccuccgcgaccagugccuggccgucugcgacggcgugcuggggguguucgcccucgacgacccgagcucccugauccagcugcagcagaucugggcgaccuggggcccccaccccgcccagccccucguccugguggggaacaagugcgaccuggugaccacggccggcgacgcccacgccgcggccgccgcccucgcccacagcuggggcgcgcacuucgucgagaccuccgccaagacccggcaggggguggaggaggccuucagccugcuggugcacgagauccagcgcguccaggaggccauggccaaggagccgauggcgcgguccugccgcgagaagacccggcaccagaaggccacgugccacugcggcugcagcguggccuga

SEQ ID NO: 29741 - RNA, 3678 nt, Artificial Sequence
  derived and/or modified sequence opt1 from ERBB2__Homo_sapiens__NP_001005862
augaagcugcgccuccccgccagccccgagacccaccuggacaugcugcggcaccucuaccagggcugccaggugguccaggggaaccuggagcugaccuaccuccccacgaacgccucccugagcuuccugcaggacauccaggaggugcagggcuacgugcucaucgcgcacaaccagguccgccaggugccccugcagcggcugcgcaucgugcgggggacccagcuguucgaggacaacuacgcccuggccguccuggacaacggcgacccccucaacaacaccaccccggugacgggggccucccccggcggccugcgcgagcugcagcuccggagccugaccgagauccugaagggcggggugcucauccagcgcaacccccagcugugcuaccaggacaccauccuguggaaggacaucuuccacaagaacaaccagcucgcccugacccugaucgacacgaaccggucccgcgcgugccaccccugcagcccgaugugcaaggggucccggugcuggggcgagagcuccgaggacugccagagccucacccgcaccgucugcgccgggggcugcgcccggugcaagggcccccugcccaccgacugcugccacgagcagugcgccgcggggugcacgggccccaagcacuccgacugccuggccugccuccacuucaaccacagcgggaucugcgagcugcacugcccggcccuggugaccuacaacaccgacaccuucgaguccaugcccaaccccgagggccgcuacacguucggcgccagcugcgugaccgccugccccuacaacuaccucuccaccgacgucgggagcugcacccuggugugcccgcugcacaaccaggaggugacggcggaggacggcacccagcggugcgagaagugcuccaagcccugcgcccgcgucugcuacgggcucggcauggagcaccuccgcgaggugcgcgccgugaccagcgccaacauccaggaguucgccgggugcaagaagaucuucggcucccuggcguuccugcccgagagcuucgacggcgaccccgccagcaacaccgccccgcugcagcccgagcagcugcaggucuucgagacgcucgaggagaucaccggguaccuguacaucuccgccuggcccgacagccugcccgaccucuccguguuccagaaccugcaggucauccggggccgcauccugcacaacggggccuacagccucacccuccagggccuggggaucuccuggcugggccuccggagccugcgggagcugggcuccgggcucgcgcugauccaccacaacacccaccugugcuucgugcacacggugccgugggaccagcuguuccgcaacccccaccaggcccuccugcacaccgccaaccggcccgaggacgagugcgugggcgaggggcucgccugccaccagcugugcgcccgcggccacugcugggggcccggcccgacccagugcgucaacugcagccaguuccugcggggccaggagugcguggaggagugccgcguccuccaggggcugccccgggaguacgugaacgcgcgccacugccugcccugccacccggagugccagccccagaacggcuccgugaccugcuucgggcccgaggccgaccagugcgucgccugcgcccacuacaaggacccgcccuucugcguggcgcggugccccagcggcgugaagcccgaccucuccuacaugcccaucuggaaguucccggacgaggagggcgccugccagcccugccccaucaacugcacgcacagcugcgucgaccuggacgacaaggggugccccgccgagcagcgcgccuccccgcugaccagcaucaucuccgccguggugggcauccuccuggucguggugcugggggucguguucggcauccucaucaagcggcgccagcagaagauccggaaguacaccaugcgccggcugcugcaggagaccgagcucguggagccccugacgcccagcggggcgaugcccaaccaggcccagaugcgcauccugaaggagaccgagcuccggaaggucaaggugcugggcuccggcgccuucgggaccguguacaagggcaucuggaucccggacggggagaacgucaagauccccguggccaucaaggugcugcgcgagaacaccagccccaaggccaacaaggagauccucgacgaggcguacgucauggccggcguggggucccccuacgugagccggcugcugggcaucugccucaccagcacgguccagcuggugacccagcugaugccguacggcugccuccuggaccacgugcgcgagaaccgggggcgccugggcucccaggaccuccugaacuggugcaugcagaucgccaaggggaugagcuaccuggaggacguccgccucgugcaccgggaccuggccgcccgcaacgugcuggucaagucccccaaccacgugaagaucaccgacuucggccucgcgcggcugcuggacaucgacgagaccgaguaccacgccgacgggggcaaggugcccaucaaguggauggcccucgagagcauccugcgccggcgcuucacgcaccaguccgacgucuggagcuacggcgugaccgugugggagcugaugaccuucggggccaagcccuacgacggcaucccggcgcgggagauccccgaccuccuggagaagggggagcgccugccccagccgcccaucugcaccaucgacgucuacaugaucauggugaagugcuggaugaucgacuccgagugccggccccgcuuccgggagcucgugagcgaguucucccgcauggcccgggacccccagcgcuucgucgugauccagaacgaggaccugggcccggccagcccccuggacuccacguucuaccggagccuccuggaggacgacgacaugggggaccugguggacgccgaggaguaccucgucccccagcagggcuucuucugccccgacccggcccccggcgccgggggcauggugcaccaccgccaccgguccagcuccacccgcagcgggggcggcgaccugacccuggggcucgagcccuccgaggaggaggcgccccggagcccgcuggcccccagcgagggcgccggguccgacguguucgacggcgaccuggggaugggcgccgcgaagggccuccagagccugcccacccacgaccccuccccgcugcagcgcuacagcgaggaccccacggucccccuccccuccgagaccgacggguacguggccccgcugaccugcagcccccagcccgaguacgugaaccagcccgacguccggccgcagccgcccagcccccgcgagggcccccugcccgccgcccgccccgccggggcgacccucgagcggccgaagacgcugucccccggcaagaacgggguggugaaggacgucuucgccuucggcggcgccguggagaaccccgaguaccugacgccccagggcggggccgcgccgcagccccacccgccgcccgccuucucccccgccuucgacaaccucuacuacugggaccaggacccgcccgagcgcggggccccgcccagcaccuucaagggcacccccaccgccgagaaccccgaguaccuggggcuggacguccccguguga

SEQ ID NO: 29742 - RNA, 3909 nt, Artificial Sequence
  derived and/or modified sequence opt1 from ERBB2IP__Homo_sapiens__NP_001006600
augaccaccaagcgcagccuguucgugcggcucguccccugccgcugccugcggggcgaggaggagacggugaccacccuggacuacucccacugcagccucgagcaggucccgaaggagaucuucaccuucgagaagacgcuggaggagcuguaccucgacgccaaccagaucgaggagcugcccaagcagcuguucaacugccagucccuccacaagcugagccugcccgacaacgaccucaccacccugcccgccuccaucgcgaaccugaucaaccuccgcgagcuggacgucagcaagaacgggauccaggaguucccggagaacaucaagaacugcaaggugcugaccaucguggaggccuccgucaaccccaucagcaagcuccccgacggcuucucccagcugcugaaccucacgcagcuguaccugaacgacgccuuccucgaguuccugcccgccaacuucgggcggcugaccaagcuccagauccuggagcugcgcgagaaccagcucaagaugcugccgaagaccaugaaccggcugacccagcucgagcgccuggaccugggcagcaacgaguucacggaggugcccgaggugcucgagcagcuguccgggcugaaggaguucuggauggacgccaaccggcucaccuucauccccggcuucaucggcagccugaagcagcugaccuaccucgacgucuccaagaacaacaucgagaugguggaggaggggaucuccacgugcgagaaccugcaggaccugcuccuguccagcaacucccugcagcagcuccccgagaccaucggcagccugaagaacaucaccacccugaagaucgacgagaaccagcugauguaccucccggacuccaucgggggccugaucagcguggaggagcuggacugcagcuucaacgaggucgaggcgcuccccuccagcaucgggcagcugaccaaccugcgcacguucgccgccgaccacaacuaccuccagcagcugccgcccgagaucggcuccuggaagaacaucaccgugcuguuccuccacagcaacaagcuggagacccugcccgaggagaugggcgacaugcagaagcucaaggugaucaaccuguccgacaaccggcugaagaaccuccccuucagcuucaccaagcugcagcagcugacggccauguggcucuccgacaaccagagcaagccccugaucccccugcagaaggagaccgacuccgagacccagaagaugguccucaccaacuacauguucccgcagcagccccgcacggaggacgugauguucaucagcgacaacgagagcuucaaccccagccugugggaggagcagcggaagcagcgcgcccagguggcguucgagugcgacgaggacaaggacgagcgggaggcgcccccgcgcgaggggaaccugaagcgguaccccacccccuaccccgacgagcucaagaacauggugaagaccgugcagaccaucgugcaccgccugaaggacgaggagacgaacgaggacuccggccgggaccugaagccgcacgaggaccagcaggacaucaacaaggacgucggggugaagaccagcgaguccaccaccacggucaagagcaagguggacgagcgcgagaaguacaugaucggcaacuccgugcagaagaucagcgagcccgaggccgagaucucccccggcagccucccggucaccgccaacaugaaggccagcgagaaccugaagcacaucgugaaccacgacgacguguucgaggaguccgaggagcugagcuccgacgaggagaugaagauggccgagaugcggccgccccucaucgagaccagcaucaaccagcccaaggucguggcccuguccaacaacaagaaggacgacaccaaggagaccgacagccuguccgacgaggugacgcacaacagcaaccagaacaacuccaacugcagcucccccagccgcauguccgacagcgucucccucaacaccgacagcucccaggacaccagccugugcagccccgugaagcagacccacaucgacaucaacuccaagauccgccaggaggacgagaacuucaacagccugcuccagaacggggacauccugaacuccagcacggaggagaaguucaaggcccacgacaagaaggacuucaaccugcccgaguacgaccucaacguggaggagcggcugguccugaucgagaaguccguggacagcaccgccaccgcggacgacacccacaagcucgaccacaucaacaugaaccugaacaagcugaucacgaacgacaccuuccagcccgagaucauggagcgcuccaagacccaggacaucgugcucggcaccagcuuccuguccaucaacagcaaggaggagacggagcaccuggagaacgggaacaaguacccgaaccucgaguccgucaacaaggugaacggccacagcgaggagaccucccagagccccaaccggaccgagccccacgacuccgacugcagcguggaccuggggaucuccaagagcaccgaggaccugagcccccagaaguccggcccggucggcuccguggucaagagccacagcaucacgaacauggagaucgggggccucaagaucuacgacauccuguccgacaacgggccccagcagcccagcaccaccgugaagaucaccuccgccguggacggcaagaacaucgugcgcagcaaguccgccacgcugcucuacgaccagccccugcaggucuucaccgggagcuccagcuccagcgaccugaucuccggcaccaaggccaucuucaaguucgacagcaaccacaacccggaggagcccaacaucauccggggccccaccuccgggccccagagcgccccgcagaucuacggcccgccccaguacaacauccaguacuccagcuccgcggccgugaaggacacgcucuggcacagcaagcagaacccccagaucgaccacgccagcuucccgccccagcugcugccccgcuccgagagcaccgagaaccaguccuacgccaagcacagcgccaacaugaacuucuccaaccacaacaacgugcgggcgaacaccgccuaccaccuccaccagcgccuggggcccgcccggcacggcgagaugugggccaucagccccaacgaccgccugauccccgcggucacccgguccacgauccagcgccagagcuccgugagcuccaccgccagcgugaaccucggggaccccggcuccacccggcgcgcccagaucccggagggcgacuaccugagcuaccgggaguuccacuccgccgggcgcaccccgcccaugaugcccggcagccagcggccccuguccgcccgcacguacagcaucgacgggcccaacgcgucccggccccagagcgcccgccccagcaucaacgagaucccggagcgcaccauguccgucagcgacuucaacuacucccggaccagccccuccaagcgccccaacgcccgggugggcagcgagcacucccuccuggacccgcccggcaagagcaaggugccccgcgacuggcgggagcagguccugcgccacaucgaggccaagaagcucgagaagauccgggugcgcguggagaaggaccccgagcugggguucuccaucagcggcggggucggcgggcggggcaaccccuuccgcccggacgacgacggcaucuucgugacccgggugcagcccgaggggcccgccuccaagcugcuccagcccggcgacaagaucauccaggcgaacggguacagcuucaucaacaucgagcacggccaggccgucucccugcugaagacguuccagaacaccguggagcucaucaucgugcgcgaggucagcuccuga

SEQ ID NO: 29743 - RNA, 552 nt, Artificial Sequence
  derived and/or modified sequence opt1 from ERBB3__Homo_sapiens__NP_001005915
augcgcgccaacgacgcccuccaggugcugggccugcuguucagccucgcgcggggguccgaggucggcaacagccaggccgugugccccgggacccugaacggccuguccgugaccggggacgccgagaaccaguaccagacgcucuacaagcuguacgagcgcugcgaggucgugaugggcaaccuggagaucgugcucaccggccacaacgccgaccugagcuuccugcaguggauccgggaggucaccggguacgugcucguggccaugaacgaguucuccacccugccgcugcccaaccuccgcgucgugcggggcacccagguguacgacgggaaguucgcgaucuucgucaugcugaacuacaacacgaacagcucccacgcccugcgccagcuccggcugacccagcugaccggccaguuccccauggugcccagcgggcucacgccgcagcccgcccaggacugguaccugcuggacgacgacccccgccuccugacccuguccgccagcuccaaggugcccgucacccucgcggccguguga

SEQ ID NO: 29744 - RNA, 3879 nt, Artificial Sequence
  derived and/or modified sequence opt1 from ERBB4__Homo_sapiens__NP_001036064
augaagcccgccaccggccugugggugugggucagccuccugguggccgcggggaccgugcagcccuccgacagccaguccgucugcgccggcacggagaacaagcugagcucccucagcgaccuggagcagcaguaccgcgcccugcggaaguacuacgagaacugcgagguggugauggggaaccucgagaucaccuccaucgagcacaaccgcgaccugagcuuccugcgguccguccgcgaggugaccggcuacgugcucgucgcccugaaccaguuccgguaccugccccucgagaaccugcgcaucauccgggggaccaagcuguacgaggaccgcuacgcccucgcgaucuuccugaacuaccggaaggacggcaacuucggccugcaggagcucgggcugaagaaccugacggagauccucaacggcgggguguacguggaccagaacaaguuccugugcuacgccgacaccauccacuggcaggacaucguccgcaaccccuggcccagcaaccugacccucguguccaccaacggcagcuccgggugcggccggugccacaagagcugcacgggccgcugcugggggccgaccgagaaccacugccagacccugacccggacggugugcgccgagcagugcgacggccgcugcuacgggcccuacgucuccgacugcugccaccgggagugcgccggcggcugcagcgggcccaaggacaccgacugcuucgcgugcaugaacuucaacgacuccggcgccugcgugacccagugcccccagaccuucguguacaacccgacgaccuuccagcuggagcacaacuucaacgccaaguacaccuacggggccuucugcgucaagaagugcccccacaacuucgugguggacagcuccagcugcguccgcgccugccccagcuccaagauggagguggaggagaacggcaucaagaugugcaagcccugcaccgacaucugcccgaaggcgugcgacgggaucggcacgggcagccucauguccgcccagaccguggacagcuccaacaucgacaaguucaucaacugcaccaagaucaacgggaaccugaucuuccuggucaccggcauccacggggaccccuacaacgccaucgaggccaucgaccccgagaagcucaacguguuccggacgguccgcgagaucaccggcuuccugaacauccagagcuggcccccgaacaugaccgacuucuccguguucagcaaccuggugaccaucgggggccggguccucuacuccggccugagccugcucauccugaagcagcaggggaucacgucccugcaguuccagagccucaaggagaucuccgccggcaacaucuacaucaccgacaacagcaaccugugcuacuaccacaccaucaacuggaccacgcuguucuccaccaucaaccagcgcaucgugauccgggacaaccgcaaggcggagaacugcaccgccgaggggauggugugcaaccaccucugcagcuccgacggcugcugggggcccggccccgaccagugccugagcugccgccgguucucccgcggccggaucugcaucgagagcugcaaccuguacgacggggaguuccgcgaguucgagaacggcagcaucugcgucgagugcgacccccagugcgagaagauggaggacgggcuccugaccugccacggcccgggccccgacaacugcacgaagugcucccacuucaaggacgggcccaacugcguggagaagugccccgacggccugcagggggccaacagcuucaucuucaaguacgccgacccggaccgggagugccaccccugccaccccaacugcacccagggcugcaacgggcccaccucccacgacugcaucuacuacccguggaccggccacagcacccucccccagcacgcccgcacgccccugaucgcggccggcgugaucgggggccuguucauccuggucaucguggggcucaccuucgccguguacguccggcgcaaguccaucaagaagaagcgggcccugcgccgguuccuggagaccgagcucguggagccgcugacccccagcggcacggcccccaaccaggcgcagcugcgcauccucaaggagaccgagcugaagcgggugaagguccugggguccggcgccuucggcaccguguacaaggggaucugggugcccgagggcgagaccgucaagaucccgguggccaucaagauccucaacgagacgaccgggcccaaggccaacguggaguucauggacgaggcgcugaucauggccagcauggaccacccccaccugguccgccuccugggcgugugccugucccccaccauccagcucgugacccagcugaugccgcacgggugccugcucgaguacguccacgagcacaaggacaacaucggcagccagcugcugcucaacuggugcgugcagaucgccaagggcaugauguaccuggaggagcggcgccuggugcaccgggaccucgccgcccgcaacguccuggugaagucccccaaccacgugaagaucacggacuucgggcuggcgcggcuccuggagggcgacgagaaggaguacaacgccgacgggggcaagaugcccaucaaguggauggcccuggagugcauccacuaccgcaaguucacccaccagagcgacgucugguccuacggggugaccaucugggagcucaugaccuucggcggcaagcccuacgacgggaucccgacgcgcgagauccccgaccugcuggagaagggcgagcggcucccccagcccccgaucugcaccaucgacguguacauggucauggugaagugcuggaugaucgacgccgacagccgccccaaguucaaggagcuggccgcggaguucucccggauggcccgcgacccccagcgguaccuggugauccagggggacgaccgcaugaagcuccccagcccgaacgacuccaaguucuuccagaaccugcuggacgaggaggaccucgaggacaugauggacgccgaggaguaccuggucccccaggccuucaacaucccgccgcccaucuacaccagccgggcccgcaucgacagcaaccggaaccaguucguguaccgcgacggcggcuucgcggccgagcaggggguguccguccccuaccgggcccccaccagcacgauccccgaggcccccguggcgcagggcgccaccgccgagaucuucgacgacuccugcugcaacgggacccugcgcaagcccguggcgccccacguccaggaggacagcuccacccagcgguacagcgccgacccgacgguguucgcccccgagcgcagcccccggggcgagcucgacgaggagggguacaugacccccaugcgcgacaagccgaagcaggaguaccugaaccccguggaggagaaccccuucgucucccggcgcaagaacggcgaccugcaggcccucgacaaccccgaguaccacaacgccuccaacggcccgcccaaggccgaggacgaguacgugaacgagccccuguaccugaacaccuucgccaacacccucgggaaggcggaguaccugaagaacaacauccugagcaugcccgagaaggccaagaaggccuucgacaacccggacuacuggaaccacucccucccgccccggagcacgcugcagcaccccgacuaccugcaggaguacuccaccaaguacuucuacaagcagaacggccgcauccggcccaucguggccgagaaccccgaguaccucagcgaguucucccugaagcccgggaccguccugcccccgccgcccuaccgccaccgcaacaccgugguguga

SEQ ID NO: 29745 - RNA, 3456 nt, Artificial Sequence
  derived and/or modified sequence opt1 from ERC1__Homo_sapiens__XP_011519238
auguacggcagcgcccgcuccguggggaagguggagcccagcucccagagcccgggccggagcccccgccugccccggagcccccgccucgggcaccggcgcaccaacuccaccggcgggagcuccggcagcuccgugggcgggggcagcgggaagacgcuguccauggagaacauccagagccugaacgccgcguacgccaccuccggcccgauguaccucagcgaccacgagaacgugggguccgagacccccaagagcaccaugacgcugggccgguccggcgggcgccugcccuacggcguccggaugaccgccauggggagcagccccaacaucgccuccagcggcguggccuccgacaccaucgcguucggcgagcaccaccucccgcccgugagcauggccuccaccgucccccacagccugcgccaggcccgggacaacacgaucauggaccugcagacccagcucaaggaggugcugcgcgagaacgaccugcuccggaaggacguggaggucaaggaguccaagcugagcuccagcaugaacuccaucaagaccuucuggagccccgagcugaagaaggagcgcgcccuccggaaggacgaggcguccaagaucaccaucuggaaggagcaguaccgcguggugcaggaggagaaccagcacaugcagaugacgauccaggcccugcaggacgagcugcggauccagcgcgaccucaaccagcuguuccagcaggacagcuccagccggaccggggagccgugcgucgccgagcugaccgaggagaacuuccagcgccuccacgccgagcacgagcggcaggccaaggagcuguuccugcuccgcaagacccuggaggagauggagcugcgcaucgagacgcagaagcagacccucaacgcgcgggacgaguccaucaagaagcugcuggagaugcuccagagcaagggccuguccgccaaggccaccgaggaggaccacgagcgcacccggcgccuggccgaggccgagaugcacgugcaccaccucgagagccugcuggagcagaaggagaaggagaacagcaugcuccgggaggagaugcaccgccgguucgagaacgcgcccgacuccgccaagacgaaggcccugcagaccgugaucgagaugaaggacagcaagaucuccagcauggagcgcgggcugcgggaccucgaggaggagauccagaugcugaaguccaacggcgcccugagcaccgaggagcgcgaggaggagaugaagcagauggaggucuaccggucccacagcaaguucaugaagaacaagaucggccaggugaagcaggagcucucccgcaaggacaccgagcugcuggcccuccagacgaagcuggagacccugaccaaccaguucagcgacuccaagcagcacaucgaggugcucaaggagagccugaccgcgaaggagcagcgggccgccauccugcagacggaggucgacgcccugcgccuccggcuggaggagaaggagaccaugcugaacaagaagaccaagcagauccaggacauggccgaggagaaggggacccaggcgggcgagauccacgaccucaaggacaugcuggacgugaaggagcgcaaggugaacguccugcagaagaagaucgagaaccuccaggagcagcugcgggacaaggagaagcagauguccagccugaaggagcgcgugaagucccuccaggccgacacgaccaacaccgacaccgcccugacgacccuggaggaggcccucgcggagaaggagcggaccaucgagcgccugaaggagcagcgcgaccgggacgagcgcgagaagcaggaggagaucgacaacuacaagaaggaccugaaggaccucaaggagaaggugagccugcugcagggggaccucuccgagaaggaggccagccugcuggaccucaaggagcacgccagcucccuggccagcuccggccugaagaaggacagccggcucaagacccuggagaucgcccuggagcagaagaaggaggagugccucaagauggagucccagcugaagaaggcgcacgaggccgcccuggaggcccgcgccagccccgagauguccgaccggauccagcaccucgagcgcgagaucacccgguacaaggacgagagcuccaaggcgcaggccgaggucgaccgccugcuggagauccucaaggagguggagaacgagaagaacgacaaggacaagaagaucgccgagcuggagagccugacgucccggcaggucaaggaccagaacaagaagguggccaaccucaagcacaaggagcaggucgagaagaagaaguccgcccagaugcuggaggaggcgcgccggcgcgaggacaaccugaacgacuccagccagcagcuccaggacucccugcggaagaaggacgaccgcaucgaggagcuggaggaggcccuccgggagagcgugcagaucaccgccgagcgcgagauggugcuggcccaggaggaguccgcgcggaccaacgccgagaagcaggucgaggagcugcucauggccauggagaaggugaagcaggagcuggagagcaugaaggccaagcuguccagcacccagcagagccucgccgagaaggagacgcaccugaccaaccugcgcgcggagcggcgcaagcaccucgaggaggugcuggagaugaagcaggaggcccugcucgccgccaucuccgagaaggacgccaacaucgcgcugcuggagcucagcuccagcaagaagaagacccaggaggagguggccgcccugaagcgggagaaggaccgccugguccagcagcucaagcagcagacccagaaccgcaugaagcugauggccgacaacuacgaggacgaccacuucaaguccagccacuccaaccagacgaaccacaagcccagcccggaccagaucauccagccccugcucgagcuggaccagaaccgguccaagcugaagcucuacaucgggcaccugaccacccugugccacgaccgcgacccccucauccugcggggccugacgcccccggccagcuacaaccucgacgacgaccaggcggccugggagaacgagcugcagaagaugacccgcgggcagaacacgccccacuuccugaagcccgccuccgccaaccucuggcccgacaaggacuuccagagcccguccgugcaccuccugcugcaggacugcaccagcuccaagcacagcacccagaaggaguccguggcgagccagucccacggcaagaccgccuucuuccacgucaugcugaugcugcaggacgagcucgagaagggcgagcgggacaacgccgagcugcaggaguucgccaacgccauccugcagcagaucgcggaccacugccccgacauccucgagcaggucgugaacgcccuggaggagagcagcuga

SEQ ID NO: 29746 - RNA, 2874 nt, Artificial Sequence
  derived and/or modified sequence opt1 from ERC2__Homo_sapiens__NP_056391
auguacggcagcgcccgcaccaucaccaaccuggaggggucccccagccgguccccgcgccucccccggagcccccgccugggccaccggcgcacguccagcgggggcgggggcggcaccgggaagacccuguccauggagaacauccagagccucaacgccgcguacgccaccuccggccccauguaccugagcgaccacgaggggguggccuccacgaccuacccgaagggcaccaugacccuggggcgggccacgaaccgcgccgucuacggcggccgggugaccgcgauggggagcucccccaacaucgccagcgccggccucucccacaccgacgugcugagcuacaccgaccagcacgggggccugacgggcuccagccaccaccaccaccaccagguccccuccaugcuccgccaggugcgggacagcaccaugcuggaccugcaggcccagcucaaggagcugcagcgcgagaacgaccugcuccggaaggagcuggacaucaaggacagcaagcugggguccagcaugaacuccaucaagaccuucuggagccccgagcucaagaaggagcgcgugcugcggaaggaggaggcggcccgcauguccguccugaaggagcagaugcgggugagccacgaggagaaccagcaccuccagcugaccauccaggcccugcaggacgagcuccgcacgcagcgggaccugaaccaccuccuccagcaggaguccggcaaccgcggggccgagcacuucaccaucgagcugaccgaggagaacuuccggcgccugcaggccgagcacgaccgccaggcgaaggagcuguuccugcugcggaagacccucgaggagauggagcugcgcaucgagacgcagaagcagacccugaacgcccgggacgagagcaucaagaagcuccuggagaugcugcaguccaagggccucccgagcaagucccuggaggacgacaacgagcgcacccggcgcauggccgaggccgagagccaggugucccaccuggaggucauccucgaccagaaggagaaggagaacauccaccuccgggaggagcugcaccgccggagccagcugcagcccgagcccgccaagaccaaggcgcugcagacggugaucgagaugaaggacaccaagaucgccucccuggagcgcaacauccgggaccucgaggacgagauccagaugcugaaggccaacggggugcugaacaccgaggaccgcgaggaggagaucaagcagaucgaggucuacaagagccacuccaaguucaugaagaccaagaucgaccagcugaagcaggagcucagcaagaaggaguccgagcugcuggcccuccagacgaagcuggagacccugagcaaccagaacagcgacugcaagcagcacaucgaggugcucaaggagucccugaccgccaaggagcagcgggcggccauccugcagaccgagguggacgcccuccgccugcggcuggaggagaaggagagcuuccucaacaagaagacgaagcagcugcaggaccugaccgaggagaagggcacccucgccggcgagauccgcgacaugaaggacaugcuggaggucaaggagcggaagaucaacgugcugcagaagaagaucgagaaccuccaggagcagcugcgcgacaaggacaagcagcugaccaaccucaaggaccgggugaagucccugcagacggacagcuccaacaccgacaccgcccuggcgacccucgaggaggcccugagcgagaaggagcgcaucaucgagcgccugaaggagcagcgggagcgcgacgaccgggagcgccucgaggagaucgaguccuuccggaaggagaacaaggaccugaaggagaaggucaacgcccugcaggccgagcucaccgagaaggagagcucccugaucgaccugaaggagcacgcgagcucccucgccagcgccgggcugaagcgcgacuccaagcucaagagccuggagaucgccaucgagcagaagaaggaggagugcuccaagcuggaggcccagcugaagaaggcgcacaacaucgaggacgacagccggaugaaccccgaguucgccgaccagaucaagcagcucgacaaggaggccuccuacuaccgcgacgagugcggcaaggcccaggccgagguggaccggcugcuggagauccucaaggagguggagaacgagaagaacgacaaggacaagaagaucgcggagcuggagagccugacgcuccgccacaugaaggaccagaacaagaaggucgccaaccugaagcacaaccagcagcuggagaagaagaagaacgcccagcuccuggaggaggugcggcgccgggaggacagcauggccgacaacucccagcaccuccagaucgaggagcugaugaacgcccuggagaagacccgccaggagcuggacgcgaccaaggcccggcucgccagcacccagcagucccuggccgagaaggaggcgcaccuggccaaccuccgcaucgagcggcgcaagcagcuggaggagauccuggagaugaagcaggaggcccuccuggccgccaucagcgagaaggacgcgaacaucgcccugcucgagcuguccgccagcaagaagaagaagacgcaggaggaggugauggcccugaagcgggagaaggaccgccucguccaccagcugaagcagcagacccagaaccggaugaagcugauggccgacaacuacgacgacgaccaccaccacuaccaccaccaccaccaccaccaccaccaccgcuccccggggcgcagccagcacuccaaccaccggcccagccccgaccaggacgacgaggagggcaucugggcguga

SEQ ID NO: 29747 - RNA, 822 nt, Artificial Sequence
  derived and/or modified sequence opt1 from ERCC1__Homo_sapiens__NP_001159521
auggaccccggcaaggacaaggagggggugccgcagcccagcggcccgcccgcccgcaagaaguucgucaucccccuggacgaggacgaggugccgcccgggguggccaagccccucuuccgguccacccagagccugcccaccgucgacaccuccgcgcaggccgcgccccagaccuacgccgaguacgccaucagccagccccuggagggcgcgggggcgaccugccccaccggcuccgagccgcucgccggcgagacgcccaaccaggcccugaagcccggggccaagagcaacuccaucaucgugagcccccgccagcggggcaacccggugcugaaguucguccgcaacgugcccugggaguucggggacgugauccccgacuacguccucggccaguccacgugcgcccuguuccugagccuccgguaccacaaccugcaccccgacuacauccacgggcgccugcagucccucggcaagaacuucgcccugcgggugcugcucgugcaggucgacgugaaggacccgcagcaggcccugaaggagcuggccaagaugugcauccucgccgacugcacccugauccuggccuggagccccgaggaggccggccgcuaccucgagaccuacaaggccuacgagcagaagcccgccgaccugcugauggagaagcucgagcaggacuucgugucccggagccuggagcagcugaucgcggccucccgcgaggaccucgcccugugccccgggcugggcccgcagaaggcccggcgccucuucgacguccugcacgagcccuuccugaaggugcccuga

SEQ ID NO: 29748 - RNA, 2283 nt, Artificial Sequence
  derived and/or modified sequence opt1 from ERCC2__Homo_sapiens__NP_000391
augaagcugaacguggacggccuccuggucuacuuccccuacgacuacaucuacccggagcaguucagcuacaugcgcgagcugaagcggacccucgacgccaaggggcacggcgugcuggagaugcccuccgggaccggcaagacggugagccugcucgcccugaucauggcguaccagcgcgccuacccccuggaggucaccaagcucaucuacugcucccggaccgugcccgagaucgagaaggugaucgaggagcugcgcaagcugcucaacuucuacgagaagcaggagggggagaagcugccguuccugggccucgcccugagcucccggaagaaccugugcauccaccccgaggucacgccccuccgcuucggcaaggacguggacgggaagugccacagccugaccgccuccuacgugcgggcccaguaccagcacgacaccagccugccccacugccgcuucuacgaggaguucgacgcgcacggccgggaggucccgcuccccgccgggaucuacaaccuggacgaccugaaggcccucggccgccggcagggguggugccccuacuuccuggcccgcuacuccauccugcacgcgaacgugguggucuacagcuaccacuaccuccuggaccccaagaucgccgaccugguguccaaggagcucgcccggaaggccguggucguguucgacgaggcccacaacaucgacaacgugugcaucgacagcauguccgucaaccugacccgccggacccuggaccgcugccagggcaaccucgagacgcugcagaagaccgugcugcggaucaaggagaccgacgagcagcgccuccgggacgaguaccgccggcugguggagggccugcgcgaggcgagcgccgcccgcgagaccgacgcccaccucgccaacccgguccugcccgacgaggugcugcaggaggcggugcccggguccauccggacggccgagcacuuccucggcuuccugcgccggcugcucgaguacgucaaguggcgccugcgggugcagcacgucgugcaggagagcccgcccgccuuccuguccgggcucgcccagcgcgugugcauccagcggaagccccugcgcuucugcgccgagcggcugcgcagccugcuccacacccuggagaucaccgaccuggcggacuucagcccccucacccugcuggccaacuucgccacgcucgucuccaccuacgccaagggcuucaccaucaucaucgagcccuucgacgaccggaccccgacgaucgccaaccccauccugcacuucagcugcauggacgcgucccuggccaucaagcccguguucgagcgcuuccagagcgugaucaucaccuccggcacccucagcccccuggacaucuacccgaagauccuggacuuccaccccgucaccauggccacguucaccaugacccucgcccgggugugccugugccccaugaucaucgggcgcggcaacgaccagguggcgaucuccagcaaguucgagacccgggaggacaucgccgucauccgcaacuacgggaaccugcuccuggagauguccgccguggugcccgacggcaucgucgccuucuucacgagcuaccaguacauggaguccaccguggccagcugguacgagcaggggauccuggagaacauccagcggaacaagcuccuguucaucgagacccaggacggcgcggagaccuccguggcccuggagaaguaccaggaggccugcgagaacggccgcggggccauccuccugagcgucgcccggggcaagguguccgaggggaucgacuucgugcaccacuacggccgcgcggucaucauguucggggugccguacguguacacgcagagccgcauccugaaggcccggcucgaguaccugcgcgaccaguuccagauccgggagaacgacuuccugaccuucgacgccaugcgccacgccgcccagugcgucggccgggcgauccgcggcaagaccgacuacgggcucaugguguucgccgacaagcgguucgcccgcggcgacaagcgggggaagcugccccgcuggauccaggagcaccugaccgacgccaaccucaaccugacgguggacgagggcguccagguggcgaaguacuuccugcggcagauggcccagcccuuccaccgcgaggaccagcucgggcugucccugcucagccuggagcagcuggaguccgaggagacccucaagcggaucgagcagaucgcccagcagcuguga

SEQ ID NO: 29749 - RNA, 2349 nt, Artificial Sequence
  derived and/or modified sequence opt1 from ERCC3__Homo_sapiens__NP_000113
augggcaagcgcgaccgggccgaccgcgacaagaagaagucccggaagcgccacuacgaggacgaggaggacgacgaggaggacgcccccgggaacgacccgcaggaggcggugcccagcgccgccggcaagcaggucgacgagagcgggaccaagguggacgaguacggcgccaaggacuaccggcugcagaugccccucaaggacgaccacaccucccgcccccuguggguggccccggacgggcacaucuuccuggaggcguucagccccgucuacaaguacgcccaggacuuccucguggccaucgccgagcccgugugccggcccacgcacguccacgaguacaagcugaccgcguacucccuguacgccgccgugagcgugggccuccagaccuccgacaucaccgaguaccugcgcaagcugagcaagacgggcgucccggacgggaucaugcaguucaucaagcucugcaccguguccuacggcaaggugaagcugguccugaagcacaaccgguacuucguggagagcugccaccccgacgugauccagcaccuccugcaggaccccgucauccgcgagugccggcugcgcaacuccgagggggaggccaccgagcucaucaccgagacguucaccagcaaguccgccaucagcaagaccgcggaguccagcggcgggcccuccaccagccgggugacggacccgcagggcaaguccgacauccccauggaccuguucgacuucuacgagcagauggacaaggacgaggaggaggaggaggagacccagaccgugagcuucgaggucaagcaggagaugaucgaggagcugcagaagcgcugcauccaccucgaguacccccugcuggccgaguacgacuuccggaacgacagcgugaaccccgacaucaacaucgaccucaagccgaccgccgugcugcgccccuaccaggagaagucccugcggaagauguucggcaacgggcgcgcccggagcggcgucaucgugcuccccugcggggccggcaagucccuggugggcgucacggcggccugcaccgugcgcaagcggugccugguccucgggaacagcgccguguccguggagcaguggaaggcccaguucaagauguggagcaccaucgacgacucccagaucugccgcuucaccagcgacgccaaggacaagcccaucggcugcuccgucgcgaucagcacguacuccaugcuggggcacaccaccaagcgcagcugggaggccgagcgggugauggaguggcugaagacccaggaguggggccucaugauccuggacgaggugcacacgaucccggccaagauguuccgccggguccugaccaucgugcaggcccacugcaagcucgggcugaccgccacccuggugcgcgaggacgacaagaucgucgaccucaacuuccugaucggccccaagcuguacgaggcgaacuggauggagcuccagaacaacggcuacaucgccaaggugcagugcgccgagguguggugccccaugucccccgaguucuaccgggaguacgucgccaucaagacgaagaagcgcauccugcuguacaccaugaacccgaacaaguuccgggcgugccaguuccucaucaaguuccacgagcgccggaacgacaagaucaucguguucgccgacaacguguucgcccugaaggaguacgccauccgccugaacaagcccuacaucuacgggcccaccagccagggcgagcggaugcagauccuccagaacuucaagcacaaccccaagaucaacaccaucuucaucuccaaggucggggacacgagcuucgaccugccggaggccaacgugcugauccagaucuccagccacggcgggucccgccggcaggaggcgcagcgccucggccgggugcugcgcgccaagaagggcauggucgccgaggaguacaacgccuucuucuacagccuggugagccaggacacccaggagauggccuacuccaccaagcggcagcgcuuccugguggaccagggguacagcuucaaggucaucaccaagcucgcgggcauggaggaggaggaccuggccuucuccacgaaggaggagcagcagcagcugcuccagaaggugcuggccgccaccgaccuggacgccgaggaggagguggucgcgggggaguucggcagccgguccagccaggccucccgccgcuucgggaccaugagcuccaugagcggcgccgacgacaccguguacauggaguaccacuccagccgguccaaggcccccagcaagcacgugcacccccucuucaagcgcuuccggaaguga

SEQ ID NO: 29750 - RNA, 2751 nt, Artificial Sequence
  derived and/or modified sequence opt1 from ERCC4__Homo_sapiens__NP_005227
auggagagcggccagcccgcccgccggaucgccauggcgccgcugcucgaguacgagcgccagcuggugcuggagcuccuggacaccgacgggcuggucgugugcgcccggggccucggggccgaccgccugcuguaccacuuccuccagcugcacugccaccccgccugccuggugcucguccugaacacccagcccgccgaggaggaguacuucaucaaccagcugaagaucgagggcguggagcaccucccccggcgcgugacgaacgagaucaccuccaacagccgguacgaggucuacacccagggcggggugaucuucgcgaccucccgcauccugguggucgacuuccugacggaccggaucccgagcgaccucaucaccggcauccugguguaccgcgcccaccggaucaucgaguccugccaggaggccuucauccugcgccucuuccggcagaagaacaagcgcggguucaucaaggccuucaccgacaacgcgguggccuucgacaccggcuucugccacgucgagcgggugaugcgcaaccuguucgugcggaagcuguaccucuggccccgcuuccacgucgccgugaacagcuuccuggagcagcacaagcccgagguggucgagauccacguguccaugacgcccaccaugcuggccauccagaccgccauccucgacauccugaacgcgugccugaaggagcucaagugccacaacccgagccuggagguggaggaccugucccucgagaacgccaucgggaagcccuucgacaagaccauccggcacuaccuggacccccuguggcaccagcucggcgccaagaccaagagccugguccaggaccugaagauccuccgcacgcugcugcaguaccucucccaguacgacugcgugaccuuccugaaccugcucgagagccugcgggccaccgagaaggccuucgggcagaacuccggcuggcuguuccucgacagcuccacgagcauguucaucaacgcgcgcgcccgcguguaccaccuccccgacgccaagauguccaagaaggagaagaucagcgagaagauggagaucaaggagggcgaggagaccaagaaggagcugguccuggaguccaacccgaagugggaggcccugaccgaggugcugaaggagaucgaggccgagaacaaggagagcgaggcgcucgggggccccgggcagguccugaucugcgccagcgacgaccggaccugcucccagcugcgcgacuacaucacgcugggcgccgaggccuuccuccugcggcuguaccgcaagaccuucgagaaggacagcaaggccgaggagguguggaugaaguuccggaaggaggacuccagcaagcgcauccggaagucccacaagcgccccaaggacccccagaacaaggagcgggcgagcaccaaggagcgcacccucaagaagaagaagcggaagcugacgcugacccagauggugggcaagccggaggagcucgaggaggagggggacgucgaggagggcuaccgccgggagaucuccagcucccccgagagcugccccgaggagaucaagcacgaggaguucgacgugaaccuguccagcgacgccgccuucgggauccugaaggagccccucaccaucauccacccgcugcugggcugcuccgaccccuacgcccucacccgcgugcugcacgaggucgagccccgguacguggugcuguacgacgcggagcucacguucguccgccagcuggagaucuaccgggccagccgccccgggaagccgcugcggguguacuuccucaucuacggcggcuccaccgaggagcagcgcuaccugaccgcccugcgcaaggagaaggaggccuucgagaagcucauccgggagaaggccagcauggugguccccgaggagcgcgaggggcgggacgagaccaaccuggaccuggugcgcggcacggcguccgccgacgugagcaccgacacccggaaggccgggggccaggagcagaacgggacccagcaguccaucgucguggacaugcgcgaguuccggagcgagcuccccagccugauccaccgccggggcaucgacaucgagcccgugacgcuggaggucggcgacuacauccucaccccggagaugugcguggagcgcaaguccaucagcgaccugaucgggucccugaacaacggccggcucuacagccagugcaucuccaugagccgcuacuacaagcggcccgugcugcugaucgaguucgaccccuccaagccguucagccucaccucccgcggggcccuguuccaggagaucagcuccaacgacaucagcuccaagcugacccuccugacccugcacuucccccggcuccgcauccuguggugccccagcccccacgccacggcggagcuguucgaggagcucaagcaguccaagccgcagcccgacgccgccaccgcccuggccaucaccgcggacagcgagacccugcccgaguccgagaaguacaaccccggcccgcaggacuuccuccugaagaugcccggggucaacgccaagaacugccggagccugaugcaccacgugaagaacaucgccgagcucgccgcgcugagccaggacgagcugacguccauccucggcaacgccgccaacgccaagcagcuguacgacuucauccacaccagcuucgccgagguggucuccaagggcaaggggaagaaguga

SEQ ID NO: 29751 - RNA, 3561 nt, Artificial Sequence
  derived and/or modified sequence opt1 from ERCC5__Homo_sapiens__NP_000114
augggcgugcaggggcuguggaagcuccuggagugcagcggccgccaggucucccccgaggcccuggaggggaagauccucgccguggacaucagcaucuggcugaaccaggcgcugaagggcgugcgggaccgccacgggaacuccaucgagaacccgcaccuccugacccuguuccaccggcucugcaagcugcuguucuuccgcauccggcccaucuucgucuucgacggcgacgcgccccuccugaagaagcagacccuggugaagcgccggcagcgcaaggaccucgccagcuccgacagccggaagacgaccgagaagcugcugaagaccuuccucaagcgccaggccaucaagaccgccuuccgguccaagcgcgacgaggcccugcccagccugacccaggugcggcgcgagaacgaccucuacguccugccgccccugcaggaggaggagaagcacuccagcgaggaggaggacgagaaggaguggcaggagcggaugaaccagaagcaggcccuccaggaggaguucuuccacaacccccaggccaucgacaucgaguccgaggacuucagcucccugcccccggaggugaagcacgagauccugaccgacaugaaggaguucaccaagcgccggcgcacccucuucgaggccaugcccgaggagagcgacgacuucucccaguaccagcugaagggccugcucaagaagaacuaccugaaccagcacaucgagcacgugcagaaggagaugaaccagcagcacagcgggcacauccggcgccaguacgaggacgagggcggguuccugaaggaggucgagucccggcgcguggugagcgaggacacgucccacuacauccucaucaagggcauccaggcgaagaccgucgccgagguggacagcgagagccugcccuccagcuccaagaugcacgggaugagcuucgacgugaaguccagccccugcgagaagcugaagaccgagaaggagccggacgccaccccgcccagcccccgcacgcuccuggccaugcaggccgcgcugcucggcuccuccagcgaggaggagcuggaguccgagaaccggcgccaggcccggggccgcaacgcccccgccgccgucgacgaggggagcaucagcccccggacccuguccgcgaucaagcgcgcccucgacgacgacgaggacgugaaggugugcgccggcgacgacguccagaccgggggccccggcgccgaggagaugcggaucaacuccagcaccgagaacuccgacgaggggcugaaggugcgcgacggcaaggggauccccuucacggccacccuggcgagcuccagcgugaacagcgccgaggagcacgucgccuccaccaacgagggccgggagccgaccgacagcgugcccaaggagcagaugucccucgugcacgucgggacggaggccuuccccaucagcgacgaguccaugaucaaggaccgcaaggaccggcugccccuggagagcgccgugguccgccacuccgacgcgccgggccuccccaacggccgggagcugacccccgccagcccgaccugcaccaacuccgugagcaagaacgagacgcacgccgaggugcuggagcagcagaacgagcugugccccuacgaguccaaguucgacagcucccuccugagcuccgacgacgagaccaagugcaagcccaacagcgccuccgaggucaucgggcccgugagccugcaggagaccagcuccaucgugagcgucccguccgaggcgguggacaacguggagaacgucgugagcuucaacgccaaggagcacgagaacuuccucgagaccauccaggagcagcagacgaccgaguccgccggccaggaccugaucagcauccccaaggccguggagcccauggagaucgacuccgaggagagcgaguccgacgggagcuucaucgagguccaguccgugaucagcgacgaggagcugcaggccgaguuccccgagaccuccaagccgcccagcgagcagggcgaggaggagcucguggggacccgcgagggcgaggcgcccgccgaguccgagagccugcugcgggacaacuccgagcgcgacgacgucgacggcgagccccaggaggccgagaaggacgccgaggacagccuccacgaguggcaggacaucaaccuggaggagcuggagacgcucgaguccaaccugcuggcccagcagaacagccucaaggcgcagaagcagcagcaggagcggaucgccgccaccgugaccgggcagauguuccuggagagccaggagcugcuccgccuguucggcaucccguacauccaggcccccauggaggccgaggcgcagugcgccauccuggaccucaccgaccagacguccgggaccaucaccgacgacagcgacaucuggcuguucggcgcccggcacguguaccgcaacuucuucaacaagaacaaguucgucgaguacuaccaguacguggacuuccacaaccagcuggggcucgaccgcaacaagcugaucaaccuggccuaccuccugggcuccgacuacaccgagggcauccccaccguggggugcgucacggcgauggagauccugaacgaguuccccggccacgggcucgagccgcugcugaaguucagcgagugguggcacgaggcccagaagaaccccaagauccggcccaacccccacgacaccaaggugaagaagaagcuccgcacccugcagcugaccccgggcuuccccaaccccgccguggccgaggccuaccucaagcccgucguggacgacuccaagggcagcuuccugugggggaagccggaccuggacaagauccgggaguucugccagcgcuacuucggcuggaaccggacgaagaccgacgagucccucuuccccgugcugaagcagcuggacgcgcagcagacccagcuccgcaucgacagcuucuuccggcuggcccagcaggagaaggaggacgccaagcgcaucaagucccagcggcugaaccgcgccgugaccugcaugcuccggaaggagaaggaggccgcggccagcgagaucgaggccgucuccguggccauggagaaggaguucgagcugcuggacaaggccaagcgcaagacgcagaagcgggggaucaccaacacccucgaggagagcuccagccugaagcgcaagcggcuguccgacagcaagcgcaagaacacgugcggcggguuccucggcgagacgugccuguccgagagcuccgacggcagcagcuccgaggacgcggagagcuccagccugaugaacguccagcggcgcaccgccgccaaggagcccaagaccuccgccagcgacucccagaacagcgugaaggaggcgcccgugaagaacgggggcgccaccacguccagcuccagcgacuccgacgacgacgggggcaaggagaagaugguccucgugaccgcccggagcguguucgggaagaagcgccggaagcugcgccgcgcccggggccgcaagcggaagaccuga

SEQ ID NO: 29752 - RNA, 4482 nt, Artificial Sequence
  derived and/or modified sequence opt1 from ERCC6__Homo_sapiens__NP_000115
augcccaacgagggcaucccgcacagcucccagacccaggagcaggacugccugcagagccagcccguguccaacaacgaggagauggccaucaagcaggagagcgggggcgacggggaggucgaggaguaccucuccuuccgcagcgugggcgacgggcuguccaccagcgccgugggcugcgcguccgccgcgccccggcgcggccccgcccugcuccacaucgaccggcaccagauccaggccgucgagccgagcgcccaggcccuggagcugcaggggcucggcguggacguguacgaccaggacguccuggagcagggggugcugcagcaggucgacaacgccauccacgaggccucccgcgcgagccagcucgucgacguggagaaggaguaccgguccgugcuggacgaccugacgagcugcaccaccucccuccgccagaucaacaagaucaucgagcagcugagcccccaggccgccaccucccgggacaucaaccgcaagcuggacagcgucaagcggcagaaguacaacaaggagcagcagcucaagaagaucacggccaagcagaagcaccuccaggccauccugggcggggcggaggugaagaucgagcucgaccacgccucccuggaggaggacgccgagcccggccccagcagccugggcuccaugcucaugccggugcaggagaccgccugggaggagcugauccgcaccgggcagaugacccccuucggcacgcagaucccccagaagcaggagaagaagccccggaagaucaugcugaacgaggccagcggguucgagaaguaccucgcggaccaggccaagcuguccuucgagcgcaagaagcagggcugcaacaagcgggccgcccgcaaggccccggcgcccgucaccccgcccgcccccgugcagaacaagaacaagcccaacaagaaggcccgggugcugagcaagaaggaggagcgccucaagaagcacaucaagaagcugcagaagcgggcccugcaguuccagggcaaggucgggcuccccaaggcccgccggcccugggaguccgacaugcgcccggaggcggagggcgacagcgagggggaggaguccgaguacuuccccaccgaggaggaggaggaggaggaggacgacgagguggagggcgccgaggccgaccugagcggggacggcaccgacuacgagcugaagccccuccccaagggcgggaagcggcagaagaaggugccgguccaggagaucgacgacgacuucuuccccuccagcggcgaggaggccgaggcggccuccgugggggagggcgggggcggcgggcgcaaggugggccgcuaccgggacgacggggacgaggacuacuacaagcagcgccugcggcgcuggaacaagcugcggcuccaggacaaggagaagcgccugaagcuggaggacgacagcgaggaguccgacgccgaguucgacgagggcuucaagguccccggguuccuguucaagaagcuguucaaguaccagcagacgggcgugcgguggcugugggagcuccacugccagcaggccggcgggauccugggcgacgagauggggcugggcaagaccauccagaucaucgccuuccucgcgggccugagcuacuccaagauccgcacccgggggagcaacuaccgcuucgagggccuggggcccaccgugaucgugugcccgacgaccgugaugcaccagugggucaaggaguuccacaccugguggccgcccuuccggguggccauccuccacgagaccggcuccuacacgcacaagaaggagaagcugauccgcgacguggcccacugccacgggauccugaucaccagcuacuccuacauccggcugaugcaggacgacaucagccgcuacgacuggcacuacgucauccucgacgagggccacaagauccggaaccccaacgccgccgugacccuggcgugcaagcaguuccgcacgccccaccggaucauccugagcggcucccccaugcagaacaaccuccgcgagcuguggagccuguucgacuucaucuuccccgggaagcucggcacccugccgguguucauggagcaguucuccguccccaucaccaugggcggguacagcaacgccucccccguccaggugaagaccgccuacaagugcgccugcgugcugcgggacaccaucaaccccuaccuccugcgccgcaugaaguccgacgugaagaugagccugagccucccggacaagaacgagcagguccuguucugccggcugacggacgagcagcacaagguguaccagaacuucguggacuccaaggagguguaccgcauccucaacggggagaugcagaucuucagcggccugaucgcccugcggaagaucugcaaccaccccgaccucuucuccggcgggcccaagaaccugaagggccugcccgacgacgagcucgaggaggaccaguucggguacuggaagcgcagcggcaagaugaucgucguggagucccugcugaagaucuggcacaagcaggggcagcgggugcuccuguucagccagucccgccagaugcuggacauccucgaggucuuccugcgggcgcagaaguacaccuaccugaagauggacggcaccaccacgaucgccagccgccagccgcucaucacccgguacaacgaggacaccuccaucuucguguuccugcugaccacgcgcgugggcgggcucggcgucaaccugaccggggccaaccggguggugaucuacgaccccgacuggaaccccagcaccgacacccaggcccgcgagcgggcguggcgcaucggccagaagaagcaggucaccguguaccggcugcucacggccgggaccaucgaggagaagaucuaccaccgccagaucuucaagcaguuccugaccaaccgggugcugaaggaccccaagcagcgccgguucuucaagagcaacgaccucuacgagcuguucacccugacguccccggacgccagccaguccaccgagaccagcgccaucuucgccggcaccggcuccgacguccagacgcccaagugccaccucaagcgccggauccagcccgcguucggggccgaccacgacgugcccaagcgcaagaaguucccggccagcaacaucuccgugaacgacgccaccagcuccgaggagaaguccgaggccaagggcgcggaggucaacgccgugaccagcaaccgcagcgacccccugaaggacgacccccacauguccagcaacgugaccuccaacgaccggcugggggaggagacgaacgccgucagcggccccgaggagcucuccgugaucagcggcaacggggagugcuccaacagcagcggcaccgggaagaccuccaugccgagcggcgacgaguccaucgacgagaagcuggggcugagcuacaagcgcgagcggcccucccaggcccagaccgaggccuucugggagaacaagcagauggagaacaacuucuacaagcacaagagcaagacgaagcaccacuccguggcggaggaggagacccucgagaagcaccuccgccccaagcagaagccgaagaacagcaagcacugccgggacgccaaguucgagggcacccgcaucccccaccuggucaagaagcggcgcuaccagaagcaggacuccgagaacaagagcgaggccaaggagcaguccaacgacgacuacgugcuggagaagcuguucaagaaguccgugggcguccacagcgugaugaagcacgacgccaucauggacggggcgagccccgacuacgugcuggucgaggccgaggccaaccggguggcccaggacgcccucaaggcgcugcgccugucccggcagcgcugccucggcgccgugagcgggguccccaccuggacgggccaccgggggaucuccggcgccccggccggcaagaagucccgcuucgggaagaagcggaacagcaacuucagcgugcagcaccccagcuccaccagccccaccgagaagugccaggacggcaucaugaagaaggaggggaaggacaacgugcccgagcacuucuccggccgcgccgaggacgcggacagcuccagcgggccgcuggccuccagcucccugcucgccaagaugcgggcccgcaaccaccugauccugcccgagcggcucgagagcgaguccggccaccuccaggaggccagcgcgcugcugcccaccacggagcacgacgaccugcuggucgagaugcgcaacuucaucgccuuccaggcccacaccgacggccaggccuccacccgcgagauccuccaggaguucgagagcaagcuguccgccagccaguccugcguguuccgggagcugcuccgcaaccugugcaccuuccaccggacgagcgggggcgaggggaucuggaagcugaagcccgaguacugcuga

SEQ ID NO: 29753 - RNA, 2139 nt, Artificial Sequence
  derived and/or modified sequence opt1 from ERCC6L2__Homo_sapiens__NP_001010895
augcagcccggcagcgccccgccgcccgggcgcauggaccccuccgcgccccagccccgggccgagaccagcggcaaggacaucuggcaccccggggagcgcugccuggcccccuccccggacaacggcaagcucugcgaggccagcaucaaguccaucaccguggacgagaacggcaagagcuucgccgucgugcuguacgccgacuuccaggagcggaagaucccccugaagcagcuccaggaggugaaguucgucaaggacugcccccgcaaccugaucuucgacgacgaggaccuggagaagcccuacuucccgaaccggaaguuccccuccagcuccguggcguucaagcucagcgacaacggggacuccauccccuacacgaucaaccgcuaccugcgggacuaccagcgcgagggcacccgguuccuguacgggcacuacauccacggcgggggcugcauccucggggacgacaugggccugggcaagaccgugcaggucaucagcuuccuggccgccgugcuccacaagaaggggacccgcgaggacaucgagaacaacaugcccgaguuccugcugcgguccaugaagaaggagccgcucagcuccacggccaagaagauguuccugaucguggcgccccugagcguccucuacaacuggaaggacgagcuggacaccuggggcuacuuccgcgugaccgugcugcacgggaaccggaaggacaacgagcucauccgcgucaagcagcggaagugcgagaucgcccugaccacguacgagacccugcgccucugccuggacgagcugaacucccucgaguggagcgccgugaucguggacgaggcccaccggaucaagaaccccaaggcccgcgucaccgaggugaugaaggcgcugaagugcaacgugcggaucggccugaccggcacgauccuccagaacaacaugaaggagcuguggugcgucauggacugggccgugcccgggcugcucggcuccgggaccuacuucaagaagcaguucagcgacccgguggagcacggccagcgccacaccgccaccaagcgggagcuggccacggggcgcaaggccaugcagcgccuggcgaagaagaugagcggcugguuccuccggcgcaccaagacccugaucaaggaccagcugcccaagaaggaggaccggauggucuacugcucccucaccgacuuccagaaggccguguaccagacggugcuggagaccgaggacgucacccugauccuccagagcuccgagcccugcacgugccgcagcggccagaagcggcgcaacugcugcuacaagaccaacucccacggggagaccgugaagacccuguaccugagcuaccucaccguccugcagaagguggccaaccacguggcccugcuccaggccgcguccacgagcaagcagcaggagacccugaucaagcggaucugcgaccaggucuucucccgcuuccccgacuucgugcagaaguccaaggacgccgccuucgagacccugagcgacccgaaguacagcggcaagaugaaggugcugcagcagcuccugaaccacugccggaagaaccgcgacaagguccuccuguucuccuucagcaccaagcugcuggacgugcuccagcaguacugcauggccuccgggcuggacuaccggcgccuggacggcagcacgaaguccgaggagcggcucaagaucgugaaggaguucaacagcacccaggacgucaacaucugccugguguccaccauggccgggggccugggccucaacuucgugggggcgaacgucguggugcuguucgaccccaccuggaaccccgccaacgaccugcaggccaucgaccgcgccuaccggaucggccagugccgcgacgucaaggugcuccggcugaucagccuggggacgguggaggagaucauguaccuccgccagaucuacaagcagcagcugcacugcgucguggugggcagcgagaacgcgaagcgguacuucgaggccguccagggguccaaggagcaccagggcgagcuguucggcauccacaaccucuucaaguuccgcagccagggguccugccugaccaaggacauccuggagguguga

SEQ ID NO: 29754 - RNA, 3186 nt, Artificial Sequence
  derived and/or modified sequence opt1 from ERCC6-PGBD3__Homo_sapiens__NP_001263988
augcccaacgagggcaucccgcacagcucccagacccaggagcaggacugccugcagagccagcccguguccaacaacgaggagauggccaucaagcaggagagcgggggcgacggggaggucgaggaguaccucuccuuccgcagcgugggcgacgggcuguccaccagcgccgugggcugcgcguccgccgcgccccggcgcggccccgcccugcuccacaucgaccggcaccagauccaggccgucgagccgagcgcccaggcccuggagcugcaggggcucggcguggacguguacgaccaggacguccuggagcagggggugcugcagcaggucgacaacgccauccacgaggccucccgcgcgagccagcucgucgacguggagaaggaguaccgguccgugcuggacgaccugacgagcugcaccaccucccuccgccagaucaacaagaucaucgagcagcugagcccccaggccgccaccucccgggacaucaaccgcaagcuggacagcgucaagcggcagaaguacaacaaggagcagcagcucaagaagaucacggccaagcagaagcaccuccaggccauccugggcggggcggaggugaagaucgagcucgaccacgccucccuggaggaggacgccgagcccggccccagcagccugggcuccaugcucaugccggugcaggagaccgccugggaggagcugauccgcaccgggcagaugacccccuucggcacgcagaucccccagaagcaggagaagaagccccggaagaucaugcugaacgaggccagcggguucgagaaguaccucgcggaccaggccaagcuguccuucgagcgcaagaagcagggcugcaacaagcgggccgcccgcaaggccccggcgcccgucaccccgcccgcccccgugcagaacaagaacaagcccaacaagaaggcccgggugcugagcaagaaggaggagcgccucaagaagcacaucaagaagcugcagaagcgggcccugcaguuccagggcaaggucgggcuccccaaggcccgccggcccugggaguccgacaugcgcccggaggcggagggcgacagcgagggggaggaguccgaguacuuccccaccgaggaggaggaggaggaggaggacgacgagguggagggcgccgaggccgaccugagcggggacggcaccgacuacgagcugaagccccugcccaagggcgggaagcggcagaagaaggugccggugcaggagaucgacgacgacuucuuccccuccagcggcgaggaggccgaggcggccuccgugggggagggcgggggcggcgggcgcaaggugggccgcuaccgggacgacggggacgaggacuacuacaagcagcgccugagccccaagaugccccggacgcugucccuccacgagaucaccgaccugcuggagaccgacgacagcaucgaggccuccgccaucgucauccagccgcccgagaacgccaccgcgcccgugagcgacgaggaguccggcgacgaggagggcgggacgaucaacaaccucccgggcagccugcugcacaccgccgccuaccucauccaggacggguccgacgccgagagcgacagcgacgaccccuccuacgcccccaaggacgacagccccgacgaggucccguccaccuucaccgugcagcagcccccgcccagccgccggcgcaagaugacgaagauccugugcaaguggaagaaggcggaccugaccgugcagcccgucgccggccgggugaccgccccgcccaacgacuucuucaccgugaugcgcacgcccaccgagauccucgagcuguuccuggacgacgaggucaucgagcucaucgugaaguacuccaaccuguacgccugcagcaagggggugcaccugggccugaccuccagcgaguucaagugcuuccucggcaucaucuuccuguccggguacgucagcgugccccggcgccggauguucugggagcagcgcaccgacgugcacaacguccugguguccgccgcgaugcggcgcgaccgguucgagacgaucuucagcaaccuccacguggccgacaacgccaaccuggaccccgucgacaaguucuccaagcugcgcccccucaucagcaagcugaacgagcggugcaugaaguucgugcccaacgagaccuacuucuccuucgacgaguucauggugccguacuucggccgccacgggugcaagcaguucauccggggcaagcccauccgcuucggguacaaguucuggugcggcgcgaccugccugggcuacaucugcugguuccagcccuaccaggggaagaaccccaacaccaagcacgaggaguacggcgucggggccagccucgugcugcaguucuccgaggcccugacggaggcccacccgggccaguaccacuucguguucaacaacuucuucaccagcaucgcccuccuggacaagcugagcuccauggggcaccaggccaccggcaccguccgcaaggaccacaucgaccgggugccccucgagagcgacguggcgcugaagaagaaggagcgcggcacguucgacuaccggaucgacgggaagggcaacaucgucugccgcuggaacgacaacuccguggugaccgucgccagcuccggggccggcauccacccccugugccucgugagccgguacucccagaagcugaagaagaagauccaggugcagcagcccaacaugaucaaggucuacaaccaguucaugggcgggguggaccgcgccgacgagaacaucgacaaguaccgggccagcauccgcggcaagaagugguacuccagcccgcuccuguucugcuucgagcuggugcugcagaacgcguggcagcuccacaagaccuacgacgagaagcccgucgacuuccuggaguuccggcgccggguggugugccacuaccuggagacccacgggcacccgcccgagcccggccagaaggggcgcccccagaagcggaacaucgacucccgcuacgacggcaucaaccacgucaucgugaagcaggggaagcagacccggugcgccgagugccacaagaacacgaccuuccgcugcgagaagugcgacguggcccuccacgucaagugcagcguggaguaccacaccgaguga

SEQ ID NO: 29755 - RNA, 1191 nt, Artificial Sequence
  derived and/or modified sequence opt1 from ERCC8__Homo_sapiens__NP_000073
augcugggcuuccucagcgcccgccagaccgggcuggaggacccccugcggcuccgccgggccgaguccacccgccgggugcugggccuggagcucaacaaggaccgcgacgucgagcggauccacgggggcgggaucaacacgcuggacaucgagccgguggagggccgcuacaugcugagcggcggguccgacggcgugaucguccucuacgaccuggagaacagcucccggcagagcuacuacacgugcaaggcggugugcuccaucgggcgcgaccaccccgacgugcaccgguacagcgucgagaccgugcagugguacccccacgacaccggcauguucaccuccagcuccuucgacaagacccugaaggugugggacaccaacacccuccagacggccgacgucuucaacuucgaggagaccguguacagccaccacaugucccccgugagcaccaagcacugccuggucgccguggggacccgcggcccgaaggugcagcugugcgaccucaaguccggcagcugcucccacauccugcaggggcaccggcaggagauccuggccgucagcuggagcccccgcuacgacuacauccucgccacggcgagcgccgacagccgggugaagcugugggacgugcgccgggccuccggcugccugaucacccucgaccagcacaacgggaagaagucccaggccgucgaguccgcgaacaccgcccacaacggcaaggugaacggccugugcuucaccagcgacgggcugcaccuccugacggugggcaccgacaaccgcaugcggcuguggaacuccagcaacggggagaacacccucgucaacuacggcaaggugugcaacaacuccaagaaggggcugaaguucaccgugagcugcggcugcuccagcgaguucgucuucgugcccuacggcuccacgaucgccgucuacaccguguacagcggggagcagaucaccaugcugaagggccacuacaagaccguggacugcugcgucuuccaguccaacuuccaggagcucuacagcgggucccgcgacugcaacauccuggccugggugcccagccuguacgagccggugcccgacgacgacgagacgaccaccaagucccagcucaaccccgccuucgaggacgcguggagcuccagcgacgaggagggcuga

SEQ ID NO: 29756 - RNA, 510 nt, Artificial Sequence
  derived and/or modified sequence opt1 from EREG__Homo_sapiens__NP_001423
augaccgccggccgccggauggagaugcugugcgccgggcgcgugcccgcgcuccugcugugccucggcuuccaccuccugcaggccguccugagcaccacggugaucccguccugcauccccggggagagcuccgacaacugcaccgcccuggugcagaccgaggacaacccccgggucgcccaggugagcaucaccaagugcuccagcgacaugaacggcuacugccugcacgggcagugcaucuaccucguggacaugucccagaacuacugccgcugcgaggucggcuacacgggcgugcggugcgagcacuucuuccugaccgugcaccagccccugagcaaggaguacgucgcccucaccgugauccugaucauccuguuccucaucaccguggucggguccacguacuacuucugccgcugguaccggaaccgcaagagcaaggagccgaagaaggaguacgagcgggugaccuccggcgaccccgagcugccccagguguga

SEQ ID NO: 29757 - RNA, 1422 nt, Artificial Sequence
  derived and/or modified sequence opt1 from ERF__Homo_sapiens__NP_001287964
augaacuacgacaagcugagccgcgcccuccgguacuacuacaacaagcgcauccugcacaagaccaagggcaagcgguucaccuacaaguucaacuucaacaagcuggugcucgucaacuaccccuucaucgacguggggcuggccggcggggcggugccccaguccgccccgcccguccccagcggcgggucccacuuccgcuucccgcccagcacccccuccgaggugcugagccccaccgaggacccccgguccccgcccgccugcagcuccagcuccagcucccucuucagcgccguggucgcccgccggcugggccgcggcuccgugagcgacugcuccgacgggaccagcgagcuggaggagccccucggcgaggacccccgggcgcgcccgcccgggccgcccgaccugggcgccuuccgggggccgccccuggcccgccucccccacgaccccggcguguuccgggucuacccccgcccccggggcgggcccgagccccugucccccuuccccgugagcccccuggccggcccggggagccuccugccgccccagcugucccccgcgcuccccaugacccccacgcaccuggccuacacccccagcccgacccugucccccauguaccccagcggcggcgggggccccuccgggagcggcgggggcucccacuucagcuucuccccggaggacaugaagcgcuaccuccaggcccacacccagagcguguacaacuaccaccugagcccccgggccuuccugcacuaccccggccucgucgugccccagccgcagcgccccgacaagugcccccugcccccgauggcccccgagacgccgcccgugcccuccuccgcgagcuccagcuccagcuccagcagcucccccuucaaguucaagcugcagccgccgccccucgggcggcgccagcgggccgccggcgagaaggccgucgccggggcggacaagagcggcggguccgccggcggccuggccgagggggccggcgcccuggcgccgcccccgcccccgccccagaucaagguggagcccaucagcgagggggaguccgaggagguggaggucaccgacaucagcgacgaggacgaggaggacggcgagguguucaagacgccccgcgccccgcccgccccgcccaagcccgagcccggggaggcccccggcgccucccagugcaugccccucaagcugcgcuucaagcggcgcuggagcgaggacugccggcuggagggcgggggcgggcccgcgggcggcuucgaggacgagggggaggacaagaaggugcgcggcgaggggcccggcgaggccgggggcccccucacgccccggcgcgucuccagcgaccugcagcacgccaccgcccagcugucccucgagcaccgggacagcuga

SEQ ID NO: 29758 - RNA, 1461 nt, Artificial Sequence
  derived and/or modified sequence opt1 from ERG__Homo_sapiens__NP_001129626
augauccagaccgugcccgacccggccgcccacaucaaggaggcgcugagcgucguguccgaggaccagagccucuucgagugcgccuacggcacgccccaccuggccaagaccgagaugaccgccuccagcuccagcgacuacgggcagaccuccaagaugagcccccgcgugccccagcaggacuggcugucccagccgcccgcccgggucaccaucaagauggagugcaaccccagccaggugaacggcucccgcaacagccccgacgagugcuccguggcgaagggcgggaagauggucgggagcccggacacggugggcaugaacuacggcuccuacauggaggagaagcacaugcccccgcccaacaugaccaccaacgagcggcgcgugaucguccccgccgaccccacccucuggagcacggaccacgugcggcaguggcuggagugggccgugaaggaguacgggcugcccgacgucaacauccuccuguuccagaacaucgacggcaaggagcugugcaagaugaccaaggacgacuuccagcgccucacccccuccuacaacgccgacauccugcugagccaccuccacuaccugcgggagaccccgcugccccaccucacguccgacgacguggacaaggcgcugcagaacagcccccgccugaugcacgcccggaacaccgggggcgccgccuucaucuuccccaacaccagcguguacccggaggccacccagcgcaucacgacccggcccgaccuccccuacgagcccccgcgccgguccgcguggaccgggcacggccaccccacgccccagagcaaggccgcccagcccuccccgagcaccguccccaagaccgaggaccagcgcccccagcuggacccguaccagauccugggccccaccuccagccggcucgccaaccccggguccggccagauccagcuguggcaguuccugcucgagcugcugagcgacuccagcaacuccagcugcaucaccugggaggggacgaacggcgaguucaagaugaccgaccccgacgagguggcccgccgguggggcgagcgcaaguccaagccgaacaugaacuacgacaagcucagccgggcgcugcgcuacuacuacgacaagaacaucaugaccaaggugcacgggaagcgguacgccuacaaguucgacuuccacggcaucgcccaggcccugcagccccacccgcccgaguccagccucuacaaguaccccuccgaccugcccuacauggggagcuaccacgcccacccccagaagaugaacuucgucgcgccccacccgcccgcccugcccgugaccuccagcagcuucuucgccgcccccaacccguacuggaacucccccacgggcgggaucuaccccaacacccgccuccccaccagccacaugccgucccaccugggcaccuacuacuga

SEQ ID NO: 29759 - RNA, 873 nt, Artificial Sequence
  derived and/or modified sequence opt1 from ERGIC1__Homo_sapiens__NP_001026881
augcccuucgacuuccgccgguucgacaucuaccgcaaggugccgaaggaccugacccagcccaccuacacgggcgccaucaucagcaucugcugcugccucuucauccuguuccuguuccucuccgagcugaccggguucaucaccaccgaggucgugaacgagcuguacguggacgaccccgacaaggacagcggcgggaagaucgacgucucccucaacaucagccugcccaaccugcacugcgagcucgugggccuggacauccaggacgagauggggcggcacgaggugggccacaucgacaacuccaugaagaucccgcugaacaacggcgccgggugccgcuucgagggccaguucagcaucaacaagguccccgggaacuuccacguguccacgcacagcgcgaccgcccagccccagaaccccgacaugacccacgugauccacaagcucuccuucggcgacacccugcagguccagaacauccacggggccuucaacgcccugggcggcgccgaccggcucacgagcaacccgcuggcgucccacgacuacauccugaagaucgugcccaccguguacgaggacaagagcgggaagcagcgcuacuccuaccaguacaccgucgccaacaaggaguacguggccuacagccacaccggccggaucauccccgccaucugguuccgcuacgaccucucccccaucacggugaaguacaccgagcggcgccagccgcuguaccgguucaucaccaccaucugcgcgaucaucgggggcacguucaccgucgccggcauccuggacagcugcaucuucaccgccuccgaggccuggaagaagauccagcucgggaagaugcacuga

SEQ ID NO: 29760 - RNA, 1134 nt, Artificial Sequence
  derived and/or modified sequence opt1 from ERGIC2__Homo_sapiens__NP_057654
augcgccggcugaaccgcaagaagacccucagccuggugaaggagcuggacgccuuccccaaggucccggaguccuacguggagaccagcgccuccggcgggacggugagccucaucgcguucaccaccauggcccugcugaccaucauggaguucuccgucuaccaggacacguggaugaaguacgaguacgagguggacaaggacuucagcuccaagcuccggaucaacaucgacaucaccguggccaugaagugccaguacgucggcgccgacgugcuggaccuggccgagaccaugguggcgagcgccgacgggcucgucuacgagcccaccguguucgaccugagcccccagcagaaggaguggcagcgcaugcugcagcucauccagucccggcugcaggaggagcacucccugcaggacgugaucuucaagagcgccuucaaguccacgagcaccgcccugcccccgcgcgaggacgacuccagccagucccccaacgcgugccggauccacggccaccuguacgucaacaagguggccgggaacuuccacaucaccgugggcaaggccaucccccacccccgcggccacgcccaccuggccgcgcucgucaaccacgagagcuacaacuucucccaccggaucgaccaccugagcuucggggagcuggugccggccaucaucaacccccucgacggcaccgagaagaucgccaucgaccacaaccagauguuccaguacuucaucacggugguccccaccaagcugcacaccuacaagaucagcgccgacacccaccaguucuccgugacggagcgcgagcggaucaucaaccacgccgcggggagccacggcguguccgggaucuucaugaaguacgaccugagcucccucauggucaccgugaccgaggagcacaugcccuucuggcaguucuucgugcgccugugcggcaucgucggcgggaucuucagcaccacgggcaugcugcacgggaucggcaaguucaucguggagaucaucugcugccgguuccgccucggcuccuacaagccggucaacagcgugcccuucgaggacgggcacaccgacaaccaccucccccugcucgagaacaacacccacuga

SEQ ID NO: 29761 - RNA, 1152 nt, Artificial Sequence
  derived and/or modified sequence opt1 from ERGIC3__Homo_sapiens__NP_057050
auggaggcccugggcaagcucaagcaguucgacgccuaccccaagacccuggaggacuuccgcgugaagaccugcgggggcgcgacggucaccaucgugagcgggcugcucaugcugcuccucuuccuguccgagcugcaguacuaccucaccaccgaggugcacccggagcuguacgucgacaagagccggggcgacaagcugaagaucaacaucgacgugcuguucccccacaugcccugcgccuaccuguccaucgacgccauggacguggccggggagcagcagcuggacgucgagcacaaccucuucaagcagcgccuggacaaggacggcauccccgugagcuccgaggccgagcggcacgagcugggcaagguggaggucacgguguucgacccggacagccucgaccccgaccgcugcgaguccugcuacggggcggaggccgaggacaucaagugcugcaacacgugcgaggacgugcgggaggccuaccgccggcgcggcugggccuucaagaaccccgacaccaucgagcagugccggcgcgagggguucagccagaagaugcaggagcagaagaacgagggcugccaggucuacggguuccuggaggugaacaagguggcgggcaacuuccacuucgcccccggcaaguccuuccagcagagccacguccacgugcacgaccugcaguccuucgggcucgacaacaucaacaugacccacuacauccagcaccugagcuucggcgaggacuacccggggaucgugaacccccuggaccacaccaacgucaccgcgccccaggccuccaugauguuccaguacuucgugaaggugguccccaccguguacaugaagguggacggcgagguccuccggaccaaccaguucagcgugacgcgccacgagaaggucgccaacggccugcugggggaccagggccucccggggguguucgugcuguacgagcugucccccaugauggucaagcucaccgagaagcaccggagcuucacccacuuccugaccggcgugugcgccaucaucgggggcauguucacgguggccggccugaucgacucccucaucuaccacagcgcccgcgccauccagaagaagaucgaccuggggaagaccaccuga

SEQ ID NO: 29762 - RNA, 780 nt, Artificial Sequence
  derived and/or modified sequence opt1 from ERI3__Homo_sapiens__NP_001288628
augcuggcgccccuccagaccggcgccgcccgcuucagcuccuaccugcugagccgggcccgcaaggugcucgggucccaccuguucagcccgugcggcguccccgaguucugcuccaucagcacccggaagcuggccgcccacggguucggcgccuccauggcggccauggugagcuucccgccccagcgcuaccacuacuuccucgugcuggacuucgaggccacgugcgacaagccccagauccacccccaggagaucaucgaguuccccauccugaagcucaacgggcggaccauggagaucgaguccaccuuccacauguacguccagcccguggugcacccgcagcugacccccuucugcacggagcugaccggcaucauccaggccauggucgacggccagcccagccuccagcagguccuggagcgcguggacgaguggauggcgaaggaggggcugcucgaccccaacgugaaguccaucuucgugaccugcggcgacugggaccugaaggugaugcugccggggcagugccaguaccucggccugcccgucgccgacuacuucaagcaguggaucaaccugaagaaggccuacagcuucgccauggggugcuggcccaagaacggccuccuggacaugaacaagggccugucccuccagcacaucgggcggccccacagcggcaucgacgacugcaagaacaucgccaacaucaugaagacccuggcguaccgcggguucaucuucaagcagacguccaagccguucuga

SEQ ID NO: 29763 - RNA, 171 nt, Artificial Sequence
  derived and/or modified sequence opt1 from ERICH5__Homo_sapiens__NP_001164277
augggcugcagcuccagcgcccugaacaaggccggggacuccagccgcuuccccuccggcgagaccggggagaagguggagaccgacauggagaacgagaaggucagcgagggcgcggagacgaaggaggaggagaccggggaggugguggaccucuccgccgccaccuga

SEQ ID NO: 29764 - RNA, 2091 nt, Artificial Sequence
  derived and/or modified sequence opt1 from ERICH6B__Homo_sapiens__NP_872348
augagcgccgagaacaaccagcuguccggcgccagcccgccccacccgcccaccacgccccaguacuccacccagaaccuccccagcgagaaggaggacaccgagguggagcuggacgaggagucccugcaggacgagagccccuucucccccgagggggagagccucgaggacaaggaguaccuggaggaggaggaggaccuggaggaggaggaguaccucggcaaggaggaguaccugaaggaggaggaguaccuggggaaggaggagcaccucgaggaggaggaguaccuggagaaggcgggcuaccuggaggaggaggaguacaucgaggaggaggaguaccucgggaaggagggcuaccuggaggaggaggaguaccugggcaaggaggagcaccucgaggaggaggaguaccuggggaaggagggcuaccuggagaaggaggacuacaucgaggaggucgacuaccucgggaagaaggccuaccuggaggaggaggaguaccugggcaagaaguccuaccucgaggaggagaaggcccuggagaaggaggagaaccuggaggaggaggaggcccucgagaaggaggagaaccuggacgggaaggagaaccuguacaagaaguaccucaaggagcccaaggccagcuacuccagccagaccaugcugcugcgcgacgcgcgguccccggacgccggccccagccaggugaccacguuccucaccgugccccugaccuucgccacccccuccccggucagcgaguccgccacggagagcuccgagcugcuccugacccuguaccgccggagccaggcgagccagaccgacuggugcuacgaccgcaccgccgugaagucccucaagagcaaguccgagacggagcaggagaccaccaccaagcuggcccccgaggagcacgugaacacgaagguccagcagaagaaggaggagaacgugcuggaguucgccagcaaggagaacuucugggacggcaucaccgacgaguccaucgacaagcucgagguggaggaccuggacgagaacuuccugaacagcuccuaccagaccgucuucaagaccaucaucaaggagauggccgcgcacaacgagcucgaggaggacuucgacaucccccugacgaagcugcucgagagcgagaaccgguggaagcuggugaucaugcugaagaagaacuacgagaaguucaaggagaccauccuccgcaucaagcggcgccgggaggcccagaagcugaccgagaugaccuccuucacguuccaccugaugagcaagcccaccccggagaagcccgagaccgaggagauccagaagccccagcgcgugguccaccaccggaagaagcuggagcgcgacaaggaguggauccagaagaagaccguggugcaccagggggacggcaagcucauccuguaccccaacaagaacgucuaccagauccuguucccggacgggacgggccagauccacuaccccuccggcaaccucgccaugcugauccuguacgccaagaugaagaaguucaccuacaucauccucgaggacagccuggaggggcggauccgcgcccugaucaacaacuccggcaacgcgaccuucuacgacgagaacagcgacaucuggcucaaccuguccagcaaccugggguacuacuuccccaaggacaagcggcagaaggccuggaacugguggaaccucaacauccacgugcacgcgcccccggugcagcccaucucccugaagaucaacgaguacauccagguccagauccgcagccaggacaagaucaucuucugcuucaccuacgagcagaagcagaucugccugaaccucggcacgcgguacaaguucgugauccccgaggugcuguccgagaugaagaagaagaccauccuggaggccgagcccgggccgaccgcccagaagauccgcguccuccugggcaagaugaaccggcugcucaacuacgccaccacgcccgaccuggagaacuucaucgaggccgugagcaucagccugauggacaacaaguaccucaagaagaugcuguccaagcugugguucuga

SEQ ID NO: 29765 - RNA, 1374 nt, Artificial Sequence
  derived and/or modified sequence opt1 from ERLEC1__Homo_sapiens__NP_001120869
auggaggagggcgggggcggggugcgcagccugguccccggcgggccggugcuccuggugcugugcggccuccuggaggccuccggcgggggccgggcccugccccagcucagcgacgacauccccuuccgcgucaacuggcccgggaccgaguucucccugccgaccacgggcgugcuguacaaggaggacaacuacgugaucaugaccaccgcgcacaaggagaaguacaagugcauccucccccuggucaccagcggggacgaggaggaggagaaggacuacaagggccccaacccccgggagcugcucgagccgcuguucaagcaguccagcugcuccuaccgcaucgagagcuacuggacguacgaggugugccacggcaagcacauccggcaguaccacgaggagaaggagaccgggcagaagaucaacauccacgaguacuaccugggcaacaugcucgccaagaaccugcuguucgagaaggagcgcgaggccgaggagaaggagaaguccaacgagauccccaccaagaacaucgaggggcagaugacccccuacuaccccgugggcaugggcaacgggacgccgugcagccucaagcagaaccggccccgcuccagcaccgucauguacaucugccaccccgaguccaagcacgagauccugagcguggccgaggugacgaccugcgaguacgaggucgugauccugacgccccuccugugcucccacccgaaguaccgguuccgcgccagccccgugaacgacaucuucugccagucccugcccggcagccccuucaagccgcucacccugcggcagcuggagcagcaggaggagauccuccgcguccccuuccggcgcaacaaggaggaggaccugcaguccaccaaggaggagcgguuccccgcgauccacaagagcaucgccaucgggagccagcccgugcugaccgugggcaccacccacaucuccaagcucaccgacgaccagcugaucaaggaguuccugagcggguccuacugcuuccgcggcggcgucgggugguggaaguacgaguucugcuacggcaagcacgugcaccaguaccacgaggacaaggacagcgggaagaccuccguggucgugggcacguggaaccaggaggagcacaucgagugggccaagaagaacaccgcccgggcguaccaccuccaggacgacgggacccagaccgugcgcugcaaggagagcgacuccccgcacgccgucacgguguacaugcuggagccccacagcugccaguacauccugggcgucgagucccccgugaucugcaagauccucgacaccgccgacgagaacggccugcugagccuccccaacuga

SEQ ID NO: 29766 - RNA, 1047 nt, Artificial Sequence
  derived and/or modified sequence opt1 from ERLIN1__Homo_sapiens__XP_005269499
augaacaugacccaggcccgcgugcuggucgccgcgguggugggccucgucgccgugcugcuguacgccagcauccacaagaucgaggaggggcaccucgccguguacuaccggggcggggcccugcugaccucccccagcggcccgggguaccacaucaugcuccccuucaucacgaccuuccgcuccguccagaccacccugcagacggacgaggugaagaacgugcccugcggcaccagcggcggggucaugaucuacaucgaccggaucgagguggugaacaugcuggcgcccuacgccgucuucgacaucgugcgcaacuacaccgccgacuacgacaagacccucaucuucaacaagauccaccacgagcugaaccaguucugcuccgcccacacgcugcaggagguguacaucgagcuguucgaccagaucgacgagaaccucaagcaggcgcugcagaaggaccucaaccugauggccccgggccugaccauccaggccguccgggugaccaagcccaagauccccgaggccauccgccggaacuucgagcucauggaggccgagaagaccaagcugcugaucgcggcccagaagcagaagguggucgagaaggaggccgagacggagcgcaagaaggccgugaucgaggccgagaagaucgcccagguggcgaagauccgguuccagcagaaggucauggagaaggagaccgagaagcgcaucagcgagaucgaggacgccgccuuccucgcccgggagaaggcgaaggccgacgccgaguacuacgccgcccacaaguacgcgaccuccaacaagcacaagcugacccccgaguaccuggagcucaagaaguaccaggccaucgccagcaacuccaagaucuacuucgggagcaacaucccgaacauguucguggacuccagcugcgcccugaaguacuccgacauccgcacgggccgggagagcucccugcccagcaaggaggcgcucgagcccuccggggagaacgugauccagaacaaggagagcaccggcuga

SEQ ID NO: 29767 - RNA, 459 nt, Artificial Sequence
  derived and/or modified sequence opt1 from ERLIN2__Homo_sapiens__NP_001003791
auggcccagcugggcgccguggucgcgguggccagcuccuucuucugcgccagccucuucuccgccgugcacaagaucgaggaggggcacaucggcgucuacuaccgcgggggcgcccugcugaccagcaccuccgggcccggcuuccaccucaugcugccguucaucacgagcuacaaguccgugcagaccacccugcagaccgacgaggugaagaacguccccugcggcacgagcgggggcgugaugaucuacuucgaccggaucgagguggucaacuuccucgugcccaacgcgguguacgacaucgucaagaacuacaccgccgacuacgacaaggcccugaucuucaacaagauccaccacgagcugaaccaguucugcuccgugcacacccuccaggagguguacaucgagcuguucgggcuggagaacgacuucagccaggaguccagcuga

SEQ ID NO: 29768 - RNA, 1428 nt, Artificial Sequence
  derived and/or modified sequence opt1 from ERMAP__Homo_sapiens__XP_011538872
auggagauggccagcuccgccggcagcuggcuguccgggugccucaucccccugguguuccugcgccucagcguccacguguccggccacgcgggggacgccggcaaguuccacguggcccugcucgggggcaccgccgagcugcugugcccgcugagccucuggcccggcaccguccccaaggaggugcgguggcugcgcucccccuucccgcagcggagccaggccgugcacaucuuccgcgacgggaaggaccaggacgaggaccugaugcccgaguacaagggccggacgguccucgugcgcgacgcgcaggagggguccgugacccugcagauccuggacguccggcucgaggaccagggcagcuaccgcugccugauccagguggggaaccuguccaaggaggacaccgugauccuccaggucgccgcccccagcgugggcucccugagccccuccgccguggcgcuggccgucauccucccggugcuggugcugcucaucauggucugccugugccugaucuggaagcagcggcgcgccaaggagaagcuccuguacgagcacgugaccgagguggacaaccugcucagcgaccacgccaaggagaagggcaagcugcacaaggccgucaagaagcugcgguccgagcucaagcugaagcgcgcggccgccaacagcggguggcggcgcgcccggcugcacuucguggccgugacgcucgaccccgacaccgcgcaccccaagcugauccuguccgaggaccagcgcugcguccggcucggcgaccgccggcagcccgugccggacaacccccagcgcuucgacuucgucgugagcauccuggggagcgaguacuucaccaccggcugccacuacugggagguguacgucggcgacaagacgaaguggauccugggggugugcuccgagagcgugucccggaagggcaaggucaccgccagccccgccaacgggcacuggcuccugcgccagucccgcggcaacgaguacgaggcccugaccagcccccagaccuccuuccggcucaaggagccgccccgcugcguggggaucuuccuggacuacgaggccggcgugaucagcuucuacaacgucacgaacaagucccacaucuucaccuucacccacaacuucagcggcccccugcggcccuucuucgagccgugccuccacgacgggggcaagaacaccgcgccccuggugaucugcuccgagcugcacaagagcgaggaguccaucgugccccgccccgaggggaagggccacgccaacggggacgucagccugaaggugaacuccagccuccugccgcccaaggcccccgagcugaaggacaucauccucucccugcccccggaccugggccccgcccuccaggagcugaaggcccccagcuucuga

SEQ ID NO: 29769 - RNA, 1896 nt, Artificial Sequence
  derived and/or modified sequence opt1 from ERMARD__Homo_sapiens__NP_001265460
auggaggugcugaucggcgaccccaucacgaccugccucagcccguccgucuacgacaucaucugcaaccugggguuccagcugcgcgagaacugcgacaucaacagcaucgugacccagaacggcgaggugugcuggaagaccaucaccgacugcgucuccuacaccgagagcgagcaggggcucgacuacuggggcuccgugcggcugcuggggcccgugugcgaggccguccacagccacuuccucucccugacgaagggccaguucgagauccgcuacgcccccugguuccaguggaccagcuuccccgagcuguucccggagaucuucgacgcgcucgagucccugcagagccccgccaucucccugagccucaugaagcugaccuccugccuggagcgggcccucggcgacguguuccugcugaucgggaaggagugccccuuccuccugcgcgaccugcucagcuccgaggagcuggcccagguguucagccaguccgucaugaacgugcugaagguguucgucggcagccccugcgggcucaaccugcggaacgugcuguggcacggcuucgccuccccggaggagaucccgcccaaguacugcagcaugaugauccuccugaccgcggggcugggccagcuccucaagagcuaccugcagaacacgaagcugacccuggcccaccgcuccuucaucagccugaccaaccucgaggaccugaucguguuccccgacgucaccuacgaggugcuguccgugcucgaggaggucaugaugaaguccgccuucauccugaagaucaugcugcccuacugggagguggcccucgugaaguucaagagccaccgguucgcggacugcgccauccugcugcucacgcagcuggagaccggccugcgcaacgucuucgccacccucaaccggugccccaagcgccugcugaccgccgagagcacggcccuguacaccaccuucgaccagauccucgcgaagcaccugaacgacgggaagaucaaccagcugccccucuuccugggcgagcccgccauggaguuccugugggacuuccucaaccaccaggaggggccgcggauccgcgaccaccugucccacggcgagaucaaccugcacgaguucagcaaggagaccacgaaccagcuccuggccuucucccuggugcuccugcugcgguucguggacgacugccuccugagcgucuucaaggagaaguccgccguggagcugcucaucagccuggccgagggcuacuccagccgcugccaccccgucuuccagcugaagaagcagguccucuccugcgaggagagcauccgggugugggcgcugcugcccuuccccgaggagcucacccgccaggccgugcggcuggaggacaacuccgagaccaacgccugccacagccugaucaccaagaugacggacgagcucuaccaccacaugccggagaaccgcugcgugcugaaggaccuggaccggcuccccaccgagacccccaccuccgacacgccccuggcccuggccccgcgcaagccccagcccugccggugccgccgccgggugcgccccagcauccggcuccugagcccgguccugucccucauccugcugcucaucgcgcuggagcuggugaacauccacgccgugugcgggaagaacgcccacgaguaccagcaguaccucaaguucgucaagagcauccugcaguacaccgagaaccugguggccuacaccuccuacgagaagaacaaguggaacgagaccaucaaccucacgcacaccgcccugcugaagauguggaccuucagcgagaagaagcagaugcucauccaccuggcgaagaaguccaccagcaaggugcugcucuga

SEQ ID NO: 29770 - RNA, 2715 nt, Artificial Sequence
  derived and/or modified sequence opt1 from ERMP1__Homo_sapiens__NP_079172
auggaguggggcagcgaguccgccgccgugcgccggcaccgcgucgggguggagcggcgcgagggcgcggccgccgcgcccccgcccgagcgggaggcccgcgcccaggagccccugguggacgggugcagcggcgggggccggacccgcaagcggucccccggcgggagcggcggggccucccgcggcgccgggaccggccucagcgagguccgggccgcgcugggccuggcccucuaccugaucgcccugcgcacgcucgugcagcugucccugcagcagcucgugcugcggggcgccgccgggcaccgcggggaguucgacgcgcugcaggcccgggacuaccucgagcacaucaccagcaucggcccgcgcaccaccggcucccccgagaacgagauccugacgguccacuaccugcucgagcagaucaagcugaucgaggugcagagcaacucccugcacaagaucagcguggacguccagcggcccaccggguccuucagcaucgacuuccucggcggguucaccuccuacuacgacaacaucaccaacgugguggucaagcuggagccccgcgacggcgcccagcacgccgugcuggccaacugccacuucgacagcguggcgaacuccccgggggccagcgacgacgccgucuccugcagcgugaugcucgaggugcugcggguccugagcacguccagcgaggcccuccaccacgccgugaucuuccuguucaacggcgcggaggagaacgugcugcaggccucccacggcuucaucacccagcaccccugggccagccucauccgcgccuucaucaaccuggaggccgcgggggucggcgggaaggagcugguguuccagaccggccccgagaaccccuggcucgugcaggccuacgucuccgccgccaagcacccguucgcgagcguggucgcccaggagguguuccaguccgggaucauccccagcgacaccgacuuccggaucuaccgcgacuucggcaacauccccggcaucgaccuggccuucaucgagaacggguacaucuaccacacgaaguacgacaccgccgaccgcauccugaccgacuccauccagcgggccggcgacaacauccucgcggugcugaagcaccuggccaccagcgacaugcucgccgccgccuccaaguaccgccacgggaacauggucuucuucgacgugcugggccuguucgugaucgcguaccccagccggaucggguccaucaucaacuacauggucgugaugggcgugguccucuaccugggcaagaaguuccugcagccgaagcacaagacggggaacuacaagaaggacuuccucugcggccuggggaucacccugaucagcugguucaccucccucgugaccgugcugaucaucgccgucuucaucagccugaucggccagucccucagcugguacaaccacuucuacguguccgugugccuguacggcacggccaccgucgccaagaucauccugauccacacccuggccaagcgcuucuacuacaugaacgcgagcgcccaguaccucggggagguguucuucgacaucagccuguucgugcacugcugcuuccuggucacccucacguaccagggccugugcuccgccuucaucagcgccguguggguggcguucccccugcucaccaagcugugcguccacaaggacuucaagcagcacggggcccagggcaaguucaucgccuucuaccugcucgggauguucauccccuaccuguacgcccuguaccucaucugggccguguucgagauguucacccccauccugggccgguccggcagcgagaucccgcccgacgugguccuggcguccauccucgccgggugcaccaugauccugagcuccuacuucaucaacuucaucuaccuggccaagagcacgaagaagaccaugcucacccugacccuggugugcgccaucacguuccuccuggugugcuccggcaccuucuuccccuacagcuccaaccccgccaacccgaagcccaagcgcgucuuccugcagcacaugacccggaccuuccacgaccucgaggggaacgcggugaagcgcgacagcggcaucuggaucaacggguucgacuacacgggcaucucccacaucacgccccacauccccgagaucaacgacagcauccgggcccacugcgaggagaacgccccgcugugcggcuuccccugguaccugcccgugcacuuccucauccgcaagaacugguaccugccggcccccgaggucagcccccggaacccgccccacuuccgccugaucuccaaggagcagacccccugggacuccaucaagcucaccuucgaggccaccgggcccagccacaugagcuucuacgugcgggcgcacaagggcuccacccugagccaguggucccuggggaacggcacccccgugaccagcaagggcggggacuacuucgucuucuacucccacggccuccaggccagcgccuggcaguucuggaucgagguccagguguccgaggagcacccggaggggauggugaccguggccaucgcggcccacuaccugagcggcgaggacaagcgcagcccccagcuggacgcccucaaggagaaguuccccgacuggacguuccccuccgccugggugugcaccuacgaccuguucgucuucuga

SEQ ID NO: 29771 - RNA, 2934 nt, Artificial Sequence
  derived and/or modified sequence opt1 from ERN1__Homo_sapiens__NP_001424
augcccgcccgccggcugcuccugcugcucacccugcugcuccccggccuggggaucuucggcagcaccuccacggugacccugcccgagacccuccuguucgucagcacccuggacgggucccuccacgccgugagcaagcgcacgggcuccaucaaguggacccugaaggaggaccccgugcugcagguccccacccacguggaggagccggcguuccuccccgaccccaacgacgggagccuguacacccugggcuccaagaacaacgagggccucacgaagcugcccuucaccaucccggagcuggugcaggccagccccugccgguccagcgacgggauccucuacaugggcaagaagcaggacaucugguacgucaucgaccugcugaccggggagaagcagcagacccucuccagcgccuucgccgacucccugugccccagcacgucccugcucuaccugggccgcaccgaguacaccaucaccauguacgacacgaagacccgggagcugcgcuggaacgccaccuacuucgacuacgcggccagccuccccgaggacgacguggacuacaagaugucccacuucgugagcaacggggacggccuggucgugaccguggacuccgagagcggcgacguccuguggauccagaacuacgccagcccggugguggccuucuacgucuggcagcgggaggggcuccgcaaggugaugcacaucaacguggcggucgagacgcugcgguaccugaccuucauguccggcgagguggggcgcaucaccaaguggaaguaccccuuccccaaggagaccgaggccaagagcaagcucacgcccacccuguacgugggcaaguacuccaccagccuguacgccuccccgagcaugguccacgagggcguggccguggucccccggggguccacccucccccugcuggagggcccccagacggacggggugaccaucggcgacaagggggagugcgucaucaccccgagcaccgacgugaaguucgaccccggccucaaguccaagaacaagcugaacuaccugcgcaacuacuggcuccugaucggccaccacgagacgccccugagcgccuccaccaagaugcucgagcgguuccccaacaaccugccgaagcaccgcgagaacgugauccccgcggacagcgagaagaaguccuucgaggaggucaucaaccugguggaccagaccagcgagaacgcccccaccacggugucccgggacgucgaggagaagcccgcccacgccccggcccgccccgaggcgcccguggacagcaugcugaaggacauggccaccaucauccucuccaccuuccugcugaucggguggguggccuucaucaucaccuacccgcucagcaugcaccagcagcagcagcugcagcaccagcaguuccagaaggagcuggagaagauccagcuccugcagcagcagcagcagcagcugcccuuccacccgcccggcgacaccgcccaggacggggagcuccuggacacguccggccccuacagcgagagcuccgggaccagcucccccagcaccagcccccgggccuccaaccacucccugugcagcggcuccagcgcguccaaggccggcagcucccccagccucgagcaggacgacggggacgaggagaccuccgucgugaucgugggcaagaucagcuucugcccgaaggacguccuggggcacggcgccgaggggacgaucguguaccgcggcauguucgacaaccgggacguggccgucaagcgcauccugcccgagugcuucuccuucgccgaccgggaggugcagcuccugcgcgagagcgacgagcaccccaacgugauccgcuacuucugcaccgagaaggaccggcaguuccaguacaucgcgaucgagcugugcgccgccacccuccaggaguacgucgagcagaaggacuucgcccaccugggccuggagcccaucacccuccugcagcagacgaccagcgggcuggcgcaccuccacucccugaacaucgugcaccgcgaccugaagccgcacaacauccucaucagcaugcccaacgcccacggcaagaucaaggccaugaucuccgacuucgggcugugcaagaagcuggccgugggccggcacagcuucucccgccggagcggcguccccgggaccgagggcuggaucgcccccgagaugcucuccgaggacugcaaggagaacccgaccuacacgguggacaucuucagcgcggggugcguguucuacuacgucaucuccgagggcagccaccccuucgggaagucccugcagcgccaggccaacauccugcucggcgccugcagccuggacugccugcaccccgagaagcacgaggacgugaucgcccgggagcucaucgagaagaugaucgccauggacccccagaagcgcccguccgcgaagcacgugcugaagcaccccuucuucuggagccuggagaagcagcuccaguucuuccaggacgucuccgaccggaucgagaaggagagccuggacggccccaucgugaagcagcuggagcgcgggggccgggccguggucaagauggacuggcgcgagaacaucaccgugccccuccagaccgaccugcggaaguuccgcaccuacaagggcggguccgugcgggaccugcuccgcgccaugcggaacaagaagcaccacuaccgcgagcugccggccgagguccgggagacgcuggggagccuccccgacgacuucgugugcuacuucaccucccgcuucccccaccuccuggcccacaccuaccgcgcgauggagcugugcagccacgagcggcuguuccagccguacuacuuccacgagccgcccgagccccagccgcccgugacccccgacgcccuguga

SEQ ID NO: 29772 - RNA, 2781 nt, Artificial Sequence
  derived and/or modified sequence opt1 from ERN2__Homo_sapiens__NP_150296
auggccagcgccgugcgcggcucccggcccuggccgcgccuggggcuccagcugcaguucgcggcccugcuccugggcacccugagcccccagguccacacccuccggcccgagaaccugcugcucguguccacgcuggacgggagccugcacgcccucuccaagcagaccggcgaccugaaguggacccugcgcgacgaccccgugaucgaggggccgauguacgucaccgagauggccuuccucagcgaccccgccgacggcucccuguacauccugggcacgcagaagcagcaggggcucaugaagcugcccuucaccauccccgagcuggugcacgcgagcccgugccgguccagcgacggcguguucuacaccgggcgcaagcaggacgccugguucgucguggaccccgaguccggcgagacccagaugacgcucaccaccgaggggcccagcacgccccggcuguacaucggccgcacccaguacaccgugaccaugcacgacccgcgggcccccgcccugcgcuggaacaccacguaccggcgcuacuccgcgccgcccauggacggcagccccgggaaguacaugucccaccucgccagcugcggcauggggcugcugcucaccgucgaccccggcuccggcaccgugcuguggacccaggaccugggggugcccgucaugggcguguacacguggcaccaggacgggcuccggcagcugccccaccugacccucgcccgcgacacccugcacuuccuggcccuccgguggggccacauccgccugccggccagcgggccccgggacaccgcgacgcuguucuccacccucgacacccagcugcugaugacccucuacgugggcaaggacgagacgggcuucuacgucagcaaggcccuggugcacaccgggguggcccuggucccccgcggccucacccuggcccccgccgacgggccgaccacggacgaggugacccuccaggugagcggcgagcgggaggggucccccagcaccgcgguccgcuaccccuccggcagcguggcccugcccucccaguggcugcugaucggccaccacgagcugccgcccgugcuccacaccacgaugcugcggguccaccccacccuggggagcggcaccgccgagacccgcccgcccgagaacacccaggcccccgccuucuuccucgagcugcugucccucagccgcgagaagcugugggacuccgagcugcaccccgaggagaagacgccggacagcuaccucgggcugggcccccaggaccugcucgcggccucccugaccgccgugcugcucgggggcuggauccuguucgucaugcggcagcagcagccccaggugguggagaagcagcaggagacgccccuggccccggccgacuucgcgcacaucagccaggacgcccagucccuccacagcggcgccucccgccggagccagaagcgccugcagucccccagcaagcaggcccagccccuggacgaccccgaggcggagcagcucaccgucguggggaagaucuccuucaacccgaaggacgugcugggccgcggggccggcggcaccuucgucuuccgggggcaguucgagggccgggccguggccgugaagcgccugcuccgggagugcuucgggcugguccgccgggaggugcagcugcuccaggagagcgaccgccaccccaacgugcugcgguacuucugcaccgagcgcggcccccaguuccacuacaucgcccuggagcucugccgggcgagccugcaggaguacgucgagaaccccgaccuggaccgcgggggccucgagccggagguggugcugcagcagcugauguccggccucgcccaccuccacagccugcacaucguccaccgggaccugaagcccgggaacauccugaucaccggccccgacucccaggggcugggccgcguggugcucagcgacuucgggcugugcaagaagcugcccgccggccggugcuccuucagccuccacuccggcaucccggggaccgagggcuggauggcccccgagcugcugcagcuccugccgcccgacagccccacguccgccgucgacaucuucagcgcggggugcguguucuacuacgugcuguccggcgggagccaccccuucggcgacucccucuaccgccaggccaacauccugaccggcgcccccugccuggcccaccucgaggaggagguccacgacaaggugguggcccgcgaccuggucggggcgaugcugagcccgcucccccagccccggcccuccgccccgcagguccuggcccaccccuucuucuggagccgcgccaagcagcugcaguucuuccaggacguguccgacuggcucgagaaggagagcgagcaggagccccuggugcgggcgcuggaggccggcgggugcgccguggugcgcgacaacuggcacgagcacaucagcaugccccuccagaccgaccugcggaaguuccgcuccuacaagggcaccagcguccgggaccugcuccgcgccgugcggaacaagaagcaccacuaccgcgagcugccgguggagguccggcaggcccugggccaggugcccgacggguucgugcaguacuucacgaaccgcuucccccggcuccugcugcacacccaccgcgcgaugcgguccugcgccagcgagucccucuuccugcccuacuacccgcccgacagcgaggcccgccggcccugccccggcgccaccgggcgcuga

SEQ ID NO: 29773 - RNA, 1404 nt, Artificial Sequence
  derived and/or modified sequence opt1 from ERO1LB__Homo_sapiens__NP_063944
augagccagggcgugcgccgggccggggccggccagggggucgcggccgccgugcagcugcucgugacccuguccuuccugcgcagcgucguggaggcccaggugaccggcguccucgacgacugccugugcgacaucgacuccaucgacaacuucaacacguacaagaucuuccccaagaucaagaagcugcaggagcgggacuacuuccgcuacuacaaggugaaccucaagcggccgugccccuucugggccgaggacgggcacugcagcaucaaggacugccacguggagcccugccccgaguccaagaucccggucggcaucaaggcgggccacagcaacaaguaccugaagauggccaacaacaccaaggagcuggaggacugcgagcaggccaacaagcucggggccaucaacuccacccugagcaaccaguccaaggaggcguucaucgacugggcccgcuacgacgacagccgggaccacuucugcgagcuggacgacgagcgcucccccgccgcccaguacguggaccuccugcugaaccccgagcgguacaccggcuacaaggggacgagcgccuggcgcguguggaacuccaucuacgaggagaacugcuucaagccccggagcgucuaccgcccgcucaacccccuggcgcccucccggggcgaggacgacggggagagcuucuacaccuggcuggagggccucugccuggagaagcgcguguucuacaagcugaucuccggccuccacgccagcaucaaccugcaccugugcgccaacuaccuccuggaggagaccugggggaagcccuccuggggcccgaacaucaaggaguucaagcaccgguucgaccccguggagaccaagggggagggcccccgccggcugaagaaccucuacuuccuguaccugaucgagcuccgcgcccugagcaaggucgcccccuacuucgagcggagcaucguggaccuguacacgggcaacgcggaggaggacgccgacaccaagacccuccugcugaacaucuuccaggacaccaaguccuucccgaugcacuucgacgagaaguccauguucgccggggacaagaagggcgccaagagccucaaggaggaguuccgccugcacuucaagaacaucagccggaucauggacugcguggggugcgacaagugccgccuguggggcaagcuccagacgcaggggcugggcaccgcccugaagauccucuucuccgagaaggagauccagaagcugcccgagaacagccccuccaagggcuuccagcugacccgccaggagaucgucgcgcuccugaacgccuucgggcggcugagcaccuccauccgcgaccuccagaacuucaaggugcugcugcagcacagccgguga

SEQ ID NO: 29774 - RNA, 1407 nt, Artificial Sequence
  derived and/or modified sequence opt1 from ERO1L__Homo_sapiens__NP_055399
augggccgcggguggggcuuccuguucgggcuccugggcgccguguggcugcucagcuccgggcacggcgaggagcagcccccggagaccgccgcgcagcggugcuucugccaggucagcggcuaccuggacgacugcacgugcgacguggagaccaucgaccgcuucaacaacuaccggcuguucccccgccuccagaagcugcuggaguccgacuacuuccgguacuacaaggugaaccucaagcgccccugccccuucuggaacgacaucagccagugcgggcggcgcgacugcgccgucaagccgugccaguccgacgaggugcccgacggcaucaagagcgccuccuacaaguacagcgaggaggccaacaaccugaucgaggagugcgagcaggccgagcggcugggggcgguggacgagucccucagcgaggagacccagaaggccguccugcaguggaccaagcacgacgacuccagcgacaacuucugcgaggccgacgacauccagucccccgaggccgaguacguggaccugcuccugaaccccgagcgcuacaccggcuacaaggggccggacgcguggaagaucuggaacgugaucuacgaggagaacugcuucaagccccagacgaucaagcggccccugaacccccucgccagcggccagggcaccuccgaggagaacaccuucuacagcuggcuggaggggcugugcgucgagaagcgcgccuucuaccggcucaucuccggccugcacgccagcaucaacgugcaccuguccgcccgcuaccuccugcaggagaccuggcuggagaagaagugggggcacaacaucacggaguuccagcagcgguucgacggcauccucaccgagggcgaggggccgcgccggcugaagaaccuguacuuccucuaccugaucgagcugcgcgcgcucagcaaggugcugcccuucuucgagcggcccgacuuccagcuguucaccggcaacaagauccaggacgaggagaacaagaugcuccugcuggagauccuccacgagaucaagagcuucccccugcacuucgacgagaacuccuucuucgccggggacaagaaggaggcccacaagcugaaggaggacuuccgccuccacuuccggaacaucagccgcaucauggacugcgucggcugcuucaagugccgccugugggggaagcugcagacccagggccucggcacggcccugaagauccuguucuccgagaagcucaucgccaacaugccggagagcgggcccuccuacgaguuccaccugacccggcaggagaucgugagccuguucaacgcguucggccgcaucuccaccagcgugaaggagcuggagaacuuccggaaccuccugcagaacauccacuga

SEQ ID NO: 29775 - RNA, 162 nt, Artificial Sequence
  derived and/or modified sequence opt1 from ERP29__Homo_sapiens__NP_001029197
auggccgccgccgugccccgcgccgccuuccugagcccgcuccugccccugcuccugggcuuccugcuccuguccgcgccccacgggggcagcgggcugcacaccaagggcgcccucccccuggacaccgucacguucuacaagaucauggugaccuccuga

SEQ ID NO: 29776 - RNA, 1221 nt, Artificial Sequence
  derived and/or modified sequence opt1 from ERP44__Homo_sapiens__NP_055866
augcaccccgccguguuccugagccucccggaccugcgcugcucccugcuccugcuggucaccuggguguucacccccgugacgaccgagaucaccagccucgacaccgagaacaucgacgagauccugaacaacgccgacgucgcgcuggugaacuucuacgccgacuggugccgguucucccagaugcuccaccccaucuucgaggaggccagcgacgugaucaaggaggaguuccccaacgagaaccaggucguguucgcccgcguggacugcgaccagcacuccgacaucgcccagcgguaccgcaucagcaaguacccgacgcugaagcuguuccggaacggcaugaugaugaagcgcgaguaccgggggcagcgcuccgucaaggcgcucgccgacuacauccggcagcagaaguccgaccccauccaggagauccgcgaccuggccgagaucaccacccuggaccggagcaagcgcaacaucaucggcuacuucgagcagaaggacagcgacaacuaccggguguucgagcgcguggccaacauccuccacgacgacugcgcguuccuguccgccuucggggacgucagcaagcccgagcgguacuccggcgacaacaucaucuacaagcccccggggcacagcgcccccgacaugguguaccugggcgccaugaccaacuucgacgugacguacaacuggauccaggacaagugcgucccccucgugcgcgagaucaccuucgagaacggcgaggagcugaccgaggaggggcugcccuuccucauccuguuccacaugaaggaggacaccgagucccuggagaucuuccagaacgagguggcccggcagcucaucagcgagaagggcacgaucaacuuccugcacgcggacugcgacaaguuccgccacccgcugcuccacauccagaagacccccgccgacugccccgucaucgccaucgacuccuuccggcacauguacguguucggggacuucaaggacgugcugauccccggcaagcugaagcaguucgucuucgaccuccacagcgggaagcugcaccgcgaguuccaccacggcccggaccccaccgacaccgcccccggcgagcaggcccaggacguggcguccagcccgcccgagagcuccuuccagaagcuggcccccagcgaguaccgguacacgcuccugcgcgaccgcgacgagcuguga

SEQ ID NO: 29777 - RNA, 1815 nt, Artificial Sequence
  derived and/or modified sequence opt1 from ERV3-1__Homo_sapiens__NP_001007254
augcugggcaugaacaugcuccugaucacccuguuccuccugcugccccucagcaugcugaagggggagccgugggagggcugccugcacugcacccacacgaccugguccgggaacaucaugaccaagacccuccuguaccacacguacuacgagugcgccgggaccugccuggggaccugcacccacaaccagacgaccuacagcgugugcgaccccggccgcggccagcccuacgucugcuacgaccccaaguccagcccggggaccugguucgagauccacgugggcuccaaggagggggaccuccugaaccagaccaagguguuccccagcggcaaggacgucgugucccuguacuucgacgugugccagaucgucagcauggggucccucuuccccgugaucuucagcuccauggaguacuacagcuccugccacaagaaccgguacgcccaccccgcgugcagcacggacuccccggugacgaccugcugggacugcaccaccuggagcaccaaccagcagucccugggccccaucaugcugaccaagaucccccucgagcccgacugcaagaccagcacgugcaacuccgucaaccugaccauccuggagccggaccagcccaucuggaccaccggccucaaggcgccccugggggcccgcgugagcggcgaggagaucgggcccggcgccuacguguaccuguacaucaucaagaagacgcggacccgcagcacccagcaguuccgggucuucgaguccuucuacgagcacgugaaccagaagcucccggagcccccgccccuggccagcaaccuguucgcccagcucgccgagaacaucgccuccagccugcacguggccuccugcuacgucugcggcgggaugaacaugggcgaccaguggcccugggaggcgcgcgagcugaugccccaggacaacuucacccucacggccagcucccuggagcccgcccccagcucccagagcaucugguuccugaagaccuccaucaucgggaaguucugcaucgcccgguggggcaaggccuucaccgacccggugggggagcugaccugccucggccagcaguacuacaacgagacgcugggcaagacccucuggcgcggcaagagcaacaacuccgagagcccccaccccucccccuucagccgguucccgucccugaaccacagcugguaccagcuggaggcgcccaacaccuggcaggcccccuccggccucuacuggaucugcgggccgcaggccuaccgccagcugcccgccaaguggagcggcgccugcgugcuggggaccauccggcccagcuucuuccucaugccccugaagcagggcgaggcgcugggcuacccgaucuacgacgagacgaagcgcaaguccaagcgggggaucaccaucggcgacuggaaggacaacgaguggccgcccgagcgcaucauccaguacuacgggcccgccaccugggccgaggacggcauguggggguaccggacccccgucuacaugcucaaccgcaucauccggcugcaggccgugcuggagaucaucaccaacgagacggccggcgcgcucaaccugcuggcccagcaggccaccaagaugcgcaacgugaucuaccagaaccggcuggcccucgacuaccugcuggcccaggaggagggcgucugcgggaaguucaaccucaccaacugcugccuggagcuggacgacgagggcaaggugaucaaggagaucaccgcgaagauccagaagcucgcccacauccccgugcagacguggaagggguga

SEQ ID NO: 29778 - RNA, 1617 nt, Artificial Sequence
  derived and/or modified sequence opt1 from ERVW-1__Homo_sapiens__NP_055405
auggcccugcccuaccacaucuuccucuucaccgugcugcugccgagcuucacccucacggccccgccgcccugccgcugcaugaccuccagcucccccuaccaggaguuccuguggcggaugcagcgccccggcaacaucgacgcgcccagcuaccggucccugagcaaggggacccccaccuucacggcccacacccacaugccccgcaacugcuaccacuccgccacccucugcaugcacgccaacacccacuacuggacgggcaagaugaucaaccccagcugccccgggggccugggggucaccgugugcuggaccuacuucacccagacgggcauguccgacggcgggggcgugcaggaccaggcccgggagaagcacgucaaggaggugaucagccagcugacccgcgugcacgggaccuccagccccuacaagggccucgaccuguccaagcugcacgagacccuccggacgcacacccgccuggucagccuguucaacaccacccucacggggcugcacgagguguccgcgcagaacccgaccaacugcuggaucugccugccccucaacuuccggcccuacgugagcauccccgucccggagcaguggaacaacuucuccaccgagaucaacaccacgagcgugcuggugggcccccuggucuccaaccucgagaucacccacaccagcaaccugaccugcgugaaguucagcaacacgaccuacaccaccaacucccagugcauccgcugggugacgccgcccacccagaucgucugccugcccagcggcaucuucuucgugugcgggaccuccgccuaccggugccucaacggcagcuccgagagcaugugcuuccuguccuuccuggugccgcccaugaccaucuacacggagcaggaccucuacagcuacgucaucuccaagccccgcaacaagcgggugcccauccugcccuucgugaucggggccggcguccugggcgcccucgggaccggcaucgggggcaucaccaccagcacccaguucuacuacaagcugucccaggagcugaacggggacauggagcgcguggcggacagccucgugacgcugcaggaccagcugaacucccucgccgccgucgugcugcagaaccggcgcgcccuggaccuccugaccgccgagcggggcgggaccugccuguuccucggcgaggagugcugcuacuacgucaaccagagcggcaucgugaccgagaaggugaaggagauccgcgaccggauccagcgccgggcggaggagcugcgcaacacggggcccuggggccugcucucccaguggaugcccuggauccugccguuccuggggccccucgccgccaucauccugcugcuccuguucggccccugcaucuucaaccugcuggucaacuucgugagcucccgcaucgaggccgugaagcuccagauggagccgaagaugcagagcaagaccaagaucuaccggcgcccccuggaccggcccgccagcccccgcuccgacgucaacgacaucaagggcaccccgcccgaggagaucagcgcggcccagccccugcuccggcccaacuccgccgggagcuccuga

SEQ ID NO: 29779 - RNA, 1173 nt, Artificial Sequence
  derived and/or modified sequence opt1 from ESAM__Homo_sapiens__NP_620411
augaucagccugcccggcccgcucgugaccaaccugcugcgcuuccucuuccuggggcuguccgcccucgccccgcccagccgggcgcagcugcagcugcaccuccccgccaaccgccugcaggccgucgagggcggggagguggugcugcccgccugguacacccuccacggcgaggucuccagcucccagcccugggaggugcccuucgugaugugguucuucaagcagaaggagaaggaggaccagguccugagcuacaucaacggggugacgaccuccaagcccggcgugagccuggucuacuccaugccgagccggaaccucucccugcgccuggagggccuccaggagaaggacagcgggcccuacuccugcagcgugaacgugcaggacaagcagggcaagucccgggggcacagcaucaagacccuggagcugaacguccucgugccgcccgccccgcccuccugccgccugcagggcgugccccacgucggggcgaacgugacccugagcugccagagcccccgguccaagcccgccgugcaguaccagugggaccgccagcuccccagcuuccagacguucuucgcccccgcccuggacgucauccggggcucccugagccucaccaaccuguccagcuccauggcgggcguguacgugugcaaggcccacaacgaggucgggaccgcccagugcaacgugacccuggaggugagcacgggccccggggccgccgucguggcgggcgccgucgugggcacccucguggggcugggccugcucgccgggcugguccugcucuaccaccgccggggcaaggcccuggaggagccggccaacgacaucaaggaggacgcgaucgcgccccgcacccugcccuggcccaaguccagcgacaccaucuccaagaacgggacgcucagcuccgugaccagcgcccgggcccugcgcccgccccacggcccgccccggcccggcgcccugacccccacccccucccucagcucccaggcccugccgagcccccgccugcccacgaccgacggggcccacccccagccgaucucccccauccccggcggggugagcuccagcggccucagccggaugggggccguccccgugauggugccggcccagucccaggccggcagccuggucuga

SEQ ID NO: 29780 - RNA, 2523 nt, Artificial Sequence
  derived and/or modified sequence opt1 from ESCO1__Homo_sapiens__NP_443143
augaugagcauccaggagaaguccaaggagaacagcuccaaggugaccaagaaguccgacgacaagaacagcgagaccgagauccaggacagccagaagaaccuggccaagaaguccggccccaaggagacgaucaagagccaggccaaguccagcuccgagagcaagaucaaccagccggagcucgagacccgcauguccacccggagcuccaaggcggccagcaacgacaaggccaccaaguccaucaacaagaacacggucaccgugcgcggguacagccaggaguccaccaagaagaagcugagccagaagaagcuggugcacgagaaccccaaggccaacgagcagcucaaccggcgcagccagcggcugcagcagcugaccgaggucucccgccggagccuccgcucccgggagauccagggccaggugcaggccgugaagcagagccugccgcccacgaagaaggagcagugcuccagcacccaguccaagagcaacaagaccucccagaagcacgucaagcgcaaggugcuggaggucaagagcgacuccaaggaggacgagaaccucgugaucaacgaggugaucaacagccccaaggggaagaagcggaagguggagcaccagaccgcgugcgccugcuccagccagugcacgcagggcuccgagaagugcccccagaagaccacccgccgggacgagaccaagcccguccccgugacgagcgaggugaagcgcuccaagauggccaccagcgucgugccgaagaagaacgagaugaagaaguccgugcacacccaggucaacaccaacacgacccugcccaagagcccccagcccagcgugccggagcaguccgacaacgagcuggagcaggccggcaagagcaagcggggguccauccuccagcugugcgaggagaucgcgggcgagaucgagagcgacaacguggaggucaagaaggaguccagccagauggaguccgugaaggaggagaagcccaccgagaucaagcuggaggagaccagcguggagcgccagauccuccaccagaaggagacgaaccaggacguccagugcaaccgguucuuccccucccgcaagaccaagcccgugaagugcauccugaacgggaucaacagcuccgccaagaagaacagcaacuggaccaagaucaagcuguccaaguucaacagcguccagcacaacaagcucgacucccaggugagcccgaagcugggccugcuccggaccuccuucagcccgcccgcccuggagaugcaccaccccgugacgcagagcaccuuccuggggaccaagcuccacgaccgcaacaucacgugccagcaggagaagaugaaggagaucaacuccgaggaggucaagaucaacgacaucaccguggagaucaacaagaccaccgagcgggcccccgagaacugccaccuggccaacgagaucaagcccagcgacccgccccuggacaaccagaugaagcacuccuucgacagcgcguccaacaagaacuucagccagugccucgaguccaagcuggagaacagccccguggagaacgucaccgccgccuccacgcugcucagccaggccaagaucgacaccggcgagaacaaguuccccggguccgcgccccagcagcacagcauccuguccaaccagaccagcaaguccagcgacaaccgcgagacgccccgcaaccacucccugccgaagugcaacagccaccucgagaucaccauccccaaggaccugaagcugaaggaggccgagaagaccgacgagaagcagcucaucaucgacgccggccagaagcgguucggcgccguguccugcaacgugugcgggaugcuguacaccgccagcaaccccgaggacgagacccagcaccuccucuuccacaaccaguucaucagcgccgucaaguacgugggcuggaagaaggagcgcauccuggcggaguacccggacgggcggaucaucauggugcugcccgaggaccccaaguacgcccucaagaaggucgacgagauccgcgagaugguggacaacgaccugggcuuccagcaggcgccccugaugugcuacucccggaccaagacgcuccuguucaucagcaacgacaagaagguggucggcugccugaucgccgagcacauccaguggggguaccgcgugaucgaggagaagcucccggugauccgguccgaggaggagaagguccgcuucgagcggcagaaggccuggugcugcagcacccugcccgagcccgccaucugcggcaucucccgcaucuggguguucagcaugaugcggcgcaagaagaucgccucccggaugaucgagugccugcgcagcaacuucaucuacggguccuaccugagcaaggaggagaucgccuucuccgaccccaccccggacggcaagcuguucgccacccaguacugcgggacgggccaguuccugguguacaacuucaucaacggccagaacagcaccuga

SEQ ID NO: 29781 - RNA, 1806 nt, Artificial Sequence
  derived and/or modified sequence opt1 from ESCO2__Homo_sapiens__XP_011542723
auggccgcccugaccccgcgcaagcggaagcaggacagccucaagugcgacucccugcugcacuucaccgagaaccucuucccgagccccaacaagaagcacugcuucuaccagaacuccgacaagaacgaggagaaccugcacugcagccagcaggagcacuucgugcuguccgcgcucaagacgaccgagaucaaccgccugcccagcgccaaccagggcucccccuucaagagcgcccuguccaccgucagcuucuacaaccagaacaagugguaccucaacccgcuggagcggaagcugaucaaggagucccgcagcacgugccucaagaccaacgacgaggacaaguccuuccccaucgugaccgagaagaugcaggggaagcccgugugcagcaagaagaacaacaagaagccccagaagucccugaccgccaaguaccagccgaaguaccggcacaucaagcccgucagccgcaacucccggaacagcaagcagaaccgcgugaucuacaagcccaucguggagaaggagaacaacugccacuccgccgagaacaacagcaacgcgccccggguccugagccagaagaucaagccccaggugacccuccagggcggggccgccuucuucgugcgcaagaaguccagccugcggaaguccagccuggagaacgagcccucccucggccgcacgcagaaguccaagagcgaggucaucgaggacagcgacguggagaccguguccgagaagaagaccuucgccacccggcagguccccaagugccuggugcuggaggagaagcucaagaucgggcugcugagcgcguccagcaagaacaaggagaagcucaucaaggacuccagcgacgaccgcguguccagcaaggagcacaaggucgacaagaacgaggccuucuccagcgaggacucccugggcgagaacaagacgaucagccccaagagcaccguguacccgaucuucuccgccagcuccgugaacagcaagcggucccugggcgaggagcaguucagcgucggguccgugaacuucaugaagcagaccaacauccagaagaacaccaacacgcgcgacaccagcaagaagaccaaggaccagcucaucaucgacgccggccagaagcacuucggggccaccgugugcaaguccugcggcaugaucuacacggcgagcaaccccgaggacgagaugcagcacguccagcaccaccaccgguuccuggaggggaucaaguacgugggcuggaagaaggagcgcguggucgccgaguucugggacggcaagaucgugcugguccucccccacgaccccuccuucgccaucaagaagguggaggacgugcaggagcuggucgacaacgagcugggguuccagcaggucgugccgaagugccccaacaagaucaagaccuuccucuucaucagcgacgagaagcggguggugggcugccugaucgccgagcccaucaagcaggccuuccgcgugcuguccgagcccaucgggccggagagccccuccagcaccgagugcccccgggcguggcagugcuccgacguccccgagccggccgugugcggcaucagccgcaucuggguguuccgccucaagcggcgcaagcggaucgcccgccggcuggucgacacccugcgcaacugcuucauguucggcugcuuccucagcacggacgagaucgccuucuccgaccccacccccgacgggaagcuguucgccaccaaguacugcaacaccccgaacuuccugguguacaacuucaacagcuga

SEQ ID NO: 29782 - RNA, 849 nt, Artificial Sequence
  derived and/or modified sequence opt1 from ESD__Homo_sapiens__XP_011533256
auggcccugaagcagaucagcuccaacaagugcuucggcgggcuccagaagguguucgagcacgacagcgucgagcugaacugcaagaugaaguucgccguguaccugcccccgaaggcggagaccggcaagugccccgcccucuacuggcuguccgggcugaccugcacggagcagaacuucaucagcaaguccggcuaccaccagagcgccuccgagcacgggcucguggucaucgcccccgacaccagcccccgcggcugcaacaucaagggcgaggacgaguccugggacuucgggaccggcgccggguucuacguggacgcgaccgaggacccguggaagacgaacuaccggauguacagcuacgugaccgaggagcugccccagcugaucaacgccaacuuccccgucgacccccagcgcauguccaucuucggccacagcaugggcgggcacggcgcccucaucugcgcccugaagaacccggggaaguacaaguccgugagcgcguucgcccccaucugcaaccccgugcugugccccuggggcaagaaggccuucuccggguaccucggcaccgaccagagcaaguggaaggccuacgacgccacccaccuggucaaguccuacccgggcagccagcuggacauccucaucgaccaggggaaggacgaccaguuccugcuggacggccagcuccugcccgacaacuucaucgcggccugcacggagaagaagauccccgugguguuccggcugcaggagggguacgaccacuccuacuacuucaucgccaccuucaucaccgaccacauccgccaccacgccaaguaccucaacgccuga

SEQ ID NO: 29783 - RNA, 2556 nt, Artificial Sequence
  derived and/or modified sequence opt1 from ESF1__Homo_sapiens__NP_001263309
augagcuccaagcaggagaucaugagcgaccagcgcuuccggcgcguggccaaggacccccgguucugggagaugccggagaaggaccgcaaggucaagaucgacaagcgguuccgcgccauguuccacgacaagaaguucaagcugaacuacgcgguggacaagcggggccgccccaucucccacagcaccaccgaggaccucaagcgguucuacgaccuguccgacagcgacuccaaccugagcggggaggacuccaaggcccucagccagaagaagaucaagaagaagaagacgcagaccaagaaggagaucgacuccaagaaccugguggagaagaagaaggagaccaagaaggccaaccacaagggcagcgagaacaagaccgaccuggacaacuccaucgggaucaagaagaugaagacgagcugcaaguucaagaucgacuccaacaucagccccaagaaggacuccaaggaguucacccagaagaacaagaaggagaagaagaacaucguccagcacaccaccgacagcucccucgaggagaagcagcgcacgcuggacagcggcaccagcgagaucgugaaguccccgcggaucgagugcagcaagacccgccgggagaugcaguccgugguccagcugaucaugacccgcgacagcgacggguacgagaacuccacggacggcgagaugugcgacaaggacgcccucgaggaggacagcgaguccgugagcgagaucggcuccgacgaggagagcgagaacgagaucaccuccguggggcgggccagcggcgacgacgacggguccgaggacgacgaggaggaggacgaggacgaggaggaggacgaggacgaggacagcgaggacgacgacaaguccgacagcggccccgaccuggcgcgcgggaagggcaacaucgagaccuccagcgaggacgaggacgacaccgccgaccuguuccccgaggaguccggcuucgagcacgccuggcgggagcucgacaaggacgcgccccgcgccgacgagaucacgcggcgccuggccgucugcaacauggacugggaccggcugaaggccaaggaccuccuggcccuguucaacagcuucaagcccaagggcggggugaucuucagcgugaagaucuacccguccgaguucgggaaggagcgcaugaaggaggagcagguccagggccccguggagcuccugagcauccccgaggacgcccccgagaaggacuggaccucccgcgagaagcugcgggacuaccaguucaagcgccucaaguacuacuacgcgguggucgacugcgacagcccggagaccgccuccaagaucuacgaggacugcgacggccuggaguucgagagcuccugcagcuucaucgaccugcgguucauccccgacgacaucaccuucgacgacgagcccaaggacguggccuccgaggugaaccucacggccuacaagcccaaguacuucaccagcgccgcgauggggaccuccaccgucgagaucacgugggacgagaccgaccacgagcgcaucaccaugcugaaccggaaguucaagaaggaggagcugcucgacauggacuuccaggccuaccuggccagcuccagcgaggacgaggaggagaucgaggaggagcugcagggcgacgacggggugaacguggaggaggacggcaagaccaagaagucccagaaggacgacgaggagcagaucgccaaguaccgccagcuccugcaggucauccaggagaaggagaagaaggggaaggagaacgacauggagauggagaucaagugggugccgggccugaaggagagcgccgaggagauggugaagaacaagcucgagggcaaggacaagcugacgcccugggagcaguuccuggagaagaagaaggagaagaagcggcucaagcgcaagcagaaggcgcuggccgaggaggccuccgaggaggagcugcccagcgacgucgaccucaacgaccccuacuucgccgaggaggugaagcagaucgggaucaacaagaaguccgucaagagcgccaaggacggcaccagcccggaggaggagaucgagaucgagcggcagaaggcggagauggcccugcugaugauggacgaggacgaggacuccaagaagcacuucaacuacaacaagaucguggagcaccagaaccucagcaagaagaagaagaagcagcugaugaagaagaaggagcugaucgaggacgacuucgaggugaacgucaacgacgcccgcuuccaggccauguacaccucccaccucuucaaccuggaccccagcgaccccaacuucaagaagaccaaggcgauggagaagauccuggaggagaaggcccggcagcgcgagcggaaggagcaggagcucacgcaggccaucaagaagaaggaguccgagaucgagaaggagagccagcgcaaguccaucgaccccgcccugagcaugcugaucaaguccaucaagaccaagaccgagcaguuccaggcccggaagaagcagaaggugaaguga

SEQ ID NO: 29784 - RNA, 405 nt, Artificial Sequence
  derived and/or modified sequence opt1 from ESM1__Homo_sapiens__NP_001129076
augaaguccgugcugcuccugaccacccugcucguccccgcccaccugguggccgcgugguccaacaacuacgccguggacugcccgcagcacugcgacagcuccgagugcaagagcagcccccgcugcaagcggacgguccuggacgacugcggcugcugccgcgugugcgccgccgggcggggcgagaccugcuaccgcaccgugagcgggauggacggcaugaagugcgggcccggccuccggugccagcccuccaacggcgaggacccguucggggaggaguucggcaucugcaaggagcacgacauggccagcggggacggcaacaucguccgcgaggagguggugaaggagaacgcggccgggucccccgucaugcggaaguggcugaacccccgcuga

SEQ ID NO: 29785 - RNA, 6363 nt, Artificial Sequence
  derived and/or modified sequence opt1 from ESPL1__Homo_sapiens__NP_036423
augcgcagcuucaagcgggugaacuucggcacccugcuguccagccagaaggaggccgaggagcugcugcccgcccugaaggaguuccuguccaacccgcccgccggguuccccagcucccgcagcgacgccgagcggcgccaggccugcgacgccauccugcgggccugcaaccagcagcucaccgcgaagcuggccugcccccgccaccugggcucccuccuggagcuggccgagcucgccugcgacggguaccuggucagcacgccccagcggccgccccucuaccucgagcgcauccuguucgugcugcuccggaacgcggccgcccagggcucccccgaggccacccugcgccuggcccagccccuccacgcgugccuggugcagugcagccgggaggccgcgccccaggacuacgaggccguggcccgcggguccuucagccugcucuggaagggcgcggaggcccugcuggagcggcgcgccgccuucgccgcgcggcucaaggcccuguccuuccuggugcuccuggaggacgagagcacccccugcgaggugccccacuucgccucccccaccgccugccgcgccgucgcggcccaccagcuguucgacgccagcggccacgggcucaacgaggccgacgcggacuuccuggacgaccugcucucccggcacgugauccgcgcccuggugggcgagcgggggagcuccagcggccugcucagcccccagcgcgcccugugccugcucgagcugacccuggagcacugccggcgcuucugcuggucccgccaccacgacaaggccaucagcgccgucgagaaggcgcacuccuaccuccggaacaccaaccuggcccccagccugcagcucugccagcugggggugaagcugcuccaggugggcgaggagggcccccaggccgucgccaagcuccugaucaaggccuccgcggugcugagcaaguccauggaggcccccuccccgccccugcgcgcccuguacgaguccugccaguucuuccugagcgggcucgagcggggcaccaagcgccgguaccgccuggacgccauccugucccucuucgccuuccucgggggcuacugcagccugcuccagcagcugcgggacgacggcguguacgggggcuccagcaagcagcagcaguccuuccugcagauguacuuccaggggcuccaccuguacaccgucgugguguacgacuucgcgcagggcugccagaucgucgaccuggccgaccucacccagcugguggacagcugcaaguccaccguggucuggaugcuggaggcccucgaggggcugagcggccaggagcugaccgaccacaugggcaugaccgccuccuacacgagcaaccucgcguacagcuucuacucccacaagcuguacgccgaggccugcgccaucagcgagccccugugccagcaccucgggcuggugaagcccggcaccuaccccgaggugccgcccgagaagcugcaccgcugcuuccggcuccaggucgagucccugaagaagcuggggaagcaggcccagggcugcaagauggugauccucuggcuggcggcccugcagccgugcagccccgagcacauggccgagcccgucaccuucugggugcgcgugaagauggacgccgcccgggcgggggacaaggagcuccagcugaagacccugcgcgacucccucagcggcugggaccccgagacgcuggcccugcuccugcgggaggagcugcaggccuacaaggccguccgcgccgacaccggccaggagcgguucaacaucaucugcgaccuccuggagcuguccccggaggagacccccgcgggggccugggcccgcgccacccaccucguggagcuggcccaggugcugugcuaccacgacuucacgcagcagaccaacugcagcgcccucgacgccauccgggaggcccugcagcugcucgacuccguccgccccgaggcccaggcgcgggaccagcugcuggacgacaaggcccaggcccuccuguggcuguacaucugcacccucgaggccaagaugcaggagggcaucgagcgcgaccgccgggcccaggcgccggggaaccuggaggaguucgaggugaacgaccugaacuacgaggacaagcuccaggaggaccgcuuccuguacagcaacaucgccuucaaccuggccgccgacgccgcgcaguccaagugccucgaccaggcccuggcccuguggaaggagcuccugaccaagggccaggcccccgccgugcggugccugcagcagacggcggccagccuccagauccuggccgcccuguaccagcucgucgcgaagcccaugcaggcccuggaggugcugcuccugcugcgcaucguguccgagcggcucaaggaccacagcaaggccgccggguccagcugccacaucacccagcugcugcucacccugggcugccccuccuacgcccagcugcaccucgaggaggcggccagcagccugaagcaccuggaccagaccacggacaccuaccuccugcugucccugaccugcgaccugcugcgcagccagcuguacuggacccaccagaaggucacgaagggcgugucccuccugcugagcgugcuccgggaccccgcccugcagaaguccagcaaggccugguaccugcuccgcguccaggugcugcagcugguggccgcguaccucucccugcccagcaacaaccugucccacagccucugggagcagcugugcgcccagggguggcagacccccgagaucgcccugaucgacucccacaagcuccugcggagcaucauccugcuccugaugggcuccgacauccugagcacccagaaggccgccgucgagaccuccuuccucgacuacggggagaaccuggugcagaaguggcagguccugagcgaggugcucuccugcagcgagaagcuggugugccaccugggccgccucggcuccgugagcgaggcgaaggccuucugccuggaggcccugaagcucacgaccaagcugcagaucccccggcagugcgcccuguuccucguccugaagggggagcuggagcucgcgcgcaacgacaucgaccugugccagagcgaccugcagcagguccuguuccugcuggaguccugcaccgaguucggcggggugacccagcaccucgacagcgucaagaaggugcaccuccagaagggcaagcagcaggcccaggugccgugcccgccccagcugcccgaggaggagcuguuccuccgggggccggcccuggagcucgucgccaccguggccaaggagcccggccccaucgcgcccuccacgaacagcuccccggugcugaagaccaagccccagcccauccccaacuuccugagccacuccccgaccugcgacugcagccucugcgccucccccguccugaccgccgugugccugcgcugggugcucgucacggccggcgugcggcuggccauggggcaccaggcgcagggccuggaccuccuccaggugguccugaaggggugccccgaggccgccgagcgccucacccaggcccugcaggccagccugaaccacaagacgccgcccucccucgugcccagccugcuggacgagauccucgcgcaggccuacacccugcuggcccucgagggccugaaccagcccuccaacgagagccugcagaaggugcuccaguccgggcugaaguucgucgccgcgcggaucccccaccuggagcccuggcgcgccagccuccugcugaucugggcccucacgaagcugggcggccuguccugcugcaccacccagcuguucgccagcuccuggggguggcagccgccccugaucaagagcgugccgggcagcgagcccuccaagacccaggggcagaagcggagcggccgcgggcggcagaagcuggccuccgcgccccuccgccugaacaacacgagccagaagggccuggagggccgcgggcuccccugcaccccgaagccgcccgaccggauccgccaggccggcccccacgugccguucaccgucuucgaggaggugugccccaccgaguccaagcccgaggugccccaggccccgcggguccagcagcgcgugcagacgcggcugaaggugaacuucagcgacgacuccgaccuggaggaccccgucagcgccgaggccuggcucgcggaggagcccaagcgccgggggaccgccucccgcggccgggggcgcgcccggaagggccugagccugaagaccgacgccguggucgcccccggcuccgcgccggggaaccccggccucaacgggcgcagccggcgcgccaagaagguggccucccggcacugcgaggagcgccggccccagcgcgccagcgaccaggcccggcccggcccggagaucaugcgcaccauccccgaggaggagcugacggacaacuggcgcaagauguccuucgagauccugcggggcagcgacggggaggacuccgcgagcggcgggaagacccccgcccccggcccggaggccgccuccggggagugggagcuccugcgccuggacagcagcaagaagaagcuccccucccccugcccggacaaggagagcgacaaggaccugggcccccggcugcgccugcccuccgcgcccguggccaccggccucagcacccuggacuccaucugcgacagccuguccgucgccuuccgggggaucagccacugcccgcccuccggccucuacgcccaccugugccgcuuccuggcccucugccuggggcaccgggaccccuacgcgacggccuuccuggugaccgagagcguguccaucacgugccgccaccagcuccugacccaccuccaccggcagcucagcaaggcccagaagcaccgcggcucccuggagaucgccgaccagcugcaggggcucagccugcaggagaugcccggcgacgucccgcuggcccggauccagcgccucuucuccuuccgggcgcuggagagcggccacuucccccagcccgagaaggaguccuuccaggagcgccuggcccucauccccagcggggugacggugugcguccuggcccuggccacccuccagccgggcaccguggggaacacccugcugcucacgcggcuggagaaggacagcccgcccgugagcguccagauccccaccggccagaacaagcugcaccuccgcagcgugcugaacgaguucgacgccauccagaaggcgcagaaggagaacuccagcugcaccgacaagcgggagugguggaccgggcgccuggcccucgaccaccggauggaggugcugaucgccucccuggagaaguccguccucggcugcuggaagggccugcugcucccguccagcgaggagcccgggcccgcccaggaggcgucccgccugcaggagcugcuccaggacugcggcuggaaguaccccgaccggacgcugcugaagaucaugcucagcggggccggcgcccugaccccgcaggacauccaggcccuggccuacggccucugccccacccagcccgagcgcgcgcaggagcugcugaacgaggccguggggcgccuccagggccugaccgugcccuccaacagccaccugguccucgugcuggacaaggaccugcagaagcucccgugggaguccaugcccagccugcaggcccugcccgugacccggcuccccuccuuccgcuuccugcugagcuacuccaucaucaaggaguacggggccagcccgguccucucccagggcguggacccccggagcacguucuacgugcugaacccccacaacaaccuguccagcaccgaggagcaguuccgcgccaacuucagcuccgaggcgggguggcggggcgucgugggcgaggugccgcgccccgagcagguccaggaggcccucaccaagcacgaccuguacaucuacgccgggcacggcgccggggcccgguuccuggacggccaggcggugcuccgccugagcugccgggccguggcccuccuguucgggugcuccagcgccgcgcuggccguccgcggcaaccuggagggcgccgggaucgugcucaaguacaucauggccggcugcccccuguuccuggggaaccucugggacgugaccgaccgggacaucgaccgcuacacggaggcccugcugcagggcuggcucggggcgggccccggcgccccgcugcuguacuacgucaaccaggcccggcaggcgccccgccucaaguaccugaucggggccgcgcccaucgccuacggccugcccgugucccuccgguga

SEQ ID NO: 29786 - RNA, 2475 nt, Artificial Sequence
  derived and/or modified sequence opt1 from ESPN__Homo_sapiens__XP_011540537
auggcccuggagcaggcccuccaggcggcccgccagggcgagcuggacgugcugcggagccuccacgccgccgggcugcugggccccucccuccgcgacccgcuggacgcccugcccguccaccacgcggcccgggccgggaagcuccacugccugcgcuuccugguggaggaggccgcgcuccccgccgccgcccgggcccgcaacggcgcgacccccgcccacgacgccagcgccaccgggcaccuggccugccugcaguggcuccugucccagggcggcugccgggugcaggacaaggacaacagcggggcgacgguccugcaccucgccgcccgcuucggccacccggagguggugaacuggcugcugcaccacgggggcggggaccccaccgccgccaccgacaugggcgcgcuccccauccacuacgccgccgccaagggcgacuuccccucccugcggcugcucgucgagcacuacccggagggggugaacgcccagaccaagaacggcgcgacgccccuguaccuggccugccaggaggggcaccucgaggugacccaguaccugguccaggagugcggcgccgacccccacgcccgcgcgcacgacggcaugaccccccugcacgccgccgcccagauggggcacagcccggugaucguguggcucgucuccugcaccgacgugagccuguccgagcaggacaaggacggcgccacggcgaugcacuucgccgccagccgggggcacaccaaggugcuguccuggcuccugcugcacggcggggagaucagcgccgaccucuggggcggcaccccccugcacgacgccgcggagaacggggagcuggagugcugccagauccucgucgugaacggcgccgagcuggacgugcgcgaccgggacggguacaccgccgccgaccuguccgacuucaacggccacagccacugcacgcgcuaccuccggaccgucgagaaccuguccguggagcaccgcgugcugagccgggaccccuccgccgagcucgaggcgaagcagcccgacagcgggauguccagcccgaacaccaccgucagcgugcagccccugaacuucgaccuguccagccccacguccacccucagcaacuacgacuccugcagcuccagccacuccagcaucaagggccagcaccccccgugcggccuguccagcgcccgcgccgccgacauccaguccuacauggacaugcugaaccccgagcuggggcucccccggggcaccaucgggaagcccaccccgcccccccccccgcccagcuuccccccgcccccccccccgcccggcacgcagcugccccccccgccccccggguaccccgcgccgaagccccccgugggcccccaggccgccgacaucuacaugcagaccaagaacaagcugcgccacgucgagaccgaggcccucaagaaggagcuguccagcugcgacggccacgacgggcugcggcgccaggacuccagccgcaagccgcgggccuucuccaagcagcccagcaccggcgacuacuaccgccagcucgggcggugccccggcgagacgcuggcggcccgccccggcauggcccacagcgaggaggccgcccugcucccggggaaccacgugcccaacggcugcgcggccgaccccaaggccucccgggagcugcccccgccccccccgcccccccccccgccccugcccgaggccgccagcucccccccgcccgcgcccccccucccgcuggagagcgccgggcccggcugcgggcagcgccgguccagcuccagcaccggcuccaccaagagcuucaacaugaugucccccaccggcgacaacagcgagcugcucgccgagaucaaggccgggaagucccugaagcccacgccgcagagcaagggccugaccaccgucuucuccgggaucggccagcccgcguuccagcccgacagcccccucccguccgugagccccgcccugagccccgugcgcucccccaccccgcccgccgccggguuccagccccugcucaacggcagccugguccccgugccgcccacgacccccgccccgggcgugcagcuggacgucgaggcgcucauccccacccacgacgagcaggggcggcccauccccgaguggaagcgccaggugauggugcggaagaugcagcugaagaugcaggaggaggaggagcagcgccggaaggaggaggaggaggaggcccgccuggccuccaugccggccuggcggcgcgaccuccugcggaagaagcuggaggaggagcgcgagcagaagcggaaggaggaggagcgccagaagcaggaggagcuccgccgggagaaggagcagagcgagaagcugcgcacccugggcuacgacgaguccaagcucgcccccuggcagcggcaggucauccugaagaagggggacaucgcgaaguacuga

SEQ ID NO: 29787 - RNA, 1794 nt, Artificial Sequence
  derived and/or modified sequence opt1 from ESR1__Homo_sapiens__NP_001278159
augaccaugacccugcacacgaaggccagcggcauggcccuccugcaccagauccaggggaacgagcuggagccccucaaccgcccgcagcugaagaucccccuggagcggccccucggcgagguguaccuggacuccagcaagcccgcggucuacaacuacccggagggggccgccuacgaguucaacgccgccgcggccgccaacgcccagguguacggccagaccgggcugcccuacggccccggcuccgaggcggccgccuucgggagcaacggccucgggggcuucccgccccugaacuccgugagccccagcccccugaugcuccugcacccgccgccccagcugucccccuuccuccagccccacgggcagcagguccccuacuaccuggagaacgagcccuccggcuacaccgugcgcgaggccggcccgcccgccuucuaccggcccaacagcgacaaccgccggcagggcgggcgcgagcggcuggcguccaccaacgacaaggggagcauggccauggaguccgccaaggagacgcgcuacugcgccgugugcaacgacuacgccagcggcuaccacuacggcgucugguccugcgaggggugcaaggcguucuucaagcggagcauccagggcaaccgccacaacgacuacaugugccccgccaccaaccagugcaccaucgacaagaaccggcgcaaguccugccaggccugccggcuccgcaagugcuacgagguggggaugaugaagggcgggauccggaaggaccgccggggcggccgcaugcugaagcacaagcggcagcgcgacgacggggagggccgcggggaggugggcagcgccggggacaugcgggccgcgaaccuguggcccagcccccucaugaucaagcgcuccaagaagaacagccuggcccugucccucaccgccgaccagauggucagcgcccugcuggacgccgagccgcccauccucuacuccgaguacgaccccacgcggcccuucagcgaggcguccaugaugggccugcugaccaaccucgccgaccgcgagcuggugcacaugaucaacugggccaagcgggugccgggcuucgucgaccugacccuccacgaccaggugcaccuccuggagugcgccuggcuggagauccugaugaucgggcugguguggcgcagcauggagcaccccggcaagcuccuguucgcgcccaaccugcuccuggaccggaaccaggggaagugcgucgagggcaugguggagaucuucgacaugcugcucgccaccuccagccgcuuccggaugaugaaccugcagggggaggaguucgugugccugaaguccaucauccuccugaacagcggcgucuacacguuccuguccagcacccugaagucccucgaggagaaggaccacauccaccgcgugcuggacaagaucaccgacacccugauccaccucauggccaaggccggccugacgcugcagcagcagcaccagcggcucgcccagcugcugcucauccugagccacauccgccacauguccaacaaggggauggagcaccuguacagcaugaagugcaagaacguggucccgcucuacgaccugcugcucgagaugcuggacgcgcaccggcugcacgcccccaccucccgcggcggggccagcguggaggagaccgaccagucccaccucgccaccgccggcagcacgagcucccacagccugcagaaguacuacaucaccggcgaggcggagggguuccccgccaccguguga

SEQ ID NO: 29788 - RNA, 1446 nt, Artificial Sequence
  derived and/or modified sequence opt1 from ESR2__Homo_sapiens__NP_001201831
auggacaucaagaacagccccuccagccugaacuccccgagcuccuacaacugcagccaguccauccucccccuggagcacgggagcaucuacauccccuccagcuacguggacucccaccacgaguaccccgccaugaccuucuacagcccggccgucaugaacuacuccauccccagcaacgugaccaaccuggagggcgggcccgggcgccagacgaccucccccaacgugcucuggccgacccccggccaccugagcccccuggucgugcaccggcagcucucccaccuguacgcggagccccagaaguccccguggugcgaggcccgcagccuggagcacacccuccccgugaaccgggagacgcugaagcgcaaggucagcgggaaccggugcgccagccccgugaccggccccggcuccaagcgcgacgcccacuucugcgccgugugcagcgacuacgcguccggguaccacuacggcgucuggagcugcgaggggugcaaggccuucuucaagcgguccauccagggccacaacgacuacaucugcccggccaccaaccagugcaccaucgacaagaaccgccgcaagagcugccaggccugccggcugcggaagugcuacgagguggggauggugaagugcggcucccgccgggagcgcugcggcuaccggcucguccgccggcagcgcagcgcggacgagcagcugcacugcgccgggaaggccaagcgguccggcgggcacgcgccccgcgugcgggagcugcuccuggacgcccugagccccgagcagcucgugcugacgcugcucgaggccgagcccccgcacguccugaucucccgccccagcgcccccuucaccgaggccuccaugaugaugagccugaccaagcucgccgacaaggagcuggugcacaugaucuccugggccaagaagauccccggcuucguggagcugagccucuucgaccagguccgccugcuggaguccugcuggauggaggugcucaugaugggccugauguggcggagcaucgaccacccggggaagcugaucuucgcgcccgaccucgugcuggaccgcgacgagggcaagugcgucgaggggauccuggagaucuucgacaugcuccuggccaccacgucccgguuccgcgagcugaagcuccagcacaaggaguaccugugcgugaaggccaugauccugcucaacagcagcauguacccccuggugaccgccacccaggacgccgacuccagccggaagcuggcgcaccuccugaacgccgucaccgacgcccuggugugggucaucgccaaguccggcaucagcucccagcagcagagcaugcgccucgccaaccugcugaugcugcucucccacgugcggcacgcgcgcuggggcgagaagcaguucauccaccugaagcugagcuga

SEQ ID NO: 29789 - RNA, 2034 nt, Artificial Sequence
  derived and/or modified sequence opt1 from ESRP1__Homo_sapiens__NP_001030087
augaccgccagccccgacuaccuggugguccucuucggcaucaccgccggggcgacgggcgccaagcugggguccgacgagaaggagcugauccuccuguucuggaaggugguggaccuggccaacaagaaggucggccagcuccacgaggugcuggugcgcccggaccagcuggagcucaccgaggacugcaaggaggagaccaagaucgacgucgagagccuguccagcgccucccagcuggaccaggcccuccggcaguucaaccagagcguguccaacgagcugaacaucggggugggcaccagcuucugccugugcacggacggccagcuccacguccgccagauccugcaccccgaggcguccaagaagaacgugcugcuccccgagugcuucuacagcuucuucgaccugcggaaggaguucaagaagugcugccccggguccccggacaucgacaagcuggacguggccaccaugaccgaguaccucaacuucgagaaguccuccagcgucucccgcuacggcgccagccagguggaggacauggggaacaucauccuggccaugaucuccgagcccuacaaccaccgguucagcgaccccgagcgcgugaacuacaaguucgaguccgggaccugcagcaagauggagcugaucgacgacaacacggucgugcgggcgcgcggccuccccuggcagagcagcgaccaggacaucgcccgguucuucaagggccugaacaucgccaagggcggggccgcccugugccucaacgcgcagggccgccggaacggggaggcccuggugcgcuucgucagcgaggagcaccgggaccuggcccuccagcgccacaagcaccacaugggcacccgguacaucgagguguacaaggccaccggcgaggacuuccugaagaucgccgggggcaccuccaacgagguggcgcaguuccugagcaaggagaaccaggucaucgugcgcaugcgggggcucccguucacggccaccgccgaggagguggucgccuucuucggccagcacugccccaucaccgggggcaaggagggcauccuguucgugaccuaccccgacgggcgccccacgggcgacgccuucguccuguucgcgugcgaggaguacgcccagaacgcccuccggaagcacaaggaccugcuggggaagcgcuacaucgagcuguuccgguccaccgccgccgaggugcagcagguccucaaccgcuucagcuccgcgccgcugaucccccuccccacgcccccgaucauccccgugcugccccagcaguucgugcccccgaccaacgugcgcgacugcauccggcugcgcggccuccccuacgccgccaccaucgaggacauccuggacuuccugggggaguucgccaccgacauccggacccacggcguccacauggugcucaaccaccagggccgccccagcggggacgcguucauccagaugaaguccgccgaccgggccuucauggccgcccagaagugccacaagaagaacaugaaggaccgcuacguggaggucuuccagugcagcgcggaggagaugaacuucgugcugaugggcgggacccugaaccggaacggccugagcccgccgcccugccucuccccgcccuccuacacguuccccgcccccgccgccgugauccccaccgaggccgcgaucuaccagcccagcgucauccugaacccccgcgcccugcagcccuccaccgccuacuaccccgccgggacccagcuguucaugaacuacacggccuacuacccgagcccgcccggcucccccaacagccucggcuacuuccccaccgcggccaaccuguccggggugccgccccagcccggcaccgugguccggaugcaggggcucgccuacaacaccggcgugaaggagauccugaacuucuuccagggcuaccaguacgccacggaggacgggcugauccacaccaacgaccaggcgcgcacccuccccaaggagugggugugcaucuga

SEQ ID NO: 29790 - RNA, 2154 nt, Artificial Sequence
  derived and/or modified sequence opt1 from ESRP2__Homo_sapiens__NP_079215
augacccccccgcccccccccccgcccccccccggcccggaccccgccgccgaccccgcggccgaccccugcccguggcccgggagccuggugguccucuucggcgccaccgccggggcccugggccgcgaccugggguccgacgagacggaccucauccugcugguguggcagguggucgagccccggagccgccaggugggcacccuccacaagucccuggugcgggcggaggccgccgcccugagcacccagugccgcgaggcguccggccucagcgccgacucccuggcccgggccgagccccuggacaagguccuccagcaguucagccagcuggugaacggggacguggcccugcucggcgggggcccguacaugcugugcaccgacgggcagcagcugcuccgccagguccugcaccccgaggcgucccggaagaaccuggugcuccccgacauguucuucagcuucuacgaccugcgccgggaguuccacaugcagcaccccuccacgugcccggcccgcgaccugaccguggccaccauggcccagggccucggccuggagaccgacgccacggaggacgacuucggggucugggaggugaagaccaugguggcggucauccugcaccuccugaaggagcccagcucccagcuguucagcaagcccgaggugaucaagcagaaguacgagaccggccccugcuccaaggccgacguggucgacagcgagaccguggugcgggcccgcgggcucccguggcaguccagcgaccaggacgucgcccgguucuucaagggccugaacguggcccgcggcgggguggcgcugugccucaacgcccagggccggcgcaacggggaggcccugauccgguucgucgacuccgagcagcgcgaccuggcccuccagcggcacaagcaccacaugggcgugcgcuacaucgaggucuacaaggccacgggggaggaguucgugaagaucgcgggcggcaccagccuggagguggcccgguuccugagccgcgaggaccaggucauccuccgccugcgggggcugcccuucuccgccggccccaccgacgugcucggguuccugggccccgagugcccggugaccgggggcacggagggccugcucuucguccgccaccccgacgggcggcccaccggcgacgccuucgcgcuguucgccugcgaggagcuggcccaggccgcccuccgccggcacaaggggaugcugggcaagcgcuacaucgagcuguuccggagcaccgcggccgaggugcagcaggugcugaaccgcuacgccuccgggccgcuccugcccacccugacggccccccuccugcccaucccguucccccuggcccccggcaccggccgggacugcguccgccuccgggggcugcccuacaccgcgaccaucgaggacauccugagcuuccucggcgaggccgccgccgacauccgcccgcacggggugcacauggugcugaaccagcagggccggcccuccggcgacgccuucauccagaugacgagcgcggagcgcgcccuggccgccgcgcagcggugccacaagaaggucaugaaggagcgcuacguggaggugguccccugcuccaccgaggagaugagccgggugcucauggggggcacccuggggcgcuccggcaugagccccccgcccugcaagcugcccugccucucccccccgaccuacacgaccuuccaggccacccccacccugauccccacggagaccgccgcccuguaccccagcuccgcccuccugccggcggcccgggugcccgccgcccccacccccgucgccuacuacccggggcccgcgacccagcuguaccucaacuacacggccuacuaccccagcccgcccgugucccccaccaccgugggcuaccugaccacccccacggccgcccuggccagcgcgccgaccuccguccucagccaguccggcgcccuggugcgcaugcagggggugcccuacaccgccggcaugaaggaccugcucagcgucuuccaggccuaccagcugcccgcggacgacuacaccagccugaugcccgugggggacccgccccgcacggugcuccaggcccccaaggagugggucugccuguga

SEQ ID NO: 29791 - RNA, 1272 nt, Artificial Sequence
  derived and/or modified sequence opt1 from ESRRA__Homo_sapiens__NP_001269379
augagcucccagguggucggcaucgagccccuguacaucaaggccgagccggccagccccgacucccccaaggggagcuccgagaccgagaccgagcccccgguggcgcucgcccccggccccgcccccacgcgcugccugccggggcacaaggaggaggaggacggcgagggggccggccccggcgagcagggcggcgggaagcuggugcucagcucccugcccaagcggcugugccucgucugcggggacguggccagcggguaccacuacggcguggcguccugcgaggccugcaaggccuucuucaagcgcaccauccagggcagcaucgaguacuccugccccgccagcaacgagugcgagaucaccaagcggcgccggaaggcgugccaggccugccgcuucaccaagugccugcgggucgggaugcugaaggagggcgugcgccucgaccgggugcgcgggggccggcagaaguacaagcgccggccggaggucgacccccugcccuuccccggcccguuccccgccgggccccuggccguggccggcgggccccgcaagacggcggccccggugaacgcccucgucucccaccuccuggugguggagcccgagaagcuguacgccaugcccgaccccgccggcccggacgggcaccuccccgcggucgccacccugugcgaccuguucgaccgggagaucguggugaccaucagcugggccaaguccauccccggcuucagcucccugagccuguccgaccagaugagcguccuccagagcguguggauggaggugcugguccugggcguggcccagcgcucccucccccugcaggacgagcuggccuucgcggaggaccucgugcuggacgaggagggggcccgggccgccggccugggggagcucggcgccgcgcugcugcagcucguccgccggcugcaggcccugcgccucgagcgggaggaguacgugcugcugaaggcccucgcccuggcgaacagcgacuccguccacaucgaggacgccgaggccguggagcagcugcgcgaggcccuccacgaggcccugcuggaguacgaggcggggcgcgccggcccgggcgggggcgccgagcggcgccgggccgggcgccuccugcugacccucccccugcugcggcagacggccggcaaggugcuggcgcacuucuacggggucaagcucgagggcaaggugcccaugcacaagcuguuccuggagaugcucgaggccaugauggacuga

SEQ ID NO: 29792 - RNA, 1527 nt, Artificial Sequence
  derived and/or modified sequence opt1 from ESRRB__Homo_sapiens__NP_004443
augagcuccgacgaccgccaccugggcagcuccugcgggagcuucaucaagaccgagcccuccagcccguccagcggcaucgacgcccucucccaccacagccccuccgggagcuccgacgccagcggcggguucggccuggcgcugggcacccacgccaacgggcucgacuccccgcccauguucgccggcgccgggcugggcgggacgcccugccgcaagagcuacgaggacugcgccuccggcaucauggaggacagcgcgaucaagugcgaguacaugcugaacgccauccccaagcggcucugccuggugugcggcgacaucgccuccggguaccacuacggcgucgccagcugcgaggcgugcaaggccuucuucaagcggaccauccaggggaacaucgaguacagcugccccgccaccaacgagugcgagaucaccaagcgccggcgcaaguccugccaggccugccgguucaugaagugccugaaggugggcaugcucaaggagggcgugcgccuggaccggguccgcgggggccggcagaaguacaagcgccggcuggacagcgaguccagccccuaccucucccugcagaucagcccgcccgccaagaagccccugacgaagaucguguccuaccuccugguggcggagcccgacaagcuguacgccaugccgccgcccgggaugcccgagggcgacaucaaggcccucaccacccugugcgaccuggccgaccgcgagcucgucgugaucaucgggugggccaagcacauccccggcuucagcucccugagccugggcgaccagaugucccuccugcagagcgcguggauggagauccugauccucgggaucguguaccggucccugcccuacgacgacaagcuggucuacgccgaggacuacaucauggacgaggagcacagccgccucgccggccugcuggagcucuaccgggccauccugcagcuggugcgccgguacaagaagcucaagguggagaaggaggaguucgucacccugaaggcccuggcgcucgccaacuccgacagcauguacaucgaggaccuggaggccgugcagaagcugcaggaccuccugcacgaggcccugcaggacuacgagcucucccagcgccacgaggagcccuggcggacggggaagcugcugcucacccugccccugcugcgccagaccgccgcgaaggccgugcagcacuucuacagcgucaagcuccagggcaaggugccgaugcacaagcuguuccuggagaugcucgaggccaagguggggcaggagcagcugcgcggcucccccaaggacgagcggaugagcagccacgacggcaagugccccuuccaguccgccgcguucaccagccgcgaccaguccaacagccccgggaucccgaacccccggcccuccagccccacgccgcugaacgagcgcggccggcagaucucccccagcacccgcacccccgggggccaggggaagcaccucuggcugaccauguga

SEQ ID NO: 29793 - RNA, 1191 nt, Artificial Sequence
  derived and/or modified sequence opt1 from ESRRG__Homo_sapiens__NP_001230436
augagcaacaaggaccgccacaucgacuccagcugcuccagcuucaucaagaccgagcccuccagcccggccucccugaccgacagcgugaaccaccacucccccggcgggagcuccgacgccagcggcuccuacagcuccacgaugaacgggcaccagaacggccucgacagcccgccccuguaccccuccgcgcccauccucgggggcagcggccccguccggaagcuguacgacgacugcuccagcaccaucguggaggacccccagaccaagugcgaguacaugcugaacagcaugccgaagcgccugugccucgugugcggggacaucgccuccggcuaccacuacggggucgccagcugcgaggccugcaaggccuucuucaagcggaccauccagggcgugcgccuggaccgggugcgcgggggccggcagaaguacaagcgccggaucgacgcggagaacucccccuaccugaacccccagcucguccagcccgccaagaagccguacaacaagaucgugagccaccuccugguggccgagcccgagaagaucuacgccaugcccgaccccacggucccggacuccgacaucaaggcgcugaccacccugugcgaccuggccgaccgcgagcucguggugaucaucggcugggccaagcacauccccggguucagcacccugucccuggccgaccagaugagccuccugcaguccgccuggauggagauccugauccucggcgucguguaccggagccuguccuucgaggacgagcugguguacgcggacgacuacaucauggacgaggaccagagcaagcucgccgggcugcuggaccucaacaacgccauccugcagcuggucaagaaguacaaguccaugaagcucgagaaggaggaguucgugacgcugaaggccaucgcccuggcgaacagcgacuccaugcacaucgaggacguggaggccguccagaagcuccaggacgugcugcacgaggcccugcaggacuacgaggccggccagcacauggaggacccccgccgggccggcaagaugcucaugacccugccccugcuccgccagaccagcaccaaggcggugcagcacuucuacaacaucaagcuggaggggaaggucccgaugcacaagcuguuccucgagaugcuggaggccaagguguga

SEQ ID NO: 29794 - RNA, 1221 nt, Artificial Sequence
  derived and/or modified sequence opt1 from ESX1__Homo_sapiens__NP_703149
auggagagccugcgcggcuacacccacuccgacaucggguaccggagccucgccgugggcgaggacaucgaggaggucaacgacgagaagcugaccgugacgucccugauggcccgcgggggcgaggacgaggagaacacccggagcaagcccgaguacgggaccgaggcggagaacaacgugggcaccgagggcuccgucccgagcgacgaccaggaccgcgaggggggcgggggccacgagcccgagcagcagcaggaggagcccccccucacgaagccggagcagcagcaggaggagcccccccugcuggagcucaagcaggagcaggaggagcccccgcagaccaccguggaggggccccagcccgccgagggcccccagaccgccgagggcccgcagccccccgagcggaagcgccggcgccggacggccuucacccaguuccagcugcaggagcuggagaacuucuucgacgagucccaguaccccgacguggucgcccgcgagcggcucgcggcccgccugaaccugaccgaggaccgggugcaggugugguuccagaaccgccgggccaaguggaagcgcaaccagcggguccucaugcugcgcaacaccgccacggcggaccuggcccacccgcucgacauguuccuggggggcgccuacuacgccgcccccgcgcuggaccccgcccucugcgugcaccuggugccccagcugccgcggccccccguccuccccgugccgcccaugcccccccgcccgcccauggugcccaugccgccccggccccccaucgccccgaugccccccauggcccccgucccgcccgggagccgcauggcccccgugcccccgggcccccgcauggcgcccgugcccccguggccccccauggcccccgucccgcccuggccccccauggccccggugcccaccggccccccgauggcccccgugccccccgggccgcccauggcccgggucccccccggcccgcccauggcgcgcgugccccccgggccgcccauggccccccugcccccgggcccccccauggccccccugccgcccgggccccccauggccccgcucccccccggccccccgauggccccccugcccccgcggucccacgugccccacaccggccuggcgcccguccacaucaccugggcccccgugaucaacagcuacuacgccugcccguucuucuga

SEQ ID NO: 29795 - RNA, 3345 nt, Artificial Sequence
  derived and/or modified sequence opt1 from ESYT1__Homo_sapiens__NP_001171725
auggagcgcagccccggcgaggggccgucccccagccccauggaccagcccuccgccccgagcgaccccaccgaccagccgcccgccgcgcacgccaagcccgaccccggcuccgggggccagcccgccgggcccggcgccgccggcgaggcgcuggccgugcucaccagcuucgggcggcgccugcugguccucaucccgguguaccuggccggcgccguggggcuguccgucggcuucguccucuucgggcuggcgcuguaccucggcuggcggcgcgugcgggacgagaaggagcgcagccugcgggccgcccgccagcugcucgacgacgaggagcagcugacggccaagacccuguacaugucccaccgggagcuccccgccugggucagcuuccccgacguggagaaggcggaguggcugaacaagaucguggcccaggucuggcccuuccugggccaguacauggagaagcuccuggccgagaccguggccccggccgugcgcggguccaacccccaccuccagaccuucacguucacccgggucgagcucggcgagaagccccugcgcaucaucggggugaaggugcaccccggccagcggaaggagcagauccugcucgaccugaacaucagcuacgucggcgacgugcagaucgacguggaggucaagaaguacuucugcaaggcgggggugaagggcaugcagcugcacggggugcuccgcgucauccuggagccgcugaucggcgaccuccccuucgugggggccguguccauguucuucauccggcgccccacccuggacaucaacuggaccggcaugacgaaccugcucgacauccccggccugagcucccugagcgacaccaugaucauggacuccaucgccgccuuccucguccugccgaaccggcugcucgugccccugguccccgaccugcaggacguggcccagcuccgcagcccccugccgcgggggaucauccgcauccaccuccuggcggcccggggccuguccagcaaggacaaguacgugaaggggcugaucgagggcaagagcgaccccuacgcccugguccgccuggggacccagaccuucugcucccgcgugaucgacgaggagcucaacccccaguggggcgagacguacgaggugauggugcacgaggugccgggccaggagaucgagguggaggucuucgacaaggaccccgacaaggacgacuuccuggggcggaugaagcuggacgugggcaaggugcugcaggccagcguccuggacgacugguucccccuccagggcgggcagggccaggugcaccuccggcuggaguggcugucccugcugagcgacgccgagaagcucgagcagguccugcaguggaacuggggcguguccagccgccccgacccgcccuccgcggccauccuggugguguaccucgaccgcgcccaggaccugcccauggucaccagcgagcuguacccgccccagcucaagaaggggaacaaggagcccaaccccauggugcagcuguccauccaggacgugacccaggagagcaaggccgucuacuccaccaacugccccgugugggaggaggcguuccgguucuuccugcaggacccgcagagccaggagcucgacgugcaggucaaggacgacucccgcgcccugacgcugggggcccucacccugccccuggcccggcuccugaccgcccccgagcugauccucgaccagugguuccagcugagcuccagcggccccaacucccgccuguacaugaagcucgugaugcggauccuguaccuggacagcuccgagaucugcuucccgaccgugcccgggugccccggcgcgugggacgucgacagcgagaacccccagcgcggcagcuccguggacgccccgccccggcccugccacacgacccccgacagccaguucgggaccgagcacgugcuccgcauccacguccuggaggcccaggaccugaucgccaaggaccgguuccucggcgggcuggugaagggcaaguccgacccguacgugaagcugaagcucgccgggcgcagcuuccggucccacgucgugcgcgaggaccugaacccccgguggaacgagguguucgaggucaucgugaccagcgugcccggccaggagcuggaggucgagguguucgacaaggaccucgacaaggacgacuuccugggccgcugcaaggugcggcugacgaccguccucaacuccggguuccuggacgaguggcugacccucgaggacgugccgagcggccgccugcaccuccggcuggagcgccugacgccccgccccaccgcggccgagcuggaggaggugcuccaggucaacucccugauccagacccagaaguccgccgagcuggccgccgcgcuccugagcaucuacauggagcgggccgaggaccugccccuccgcaaggggaccaagcaccugagcccguacgccacccugacggugggcgacuccagccacaagaccaagaccaucucccagaccagcgcccccgugugggacgaguccgcgagcuuccucauccggaagccccacacggagagccuggagcugcagguccgcggggagggcaccggcgugcucgggucccugagccugccccucuccgagcugcugguggccgaccagcucugccuggaccggugguucacccugagcuccggccaggggcagguccuccugcgcgcccagcugggcauccucgugagccagcacuccggggucgaggcccacagccacuccuacagccacuccagcuccagccuguccgaggagccggagcugagcggcggcccgccccacaucaccuccagcgcccccgagcuccggcagcgccugacccacguggacagcccccuggaggcgcccgccgggccccucggccaggugaagcugacgcugugguacuacuccgaggagcggaagcucgucagcaucgugcacgggugccgcucccugcggcagaacggccgcgacccgcccgaccccuacgugagccugcuccugcugcccgacaagaaccgggggaccaagcgccggaccucccagaagaagcgcacccucagccccgaguucaacgagcgguucgagugggagcugccgcuggacgaggcccagcgccggaagcuggacgucuccgucaagagcaacuccagcuucaugucccgcgagcgcgagcuccugggcaaggugcagcuggaccucgccgagacggaccugagccagggcguggcccggugguacgaccugauggacaacaaggacaagggguccagcuga

SEQ ID NO: 29796 - RNA, 2682 nt, Artificial Sequence
  derived and/or modified sequence opt1 from ESYT2__Homo_sapiens__NP_065779
augacgcccccgagccgcgccgaggccggcgugcggcgcucccggguccccagcgaggggcgcuggcggggcgcggagccgcccgggaucuccgccagcacccagcccgccuccgccggccgcgccgcgcggcacugcggggccaugagcggcgcccgcggcgaggggcccgaggccggcgcgggcggggccgggggccgggccgcccccgagaaccccggcggggugcuguccguggagcucccgggccugcuggcccagcucgcgcgcagcuucgcccugcugcuccccgucuacgcccugggguaccugggccucuccuucagcugggugcugcuggcccucgcccugcuggcguggugccggcgcucccggggccucaaggcccugcgccugugccgggcccucgcccugcuggaggacgaggagcgcgugguccggcucggggugcgcgccugcgaccugcccgcgugggugcacuuccccgacaccgagcgggccgaguggcugaacaagaccgucaagcacauguggccguucaucugccaguucaucgagaagcuguuccgcgagaccaucgagcccgccgugcggggcgccaacacccaccugagcacguucuccuucaccaagguggacgucgggcagcagccccugcgcaucaacggcgugaagguguacaccgagaacgucgacaagcgccagaucauccucgaccugcagaucagcuucguggggaacugcgagaucgaccuggagaucaagcgguacuucugccgcgccggcgugaaguccauccagauccacggcaccaugcgggucauccucgagccccugaucggggacaugccgcuggugggcgcgcucagcaucuucuuccugcgcaagccccugcucgagaucaacuggacggggcugaccaaccugcucgacgugcccggccugaacgggcuguccgacaccaucauccucgacaucaucagcaacuaccugguccugcccaaccggaucaccgugccgcucguguccgagguccagaucgcccagcugcgcuuccccgugcccaagggcguccugcggauccacuucaucgaggcccaggaccuccagggcaaggacacguaccugaaggggcuggugaagggcaagagcgaccccuacgggaucauccgcgugggcaaccagaucuuccagagccgggucaucaaggagaaccuguccccgaaguggaacgagguguacgaggcccucguguacgagcaccccgggcaggagcuggagaucgagcuguucgacgaggaccccgacaaggacgacuuccucggcagccugaugaucgaccugaucgaggucgagaaggagcgccuccuggacgagugguucacccuggacgaggugcccaagggcaagcuccaccuccggcuggaguggcucacccugaugccgaacgcguccaaccuggacaaggugcucaccgacaucaaggccgacaaggaccaggccaacgacgggcugagcuccgcccugcucauccuguaccuggacagcgcccgcaaccuccccuccggcaagaagaucagcuccaaccccaacccggucgugcagaugagcguggggcacaaggcgcaggaguccaagauccgguacaagacgaacgagcccgucugggaggagaacuucaccuucuucauccacaaccccaagcgccaggaccuggagguggaggugcgggacgagcagcaccagugcagccugggcaaccucaaggucccccugucccagcugcucaccagcgaggacaugaccgugucccagcgcuuccagcugagcaacuccggcccgaacagcacgaucaagaugaagaucgcccugcgggugcuccaccuggagaagcgcgagcggccgcccgaccaccagcacuccgcccaggucaagcgccccagcgugagcaaggaggggcgcaagaccuccaucaagagccacauguccggcagccccgggcccggcggguccaacaccgcccccagcacccccgugaucggcggcuccgacaagccggggauggaggagaaggcccagccgcccgaggcgggcccccaggggcugcacgaccucggccggagcuccagcucccugcuggccagccccgggcacaucuccgucaaggagcccacgcccagcaucgccuccgacaucagccuccccaucgccacccaggagcugcgccagcggcugcgccagcucgagaacggcaccacccugggccaguccccgcuggggcagauccagcucacgauccggcacagcagccagcgcaacaagcugaucguggugguccacgccugccggaaccugaucgcguucuccgaggacggcagcgaccccuacgugcgcauguaccuccugcccgacaagcggcgcuccgggcggcgcaagacccacgugagcaagaagacccugaaccccgucuucgaccaguccuucgacuucagcgugucccucccggaggugcagcggcgcacccuggacgucgccgugaagaacagcggcggguuccuguccaaggacaagggccuccugggcaaggugcuggucgcccucgccagcgaggagcuggcgaagggguggacgcagugguacgaccugaccgaggacggcacccggccccaggccaugaccuga

SEQ ID NO: 29797 - RNA, 2661 nt, Artificial Sequence
  derived and/or modified sequence opt1 from ESYT3__Homo_sapiens__NP_114119
augcgcgccgaggagcccugcgccccgggcgcgcccagcgcccugggggcccagcggacccccggccccgagcuccgccuguccagccagcugcucccggagcugugcaccuucgugguccgggugcuguucuaccucgggcccguguaccuggccggcuaccuggggcucuccaucacguggcugcugcucggcgcccugcuguggaugugguggcgccggaaccgccggggcaagcucgggcgccuggcggccgccuucgaguuccuggacaacgagcgggaguucaucagccgcgagcuccggggccagcaccuccccgccuggauccacuuccccgacgucgagcgcguggagugggcgaacaagaucaucucccagaccuggccguaccugagcaugaucauggaguccaaguuccgggagaagcuggagcccaagauccgcgagaaguccauccaccuccggaccuucaccuucacgaagcuguacuucgggcagaagugcccccgcgugaacggcgucaaggcccacaccaacacgugcaaccggcgccgggugaccguggaccugcagaucugcuacaucggggacugcgagaucuccgucgagcugcagaagauccaggccggcgugaacggcauccagcugcaggggacccuccgcgugauccuggagccccugcucgucgacaagccguucgugggcgccgugaccgucuucuuccugcagaagccccaccuccagaucaacuggaccgggcugaccaaccugcuggacgcccccggcaucaacgacgugagcgacucccuccuggaggaccugaucgcgacgcaccucgugcugcccaaccgggucaccgugccggugaagaagggccuggaccucaccaaccugcgcuucccccugcccugcggggucauccgcgugcaccuccuggaggccgagcagcuggcccagaaggacaacuuccucggccugcggggcaagagcgaccccuacgccaagguguccaucgggcugcagcacuuccgcagccggaccaucuaccgcaaccugaacccgacguggaacgaggucuucgaguucaugguguacgagguccccgggcaggaccucgagguggaccuguacgacgaggacaccgaccgggacgacuuccugggcucccuccagaucugccugggcgacgugaugaccaaccgcgucguggacgagugguucgugcugaacgacaccacgagcgggcggcuccaccuccgccuggaguggcugucccugcugaccgaccaggagguccucaccgaggaccacggcgggcugagcaccgccauccuggugguguuccucgaguccgcgugcaaccugccccggaaccccuucgacuaccugaacggcgaguaccgcgccaagaagcucagccgguucgcccgcaacaaggucagcaaggacccguccagcuacgugaagcuguccguggggaagaagacgcacaccagcaagaccugcccccacaacaaggaccccgucuggucccagguguucagcuucuucgugcacaacgucgccaccgagcggcugcaccucaaggugcuggacgacgaccaggagugcgcccugggcaugcucgaggugccccugugccagauccugccguacgcggaccucacgcuggagcagcgcuuccagcuggaccacuccggccucgacagccugaucuccaugcggcugguccuccgcuuccuccagguggaggagcgggagcuggggagccccuacaccggccccgaggcccugaagaaggggccgcugcugaucaagaagguggccaccaaccagggccccaaggcccagccccaggaggaggggcccaccgaccucccgugcccgcccgaccccgccuccgacacgaaggacgucagccgcuccaccaccaccacgaccagcgcgaccaccguggccaccgagcccacgucccaggagaccggccccgagcccaagggcaaggacagcgccaagcgguucugcgagcccaucggggagaagaaguccccggccaccaucuuccugaccgugcccggcccccacagccccgggccgaucaagagcccccgccccaugaagugccccgcgagcccguucgccuggccgcccaagcgccuggcccccagcauguccagccucaacucccuggccagcuccugcuucgaccuggccgacaucagccucaacaucgagggcggcgaccugcggcgccggcagcugggggagauccagcucacgguccgcuacgugugccugcggcgcugccuguccgugcucaucaacggcugccggaaccugacccccugcaccagcuccggggcggaccccuacguccgcguguaccugcuccccgagcggaagugggccugccgcaagaagaccagcgugaagcggaagacgcuggagccgcuguucgacgagaccuucgaguucuucguccccauggaggaggugaagaagcgcucccucgacguggccgucaagaacagccggccccugggcucccaccgccggaaggagcuggggaaggugcucaucgaccugagcaaggaggaccugaucaagggcuucucccagugguacgagcucacccccaacggccagccgcgcagcuga

SEQ ID NO: 29798 - RNA, 2781 nt, Artificial Sequence
  derived and/or modified sequence opt1 from ETAA1__Homo_sapiens__NP_061875
augagccgccggcgcaagcacgacgacucccccagcccgaagaagacgccccacaagaccguggccgccgaggagugcggcuccgucguggagcccgggcggcgccggcugcgcagcgcgcggggcuccuggcccugcggggcccgcgagggcccgcccgggcccgugcggcagcgcgagcagcccccgacggccgcccucugcagcaaguccaaccccgaggagcgguacgagacccccaagcgcgcccugaagauggacagccuguccagcuccuucagcucccccaacgacccggacggccagaacgacaucuucugggaccagaacagcccccucaccaagcagcugggcaaggggcggaagaagcagaucuacaccacggacuccgacgagaucagccacaucgucaaccgcaucgcgccccaggacgagaagcccaccaccaacuccaugcuggacauguggaucggcgagaccgccaucccgugcacgcccagcguggccaaggggaagucccgggccaagaucagcugcaccaagcucaagacccagagccaggaggaggagcugaugaagcuggcgaagcaguucgacaagaacauggaggagcucgacgugauccaggagcagaacaagcgcaacuacgacuucacccagaugaucuccgagacggagauccugagcaacuacaaggacaacauccagauguggucccugcacaacaucguccccgagaucgacaacgccaccaagaagcccaucaagggcaacaccaagaucagcguggccaacaaccagaacuccagccagaagccguucgaccagaucgccgaggccgcguucaacgccaucuucgacggguccacccagaagugcagcggccagcucucccaggagcugcccgaggccuucuggagcacguccaacaccaccuucgugaagaccaacgcccugaaggaggagaagaucaucacgaacgagacccucgucaucgagaagcugagcaacaagacgccccggucccugagcucccagguggacacccccaucaugaccaagagcugcgugaccuccugcaccaaggagccggagaccagcaacaaguacaucgacgccuucaccaccuccgacuucgaggacgacugggagaaccuccugggcagcgagcccuucgcgaugcagaacaucgacaugcccgagcuguuccccagcaagaccgcccacgucaccgaccagaaggagaucugcacguucaacuccaagaccgugaagaacaccagccgcgccaacaccuccccggacgcccggcucggggacagcaaggugcugcaggaccuguccagcaagacguacgaccgcgagcucaucgacgccgaguaccgguucucccccaacagcaacaaguccaacaagcugagcaccggcaacaagaugaaguucgagaacuccagcaacaagaucgucauccaggacgagauccagaacugcaucgugaccuccaaccugaccaagaucaaggaggacauccucaccaacagcacggaggcguccgagcgcaagagcgcccugaacacccgcuacuccaacgagcagaagaacaagugcauccugaaccagagcaucaaggcccccgugaacaccgaccucuucgggagcgccaaccugggcuccaagaccagcgucuccaacccgaaccagacgagcgccuccaaggugggcagcuucuucgacgacuggaacgaccccuccuucgcgaacgagaucaucaaggccugccaccagcuggacaacaccugggaggccgacgacguggacgacgaccuccuguaccaggccugcgacgacaucgagcggcugacccagcagcaggacauccgcaaggacagcaagaccuccgagagcaucugcgagaucaacaacaacuccgagcacggggcgaagcucacgcagcagcaggacauccggaaggacagcaagaccuccgagagcaucugcgagaucaacaacaacuccgagcacggcgccaagaacauguucgccaucagcaagcagggguccaaccugguccagagcaagcaccugaaccccggcuccaucagcgugcagaccagccucaccaacuccagccagaucgacaagcccaugaagauggagaagggggagauguacggcaacuccccgcgcuuccugggcgccacgaaccugaccauguacagcaagaucuccaacugccagaucaacaaccuccacgugagcuacaccaacaccgacguccccauccaggugaacuccagcaagcugguccugcccggguccagcucccucaacgugacgagcgaccacaugaacaccgagaucaccaccuacaagaagaagcuguccacgaaccagcccugccacaagaccgugaccgacgaggcccagagcaaccugaacaccacggucggcuucuccaaguucaccuucacccggaugaagaacagccagauccucucccaguucaaccagaacugcaucaccgggagcauguccgacacgaagaucacccagggcguggagaagaagaagggggugaacccgcugcuggaggaggcggucggccagcagagccuggugaagcucagcgagucccugaagcagagcuccaaggaggaggaggagaagaaccgcaagugcagccccgaggagauccagcggaagcgccaggaggcccuggugcggcgcauggccaaggcccgggccuccagcgucaacgcggcccccaccuccuuccucuga

SEQ ID NO: 29799 - RNA, 1272 nt, Artificial Sequence
  derived and/or modified sequence opt1 from ETF1__Homo_sapiens__NP_001269114
augaagcaggacgugcugaacugcaccgagggccccauccacagcaacgggaccuccaugaucagccucaucaucccgcccaaggaccagaucucccgcgucgccaagaugcuggccgacgaguucggcacggcgagcaacaucaagucccgggugaaccgccugagcgugcucggggccaucaccuccguccagcagcggcugaagcuguacaacaaggugccgcccaacggccucguggucuacugcgggaccaucgugaccgaggagggcaaggagaagaaggugaacaucgacuucgagcccuucaagcccaucaacacgagccuguaccugugcgacaacaaguuccacaccgaggcccucaccgcccugcuguccgacgacagcaaguucggcuucaucgucaucgacggguccggcgcccucuucgggacccugcagggcaacacgcgcgaggugcugcacaaguucaccguggaccuccccaagaagcacgggcggggcggccagagcgcgcugcgcuucgcccggcugcgcauggagaagcggcacaacuacguccgcaagguggccgagaccgccgugcagcuguucaucuccggggacaaggucaacguggcgggccucgugcuggccgggagcgccgacuucaagaccgagcucucccagagcgacauguucgaccagcggcugcaguccaagguccugaagcucguggacaucagcuacggcggcgagaacggguucaaccaggccaucgagcuguccacggaggugcugagcaacgucaaguucauccaggagaagaagcucaucggccgcuacuucgacgagaucagccaggacaccgggaaguacugcuucggcguggaggacacccugaaggcccuggagaugggggcgguggagauccucaucgucuacgagaaccuggacaucaugcgguacgugcugcacugccagggcaccgaggaggagaagauccucuaccugacgcccgagcaggagaaggacaagucccacuucaccgacaaggagaccggccaggagcacgagcugaucgagagcaugccgcuccuggagugguucgccaacaacuacaagaaguucggggccacccuggagaucgucacggacaagucccaggagggcagccaguucgugaagggguucggcgggaucggcggcauccuccgcuaccggguggacuuccaggggauggaguaccagggcggggacgacgaguucuucgaccuggacgacuacuga

SEQ ID NO: 29800 - RNA, 1002 nt, Artificial Sequence
  derived and/or modified sequence opt1 from ETFA__Homo_sapiens__NP_000117
auguuccgcgccgccgcgcccggccagcugcggcgcgccgccagccuccugcgguuccaguccacccuggugaucgccgagcacgccaacgacagccucgcgccgaucacccugaacacgaucaccgccgccacccgccucgggggcgaggucuccugccugguggccgggaccaagugcgacaagguggcgcaggaccugugcaaggucgccggcaucgccaaggugcugguggcccagcacgacgucuacaaggggcuccugcccgaggagcugacgccccucauccuggccacccagaagcaguucaacuacacccacaucugcgcgggcgccagcgccuucggcaagaaccugcucccccggguggccgccaagcuggagguggcgccgaucuccgacaucaucgccaucaagagccccgacaccuucguccgcacgaucuacgccgggaacgcccugugcaccgugaagugcgacgagaaggugaaggucuucuccgugcggggcaccagcuucgacgccgcggccaccuccgggggcagcgccuccagcgagaaggccuccagcacgucccccguggagaucagcgaguggcucgaccagaagcugaccaaguccgaccgccccgagcugaccggggccaaggucguggugagcggcggccgggggcucaaguccggcgagaacuucaagcugcuguacgaccucgcggaccagcugcacgccgccgucggggccagccgcgcggccguggacgccggcuucgugccgaacgacaugcaggucggccagaccgggaagaucguggcccccgagcuguacaucgccgugggcaucagcggggcgauccagcaccucgccggcaugaaggacuccaagacgaucgucgccaucaacaaggaccccgaggcccccaucuuccagguggccgacuacgggaucgucgcggaccuguucaagguggugccggagaugaccgagauccugaagaagaaguga

SEQ ID NO: 29801 - RNA, 1041 nt, Artificial Sequence
  derived and/or modified sequence opt1 from ETFB__Homo_sapiens__NP_001014763
auguaccugagccucugggugaccaucaacaccgucaaccugcgcaacacgcuguccggccuccgcggggccgugaccaccgugggcaugaucaagagcgacguccccgggacccaggaguggcuggacgagcgccggcgccagggcgaccugccgcuccccacgaacuccaaccccgugcugagccuggagcucugcgaccccgggcagggcccggcccccuuccaggcgguggucgugcugauccagcccggccgggggcuggcccuccggcccccgcccuccugccuguucccgcccgaccccacccccagcccgcccgccggccagauccgggugaagcccgaccgcaccggggucgugaccgacggcgugaagcacuccaugaaccccuucugcgagaucgccgucgaggaggccgugcggcugaaggagaagaagcucgugaaggaggucaucgcggugagcugcgggcccgcccagugccaggagacgauccgcaccgcccuggccaugggcgcggaccggggcauccacguggaggugcccccggccgaggccgagcgccuggggccccuccaggucgcccgggugcuggccaagcuggcggagaaggagaaggucgaccucgugcugcugggcaagcaggccaucgacgacgacugcaaccagaccgggcagaugaccgccggcuuccucgacuggccccagggcacguucgccucccaggugacccuggagggggacaagcugaaggucgagcgcgagaucgacggcgggcucgagacccugcggcugaagcuccccgccguggucaccgcggaccugcgccugaacgagccgcgguacgccacgcuccccaacaucaugaaggccaagaagaagaagaucgaggugaucaagcccggcgaccuggggguggaccugaccagcaagcucuccgucaucagcguggaggacccgccccagcgcaccgccggcgugaaggucgagaccacggaggaccugguggccaagcugaaggagaucggccggaucuga

SEQ ID NO: 29802 - RNA, 1713 nt, Artificial Sequence
  derived and/or modified sequence opt1 from ETFDH__Homo_sapiens__NP_001268666
augcuggugccccucgccaagcugagcugccugggcgucaacauggagcgcuucgccgaggaggcggacguggugaucgucggggccggcccggccgggcucuccgccgccgugcggcugaagcagcuggcgguggcccacgagaaggacauccgcgucugccucguggagaaggccgcccagaucggcgcgcacacccugagcggggccugccuggaccccggcgccuucaaggagcuguuccccgacuggaaggagaagggcgccccgcucaacaccccggugacggaggaccgguucgggauccugaccgagaaguaccgcauccccguccccauccuccccggccugccgaugaacaaccacgggaacuacaucgugcggcugggccaccucguguccuggaugggggagcaggccgaggcgcugggcgucgagguguaccccggcuacgccgccgccgaggugcuguuccacgacgacgggagcgucaagggcaucgccaccaacgacguggggauccagaaggacggcgcgcccaaggccaccuucgagcgcggccucgagcugcacgccaaggugacgaucuucgccgaggggugccacggccaccuggccaagcagcucuacaagaaguucgaccugcgggcgaacugcgagccccagaccuacgggaucggccugaaggagcucugggucaucgacgagaagaacuggaagccggggcgcguggaccacaccgugggcuggccccuggaccggcacaccuacggcggguccuuccuguaccaccucaacgagggcgagccccuggucgcccuggggcucguggugggccuggacuaccagaaccccuaccugagcccguuccgcgaguuccagcgguggaagcaccaccccuccauccgccccacgcucgagggcgggaagcggaucgccuacggcgcccgcgcccugaacgagggcggguuccagagcauccccaagcugaccuuccccgggggccuccugaucgggugcucccccggcuucaugaacguccccaagaucaagggcacccacaccgcgaugaaguccgggauccuggccgccgagagcaucuucaaccagcucacgagcgagaaccugcaguccaagaccaucggccugcacgugaccgaguacgaggacaaccucaagaacagcugggucuggaaggagcuguacuccgugcggaacauccgccccagcugccacggggugcugggcgucuacggcgggaugaucuacaccggcaucuucuacuggauccuccgggggauggagccguggacgcugaagcacaagggcuccgacuucgagcgccugaagcccgccaaggacugcacccccaucgaguaccccaagccggacgggcagaucagcuucgaccuccuguccagcguggcgcugagcggcaccaaccacgagcacgaccagcccgcccaccugacccuccgggacgacuccauccccgugaaccgcaaccugagcaucuacgacggcccggagcagcgguucugccccgccggggucuacgaguucgugcccguggagcagggcgacggguuccgccugcagaucaacgcccagaacugcguccacugcaagacgugcgacaucaaggaccccucccagaacaucaacuggguggugccggagggcgggggcggccccgccuacaacgggauguga

SEQ ID NO: 29803 - RNA, 765 nt, Artificial Sequence
  derived and/or modified sequence opt1 from ETHE1__Homo_sapiens__NP_055112
auggccgaggccgugcugcgcgucgcgcggcgccagcucagccagcggggcggguccggcgcccccauccugcugcgccagauguucgagccggugagcugcaccuucaccuaccuccugggggaccgggagucccgcgaggccgugcugaucgaccccguccucgagacggcgccccgggacgcccagcugaucaaggagcugggccuccgccugcuguacgccgugaacacccacugccacgccgaccacaucaccgggagcggccuccugcggucccugcuccccggcugccagagcgugaucucccgccugagcggggcccaggccgaccugcacaucgaggacggcgacuccauccgguucgggcgcuucgcgcucgagacccgggccagcccgggccacacgcccgggugcgucaccuucgugcugaacgaccacuccauggccuucaccggcgacgcccugcucauccgcggcugcgggcggaccgacuuccagcagggcugcgccaagacgcuguaccacagcgugcacgagaagaucuucacccugcccggggacugccucaucuaccccgcgcacgacuaccacggcuucaccgucuccaccguggaggaggagcgcacgcugaacccgcggcugacccucagcugcgaggaguucgugaagaucaugggcaaccugaaccugcccaagccccagcagaucgacuucgccguccccgccaacaugcgcugcggggugcagaccccgaccgccuga

SEQ ID NO: 29804 - RNA, 777 nt, Artificial Sequence
  derived and/or modified sequence opt1 from ETNK1__Homo_sapiens__NP_001034570
augcugugcggccgcccccggagcuccagcgacaaccgcaacuuccuccgggagcgcgccgggcuguccagcgccgcggugcagacccggaucggcaacuccgccgccagccgccgguccccggccgcccgcccgcccguccccgcgccgcccgcccugccccgggggcgccccggcaccgaggggagcacgucccucagcgcccccgccgugcugguggucgcgguggccguggucgugguggucguguccgccguggccugggccauggcgaacuacauccacgucccgcccggcagccccgaggugcccaagcugaacgugaccguccaggaccaggaggagcaccggugccgcgagggcgcccucucccugcugcagcaccuccggccccacugggacccccaggaggugacccugcagcuguucaccgacgggaucacgaacaagcucaucggcugcuacguggggaacaccauggaggacgucgugcuggugcgcaucuacggcaacaagaccgagcugcucgucgaccgggacgaggaggucaagagcuuccgcgugcugcaggcccacgggugcgcgccccagcuguacugcaccuucaacaacggccucugcuacgaguucauccagggcgaggcccuggacccgaagcacgugugcaaccccgccaucuucucccugagcucccucacgcugugcaaggggaagaccacccggugcuucggccugaccgggugccgcggcagccggcuccugcuguccuucuucuga

SEQ ID NO: 29805 - RNA, 1185 nt, Artificial Sequence
  derived and/or modified sequence opt1 from ETNK2__Homo_sapiens__NP_001284689
auggccgugcccccgagcgcgccccagccccgcgccuccuuccaccuccggcgccacacccccugcccgcagugcagcuggggcauggaggagaaggccgccgccuccgccagcugccgggagccgcccgggccgccccgcgcggccgccgucgccuacuucggcaucuccguggaccccgacgacauccugcccggggcgcugcggcugauccaggagcuccgcccccacuggaagcccgagcagguccggaccaagcgcuucacggacggcaucaccaacaagcugguggccugcuacguggaggaggacaugcaggacugcgugcugguccggguguacggggagcgcaccgagcuccugguggaccgggagaacgagguccgcaacuuccagcugcuccgggcccacagcugcgcccccaagcuguacugcaccuuccagaacggccugugcuacgaguacaugcagggcguggcccucgagcccgagcacauccgcgagccccggcuguuccgccugaucgcgcucgagauggccaagauccacacgauccacgccaacgggucccugccgaagcccauccuguggcacaagaugcacaacuacuucacccucgugaagaacgagaucaaccccagccuguccgccgacguccccaagguggaggugcuggagcgggagcucgccuggcugaaggagcaccugagccagcucgaguccccggucguguucugccacaacgaccugcugugcaagaacaucaucuacgacagcaucaagggccacgugcgcuucaucgacuacgaguacgcgggguacaacuaccaggccuucgacaucggcaaccacuucaacgaguucgccggggucaacgagguggacuacugccucuaccccgcccgggagacccagcugcaguggcugcacuacuaccuccaggcccagaagggcauggcggugacgccccgcgagguccagcggcuguacguccaggugaacaaguucgcccugggccccuccugcgugagcuccaccaugaccgccagccuccagugcugccgcguggggaaccgccacggcgagaucgcccggcugacccuguccggccucuucccgggggucagccugcugcucggcucccuggggccccaccccgagcccgugcugcaccaccgccucuga

SEQ ID NO: 29806 - RNA, 1482 nt, Artificial Sequence
  derived and/or modified sequence opt1 from ETNPPL__Homo_sapiens__NP_001140062
augugcgagcuguacagcaagcgcgacacccucggccugcggaagaagcacaucgggcccuccugcaagguguucuucgccagcgacccgaucaagaucguccgcgcccagcggcaguacauguucgacgagaacggcgagcaguaccuggacugcaucaacaacguggcgcacgggguggucaaggccgcccucaagcagauggagcugcugaacaccaacucccgcuuccuccacgacaacaucguggaguacgccaagcggcugagcgccacgcugcccgagaagcucuccgugugcuacuucaccaacagcggcuccgaggcgaacgaccuggcccugcgccucgcccggcaguuccgcgggcaccaggacgucaucacccuggaccacgccuaccacggccaccugagcucccucaucgagaucagccccuacaaguuccagaagggcaaggacgugaagaaggaguucgugcacgucgcgcccaccccggacacguaccgggggaaguaccgcgaggaccacgccgacuccgccagcgccuacgccgacgaggugaagaagaucaucgaggacgcgcacaacuccggccggaagaucgccgccuucaucgccgagagcaugcaguccugcgggggccagaucaucccgcccgccggguacuuccagaagguggcggaguacguccacggcgccggcgggguguucaucgccgacgaggugcaggucggcuucgggcgcgugggcaagcacuucuggagcuuccagauguacggcgaggacuucgugcccgacaucgucaccauggggaagcccaugggcaacgggcaccccguggccugcguggucaccaccaaggagaucgccgaggcguucuccagcuccggcauggaguacuucaacacguacgggggcaaccccgugagcugcgccgugggccuggccguccuggacaucaucgagaacgaggaccuccaggggaacgccaagcgggugggcaacuaccugaccgagcugcucaagaagcagaaggccaagcacacccugaucggggacauccgcggcaucgggcuguucaucggcaucgaccucgucaaggaccaccugaagcggacccccgcgacggccgaggcccagcacaucaucuacaagaugaaggagaagcgcgugcugcucagcgccgacggcccgcaccggaacgugcugaagaucaagccgcccaugugcuucaccgaggaggacgcgaaguucauggucgaccagcuggaccgcauccucaccgugcuggaggaggccauggggaccaagacggaguccgugaccagcgagaacacccccugcaagaccaagaugcugaaggaggcccacaucgagcuccugcgggacuccacgaccgacagcaaggagaaccccucccgcaagcggaacggcaugugcaccgacacccacagccugcucuccaagcgccugaagacguga

SEQ ID NO: 29807 - RNA, 1458 nt, Artificial Sequence
  derived and/or modified sequence opt1 from ETS1__Homo_sapiens__NP_001137292
augagcuacuucguggacuccgccggcagcucccccgucccguacagcgcgccccgccccgccguggugcggcaggggcccuccaacaccuacgaggacccgcgcaugaacugcggcuuccagagcaacuaccaccagcagcggcccugcuaccccuucugggacgagauggccacccaggagguccccacggggcuggagcacugcguguccgacauggagugcgccgacgugccgcuccugacccccagcuccaaggagaugaugagccaggcccugaaggccaccuucuccggcuucaccaaggagcagcagcgccucgggauccccaaggacccccggcaguggacggagacccacguccgcgacugggugaugugggcggugaacgaguucagccugaagggcgucgacuuccagaaguucugcaugaacggcgccgcccugugcgcccucgggaaggacugcuuccuggagcuggcgccggacuucgugggcgacauccucugggagcaccuggagauccugcagaaggaggacgugaagcccuaccaggucaacggggugaaccccgccuaccccgagucccgguacaccagcgacuacuucaucuccuacggcaucgagcacgcccagugcgugccgcccagcgaguucuccgagcccagcuucaucaccgaguccuaccagacgcuccaccccaucagcagcgaggagcugcugucccucaaguacgagaacgacuacccgagcgucauccugcgcgacccccugcagaccgacacccuccagaacgacuacuucgccaucaagcaggagguggugacccccgacaacaugugcauggggcggacgucccgcggcaagcugggcgggcaggacagcuucgaguccaucgagagcuacgacuccugcgaccggcugacccagagcugguccagccaguccagcuucaacucccuccagcgcguccccagcuacgacuccuucgacagcgaggacuacccggccgcgcugcccaaccacaagcccaagggcaccuucaaggacuacgugcgggaccgcgccgaccugaacaaggacaagcccgugaucccggccgccgcccucgcgggguacaccggcuccggccccauccagcuguggcaguuccugcucgagcugcugacggacaagagcugccaguccuucaucagcuggaccggggacggcugggaguucaagcucagcgaccccgacgaggucgcccggcgcugggggaagcggaagaacaagccgaagaugaacuacgagaagcugucccgcggccugcgguacuacuacgacaagaacaucauccacaagaccgccgggaagcgcuacguguaccgguucgugugcgaccuccagagccugcugggcuacacccccgaggagcuccacgccaugcuggacgucaagcccgacgccgacgaguga

SEQ ID NO: 29808 - RNA, 1830 nt, Artificial Sequence
  derived and/or modified sequence opt1 from ETS2__Homo_sapiens__NP_001243224
augggcagcgcccaguuccaggggcugaucacccaggcccgccuccccuucggcgcgaccuccacgaccgccccgagccugcggaacuccaaggggcgcuucggcgugcgggcccuggcccccgagcgcacccccagcgcgccccggaaggucuccgcccgccucccggggcggacccuggcccgcacguggggccggggccccgcccccggggccagcggccccgcgggggagggcccgucccgcgugaccgccgggggcggcgggaagcugcgggcccccggcgccgcccgccccgcgagcgggcuccccgaccggcuguggccggcccccucccccagccccggcgcccaccgcgccgccgcgggcgccgagcagccgcccucccggcccagcgccgggcccgcccgcuccggccggaugaacgacuucgggaucaagaacauggaccagguggccccggucgcgaacagcuaccgcggcacccugaagcggcagcccgccuucgacaccuucgacgggucccucuucgccguguuccccagccugaacgaggagcagacgcugcaggaggugcccaccggccucgacuccaucagccacgacuccgccaacugcgagcugccgcugcucacccccugcagcaaggccgucaugagccaggcgcugaaggccaccuucuccggcuucaagaaggagcagcgccggcuggggauccccaagaaccccuggcucuggagcgagcagcaggucugccaguggcugcugugggccacgaacgaguucucccucgugaacgugaaccugcagcgcuucggcaugaacgggcagaugcugugcaaccucggcaaggagcgcuuccuggagcuggccccggacuucgugggggacauccucugggagcaccuggagcagaugaucaaggagaaccaggagaagaccgaggaccaguacgaggagaacagccaccugaccuccgugccccacuggaucaacagcaacacccucggcuucggcacggagcaggcgcccuacgggaugcagacccagaacuacccgaagggcgggcugcuggacuccaugugccccgccagcacccccuccguccucagcuccgagcaggaguuccagauguuccccaagagccggcuguccagcguguccgugaccuacugcagcgucucccaggacuucccgggcagcaaccugaaccuccugacgaacaacuccgggacccccaaggaccacgacagccccgagaacggcgccgacagcuucgaguccagcgacucccugcuccagagcuggaacucccagagcucccugcuggacgugcagcgcgugcccagcuucgaguccuucgaggacgacugcagccagucccucugccugaacaagccgaccaugagcuucaaggacuacauccaggagcgguccgaccccgucgagcagggcaagcccgugauccccgccgccgugcuggcgggguucaccggcagcgggccgauccagcucuggcaguuccugcuggagcuccuguccgacaagagcugccaguccuucaucagcuggacgggcgacggcugggaguucaagcuggccgaccccgacgaggucgcccgccggugggggaagcgcaagaacaagcccaagaugaacuacgagaagcugagccggggccuccgcuacuacuacgacaagaacaucauccacaagaccuccgggaagcgguacguguaccgcuucgugugcgaccugcagaaccugcucggcuucacccccgaggagcugcacgccauccuggggguccagccggacaccgaggacuga

SEQ ID NO: 29809 - RNA, 1365 nt, Artificial Sequence
  derived and/or modified sequence opt1 from ETV1__Homo_sapiens__NP_001156619
auggacggcuucuacgaccagcagguccccuacauggugaccaacagccagcgcgggcggaacugcaacgagaagccgaccaacgugcgcaagcggaaguucaucaaccgcgaccuggcccacgacuccgaggagcuguuccaggaccucagccagcugcaggagacguggcucgccgaggcccaggugcccgacaacgacgagcaguucguccccgacuaccaggcggagucccuggccuuccacggccugccccucaagaucaagaaggagccgcacagccccugcuccgagaucagcuccgccugcagccaggagcagcccuucaaguucuccuacggggagaagugccuguacaacgugagcgccuacgaccagaagccccaggugggcaugcggccguccaacccgcccacccccagcuccacccccgucagcccccugcaccacgcgucccccaacagcacccacacgcccaagccggaccgcgccuuccccgcccaccucccgcccucccagagcauccccgacuccagcuaccccauggaccaccgguuccgccggcagcugagcgagcccugcaacuccuucccgccccugcccaccaugccccgcgaggggcggcccauguaccagcgccagaugagcgagccgaacauccccuucccgccccagggcuucaagcaggaguaccacgaccccguguacgagcacaacaccauggugggcuccgccgcgagccaguccuucccgccgccccucaugaucaagcaggagccccgggacuucgccuacgacagcgggugcauguucgagaagggcccccgccaguucuacgacgacacgugcgucgugcccgagaaguucgacggggacaucaagcaggagcccggcauguaccgggaggggcccaccuaccagcgccggggcucccugcagcuguggcaguuccucguggcccugcuggacgaccccagcaacucccacuucaucgccuggaccggccgcgggauggaguucaagcucaucgagcccgaggaggucgcccggcgcuggggcauccagaagaaccggccggcgaugaacuacgacaagcugagccgcucccugcgcuacuacuacgagaaggggaucaugcagaagguggccggcgagcgguacguguacaaguucgucugcgaccccgaggcccucuucagcauggccuuccccgacaaccagcgcccccugcugaagaccgacauggagcggcacaucaacgaggaggacaccgugccgcucucccacuucgacgagagcauggccuacaugcccgagggcgggugcugcaacccccaccccuacaacgagggcuacguguacuga

SEQ ID NO: 29810 - RNA, 432 nt, Artificial Sequence
  derived and/or modified sequence opt1 from ETV3__Homo_sapiens__NP_005231
augaaggccggcugcagcaucguggagaagcccgagggcgggggcggguaccaguucccggacugggccuacaagaccgaguccagccccgggucccgccagauccagcuguggcacuucauccucgagcugcugcagaaggaggaguuccggcacgucaucgcguggcagcagggcgaguacggcgaguucgugaucaaggaccccgacgagguggcccgccucugggggcggcgcaagugcaagccccagaugaacuacgacaagcugagccgggcccugcgcuacuacuacaacaagcggauccuccacaagaccaagggcaagcgcuucacguacaaguucaacuucaacaagcuggucaugccgaacuaccccuucaucaacauccgguccagcgggaagauccagacccugcucgugggcaacuga

SEQ ID NO: 29811 - RNA, 1455 nt, Artificial Sequence
  derived and/or modified sequence opt1 from ETV4__Homo_sapiens__NP_001073143
auggagcgccggaugaaggccggcuaccuggaccagcagguccccuacaccuucagcuccaagagcccggggaacggcucccuccgcgaggcccugaucgggccccugggcaagcucauggaccccgggagccugcccccgcuggacuccgaggaccucuuccaggaccugagccacuuccaggagaccuggcuggcggaggcccaggugcccgacuccgacgagcaguucgugcccgacuuccacagcgagaaccucgccuuccacucccccacgacccggaucaagaaggagccgcagagcccccgcaccgaccccgcccuguccugcagccggaagcccccgcugcccuaccaccacggcgagcagugccucuacuccagcgccuacgacccgccccgccagaucgcgaucaagucccccgcccccggcgcccuggggcagagcccccugcagcccuucccgcgggccgagcagcgcaacuuccuccgguccagcggcaccucccagccccaccccgggcacggcuaccugggggagcacagcagcguguuccagcagccccuggacaucugccacuccuucacgagccagggcggcgggcgcgagccgcuccccgcgcccuaccagcaccagcuguccgagcccugcccgcccuacccccagcagagcuucaagcaggaguaccacgacccgcuguacgagcaggccggccagcccgccgucgaccagggcggggugaacggccaccgguaccccggggccggcguggucaucaagcaggagcagaccgacuucgccuacgacuccgacgugaccgggugcgcgagcauguaccuccacaccgagggcuucuccgggcccagcccgggcgacggcgccaugggguacggcuacgagaagccccugcgccccuuccccgacgacgugugcgucgugccggagaaguucgagggggacaucaagcaggagggcgugggggccuuccgggagggcccgcccuaccagcgccggggcgcccugcagcucuggcaguuccuggucgcccugcucgacgaccccacgaacgcgcacuucaucgccuggaccgggcgcggcauggaguucaagcugaucgagcccgaggagguggcccggcugugggggauccagaagaaccgccccgccaugaacuacgacaagcucucccggagccugcgcuacuacuacgagaagggcaucaugcagaagguggccggggagcgguacgucuacaaguucgugugcgagcccgaggcgcuguucucccucgccuuccccgacaaccagcgcccggcccugaaggccgaguucgaccgccccgugagcgaggaggacaccgucccccugucccaccucgacgagagccccgccuaccugccggagcuggcgggccccgcccagcccuucggccccaagggcggguacuccuacuga

SEQ ID NO: 29812 - RNA, 1533 nt, Artificial Sequence
  derived and/or modified sequence opt1 from ETV5__Homo_sapiens__NP_004445
auggacggcuucuacgaccagcagguccccuucauggucccgggcaagagccgcuccgaggagugccggggccgccccgugaucgaccggaagcgcaaguuccuggacaccgaccucgcccacgacagcgaggagcuguuccaggaccugucccagcuccaggaggccuggcuggcggaggcccaggugcccgacgacgagcaguucguccccgacuuccagagcgacaaccuggugcuccacgccccgccgcccaccaagaucaagcgggagcugcacucccccagcuccgagcugagcuccugcagccacgagcaggcccucggggccaacuacggcgagaagugccuguacaacuacugcgcguacgaccgcaagccgcccuccggguucaagccccugacgcccccgaccacgccccucagccccacccaccagaacccccuguucccgccgccccaggccacccugcccaccuccggccacgcccccgccgcgggccccgugcaggggguggggcccgcccccgccccgcacagccuccccgagcccgggccccagcagcagaccuucgccgugccgcggccgccccaccagccccugcagaugcccaagaugaugcccgagaaccaguaccccuccgagcagcgcuuccagcggcagcugagcgagccgugccaccccuucccgccccagcccggcgugcccggggacaaccgccccuccuaccaccggcagaugagcgagcccaucgucccggccgcgcccccgccgccccagggcuucaagcaggaguaccacgacccccucuacgagcacggcgugcccgggaugcccggcccgcccgcccacggguuccagucccccaugggcaucaagcaggagccccgcgacuacugcguggacagcgagguccccaacugccagagcuccuacaugcggggcggguacuucagcuccagccacgagggcuucuccuacgagaaggacccccgccuguacuucgacgacacgugcguggugcccgagcggcuggaggggaaggucaagcaggagcccaccauguaccgcgagggcccgcccuaccagcggcgcgggagccuccagcuguggcaguuccuggugacccuccuggacgaccccgccaacgcccacuucaucgccuggaccggccggggcauggaguucaagcugaucgagcccgaggagguggcgcgccggugggggauccagaagaaccgccccgccaugaacuacgacaagcucucccgcagccugcgguacuacuacgagaagggcaucaugcagaaggucgccggggagcgcuacguguacaaguucgugugcgaccccgacgcccuguucuccauggccuuccccgacaaccagcggccguuccucaaggcggagagcgagugccaccuguccgaggaggacacccugccccucacgcacuucgaggacagccccgccuaccugcuggacauggaccgcugcuccagccuccccuacgccgagggcuucgccuacuga

SEQ ID NO: 29813 - RNA, 1359 nt, Artificial Sequence
  derived and/or modified sequence opt1 from ETV6__Homo_sapiens__NP_001978
augagcgagacccccgcccagugcuccaucaagcaggagcgcaucagcuacaccccgcccgagucccccgugcccagcuacgccuccagcacgccgcugcacguccccgugccccgggcgcuccgcauggaggaggacuccauccggcugcccgcccaccuccgccugcagccgaucuacuggagccgggacgacguggcccaguggcugaagugggccgagaacgaguucucccugcgccccaucgacagcaacaccuucgagaugaacggcaaggcccuccugcugcucaccaaggaggacuuccgguaccgcagcccccacuccggggacguccuguacgagcugcuccagcacauccugaagcagcggaagccccgcauccuguucuccccguucuuccaccccggcaacagcauccacacccagcccgaggugauccuccaccagaaccacgaggaggacaacugcgugcagcggacgccccgcccguccgucgacaacgugcaccacaacccgcccaccaucgagcugcugcaccggagccgcucccccaucaccaccaaccaccggcccagccccgaccccgagcagcgcccccuccgguccccgcuggacaacaugauccgccggcugagccccgcggagcgcgcccaggggccccggccccaccaggagaacaaccaccaggagagcuacccgcucuccgugagccccauggagaacaaccacugccccgccuccagcgagucccacccgaagcccagcagcccccgccaggaguccacgcgcgucauccagcugaugcccuccccgaucaugcacccccugauccucaacccccggcacagcguggacuucaagcagucccgccugagcgaggacggccugcaccgggaggggaagcccaucaaccucucccaccgcgaggaccuggccuacaugaaccacaucauggugagcgucuccccgcccgaggagcacgcgaugcccaucggccggaucgccgacugccgccugcucugggacuacguguaccagcugcugagcgacucccgguacgagaacuucauccgcugggaggacaaggagagcaagaucuuccggaucguggaccccaacggccucgcccgccugugggggaaccacaagaaccggaccaacaugaccuacgagaagaugucccgcgcccugcggcacuacuacaagcucaacaucauccgcaaggagccgggccagcggcugcuguuccgcuucaugaagacccccgacgagaucaugagcgggcggacggaccgccucgagcaccuggagagccaggagcuggacgagcagaucuaccaggaggacgagugcuga

SEQ ID NO: 29814 - RNA, 954 nt, Artificial Sequence
  derived and/or modified sequence opt1 from ETV7__Homo_sapiens__NP_001193964
augcaggagggcgagcuggccaucagccccaucuccccgguggccgcgaugccgccccucgggacccacguccaggcccgcugcgaggcccagaucaaccugcugggcgagggcgggaucugcaagcuccccgggcggcugcgcauccagcccgcccuguggagccgggaggacgugcuccacuggcugcgcugggccgagcaggaguacucccugcccugcaccgcggagcacggcuucgagaugaacggccgggcccucugcauccugacgaaggacgacuuccgccaccgggcccccagcuccggggacgugcuguacgagcuccugcaguacaucaagacccagcgccgggcccuggucugcggccccuucuucgggggcaucuuccgccucaagaccccgacccagcacagccccgugccgcccgaggaggugacggggcccucccagauggacacccggcgcggccaccuccugcagccgcccgaccccggccugaccagcaacuucgggcaccuggacgaccccggccuggcgcgguggacccccgggaaggaggagucccucaaccugugccacugcgccgagcugggcugccgcacgcagggcgucugcagcuuccccgccaugccccaggccccgaucgacgggcggaucgccgacugccgccuccugugggacuacguguaccagcugcuccuggacacccgguacgagcccuacaucaagugggaggacaaggacgcgaagaucuuccgcguggucgaccccaacggccuggcccggcucugggggaaccacaagaaccgcgugaacaugaccuacgagaagaugucccgggcccugcgccacuacuacaagcugaacaucaucaagaaggagcccggccagaagcuccuguuccgcaacgggcugcagcucaucuucaucuucaucuggagcuuccaguga

SEQ ID NO: 29815 - RNA, 459 nt, Artificial Sequence
  derived and/or modified sequence opt1 from EVA1A__Homo_sapiens__NP_115557
augcgccugccccucagccacuccccggagcacguggagauggcccugcugagcaacauccucgccgcguacuccuucgucagcgagaaccccgagcgggccgcccuguacuucguguccggcgugugcaucgggcugguccucacccuggccgcccuggugauccgcaucagcugccacaccgacugccggcgccggcccggcaagaaguuccuccaggaccgcgaguccagcuccgacagcuccgacagcgaggacggguccgaggacacggugagcgaccuguccguccggcgccaccggcgcuucgagcggacccugaacaagaacguguucaccagcgcggaggagcucgagcgcgcccagcggcuggaggagcgcgagcggaucauccgcgagaucuggaugaacggccagcccgaggugccggggacccggucccugaaccgcuacuacuga

SEQ ID NO: 29816 - RNA, 1326 nt, Artificial Sequence
  derived and/or modified sequence opt1 from EVA1C__Homo_sapiens__NP_478067
augcugcuccccggccgcgcccggcagccgcccacgccccagcccgugcagcacccggggcugcgccggcaggucgagccgcccggccagcugcuccgccuguucuacugcaccgugcuggugugcagcaaggagaucuccgcccucaccgacuucagcggguaccugaccaagcugcuccagaaccacaccaccuacgcgugcgacggcgacuaccugaaccugcagugcccccggcacuccacgaucagcguccaguccgccuucuacgggcaggacuaccagaugugcagcucccagaagcccgccagccagcgcgaggacucccugaccugcguggccgccaccaccuuccagaaggugcuggacgagugccagaaccagcgggcgugccaccuccucgucaacagccgcguguucggccccgaccugugccccggcuccagcaaguaccugcucguguccuucaagugccagcccaacgagcugaagaacaagacggucugcgaggaccaggagcugaagcuccacugccacgagagcaaguuccugaacaucuacuccgccaccuacgggcggcgcacccaggagcgggacaucugcagcuccaaggccgagcgccugccgcccuucgacugccucagcuacuccgcccuccaggugcugagccggcgcugcuacggcaagcagcggugcaagaucaucgugaacaaccaccacuucgggagccccugccuccccggcgucaagaaguaccugaccgugacguacgcgugcgugccgaagaacauccugaccgccaucgaccccgccaucgccaaccucaagcccucccugaagcagaaggacggggaguacggcaucaacuucgaccccagcggcuccaagguccugcgcaaggacgggauccucgugagcaacucccuggccgcguucgccuacauccgggcccacccggagcgcgccgcccugcuguucgugagcuccgucugcaucggccuggcgcugacccucugcgcccuggugauccgggagagcugcgccaaggacuuccgcgaccugcagcucgggcgggagcagcuggugcccggcuccgacaaggucgaggaggacagcgaggacgaggaggaggaggaggaccccuccgagagcgacuuccccggcgagcuguccggguucugccgcaccagcuacccgaucuacuccagcaucgaggccgccgagcucgcggagcgcaucgagcggcgcgagcagaucauccaggagaucuggaugaacuccggccuggacacgagccugccccggaacauggggcaguucuacuga

SEQ ID NO: 29817 - RNA, 3687 nt, Artificial Sequence
  derived and/or modified sequence opt1 from EVC2__Homo_sapiens__NP_001159608
augaucuggcccaagguggagugcugccacuucaagaccgccgucgaggcgccccugggcaugaagcucgacaagaagauggagguguucaucccccugagcaccuccgccgccagcuccgggcccugggcccacagccuguucgccuucauccccuccuggccgaagaagaaccucuucaagcgcgagagccccaucacgcaccggcuguacggcgacaucucccgcgaggugcaggggaccagcgagaacggcgucaucuuccagaagugcgcccugguguccgggagcuccgaggcgcagaccgcccggaucuggcuccuggugaacaacaccaagacgaccagcuccgccaaccugagcgagcuccugcugcucgacuccaucgccggccugaccaucugggacagcgucggcaaccgcaccuccgagggguuccaggcguucagcaagaaguuccuccaggugggcgacgccuucgccguguccuacgccgccacgcuccaggcgggggaccugggcaacggggagagccugaagcuccccgcccagcugaccuuccagagcuccagccggaaccgcacccagcugaagguccucuucuccaucaccgccgaggagaacgugacggugcugccccaccacggccugcacgccgccggcuucuucaucgcguuccuccugagccugguccucaccugggccgcccuguuccugauggugcgguaccagugccucaaggggaacaugcugacccgccaccggguguggcaguacgaguccaagcuggagccgcuccccuucaccagcgccgacggcgucaacgaggaccugucccugaacgaccagaugaucgacauccucagcuccgaggaccccgggagcaugcugcaggcccuggaggagcucgagaucgcgacgcugaaccgcgccgacgccgaccuggaggccugccggacccagaucuccaaggacaucaucgcccuccugcugaagaaccucaccagcuccggccaccugagcccccagguggagcgcaagauguccgcgguguucaagaagcaguuccugcuccuggagaacgagauccaggaggaguacgaccggaagauggucgcccugaccgccgagugcgaccuggagacgcgcaagaagauggagaaccaguaccagcgggagaugauggccauggaggaggcggaggagcuccugaagcgcgccggcgagcggagcgccguggagugcuccaaccugcuccgcacccugcacgggcuggagcaggagcaccuccgcaagagccuggcccugcagcaggaggaggacuucgccaaggcgcaccggcagcucgccguguuccagcggaacgagcugcacuccaucuucuucacccagaucaagagcgccaucuucaagggcgagcugaagccggaggccgccaagaugcuccugcagaacuacagcaagauccaggagaacgucgaggagcugauggacuucuuccaggcguccaagcgcuaccaccucagcaagcgcuucgggcaccgggaguaccuggugcagaaccugcaguccagcgagacccgcgugcagggccuccuguccacggccgccgcccagcugacccaccucauccagaagcacgagcgggccggguaccuggacgaggaccagauggagaugcugcucgagcgcgcgcagaccgaggucuucagcaucaagcagaagcuggacaacgaccugaagcaggagaagaagaagcuccaccagaagcugaucaccaagcggcgccgggagcugcuccagaagcaccgcgagcagcggcgcgagcaggccuccgugggcgaggccuuccggacggucgaggacgccggccaguaccugcaccagaagcgcagccugauggaggagcacggggcgacccucgaggagcugcaggagcggcuggaccaggccgcccucgacgaccugcgcacccugacccucucccuguucgagaaggccacggacgagcugcggcgccuccagaacagcgccaugacccaggagcugcugaagcggggcgugcccuggcuguuccugcagcagauccuggaggagcacgggaaggagauggcggcccgcgccgagcagcucgagggcgaggagcgggaccgcgaccaggagggggugcaguccguccgccagcggcugaaggacgacgcccccgaggccgugaccgaggagcaggcggagcugcgccggugggagcaccucaucuucaugaagcugugcagcuccguguucagccuguccgaggaggagcuccugcgcaugcggcaggagguccacggcugcuucgcccagauggaccgcagccuggcccuccccaagauccgggcccgcgugcugcugcagcaguuccagaccgccuggcgggaggcggaguucgugaagcucgaccaggccgucgccgccccggagcugcagcagcaguccaaggugcgcaagagccggagcaaguccaagagcaagggcgagcugcucaagaagugcaucgaggacaagauccaccugugcgaggagcaggcguccgaggaccugguggagaagguccgcggggagcuccugcgggagcgcgugcagcggauggaggcccaggagggcggguucgcccagagccugguggcccuccaguuccagaaggccucccgcgucacggagacccugagcgcguacaccgcccugcucuccauccaggaccugcugcucgaggagcugagcgccuccgagaugcugaccaagagcgccugcacccagauccucgagucccacagccgggagcugcaggagcuggagcgcaagcucgaggaccagcuggugcagcaggaggccgcgcagcagcagcaggcccuggccuccuggcagcaguggguggccgacggccccgggauccucaacgagcccggcgaggucgacagcgagcgccagguguccacggugcugcaccaggcccugagcaagucccagacccuccuggagcagcaccagcagugccugcgggaggagcagcagaacagcgucgugcucgaggaccugcuggagaacauggaggcggacaccuucgccacccucugcucccaggagcugcggcuggccagcuaccuggcccgcauggccauggugcccggcgcgacgcuccgccggcugcugagcgucgugcucccgaccgccucccagccccagcugcuggcccuccuggacagcgccaccgagcgccacguggaccacgcggccgaguccgacgggggcgccgagcaggccgacgucgggcggcgccggaagcaccagagcugguggcaggcccuggacggcaagcuccgcggcgaccugaucucccgggggcuggagaagaugcucugggcgcgcaagcggaagcagagcauccugaagaagaccugccugccccuccgcgagcggaugaucuucuccggcaaggggagcuggccccaccugucccuggagccgaucggcgagcucgcccccgugcccaucgugggggccgagacgaucgaccugcugaacaccggcgagaagcuguucaucuuccgcaaccccaaggagccggagaucagccuccacgucccgccccggaagaagaagaacuuccugaacgccaagaaggccaugcgcgcgcucggcauggacuga

SEQ ID NO: 29818 - RNA, 2979 nt, Artificial Sequence
  derived and/or modified sequence opt1 from EVC__Homo_sapiens__NP_714928
auggcccgcggcggggccgcgugcaagagcgacgcccggcugcuccugggccgcgacgcccugcggcccgccccggcccuccuggcgcccgccgugcugcucggggccgcccugggccuggggcucggccuguggcugggcugccgcgcggggcggcagcgcacccggcaccagaaggacgacacccagaaccuccugaagaaccuggaguccaacgcccagacgcccagcgagaccggcucccccagccgccggcgcaagcgggagguccagauguccaaggacaaggaggccguggacgagugcgagccgcccagcaacuccaacaucaccgccuucgcccucaaggcgaaggugaucuaccccaucaaccagaaguuccgcccccuggccgacgggagcuccaacccgagccugcacgagaaccucaagcaggccguccugccccaccagcccguggaggccucccccagcuccagccugggcucccucagccagggggagaaggacgacugcuccagcuccagcagcgugcacuccgccaccagcgacgaccgguuccugucccgcacguuccugcgggucaacgcguucccggaggugcucgccugcgagagcguggacgucgaccugugcaucuacucccugcaccucaaggaccugcugcaccucgacaccgcccugcgccaggagaagcacaugauguucauccagaucuucaagaugugccugcucgaccugcugcccaagaagaaguccgacgacgagcucuaccagaagauccugagcaagcaggagaaggaccuggaggagcucgagaagggccuccaggugaagcugagcaacaccgagauguccggcgccggggacagcgaguacaucacccuggccgacguggagaagaaggagcgggaguacuccgagcagcugaucgacaacauggaggcguucuggaagcagauggccaacauccagcacuuccuggucgaccaguucaagugcagcuccagcaaggcccgccagcucaugaugacgcugaccgagcggaugaucgccgccgagggccugcucugcgacucccaggagcugcaggcgcuggacgcccuggagcgcaccauggggcgggcccacauggccaaggugaucgaguuccucaagcuccaggugcaggaggagacccgcugccgccuggcggccaucagccacggccuggagcugcuggccggcgaggggaagcucuccggccggcagaaggaggagcugcugacgcagcagcacaaggccuucuggcaggaggccgagcgcuucagccgggaguucguccagcgcgggaaggaccucgugaccgcgucccuggcccaccagguggagggcaccgccaagcugacccucgcccaggaggaggagcagcggagcuuccuggccgaggcgcagcccacggccgaccccgagaaguuccuggaggccuuccacgagguccucgagcgccagcggcugaugcagugcgaccuggaggaggaggagaacgugcgcgccaccgaggccguggucgcgcucugccaggagcuguacuucagcaccguggacaccuuccagaaguucguggacgcccuguuccuccagacgcugccggggaugaccggccugccgcccgaggagugcgacuaccuccggcaggagguccaggagaacgccgccuggcagcugggcaaguccaaccgcuuccggcgccagcaguggaagcuguuccaggagcuccuggagcaggaccagcaggucuggauggaggagugcgcgcugagcuccgugcuccagacccaccuccgggaggaccacgaggggaccauccgcggcgugcuggggcggcugggcgggcugacggaggagagcacccgcugcgugcugcagggccacgaccuccugcugcgguccgcccuccgccggcuggcccugcgcggcaacgcccucgccacccugacccagaugcgccugagcgggaagaagcaccuccugcaggagcugcgggagcagcgcgcgcucgagcagggcuccagccagugccuggacgagcaccaguggcagcugcuccgggcccuggaggcccgcguccuggaggaggccucccggcucgaggaggaggcccagcagacgcgccugcagcugcagcagcggcuccuggcggaggcccaggagguggggcagcugcuccagcagcacauggagugcgccaucggccaggcccugcuggugcacgcccgcaacgcggccaccaagagccgggccaaggaccgcgacgacuucaagcggacccucauggaggccgcggucgaguccguguacgugaccagcgccggggucucccgccuggugcaggccuacuaccagcagaucggccggaucauggaggaccacgaggagcgcaagcugcagcaccucaagacgcugcagggcgagcggauggagaacuacaagcugcgcaagaagcaggagcucagcaaccccuccagcgggucccggaccgccggcggggcccacgagaccagccaggcggugcaccagcgcaugcugagccagcagaagcgguuccuggcccaguuccccguccaccagcagaugcgccuccacgcccagcagcagcaggccggcgugauggaccugcuggaggcccagcucgagacccagcugcaggaggcggagcagaacuucaucuccgagcuggccgcccucgcccgggugccccuggccgagagcaagcugcuccccgcgaagcgcggccugcuggagaagccccuccgcacgaagcggaagaagccgcugccccaggagcgcggggaccugggcguccccaacaacgaggaccucgccuccggggaccagaccagcggcucccugagcuccaagcggcugagccagcaggaguccgaggccggggacagcggcaacuccaagaagaugcucaagcgccggagcaaccuguga

SEQ ID NO: 29819 - RNA, 780 nt, Artificial Sequence
  derived and/or modified sequence opt1 from EVI2A__Homo_sapiens__NP_001003927
augcugcuccgcagcugguucggcaacaaggacuuccaggcccugcccauccuggcccggcucccguccaugcccaccgacauggagcacaccgggcacuaccugcaccuggcguuccucaugacgaccguguucagccugucccccggcaccaaggccaacuacacccgccugugggccaacagcacguccagcugggacuccgucauccagaacaagaccgggcggaaccagaacgagaacaucaacaccaaccccaucaccccggagguggacuacaagggcaacagcacgaacaugcccgagaccucccacaucguggcccucaccagcaaguccgagcaggagcuguacauccccagcgucguguccaacagccccuccaccgugcagagcaucgagaacacguccaagagccacggggagaucuucaagaaggacgucugcgccgagaacaacaacaacauggcgaugcugaucugccucaucaucaucgccgugcuguuccugaucugcaccuuccucuuccuguccaccgugguccuggccaacaaggugagcagccuccgccgguccaagcaggucggcaagcgccagccgcggagcaacggcgacuuccuggccuccgggcuguggcccgcggagagcgacaccuggaagcgcacgaagcagcucaccggccccaaccuggugaugcaguccaccggggugcugaccgccacgcgggagcgcaaggacgaggagggcaccgagaagcucaccaacaagcagaucggguga

SEQ ID NO: 29820 - RNA, 1347 nt, Artificial Sequence
  derived and/or modified sequence opt1 from EVI2B__Homo_sapiens__NP_006486
auggaccccaaguacuucauccugauccucuucugcggccaccugaacaacaccuucuucagcaagaccgagacgaucaccaccgagaagcagucccagcccacccuguucacgagcuccaugagccaggugcucgccaacucccagaacaccaccgggaacccccugggccagcccacccaguucagcgacacguucuccgggcagagcaucucccccgccaaggucaccgcgggccagcccacccccgccguguacaccagcuccgagaagcccgaggcccacacgagcgccgggcagccccuggccuacaacaccaagcagcccacccccaucgcgaacaccuccagccagcaggccguguucacguccgcccgccagcuccccagcgcccggaccuccaccacccagccgcccaagagcuucgucuacacguucacccagcaguccagcagcgugcagauccccucccgcaagcagaucaccgugcacaaccccagcacccagcccacguccaccgucaagaacagcccccgguccacccccggcuucauccuggacaccacgagcaacaagcagacgccccagaagaacaacuacaacuccaucgcggccauccugaucggcgugcuccugaccagcaugcugguggccaucaucaucaucguccucuggaagugccugcgcaagcccgugcugaacgaccagaacugggccgggcgguccccguucgccgacggcgagacccccgacaucugcauggacaacauccgcgagaacgagaucagcaccaagcggaccuccaucaucagccucacccccuggaagcccuccaagagcacccugcuggcggacgaccucgagaucaagcuguucgaguccagcgagaacaucgaggacuccaacaacccgaagacggagaagaucaaggaccaggugaacgggaccagcgaggacuccgccgacggcagcaccgucgggaccgccgugagcuccagcgacgacgccgaccugcccccgcccccgccccuccuggaccuggagggccaggaguccaaccagagcgacaagcccaccaugacgaucguguccccgcuccccaacgacagcaccucccugccgcccagccuggacugccucaaccaggacugcggcgaccacaaguccgagaucauccagagcuucccgccccuggacucccugaaccucccccugccgcccgucgacuucaugaagaaccaggaggacagcaaccuggagauccagugccaggaguucuccaucccgcccaacagcgaccaggaccucaacgagucccugcccccgccgcccgccgagcugcucuga

SEQ ID NO: 29821 - RNA, 2685 nt, Artificial Sequence
  derived and/or modified sequence opt1 from EVI5__Homo_sapiens__XP_011540402
augaccagcggcgccucccugaagcucaccagcggguuccccguggccacggacaaggucgcggagaagcuguccagcacccuguccugggugaagaacaccgugagccacaccgucucccagauggccagccagguggccucccccagcacgucccuccacaccaccagcuccagcaccacgcuguccacccccgcccugagccccuccagccccucccagcucagcccggacgaccuggagcugcucgccaagcuggaggagcagaaccgccugcucgagaccgacagcaagucccugcggagcgugaacggcucccgccggaacagcggguccagccuggucuccagcuccagcgcguccagcaaccucucccaccuggaggaggacagcuggauccuguggggccgcaucgugaacgagugggaggacgugcggaagaagaaggagaagcaggucaagcccuucgagugcugggugcucuaccaccacucccagcugugccgcuuccaggugcacuaccugaagcggagccacaccgaggagcucguccacaaggggaucccccaccacuuccgcgccaucguguggcagcugcugugcuccgcccagagcaugcccaucaaggaccaguacuccgagcuccugaagaugacgagcccgugcgagaagcugauccggcgcgacaucgcccggaccuaccccgagcacaacuucuucaaggagaaggacagccucggccaggaggugcuguucaacgucaugaaggcguacucccugguggaccgcgaggugggcuacugccaggggagcgccuucaucgucggccuccugcugaugcagaugcccgaggaggaggccuucugcguguucgugaagcucaugcaggacuaccggcugcgcgagcuguucaagcccuccauggccgagcucgggcugugcauguaccaguucgagugcaugauccaggagcaccucccggagcuguucguccacuuccagagccaguccuuccacaccagcauguacgccuccagcugguuccugaccaucuuccugacgaccuucccccuccccaucgcgacccggaucuucgacaucuucauguccgagggccuggagaucguguuccgcguggggcuggcccuccugcagaugaaccaggccgagcugaugcagcucgacauggagggcaugcugcagcacuuccagaaggucaucccccaccaguucgacggcgugccggacaagcugauccaggccgccuaccaggucaaguacaacagcaagaagaugaagaagcuggagaaggaguacaccacgaucaagaccaaggagauggaggagcaggucgagaucaagcggcuccgcaccgagaaccggcugcugaagcagcgcaucgagacccucgagaaggaguccgcgagccuggccgaccggcugauccagggccaggugacgcgcgcccaggaggccgaggagaacuaccucaucaagcgcgagcuggccaccaucaagcagcaguccgacgaggcgagcgccaagcuggagcaggccgagaacaccauccggaagcuccagcaccagcagcaguggcacaagugcuccagcaacuacaacgaggacuucgugcugcagcuggagaaggagcucgugcaggcccgccuguccgaggccgagagccagugcgcgcugaaggagaugcaggacaaggugcucgacaucgagaagcggaacaacagccugcccgacgagaacaacaucgcccgccugcaggaggagcucaucgccgucaagcugcgggaggccgaggcgaucauggggcugaaggagcuccgccagcaggucaaggaccuggaggagcacuggcagcggcaccuggcccgcaccacggggcgguggaaggacccgcccaagaagaacgccaugaacgagcuccaggacgagcugaugaccauccgccugcgggaggccgagacccaggccgagauccgcgagaucaagcagcggaugauggagauggagacccagaaccagaucaacuccaaccaccuccgccgggcggagcaggaggugaucagccugcaggagaaggugcaguaccuguccgcccagaacaagggccuccugacgcagcugagcgaggccaagcgcaagcaggccgagaucgagugcaagaacaaggaggaggugauggccgugcggcuccgcgaggcggacuccaucgccgccgucgccgagcugcggcagcacaucgccgagcuggagauccagaaggaggagggcaagcuccaggggcagcugaacaagagcgacuccaaccaguacaucggcgagcugaaggaccagaucgcggagcucaaccacgagcugcgcugccugaaggggcagcgcggcuucagcgggcagccgcccuucgacggcauccacaucgugaaccaccucaucggcgacgacgaguccuuccacagcuccgacgaggacuucaucgacaacagccugcaggagaccggggugggcuucccccugcacgggaaguccggcagcaugucccucgaccccgccgucgccgacgggagcgaguccgagaccgaggacagcgugcuggagacccgggaguccaaccaggugguccagaaggagcgcccgccccggcgccgggagagcuacagcacgaccguguga

SEQ ID NO: 29822 - RNA, 1257 nt, Artificial Sequence
  derived and/or modified sequence opt1 from EVL__Homo_sapiens__NP_057421
auggccaccagcgagcaguccaucugccaggcccgcgcgagcgugauggucuacgacgacaccuccaagaagugggugcccaucaagccgggccagcagggguucagccggaucaacaucuaccacaacacggccuccaacaccuuccgcguggucggcgugaagcugcaggaccagcagguggucaucaacuacagcaucgugaaggggcucaaguacaaccaggccacccccaccuuccaccaguggcgggacgcccgccagguguacggccugaacuucgccuccaaggaggaggcgacgaccuucagcaacgccaugcuguucgcccucaacaucaugaacucccaggaggggggccccagcucccagcggcagguccagaacggccccagcccggacgagauggacauccagcgccggcaggugauggagcagcaccagcagcagcgccaggagucccuggagcggcgcaccagcgccaccgggcccauccugccccccggccacccguccagcgcggccuccgcccccgugagcugcuccgggccccccccgcccccccccccgcccgucccccccccgcccacgggcgccaccccccccccgccccccccccucccggccgggggcgcgcagggcagcagccacgacgaguccagcauguccgggcuggccgccgccaucgccggcgcgaagcugcggcgcgugcagcggcccgaggacgccagcgggggcuccagccccuccggcaccagcaaguccgacgccaaccgcgccagcuccgggggcgggggcgggggccucauggaggagaugaacaagcugcuggccaagcggcgcaaggcggccagccaguccgacaagccggccgagaagaaggaggacgagagccagauggaggaccccuccaccagccccucccccggcacgcgggccgccagccagccgcccaacuccagcgaggcggggcgcaagcccugggagcggagcaacuccguggagaagcccgucagcuccauccucagccgcaccccguccguggccaagagccccgaggccaaguccccccugcagagccagccccacucccggaugaagccggccggcagcgugaacgacauggcgcuggacgccuucgaccucgaccgcaugaagcaggagauccuggaggaggucgugcgcgagcugcacaaggugaaggaggagaucaucgacgccauccggcaggagcucuccgggaucagcaccaccuga

SEQ ID NO: 29823 - RNA, 6102 nt, Artificial Sequence
  derived and/or modified sequence opt1 from EVPL__Homo_sapiens__NP_001979
auguucaagggccugagcaaggggucccagggcaaggggagccccaagggcucccccgccaaggggagccccaagggcucccccagccggcacucccgggccgccacccaggagcuggcccugcugaucagccggaugcaggccaacgccgaccagguggagcgggacauccuggagacccagaagcgccugcagcaggaccggcugaacuccgagcagagccaggcccugcagcaccagcaggagacgggccgcucccugaaggaggcggaggugcugcucaaggaccuguuccuggacguggacaaggcccggcgccucaagcacccccaggccgaggagaucgagaaggacaucaagcagcugcacgagcgggugacccaggagugcgccgaguaccgcgcgcuguacgagaagaugguccucccgcccgacguggggccccggguggacugggcccgcguccuggagcagaagcagaagcaggucugcgccggccaguacgggcccggcauggccgagcuggagcagcagaucgccgagcacaacauccuccagaaggagaucgacgcguacgggcagcagcugcggagccuggugggcccggacgccgccaccauccgcucccaguaccgggaccuccugaaggccgccagcuggcgcggccagucccuggggagccucuacacccaccuccagggcugcacgcggcagcuguccgcgcucgccgagcagcagcgccggauccugcagcaggacuggagcgaccugauggccgaccccgccgggguccgccgggaguacgagcacuucaagcagcacgagcuccugucccaggagcagagcgugaaccagcuggaggacgacggcgagcgcaugguggagcuccgccaccccgccgucggccccauccaggcgcaccaggaggcccugaagauggaguggcagaacuuccugaaccucugcaucugccaggagacccagcugcagcacguggaggacuaccggcgcuuccaggaggaggccgacagcgugucccagacccuggccaagcucaacagcaaccuggacgccaaguacuccccggcgcccggcgggccgcccggggccccgaccgagcugcuccagcagcuggaggccgaggagaagcggcuggccgucacggagcgcgcgaccggggaccuccagcggcgcagccgggacguggcgccccugccccagcgccggaacccgccccagcagccccugcacguggacuccaucugcgacugggacagcggggagguccagcuccugcagggcgagcgcuacaagcugguggacaacaccgacccccacgccugggugguccagggccccgggggcgagaccaagcgggcccccgccgcgugcuucugcauccccgcccccgaccccgacgccguggcccgcgccucccggcuggcgagcgagcuccaggcccugaagcagaagcuggccacggugcagucccgccucaaggccagcgccgucgagucccugcggccgagccagcaggcgcccuccgggagcgaccuggccaacccccaggcccagaagcuccugacccagaugacccgccuggacggcgaccucgggcagaucgagcgccaggugcuggccugggcgcgcgccccgcugucccggcccacgccccuggaggaccuggagggccgcauccacagccacgagggcacggcccagcgccugcagucccucgggaccgagaaggagaccgcccagaaggagugcgaggccuuccugagcacccggcccgucggcccggcggcccugcagcuccccguggcccugaacuccgugaagaacaaguucagcgacguccaggugcugugcagccucuacggggagaaggccaaggccgcgcuggaccuggagcgccagauccaggacgccgaccgggugauccgcggcuucgaggccacgcucguccaggaggcccccauccccgccgagccgggggcgcugcaggagcggguguccgagcugcagcgccagcggcgcgagcuccuggagcagcagaccugcgugcugcggcuccaccgcgcccugaaggccagcgagcacgccugcgcggcccugcagaacaacuuccaggaguucugccaggaccucccccggcagcagcgccagguccgggcccugaccgaccgcuaccacgccgugggcgaccagcuggaccuccgggagaaggugguccaggacgccgcgcugaccuaccagcaguucaagaacugcaaggacaaccuguccagcuggcucgagcaccucccccgcucccaggugcggcccagcgacggcccgucccagaucgccuacaagcugcaggcccagaagcgccucacgcaggagauccagagccgggagcgcgaccgggccaccgccucccaccugagccaggcgcugcaggccgcccuccaggacuacgagcugcaggccgacaccuaccgcugcucccuggagcccacccucgccgugagcgcgcccaagcgcccccgggucgccccgcugcaggaguccauccaggcccaggagaagaaccuggccaaggccuacacggagguggcggccgcccagcagcagcuccugcagcagcuggaguucgcccgcaagaugcucgagaagaaggagcugagcgaggacauccggcgcacccacgacgcgaagcagggguccgagagccccgcccaggccggccgggaguccgaggcccugaaggcccagcucgaggaggagcgcaagcggguggcgcgcguccagcacgagcuggaggcccagcggagccagcugcuccagcugcgcacccagcggccccuggagcgccucgaggagaaggaggugguggaguucuaccgggacccccagcuggaggggagccugucccgcgucaaggcccagguggaggaggagggcaagcggcgcgccggccuccaggccgaccuggagguggcggcccagaaggucgugcagcuggagagcaagcggaagaccaugcagccgcaccuccugacgaaggaggugacccaggucgagcgcgaccccgggcuggacucccaggccgcccagcuccggauccagauccagcagcugcgcggcgaggacgccgugaucagcgcgcgccuggaggggcucaagaaggagcugcuggcccucgagaagcgggagguggacgucaaggagaaggugguggucaaggagguggugaaggucgagaagaaccuggagauggugaaggccgcccaggcgcugcgccuccagauggaggaggacgccgcccggcgcaagcaggccgaggaggccguggcgaagcugcaggcccggaucgaggaccuggagcgcgccaucuccagcgucgagcccaaggugaucgugaaggaggucaagaagguggagcaggaccccggccuccugcaggaguccagccggcugcgcucccuccuggaggaggagcggaccaagaacgccacccuggcccgcgagcucagcgaccugcacuccaaguacagcguggucgagaagcagcggccgaaggugcagcugcaggagcgcgugcacgagaucuuccaggucgaccccgagacggagcaggagaucacccggcucaaggcgaagcugcaggagauggccgggaagcgcuccggcguggagaaggagguggagaagcugcugcccgaccucgagguccugcgggcccagaagccgaccguggaguacaaggaggucacccaggagguggugcgccacgagcggagccccgagguccugcgcgagaucgaccggcucaaggcccagcugaacgagcuggugaacucccacggccgcagccaggagcagcucauccggcugcagggggagcgcgacgaguggcgccgggagcgcgccaagguggagaccaagacggucuccaaggagguggugcggcacgagaaggaccccguccuggagaaggaggcggagcgccuccggcaggaggugcgcgaggccgcccagaagcggcgcgccgcggaggacgccguguacgagcugcagagcaagcggcugcuccuggagcgccggaagcccgaggagaaggucguggugcaggaggucguggugacccagaaggacccgaagcugcgcgaggagcacucccggcucagcggcagccuggacgaggaggucgggcgccggcgccagcuggagcucgaggugcagcagcugcgggccggcguggaggagcaggaggggcugcucuccuuccaggaggaccgcagcaagaagcuggccgucgagcgggagcugcgccagcucacccugcgcauccaggagcuggagaagcggccgcccaccgugcaggagaagaucaucauggaggagguggucaagcucgagaaggaccccgaccuggagaaguccacggaggcccugcgcugggaccucgaccaggagaagacccaggugaccgagcugaaccgggagugcaagaaccuccaggugcagaucgacguccuccagaaggccaagucccaggagaagaccaucuacaaggaggugauccgcgugcagaaggaccggguccuggaggacgagcgcgcccgggugugggagaugcugaaccgcgagcggacggcccgccaggcccgggaggaggaggcccgccggcuccgcgagcggaucgaccgcgcggagacccugggccggaccuggucccgcgaggagagcgagcugcagcgggcccgcgaccaggccgaccaggagugcggccggcuccagcaggagcugcgcgcccuggagcgccagaagcagcagcagacccuccagcugcaggaggaguccaagcugcucagccagaagacggaguccgagcggcagaaggccgcgcagcgcgggcaggagcugagccggcuggaggccgccauccuccgcgagaaggaccagaucuacgagaaggagcggacccugcgcgaccugcacgccaaggugucccgggaggagcucagccaggagacccagacccgcgagacgaaccuguccaccaagaucagcauccuggagccggagaccggcaaggacaugucccccuacgaggccuacaagcgggggaucaucgaccgcggccaguaccuccagcugcaggagcuggagugcgacugggaggaggucaccacgagcgggcccugcggcgaggaguccgugcuccuggaccgcaagagcggcaagcaguacuccaucgaggcggcccugcgcugccggcgcaucagcaaggaggaguaccaccucuacaaggacgggcaccuccccaucagcgaguucgcccugcucguggccggcgagaccaagccguccagcucccugagcaucggguccaucaucagcaagagcccccuggcgagccccgcgccccaguccaccagcuucuucuccccgagcuucucccucggccugggggacgacagcuuccccaucgccggcaucuacgacaccacgaccgacaacaagugcuccaucaagaccgccgucgccaagaacaugcuggaccccaucaccggccagaagcuccuggaggcgcaggccgccaccggcggcaucguggaccugcucagccgggagcgcuacuccgugcacaaggccauggagcgggggcugaucgagaacaccagcacccagcgccugcucaacgcccagaaggcguucaccggcaucgaggaccccgucacgaagaagcggcuguccgugggcgaggccgugcagaagggguggaugccgcgcgagagcguccugccccaccuccaggugcagcaccugaccggcgggcugaucgaccccaagcgcaccggccggauccccauccagcaggcccuccugagcgggaugaucuccgaggagcuggcccagcuccugcaggacgagagcuccuacgagaaggaccugaccgacccgaucagcaaggagcgccucuccuacaaggaggccaugggccggugccgcaaggacccccugagcggccugcuccugcugcccgcggcccucgagggguaccggugcuaccgcuccgccagccccacggugccgcggucccugcgcuga

SEQ ID NO: 29824 - RNA, 678 nt, Artificial Sequence
  derived and/or modified sequence opt1 from EVX1__Homo_sapiens__NP_001291449
augcgccgguaccgcaccgccuucacccgggagcagaucgcccgccuggagaaggaguucuaccgggagaacuacgugagccgcccccggcgcugcgagcucgcggccgcccugaaccugccggagacgaccaucaaggucugguuccagaaccggcgcaugaaggacaagcggcagcgccucgccaugaccuggccccaccccgccgaccccgcguucuacaccuacaugaugucccacgccgccgccgcgggcgggcugccguaccccuuccccagccaccucccccugccguacuacucccccgugggccugggggccgccagcgccgccuccgcggccgccagccccuucuccggcagccugcggccccucgacacguuccgcgugcugucccagccguacccccggcccgagcugcucugcgccuuccgccacccgccccuguaccccgggcccgcccacggccugggcgcgagcgccgggggccccugcuccugccucgccugccacagcgggccggccaacggccuggcgccccgggccgccgccgccuccgacuucacgugcgccagcaccucccgcagcgacuccuuccugaccuucgcgcccagcguccucuccaaggccagcagcguggcccuggaccagcgggaggaggugccccugacccgcuga

SEQ ID NO: 29825 - RNA, 1431 nt, Artificial Sequence
  derived and/or modified sequence opt1 from EVX2__Homo_sapiens__XP_011509410
augauggagcgcauccggaaggagaugauccugauggagcgcggccuccacagccccaccgccgggaagcgguucuccaaccugagcaacuccgccggcaacgcggugcuggaggcccucgagaacagccagcaccccgcccgccugagcccccggcugcccuccgcgccccuccacuccgcccugggggagcugccggccaagggcaaguucgagaucgacacccucuucaaccugcagcacacggggagcgaguccaccgucagcuccgagaucagcuccgccgccgagagccgcaagaagcccggccacuacuccgaggccgcggccgaggccgacaugagcuccgacguggaggugggcugcagcgcccugcggucccccgggggccucggggccgcgcagcugaaggagaacaacggcaagggguacgccgagagcggcagcgccgccggcaccaccacguccgccagcggguccggccuggggagccuccacggcggcuccgggggcagcgggggcuccgcggcccucgggggcagcggcuccggggccgaccagguccgccgguaccgcaccgccuucacccgggagcagaucgcccgccuggagaaggaguucuaccgggagaacuacgugagccgcccccggcgcugcgagcuggcggccgcccugaaccugccggagaccacgaucaaggugugguuccagaaccggcgcaugaaggacaagcggcagcgccucgccauguccuggccccaccccgccgaccccagcuucuacaccuacaugaugacccacgcggccgccaccggcucccugccguaccccuuccacagccacgucccccugcacuacuacccccacgugggggugacggccgcggccgccgccgccgcggccuccggcgccgccgccgcggccagcuccccguucgccaccagcauccggccccucgacaccuuccgcgcccugucccaccccuacagccgccccgagcugcucugcagcuuccggcacccggggcuguaccaggcccccgcggccgccgccggccugaacuccgcggccagcgccgccgccgcggccgccgccgccgcggccgccgccuccagcgccgcggccgccggcgccccgcccuccgggggcagcgcgcccugcuccugccucagcugccacuccagccaguccgccgccgccgccgcggccgccgccgccgcggcccuggggagccgcggcgggggcggcgggggcgggggcggcgggggcgggggcgggggcggcgccggggccggcgggggcuccgacuucgggugcagcgccgcggccccgcgguccgagagcggcuuccugcccuacuccgccgccguccucagcaagaccgccgugagcccgcccgaccagcgcgacgaggcgccccugacgcgguga

SEQ ID NO: 29826 - RNA, 1968 nt, Artificial Sequence
  derived and/or modified sequence opt1 from EWSR1__Homo_sapiens__NP_001156757
auggccagcaccgacuacuccaccuacagccaggccgcggcccagcagggcuacuccgccuacacggcccagcccacccagggguacgcccagaccacccaggcguacggccagcagagcuacgggacguacggccagccgaccgacguguccuacacccaggcccagaccacggccaccuacgggcagaccgccuacgcgaccagcuacggccagccccccacgggcuacaccacccccaccgccccgcaggccuacucccagcccguccagggguacggcacgggggccuacgacaccaccaccgccacggugaccaccacccaggcgagcuacgccgcccaguccgccuacggcacgcagcccgccuaccccgcguacgggcagcagccggccgccaccgcccccacccgcccccaggacggcaacaagcccaccgagacgagccagccgcaguccagcaccggcggguacaaccagcccucccugggcuacgggcagagcaacuacuccuacccccaggugcccggcagcuacccgaugcagcccgucaccgccccccccuccuacccgcccaccagcuacuccagcacgcagcccaccagcuacgaccaguccagcuacucccagcagaacaccuacggccagcccagcuccuacgggcagcagagcuccuacggccagcagagcuccuacgggcagcagccgcccaccagcuaccccccccagacgggcuccuacagccaggcgccgucccaguacagccagcaguccagcuccuacgggcagcagagcuccuuccggcaggaccaccccagcagcaugggcguguacggccaggaguccgggggcuucagcgggcccggcgagaaccgcuccaugagcgggccggacaaccggggccgcggccgggggggcuucgaccgcgggggcaugucccgggggggccgcggcgggggccgggggggcaugggcgccggggagcgcggcggguucaacaagcccggcgggcccauggacgagggccccgaccucgaccugggcccgcccguggaccccgacgaggacagcgacaacuccgccaucuacguccaggggcugaacgacagcgugacccucgacgaccuggccgacuucuucaagcagugcggcguggucaagaugaacaagcggaccgggcagcccaugauccacaucuaccuggacaaggagaccggcaagccgaagggggacgccaccguguccuacgaggacccccccacggcgaaggccgccguggagugguucgacggcaaggacuuccagggcagcaagcucaaggucucccuggcccgcaagaagcccccgaugaacagcaugcgggggggccugcccccccgcgaggggcggggcaugcccccgccccuccgcgggggccccggcgggcccggcgggccgggcgggcccaugggccggaugggcgggcgcggcggggaccggggcggcuuccccccccgcgggccgcggggcucccgcgggaaccccagcggcgggggcaacgugcagcaccgcgcgggcgacuggcagugccccaacccggggugcggcaaccagaacuucgccuggcggaccgagugcaaccagugcaaggcccccaagcccgagggguuccugcccccgcccuucccccccccgggcggggaccgcggccggggcgggcccggcgggaugcgcggcgggcggggcggccugauggaccgcgggggccccgggggcauguuccggggcgggcgcggcggggaccggggcggguuccgcggcggccgggggauggaccgcggcggguucggcgggggccggcgcggcgggcccggcgggccgcccggcccccucauggagcagauggggggccggcgcggcgggcggggcgggcccggcaagauggacaagggggagcaccgccaggagcggcgcgaccgcccguacuga

SEQ ID NO: 29827 - RNA, 1866 nt, Artificial Sequence
  derived and/or modified sequence opt1 from EXD2__Homo_sapiens__NP_001180292
augagccgccagaaccugguggcccucaccgucaccacgcugcugggcguggccgucgggggcuucgugcucuggaaggggauccagcggcgccggcgcuccaagaccagccccgugacccagcagccgcagcagaaggugcugggcucccgggagcugcccccgcccgaggacgaccagcuccacagcuccgcgccccgcagcuccuggaaggagcggauccugaaggccaaggucgugaccgugagccaggaggccgagugggaccagaucgagccccugcuccgcuccgagcuggaggacuuccccguccuggggaucgacugcgagugggugaaccucgagggcaaggccagcccccugucccugcuccagauggccagcccguccggccugugcgugcugguccggcuccccaagcugaucugcgggggcaagacgcugccccgcacccuccuggacauccuggcggacgggaccauccucaaggugggcguggggugcagcgaggacgccuccaagcugcugcaggacuacggccucgucgugcggggcugccuggaccugcgcuaccucgccaugcggcagcgcaacaaccugcugugcaacgggcucagccugaagucccuggccgagaccgugcucaacuucccccuggacaagagccugcuccugcggugcuccaacugggacgcggagacgcugaccgaggaccaggucaucuacgccgcccgcgacgcccagaucagcguggcccucuuccugcaccuccugggcuacccguucagccggaacucccccggggagaagaacgacgaccacagcuccuggcgcaaggugcuggagaagugccagggcgucguggacauccccuuccggagcaagggcaugucccgccugggggaggaggugaacggcgaggcgaccgagagccagcagaagccccggaacaagaaguccaagauggacgggauggucccgggcaaccaccaggggcgcgacccccgcaagcacaagcggaagccccucggcgugggcuacagcgcccgcaagagcccccuguacgacaacugcuuccugcacgccccggacgggcagccccugugcacgugcgaccggcgcaaggcccagugguaccucgacaagggcaucggggagcuggucuccgaggagcccuucguggugaagcugcgguucgagcccgccggccgcccggagucccccggggacuacuaccucauggucaaggagaaccugugcguggugugcggcaagcgggacagcuacauccgcaagaacgucaucccccacgaguaccggaagcacuuccccaucgagaugaaggaccacaacucccacgacgugcugcuccugugcaccagcugccacgcgaucuccaacuacuacgacaaccaccugaagcagcagcucgccaaggaguuccaggccccgaucggcagcgaggaggggcugcgccugcucgaggaccccgagcggcgccaggugcgguccggcgcccgcgcccugcugaacgcggagagccuccccacccagcggaaggaggagcugcugcaggcccuccgcgaguucuacaacaccgacgucgugaccgaggagaugcugcaggaggccgccucccuggagacgcggaucagcaacgagaacuacgugccgcacgggcucaaggucgugcagugccacagccagggcgggcugcgcucccugaugcagcucgagagccgguggcgccagcacuuccuggacuccaugcagcccaagcaccucccccagcaguggagcguggaccacaaccaccagaagcugcugcgcaaguucggcgaggaccugcccauccagcucuccuga

SEQ ID NO: 29828 - RNA, 2631 nt, Artificial Sequence
  derived and/or modified sequence opt1 from EXD3__Homo_sapiens__NP_060290
auggaccccggcgacccggccggggaccccgccgcgggcgagcgccaccggauggggcgcgacccccugcuccugcugcaggcccuccagacccuguggagcacccgggagcgcaagcagcugcgggaggaggccuggcgcggcuucgccgcccucgacgacccccuggcggggcugcucgacaugcuggaguccugccggggccagcgcggcgaggggccgagccuggccgccuggaucucccaccagcuccagugcuggcugcaggcccagcccugccccagccuggcgcagcacucccuccggcugaagcagcugcaggcccgcgccgugaagguccucacggagagcccgcccucccuggccgcgccccuggcgagcaucuuccagcuccaggacgccgaccgguccugccugcuggcccacgugcaccgccuccaccacgagggccgguuccgcgaggccgccacccugggggcgacccugaagcuccagagcgagcugggcguggagaagauguccaucccccugcuccugcaggacaaggucgcccugguggagcgguacguggccggguuccccgaccuccagcgccggcugcugguccucauggacagcuggugccagccgggcuucgacaucaaggacguggcccgccgguaccccgaggugaccucccugagccuggagaagcucucccccaaggcccugagccgccagguccugcggcuccaggagcgcuacggcguggcgcccgcccugugcccgaacgccgccauccagcagcgccuggccgcgcuccggcaccugugccacaagcgcuucguggagaagucccugagccaggagaacuggacggaccacguccaggggcucgugggccagucccccuggcugcaggagcagcugagccagcugcucgugagccacuccgaccccgucaccgccgcccagugcgccauggagcugcugcuccccgaggagcggcugccggcggccguggccguggagcugcgccgguuccgccuccaggggcgggccaccgaggccgacagccgccuggaggucaaggacaugaaggaccgguacuaccagcugcccaucccccgcgagaacgugcaccuccuggcguccugggaggaccugacccggcacgagggcgcccuccugcagugccaccagguggucggcguggacguggaguggacgcccgucuucguggccgggggccgcccgcggcccagccugcuccaggucgccguggaggggcacguguuccugcuggacguccucgcccugucccagccgcccaccggccagggggcgcaggccuucagccgccugguggcccagcuccuguccgaccccagcaucaccaagcugggcuacggcauggugggggaccuccagaagcugggcaccuccugccccgcccuggcccacgucgagaagcagauccucgggggcauggaccugcugcucgugcaccggcagaugcgcguggcgagcguccccgccccggccguggaccgggcccgcgagcugcgggggcugucccuccuggugcagcagguccugggcacggcgcucgacaagacccagcagcugagcaacugggaccgccgcccccugugcgaggagcaggucaucuacgccgccgccgacgccuacugccuccuggaggugcaccaggcgcugugccgggagcccgcccgcuuccaccucuccgaggaccuggccggcagccggcgcccccggcaccgcgagcggccgggggcccgcaagccgcccggccugcagaaggccuccgcgcccgccgcgccccgccaggugcccguggccguggccgucagcgagggggccgcgccccagauccccgcccgggccuuccggguggugugcgacaacaugcuccagggccuggcccgcucccugcggugccucggggucgacgcccgcaugcugggcaacggcgaggaccaccggcgcgccgccgagguggcccggcaggaggggcgcaucauccugaccagcggccagccguuccacaagcuccgggcccaggugggggccggccgcugccuguccgucgacugcagccugaaggcccagcagcaggccaaggccgugcucaagcacuucaacgugcgggucacccacgcggacaucuucagccgcugccaggccugcaacugcgaccaguaccugaaggugucccgcgacaugaugaagcagcugauguggcucagcucccaccaggagggcccccggagcuccggggacgaggccacgcagagccaggccgugcaggagcccggccccgccccggacgcggcccccgaggggugcaccuacgaccgccccugccgguggcugcagauggccgaccugcgcgccgagacccccgacaugcucgccgacggcacccggcugcagcuggcgggggucccggugggcgugcuccgcacgcccggccugcggugcuucuacugcugcaccgggugcggcaaggucuucugggacgggucccaccugggccgcguggccacccacuuccgggacaugcucgagagcgcccccucccccugcgagccgagccccgcccccuccccggcgagcucccccuucuga

SEQ ID NO: 29829 - RNA, 2412 nt, Artificial Sequence
  derived and/or modified sequence opt1 from EXO1__Homo_sapiens__NP_003677
augggcauccaggggcugcuccaguucaucaaggaggccagcgagcccauccacgugcgcaaguacaagggccaggucguggccguggacaccuacugcuggcugcacaagggggcgaucgccugcgccgagaagcuggccaagggcgagccgaccgaccgguacgucggguucugcaugaaguucgugaacaugcuccugucccacggcaucaagcccauccugguguucgacggcugcacgcuccccagcaagaaggaggucgagcgcucccggcgcgagcggcgccaggccaaccugcugaaggggaagcagcuccugcgggagggcaaggugagcgaggcgcgcgagugcuucacccgguccaucaacaucacccacgccauggcccacaaggugaucaaggccgcgcgcagccagggggucgacugccugguggcccccuacgaggccgacgcccagcucgccuaccugaacaaggcgggcaucgugcaggccaucaucaccgaggacuccgaccugcucgccuucgggugcaagaaggucauccugaagauggaccaguucggcaacggccuggagaucgaccaggcccggcucgggaugugccgccagcugggcgacguguucacggaggagaaguuccgguacaugugcauccugagcgggugcgacuaccucuccagccugcgcggcaucggccuggccaaggcgugcaaggugcuccggcuggccaacaacccggacaucgucaaggugaucaagaagaucgggcacuaccugaagaugaacaucaccgugcccgaggacuacaucaacggcuucauccgcgccaacaacaccuuccucuaccagcuggucuucgaccccaucaagcggaagcugaucccccucaacgccuacgaggacgacguggacccggagacccuguccuacgccgggcaguacguggacgacagcaucgcgcugcagaucgcccucggcaacaaggacaucaacacguucgagcagaucgacgacuacaaccccgacaccgccaugcccgcccacucccgcagccacuccugggacgacaagaccugccagaaguccgccaacgucuccagcaucuggcaccggaacuacagcccccgcccggagagcgggaccgugagcgacgcgccccagcugaaggagaaccccuccacggugggcgucgagcgggugaucagcaccaagggccugaaccucccccgcaaguccagcaucgucaagcgcccgcgguccgccgagcugagcgaggacgaccugcucucccaguacagccuguccuucaccaagaagaccaagaagaacagcuccgaggggaacaagagccuguccuucagcgagguguucgugcccgaccucgucaacggccccacgaacaagaaguccgugagcacgcccccgcgcacccggaacaaguucgccaccuuccugcagcgcaagaacgaggaguccggggccguggucgugcccggcacccggagccgcuucuucugcuccagcgacagcaccgacugcguguccaacaaggucagcauccagccccuggacgagaccgcggugaccgacaaggagaacaaccuccacgaguccgaguacggggaccaggagggcaagcggcugguggacacggacgucgcccgcaacagcuccgacgacauccccaacaaccacaucccgggcgaccacauccccgacaaggccaccguguucaccgacgaggagagcuacuccuucgagagcuccaaguucacccggacgaucagcccgcccacccuggggacccuccgcuccugcuucagcugguccggcgggcugggcgacuucagccggacccccucccccagccccuccacggcccugcagcaguuccgccgcaagagcgacagcccgaccucccugcccgagaacaacaugagcgacgugucccagcucaagagcgaggaguccagcgacgacgagucccacccccugcgggaggaggccugcagcucccagagccaggaguccggggaguucagccugcaguccagcaacgcguccaagcucagccagugcuccagcaaggacuccgacagcgaggagagcgacugcaacaucaagcugcuggacucccagagcgaccagaccuccaagcuccggcugagccacuucuccaagaaggacacgccccugcgcaacaaggucccgggccucuacaagagcuccagcgccgacucccugagcaccaccaagaucaagccccugggccccgcccgggccuccgggcucagcaagaagcccgccuccauccagaagcgcaagcaccacaacgcggagaacaagccgggccugcagaucaagcugaacgagcucuggaagaacuucggguucaagaaguucuga

SEQ ID NO: 29830 - RNA, 2685 nt, Artificial Sequence
  derived and/or modified sequence opt1 from EXOC1__Homo_sapiens__NP_001020095
augaccgccaucaagcacgcccugcagcgcgacaucuucacccccaacgacgagcggcuccugagcaucgugaacgucugcaaggcgggcaagaagaagaagaacugcuuccugugcgccacggugaccaccgagcgcccggugcaggucaagguggugaaggucaagaaguccgacaagggggacuucuacaagcggcagaucgccugggcccuccgcgaccuggccgugguggacgcgaaggacgccaucaaggagaaccccgaguucgaccugcacuucgagaagaucuacaagugggucgccagcuccaccgccgagaagaacgcguucaucagcugcaucuggaagcucaaccagcgguaccugcgcaagaagaucgacuucgugaacguguccagccagcugcucgaggaguccguccccagcggcgagaaccaguccgugaccgggggcgacgaggagguggucgacgaguaccaggagcugaacgcccgggaggagcaggacaucgagaucaugauggaggggugcgaguacgccaucagcaacgccgaggccuucgcggagaagcugucccgcgagcuccaggugcuggacggcgccaacauccagagcaucauggccuccgagaagcaggucaacauccugaugaagcuccuggacgaggcccugaaggagguggaccagaucgagcucaagcugagcuccuacgaggagaugcugcagagcgugaaggagcagauggaccagaucuccgagagcaaccaccucauccaccuguccaacaccaacaacgugaagcugcucagcgagaucgaguuccuggucaaccacauggaccuggccaagggccacaucaaggcgcuccaggagggggaccuggccagcucccggggcaucgaggccugcaccaacgccgccgacgcgcugcuccagugcaugaacguggcccugcgccccgggcacgaccugcuccuggccgugaagcagcagcagcagcgguucagcgaccugcgcgagcuguucgcccggcgccuggccucccaccugaacaacgucuucgugcagcagggccacgaccagagcuccacccucgcgcagcacagcgucgagcugacgcugccgaaccaccaccccuuccaccgggaccuccugcgcuacgccaagcugauggaguggcucaaguccaccgacuacgggaaguacgagggccugaccaagaacuacauggacuaccugagccggcucuacgagcgcgagaucaaggacuucuucgagguggccaagaucaagaugaccggcacgaccaaggaguccaagaaguucgccacccugccccggaaggagagcgcggugaagcaggagaccgagucccugcacgggagcuccggcaagcugacggggagcaccuccagccucaacaagcuguccguccagagcuccggcaaccgccggagccagagcuccagccugcucgacaugggcaacauguccgccagcgaccuggacguggccgaccgcaccaaguucgacaagaucuucgagcagguccuguccgagcucgagccccugugccuggccgagcaggacuucaucagcaaguucuucaagcuccagcagcaccaguccaugccggggaccauggccgaggcggaggaccuggacggcgggacgcugagccgccagcacaacugcggcacgccccuccccguguccagcgagaaggacaugauccggcagaugaugaucaagaucuuccgcugcaucgagcccgagcugaacaaccugaucgcccucggggacaagaucgacuccuucaacagccuguacaugcuggugaagaugucccaccacguguggaccgcccagaacgucgacccggccagcuuccucuccaccacgcugggcaacgugcuggugaccgucaagcggaacuucgacaagugcaucagcaaccagauccgccagauggaggaggugaagaucuccaagaaguccaaggugggcauccuccccuucgucgccgaguucgaggaguucgcggggcuggccgagagcaucuucaagaacgccgagcggcgcggcgaccuggacaaggccuacaccaagcucauccgcgggguguucgugaacgucgagaagguggccaacgagagccagaagacgccccgggacguggucaugauggagaacuuccaccacaucuucgcgacccugagccggcugaagaucuccugccucgaggccgagaagaaggaggccaagcagaaguacaccgaccaccuccagagcuacgugaucuacucccugggccagccccucgagaagcugaaccacuucuucgaggggguggaggcccgcgucgcgcagggcauccgggaggaggaggugagcuaccagcuggccuucaacaagcaggagcuccgcaaggugaucaaggaguacccgggcaaggaggucaagaaggggcuggacaaccuguacaagaagguggacaagcaccucugcgaggaggagaaccugcuccagguggucuggcacuccaugcaggacgaguucauccggcaguacaagcacuucgagggccugaucgcccgcugcuaccccgggagcggcgugaccauggaguucaccauccaggacauccuggacuacugcuccagcaucgcccagucccacuga

SEQ ID NO: 29831 - RNA, 2775 nt, Artificial Sequence
  derived and/or modified sequence opt1 from EXOC2__Homo_sapiens__NP_060773
augagccgcucccggcagcccccgcuggugaccggcaucagccccaacgaggggauccccuggaccaaggucacgauccgcggcgagaaccucgggaccggccccaccgaccugaucgggcugaccaucugcggccacaacugccuccugacggccgaguggauguccgccagcaagaucgugugccgggugggccaggcgaagaacgacaagggggacaucaucgucaccaccaaguccggcgggcgcggcaccagcacgguguccuucaagcugcucaagccggagaagaucgggauccuggaccagagcgccgugugggucgacgagaugaacuacuacgacaugcggaccgaccgcaacaagggcaucccgccccugucccuccggcccgccaacccccugggcaucgagaucgagaaguccaaguucagccagaaggaccuggagaugcuguuccacgggaugagcgccgacuucaccuccgagaacuucagcgccgcgugguaccugaucgagaaccacuccaacaccagcuucgagcagcugaagauggccgugacgaaccucaagcgccaggccaacaagaaguccgagggcagccuggccuacgugaagggcgggcuguccaccuucuucgaggcgcaggacgcccucagcgccauccaccagaagcuggaggccgacggcaccgagaaggucgaggggagcaugacccagaagcuggagaacgugcucaaccgggccuccaacacggcggacacccuguuccaggaggugcugggccgcaaggacaaggccgacagcacccggaacgcccucaacguccugcagcgcuucaaguuccuguucaaccucccccugaacaucgagcggaacauccagaagggggacuacgacguggugaucaacgacuacgagaaggccaagucccuguucggcaagaccgagguccagguguucaagaaguacuacgccgagguggagacgcgcaucgaggcgcuccgggagcugcugcucgacaagcugcuggagacccccagcacccuccacgaccagaagcgcuacauccgguaccuguccgaccugcacgccagcggggaccccgccuggcagugcaucggcgcccagcacaaguggauccuccagcugaugcacuccugcaaggagggcuacgucaaggaccugaaggggaacccgggccuccacagccccaugcuggaccuggacaacgacacccgccccuccgugcucgggcaccugagccagacggccucccugaagcggggcagcuccuuccagagcgggcgcgacgacaccuggcgguacaagacgccccaccgcguggcguucgucgagaagcucaccaagcuggugcugucccagcugccgaacuucuggaagcucuggaucagcuacgugaacggcucccuguucagcgagaccgccgagaaguccggccagaucgagcgcagcaagaacguccggcagcgccagaacgacuucaagaagaugauccaggaggugaugcacagccuggucaagcucacccgcggggcccugcugccccucuccauccgggacggcgaggccaagcaguacgggggcugggaggugaagugcgagcugagcgggcaguggcuggcccacgcgauccagaccgugcggcucacccacgagucccugacggcccuggagauccccaacgaccuccugcagaccauccaggaccugauccucgaccugcgcguccggugcgugauggccacccugcagcacaccgccgaggagaucaagcgccucgcggagaaggaggacuggaucguggacaacgagggccugacgagccugcccugccaguucgagcagugcaucgucugcucccuccagagccugaagggcgugcuggagugcaagccgggggaggccuccguguuccagcagcccaagacccaggaggaggucugccagcucagcaucaacaucaugcaggucuucaucuacugccuggagcagcuguccaccaagcccgacgccgacaucgacaccacccaccucagcguggacguguccagccccgaccuguucggcuccauccacgaggacuucagccugacguccgagcagcggcuccugaucgugcugagcaacugcugcuaccucgagcgccacaccuuccugaacaucgccgagcacuucgagaagcacaacuuccaggggaucgagaagaucacccagguguccauggccagccugaaggagcucgaccagcggcuguucgagaacuacaucgagcugaaggcggacccgaucgucggcagccucgagcccggcaucuacgccggguacuucgacuggaaggacugccugccgcccaccggcgugcgcaacuaccugaaggaggcccucgugaacaucaucgccguccacgccgagguguucacgaucuccaaggagcuggugccccggguccugagcaaggugaucgaggcgguguccgaggagcucagccgccugaugcagugcgucuccagcuucuccaagaacggggcccugcaggcccggcucgagaucugcgcccugcgcgacaccguggccguguaccugacccccgagagcaaguccagcuucaagcaggcgcucgaggcccugccccagcuguccagcggcgccgacaagaagcuccuggaggagcugcucaacaaguucaaguccagcaugcaccuccagcugaccugcuuccaggccgcguccagcacgaugaugaagaccuga

SEQ ID NO: 29832 - RNA, 2241 nt, Artificial Sequence
  derived and/or modified sequence opt1 from EXOC3L1__Homo_sapiens__NP_848611
auggacagcgccgccaaggacgagaugcagcccgcgcuguccccgggccccgaguggcccgagcaggagcgcgccgagcagcucgcccgcggggccgcccugaagugggcgagcggcaucuucuaccgccccgagcagcuggcccggcucgggcaguaccgcucccgggaggugcagcggaccugcagccuggagucccggcucaagagcgucaugcaguccuaccuggagggcgugcagaccgggguguggcagcuggcccaggccaucgaggucgugcagggcacgcgcgaggcgcugagccaggcccggggccuccugcaggggaugucccaggcccugcagacccucgagccgcugcgcgagcggguggcccagcacaagcagcugcaggcccucagccaccuccugccccgccugcgggcgguccccgccgccgugucccacacccagacccugaucgacggccagcaguuccuggaggccuacgugagccuccgcgagcuggagcagcugcgggaggacacgugggcgccccucgggggccuggagcugccggucuuccaggggcucgaccugcuguucgaggcccucggccaggccguggaggccgccgccggcgcggccgggaagcuggcccgcgaggaccccgcccugcucguggccgcgguccggguggccgagguggagaccggccgcaccacgccccuggggcaggucccccgggacuggcgccagcggugccugcgcgcccuccaggagggccuggagcaggcccacuucggcuccccgcugcuccccgcgcccggggcccugcccggcuggcuggaggcccuccgcguggcccugccgguggagcuggccaccgcggaggcccucgucgcccccugcugcccgccccaguacaacguggugcagcugugggcccacacccugcacagcgggcuccggcgcucccugcagaaccugcuggccggccccgagcucgaggcggccgacgccuucgcccugcugcacugggcccuccacgucuaccuggggcaggagaugaugggcagccuggagcucggccccgaggcggacgugucccagcuggagccccugcucacccuggagaacaucgagcagcuggaggccaccuucguggccaacauccaggccagcgucucccaguggcuccagaacgcgcuggacggggagguggccgaguggggccgggagcacgggcccaacacggacccgagcggcagcuacuacucccccaugcccgccaucguccugcagauccucgaggagaacauccgcguggccagccugguguccgagagccugcagcagcggguccacgggauggcccucuccgagcugggcaccuuccugcgcagcuucuccgacgcgcucauccgguucagccgcgaccacuuccggggcaaguccauggcgccccacuacgugccguaccugcuggccgcccucaaccacaagagcgcccuguccagcuccgugagcguccugcagcucgacggggcccccuccggcgcccuggcccccguggaggccgcccuggacgagcuccagcgccggaucuaccgccuggugcuggaggcgcuccaggccgagcugcagccgcuguucgccgaccuccccagccggcaguggcuguccagccccgagcugcuccaguccgucugcgagcgcaccgggcgguucugccgcgacuucuggcgggugcgcaaccccaccgugcagcugcugcucgccgaggcggagcgggccgucgugcugcaguaccugagcgcccucaugcagggccgccuggugugccgcggggccgacgagcggacgcaggccgcggagcgccugcggcacgacgccgcccagcuccagcagcuguuccugagccucggccuggaggagaacgcccacugcgccccgguccugcucgcgcugcgcgagcugcucaaccugcgggaccccgcccugcucggccuggagguggccgggcugcgccagcaguuccccgacguguccgaggaccacgucagcgcccuccugggccugcgcggggaccucucccgggagcagcaccuggccgcgcugagcucccuccaggccgcccugcccccgagcccccgggccucccgccgggugcuguucagccucgugcccgcccccgcgcuggccccggccuccugccugcccagcggcuccugcgcccgcgcgcuccugcuggccgaguga

SEQ ID NO: 29833 - RNA, 1230 nt, Artificial Sequence
  derived and/or modified sequence opt1 from EXOC3L2__Homo_sapiens__NP_612635
auggccgcccuggagaacggcgagcucgggccccugcugagcccgggcacccuccgcgggcuggaggacgagugcgugaccgacgucaaggcgcagacgcgggccgcccugcuccgcgugcugcaggaggacgaggagcacuggggcucccuggaggaccagcccagcucccucgcccaggacgugugcgagcugcuggaggagcacaccgagcgggcgccccgcaucagccaggaguucggggagcggauggcccacugcugccucggcggccuggccgaguuccugcaguccuuccagcagcgcgucgagcgguuccacgagaaccccgccgugcgcgagaugcucccggacaccuacaucagcaagaccaucgcccuggugaacugcgggccgccccugcgggcgcucgccgagcgccuggcccgggucggcccgcccgaguccgagcccgcccgcgaggccagcgcguccgcccuggaccacgugacgcggcucugccaccgcguggucgccaaccugcuguuccaggagcuccagccccacuucaacaagcugaugcggcgcaaguggcugagcucccccgaggcccucgacgggaucgugggcacccugggggcccaggcgcuggcccuccggcgcaugcaggacgagcccuaccaggcccugguggccgagcugcaccggcgcgcccucgucgaguacgugcggccccugcugcgcggccgccuccggugcagcuccgcgcgcacccggagccgcguggccggccggcugcgcgaggacgccgcccagcugcagcgccucuuccgccggcuggagucccaggccagcuggcuggacgcggucgugccccaccucgccgaggugaugcagcuggaggacacccccuccauccaggucgaggugggggugcugguccgcgacuacccggacauccggcagaagcacguggccgcccuccuggacauccgcggccugcggaacacggcggcccgccaggagauccucgccguggcccgggaccuggagcugagcgaggagggggcccuguccccgccccgcgaccgggcguucuucgccgacauccccgucccccgccccagcuucugccucagccugccccuguuccucggccggcugccccugucccgccucgcccgcccgagccuggccugccugccccggccccggcccccgucccucgcccggccccgcgcgcagcgguga

SEQ ID NO: 29834 - RNA, 1422 nt, Artificial Sequence
  derived and/or modified sequence opt1 from EXOC4__Homo_sapiens__NP_001032203
auggccgccgaggcggccggcgggaaguaccgcagcaccguguccaagagcaaggaccccuccggccugcucaucagcgucauccggacccuguccacgagcgacgacguggaggaccgcgagaacgagaaggggcggcuggaggaggccuacgagaagugcgaccgcgaccucgacgagcugaucgugcagcacuacaccgagcugaccaccgccauccggacguaccaguccaucaccgagcgcaucaccaacagccggaacaagaucaagcaggucaaggagaaccuccuguccugcaagaugcugcuccacugcaagcgcgacgagcugcggaagcuguggaucgagggcaucgagcacaagcacgugcucaaccugcuggacgagaucgagaacaucaagcaggucccgcagaagcucgagcagugcauggccagcaagcacuaccuguccgcgaccgacaugcuggugagcgccguggagucccucgaggggccccugcuccagguggagggccugagcgaccugcgccuggagcuccacuccaagaagaugaaccugcaccugguccucaucgacgagcugcaccggcaccuguacaucaagagcacgucccgcguggugcagcggaacaaggagaagggcaagaucagcucccucgucaaggacgccagcgugccccugaucgacgugaccaaccugcccaccccgcgcaaguuccucgacaccagccacuacuccacggccgggagcuccagcguccgggagaucaaccugcaggacaucaaggaggaccuggagcucgaccccgaggagaacuccacccuguucaugggcauccugaucaaggggcucgcgaagcugaagaagauccccgagaccgugaaggccaucaucgagcgccuggagcaggagcucaagcagaucgugaagcggagcaccacgcaggucgccgacuccggcuaccagcgcggggagaacgugaccguggagaaccagccccggcugcugcucgagcugcuggagcuccuguucgacaaguucaacgccgucgccgcggcccacagcguggugcugggcuaccugcaggacaccgucgugaccccgcucacgcagcaggaggacaucaagcuguacgacauggccgacgucugggugaagauccaggacgugcugcagaugcuccugaccgaguaccuggacaugaagaacacccgcaccgccuccgagcccagcgcccagcucuccuacgcgagcacgggccgggaguucgccgccuucuucgccaagaagaagccccagcgccccaagaacucccuguucaaguucgagagcuccagccacgccaucuccaugagcgcguaccugcgcgagcagcggcgcgagcucuacucccggagcggggagcugcagggcuga

SEQ ID NO: 29835 - RNA, 2127 nt, Artificial Sequence
  derived and/or modified sequence opt1 from EXOC5__Homo_sapiens__NP_006535
auggccaccaccgccgagcuguucgaggagcccuucguggcggacgaguacaucgagcgccucguguggcggacgccgggcgggggcagccgcgggggccccgaggccuucgaccccaagcggcugcuggaggaguucgugaaccacauccaggagcuccagaucauggacgagcgcauccagcggaagguggagaagcuggagcagcagugccagaaggaggccaaggaguucgccaagaagguccaggagcugcagaaguccaaccagguggccuuccagcacuuccaggagcucgacgagcacaucagcuacguggcgaccaaggucugccaccugggggaccagcuggagggcgugaacacgccccgccagcgggccguggaggcccagaagcucaugaaguacuucaacgaguuccuggacggcgagcugaaguccgacgucuucaccaacagcgagaagaucaaggaggccgcggacaucauccagaagcuccaccugaucgcccaggagcugccguucgaccgcuucuccgaggucaagagcaagaucgccuccaaguaccacgaccucgagugccagcugauccaggaguucaccagcgcccagcggcgcggggagaucucccggaugcgcgagguggccgcggugcugcuccacuucaagggcuacagccacugcguggacguguacaucaagcagugccaggagggggccuaccugcggaacgacaucuucgaggacgccggcauccugugccagcgcgucaacaagcaggucggggacaucuucuccaaccccgagaccgugcucgccaagcugauccagaacguguucgagaucaagcugcagagcuucgugaaggagcagcucgaggagugccggaaguccgacgccgagcaguaccugaagaaccuguacgaccucuacacccgcaccacgaaccugagcuccaagcugauggaguucaaccucggcaccgacaagcagaccuuccugagcaagcugaucaaguccaucuucaucagcuaccucgagaacuacaucgagguggagaccggcuaccugaagucccggagcgcgaugauccugcagcgcuacuacgacagcaagaaccaccagaagcgguccaucgggacgggcgggauccaggaccucaaggagcgcauccggcagcgcaccaaccugccccugggccccagcaucgacacccacggcgagaccuuccucucccaggaggucguggugaaccugcugcaggagacgaagcaggccuucgagcgcugccaccggcucagcgacccguccgaccugccccgcaacgccuuccggaucuucaccauccuggucgaguuccucugcaucgagcacaucgacuacgcccuggagaccgggcuggccggcauccccagcuccgacagccgcaacgcgaaccucuacuuccuggacgugguccagcaggccaacaccaucuuccaccuguucgacaagcaguucaacgaccaccugaugccccucaucuccagcuccccgaagcugagcgagugccugcagaagaagaaggagaucaucgagcagauggagaugaagcucgacacggggaucgaccggacccugaacugcaugaucggccagaugaagcacauccuggccgccgagcagaagaagaccgacuucaagcccgaggacgagaacaacgugcucauccaguacaccaacgccugcgugaaggucugcgcguacgugcgcaagcaggucgagaagaucaagaacuccauggacgggaagaacguggacacggugcugauggagcugggcgugcgguuccaccgccucaucuacgagcaccuccagcaguacagcuacuccugcaugggcgggaugcuggccaucugcgacgucgccgaguaccggaagugcgccaaggacuucaagauccccauggugcugcaccuguucgacacccugcacgcgcucugcaaccugcugguggucgcccccgacaaccucaagcaggucugcagcggcgagcagcuggccaaccuggacaagaacauccuccacuccuucgugcagcugcgcgccgacuaccggagcgcccgccuggcgcggcacuucuccuga

SEQ ID NO: 29836 - RNA, 2055 nt, Artificial Sequence
  derived and/or modified sequence opt1 from EXOC7__Homo_sapiens__NP_001013861
augaucccgccccaggaggccagcgcccgccggcgcgagaucgaggacaagcugaagcaggaggaggagacccucuccuucauccgggacagccuggagaaguccgaccagcugaccaagaacauggugagcauccucuccagcuucgagucccgccugaugaagcuggagaacagcaucauccccguccacaagcagacggagaaccuccagcggcugcaggagaacguggagaagacccuguccugccucgaccacgugaucagcuacuaccacgucgcguccgacaccgagaagaucauccgcgagggccccaccgggcggcuggaggaguaccugggcagcauggccaagauccagaaggccguggaguacuuccaggacaacucccccgacagcccggagcucaacaaggugaagcugcuguucgagcgcgggaaggaggcccucgaguccgaguuccggagccugaugacgcgccacuccaaggucgugagccccgugcugauccucgaccugaucuccggcgacgacgaccuggaggcccaggaggacgucacccucgagcaccuccccgagagcgugcugcaggacgugauccggaucagccgcuggcuggucgaguacgggcggaaccaggacuucaugaacguguacuaccagauccgcuccagccagcuggaccgguccaucaagggccugaaggagcacuuccacaagagcuccagcuccagcggcgugcccuacuccccggcgauccccaacaagcgcaaggacacccccaccaagaagcccgucaagcggccggggacgauccgcaaggcccagaaccuccugaagcaguacagccagcacggccuggacgggaagaagggcggguccaaccucaucccccuggagggccgggacgacaugcuggacguggagaccgacgccuacauccacugcgugagcgccuucgucaagcucgcgcaguccgaguaccagcugcuggccgacaucauccccgagcaccaccagaagaagaccuucgacagccucauccaggacgcccuggacggccugaugcucgagggggagaacaucguguccgccgcccgcaaggcgaucgugcggcacgacuucagcaccguccugacgguguuccccauccugcgccaccucaagcagaccaagccggaguucgaccaggugcugcagggcaccgccgccuccaccaagaacaagcugcccgggcucaucacgagcauggagaccaucggcgccaaggcccuggaggacuucgcggacaacaucaagaacgaccccgacaaggaguacaacaugcccaaggacggcaccguccacgagcugaccuccaacgccauccucuuccugcagcagcugcuggacuuccaggagacggccggggccaugcucgccagccaggagaccagcuccagcgcgaccuccuacagcuccgaguucagcaagcgccugcuguccaccuacaucugcaaggugcucggcaaccugcagcugaaccuccugagcaaguccaaggucuacgaggacccggcccugagcgccaucuuccuccacaacaacuacaacuacauccugaagucccuggagaaguccgagcucauccagcugguggccgugacgcagaagaccgccgagcggagcuaccgcgagcacaucgagcagcagauccagaccuaccagcggagcuggcugaaggucaccgacuacaucgcggagaagaaccuccccguguuccagcccggggugaagcugcgcgacaaggagcggcagaucaucaaggagcgcuucaagggcuucaacgacgggcuggaggagcucugcaagauccagaaggccugggccauccccgacacggagcagcgggaccgcauccggcaggcccagaagaccaucgucaaggagaccuacggcgcguuccugcagaaguucggcuccgugccguucaccaagaaccccgagaaguacaucaaguacgggguggagcaggucggcgacaugaucgaccgccuguucgacacgagcgccuga

SEQ ID NO: 29837 - RNA, 957 nt, Artificial Sequence
  derived and/or modified sequence opt1 from EXOG__Homo_sapiens__NP_001138936
auggccaucaagagcaucgccucccgccugcggggcagccgccgguuccucuccggguucguggcgggcgccgucgugggggccgccggcgccgggcuggcggcccugcaguucuuccgcagccagggcgccgagggcgcccucaccgggaagcagcccgacggcgacgcggaccggaagcacugcaaguucaagccggaccccaacaucccgcccaccuucuccgccuucaacgaggacuacguggggagcggcuggucccgcgggcacauggcccccgccggcaacaacaaguucagcuccaaggccauggcggagacguucuaccugagcaacaucgucccccaggacuucgacaacaacuccggcuacuggaaccggaucgagauguacugccgcgagcugaccgagcgguucgaggacguguggguggucagcgggccccucacccugccccagacccgcggcgacgggaagaagaucguguccuaccaggugaucggcgaggacaacgucgccgugccgagccaccuguacaaggugauccucgcccggcgcuccagcgucuccacggagccccuggcccugggcgccuucguggugcccaacgaggcgaucggguuccagccccagcucaccgaguuccaggucagccugcaggaccuggagaagcucuccggccugguguucuucccgcaccuggaccggaccagcgacauccgcaacaucugcagcguggacacgugcaagcuccuggacuuccaggaguucacccuguaccucuccacccggaagaucgagggggcccgcagcguccugcggcuggagaagaucauggagaaccucaagaacgccgagaucgagcccgacgacuacuucaugucccgcuacgagaagaagcuggaggagcugaaggccaaggagcagagcggcacccagauccggaagcccuccuga

SEQ ID NO: 29838 - RNA, 588 nt, Artificial Sequence
  derived and/or modified sequence opt1 from EXOSC1__Homo_sapiens__NP_057130
auggcgcccccggugcgcuacugcauccccggcgagcggcugugcaaccucgaggaggggagccccggcuccgggaccuacacccgccacggcuacaucuucagcucccuggccgggugccugaugaaguccagcgagaacggcgcccuccccgucgugagcgugguccgggagacggagucccagcugcugccggacgugggcgccaucgugaccugcaaggucagcuccaucaacagccgcuucgccaaggugcacauccucuacgugggguccaugccccugaagaacagcuuccggggcaccauccgcaaggaggacguccgggccaccgagaaggacaagguggagaucuacaaguccuuccgccccggggacaucgugcuggccaaggucaucagccucggcgacgcgcaguccaacuaccugcugacgaccgccgagaacgagcucggggugguggucgcccacagcgaguccggcauccagauggugcccaucagcuggugcgagaugcagugcccgaagacccacaccaaggaguuccggaagguggcccgcguccagcccgaguuccugcagacguga

SEQ ID NO: 29839 - RNA, 804 nt, Artificial Sequence
  derived and/or modified sequence opt1 from EXOSC2__Homo_sapiens__NP_001269637
auggccauggagaugcgccugcccguggcccggaagccgcucagcgagcgccugggccgggacaccaagaagcaccuggucgugcccggggacaccaucacgaccgacaccggcuucaugcgcgggcacggcaccuacaugggggaggagaagcucaucgcguccguggccggcagcgucgagcgggugaacaagcugaucugcgugaaggcccugaagacgcgcuacaucggcgaggucggggacaucguggugggccggaucaccgagguccagcagaagcgcuggaagguggagaccaacucccggcucgacagcgugcugcugcucuccagcaugaaccugcccgggggcgagcugcgccggcgcuccgccgaggacgagcucgccaugcggggguuccugcaggagggcgaccugaucagcggcguccucguccaggugucccccagccuggugaagcgccagaagacccacuuccacgaccugccgugcggggcguccgugauccucggcaacaacggguucaucuggaucuaccccacgcccgagcacaaggaggaggaggccggcggcuucaucgccaaccuggagcccgugagccuggccgaccgggaggucaucucccgccuccggaacugcaucaucagccuggugacccagcgcaugaugcuguacgacaccuccauccucuacugcuacgaggcgagccugccgcaccagaucaaggacauccugaagcccgagaucauggaggagaucgugauggagacccggcagcgccuccuggagcaggagggguga

SEQ ID NO: 29840 - RNA, 495 nt, Artificial Sequence
  derived and/or modified sequence opt1 from EXOSC3__Homo_sapiens__NP_001002269
auggccgagcccgccagcguggcggccgagucccuggccggcagccgcgcccgggccgcgcgcaccguccucggccagguggugcugccgggggaggagcugcuccugcccgagcaggaggacgccgaggggcccggcggggccgucgagcggccccugucccucaacgcccgcgcgugcagccgggugcgcguggucugcggcccgggccugcggcgcugcggggaccggcugcucgugaccaagugcggccgccugcggcacaaggagcccggguccggcagcgggggcggcguguacugggucgacucccagcagaagcgcuacgugcccgugaagggggaccacgucaucggcaucgugacggccaagagcggggacaucuucaagguggacgucggcggcuccgagcccgccagccuguccuaccucagcuucgagggggccaccaagcggaaccgcccgaacgugcaggccaucuccagccggcuguga

SEQ ID NO: 29841 - RNA, 738 nt, Artificial Sequence
  derived and/or modified sequence opt1 from EXOSC4__Homo_sapiens__NP_061910
auggccggccuggagcuccugagcgaccagggguaccgcguggacggccggcgcgccggggagcugcggaagauccaggcgcgcaugggcgucuucgcccaggccgacggguccgccuacaucgagcagggcaacaccaaggcccucgcggugguguacggcccccacgagauccgggggagccgcgcccgggcccugccggaccgcgcccuggucaacugccaguacuccagcgcgaccuucuccacgggcgagcggaagcgccggccccacggggaccgcaagagcugcgagaugggccuccagcugcggcagaccuucgaggccgccauccugacccagcuccacccccgcucccagaucgacaucuacguccaggugcugcaggccgacgggggcaccuacgccgcgugcgugaacgccgccacgcuggccgugcucgacgccggcauccccaugcgggacuucgugugcgcgugcagcgccggguucgucgacggcaccgcccuggccgaccugucccacguggaggaggccgccgggggcccgcagcucgcgcuggcccugcuccccgccagcggccagaucgcccugcuggagauggacgcgcgccuccacgaggaccaccuggagcgggugcuggaggccgccgcccaggcggcccgcgacguccacacccuccuggaccggguggugcgccagcacguccgggaggccuccauccugcucggggacuga

SEQ ID NO: 29842 - RNA, 708 nt, Artificial Sequence
  derived and/or modified sequence opt1 from EXOSC5__Homo_sapiens__NP_064543
auggaggaggagacccacaccgacgccaagauccgcgccgagaacggcacggggagcagcccccggggcccggggugcagccugcgccacuucgcgugcgagcagaaccuccugucccggcccgacggcagcgccuccuuccugcagggggacaccagcgugcucgccggcgucuacggccccgccgaggugaagguguccaaggagaucuucaacaaggccacccuggaggucauccugcgccccaagaucgggcucccgggcguggcggagaagucccgggagcgccugauccggaacacgugcgaggccgugguccuggggacccuccacccccgcaccuccaucaccguggugcugcaggucgugagcgacgccggcucccugcucgccugcugccugaacgcggccugcauggcccugguggacgccgggguccccaugcgggcccucuucugcggcguggcgugcgcccuggacagcgacggcacccuggugcucgaccccacguccaagcaggagaaggaggcccgcgccguccugaccuucgcccuggacagcguggagcggaagcuccugauguccagcaccaaggggcuguacuccgacaccgagcuccagcagugccuggcggccgcccaggccgccagccagcacguguuccgcuucuaccgggagucccugcagcgccgguacagcaagagcuga

SEQ ID NO: 29843 - RNA, 819 nt, Artificial Sequence
  derived and/or modified sequence opt1 from EXOSC6__Homo_sapiens__NP_478126
augcccggcgaccaccgccggauccgcgggccggaggagagccagccgccccagcuguacgccgccgacgaggaggaggcgcccggcacccgggaccccacccgccuccggcccguguacgcccgcgccgggcugcugucccaggccaagggcagcgccuaccucgaggccgggggcacgaagguccugugcgcgguguccggcccccggcaggccgagggcggggagcgcgggggcgggcccgccggcgcgggcggggaggccccggccgcccugcggggccgccuccugugcgacuuccggcgcgcccccuucgcggggcggcgccggcgcgccccgcccggcggcugcgaggagcgggagcuggcccucgcccugcaggaggcccuggagcccgcggugcgccucgggcgguacccccgcgcccagcuggaggucagcgcccugcuccuggaggacggcggguccgcccuggccgcggcccucaccgccgccgcccuggcgcuggccgacgccggcguggagauguacgaccucguggucgggugcggccugagccuggcccccggccccgcgccgaccuggcuccuggaccccacccggcuggaggaggagcgcgccgccgccgggcucacgguggcccugaugcccgugcugaaccaggucgcgggccuccugggguccggcgagggcgggcugaccgagagcugggccgaggccgugcgccucggccuggaggggugccagcggcuguaccccgugcuccagcagucccugguccgcgccgcccggcgccggggcgcggccgcccagccguga

SEQ ID NO: 29844 - RNA, 876 nt, Artificial Sequence
  derived and/or modified sequence opt1 from EXOSC7__Homo_sapiens__NP_055819
auggccagcgugacccuguccgaggccgagaaggucuacaucgugcacggcgugcaggaggaccuccgcgucgacgggcggggcugcgaggacuaccgcugcguggagguggagaccgacgucgugagcaacacguccgggagcgcgcgggugaagcugggccacaccgacauccuggucggggugaaggccgagaugggcacccccaagcucgagaagccgaacgagggcuaccuggaguucuucguggacugcuccgccagcgccacccccgaguucgaggggcgcggcggggacgaccugggcacggagaucgccaacacccucuaccggaucuucaacaacaaguccagcgucgaccugaagacccugugcaucagcccccgcgagcacugcugggugcucuacguggacguccugcugcucgagugcgggggcaaccuguucgacgcgaucuccaucgccgugaaggccgcccuguucaacacccggaucccccgcgugcggguccucgaggacgaggagggcuccaaggacaucgagcugagcgacgacccguacgacugcauccgccuguccguggagaacgugcccugcaucgucacgcucugcaagaucggguaccggcacgugguggacgcgacccugcaggaggaggccugcagccuggccucccuccuggucagcgugaccuccaagggcgucgugaccugcaugcgcaagguggggaagggcagccuggaccccgaguccaucuucgagaugauggagacgggcaagcgggucgggaaggugcuccacgccagccugcagagcgugguccacaaggaggagucccugggccccaagcgccagaaggugggguuccucggcuga

SEQ ID NO: 29845 - RNA, 831 nt, Artificial Sequence
  derived and/or modified sequence opt1 from EXOSC8__Homo_sapiens__NP_852480
auggccgccggcuucaagaccguggagccccuggaguacuaccgccgguuccucaaggagaacugccgcccggacgggcgggagcugggcgaguuccgcaccacgaccgucaacaucgggagcaucuccaccgcggacggcagcgcccuggugaagcucgggaacaccacggugaucugcggcgucaaggccgaguucgccgcccccuccaccgacgcgcccgacaagggcuacguggugcccaacgucgaccugccgccccugugcagcucccgguuccgcagcgggccgcccggcgaggaggcccagguggccucccaguucaucgccgacgugaucgagaacagccagaucauccagaaggaggaccucugcaucuccccggggaagcuggucugggugcuguacugcgaccucaucugccuggacuacgacggcaacauccuggacgcgugcaccuucgcccuccuggccgcccugaagaacgugcagcuccccgaggucaccaucaacgaggagacggcccuggcggaggugaaccugaagaagaaguccuaccucaacauccggacccaccccguggccaccagcuucgccgucuucgacgacacccugcugaucguggaccccacgggggaggaggagcaccucgccaccggcacccugaccaucgugauggacgaggagggcaagcugugcugccuccacaagcccgggggcagcgggcugacgggcgccaagcugcaggacugcaugucccgcgcggucacccggcacaaggaggugaagaagcucauggacgaggugaucaagagcaugaagcccaaguga

SEQ ID NO: 29846 - RNA, 5970 nt, Artificial Sequence
  derived and/or modified sequence opt1 from EXPH5__Homo_sapiens__NP_055880
augaccaaggugcccccggccuucgacuucagcuuccugaacgacgaggaggcccgcaagauccuccagguccuggagcggaacgaggagcugcagcgcgcggagaaggaccggaucuccaagcuccagaagaccaagcgcgacauccgguggcugcagggcgugacgggggagugguucgaggagauccagcgcaagaaguucugcaacgagaccgacgugagccagaugcugaagcagccccucaccuaccggcuguccaaggagauggccaagaacgaccccaucgagcugcccaccagccgcuccaagaacgucacgaaccagaagaagccgacccccuucagcucccggaugagcuuccgcuccagcuucgccucccucuucagcuuccggaaguccggcaaggagaccagcaagcugcccucccuggggcagaagggcugcgacgggcacgccggccccccgaugcccgugcgcggcgccgcggugcaggccaagaucuacaacagcccccucgagaaccaccuggucgacuccaccuucgugcccaagccggccgugaugcgggaggagagcgggaugcccccccccugggacgccucccugcucgagaacgaguucuuccagguccuggacgaccuggacagcaagcucgcgcaggagcagagcgccuccagcgugaacacgcgcaccccgcugaacuacggcucccggacccaguucgggcacuucuacagcuccggcaaccgccacgggaacaucaccgagcggcacaagaagcacuacaacgagacgagcaacauguccaucuacgacauccugcgccccggcaccccccgggagggcuucaagaccuucagcccccgcaccuccacgaucuacgacauguaccggacccgcgagccgcgcguguucaaggaggacuacguccagaagaacaccuucgggagcaccucccucugcuucgacagccggcagcgcuccgcccugcccgccacgggccacuucaccgcccggagccugcacuuccccgcgaccacccaguccaagagcggguucauccccccgcgccaccagcagucccccaagcggacgccccucagcuccaucaucuggaaccgcagcgacagcucccgggaccgcgagaaccaggaggaguuccugcgggcccccagcccgauggagaucgaccccgccgacaaguacguguacccccgcggcuuccaggagaacaagcgguacgaguccuaccacagccagaacguguaccagcgcgucucccugaacgccccgauggagaacgccaugagccccgacaccuucgagaacuccgagaacaugcccuucuaccaccagagcaacaccuucacccgguccuucuucagcaacacguucggccgcuccggggagcagcggcgcuucggccaggggcccuucuggggccaggagaaggggcacagcuucugguccgacuuccaccggagccgcaaguccuucagcuccagcgaccgggacuucgagaugaucagcauggaggcgaacuccgugagcgccauccacggccacaacguguccagcgagcacugggaguccuucagcuccggcuacgggaccgacgucagccgcggccaggaggagccgcaccccuggcaguucgacuuccagcgcuccacccucgacagcaugguggugucccacgggaacgagacccagcugacgccccacuucggcacccccaacgucugcagcaugaccggguccagcuaccacgugaaguccagcgagcuggugucccagcaggacagcuccccggucgaggugcacaucaacaaggaggccagcagcuucggcaucgcccagacccucgccuccagcuucaagacguccuucagccagaucuccgacgaccggcgcaacccccagagccccaaccugcagaaccccaccgucacccugcagaagaucuucccgaacaagcccgcgucccaccccaugcggagccacaccgaggugaccgugacguccagcaacuccgucgacagccucccccuggccaagucccagccgaacauccuggugaccgaggugaacaacgagaaggaccucaacgagagcaucuccgaggaggacaagcagcugagcaagauggaccagaccaacaaggccggcgagaucccccagcccgucucccagaccgggaucagcaacucccugcccgacuuccagaacccgcucagccaggacagcgccaaguccaacggcuucggguucaacgccagcacgaucaucuccagcaagaaguccccccgcguguucagccggaaggacaccuccaagauguacaucccccacaccgacaagagcaacgacaucaagcaggacaagcgcuucaccgagaaccggaagcugggcuccacggcgagccugcccuucauccaggagcaccgcaccccgcccuccuucccccggaccgaccaggggugccaccaggagcucaccgugaacaacgaggacaucagccgcaucaucacgaacaaccacugguccagcgcccugaccgacacccagaacgcccaguacuccaagugcaagcugaccccgggccacaagacgagcugcgacucccucgaccugagcuccgccgcgcugcccgacagcagccccuccaagaacagcucccucgacgcccccgucgugccgagcaccaccguguucucccggcgcagccccuccgacaaggaccccagccugggcgagcgggaggagaaggacaacgccgggaagaaccagaagaaccaguucaucgucucccacagcgagaaccaggagcgcaacgacucccccgugccgacccacgacgagguggucgacgugaagugccacagccacucccccuuccggaacgagcgcggcaaggggaagauccggcaccacaucagcugcaucgagaagcuguccaagacggagagcaucuccgugcccaccagcgaccaccgcucccugaucgaggccaaccagagcaacagcaaggucuccgagcucgacaccaucuacugcacccugccccggaagagcuccagcuuccugauccacggccgccaguccggcagcaagaucauggccgcgucccuccggaacgggccgccccccuuccagaucaagaacaacguggaggacgccaugggcaacuacaugcugaacaaguucagccccuccagcccggaguccgccaacgagugcagcaaggugcuguccgacagcgcccucgaggcccccgaggcgacggagcgcaugaccaacgucaaguccagcggguccaccagcgugcgcaagggcccccugcccuuccugaucaaccgggccauguccugcccgagcggggagccccacgccagcaccggccgcgagggccggaagaagccccucacguccgggauggacgccagcgagcugaccccccgcgccugggagcggaucaucuccccgguggagagcgacuccagcguccgcgacugcucccugaccaagcggcagcaccagaaggagaacuuccaggaguacaccgagaaggagggcaagauggcggccagccgccgguccguguucgcccucagcaacgaggacccccugcccuucugcuccgaccugagcgggaaggagcgcggcaagacgcuccacaaggugaagaccaccuccaccuucagcgucuccggggacgaggacaacgugaagugccuggagguggucagcaucuacuacacgcugccccggaagccguccaagaaguucugcaaccuccugcagcaguacacccagaacaccaaccugcucaucgagagcccccagguggagaccgagaccuuccccaacgcccuggagaaggacaagcagaacuacagcacgcgcgagcaguccggcaccccgagcugcgagaaccugaagauguccgugaacagcgaccagacccucaccacggagaacaugaccgcguuccggcuguccaaccgcggcccccuggcccccacccuccaggagauggccagcgucgaggccgccgugucccugcccgaggaggagagcaaggcgcgggagaucuucuccgacaaccuggccaagaccccgcucggggacagcgagaacaagaaggagcgcggcaagaagcugcaguccgagacgcugcacaccagccucaugcugcagcggaagaacguguccgaggagaagagcgagaacugccagcaguccaucaacagcuccaacagcgggcccuccagccugcccgcccucagcgaggucaacaucggcaacucccagacccgccggagcuccugggagugcaccgggagcggccgcgccauccccuucacgggcuccgggaagugcccgcagaaggaccacaccagcaccgccgugggcgacggguccagcggcucccagccccgcgaggggcggggcgacaucggcaccaacugccagaagaugacgaacaagacccugagccacuccgagagccagguguucgcgcugacccccgcccuccacaagcugcagcugggggaggagacccaguccgacgagcccaaccucgagagccugcaguccgagccgcgcgagcugccccagcggagccaggaggccaacaugacggagucccgcaaggccgaggacgagaugcagaagagcgccugggaccagcccucccuccccgagggcaacaagaacaagaccaaccuggacgaccuggucaagggggagaaccggagcagcgugaagcaccgccucgcggccauguccaaggccagccggaaguucccggccaaggacguguccccccgccggcacgucgcgaccaucuucccccagagcggcucccgcagcggcuucgaccaccugucccuggggaccguggagugcaacccccucuucccggagcccacgcccaagagcgccgaguccaucggcgagagccggcuguccgagaacgggaagcacgugaagaagagcgagaaccugcuccccaucaccguccugccgaaccgcgagcccuccacccacgugagcaaccagaaguccaacagcaucucccagcggcaccagaacgaguucaagaacgugagcgagucccccagcaagcacgagaacagcaaggacgucaccgccgcccagaaccuggugcgcgaguccggcgcccccagcccgaucacguucaccucccuccgggaggcggaguucagcgacaaccagcgccggcuguccccccccuucccgcuggagcccgcccagaagagccgcguguccagcccccucgccuccuuccugcagcagcagcggagcgccuccagccuggagugggagcccgagccgcaccucuaccgcuccaagagccugaaguccaucaacguccacggggaccugcuccggaagagccacccccccaaggugcgcgagcgccacuucuccgagagcaccuccaucgacaacgcccugagccggcugacccucggcaacgaguucagcgucaacaacggcuacucccgccgguuccgcagcuucuccgagcugcccagcugcgacgggaacgaguccugggcguaccggagcggcacgaagaccgggccgcgcuccgccaucagcaucuaccggcccaucgacuacggcaucuucgggaaggagcagcagcuggccuuccucgagaacgugaagcgcucccugacccagggccggcuguggaagcccagcuuccucaagaaccccggcuuccugaaggacgaccugcgcaacccgcccaaccccuccgagagccucuccagcaacucccccagcucccaggugccggaggacgggcugagccccuccgagccccugaacaucuacgaggacgaccccgucgacagcgacugcgacaccgacacgaccaccgacgacgaguacuaccucgacgagaacgacaaggagagcgagcuguga

SEQ ID NO: 29847 - RNA, 2241 nt, Artificial Sequence
  derived and/or modified sequence opt1 from EXT1__Homo_sapiens__NP_000118
augcaggccaagaagcgcuacuucauccugcucagcgccggcuccugccuggcgcuccucuucuacuucgggggccugcaguuccgggccagccgcucccacagccggcgcgaggagcacuccgggcggaacggccugcaccaccccagcccggaccacuucuggccccgcuuccccgacgcccuccggcccuucgugccgugggaccagcuggagaacgaggacuccagcguccacaucagcccccgccagaagcgggacgccaacuccuccaucuacaaggggaagaagugccgcauggagagcugcuucgacuucacccugugcaagaagaacggcuucaagguguacguguacccccagcagaagggcgagaagaucgccgaguccuaccagaacauccucgcggccaucgaggggagccgguucuacaccuccgaccccagccaggccugccuguucguccugucccucgacacgcuggaccgcgaccagcugagcccgcaguacgugcacaaccuccgguccaaggugcagagccugcaccuguggaacaacggccgcaaccaccucaucuucaaccuguacagcgggaccuggcccgacuacaccgaggacgucggcuucgacaucgggcaggccaugcuggcgaaggccuccaucagcaccgagaacuuccggcccaacuucgacguguccaucccccucuucagcaaggaccacccgcgcacgggcggcgagcggggguuccugaaguucaacaccaucccgccccugcgcaaguacaugcucguguucaagggcaagcgguaccugaccgggaucggcuccgacacccgcaacgcccuguaccacguccacaacggcgaggacguggugcuccugacgaccugcaagcacgggaaggacuggcagaagcacaaggacagccggugcgaccgcgacaacaccgaguacgagaaguacgacuaccgcgagaugcugcacaacgccaccuucugccucgucccccggggccgccggcugggguccuuccgcuuccuggaggcccuccaggcggccugcgugcccgugaugcugagcaacggcugggagcugcccuucuccgaggucaucaacuggaaccaggccgccgugaucggggacgagcggcuccugcugcagauccccagcacgauccgcuccauccaccaggacaagauccucgcccugcggcagcagacccaguuccugugggaggcguacuucagcuccguggagaagaucguccucaccacccuggagaucauccaggaccgcaucuucaagcacaucagccggaacucccugaucuggaacaagcaccccggcggccucuucgugcugccgcaguacagcuccuaccugggggacuuccccuacuacuacgccaaccucggccugaagccgcccagcaaguucacggccgugauccacgccgucacgccccuggugucccagagccagcccgugcugaagcuccuggucgccgcggccaagagccaguacugcgcccagaucaucgugcuguggaacugcgacaagccccuccccgccaagcaccgcuggccggccaccgcgguccccgugguggucaucgagggggaguccaaggugaugagcucccgguuccugcccuacgacaacaucaucaccgacgccgugcugagccucgacgaggacaccguccuguccaccaccgagguggacuucgccuucaccguguggcagagcuucccggagcgcaucgucggcuaccccgcccggucccacuucugggacaacagcaaggagcgcuggggguacacguccaaguggaccaacgacuacagcauggugcugaccggcgcggccaucuaccacaaguacuaccacuaccucuacucccacuaccugcccgccagccugaagaacaugguggaccagcucgccaacugcgaggacauccugaugaacuuccuggucuccgccgugaccaagcugcccccgaucaaggugacgcagaagaagcaguacaaggagaccaugaugggccagaccagccgggcgucccgcugggccgaccccgaccacuucgcccagcggcagagcugcaugaacaccuucgccuccugguucggguacaugccccugauccacagccagaugcgccuggaccccguccucuucaaggaccaggugagcauccugcggaagaaguaccgcgacaucgagcgccuguga

SEQ ID NO: 29848 - RNA, 2256 nt, Artificial Sequence
  derived and/or modified sequence opt1 from EXT2__Homo_sapiens__NP_000392
augagcugcgccuccggcagcgggggcgggcugcgccacccccuccggugccagaagccgugggacgaggagugcgaggaggaggccgugugcgucaucaugugcgcguccgugaaguacaacauccgcggccccgcccugaucccccggaugaagaccaagcaccgcaucuacuacaucacccuguucagcaucgugcuccuggggcugaucgccacgggcauguuccaguucuggccccacuccaucgagagcuccaacgacuggaacgucgagaagcggagcauccgcgacgugccggugguccggcuccccgccgacucccccauccccgagcgcggcgaccugagcugccggaugcacacgugcuucgacguguaccgcugcggguucaacccgaagaacaagaucaagguguacaucuacgcccugaagaaguacgucgacgacuucggcguguccgugagcaacaccaucucccgggaguacaacgagcuccugauggcgaucagcgacuccgacuacuacaccgacgacaucaaccgcgccugccuguucguccccagcaucgacgugcucaaccagaacacccugcggaucaaggagaccgcccaggccauggcgcagcugucccgcugggaccgggggaccaaccaccuccuguucaacaugcugcccggcgggcccccggacuacaacaccgcccucgacgugccccgcgaccgggcccugcuggccggcggcggguucagcacguggaccuaccgccagggcuacgacgucuccauccccguguacagcccccucagcgccgagguggaccugccggagaaggggcccggcccccggcaguacuuccugcucuccagccaggucggccugcaccccgaguaccgcgaggaccuggaggcgcuccaggugaagcacggggaguccgugcugguccuggacaagugcaccaaccucagcgagggcgugcuguccgugcggaagcgcugccacaagcaccaggucuucgacuacccccaggugcugcaggaggccaccuucugcgucgugcuccgcggggcccggcugggccaggccgugcugagcgacguccuccaggccgggugcgugcccguggucaucgcggacuccuacauccugcccuucagcgaggugcuggacuggaagcgcgccuccguggucgugcccgaggagaagaugagcgacguguacuccauccuccagagcaucccgcagcggcagaucgaggagaugcagcgccaggcccggugguucugggaggccuacuuccaguccaucaaggccaucgcgcuggccacgcugcagaucaucaacgaccgcaucuaccccuacgccgccaucagcuacgaggaguggaacgacccgcccgccgucaaguggggcuccgugagcaacccccucuuccugccccugaucccgccgcagucccagggcuucaccgcgaucgugcucaccuacgaccgggucgagagccuguuccgcgugaucaccgagguguccaagguccccagccugagcaagcuccuggugguguggaacaaccagaacaagaacccgcccgaggacucccuguggcccaagauccgggucccccugaagguggugcgcacggccgagaacaagcucagcaaccgguucuuccccuacgacgagaucgagaccgaggccguccuggccaucgacgacgacaucaucaugcugaccuccgacgagcuccaguucggguacgagguguggcgcgaguuccccgaccggcuggugggcuacccggggcgccugcaccucugggaccacgagaugaacaaguggaaguacgagagcgaguggaccaacgaggucuccauggugcugacgggcgcggccuucuaccacaaguacuucaacuaccuguacaccuacaagaugcccggggacaucaagaacuggguggacgcccacaugaacugcgaggacaucgccaugaacuuccucgucgccaacgugaccggcaaggcggugaucaaggucacgccccggaagaaguucaagugccccgagugcaccgccaucgacggccugagccuggaccagacccacaugguggagcgcuccgagugcaucaacaaguucgccagcguguucgggaccaugccgcucaaggucguggagcaccgggccgaccccgugcuguacaaggacgacuuccccgagaagcugaaguccuuccccaacaucggcagccucuga

SEQ ID NO: 29849 - RNA, 1014 nt, Artificial Sequence
  derived and/or modified sequence opt1 from EXTL2__Homo_sapiens__XP_011539298
augcgcaccuggaacagcggcgggaccaagugcugccacaucugcaagcugcccggccgggugauggggauccgcguccuccggcugucccugguggugauccucguccugcugcucguggccggcgcccugacggcgcugcucccgagcgugaaggaggacaagaugcugaugcugcgccgggagaucaagucccagggcaagagcaccauggacuccuucacccucaucaugcagaccuacaaccgcacggaccugcugcucaagcugcugaaccacuaccaggccguccccaaccuccacaaggugaucguggucuggaacaacaucggggagaaggcccccgacgagcuguggaacagccugggcccccacccgauccccgugaucuucaagcagcagaccgccaaccggaugcgcaaccggcuccagguguuccccgagcuggagaccaacguccugaugguggacgacgacacccucaucuccacgcccgaccugguguucgccuucagcgucuggcagcaguucccggaccagaucgugggguucgugccccgcaagcacgucuccaccagcuccggcaucuacagcuacggguccuucgagaugcaggcgcccggcagcgggaacggcgaccaguacuccauggugcugaucggcgccagcuucuucaacuccaaguaccucgagcuguuccagcggcagcccgccgccgugcacgcgcugaucgacgacacccagaacugcgacgacaucgccaugaacuucaucaucgccaagcacaucgggaagaccagcggcaucuucgucaagccggugaacauggacaaccucgagaaggagacgaacuccggguacagcggcauguggcaccgcgccgagcacgcccugcagcggagcuacugcaucaacaagcuggugaacaucuacgacuccaugccccuccgcuacagcaacaucaugaucucccaguucggcuuccccuacgcgaacuacaagcggaagaucuga

SEQ ID NO: 29850 - RNA, 2760 nt, Artificial Sequence
  derived and/or modified sequence opt1 from EXTL3__Homo_sapiens__NP_001431
augaccggcuacaccaugcugcgcaacgggggcgccgggaacggcgggcagacgugcaugcuccgguggagcaaccgcauccggcugaccuggcuguccuucacccucuucgugauccugguguucuucccccugaucgcccacuacuaccucaccacgcuggacgaggcggacgaggccggcaagcgcaucuucggcccgcggguggggaacgagcugugcgaggugaagcacguccucgaccugugccgcauccgggagagcguguccgaggagcugcuccagcuggaggccaagcgccaggagcugaacagcgagaucgccaagcucaaccugaagaucgaggccugcaagaaguccaucgagaacgcgaagcaggaccugcuccagcugaagaacgugaucagccagaccgagcacuccuacaaggagcugauggcccagaaccagcccaagcucagccugcccauccggcugcuccccgagaaggacgacgccggccugccgccgcccaaggccacccgcgggugccggcugcacaacugcuucgacuacucccgcugcccccucaccagcggcuuccccgucuacguguacgacuccgaccaguucguguucgggagcuaccuggacccccuggucaagcaggcguuccaggccacggcccgggccaacguguacgugaccgagaacgccgacaucgcgugccucuacgucauccuggugggcgagaugcaggagcccgugguccugcgccccgccgagcucgagaagcagcuguacucccugccgcacuggcggaccgacggccacaaccacgugaucaucaaccucagccgcaaguccgacacccagaaccugcuguacaacgugagcacggggcgggccauggucgcccaguccaccuucuacaccgugcaguaccgccccggcuucgaccucguggucagcccccuggugcacgccauguccgagcccaacuucauggagaucccgccccaggugcccgucaagcggaaguaccuguucaccuuccagggggagaagaucgagagccuccgcagcucccugcaggaggcgcggagcuucgaggaggagauggagggcgacccgcccgccgacuacgacgaccgcaucaucgccacgcugaaggccgugcaggacuccaagcucgaccagguccugguggaguucacgugcaagaaccagcccaagcccagccugcccaccgagugggcccucugcggcgagcgcgaggaccggcuggagcugcugaagcucuccaccuucgcgcugaucaucaccccgggggacccccgccuggugaucagcuccggcugcgccacccgccucuucgaggcccuggaggucggggccgugcccgugguccugggcgagcagguccagcuccccuaccaggacaugcugcaguggaacgaggccgcgcugguggugccgaagccccgggugaccgaggugcacuuccuccugcggagccuguccgacagcgaccuccuggccaugcgccggcaggggcgcuuccugugggagaccuacuucuccacggccgacagcaucuucaacaccguccucgccaugauccggacccgcauccagauccccgcggccccgauccgggaggaggccgccgccgagaucccccaccgcuccggcaaggcggccggcaccgaccccaacauggccgacaacggggaccuggaccugggccccguggagacggagccgcccuacgccagcccccgguaccuccgcaacuucacccugaccgugaccgacuucuaccgguccuggaacugcgcccccgggccguuccaccuguucccccacacgcccuucgaccccguccucccgagcgaggcgaaguuccugggcuccgggaccggcuuccgccccaucggcgggggcgccgggggcagcgggaaggaguuccaggccgcccugggcggcaacgugccccgggagcaguucaccguggucaugcucaccuacgagcgcgaggaggugcugaugaacucccuggagcggcucaacgggcugcccuaccugaacaagguggucgugguguggaacagcccgaagcuccccagcgaggaccugcuguggcccgacaucggcguccccaucaugguggugcgcacggagaagaacucccucaacaaccgcuuccugccguggaacgagaucgagaccgaggccauccugagcaucgacgacgacgcgcaccuccggcacgacgagaucauguucggguuccgcgucuggcgggaggcccgcgaccggaucgugggcuuccccggccgcuaccacgccugggacaucccccaccaguccuggcuguacaacagcaacuacuccugcgagcugagcauggugcucaccggggccgcguucuuccacaaguacuacgccuaccuguacuccuacgucaugccccaggccauccgggacaugguggacgaguacaucaacugcgaggacaucgccaugaacuuccuggugagccacaucacccgcaagccgcccaucaaggucaccucccgguggacguuccgcugccccggcugcccgcaggcccucagccacgacgacucccacuuccacgagcggcacaagugcaucaacuucuucgugaagguguacggguacaugccccugcuguacacccaguuccgcgucgacagcguccucuucaagacccggcugccccacgacaagaccaagugcuucaaguucaucuga

SEQ ID NO: 29851 - RNA, 1779 nt, Artificial Sequence
  derived and/or modified sequence opt1 from EYA1__Homo_sapiens__NP_000494
auggagaugcaggaccugaccagcccccacucccgccucagcggcuccagcgagucccccagcgggcccaagcugggcaacucccacaucaacagcaacuccaugacccccaacgggacggaggugaagaccgagcccaugagcuccagcgagaccgccuccaccacggccgacggcagccugaacaacuucuccgggagcgcgaucggcuccagcuccuucagcccgcggcccacccaccaguucagcccgccccagaucuaccccuccaaccgccccuacccccacauccuccccaccccgagcucccagaccauggccgccuacggccagacgcaguucaccaccgggaugcagcaggccaccgccuacgcgacguacccccagcccggccagcccuacgggaucagcuccuacggcgcccugugggccgggaucaagaccgagggcggccugagccagucccagagcccggggcagaccggcuuccucuccuacgggaccagcuucuccacgccccagcccggccaggcccccuacagcuaccagaugcagggcuccagcuucaccaccuccagcgggaucuacaccggcaacaacucccugacgaacagcuccggguucaacagcagccagcaggacuacccguccuaccccagcuucggccaggggcaguacgcgcaguacuacaacuccagccccuaccccgcccacuacaugaccuccagcaacaccuccccgaccacgcccagcaccaacgccaccuaccagcugcaggagccgcccuccggcaucaccagccaggccgucacggaccccaccgccgaguacuccaccauccacagccccuccacccccaucaaggacagcgacuccgaccggcuccgccggggcagcgacgggaagucccgcggccgggggcgccggaacaacaacccgagcccgccgcccgacagcgaccuggagcgcguguucaucugggaccuggacgagacgaucaucguguuccacucccuccugaccggcagcuacgcgaaccgguacgggcgcgacccgcccaccuccgucagccugggccuccggauggaggagaugaucuucaaccuggccgacacccaccuguucuucaacgaccucgaggagugcgaccaggugcacaucgacgacguguccagcgacgacaacggccaggaccuguccacguacaacuucgggaccgacggcuuccccgccgccgccaccagcgcgaaccugugccucgccaccgggguccgcggcgggguggacuggaugcggaagcuggccuuccgcuaccggcgcgugaaggagaucuacaacaccuacaagaacaacgucggcggccugcucgggcccgccaagcgggaggccuggcugcagcugcgcgcggagaucgaggcccucacggacuccuggcugacccuggcccucaaggcccugagccugauccacucccggaccaacugcgugaacauccucgugaccacgacccagcugauccccgcccuggcgaagguccuccuguacggccuggggaucguguuccccaucgagaacaucuacagcgccaccaagaucggcaaggaguccugcuucgagcgcaucauccagcgcuucggccggaagguggucuacguggugaucggggacggcgucgaggaggagcagggggccaagaagcacgccaugcccuucuggcgcaucagcucccacagcgaccucauggcgcugcaccacgcccuggagcucgaguaccuguga

SEQ ID NO: 29852 - RNA, 1617 nt, Artificial Sequence
  derived and/or modified sequence opt1 from EYA2__Homo_sapiens__NP_005235
augguggagcuggucaucagccccucccucaccgugaacagcgacugccuggacaagcugaaguucaaccgcgccgacgccgcgguguggacccucuccgaccggcagggcaucaccaagagcgccccgcugcgcgucucccagcuguucagccgguccugcccccgcgugcucccccggcagcccagcacggccauggccgccuacgggcagacccaguacuccgcgggcauccagcaggccaccccguacacggccuacccgccgcccgcccaggcguacgggauccccagcuacuccaucaagaccgaggacagccugaaccacucccccggccagagcggguuccuguccuacggcagcuccuucagcaccucccccaccggccagagccccuacacguaccagaugcacgggaccaccggcuucuaccagggcgggaacgggcucggcaacgccgccggcuucgggagcgugcaccaggacuaccccuccuaccccggcuucccccagagccaguacccccaguacuacggguccagcuacaacccgcccuacguccccgccuccagcaucugccccuccccgcugagcaccuccacguacgugcugcaggaggccagccacaacgugcccaaccaguccagcgagucccucgcgggcgaguacaacacccacaacggccccagcacccccgccaaggagggggacaccgaccgcccgcaccgggccuccgacggcaagcugcgcgggcggagcaagcgcuccagcgaccccucccccgccggcgacaacgagaucgagcgggucuucgugugggaccuggacgagacgaucaucaucuuccacagccuccugaccgggaccuucgccagccgcuacggcaaggacaccacgaccuccgugcggaucggccugaugauggaggagaugaucuucaaccucgcggacacccaccuguucuucaacgaccuggaggacugcgaccagauccacgucgacgacgugagcuccgacgacaacgggcaggaccucagcaccuacaacuucuccgccgacggcuuccacagcuccgcccccggggccaaccugugccugggcagcggggugcacggcggcgucgacuggaugcgcaagcucgccuuccgguaccgccgggugaaggagauguacaacacguacaagaacaacgucgggggccugaucgggaccccgaagcgcgagaccuggcugcagcuccgggcggagcuggaggcccugaccgaccucuggcugacgcacucccugaaggcccucaaccugaucaacagccgccccaacugcgugaacgugcuggugaccaccacccagcucauccccgcccuggccaagguccugcucuacggccugggguccguguucccgaucgagaacaucuacagcgcgacgaagaccggcaaggaguccugcuucgagcggaucaugcagcgcuucggccgcaaggccguguacgucgugaucggggacggcgucgaggaggagcagggggccaagaagcacaacaugcccuucuggcggaucagcugccacgccgaccuggaggcgcuccgccacgcccuggagcuggaguaccucuga

SEQ ID NO: 29853 - RNA, 1920 nt, Artificial Sequence
  derived and/or modified sequence opt1 from EYA4__Homo_sapiens__NP_004091
auggaggacagccaggaccugaacgagcaguccgugaagaagaccugcaccgagagcgacgucucccagagccagaacucccgcagcauggagaugcaggaccucgccagcccccacacgcuggugggcgggggcgacaccccggggagcuccaagcuggagaaguccaaccucuccagcaccuccgugaccacgaacggcaccgggggcgagaacaugaccguccugaacaccgccgacuggcugcucagcugcaacacgcccuccagcgcgaccaugucccugcuggccgugaagaccgagccccucaacagcuccgagaccacggccaccaccggcgacggggcccuggacaccuucacgggcagcgugaucaccagcuccggguacagcccccgguccgcccaccaguacagcccgcagcuguaccccuccaagcccuacccccacauccucagcaccccggcggcccagaccauguccgccuacgccggccagacgcaguacagcgggaugcagcagcccgcggucuacaccgccuacucccagaccggccagcccuacagccugcccaccuacgaccugggcgugaugcucccggccaucaagacggaguccgggcugagccagacccagagcccccugcaguccggcugccucuccuacagccccggguucuccacgccccagccgggccagacccccuacagcuaccagaugcccggcuccagcuucgcccccagcuccaccaucuacgccaacaacagcguguccaacagcaccaacuucuccgggagccagcaggacuacccguccuacaccgcguucggccagaaccaguacgcccaguacuacagcgccuccaccuacggggccuacaugacgagcaacaacaccgccgacggcacccccuccagcaccuccacguaccagcugcaggagagccugcccgggcucaccaaccagcccggcgaguucgacaccaugcaguccccgagcacccccaucaaggaccuggacgagcggaccugccgcuccagcggcagcaagucccgcgggcggggccgcaagaacaaccccagcccgccgcccgacuccgaccuggagcgggucuucgugugggaccucgacgagacgaucaucguguuccacagccugcugaccggguccuacgcgcagaaguacggcaaggacccgcccauggccgucacccucgggcugcgcauggaggagaugaucuucaaccuggccgacacccaccucuucuucaacgaccuggaggagugcgaccaggugcacaucgacgacgugagcuccgacgacaacggccaggaccugagcacguacuccuucgccaccgacggcuuccacgccgcggccagcuccgccaaccucugccugcccaccgggguccggggcgggguggacuggaugcgcaagcuggccuuccgguaccgccgggugaaggagcucuacaacaccuacaagaacaacgucggcgggcugcugggccccgccaagcgcgacgcguggcuccagcugcgggccgagaucgagggccugacggacagcuggcucaccaacgcccugaagucccugagcaucaucuccacccgcagcaacugcaucaacgugcucgugaccacgacccagcugauccccgcccuggcgaagguccuccuguacucccucgggggcgccuuccccaucgagaacaucuacagcgccaccaagaucgggaaggaguccugcuucgagcggaucaugcagcgcuucggccggaaggugguguacgucgugaucggcgacggggucgaggaggagcaggccgccaagaagcacaacaugcccuucuggcgcaucagcagccacuccgaccugcuggcgcugcaccaggcccuggagcucgaguaccuguga

SEQ ID NO: 29854 - RNA, 9435 nt, Artificial Sequence
  derived and/or modified sequence opt1 from EYS__Homo_sapiens__NP_001136272
augaccgacaagagcaucgugauccugucccucauggucuuccacagcuccuucaucaacggcaagaccugccgccggcagcugguggaggaguggcacccccagccgagcuccuacguggucaacuggacgcugaccgagaacaucugccucgacuucuaccgcgacugcugguuccugggggugaacaccaagaucgacaccagcggcaaccaggccgugccccagaucugcccccugcagauccagcucggggacauccuggucaucuccagcgagcccucccugcaguucccggagaucaaccucaugaacgugagcgagacguccuucgugggcugcguccagaacaccaccaccgaggaccagcugcuguucgggugccggcucaagggcaugcacacggugaacagcaaguggcuguccgugggcacccacuacuucaucaccgucauggccagcgggcccucccccugcccccugggccuccgccugaacgugaccgugaagcagcaguucugccaggagagccuguccagcgaguucugcuccgggcacggcaagugccucagcgaggcguggagcaagacguacuccugccacugccagccgcccuucagcgggaaguacugccaggagcuggacgccugcuccuucaagcccugcaagaacaacggcagcugcaucaacaagcgggagaacugggacgagcaggccuacgagugcgucugccaccccccguucaccggcaagaacugcuccgagaucaucgggcagugccagccccacgugugcuuccacggcaacugcagcaacaucaccuccaacagcuucaucugcgagugcgacgagcaguucuccgggcccuucugcgaggugagcgccaagcccugcgucucccugcucuucuggaagcgcggcaucugcccgaacagcuccagcgccuacaccuacgagugccccaagggcuccagcucccagaacggggagacggacgugagcgaguucucccuggugcccugccagaacggcaccgacugcaucaagaucagcaacgacgucaugugcaucugcagccccaucuucaccgaccugcucugcaaguccauccagaccagcugcgaguccuucccgcugcggaacaacgcgacgugcaagaagugcgagaaggacuaccccugcagcugcaucuccggguucaccgagaagaacugcgagaaggccaucgaccacugcaagcugcucagcaucaacugccugaacgaggaguggugcuucaacaucaucggccgcuucaaguacgugugcauccccgggugcaccaagaaccccugcugguuccugaagaacguguaccucauccaccagcaccugugcuacugcggcgucaccuuccacggcaucugccaggacaaggggccggcccaguucgaguacguguggcagcugggcuucgccggguccgagggcgagaagugccagggggucaucgacgcguacuucuuccucgccgccaacugcacggaggacgccaccuacgugaacgaccccgaggacaacaacagcuccugcugguucccccacgagggcaccaaggagaucugcgccaacggcugcagcugccuguccgaggaggacagccaggaguaccgguaccugugcuuccuccgcugggcggggaacauguaccuggagaacaccacggacgaccaggagaacgagugccagcacgaggccgugugcaaggacgagaucaaccggccccgcugcuccugcagccuguccuacaucggccggcucugcgucgugaacguggacuacugccuggggaaccacagcaucuccguccacggccugugccucgcccugagccacaacugcaacugcagcgggcugcagcgcuacgagcggaacaucugcgagaucgacaccgaggacugcaaguccgccagcugcaagaacggcaccaccuccacgcaccuccgcggcuacuucuuccggaagugcgugccgggguucaagggcacccagugcgagaucgacaucgacgagugcgccagccaccccugcaagaacggggcgaccugcaucgaccagcccggcaacuacuucugccagugcgugccgcccuucaaggucguggacggcuucuccugccugugcaaccccggguacgugggcauccgcugcgagcaggacaucgacgacugcauccugaacgccugcgagcacaacagcaccugcaaggaccuccaccuguccuaccagugcgucugccugagcgacugggaggggaacuucugcgagcaggaguccaacgagugcaagaugaaccccugcaagaacaacagcacgugcaccgaccuguacaaguccuaccggugcgagugcaccagcggcuggaccgggcagaacugcuccgaggagaucaacgagugcgacagcgacccgugcaugaacggcggccucugccacgaguccaccauccccgggcaguucgugugccugugccccccccuguacacgggccaguucugccaccagcgcuacaaccucugcgaccugcugcacaacccgugccggaacaacagcaccugccucgcccugguggacgccaaccagcacugcaucugccgcgaggaguucgaggggaagaacugcgagaucgacgucaaggacugccuguuccucuccugccaggacuacggcgacugcgaggacauggugaacaacuuccgcugcaucugccggcccggguucagcggcucccugugcgagaucgagaucaacgagugcagcagcgagcccugcaagaacaacggcaccugcguggaccugaccaaccgcuucuucugcaacugcgagcccgaguaccacgggccguucugcgagcucgacgucaacaagugcaagaucucccccugccuggacgaggagaacugcguguaccggacggacggcuacaacugccugugcgcccccggguacaccggcaucaacugcgagaucaaccucgacgagugccugagcgagcccugccugcacgacggggugugcaucgacggcaucaaccacuacaccugcgacugcaaguccggcuucuucgggacccacugcgagacgaacgcgaacgacugccucagcaacccgugccugcacggccgcugcaccgagcugaucaacgaguaccccugcuccugcgacgccgacgggaccagcacccagugcaagaucaagaucaacgacugcacguccauccccugcaugaacgagggcuucugccagaagagcgcccacggguucaccugcaucugcccccggggcuacaccggcgccuacugcgagaaguccaucgacaacugcgccgagccggagcucaacagcgucaucugccugaacgggggcaucugcguggacgggcccggccacaccuucgacugccgcugccugcccggcuucuccgggcaguucugcgagaucaacaucaacgagugcagcuccagccccugccuccacggcgcggacugcgaggaccacaucaacggguacgugugcaagugccagccgggcugguccgggcaccacugcgagaacgagcuggagugcauccccaacagcugcguccacgagcugugcauggagaacgagcccggcuccacgugccucugcaccccgggcuucaugaccugcagcaucgggcugcugugcggcgacgagauccggcgcaucaccugccucacgcccaucuuccagcggaccgaccccaucuccacccagaccuacacgauccccccgagcgagacccuggugagcuccuuccccagcaucaaggccacccgcauccccgccaucauggacaccuaccccguggaccaggggccgaagcagacgggcaucgucaagcacgacauccugcccaccaccgggcucgccacccugcggaucuccacgccccuggagagcuaccuccugcaggagcugaucgugacccgcgagcucuccgcgaagcacagccugcuguccagcgccgacguguccagcucccgguuccucaacuucggcauccgcgaccccgcccagaucguccaggacaagaccagcgugucccacaugccgauccggaccagcgccgccacgcugggcuucuucuuccccgaccgccgggcgcgcacccccuucaucauguccagccugauguccgacuucaucuuccccacccagagccuccuguucgagaacugccagaccguggcccuguccgccaccccgacgaccagcgucauccggagcauccccggggccgacaucgagcucaaccgccagucccugcugagccgcggcuuccuccugaucgccgcguccaucagcgccacccccguggugucccggggggcccaggaggacaucgaggaguacagcgccgacucccugaucagccgccgggagcacuggcgccuccugucccccagcauguccccgaucuuccccgccaaggucaucaucagcaagcaggugaccauccugaacuccagcgcgcuccaccgguucuccacgaaggccuucaaccccagcgaguaccaggccaucaccgaggccuccagcaaccagcgccugaccaacaucaagucccaggcggccgacagccugcgggagcucagccagaccugcgccacgugcuccaugaccgagaucaagagcucccgcgaguucagcgaccaggugcugcacuccaagcagagccacuucuacgagaccuucuggaugaacuccgccauccuggccagcugguacgcgcucaugggcgcccagaccaucacguccgggcacagcuucuccagcgccaccgagaucacccccuccgucgccuucaccgaggugccgagccuguuccccuccaagaagagcgccaagcggacgauccuguccagcucccucgaggagagcaucacccugagcuccaaccuggacgugaaccucugccuggacaagaccugccugagcaucguccccucccagaccaucagcuccgaccucaugaacagcgaccugacguccaagaugaccaccgacgagcugagcguguccgagaacauccucaagcugcugaagauccgccaguacggcaucaccaugggccccacggaggugcucaaccaggagagccugcuggacauggagaaguccaaggggagccacacccucuucaagcugcacccguccgacagcucccuggacuucgagcucaaccugcagaucuaccccgacgucacccugaagaccuacagcgagaucacgcacgcgaacgacuucaagaacaaccuccccccgcugaccggcuccgugcccgacuucagcgaggugaccaccaacgucgccuucuacacggugagcgccacccccgcccuguccauccagaccagcuccagcauguccgugauccggcccgacuggccguacuucaccgacuacaugacgagccucaagaaggaggucaagaccuccagcgagugguccaagugggagcugcagcccagcgugcaguaccaggaguuccccaccgccucccgccaccugcccuucacccggagccucacccuguccagccuggaguccauccuggcgccgcagcgccucaugaucagcgacuucuccugcguccgguacuacggggacagcuaccuggaguuccagaacguggcccugaacccccagaacaacaucucccucgaguuccagacguucagcagcuacggccugcugcucuacgugaagcaggacuccaaccuggucgacggcuucuucauccagcuguucaucgagaacgggacccucaaguaccacuucuacugccccggcgaggccaaguucaagagcaucaacaccaccgugcgcguggacaacgggcagaaguacacgcugcugauccggcaggagcucgaccccugcaacgccgagcugaccauccugggccgcaacacccagaucugcgaguccaucaaccacguccucgggaagccgcugcccaagagcggcuccguguucaucggcggguuccccgaccugcacggcaagauccagaugcccgugccggucaagaacuucaccgggugcaucgaggugaucgagaucaacaacuggcggagcuucauccccuccaaggcggugaagaacuaccacaucaacaacugccgcagccagggcuucaugcucucccccacggccagcuucgucgacgccuccgacgugacccaggggguggacaccauguggaccagcgucucccccagcguggccgccccguccgugugccagcaggacgucugccacaacggcggcacgugccacgcgaucuuccugagcuccgggaucgugagcuuccagugcgacugcccccugcacuucaccggccgguucugcgagaaggacgccgggcucuucuuccccuccuucaacggcaacagcuaccuggagcugcccuuccucaaguucgugcuggagaaggagcacaaccgcaccgucaccaucuaccugacgaucaagaccaacagccucaacgggaccauccuguacuccaacggcaacaacugcggcaagcaguuccugcaccucuuccugguggaggggcgcccgagcgugaaguacggcugcgggaacucccagaacauccugaccgucagcgccaacuacuccaucaacacgaacgccuucacccccaucaccauccgguacaccacgcccgugggcagccccgggguggucugcaugaucgagaugaccgccgacggcaagccgcccgugcagaagaaggacaccgagaucucccacgcgagccaggccuacuucgaguccauguuccucggccacauccccgccaacgugcagauccacaagaaggccgggccggucuacggcuuccgcgggugcauccuggaccugcaggugaacaacaaggaguucuucaucaucgacgaggcccggcacggcaagaacaucgagaacugccacgugcccuggugcgcgcaccaccucugccgcaacaacggcaccugcaucagcgacaacgagaaccuguucugcgagugcccccggcuguacuccgggaagcucugccaguucgccagcugcgagaacaaccccugcggcaacggggccacgugcgucccgaaguccggcaccgacaucgugugccugugccccuacgggcgcagcggcccccugugcaccgacgccaucaacaucacccagccccgguucuccggcacggacgccuucggguacaccagcuuccucgcguacucccgcaucagcgacaucuccuuccacuacgaguuccaccugaaguuccagcuggccaacaaccacagcgcccuccagaacaaccugaucuucuucaccggccagaaggggcacggccugaacggggacgacuuccucgccgugggccugcugaacggcagcgucguguacuccuacaaccucgggagcggcaucgcguccauccggagcgagccgcugaaccugucccucggggugcacaccguccaccugggcaaguucuuccaggagggguggcugaagguggacgaccacaagaacaagagcaucaucgcccccggccgccucgugggccugaacgucuucucccaguucuacguggggggcuacagcgaguacacgcccgaccugcuccccaacggggccgacuucaagaacggcuuccaggggugcaucuucacccugcaggugcggaccgagaaggacggccacuuccgcggccuggggaacccggagggccaccccaacgccgggcgguccgucggccagugccacgccagccccugcucccucaugaagugcggcaacgggggcaccugcaucgagagcgggacguccguguacugcaacugcaccaccggcuggaaggggagcuucugcaccgagaccguguccacgugcgaccccgagcacgacccgccccaccacugcagccgcggcgcgaccugcaucucccugccccacggcuacaccugcuucugcccccuggggaccacgggcaucuacugcgagcaggcccucagcaucuccgacccgagcuuccggagcaacgagcuguccuggaugagcuucgccuccuuccacguccgcaagaagacccacauccagcugcaguuccagccccucgccgccgacgggauccuguucuacgcggcccagcaccugaaggcccagagcggcgacuuccucugcaucucccuggugaacagcuccgugcagcugcgguacaaccucggggaccgcaccaucauccuggagacccugcagaaggucacgaucaacggcagcaccuggcacaucaucaaggccggccgggugggggccgagggcuaccucgaccuggacgggaucaacgucaccgagaaggcguccaccaagaugagcucccuggacacgaacaccgacuucuacaucggcggggugagcucccucaaccuggugaaccccauggccaucgagaacgagcccgucggcuuccagggcugcauccgccaggugaucaucaacaaccaggagcugcagcucaccgaguucggggccaagggcgggagcaacgugggcgacugcgacggcaccgccugcggguacaacacgugccgcaacggcggggagugcaccgucaacggcaccaccuucuccugccggugccugccggacugggcggggaacacgugcaaccagagcguguccugccugaacaaccucugccugcaccagagccugugcauccccgaccaguccuucagcuacagcugccucugcacccugggcugggugggccgcuacugcgagaacaagaccuccuucagcaccgccaaguucauggggaacuccuacaucaaguacaucgaccccaacuaccggaugcgcaaccugcaguucacgaccaucagccucaacuucuccaccaccaagacggagggccugaucgucuggauggggaucgcccagaacgaggagaacgacuuccuggccaucggccuccacaaccagacccugaagaucgccgugaaccugggggagcggaucagcgugccgauguccuacaacaacggcaccuucugcugcaacaaguggcaccacgucguggugauccagaaccagacccucaucaaggcguacaucaacaacagccugauccuguccgaggacaucgacccccacaagaacuucgucgcccugaacuacgacggcaucugcuaccucgggggcuucgaguacgggcgcaaggugaacaucgugacgcaggagaucuucaagaccaacuucgucggcaagaucaaggacgugguguucuuccaggagcccaagaacaucgagcugaucaagcuggagggguacaacgucuacgacggcgacgagcagaacgaggugaccuga

SEQ ID NO: 29855 - RNA, 2244 nt, Artificial Sequence
  derived and/or modified sequence opt1 from EZH1__Homo_sapiens__NP_001982
auggagauccccaacccgcccaccagcaagugcaucaccuacuggaagcgcaaggugaaguccgaguacaugcggcugcgccagcucaagcggcugcaggccaacaugggcgccaaggcgcuguacgucgccaacuucgccaaggugcaggagaagacgcagauccucaacgaggaguggaagaagcugcgcgugcagcccguccagagcaugaagcccguguccgggcacccguuccugaagaagugcaccaucgagagcaucuuccccggcuucgccucccagcacaugcucaugcggagccugaacaccguggcccugguccccaucauguacuccuggagcccccuccagcagaacuucaugguggaggacgagaccgugcugugcaacaucccguacaugggggacgaggucaaggaggaggacgagacguucaucgaggagcugaucaacaacuacgacggcaaggugcacggggaggaggagaugauccccggcuccgugcucaucagcgacgcggucuuccuggagcugguggacgcccucaaccaguacuccgacgaggaggaggagggccacaacgacaccagcgacgggaagcaggacgacuccaaggaggaccugcccgugacccgcaagcggaagcgccacgccaucgagggcaacaagaaguccagcaagaagcaguuccccaacgacaugaucuucagcgccaucgcguccauguucccggagaacgggguccccgacgacaugaaggagcgguaccgcgagcugaccgagaugagcgaccccaacgcccugcccccgcagugcacgcccaacaucgacggccccaacgccaaguccgugcagcgggagcagagccugcacagcuuccacacccuguucugccgccggugcuucaaguacgacugcuuccuccaccccuuccacgccaccccgaacguguacaagcgcaagaacaaggagaucaagaucgagcccgagcccugcgggaccgacugcuuccugcugcucgagggcgccaaggaguacgcgaugcugcacaacccccgguccaagugcagcggccgccggcgccggcgccaccacaucgucuccgccagcugcuccaacgccagcgccuccgccguggcggagacgaaggagggggacagcgaccgggacaccggcaacgacugggccuccagcuccagcgaggccaacucccgcugccagaccccgaccaagcagaaggccagccccgccccgccccagcugugcguggucgaggcgcccuccgagcccguggaguggacgggggccgaggagagccucuuccgcguguuccacggcaccuacuucaacaacuucugcuccaucgcccggcugcugggcaccaagaccugcaagcaggucuuccaguucgccgugaaggagagccucauccugaagcugcccacggacgagcucaugaacccgucccagaagaagaagcgcaagcaccggcugugggccgcgcacugccgcaagauccagcugaagaaggacaacagcagcacccaggucuacaacuaccagcccugcgaccaccccgaccggcccugcgacuccacgugcccgugcaucaugacccagaacuucugcgagaaguucugccagugcaaccccgacugccagaaccgcuuccccgggugccggugcaagacccagugcaacaccaagcagugccccugcuaccucgccgugcgcgagugcgacccggaccugugccugaccugcggcgccagcgagcacugggacugcaagguggucuccugcaagaacugcagcauccagcgggggcucaagaagcaccuccugcucgcccccuccgacguggcgggcugggggaccuucaucaaggagagcgugcagaagaacgaguucaucuccgaguacugcggcgagcugaucagccaggacgaggccgaccgccggggcaaggucuacgacaaguacauguccagcuuccuguucaaccucaacaacgacuucgugguggacgccacgcgcaaggggaacaagauccgguucgccaaccacuccgucaaccccaacugcuacgccaagguggugauggucaacggcgaccaccgcaucgggaucuucgcgaagcgggccauccaggccggcgaggagcuguucuucgacuaccgcuacagccaggccgacgcccugaaguacguggggaucgagcgggagaccgacgugcucuga

SEQ ID NO: 29856 - RNA, 2265 nt, Artificial Sequence
  derived and/or modified sequence opt1 from EZH2__Homo_sapiens__XP_005250019
augaucuacuucauccgcaucaucaugggccagaccgggaagaaguccgagaagggccccgugugcuggcggaagcgcgucaagagcgaguacaugcggcugcgccagcucaagcgguuccgccgggccgacgaggucaagagcauguucuccagcaaccgccagaagauccuggagcggaccgagauccugaaccaggaguggaagcagcgccggauccagccggugcacauccucacguccgugagcucccugcgcgggacccgggagugcagcgugaccuccgaccuggacuuccccacccaggugaucccccucaagacgcugaacgccgucgcgagcgugcccaucauguacuccuggagcccgcugcagcagaacuucaugguggaggacgagaccguccuccacaacauccccuacaugggcgacgaggugcuggaccaggacgggaccuucaucgaggagcugaucaagaacuacgacggcaaggugcacggcgaccgcgagugcggguucaucaacgacgagaucuucgucgagcucgugaacgcccugggccaguacaacgacgacgacgacgacgacgacggggacgaccccgaggagcgggaggagaagcagaaggaccuggaggaccaccgcgacgacaaggagucccggcccccgcgcaaguuccccagcgacaagaucuucgaggccaucuccagcauguuccccgacaagggcaccgccgaggagcucaaggagaaguacaaggagcugacggagcagcagcugcccggggcccucccgcccgagugcacccccaacaucgacggccccaacgcgaaguccgugcagcgggagcagagccugcacuccuuccacacccuguucugccgccggugcuucaaguacgacugcuuccuccacccguuccacgccacccccaacacguacaagcgcaagaacaccgagaccgcccuggacaacaagcccugcggcccccagugcuaccagcaccuggagggggccaaggaguucgcggccgcccucaccgccgagcgcaucaagacgccgcccaagcggcccggcgggcgccggcgcggccggcugcccaacaacagcagccgcccguccacccccaccaucaacguccuggagagcaaggacaccgacuccgaccgggaggccggcacggagaccgggggcgagaacaacgacaaggaggaggaggagaagaaggacgagaccagcuccagcuccgaggcgaacagccgcugccagacccccaucaagaugaagcccaacaucgagccgcccgagaacguggagugguccggggccgaggccagcauguuccgggugcucaucggcacguacuacgacaacuucugcgccaucgcccgccugaucgggaccaagaccugccggcaggucuacgaguuccgcgugaaggaguccagcaucaucgcgcccgccccggccgaggacguggacaccccgccccggaagaagaagcgcaagcaccggcugugggccgcccacugccgcaagauccagcucaagaaggacggcuccagcaaccacgucuacaacuaccagcccugcgaccacccccggcagcccugcgacuccagcugccccugcgugaucgcgcagaacuucugcgagaaguucugccagugcuccagcgagugccagaaccgcuuccccggcugccggugcaaggcccagugcaacacgaagcagugcccgugcuaccuggccgugcgcgagugcgaccccgaccugugccugaccugcggggccgccgaccacugggacuccaagaacgucagcugcaagaacugcagcauccagcgcggcuccaagaagcaccuccugcucgcgcccagcgacguggccggguggggcaucuucaucaaggaccccguccagaagaacgaguucaucuccgaguacugcggggagaucaucagccaggacgaggccgaccggcgcggcaagguguacgacaaguacaugugcuccuuccuguucaaccugaacaacgacuucguggucgacgccacccggaagggcaacaagauccgcuucgcgaaccacagcgugaacccgaacugcuacgccaaggugaugauggucaacggggaccaccggaucggcaucuucgccaagcgcgccauccagaccggggaggagcuguucuucgacuaccgguacucccaggccgacgcgcucaaguacgugggcaucgagcgcgagauggagauccccuga

SEQ ID NO: 29857 - RNA, 1761 nt, Artificial Sequence
  derived and/or modified sequence opt1 from EZR__Homo_sapiens__NP_001104547
augcccaagcccaucaacgugcgcgucaccaccauggacgccgagcuggaguucgccauccagcccaacacgaccggcaagcagcuguucgaccagguggugaagaccaucgggcugcgggaggucugguacuucggccugcacuacguggacaacaagggguuccccaccuggcucaagcuggacaagaaggugagcgcgcaggagguccgcaaggagaacccccugcaguucaaguuccgggccaaguucuaccccgaggacguggccgaggagcucauccaggacaucacgcagaagcuguucuuccuccaggugaaggagggcauccucuccgacgagaucuacugcccgcccgagaccgccguccugcuggggagcuacgccgugcaggcgaaguucggcgacuacaacaaggaggugcacaaguccggcuaccucagcuccgagcgccugaucccccagcgggucauggaccagcacaagcugacccgcgaccagugggaggaccggauccagguguggcacgccgagcaccgcgggaugcucaaggacaacgccaugcuggaguaccugaagaucgcccaggaccucgagauguacggcaucaacuacuucgagaucaagaacaagaaggggaccgaccuguggcugggcguggacgcgcucgggcugaacaucuacgagaaggacgacaagcugacgcccaagaucggcuuccccuggagcgagauccggaacaucuccuucaacgacaagaaguucgucaucaagcccaucgacaagaaggcccccgacuucguguucuacgccccgcgccuccggaucaacaagcgcauccugcagcugugcaugggcaaccacgagcucuacaugcggcgccggaagcccgacaccaucgaggugcagcagaugaaggcccaggcccgcgaggagaagcaccagaagcagcuggagcggcagcagcuggagaccgagaagaagcgccgggagaccgucgagcgcgagaaggagcagaugaugcgggagaaggaggagcucaugcugcgccugcaggacuacgaggagaagacgaagaaggcggagcgcgagcucagcgagcagauccagcgggcccugcagcuggaggaggagcgcaagcgggcccaggaggaggccgagcgccucgaggccgaccggauggcggcccugcgcgccaaggaggagcuggagcggcaggccguggaccagaucaagucccaggagcagcucgccgcggagcuggccgaguacaccgccaagaucgcccugcucgaggaggcccgccggcgcaaggaggacgagguggaggaguggcagcaccgggcgaaggaggcccaggacgaccuggucaagaccaaggaggagcugcaccucgugaugaccgccccgccgcccccgcccccgcccguguacgagcccgucagcuaccacgugcaggagucccugcaggacgagggggccgagcccacgggcuacagcgcggagcuguccagcgaggggauccgcgacgaccggaacgaggagaagcgcaucaccgaggccgagaagaacgagcggguccagcgccagcuccugacccuguccagcgagcugucccaggcccgggacgagaacaagcgcacccacaacgacaucauccacaacgagaacaugcggcagggccgcgacaaguacaagacgcuccgccagauccggcagggcaacaccaagcagcgcaucgacgaguucgaggcccuguga

SEQ ID NO: 29858 - RNA, 1467 nt, Artificial Sequence
  derived and/or modified sequence opt1 from F10__Homo_sapiens__NP_000495
augggccgcccccugcaccucgugcugcuguccgccucccucgccgggcugcugcuccugggcgagagccuguucauccggcgcgagcaggcgaacaacauccucgcccgggucacccgcgccaacuccuuccuggaggagaugaagaaggggcaccuggagcgggagugcauggaggagaccugcagcuacgaggaggcccgcgagguguucgaggacuccgacaagacgaacgaguucuggaacaaguacaaggacggcgaccagugcgagaccagcccgugccagaaccaggggaagugcaaggacggccucggcgaguacacgugcacgugccuggagggguucgagggcaagaacugcgagcuguucacccggaagcucugcucccuggacaacggggacugcgaccaguucugccacgaggagcagaacagcguggucugcuccugcgcccgcggcuacacccuggcggacaacgggaaggccugcauccccaccggccccuaccccugcggcaagcagacccucgagcggcgcaagcggagcguggcccaggccaccuccagcuccggggaggcgccggacagcaucaccuggaagcccuacgacgccgccgaccuggaccccaccgagaaccccuucgaccugcucgacuucaaccagacccagccggagcgcggcgacaacaaccugacgcggaucgucgggggccaggagugcaaggacggcgagugccccuggcaggcccugcucaucaacgaggagaacgagggguucugcggcgggaccauccuguccgaguucuacauccugaccgccgcgcacugccucuaccaggccaagcgcuucaaggugcgggugggcgaccgcaacaccgagcaggaggagggcggggaggccgugcacgaggucgagguggugaucaagcacaaccgguucacgaaggagaccuacgacuucgacaucgccguccugcgccugaagacccccaucaccuuccggaugaacguggcccccgcgugccucccggagcgcgacugggccgagagcacgcugaugacccagaagaccggcaucguguccggguucggccggacccacgagaaggggcgccagagcacgcgccugaagaugcucgagguccccuacguggaccggaacuccugcaagcugagcagcuccuucaucaucacccagaacauguucugcgccggcuacgacaccaagcaggaggacgccugccagggggacagcggcggcccccacgugacccgcuucaaggacacguacuucgucaccgggaucguguccuggggcgaggggugcgcccggaagggcaaguacgggaucuacaccaaggugaccgcguuccugaaguggaucgaccgcagcaugaagacgcggggccuccccaaggccaagucccacgccccggaggucaucaccagcagcccccugaaguga

SEQ ID NO: 29859 - RNA, 1878 nt, Artificial Sequence
  derived and/or modified sequence opt1 from F11__Homo_sapiens__NP_000119
augaucuuccuguaccaggugguccacuucauccucuucaccagcguguccggcgagugcgugacccagcugcugaaggacacgugcuucgagggcggggacaucaccaccgucuucacccccagcgccaaguacugccagguggugugcacguaccacccgcgcugccuccuguucaccuucaccgccgagucccccagcgaggaccccacccggugguucacgugcguccugaaggacuccgugaccgagacccucccccgcgugaaccggaccgcggccaucagcggguacuccuucaagcagugcagccaccagaucuccgccugcaacaaggacaucuacgucgaccuggacaugaagggcaucaacuacaacagcuccguggccaagagcgcccaggagugccaggagcgcugcacggacgacgugcacugccacuucuucaccuacgcgacccggcaguucccgucccuggagcaccgcaacaucugccuccugaagcacacccagacggggacccccacccggaucaccaagcuggacaaggucgugagcggcuucucccucaagagcugcgcccuguccaaccuggccugcauccgcgacaucuuccccaacacgguguucgccgacagcaacaucgacuccgucauggcgcccgacgccuucgugugcggccggaucugcacccaccacccggggugccucuucuucaccuucuucagccaggaguggcccaaggagagccagcgcaaccugugccugcucaagaccuccgagagcggccugcccuccacgcggaucaagaaguccaaggcccugagcggguucagccuccaguccugccgccacagcauccccguguucugccacuccagcuucuaccacgacaccgacuuccugggcgaggagcuggacaucgucgccgccaagucccacgaggcgugccagaagcucugcaccaacgccgugcggugccaguucuucaccuacacgccggcccaggccagcugcaacgaggggaagggcaagugcuaccugaagcuguccagcaacggcucccccaccaagauccuccacgggcgcggcgggaucagcggcuacacccugcggcugugcaagauggacaacgagugcaccacgaagaucaagccccgcaucgugggcgggaccgccuccguccggggcgaguggcccuggcaggucacccuccacaccacgagcccgacccagcgccaccugugcgggggcuccaucaucgggaaccaguggauccugaccgcggcccacugcuucuacggcguggagagccccaagauccuccggguguacagcggcauccugaaccaguccgagaucaaggaggacaccagcuucuucggggugcaggagaucaucauccacgaccaguacaagauggccgaguccggcuacgacaucgcccugcucaagcuggagaccacggucaacuacaccgacagccagcgccccaucugccugcccuccaagggggaccggaacgugaucuacaccgacugcugggugaccggcuggggguaccgcaagcuccgcgacaagauccagaacacgcugcagaaggccaagaucccgcuggucaccaacgaggagugccagaagcgguaccgcggccacaagaucacccacaagaugaucugcgcgggcuaccgggagggcgggaaggacgccugcaagggggacagcggcgggccccucuccugcaagcacaacgagguguggcaccuggugggcaucaccagcuggggcgaggggugcgcccagcgcgagcggcccggcgucuacacgaacgugguggaguacgucgacuggauccuggagaagacccaggccguguga

SEQ ID NO: 29860 - RNA, 900 nt, Artificial Sequence
  derived and/or modified sequence opt1 from F11R__Homo_sapiens__NP_058642
augggcaccaaggcccagguggagcgcaagcugcucugccuguucauccuggccauccuccugugcagccuggcgcucggguccgucaccgugcacagcuccgagcccgaggugcggaucccggagaacaaccccgucaagcugagcugcgccuacuccggcuucagcagcccccgcguggaguggaaguucgaccagggggacacgacccggcuggugugcuacaacaacaagaucaccgccuccuacgaggaccgcgucaccuuccuccccacgggcaucaccuucaaguccgugacccgggaggacaccgggacguacacgugcauggugagcgaggagggcggcaacuccuacggggaggucaaggugaagcugaucgugcuggucccgcccagcaagcccaccgugaacauccccuccagcgccaccaucggcaaccgcgccgugcugaccugcuccgagcaggacgggagcccgcccuccgaguacaccugguucaaggacggcaucgucaugcccaccaaccccaagagcacccgggcguucuccaacagcagcuacgugcucaacccgacgaccggggagcugguguucgacccccucuccgccagcgacaccggcgaguacuccugcgaggcccgcaacggcuacgggacccccaugacgagcaacgccguccggauggaggcgguggagcgcaacgugggcgucaucguggccgccgugcuggucacccugauccuccuggggauccugguguucggcaucugguucgccuacucccggggccacuucgaccgcaccaagaaggggaccagcuccaagaaggucaucuacagccagcccuccgcccggagcgagggcgaguucaagcagacguccagcuuccucguguga

SEQ ID NO: 29861 - RNA, 1848 nt, Artificial Sequence
  derived and/or modified sequence opt1 from F12__Homo_sapiens__NP_000496
augcgcgcccugcuccugcugggcuuccuccuggugagccuggaguccacccucagcaucccgcccugggaggcccccaaggagcacaaguacaaggcggaggagcacaccgucgugcugacggugaccggggagcccugccacuuccccuuccaguaccaccggcagcuguaccacaagugcacccacaagggccgcccggggccccagcccuggugcgccaccacgcccaacuucgaccaggaccagcgguggggcuacugccucgagccgaagaaggucaaggaccacugcuccaagcacagccccugccagaagggcgggaccugcgugaacaugcccuccggcccccacugccugugcccgcagcaccugaccgggaaccacugccagaaggagaagugcuucgagccccagcuccugcgcuucuuccacaagaacgagaucugguaccggaccgagcaggccgccguggcccgcugccagugcaagggccccgacgcgcacugccagcggcuggccagccaggccugccgcacgaaccccugccuccacgggggccggugccuggaggucgaggggcaccgccugugccacugcccggugggcuacaccggcgccuucugcgacguggacaccaaggcguccugcuacgacgggcggggccucagcuaccgcgggcuggcccggaccacgcuguccggcgcccccugccagcccugggccagcgaggccaccuaccgcaacgucaccgcggagcaggcccggaacuggggccucgggggccacgccuucugccgcaaccccgacaacgacauccggccguggugcuucgugcugaaccgcgaccggcuguccugggaguacugcgaccucgcccagugccagacccccacgcaggccgcgccgcccacccccgugagcccccgccugcacgucccccugaugcccgcccagccggccccgcccaagccccagcccaccacccggacgccgccccagucccagacccccggggcccuccccgccaagcgcgagcagccgcccagccugacccgcaacggcccccuguccugcgggcagcggcuccgcaagagccuguccagcaugacccggguggugggcggccuggucgcgcuccgcggggcccaccccuacaucgccgcccuguacuggggccacuccuucugcgccgggagccugaucgcgcccugcugggugcucacggccgcccacugccugcaggaccggcccgccccggaggaccugaccgugguccucggccaggagcgccggaaccacagcugcgagcccugccagacccuggcggugcgcuccuaccggcugcacgaggccuucagccccguguccuaccagcacgaccucgcccugcugcgccuccaggaggacgccgacgggagcugcgcccugcugucccccuacguccagccggugugccuccccagcggcgcggcccggcccuccgagaccacgcugugccagguggccggcugggggcaccaguucgagggcgccgaggaguacgccagcuuccugcaggaggcgcagguccccuuccugucccucgagcgcugcagcgccccggacgugcacggguccagcauccugcccggcaugcugugcgccggguuccucgagggcggcaccgacgccugccagggggacuccggcgggccccuggucugcgaggaccaggccgcggagcggcgccugacccuccagggcaucaucagcuggggcuccgggugcggcgaccggaacaagcccgggguguacaccgacguggccuacuaccuggccuggauccgcgagcacacggucagcuga

SEQ ID NO: 29862 - RNA, 2199 nt, Artificial Sequence
  derived and/or modified sequence opt1 from F13A1__Homo_sapiens__NP_000120
augagcgagaccucccgcaccgccuucggcgggcggcgcgccgugcccccgaacaacagcaacgcggccgaggacgaccugcccacggucgagcuccagggcguggugccccgcggggucaaccugcaggaguuccugaacgugaccuccgugcaccucuucaaggagcggugggacaccaacaaggucgaccaccacaccgacaaguacgagaacaacaagcugaucgugcggcgcggccagagcuucuacgugcagaucgacuucucccggcccuacgacccgcgccgggaccuguuccgcgucgaguacgugaucgggcgguacccccaggagaacaagggcacguacauccccgugcccaucgucagcgagcuccaguccggcaaguggggcgccaagaucgugaugcgcgaggaccggagcgugcgccuguccauccagagcuccccgaagugcaucgucgggaaguuccggauguacguggccguguggacccccuacgggguccugcgcaccagccggaaccccgagaccgacacguacauccucuucaaccccuggugcgaggacgacgccguguaccuggacaacgagaaggagcgcgaggaguacgugcugaacgacaucggcgucaucuucuacggggaggugaacgacaucaagacccgguccuggagcuacggccaguucgaggacggcauccucgacacgugccuguacgugauggaccgcgcgcagauggaccuguccgggcggggcaacccgaucaaggucagccgcgugggguccgccauggucaacgccaaggacgacgagggcgugcucgugggcagcugggacaacaucuacgccuacggggucccgcccuccgcguggaccggcagcguggacauccugcuggaguaccgcagcuccgagaaccccgugcgguacgggcagugcugggucuucgccggcguguucaacacguuccuccgcugccuggggauccccgcccggaucgugaccaacuacuucagcgcccacgacaacgacgccaaccugcagauggacaucuuccucgaggaggacggcaacgucaacuccaagcugaccaaggacagcguguggaacuaccacugcuggaacgaggcguggaugacccgccccgaccugcccgugggcuucgggggcuggcaggccgucgacuccacgccccaggagaacagcgacgggauguaccggugcggcccggccuccgugcaggccaucaagcacgggcacgugugcuuccaguucgacgcccccuucgucuucgcggaggugaacagcgaccucaucuacaucaccgccaagaaggacggcacccacguggucgagaacguggacgccacccacaucggcaagcugaucgugacgaagcagaucgggggcgacgggaugauggacaucaccgacaccuacaaguuccaggagggccaggaggaggagcgccuggcccucgagaccgcccugauguacggggcgaagaagccccugaacacggagggcgucaugaagucccggagcaacguggacauggacuucgagguggagaacgccguccucggcaaggacuucaagcuguccaucaccuuccgcaacaacagccacaaccgguacaccaucaccgccuaccuguccgccaacaucacguucuacaccggggugcccaaggccgaguucaagaaggagaccuucgacgugacccucgagccgcugagcuucaagaaggaggcgguccugauccaggccggcgaguacauggggcagcuccuggagcaggccucccugcacuucuucgugacggcccgcaucaacgagacccgggacgugcucgcgaagcagaaguccaccguccugaccauccccgagaucaucaucaaggugcgcggcacccagguggucggcagcgacaugaccgugaccguggaguucaccaacccccugaaggagacccuccggaacgucugggugcaccuggacgggcccggcgugacgcgcccgaugaagaagauguuccgggagauccgccccaacagcaccguccagugggaggaggugugccggcccuggguguccgggcaccgcaagcugaucgccagcaugagcuccgacagccuccggcacgucuacggcgagcuggacgugcagauccagcgccgcccguccauguga

SEQ ID NO: 29863 - RNA, 1986 nt, Artificial Sequence
  derived and/or modified sequence opt1 from F13B__Homo_sapiens__NP_001985
augcgccugaagaaccucaccuucaucaucauccugaucaucagcggcgagcuguacgccgaggagaagcccugcggguucccccacguggagaacggccggaucgcccaguacuacuacaccuucaaguccuucuacuuccccaugagcaucgacaagaagcucuccuucuucugccuggcgggguacacgaccgagagcggccgccaggaggagcagacgaccugcaccaccgagggguggucccccgagccccggugcuucaagaagugcaccaagccggaccugagcaacggcuacaucuccgacgucaagcuccuguacaagauccaggagaacaugcgcuacggcugcgccagcggguacaagaccacgggcgggaaggacgaggagguggugcagugccuguccgacggcuggagcucccagccgaccugccggaaggagcacgagaccugccucgcccccgagcuguacaacgggaacuacagcaccacgcagaagaccuucaaggucaaggacaaggugcaguacgagugcgccaccggcuacuacaccgccggcgggaagaagacggaggagguggagugccugaccuacggcuggucccucacccccaagugcaccaagcugaagugcagcucccugcgccucaucgagaacggguacuuccaccccgucaagcagacguacgaggagggcgacguggugcaguucuucugccacgagaacuacuaccugagcggcuccgaccugauccagugcuacaacuucgggugguaccccgagagccccgucugcgagggccggcgcaaccggugcccgcccccgccccuccccaucaacuccaagauccagacccacagcaccaccuaccgccacggggagaucgugcacaucgagugcgagcugaacuucgagauccacggcagcgcggagauccggugcgaggacgggaaguggacggagccgcccaagugcaucgagggccaggagaagguggccugcgaggagccgcccuucaucgagaacggcgccgccaaccugcacuccaagaucuacuacaacggggacaaggucaccuacgcgugcaagagcggcuaccuccugcacggguccaacgagaucacgugcaaccgcggcaaguggacccugccgcccgagugcguggagaacaacgagaacugcaagcacccgcccguggucaugaacggggccguggccgacggcauccucgccagcuacgccaccggcuccagcguggaguaccggugcaacgaguacuaccugcugcgcggguccaagaucagccggugcgagcagggcaagugguccagcccgcccgucugccucgagcccugcaccgugaacguggacuacaugaaccgcaacaacaucgagaugaaguggaaguacgaggggaagguccugcacggcgaccugaucgacuucgugugcaagcagggguacgaccucagcccccugacgccccuguccgagcucuccgugcagugcaaccggggcgaggucaaguacccccugugcacccgcaaggagagcaagggcaugugcaccagcccgccccugaucaagcacggggugaucaucuccuccaccgucgacaccuacgagaacggcagcuccguggaguaccggugcuucgaccaccacuuccucgaggggagccgcgaggcguacugccuggacggcauguggaccacgccgccccugugccucgagcccugcacccugagcuucaccgagauggagaagaacaaccugcuccugaagugggacuucgacaaccggccccacauccugcacggcgaguacaucgaguucaucugccgcggggacaccuaccccgccgagcucuacaucaccggcuccauccugcgcaugcagugcgaccgggggcagcugaaguacccccgcugcaucccccggcagagcacgcucuccuaccaggagccccugcgcaccuga

SEQ ID NO: 29864 - RNA, 1869 nt, Artificial Sequence
  derived and/or modified sequence opt1 from F2__Homo_sapiens__NP_000497
auggcccacgugcgcggccugcagcuccccgggugccuggcccuggcggcccucugcagccugguccacucccagcacguguuccuggccccgcagcaggcccggagccuccugcagcgcgugcggcgcgccaacaccuuccuggaggagguccggaagggcaaccucgagcgcgagugcguggaggagaccugcuccuacgaggaggcguucgaggcccuggagagcuccacggccaccgacguguucugggccaaguacaccgcgugcgagaccgcccggacgccccgcgacaagcuggccgccugccucgaggggaacugcgccgagggccuggggaccaacuaccggggccacgucaacaucacccgcagcggcaucgagugccagcuguggcggucccgcuacccccacaagcccgagaucaacagcaccacgcacccgggggcggaccuccaggagaacuucugccggaaccccgacuccagcaccaccggccccuggugcuacaccacggaccccaccgugcgccggcaggagugcuccaucccggugugcgggcaggaccaggucaccguggccaugacgccccgcagcgagggcuccagcgugaaccuguccccgccccuggagcagugcguccccgaccgggggcagcaguaccagggccgccucgccgugaccacccacggccugcccugccuggccugggccagcgcgcaggccaaggcccucuccaagcaccaggacuucaacagcgccgugcagcuggucgagaacuucugccggaaccccgacggggacgaggagggcguguggugcuacguggccgggaagcccggcgacuucggcuacugcgaccugaacuacugcgaggaggcggucgaggaggagaccggggacggccucgacgaggacuccgaccgcgccaucgaggggcggaccgccacgagcgaguaccagaccuucuucaacccgcgcaccuucggcagcggggaggccgacugcggccugcgcccccuguucgagaagaagucccucgaggacaagaccgagcgggagcugcuggagagcuacaucgacggccgcaucguggagggguccgacgccgagaucggcaugagccccuggcaggucaugcuguuccgcaagagcccccaggagcugcugugcggggcgucccucaucuccgaccggugggugcugacggccgcccacugccugcucuacccgcccugggacaagaacuucaccgagaacgaccugcuggugcggaucggcaagcacagccgcacccgguacgagcgcaacaucgagaagaucuccaugcucgagaagaucuacauccacccccgguacaacuggcgcgagaaccuggaccgggacaucgcccugaugaagcucaagaagcccguggcguucagcgacuacauccacccggucugccugcccgaccgcgagaccgccgccucccugcuccaggccggguacaagggccgggugacgggcugggggaaccugaaggagaccuggaccgccaacgucggcaaggggcagcccagcgugcuccagguggucaaccuccccaucguggagcgcccggugugcaaggacuccacccggauccgcaucacggacaacauguucugcgcgggcuacaagcccgacgaggggaagcggggcgacgccugcgagggcgacagcgggggccccuucgucaugaaguccccguucaacaaccgcugguaccagauggggaucgugagcuggggcgagggcugcgaccgggacgggaaguacggcuucuacacccacguguuccgccugaagaaguggauccagaaggucaucgaccaguucggggaguga

SEQ ID NO: 29865 - RNA, 1278 nt, Artificial Sequence
  derived and/or modified sequence opt1 from F2R__Homo_sapiens__NP_001983
augggcccccgccggcugcuccugguggccgccugcuucagccugugcgggccgcuccuguccgcgcgcacccgggcccgccggcccgagagcaaggccaccaacgccacgcuggacccccgcuccuuccuccugcggaaccccaacgacaaguacgagccguucugggaggacgaggagaagaacgagagcggccugaccgaguaccgccucgucuccaucaacaagagcagcccccugcagaagcagcugcccgccuucaucuccgaggacgcguccggguaccucaccagcuccuggcugacccuguucgugcccagcguguacacgggcgucuucguggugucccucccgcugaacaucauggccaucgucguguucauccugaagaugaaggugaagaagcccgccgucguguacaugcuccaccuggccaccgcggacgugcuguucgucagcgugcuccccuucaagaucuccuacuacuucagcggguccgacuggcaguucggcagcgagcugugccgguucgugaccgccgccuucuacugcaacauguacgccuccauccugcucaugaccgucaucagcaucgaccgcuuccuggccgugguguaccccaugcagagccuguccuggcggacgcucggccgcgcgagcuucacgugccuggccaucugggcccuggccaucgccggggucgugccgcuccugcugaaggagcagaccauccaggugcccggccucaacaucacgaccugccacgacguccugaacgagacccugcucgagggguacuacgcguacuacuucuccgccuucagcgccguguucuucuucgugccccugaucaucuccaccgucugcuacgugagcaucauccggugccuguccagcuccgccgucgccaaccgcagcaagaagucccgggcccucuuccugagcgcggccguguucugcaucuucaucaucugcuucggccccaccaacgugcugcucaucgcccacuacuccuuccugagccacaccuccaccaccgaggccgcguacuucgccuaccugcucugcgucugcgugagcuccaucagcugcugcaucgacccgcugaucuacuacuacgccuccagcgagugccagcgcuacguguacagcauccugugcugcaaggaguccagcgaccccuccagcuacaacuccagcgggcagcucauggccuccaagauggacacgugcagcuccaaccugaacaacagcaucuacaagaagcugcugaccuga

SEQ ID NO: 29866 - RNA, 1194 nt, Artificial Sequence
  derived and/or modified sequence opt1 from F2RL1__Homo_sapiens__NP_005233
augcggagccccuccgccgccuggcugcucggcgcggccauccugcuggccgccagccucuccugcagcgggaccauccagggcaccaaccgguccagcaaggggcgcucccugaucggcaagguggacgggacgagccacgucaccggcaagggcgugaccguggagaccgucuucuccguggacgaguucagcgccuccgugcugacggggaagcucaccaccgucuuccugccgaucguguacaccaucguguucgucgugggccugcccagcaacgggauggcgcucuggguguuccuguuccggacgaagaagaagcaccccgccgucaucuacauggccaaccuggcccucgcggaccugcuguccgugaucugguucccccucaagaucgccuaccacauccacggcaacaacuggaucuacggggaggcccugugcaacgugcugaucggcuucuucuacggcaacauguacugcagcauccucuucaugaccugccuguccguccagcgcuacugggugaucgugaacccgauggggcacagccggaagaaggccaacaucgccaucggcaucucccuggcgaucuggcuccugauccugcucgucaccaucccccuguacguggugaagcagaccaucuucauccccgcccugaacaucacgaccugccacgacguccuccccgagcagcugcuggugggggacauguucaacuacuuccucagccuggccaucggcguguuccuguucccggccuuccucaccgccuccgcguacguccugaugauccgcaugcugcggagcagcgccauggacgagaacuccgagaagaagcgcaagcgggccaucaagcucaucgugaccguccuggccauguaccugaucugcuucacgcccagcaaccuccugcugguggugcacuacuuccucaucaagucccagggccagagccacgucuacgcccuguacaucguggcgcugugccucuccacccugaacagcugcaucgaccccuucguguacuacuucgucucccacgacuuccgcgaccacgccaagaacgcccugcucugccggagcgugcgcaccgugaagcagaugcaggucucccugaccagcaagaagcacucccgcaagagcuccagcuacuccagcuccagcacgaccgugaagaccuccuacuga

SEQ ID NO: 29867 - RNA, 1059 nt, Artificial Sequence
  derived and/or modified sequence opt1 from F2RL2__Homo_sapiens__NP_001243495
auggagaacgacaccaacaaccuggccaagcccacccucccgaucaagacguuccgcggcgccccgcccaacagcuucgaggaguuccccuucuccgcgcuggagggguggaccggcgccaccaucaccgugaagaucaagugccccgaggagagcgccucccaccuccacgucaagaacgccacgaugggguaccucaccagcucccugagcaccaagcugauccccgccaucuaccuccugguguucguggucggcgugcccgcgaacgccgugacccuguggaugcuguucuuccggacgcgcuccaucugcaccaccgucuucuacaccaaccuggccaucgccgacuuccuguucugcgugacgcuccccuucaagaucgcguaccaccugaacgggaacaacuggguguucggcgagguccugugccgggccaccaccgugaucuucuacggcaacauguacugcagcauccuccugcuggccugcaucuccaucaaccgcuaccucgccaucgugcacccguucaccuaccgggggcugcccaagcacacguacgcccuggugaccugcggccucgucugggcgaccguguuccuguacaugcugcccuucuucauccucaagcaggaguacuaccugguccagcccgacaucaccacgugccacgacgugcacaacacgugcgagagcuccagcccguuccagcuguacuacuucaucucccucgccuucuucggguuccugauccccuucgugcugaucaucuacugcuacgccgccaucauccgcacccucaacgccuacgaccaccgguggcugugguacgucaaggcgagccugcucauccuggugaucuucaccaucugcuucgcccccuccaacaucauccugaucauccaccacgccaacuacuacuacaacaacaccgacggccucuacuucaucuaccugaucgcccugugccucgggagccugaacuccugccuggaccccuuccucuacuuccugaugagcaagacccgcaaccacuccaccgccuaccugaccaaguga

SEQ ID NO: 29868 - RNA, 1158 nt, Artificial Sequence
  derived and/or modified sequence opt1 from F2RL3__Homo_sapiens__NP_003941
auguggggccgccugcuccuguggccccuggugcucggguucagccuguccggcgggacccagaccccgagcgucuacgacgaguccggcagcaccgggggcggcgacgacuccacccccagcauccugcccgcgccccggggguacccgggccaggugugcgccaacgacuccgacacccucgagcugcccgacagcucccgcgcccugcuccuggggugggugcccacccggcugguccccgcccucuacggccuggugcugguggucgggcucccggccaacggccuggcccugugggugcucgccacgcaggcgccccgccugcccagcaccaugcugcucaugaaccuggccgccgccgaccugcuccuggcgcuggcccugcccccgcggaucgccuaccaccuccgcggccagcgguggcccuucggggaggccgccugccgccuggcgaccgccgcccucuacggccacauguacggguccgugcugcugcucgccgccgucagccuggaccgguaccuggcgcucgugcacccccugcgcgcccgggcccugcgcggccggcgccucgcccugggccugugcauggccgcguggcucauggccgccgcccuggcccugccccucacccugcagcggcagacguuccgccuggcgcgguccgaccgcgugcucugccacgacgcccugccgcuggacgcccaggccagccacuggcagcccgcguucacgugccuggcccuccuggggugcuuccugccccuccuggccaugcugcucugcuacggcgccacccugcacacccuggccgcguccgggcggcgcuacggccacgcccuccggcugacggccgucgugcuggccagcgccguggcguucuucguccccuccaaccuccugcugcuccugcacuacagcgacccgucccccagcgccugggggaaccuguacggcgccuacgugcccagccucgcccuguccacccugaacagcugcguggaccccuucaucuacuacuacgucuccgccgaguuccgcgacaaggugcgcgcgggccucuuccagcggagcccgggggacaccguggccuccaaggccagcgccgagggcgggucccgcggcauggggacccacagcucccugcugcaguga

SEQ ID NO: 29869 - RNA, 6675 nt, Artificial Sequence
  derived and/or modified sequence opt1 from F5__Homo_sapiens__NP_000121
auguuccccgggugcccgcgccugugggugcucguggugcuggggaccagcuggguggggugggggucccaggggaccgaggccgcccagcugcggcaguucuacgucgcggcccaggggaucagcugguccuaccgccccgagcccacgaacagcucccucaaccugagcgugaccuccuucaagaagaucguguaccgggaguacgagcccuacuucaagaaggagaagccccagagcaccaucuccggccugcucggccccacccuguacgccgaggucggggacaucaucaaggugcacuucaagaacaaggccgacaagccccugagcauccacccccagggcauccgcuacuccaagcucagcgagggggccuccuaccuggaccacacguucccggcggagaagauggacgacgccguggcccccggccgggaguacaccuacgaguggagcaucuccgaggacagcgggcccacccacgacgacccgcccugccugacccacaucuacuacucccacgagaaccucaucgaggacuucaacagcggccugaucggcccccugcucaucugcaagaaggggacgcugaccgagggcgggacccagaagaccuucgacaagcagaucguccuccuguucgccguguucgacgaguccaagagcuggagccaguccagcucccugauguacacggugaacggcuacgucaacggcaccaugcccgacaucaccgugugcgcgcacgaccacaucagcuggcaccuccuggggauguccagcggccccgagcuguucuccauccacuucaacggccaggugcuggagcagaaccaccacaaggucagcgccaucacccucguguccgccacgagcaccaccgccaacaugaccgugggcccggaggggaaguggaucaucuccagccugacgcccaagcaccuccaggccggcaugcaggcguacaucgacaucaagaacugccccaagaagacccgcaaccucaagaagaucacccgggagcagcgccggcacaugaagcgcugggaguacuucaucgccgccgaggaggucaucugggacuacgcccccgugaucccggccaacauggacaagaaguaccggucccagcaccuggacaacuucagcaaccagaucggcaagcacuacaagaaggugauguacacccaguacgaggacgaguccuucacgaagcacaccgucaaccccaacaugaaggaggacgggauccugggccccaucauccgcgcccaggugcgggacacccucaagaucguguucaagaacauggccagccgccccuacuccaucuacccgcacggggucaccuucagccccuacgaggacgaggugaacuccagcuucacgagcggccggaacaacaccaugauccgcgccguccagcccggggagaccuacaccuacaaguggaacauccuggaguucgacgagcccacggagaacgacgcccagugccugacccggccguacuacuccgacguggacaucaugcgcgacaucgccagcggccucaucggccugcugcucaucugcaagucccggagccuggaccgccgggggauccagcgcgcggccgacaucgagcagcaggccguguucgccgucuucgacgagaacaaguccugguaccuggaggacaacaucaacaaguucugcgagaaccccgacgaggugaagcgcgacgaccccaaguucuacgagagcaacaucauguccaccaucaacggcuacgugccggagagcaucaccacgcucggguucugcuucgacgacaccguccaguggcacuucugcuccgugggcacccagaacgagauccugaccauccacuucaccgggcacagcuucaucuacggcaagcggcacgaggacacgcugacccucuuccccaugcgcggcgaguccgugaccgucaccauggacaacguggggacguggaugcugaccagcaugaacuccagcccccgguccaagaagcugcgccucaaguuccgggacgugaagugcauccccgacgacgacgaggacagcuacgagaucuucgagccgcccgaguccaccgucauggccacccgcaagaugcacgaccggcuggagcccgaggacgaggagagcgacgcggacuacgacuaccagaaccgccuggccgccgcccucggcauccggagcuuccgcaacuccagccugaaccaggaggaggaggaguucaaccugacggcgcuggcccucgagaacgggaccgaguucguguccagcaacaccgacaucaucgugggcuccaacuacagcucccccagcaacaucuccaaguucaccgucaacaaccuggccgagccgcagaaggcccccagccaccagcaggccacgaccgcgggcagcccccugcggcaccucaucgggaagaacagcgugcugaacuccagcaccgccgagcacuccagccccuacuccgaggacccgaucgaggacccccugcagcccgacgugaccggcauccgccuccugagccugggggccggcgaguucaagucccaggagcacgccaagcacaaggggcccaaggucgagcgggaccaggccgcgaagcaccgcuucagcuggaugaagcuccuggcccacaaggugggccggcaccugagccaggacacgggcuccccgagcgggaugcgccccugggaggaccuccccucccaggacaccggcagccccucccggaugcgcccguggaaggacccgcccagcgaccugcugcuccugaagcaguccaacagcuccaagauccugguggggcgguggcaccucgccagcgagaagggcuccuacgagaucauccaggacaccgacgaggacaccgccgucaacaacuggcugaucagcccccagaacgccucccgcgcguggggcgagagcacgccgcuggccaacaagcccggcaagcaguccggccaccccaaguucccgcgcgugcggcacaagagccuccaggugcgccaggacgggggcaagucccggcugaagaagucccaguuccugaucaagacccgcaagaagaagaaggagaagcacacccaccacgcgccccugagcccccggaccuuccacccccugcgcagcgaggccuacaacacguucagcgagcggcgccugaagcacucccucguccugcacaagagcaacgagaccucccugccgaccgaccucaaccagacccugcccagcauggacuucggguggaucgcgucccugcccgaccacaaccagaacagcuccaacgacacgggccaggccagcugcccgcccgggcucuaccagaccgugccgcccgaggagcacuaccagaccuuccccauccaggaccccgaccagaugcacuccaccagcgaccccucccaccggagcuccagccccgagcuguccgagaugcuggaguacgaccgcagccacaaguccuuccccacggacaucagccagauguccccgagcagcgagcacgagguguggcagaccgucaucucccccgaccucagccaggugacccugucccccgagcugagccagaccaaccucucccccgaccugagccacacgacccuguccccggagcucauccagcggaaccugagccccgcccugggccagaugcccaucucccccgaccucagccacaccacccuguccccggaccugagccacaccacgcucucccuggaccugagccagaccaaccucucccccgagcugagccagaccaaccugucccccgcccucggccagaugccccugagcccggaccugucccacaccacgcucagccuggacuucagccagaccaaccugucccccgagcucagccacaugacccugucccccgagcugagccagaccaaccucuccccggcccuggggcagaugcccaucagccccgaccugucccacacgacccucagccuggacuucucccagaccaaccugagccccgagcucucccagaccaaccugagcccggcgcugggccagaugccccucucccccgaccccagccacacgacccugucccuggaccucagccagaccaaccuguccccggagcugagccagaccaaccucucccccgaccugagcgagaugccccuguucgccgaccucagccagaucccccugacgccggaccuggaccagaugacccucucccccgaccugggggagaccgaccugagccccaacuucggccagaugucccucagccccgaccugucccaggugacccugagcccggacaucuccgacacgacccuccugcccgaccugagccagaucagcccgccgcccgaccucgaccagaucuucuaccccagcgaguccagccagucccugcugcugcaggaguucaacgagagcuuccccuaccccgaccucgggcagaugcccucccccagcucccccacccugaacgacaccuuccugagcaaggaguucaacccccucgucaucgugggccugagcaaggacggcacggacuacaucgagaucaucccgaaggaggaggugcaguccagcgaggacgacuacgccgagaucgacuacguccccuacgacgaccccuacaagaccgacgugcgcaccaacaucaacuccagccgggacccggacaacaucgccgccugguaccugcgcuccaacaacgggaaccggcgcaacuacuacaucgcggccgaggagaucagcugggacuacuccgaguucgugcagcgggagaccgacaucgaggacagcgacgacauccccgaggacacgaccuacaagaaggucguguuccgcaaguaccucgacuccaccuucaccaagcgggacccccgcggcgaguacgaggagcaccuggggauccugggccccaucauccgggccgagguggacgacgucauccaggugcgcuucaagaaccucgccagccgcccguacucccugcacgcccacggccugagcuacgagaaguccagcgaggggaagacguacgaggacgacucccccgagugguucaaggaggacaacgcggugcagcccaacagcuccuacaccuacgucuggcacgccaccgagcggagcggccccgaguccccggggagcgccugccgcgccugggcguacuacagcgccgugaaccccgagaaggacauccacuccggccucaucgggccccugcugaucugccagaagggcauccuccacaaggacagcaacaugcccauggacaugcgggaguucgugcugcuguucaugaccuucgacgagaagaaguccugguacuacgagaagaagucccgcuccagcuggcggcucacguccagcgagaugaagaagucccacgaguuccacgccaucaacggcaugaucuacagccugccggggcugaagauguacgagcaggaguggguccgccuccaccuccugaacaucggcgggucccaggacauccacguggugcacuuccacggccagacccuccuggagaacgggaacaagcagcaccagcugggcgucuggccccuccugcccggcagcuucaagacccuggagaugaaggccuccaagcccgggugguggcuccugaacaccgaggugggcgagaaccagcgggccgggaugcagaccccguuccugaucauggaccgcgacugccggaugcccaugggccucagcacggggaucaucuccgacagccagaucaaggcguccgaguuccugggcuacugggagccccgccuggcccggcucaacaacggcgggagcuacaacgccugguccguggagaagcuggccgccgaguucgcgagcaagcccuggauccaggucgacaugcagaaggaggugaucaucaccggcauccagacccagggggccaagcacuaccucaagagcugcuacaccacggaguucuacgucgccuacuccagcaaccagaucaacuggcagaucuucaagggcaacuccacccgcaacgugauguacuucaacggcaacagcgacgccuccaccaucaaggagaaccaguucgacccgcccaucguggcccgguacauccgcaucagccccacccgggcguacaaccgccccacgcugcggcuggagcugcaggggugcgaggucaacggcugcuccaccccgcucgggauggagaacggcaagaucgagaacaagcagaucaccgccagcuccuucaagaaguccugguggggcgacuacugggagcccuuccgcgcccggcugaacgcccagggccgcgugaacgccuggcaggcgaaggccaacaacaacaagcaguggcuggagaucgaccuccugaagaucaagaagaucaccgccaucaucacgcagggcugcaagucccugagcuccgagauguacgucaagagcuacaccauccacuacuccgagcagggggucgaguggaagcccuaccgccucaagagcuccaugguggacaagaucuucgagggcaacaccaacaccaaggggcacgugaagaacuucuucaacccgcccaucaucagccgguucauccgcgucauccccaagacguggaaccaguccaucgcccugcggcuggagcuguucggcugcgacaucuacuga

SEQ ID NO: 29870 - RNA, 1401 nt, Artificial Sequence
  derived and/or modified sequence opt1 from F7__Homo_sapiens__NP_000122
auggugagccaggcccugcgccuccugugccugcuccugggccugcaggggugccucgccgcgggcggggucgccaaggccuccggcggggagacccgggacaugcccuggaagccgggcccccaccgcguguucgugacccaggaggaggcccacggcguccugcaccggcgccggcgcgccaacgcguuccuggaggagcuccggcccgggagccuggagcgcgagugcaaggaggagcagugcuccuucgaggaggcccgggagaucuucaaggacgccgagcgcacgaagcuguucuggaucagcuacuccgacggcgaccagugcgccagcucccccugccagaacgggggcagcugcaaggaccagcuccaguccuacaucugcuucugccugccggcguucgaggggcggaacugcgagacccacaaggacgaccagcugaucugcgugaacgagaacggcggcugcgagcaguacugcagcgaccacaccgggaccaagcgcuccugccggugccacgagggcuacagccuccuggccgacgggguguccugcacgcccaccgucgaguaccccugcggcaagauccccauccuggagaagcgcaacgccagcaagccgcagggccggaucgugggcgggaaggugugccccaagggggagugccccuggcagguccuccugcuggugaacggcgcccagcucugcgggggcacccugaucaacaccaucuggguggucuccgccgcgcacugcuucgacaagaucaagaacuggcgcaaccugaucgccgugcucggcgagcacgaccugagcgagcacgacggggacgagcagucccggcgcguggcccaggucaucauccccagcacguacgugccgggcaccaccaaccacgacaucgcccugcuccggcugcaccagcccgugguccugaccgaccacguggugccccucugccugcccgagcgcacguucuccgagcggacccuggccuucguccgcuucagccucgugagcggguggggccagcugcuggaccgcggggcgaccgcccucgagcugauggugcugaacgucccgcggcucaugacccaggacugccugcagcagucccgcaaggugggcgacagccccaacaucacggaguacauguucugcgccggcuacuccgacgggagcaaggacuccugcaagggcgacagcgggggcccccacgccacccacuaccgggggaccugguaccugaccggcaucgucuccuggggccaggggugcgccacggugggccacuucgggguguacacccgcgucagccaguacaucgaguggcuccagaagcugaugcgguccgagccccgcccgggcgugcugcuccgggcgcccuuccccuga

SEQ ID NO: 29871 - RNA, 7056 nt, Artificial Sequence
  derived and/or modified sequence opt1 from F8__Homo_sapiens__NP_000123
augcagaucgagcuguccacgugcuucuuccucugccugcugcgcuucugcuucuccgccacccggcgcuacuaccucggcgccguggagcugagcugggacuacaugcagagcgaccugggggagcuccccguggacgcgcgguucccgccccgggugcccaagagcuuccccuucaacaccagcguggucuacaagaagacccuguucguggaguucaccgaccaccuguucaacaucgccaagccccggccgcccuggaugggccuccuggggcccaccauccaggccgagguguacgacaccgucgugaucacccugaagaacauggccagccacccggugucccuccacgccgucggcgugagcuacuggaaggcguccgagggggccgaguacgacgaccagaccagccagcgcgagaaggaggacgacaagguguuccccggcggcucccacaccuacgucuggcagguccugaaggagaacgggcccauggccagcgacccccugugccucaccuacuccuaccugagccacguggaccuggucaaggaccucaacuccggccugaucggggcccugcucgugugccgggagggcagccuggcgaaggagaagacccagacccugcacaaguucauccuccuguucgccguguucgacgaggggaaguccuggcacagcgagaccaagaacucccugaugcaggaccgcgacgccgccagcgcccgggcguggccgaagaugcacaccgucaacggcuacgugaaccgcagccuccccggccugaucgggugccaccggaaguccguguacuggcacgucaucggcauggggaccacccccgaggugcacagcaucuuccuggagggccacaccuuccucgugcgcaaccaccggcaggccucccuggagaucagccccaucacguuccugaccgcccagacccuccugauggaccugggccaguuccuccuguucugccacaucuccagccaccagcacgacgggauggaggccuacgucaagguggacuccugcccggaggagccccagcugcgcaugaagaacaacgaggaggccgaggacuacgacgacgaccucaccgacagcgagauggacgucgugcgguucgacgacgacaacucccccagcuucauccagauccgcuccguggcgaagaagcaccccaagacguggguccacuacaucgccgccgaggaggaggacugggacuacgccccgcuggugcuggcccccgacgaccggagcuacaagucccaguaccucaacaacggcccccagcgcaucgggcggaaguacaagaaggugcgcuucauggcguacaccgacgagaccuucaagacccgggaggccauccagcacgagagcggcauccuggggccccugcucuacggcgaggucggcgacacgcugcugaucaucuucaagaaccaggccucccgcccguacaacaucuacccccacgggaucaccgacgugcgcccccucuacagccggcgccugcccaagggcgugaagcaccugaaggacuucccgauccugcccggggagaucuucaaguacaaguggaccgucaccguggaggacggccccacgaaguccgacccgcggugccucacccgcuacuacagcuccuucgugaacauggagcgggaccuggccagcgggcugaucggcccccuccugaucugcuacaaggagagcgucgaccagcgcggcaaccagaucauguccgacaagcggaacgugauccuguucagcguguucgacgagaaccgcuccugguaccucaccgagaacauccagcgguuccugcccaaccccgccgggguccagcuggaggacccggaguuccaggcgagcaacaucaugcacuccaucaacggcuacguguucgacagccuccagcuguccgugugccugcacgaggucgccuacugguacauccucagcaucggggcccagaccgacuuccuguccguguucuucagcggcuacacguucaagcacaagaugguguacgaggacacccugacccucuuccccuucuccggggagaccgucuucaugagcauggagaaccccggccuguggauccugggcugccacaacuccgacuuccgcaaccgggggaugacggcccuccugaaggugagcuccugcgacaagaacaccggcgacuacuacgaggacagcuacgaggacaucuccgcguaccugcucagcaagaacaacgccaucgagccccgcagcuucucccagaacagccggcacccguccacccgccagaagcaguucaacgccaccaccauccccgagaacgacaucgagaagacggaccccugguucgcccaccggacccccaugccgaagauccagaacgugagcuccagcgaccugcugaugcuccugcgccagucccccacgccccacgggcugagccucuccgaccugcaggaggccaaguacgagaccuucagcgacgaccccuccccgggcgcgaucgacagcaacaacucccugagcgagaugacgcacuuccggccccagcuccaccacuccggcgacauggucuucacccccgagagcgggcugcagcugcgccucaacgagaagcugggcaccaccgccgccacggagcugaagaagcucgacuucaagguguccagcaccuccaacaaccugaucagcaccauccccagcgacaaccuggccgccgggaccgacaacacguccagccucggcccgcccuccaugcccgugcacuacgacagccagcuggacaccacccuguucgggaagaaguccagcccccucaccgaguccggcggcccgcugagccuguccgaggagaacaacgacagcaagcuccuggaguccgggcugaugaacagccaggaguccagcuggggcaagaacgucuccagcacggaguccgggcgccuguucaagggcaagcgcgcgcacgggcccgcccugcugaccaaggacaacgcccucuucaaggugagcaucucccugcugaagaccaacaagaccagcaacaacagcgccacgaaccgcaagacccacaucgacggccccucccuccugaucgagaacagcccguccguguggcagaacauccuggagagcgacaccgaguucaagaaggucacgccccugauccacgaccggaugcugauggacaagaacgccacggcgcugcgccucaaccacauguccaacaagaccaccagcuccaagaacauggagauggugcagcagaagaaggagggccccaucccgcccgacgcccagaaccccgacaugagcuucuucaagaugcuguuccugcccgaguccgcccgguggauccagcgcacccacgggaagaacagccucaacuccggccaggggcccagccccaagcagcuggugucccugggccccgagaaguccgucgaggggcagaacuuccucuccgagaagaacaaggugguggucggcaagggcgaguucacgaaggacguggggcugaaggagaugguguuccccagcucccggaaccuguuccucaccaaccuggacaaccugcacgagaacaacacccacaaccaggagaagaagauccaggaggagaucgagaagaaggagacccucauccaggagaacgucgugcugccccagauccacacggugaccggcaccaagaacuucaugaagaaccuguuccuccugagcacccgccagaacgucgagggguccuacgacggcgccuacgcgccggugcugcaggacuuccggagccucaacgacagcacgaaccgcaccaagaagcacaccgcccacuucuccaagaagggggaggaggagaaccuggagggccugggcaaccagaccaagcagaucguggagaaguacgccugcaccacgcggaucagccccaacaccucccagcagaacuucgucacccagcgcagcaagcgggcccucaagcaguuccgccugccccuggaggagaccgagcucgagaagcggaucaucguggacgacacguccacccaguggagcaagaacaugaagcaccugacccccuccacccugacgcagaucgacuacaacgagaaggagaagggggccaucacccagagcccgcucuccgacugccugacccgcagccacuccaucccccaggcgaaccggagcccccugcccaucgccaagguguccagcuucccguccauccgccccaucuaccucacccggguccuguuccaggacaacagcucccaccuccccgccgccagcuaccgcaagaaggacuccggcgugcaggagagcagccacuuccuccagggggccaagaagaacaaccugucccuggcgauccugacgcucgagaugaccggcgaccagcgggaggugggcagccuggggaccuccgccaccaacagcgucacguacaagaagguggagaacaccguccugcccaagccggaccuccccaagaccuccggcaagguggagcugcugcccaaggugcacaucuaccagaaggaccucuuccccaccgagacgagcaacggguccccgggccaccuggaccuggucgaggggagccuccugcagggcaccgagggcgccaucaaguggaacgaggccaaccgccccgggaaggugcccuuccugcggguggccaccgaguccagcgcgaagaccccguccaagcuccuggacccccuggccugggacaaccacuacggcacgcagauccccaaggaggaguggaagucccaggagaagucccccgagaagaccgccuucaagaagaaggacaccauccucagccugaacgccugcgaguccaaccacgcgaucgccgccaucaacgaggggcagaacaagccggagaucgaggucaccugggccaagcagggccgcacggagcgccugugcagccagaacccgcccgugcucaagcggcaccagcgcgagaucacccggaccacccugcaguccgaccaggaggagaucgacuacgacgacacgaucagcguggagaugaagaaggaggacuucgacaucuacgacgaggacgagaaccagagcccccggagcuuccagaagaagacccggcacuacuucaucgccgcggucgagcgccugugggacuacgggaugagcuccagcccgcacgugcuccggaaccgcgcccaguccggcagcgugccccaguucaagaaggucguguuccaggaguucaccgacggcuccuucacccagccccuguaccgcggggagcugaacgagcaccucggccugcuggggcccuacauccgcgccgagguggaggacaacaucauggucacguuccggaaccaggccagccgcccguacuccuucuacagcucccucaucagcuacgaggaggaccagcggcagggcgccgagccccgcaagaacuucgugaagcccaacgagaccaagaccuacuucuggaaggugcagcaccacauggcgcccaccaaggacgaguucgacugcaaggccugggccuacuucuccgacgucgaccuggagaaggacgugcacagcgggcugaucggcccgcuccuggugugccacaccaacacgcugaaccccgcccacggccggcaggucaccgugcaggaguucgcccucuucuucaccaucuucgacgagaccaaguccugguacuucacggagaacauggagcgcaacugccgggcgcccugcaacauccagauggaggaccccaccuucaaggagaacuaccgcuuccacgccaucaacggguacaucauggacacccugccgggccuggugauggcccaggaccagcggauccgcugguaccuccugagcaugggguccaacgagaacauccacagcauccacuucuccggccacgucuucaccgugcgcaagaaggaggaguacaagauggcccuguacaaccucuaccccggcguguucgagacggucgagaugcugcccagcaaggccgggaucuggcggguggagugccugaucggcgagcaccuccacgcggggaugagcacccuguuccugguguacuccaacaagugccagacgccccucggcauggccagcgggcacauccgcgacuuccagaucaccgccuccggccaguacggccagugggccccgaagcuggcgcggcugcacuacagcggguccaucaacgccuggagcacgaaggagcccuucuccuggaucaaggucgaccuccuggcccccaugaucauccacggcaucaagacccagggggcccgccagaaguucagcucccuguacaucagccaguucaucaucauguacucccucgacggcaagaaguggcagaccuaccgggggaacagcaccggcacgcugaugguguucuucggcaacguggacuccagcgggaucaagcacaacaucuucaacccgcccaucaucgcccgcuacauccggcugcaccccacccacuacuccauccgcagcacccuccggauggagcugaugggcugcgaccugaacuccugcagcaugccccucgggauggaguccaaggcgaucagcgacgcccagaucaccgccagcuccuacuucacgaacauguucgccaccuggagcccguccaaggcccgccugcaccuccagggccggagcaacgcguggcgcccccaggucaacaaccccaaggaguggcuccagguggacuuccagaagaccaugaaggugaccggggucacgacccagggcgugaagucccugcugaccagcauguacgugaaggaguuccucaucuccagcucccaggacggccaccaguggacccuguucuuccagaacgggaaggucaagguguuccagggcaaccaggacagcuucacgcccguggucaacucccuggacccgccccuccugacccgguaccugcgcauccacccccagagcugggugcaccagaucgcccuccggauggaggugcuggggugcgaggcccaggaccuguacuga

SEQ ID NO: 29872 - RNA, 1386 nt, Artificial Sequence
  derived and/or modified sequence opt1 from F9__Homo_sapiens__NP_000124
augcagcgcgugaacaugaucauggccgagagccccggccugaucaccaucugccuccugggguaccugcucuccgccgagugcaccgucuuccuggaccacgagaacgcgaacaagauccugaaccggccgaagcgcuacaacagcggcaagcucgaggaguucgugcaggggaaccuggagcgggagugcauggaggagaagugcuccuucgaggaggcccgcgagguguucgagaacacggagcggaccaccgaguucuggaagcaguacgucgacggcgaccagugcgagagcaaccccugccugaacgggggcuccugcaaggacgacaucaacagcuacgagugcuggugccccuucggcuucgaggggaagaacugcgagcucgacgugaccugcaacaucaagaacggccgcugcgagcaguucugcaagaacuccgccgacaacaagguggucugcagcugcacggagggguaccggcuggccgagaaccagaaguccugcgagcccgccgugccguuccccugcggccgcgugagcgucucccagaccagcaagcugacccgggcggagaccguguuccccgacguggacuacgucaacuccacggaggccgagaccauccucgacaacaucacccagagcacccaguccuucaacgacuucacgcgcguggugggcggggaggacgccaagcccggccaguucccguggcaggucgugcugaacgggaagguggacgccuucugcggcgggagcaucgucaacgagaaguggaucgugaccgcggcccacugcguggagaccggcgucaagaucaccgugguggccggcgagcacaacaucgaggagacggagcacaccgagcagaagcggaacgucauccgcaucaucccccaccacaacuacaacgccgccaucaacaaguacaaccacgacaucgcgcugcucgagcuggacgagccccuggugcucaacuccuacgucacccccaucugcaucgccgacaaggaguacaccaacaucuuccugaaguucgggagcggcuacguguccggguggggccggguguuccacaaggggcgcagcgcccugguccuccaguaccugcgggugccgcugguggaccgcgccacgugccuccggagcaccaaguucaccaucuacaacaacauguucugcgccggcuuccacgagggcgggcgcgacuccugccagggcgacagcgggggcccccacgucaccgagguggaggggacguccuuccugaccggcaucaucagcuggggcgaggagugcgcgaugaaggggaaguacggcaucuacaccaaggugucccgguacgucaacuggaucaaggagaagaccaagcugacguga

SEQ ID NO: 29873 - RNA, 1119 nt, Artificial Sequence
  derived and/or modified sequence opt1 from FA2H__Homo_sapiens__NP_077282
auggcccccgccccgccgcccgcggccagcuucucccccagcgaggugcagcgccggcuggccgccggcgccugcuggguccgccgcggggcgcggcucuacgaccuguccagcuucgugcggcaccaccccggcggggagcagcugcuccgcgcccgggccggccaggacaucuccgccgaccuggacgggccgccccaccgccacagcgcgaacgcccggcgcuggcuggagcaguacuacgugggcgagcuccggggcgagcagcagggguccauggagaacgagcccgucgcccuggaggagacccagaagaccgaccccgccauggagccccgcuucaaggugguggacugggacaaggaccuggucgacuggcggaagccccuccuguggcaggucggccaccugggggagaaguacgacgagugggugcaccagcccgugacgcgcccgauccgccucuuccacagcgaccugaucgagggccuguccaagaccgugugguacagcgugcccaucaucugggucccccucgugcuguaccuguccuggagcuacuaccggaccuucgcccaggggaacgugcgccucuucaccuccuucacgaccgaguacaccgucgcggugcccaagagcauguucccgggccuguucaugcugggcaccuuccucuggucccugaucgaguaccugauccaccgguuccucuuccacaugaagccgcccagcgacuccuacuaccugaucaugcugcacuucgugaugcacgggcagcaccacaaggcccccuucgacggcagccggcucgucuucccgcccgugcccgccucccuggugaucggggucuucuaccugugcaugcagcucauccugcccgaggccgugggcggcacgguguucgccgggggccugcucggguacguccuguacgacaugacccacuacuaccugcacuucggcagcccccacaaggggagcuaccucuacucccugaaggcgcaccacgugaagcaccacuucgcccaccagaaguccggcuucggcaucagcaccaagcugugggacuacugcuuccacacccucacgcccgagaagccccaccugaagacccaguga

SEQ ID NO: 29874 - RNA, 1599 nt, Artificial Sequence
  derived and/or modified sequence opt1 from FAAH2__Homo_sapiens__NP_777572
auggcccccagcuucaccgcccgcauccagcuguuccuccugcgggcgcugggcuuccucaucgggcuggugggccgcgccgcccugguccucgggggcccgaaguucgccuccaagacgccccggcccgugaccgagccccugcugcuccugagcgggaugcagcuggccaagcucauccgccagcggaaggugaagugcaucgacgucgugcaggcguacaucaaccgcaucaaggacgugaacccgaugaucaacggcaucgucaaguaccgguucgaggaggccaugaaggaggcccacgccguggaccagaagcuggcggagaagcaggaggacgaggccacccuggagaacaaguggcccuuccucggcgugccccugaccgucaaggaggccuuccagcugcaggggaugcccaacuccagcggccucaugaaccgccgggacgccaucgccaagaccgacgcgacggugguggcccugcugaagggggccggcgccaucccgcucgggaucaccaacugcuccgagcugugcaugugguacgagagcuccaacaagaucuacggccgcagcaacaaccccuacgaccugcagcacaucgucggcggguccagcggcggggagggcugcacccucgccgcggccugcuccgugaucggcguggggagcgacaucggcggguccauccggaugcccgccuucuucaacggcaucuucgggcacaagcccagcccgggcgucgugcccaacaagggccaguucccccuggccgugggggcccaggagcuguuccucugcaccggccccaugugccgcuacgcggaggaccuggccccgaugcugaaggucauggccgggcccggcaucaagcggcucaagcuggacacgaaggugcaccugaaggaccucaaguucuacuggauggagcacgacgggggcuccuuccugaugagcaagguggaccaggaccugaucaugacccagaagaaggucguggugcaccucgagaccauccugggcgccuccguccagcacgugaagcugaagaagaugaaguacagcuuccagcucuggaucgccaugauguccgcgaaggggcacgacggcaaggagcccgucaaguucguggaccugcugggggaccacggcaagcacgugagcccccucugggagcugaucaaguggugccuggggcucagcgucuacaccaucccguccaucggccuggcccugcucgaggagaagcugcgcuacagcaacgagaaguaccagaaguucaaggccguggaggagucccugcggaaggagcugguggacaugcucggcgacgacggggucuuccuguaccccagccaccccacgguggcccccaagcaccacgugccgcugacccgccccuucaacuucgcguacaccggcgucuucuccgcccucgggcugcccgugacccagugcccccugggccucaacgccaagggccugccgcuggggauccagguggucgccggccccuucaacgaccaccucacgcuggccguggcgcaguaccuggagaagaccuucgggggcugggugugccccgggaaguucuga

SEQ ID NO: 29875 - RNA, 384 nt, Artificial Sequence
  derived and/or modified sequence opt1 from FABP1__Homo_sapiens__NP_001434
augagcuucuccggcaaguaccagcugcagagccaggagaacuucgaggccuucaugaaggccaucgggcuccccgaggagcugauccagaagggcaaggacaucaaggggguguccgagaucguccagaacggcaagcacuucaaguucaccaucaccgcggggagcaaggugauccagaacgaguucacggugggcgaggagugcgagcuggagaccaugaccggcgagaaggucaagaccguggugcagcucgagggggacaacaagcuggucacgaccuucaagaacaucaaguccgugaccgagcugaacggcgacaucaucaccaacacgaugacccucggggacaucguguucaagcgcaucagcaagcggaucuga

SEQ ID NO: 29876 - RNA, 399 nt, Artificial Sequence
  derived and/or modified sequence opt1 from FABP2__Homo_sapiens__NP_000125
auggccuucgacagcaccuggaagguggaccgcuccgagaacuacgacaaguucauggagaagaugggcgucaacaucgugaagcggaagcuggccgcgcacgacaaccucaagcugaccaucacgcaggaggggaacaaguucaccgugaaggagagcuccaccuuccgcaacaucgaggucguguucgagcugggcgugaccuucaacuacaaccucgccgacgggacggagcugcggggcaccuggagccuggaggggaacaagcucaucggcaaguucaagcgcaccgacaacggcaacgagcugaacaccguccgggagaucaucggggacgagcuggugcagacguacguguacgagggcgucgaggccaagcgcaucuucaagaaggacuga

SEQ ID NO: 29877 - RNA, 399 nt, Artificial Sequence
  derived and/or modified sequence opt1 from FABP4__Homo_sapiens__NP_001433
augugcgacgccuucgugggcaccuggaagcuggucagcuccgagaacuucgacgacuacaugaaggaggugggggugggcuucgccacccgcaaggucgcggggauggccaagcccaacaugaucaucagcgugaacggcgacgugaucacgaucaaguccgagagcaccuucaagaacaccgagaucuccuucauccucgggcaggaguucgacgaggucaccgccgacgaccggaaggucaagagcacgaucacccuggacggcggcgugcuggugcacgugcagaagugggacgggaaguccaccaccaucaagcgcaagcgggaggacgacaagcucguggucgagugcgugaugaagggcgugacgagcacccgcgucuacgagcgggccuga

SEQ ID NO: 29878 - RNA, 408 nt, Artificial Sequence
  derived and/or modified sequence opt1 from FABP5__Homo_sapiens__NP_001435
auggccaccgugcagcagcuggagggccgcuggcggcucgucgacagcaagggguucgacgaguacaugaaggagcugggcguggggaucgcccugcgcaagaugggcgcgauggccaagcccgacugcaucaucacgugcgacgggaagaaccucaccaucaagaccgaguccacccugaagaccacgcaguucagcugcacccugggcgagaaguucgaggagaccaccgccgacggccggaagacgcagaccgugugcaacuucaccgacggggcccucguccagcaccaggagugggacggcaaggaguccaccaucacgcgcaagcugaaggacgggaagcuggugguggagugcgucaugaacaacgugaccugcacccggaucuacgagaagguggaguga

SEQ ID NO: 29879 - RNA, 534 nt, Artificial Sequence
  derived and/or modified sequence opt1 from FABP6__Homo_sapiens__NP_001124430
augaagaccgugaccaugaugauggucguggagaugcaggcccugacccaggugcuccgcgccguccugagcgcgugcacgugggugucccggaagggcgaccugcagcgcaugaagcagacccacaaggggaagcccccgagcuccauggccuucaccggcaaguucgagauggagagcgagaagaacuacgacgaguucaugaagcuccuggggaucuccagcgacgugaucgagaaggcccggaacuucaagaucgucacggaggugcagcaggacggccaggacuucaccuggucccagcacuacagcgggggccacaccaugaccaacaaguucacggugggcaaggaguccaacauccagaccaugggcgggaagaccuucaaggccaccguccagauggagggcgggaagcugguggugaacuuccccaacuaccaccagacgagcgagaucgucggggacaagcucguggagguguccaccaucggcggcgucaccuacgagcgcgugagcaagcggcuggccuga

SEQ ID NO: 29880 - RNA, 399 nt, Artificial Sequence
  derived and/or modified sequence opt1 from FABP7__Homo_sapiens__NP_001437
augguggaggccuucugcgccaccuggaagcugaccaacagccagaacuucgacgaguacaugaaggcgcucggcgucggguucgccacgcgccaggugggcaacgugaccaagcccaccgucaucaucucccaggagggggacaagguggugauccggacccugagcacguucaagaacaccgagaucuccuuccagcugggcgaggaguucgacgagaccaccgccgacgaccgcaacugcaagagcgucgugucccucgacggggacaagcuggugcacauccagaagugggacggcaaggagacgaacuucguccgggagaucaaggacggcaagauggugaugacccugaccuucggggacguggucgccgugcgccacuacgagaaggccuga

SEQ ID NO: 29881 - RNA, 399 nt, Artificial Sequence
  derived and/or modified sequence opt1 from FABP9__Homo_sapiens__NP_001073995
augguggagcccuuccugggcaccuggaagcucgucagcuccgagaacuucgaggacuacaugaaggagcugggggugaacuucgccgcccgcaacauggcgggccuggugaagccgaccgucacgaucagcguggacgggaagaugaugaccauccggaccgaguccagcuuccaggacaccaagaucuccuucaagcucggcgaggaguucgacgagacgaccgccgacaaccgcaaggucaagagcaccaucacccuggagaacggguccaugauccacgugcagaaguggcugggcaaggagacgaccaucaagcggaagaucguggacgagaagaugguggucgagugcaagaugaacaacaucgugagcacccgcaucuacgagaagguguga

SEQ ID NO: 29882 - RNA, 627 nt, Artificial Sequence
  derived and/or modified sequence opt1 from FADD__Homo_sapiens__NP_003815
auggaccccuuccuggugcuccugcacagcgucuccagcucccugagcuccagcgagcucaccgagcugaaguuccugugccucggccgcguggggaagcggaagcuggagcgcgugcaguccggccuggaccucuucagcaugcugcuggagcagaacgaccucgagccggggcacaccgagcugcugcgggagcuccuggccucccugcgccggcacgaccuccugcgccgggucgacgacuucgaggccggcgcggccgccggggccgcccccggcgaggaggaccugugcgcggccuucaacgugaucugcgacaacgugggcaaggacuggcgccggcucgcccgccagcugaaggucagcgacacgaagaucgacuccaucgaggaccgguacccccgcaaccugaccgagcgggugcgcgagagccuccggaucuggaagaacaccgagaaggagaacgccaccguggcgcaccuggucggggcccugcgcuccugccagaugaaccucguggccgaccuggugcaggagguccagcaggcccgggaccugcagaaccgcagcggcgccaugucccccaugagcuggaacuccgacgcgagcacguccgaggccagcuga

SEQ ID NO: 29883 - RNA, 1506 nt, Artificial Sequence
  derived and/or modified sequence opt1 from FADS1__Homo_sapiens__NP_037534
augggcacccgcgccgcccggcccgccgggcugccgugcggcgccgagaaccccgcccgccggcgccucgcccugggggcccggcagcagauccacagcuggagcccccgcacccccuccacgcggcugaccgcgccggccggccccgcccgcgggguggcccggcccgcgauggcccccgacccggucgccgccgagaccgccgcgcagggccccacgccccgcuacuucaccugggacgagguggcccagcgguccggcugcgaggagcgcuggcucgugaucgaccggaaggucuacaacaucagcgaguucacccgccggcaccccgggggcucccgcgugaucagccacuacgccgggcaggacgccaccgacccguucguggccuuccacaucaacaagggccuggucaagaaguacaugaacucccugcucaucggggagcugagccccgagcagcccuccuucgagcccaccaagaacaaggagcugacggacgaguuccgggagcuccgcgcgaccguggagcggaugggccugaugaaggccaaccacguguucuuccugcucuaccugcugcacauccuccugcuggacggcgccgccuggcucacccugugggucuucgggaccagcuuccugccguuccuccugugcgccgugcugcucuccgcggugcaggcccaggccggcuggcugcagcacgacuucgggcaccugagcgucuucuccacgagcaaguggaaccaccuccugcaccacuucgugaucggccaccugaagggcgcccccgccuccugguggaaccacaugcacuuccagcaccacgcgaagcccaacugcuuccgcaaggaccccgacaucaacaugcacccguucuucuucgcccucgggaagauccugagcguggagcugggcaagcagaagaagaaguacaugcccuacaaccaccagcacaaguacuucuuccucaucgggccgcccgcccugcugccccucuacuuccagugguacaucuucuacuucgucauccagcggaagaaguggguggaccuggccuggaugaucaccuucuacgugcgcuucuuccugaccuacgucccccuccugggccugaaggcguuccucgggcuguucuucaucgugcgcuuccuggaguccaacugguucgugugggucacccagaugaaccacauccccaugcacaucgaccacgaccggaacauggacugggugagcacgcagcuccaggcgaccugcaacgugcacaaguccgccuucaacgacugguucagcggccaccugaacuuccagaucgagcaccaccuguuccccaccaugccgcgccacaacuaccacaaggucgcgccccucgugcagagccugugcgccaagcacggcaucgaguaccaguccaagccccugcugagcgccuucgccgacaucauccacucccucaaggagagcgggcagcuguggcuggacgccuaccuccaccaguga

SEQ ID NO: 29884 - RNA, 1269 nt, Artificial Sequence
  derived and/or modified sequence opt1 from FADS2__Homo_sapiens__NP_001268430
augcacggccgcgaggccgggcccuucgugugcgucugcgugcugcucgccagcaucccgacgccccagacgccccugcugcaggcgucccugcccccguuccaccccgccagcgccggccaccccaucaccgggcagcaggacgccuuccgggccuuccaccccgaccucgaguucgugggcaaguuccugaagccgcuccugaucggggagcuggcgcccgaggagcccucccaggaccacggcaagaacagcaagaucaccgaggacuuccgcgcccuccggaagaccgccgaggacaugaaccuguucaagaccaaccacgucuucuuccugcuccugcuggcccacaucaucgcgcucgaguccaucgccugguucaccguguucuacuucggcaacggguggauccccacccugaucaccgccuucgugcuggccaccagccaggcccaggcgggcuggcuccagcacgacuacgggcaccuguccgucuaccgcaagccgaaguggaaccaccuggugcacaaguucgugaucggccaccucaagggggccagcgccaacugguggaaccaccggcacuuccagcaccacgccaagcccaacaucuuccacaaggaccccgacgucaacaugcugcacguguucgugcugggcgaguggcagcccaucgaguacggcaagaagaagcucaaguaccugccguacaaccaccagcacgaguacuucuuccugaucgggccgccccuccugauccccauguacuuccaguaccagaucaucaugacgaugaucguccacaagaacuggguggaccuggccugggcgguguccuacuacauccgcuucuucaucaccuacauccccuucuacggcauccucggggcccugcuguuccucaacuucauccgguuccuggagagccacugguucgucugggugacccagaugaaccacaucgugauggagaucgaccaggaggccuaccgcgacugguucuccagccagcugaccgccacgugcaacgucgagcaguccuucuucaacgacugguucagcggccaccucaacuuccagaucgagcaccaccuguuccccaccaugccccggcacaaccugcacaagaucgcgccccucgugaagucccugugcgccaagcacggcaucgaguaccaggagaagccgcugcuccgcgcccugcuggacaucauccggagccucaagaaguccgggaagcuguggcuggacgccuaccuccacaaguga

SEQ ID NO: 29885 - RNA, 1338 nt, Artificial Sequence
  derived and/or modified sequence opt1 from FADS3__Homo_sapiens__NP_068373
augggcggggugggcgagcccgggccgcgcgagggccccgcccagcccggggcgccccugccgaccuucugcugggagcagauccgggcccacgaccagcccggcgacaaguggcucgucaucgagcgccggguguacgacaucagccgcugggcccagcggcaccccggcgggagccgccugaucggccaccacggggccgaggacgccaccgacgccuuccgggcguuccaccaggaccugaacuucgugcgcaaguuccuccagccccugcugaucggcgagcucgccccggaggagcccagccaggacgggccccugaacgcccagcuggucgaggacuuccgggcccuccaccaggcggccgaggacaugaagcuguucgacgccucccccacguucuucgccuuccugcucggccacauccuggccauggaggugcuggcguggcuccugaucuaccugcucggcccggggugggugcccagcgcccuggccgccuucauccuggccaucucccaggcgcagagcuggugccuccagcacgaccugggccacgccuccaucuucaagaaguccugguggaaccacgucgcccagaaguucgugauggggcagcugaagggcuucagcgcccacugguggaacuuccgccacuuccagcaccacgccaagcccaacaucuuccacaaggaccccgacgugaccgucgcgccgguguuccuccugggcgagagcuccguggaguacgggaagaagaagcggcgcuaccugcccuacaaccagcagcaccucuacuucuuccugaucggcccgccccugcucacccuggucaacuucgagguggagaaccuggccuacaugcucgugugcaugcagugggccgaccugcugugggccgccagcuucuacgcgcgguucuuccucuccuaccugcccuucuacgggguccccggcgugcuccuguucuucguggccguccgcgugcuggagagccacugguucguguggaucacccagaugaaccacauccccaaggagaucgggcacgagaagcaccgggacugggucuccagccagcuggccgccacgugcaacguggagcccucccucuucaccaacugguucagcggccaccugaacuuccagaucgagcaccaccuguucccgcgcaugccccggcacaacuacucccgcguggcgccccucgucaagagccugugcgccaagcacggccugagcuacgaggugaagcccuuccucaccgcccuggucgacaucgugcggucccugaagaaguccggggacaucuggcuggacgccuaccuccaccaguga

SEQ ID NO: 29886 - RNA, 1338 nt, Artificial Sequence
  derived and/or modified sequence opt1 from FAF2__Homo_sapiens__NP_055428
auggccgcccccgaggagcgcgaccugacccaggagcagaccgagaagcuccugcaguuccaggaccugacgggcaucgagagcauggaccagugccggcacacccucgagcagcacaacuggaacaucgaggcggccgugcaggaccgccugaacgagcaggagggggucccguccguguucaacccgccgcccagccggccccuccaggugaacaccgccgaccaccgcaucuacuccuacgucgugagccggccccagccccgcggccugcugggguggggcuacuaccugaucaugcuccccuuccgguucaccuacuacacgauccuggacaucuuccgcuucgcccugcgguucauccgccccgacccccggucccgcgugaccgaccccgucggggacaucgugagcuucaugcacuccuucgaggagaaguacggccgggcccaccccguguucuaccagggcaccuacagccaggcgcucaacgacgccaagcgcgagcugcgguuccugcucgucuaccugcacggggacgaccaccaggacuccgacgaguucugccgcaacacccugugcgccccggaggugaucagccucaucaacacgcggaugcuguucugggccugcuccaccaacaagcccgagggcuaccgcgugagccaggcgcugcgggagaacaccuaccccuuccucgccaugaucaugcugaaggaccgccggaugaccgucguggggcgccuggagggccucauccagcccgacgaccugaucaaccagcugacguucaucauggacgccaaccagaccuaccucguguccgagcgccuggagcgggaggagcgcaaccagacccagguccugcggcagcagcaggacgaggccuaccucgccagccugcgcgcggaccaggagaaggagcggaagaagcgcgaggagcgggagcgcaagcggcgcaaggaggaggaggugcagcagcagaagcuggccgaggagcggcgccggcagaaccuccaggaggagaaggagcgcaagcuggagugccugccgcccgagcccucccccgacgacccggagagcgugaagaucaucuucaagcuccccaacgacucccgggucgagcgccgguuccacuucagccagucccugaccgugauccacgacuuccuguucagccucaaggagagccccgagaaguuccagaucgaggccaacuucccccgccgggugcugccgugcauccccuccgaggaguggcccaacccgcccacgcugcaggaggccgggcucagccacaccgagguccuguucgugcaggaccugaccgacgaguga

SEQ ID NO: 29887 - RNA, 945 nt, Artificial Sequence
  derived and/or modified sequence opt1 from FAHD2A__Homo_sapiens__NP_057128
augcuggugagcggccgccggcgccuccugaccguccugcuccaggcccagaaguggcccuuccagcccucccgggacaugcgccuggugcaguuccgggcgccccaccugguggggccccaccucggccuggagaccgggaacggcgggggcgucaucaaccugaacgccuucgaccccacccucccgaagaccaugacccaguuccuggagcagggcgaggccacccugagcguggcccgccgggcccucgccgcgcagcugcccgugcugccccgcuccgaggucacguuccucgcccccgugacccggccggacaagguggucugcguggggaugaacuacguggaccacugcaaggagcagaacguccccgugcccaaggagcccaucaucuucagcaaguucgccuccagcaucgugggcccguacgacgaggucgugcugccgccccagucccaggagguggacugggaggucgagcuggccguggugaucgggaagaagggcaagcacaucaaggcgaccgacgccauggcccacgucgccggguucaccguggcccacgacgugagcgcgcgcgacuggcagaugcggcgcaacggcaagcaguggcuccugggcaagacguucgacaccuucugcccccuggggcccgcccucgucaccaaggacuccguggccgacccccacaaccugaagaucugcugccgggucaacggcgagguggugcagagcgggaacaccaaccagauggucuucaagacggaggaccugaucgccugggugucccaguucgugaccuucuaccccggcgacgucauccucaccggcacgcccccgggggugggcguguuccgcaagccgcccgucuuccugaagaagggggacgaggugcagugcgagaucgaggagcugggcgugaucaucaacaaggucguguga

SEQ ID NO: 29888 - RNA, 1260 nt, Artificial Sequence
  derived and/or modified sequence opt1 from FAH__Homo_sapiens__NP_000128
augagcuucauccccguggccgaggacuccgacuucccgauccacaaccugcccuacggcgucuucagcacccgcggggacccccggccccgcaucggcguggccaucggggaccagauccucgaccuguccaucaucaagcaccuguucaccggcccggugcucagcaagcaccaggacgucuucaaccagcccacgcugaacuccuucauggggcugggccaggcggccuggaaggaggcccggguguuccuccagaaccugcugagcgugucccaggcccgccuccgggacgacaccgagcugcgcaagugcgccuucaucagccaggcguccgccaccaugcaccuccccgccaccaucggcgacuacacggacuucuacagcucccggcagcacgccaccaacgucgggaucauguuccgcgacaaggagaacgcgcugaugcccaacuggcugcaccucccggugggcuaccacgggcgggccagcuccguggucgugagcggcacccccauccgccggcccauggggcagaugaagcccgacgacuccaagccgcccguguacggcgccugcaagcugcuggacauggagcuggagauggccuucuucgucggccccgggaaccgccucggcgagcccaucccgaucagcaaggcccacgagcacaucuucgggauggugcugaugaacgacugguccgcgcgggacauccagaagugggaguacgugccccugggccccuuccucggcaagagcuucgggaccacggucucccccuggguggugccgauggacgcccugaugcccuucgccguccccaaccccaagcaggacccgcgcccccugcccuaccucugccacgacgagcccuacaccuucgacaucaaccugagcgugaaccugaagggcgaggggaugagccaggccgccaccaucugcaaguccaacuucaaguacauguacuggaccaugcuccagcagcugacgcaccacagcgugaacggcugcaaccugcggccgggggaccuccuggcguccggcaccaucagcggccccgagcccgagaacuucggguccaugcuggagcucagcuggaagggcaccaagccgaucgaccuggggaacggccagacccgcaaguuccugcucgacggggacgaggucaucaucacgggcuacugccagggcgacggguaccggaucggcuucgggcagugcgccggcaaggugcugcccgcccugcuccccuccuga

SEQ ID NO: 29889 - RNA, 951 nt, Artificial Sequence
  derived and/or modified sequence opt1 from FAIM2__Homo_sapiens__NP_036438
augacccagggcaagcugagcguggccaacaaggcccccgggaccgagggccagcagcagguccacggggagaagaaggaggcgccggccgugcccuccgccccgcccagcuacgaggaggccacguccggcgaggggaugaaggccggcgcguucccgcccgcccccaccgccgugccccuccacccgagcugggccuacgucgaccccuccagcuccagcuccuacgacaacggcuuccccaccggggaccacgagcuguucaccacguucagcugggacgaccagaaggugcgccggguguucguccgcaagguguacaccauccugcucauccagcugcuggugacccucgcggucguggcccuguucaccuucugcgaccccgugaaggacuacguccaggccaaccccggcugguacugggccuccuacgccguguucuucgcgacguaccugacccucgccugcugcagcgggccccggcgccacuuccccuggaaccugauccugcucaccguguucacccuguccauggccuaccugacgggcaugcucagcuccuacuacaacaccaccagcguccugcugugccucgggaucaccgcccuggugugccuguccgugacggucuucagcuuccagaccaaguucgacuucaccuccugccagggcguccucuucgugcugcugaugacccucuucuucagcggccugauccuggccauccuccugcccuuccaguacgugccguggcugcacgcgguguacgccgcccucggggccggcguguucacgcuguuccuggcccucgacacccagcugcugauggggaaccggcgccacagccucucccccgaggaguacaucuucggcgcgcugaacaucuaccuggacaucaucuacaucuucaccuucuuccuccagcuguucggcaccaaccgggaguga

SEQ ID NO: 29890 - RNA, 837 nt, Artificial Sequence
  derived and/or modified sequence opt1 from FAIM3__Homo_sapiens__NP_001135945
auggacuucuggcuguggccccucuacuuccugccggaguacgagcccagcugggaggagcagcccaugcccgagaccccgaagugguuccaccuccccuaccuguuccagaugcccgccuacgccuccagcuccaaguucgugacccgcgucacgacccccgcgcagcggggcaaggugccgcccgugcaccacagcucccccaccacccagaucacgcaccgcccccgggucagccgcgccuccagcguggccggggacaagccgcggaccuuccugcccuccaccaccgccagcaagaucuccgcccuggagggccuccugaagccccagacgcccagcuacaaccaccacacccgccugcaccggcagcgcgcgcucgacuacgggucccagagcggccgggaggggcagggcuuccacauccugaucccgaccauccugggccucuuccugcuggcccuccuggggcugguggucaagcgcgccguggagcggcgcaaggcccucucccggcgcgcgcggcgccuggccgugcggaugcgcgcccuggagagcucccagcggccccgcggcagcccccggccccgcucccagaacaacaucuacagcgccugcccgcgccgggcccgcggggcggacgccgccggcaccggggaggcccccguccccggccccggcgccccgcucccgcccgcgccccuccaggugagcgagucccccuggcugcacgcccccagccugaagacguccugcgaguacgugagccuguaccaccagcccgccgccaugauggaggacuccgacagcgacgacuacaucaacgucccggccuga

SEQ ID NO: 29891 - RNA, 1155 nt, Artificial Sequence
  derived and/or modified sequence opt1 from FAM102A__Homo_sapiens__NP_001030331
auggccuuccugaugaagaagaagaaguucaaguuccagaccaccuucacgcucgaggagcugaccgccgugcccuucgucaacggcgugcuguucugcaaggugcgccuccuggacgggggcgacuucgucagccuguccagccgggaggaggugcaggagaacugcgugcgcuggcggaagcgcuucaccuucgucugcaagauguccgcgaaccccgccaccgggcuccuggaccccugcguguuccgggugagcguccgcaaggagcugaagggcgggaaggccuacuccaagcucggcuucgccgaccugaaccuggccgaguucgcgggcagcggguccacggugcggugcugccuccuggagggcuacgacaccaagaacacccgccaggacaacagcauccugaaggugaccaucgggauguuccuccuguccggcgaccccugcuucaagacgcccccgagcaccgccaaguccaucagcauccccgggcaggacuccagccugcagcugaccugcaagggcggcgggaccuccagcggcggguccagcacgaacucccucaccggcagccggccgcccaaggcccgccccaccauccugagcuccggccuccccgaggagcccgaccagaaccugagcucccccgaggaggucuuccacagcgggcacucccggaacagcuccuacgccagccagcaguccaagaucagcggcuacuccaccgagcacagccgcuccagcucccugagcgaccucacgcaccggcgcaacaccuccaccagcuccagcgcgagcgggggccuggggaugaccguggagggcccggagggcuccgagcgggagcaccgcccgcccgagaagccgccccggccgccccgcccccugcaccucagcgaccgguccuuccgccggaagaaggacagcguggagucccaccccacgugggucgacgacacccgcaucgacgccgacgccaucguggagaagaucgugcagagccaggacuucaccgacggguccaacaccgaggacagcaaccugcgccuguucgucucccgggacggcagcgccacgcucuccgggauccagcuggccacccgcgugagcuccggcguguacgagcccgucgugaucgagagccacuga

SEQ ID NO: 29892 - RNA, 357 nt, Artificial Sequence
  derived and/or modified sequence opt1 from FAM103A1__Homo_sapiens__NP_113640
augaccgacaccgccgaggccgugcccaaguucgaggagauguucgcgagccgcuucacggagaacgacaaggaguaccaggaguaccugaagcggccgcccgaguccccgcccaucgucgaggaguggaacagccgcgccggcgggaaccagcggaaccgcggcaaccggcuccaggacaaccgccaguuccgggggcgcgacaaccgguggggcuggcccuccgacaaccgcagcaaccaguggcacgggcgguccuggggcaacaacuacccccagcaccgccaggagcccuacuacccccagcaguacggccacuacggguacaaccagcggccgcccuacggcuacuacuga

SEQ ID NO: 29893 - RNA, 1071 nt, Artificial Sequence
  derived and/or modified sequence opt1 from FAM105A__Homo_sapiens__NP_061891
auggccgccacccgcagccccacccgggcgcgcgagcgggagcgcuccggcgccccggccgccgggagcgaccaggugcacuccuggaugcuggccaccagccaggcgcucgacaccgucuggcggauggccaagggcuucgugaugcuggccguguccuuccuggucgccgcgaucugcuacuuccgccggcuccaccuguacagcgggcacaagcugaagugguggaucggcuaccuccagcgcaaguucaagcggaaccuguccguggaggccgagguggaccugcucagcuacugcgcccgcgaguggaagggggagacgccccggaacaagcugaugcgcaaggccuacgaggagcuguucuggcggcaccacaucaagugcguccgccaggugcggcgcgacaacuacgacgcccuccgguccgugcuguuccagaucuucagccagggcaucuccuuccccagcuggaugaaggagaaggacaucgucaagcugcccgagaagcuccuguucucccagggcugcaacuggauccagcaguacagcuucgggccggagaaguacaccggcuccaacguguucgggaagcugcgcaaguacguggagcuccugaagacccaguggaccgaguucaacggcauccgggacuaccacaagcgcgggagcaugugcaacacccuguucuccgacgcgauccucgaguacaagcuguacgaggcccugaaguucaucaugcucuaccaggucaccgagguguacgagcagaugaagacgaagaaggugauccccagccuguuccggcuccuguucucccgcgagaccagcagcgacccccuguccuucaugaugaaccaccugaacagcgucggcgacacgugcggccucgagcagaucgacauguucauccugggguacucccuggaggugaagaucaagguguuccgccucuucaaguucaacagccgggacuucgaggucugcuaccccgaggagccgcugcgcgacuggcccgagaucucccugcucaccgagaacgaccggcacuaccacauccccguguucuga

SEQ ID NO: 29894 - RNA, 519 nt, Artificial Sequence
  derived and/or modified sequence opt1 from FAM107A__Homo_sapiens__NP_001269642
auggcccagcgccugggcgagugggcccgggggcccagcgacgcgaccggccucuaccgcgccgugcugcugcgguccgccgccauguacagcgagauccagcgcgagcgggccgacaucgggggccucauggcgcgcccggaguaccgggaguggaaccccgagcugaucaagcccaagaagcugcucaaccccgucaaggccucccgcagccaccaggagcugcaccgggagcugcucaugaaccaccgccgggggcugggcguggacuccaagccggagcugcagcgcgugcucgagcaccggcgccggaaccagcugaucaagaagaagaaggaggagcuggaggccaagcgccuccagugccccuucgagcaggagcugcugcggcgccagcagcggcucaaccagcuggagaagccgcccgagaaggaggaggaccacgcccccgaguucaucaagguccgcgagaaccugcggcgcaucgcgacccucacgagcgaggagcgcgagcuguga

SEQ ID NO: 29895 - RNA, 396 nt, Artificial Sequence
  derived and/or modified sequence opt1 from FAM107B__Homo_sapiens__NP_001269625
auggccgagcccgacuacaucgaggacgacaacccggagcugauccgcccccagaagcucaucaaccccgugaagaccagccggaaccaccaggaccugcaccgcgagcugcucaugaaccagaagcggggccuggcgccccagaacaagccggagcugcagaaggucauggagaagcgcaagcgggaccaggugaucaagcagaaggaggaggaggcccagaagaagaaguccgaccucgagaucgagcugcugaagcgccagcagaagcucgagcagcuggagcuggagaagcagaagcuccaggaggagcaggagaacgcccccgaguucgugaaggucaaggggaaccugcggcgcaccggccaggagguggcccaggcccaggagagcuga

SEQ ID NO: 29896 - RNA, 789 nt, Artificial Sequence
  derived and/or modified sequence opt1 from FAM109A__Homo_sapiens__NP_001171467
auggcccccggcagcccgcccgggcccgccaucgcgaccaugaagcugaacgagcgcucccucgccuucuacgcgaccugcgacgcccccguggacaacgccggcuuccuguacaagaagggcgggcggcacgccgccuaccaccgccggugguucguccugcgcgggaacaugcuguucuacuucgaggacgccgccagccgggagcccgugggcgugaucauccucgagggcugcacggucgagcugguggaggcggccgaggaguucgccuucgccgugcgcuucgccgggacccgggcgcgcaccuacguccucgccgccgagucccaggacgccauggagggcugggugaaggcccugagccgggcguccuucgacuaccugcgccucgugguccgggagcuggagcagcagcuggccgccgugcgcgggggcgggggcauggcccucccccagccccagccccagagccugccgcugccgcccucccuccccagcgcccuggcgcccgugcccucccugcccagcgcccccgccccgguccccgcccucccccugccccggcgcccguccgcccugccgcccaaggagaacggcugcgcgguguggagcaccgaggccacguuccggcccgggcccgagcccccgccgcccccgccccgccggcgcgccuccgcgccccacggcccccucgacauggcccccuucgcccggcugcacgagugcuacgggcaggagauccgcgcccugcggggccaguggcucagcucccgcgugcagcccuga

SEQ ID NO: 29897 - RNA, 888 nt, Artificial Sequence
  derived and/or modified sequence opt1 from FAM110A__Homo_sapiens__NP_001276075
augcccgugcacacccugagcccgggcgcccccuccgcccccgcgcuccccugccgccugcggacccgcgucccgggguaccugcuccggggccccgccgacgggggcgcccgcaagcccagcgccguggagcggcuggaggccgacaaggcgaaguacgugaagucccugcacgucgccaacacgcgccaggagcccgugcagccgcuccugagcaagcagccccuguucucccccgagacccggcgcaccgugcucacccccagccggcgcgcccugccggggcccugccggcgcccccagcuggaccucgacauccuguccagccugaucgaccucugcgacucccccgucagcccggccgaggcgucccggacgcccggccgcgccgagggcgccgggcggccgccgcccgccaccccgccccgcccgccgcccagcaccuccgccgugcggcgcguggacguccggccccugcccgcgagccccgcccgccccugccccucccccggccccgccgccgccagcucccccgcgcggccgcccgggcugcagcgcagcaaguccgaccucagcgagcgcuucagccgggccgccgccgaccuggagcgcuucuucaacuucugcggccuggaccccgaggaggcccgggggcucggcguggcgcaccuggcccgcgccuccagcgacaucgugucccuggccggccccagcgccgggcccggcuccagcgagggcgggugcucccggcgcagcuccgucaccguggaggagcgggcgcgcgagcgggugcccuacggcgucagcgugguggagcgcaacgcccgggucaucaaguggcucuacgggcugcgccaggcccgggagucccccgccgcggagggcuga

SEQ ID NO: 29898 - RNA, 1113 nt, Artificial Sequence
  derived and/or modified sequence opt1 from FAM110B__Homo_sapiens__NP_671722
augcccaccgagacccugcagacgggcagcauggugaagccggucucccccgccgggaccuucaccagcgccgugccccuccgcauccugaacaagggccccgacuacuuccggcgccaggcggagccgaaccccaagcggcuguccgccguggagcgccucgaggccgacaaggccaaguacgucaagagccaggaggugaucaacgccaagcaggagcccgugaagcccgcgguccuggccaagccgcccgugugccccgccgccaagcgggcgcuggggucccccacccucaagguguucggcaaccacgccaagacggagagcgggguccagcgcgagaaccugaagcuggagauccucaagaacaucaucaacuccagcgagggcuccagcuccggcagcgggcacaagcacuccagccggaacuggccgccccaccgcuccgaggccaccgaccugcaccggcacagcuucgccgagucccugaagguguaccccacccagggccgccggagcccccaggagggcgggucccacguggggcgccggcuccuggagcagagcgccgagagcuuccugcacgucucccacagcuccagcgacauccgcaaggugaccuccgugaagccgcucaaggcgauccccugcagcuccagcgccccgccccugccgcccaagcccaagaucgccgccaucgccuccaugaagucccccgaggcggaccccgucgagcccgccugcggcgugagccggcgccccagccugcagcgguccaagagcgaccucuccgaccgcuacuuccggguggacgccgacgucgagcgcuucuucaacuacugcggccuggaccccgaggagcuggagaaccucgggauggagaacuucgcccgggccaacagcgacaucaucucccugaacuuccgcagcgcguccaugaucagcagcgacugcgagcagucccaggacagcaacuccgaccugcgcaacgacgacagcgccaacgaccgggugccguacggcaucuccgccaucgagcgcaacgcccggaucaucaaguggcucuacagcaucaagcaggcccgcgagucccagaaggugagccacgucuga

SEQ ID NO: 29899 - RNA, 966 nt, Artificial Sequence
  derived and/or modified sequence opt1 from FAM110C__Homo_sapiens__NP_001071178
augcgcgcccuggccgcgcucagcgcgcccccgaacgagcggcugcugccccgcgaccccgccgccacccgggaccccgacgccgcccgcccggcccggcgcuccgccguggagcggcucgccgcggaccgcgccaaguacgugcggggccgccccgggaccggccgcgggguggccagcgagggcuccgggcccggcgccaucaagugccccggcaacgacccggggccgcccgcccgggcgcccgcccccguggcccggcgcgccaucgcccggaagccccugcgccccgacagccugaucaucuaccggcagaagugcgaguucguccgcggcuccggggcggacggcccccgggccagccucgugaagaagcuguuccaggggccgggcaaggacaaggcccccgugccccgcacgggcgacgaggggaaggccggcaaccccgagaccgucccgaccacccccgggcccgccgcggaccccgccaucccggagacgcccgcccccgccgcccgguccgcggcccccagcuccgugccggccgccccgcccggccccgagccccgcgugguccgccggcgcggccugcagcggagccaguccgaccucagcucccgcuacagcgcggcccuggccgaguccgacaccuucuuccaguacugcgggcuggaccccgaggugguggaggcccucggccgggagaacuucaccgccgggagcgacugcgucacccugaaggugcgcuccgugagcgucgcgacguccggcagcggguucagccggcacuccggcggcgacgacgaggggcugcaggaggaggagcucaucgagcagguccccagcaccaccuccgugaucgagcgcaacgcccggaucaucaaguggcuguacacgugcaagaaggccaaggagaccccgagccaggagcagucccgcacccggggcagcaagcccucccgcuga

SEQ ID NO: 29900 - RNA, 2115 nt, Artificial Sequence
  derived and/or modified sequence opt1 from FAM111B__Homo_sapiens__NP_001136176
augaagcagacccacgccgacacccccguggaccacugccugagcggcauccgcaagugcuccagcacguucaagcucaaguccgaggucaacaagcacgagaccgcccuggagaugcagaacccgaaccugaacaacaaggagugcugcuucaccuucacccucaacgggaacagccggaagcuggaccgcuccguguucacggcguacggcaagcccagcgaguccaucuacagcgcccuguccgccaacgacuacuucagcgagcggaucaagaaccaguucaacaagaacaucaucguguacgaggagaagaccaucgacgggcacaucaaccucggcaugccccugaagugccugcccuccgacagccacuucaagaucaccuucgggcagcgcaaguccagcaaggaggacggccacauccuccggcagugcgagaacccgaacauggagugcauccuguuccacgucguggccaucggccgcacccggaagaagaucgugaagaucaacgagcugcacgagaagggguccaagcucugcaucuacgcccugaagggcgagacgaucgagggggcgcugugcaaggacggccgcuuccggagcgacaucggggaguucgaguggaagcucaaggagggccacaagaagaucuacggcaagcaguccauggucgacgaggugagcgggaaggugcuggagauggacaucuccaagaagaaggcccugcagcagaaggacauccacaagaagaucaagcagaacgagagcgccaccgacgagaucaaccaccagagccucauccaguccaagaagaagguccacaagcccaagaaggacggcgagaccaaggacguggagcacagccgcgagcagauccugccgccccaggaccugucccacuacaucaaggacaagacccggcagacgaucccccgcauccggaacuacuacuucugcagccucccccgcaaguaccggcagaucaacucccaggugcgccggcgcccccaccuggggcggcgcuacgccaucaaccuggacguccagaaggaggcgaucaaccuccugaagaacuaccagacccugaacgaggccaucaugcaccaguaccccaacuucaaggaggaggcccagugggugcggaaguacuuccgcgaggagcagaagcgcaugaaccucagcccggccaagcaguucaacaucuacaagaaggacuucggcaagaugaccgccaacuccgugagcgucgcgaccugcgagcagcugacguacuacuccaagagcgugggcuucaugcagugggacaacaacgggaacaccggcaacgcgaccugcuucguguucaacgggggcuacaucuucacgugccggcacgucgugcaccugaugguggggaagaacacccaccccucccucuggcccgacaucaucagcaagugcgccaaggucaccuucaccuacaccgaguucugccccacgccggacaacugguucuccaucgagcccuggcugaaggugagcaacgagaaccuggacuacgccauccucaagcugaaggagaacggcaacgccuucccgcccggccuguggcgccagaucagcccccagcccuccaccgggcucaucuaccugaucggccaccccgaggggcagaucaagaagaucgacggcugcaccgugaucccccugaacgagcggcucaagaaguacccgaacgacugccaggacgggcuggucgaccuguacgacaccacguccaacguguacugcauguucacccagcgcagcuuccucuccgaggucuggaacacccacacccugagcuacgacacgugcuucagcgacggcuccagcggcucccccguguucaacgccagcgggaagcugguggcccuccacaccuucggccuguucuaccagcggggguucaacguccacgcccugaucgaguucggcuacuccauggacagcauccucugcgacaucaagaagaccaacgagucccuguacaagagccugaacgacgagaagcuggagaccuacgacgaggagaaggggaagcaggaguccagccuccaggaccaccagaucgagcccauggagugcuga

SEQ ID NO: 29901 - RNA, 1692 nt, Artificial Sequence
  derived and/or modified sequence opt1 from FAM114A1__Homo_sapiens__NP_612398
augagcgacgacgccggcgacacccuggccaccggggacaaggcggaggugacggagaugcccaacuccgacagccugccggaggacgccgagguccacugcgacuccgccgccgugagccacgagcccacccccgccgacccccgcggcgaggggcacgagaacgcggccgugcagggcgccggggccgcggccaucggcccgcccguccagccccaggacgccaacgcccuggagcccccgcugaacggcgacgugaccgaggacacccucgccgagugcaucgacuccgugagccuggaggcggagccccgguccgagaucccccugcaggagcagaacuaccucgccgucgacagcccgcccuccgggggcgggugggccggcugggggagcuggggcaagucccugcugagcuccgccagcgccacggugggccacgggcucaccgcggugaaggagaaggccggcgccacccugcgcauccacggggucaacuccggcagcuccgagggcgcccagcccaacaccgagaacggggugcccgagaucacggacgccgcgaccgaccagggccccgccgagagcccgcccaccucccccagcagcgccucccgggggaugcugagcgccaucaccaacgugguccagaacacgggcaaguccgugcucaccgggggccuggacgcccuggaguucaucggcaagaagaccaugaacgugcucgcggagagcgaccccggguucaagcgcaccaagacgcugauggagcggaccgucucccugagccagaugcuccgcgaggccaaggagaaggagaagcagcggcuggcccagcagcugaccauggagcgcaccgcccacuacggcaugcuguucgacgaguaccaggggcugucccaccuggaggcgcucgagauccugagcaacgaguccgagagcaaggugcaguccuuccuggccagccucgacggcgagaagcuggagcugcucaagaacgaccugaucuccaucaaggacaucuucgccgccaaggagcuggagaacgaggagaaccaggaggagcaggggcucgaggagaagggcgaggaguucgcccggaugcugacggagcuccucuucgagcugcacguggcggccaccccggacaagcugaacaaggccaugaagcgcgcccacgacugggucgaggaggaccagaccguggugagcgucgacguggccaagguguccgaggaggagaccaagaaggaggagaaggaggagaagucccaggacccccaggaggacaagaaggaggagaagaagacgaagaccaucgaggaggucuacaugagcagcaucgagucccucgcggaggugaccgcccggugcaucgagcagcugcacaaggucgccgagcugauccuccacggccaggaggaggagaagcccgcccaggaccaggccaaggugcugaucaagcugaccacggcgaugugcaacgagguggccagccucagcaagaaguucaccaacucccugaccaccgucgggagcaacaagaaggccgaggugcugaaccccaugaucuccagcgugcuccuggagggcugcaacuccacgaccuacauccaggacgccuuccagcugcugcucccgguccuccaggugagccacauccagaccuccugccugaaggcgcagcccuga

SEQ ID NO: 29902 - RNA, 2769 nt, Artificial Sequence
  derived and/or modified sequence opt1 from FAM120B__Homo_sapiens__NP_001273308
auggaccgccagaugauccugagccgguccagcgugaugggcguccgcgggcuccagggcuucgugggguccacgugcccccacaucugcaccguggucaacuucaaggagcuggccgagcaccaccggagcaaguacccgggcugcacccccaccaucgugguggacgccaugugcugccugcgcuacugguacacccccgaguccuggaucugcgggggccaguggcgggaguacuucagcgcgcuccgcgacuucgucaagaccuucacggccgccggcaucaagcugaucuucuucuucgacgggaugguggagcaggacaagcgggacgagugggugaagcgccggcugaagaacaaccgcgagaucucccggaucuuccacuacaucaagagccacaaggagcagcccggccgcaacauguucuucaucccguccgggcucgccgucuucacccgguucgcccugaagacccugggccaggagacccucugcagccugcaggaggcggacuacgagguggccuccuacgggcugcagcacaacugccucggcauccugggcgaggacacggacuaccugaucuacgacacgugccccuacuucagcaucuccgagcucugccuggagagccuggacaccgugaugcucugccgcgagaagcugugcgagucccuggggcucugcgucgccgaccugccccugcucgccugccugcugggcaacgacaucauccccgaggggauguucgagagcuuccgguacaagugccucuccagcuacaccuccgugaaggagaacuucgacaagaagggcaacaucauccuggcggugagcgaccacaucagcaagguccuguaccucuaccagggcgagaagaagcuggaggagauccugccgcucgggcccaacaaggcccuguucuacaagggcauggccuccuaccugcuccccgggcagaagucccccugguucuuccagaagccgaagggcgugaucacccuggacaagcaggucaucagcaccagcuccgacgccgagagccgcgaggaggugcccaugugcuccgacgccgagagccggcaggaggugcccaugugcaccgggcccgagucccgccgggaggugccggucuacaccgacagcgagccccgccaggaggugcccaugugcuccgaccccgagccgcggcaggaggugcccacgugcaccggccccgagagccgccgcgagguccccaugugcuccgacccggagccccggcaggaggugcccaugugcaccggccccgaggcgcgccaggaggucccgauguacaccgacagcgagccccggcaggaggugcccauguacacggacuccgagccgcgccaggaggugcccauguacaccgggagcgagccccggcaggagguccccauguacaccggcccggagucccgccaggaggugcccauguacaccgggcccgagagccggcaggaggugcugauccgcacggaccccgagucccggcaggagaucaugugcaccggccacgagagcaagcaggaggucccgaucugcaccgaccccaucagcaagcaggaggacuccaugugcacccacgccgagaucaaccagaagcuccccguggccacggacuucgaguucaagcuggaggcccugaugugcaccaaccccgagaucaagcaggaggacccgaccaacguggggcccgaggucaagcagcaggucaccauggugagcgacacggagauccucaagguggcccgcacccaccacgugcaggcggaguccuaccugguguacaacaucaugagcuccggcgagaucgagugcagcaacacccuggaggacgagcucgaccaggcccugcccucccaggccuucaucuaccggcccauccgccagcgggucuacagccugcuccuggaggacugccaggacgugaccuccacgugccuggccgugaaggagugguucgucuacccgggcaacccccugcgccaccccgaccucgugcggccccugcagaugaccauccccgggggcaccccgagccugaagauccucuggcugaaccaggagcccgagauccaggugcgccggcuggacacccuccuggccugcuucaaccuguccagcucccgcgaggagcuccaggcggucgagagccccuuccaggcccugugcugccugcucaucuaccuguucguccagguggacacccugugccucgaggaccugcacgccuucaucgcccaggcccugugccuccaggggaaguccacgagccagcuggugaaccugcagccggacuacaucaacccccgggcggugcagcucggcucccugcuggugcgcgggcucaccacccugguccuggugaacagcgccugcggcuuccccuggaagaccagcgacuucaugccguggaacguguucgacggcaagcuguuccaccagaaguaccuccaguccgagaagggguacgccgucgaggugcugcucgagcagaaccgcagccggcugacgaaguuccacaaccugaaggccguggucugcaaggcgugcaugaaggagaaccgccggaucaccggccgcgcccacugggggucccaccacgccggccgguggggccgccaggggagcuccuaccaccggaccggcagcggguacucccgcagcucccagggccagcccuggcgggaccaggggcccggcagccgccaguacgagcacgaccaguggcggcgcuacuga

SEQ ID NO: 29903 - RNA, 3291 nt, Artificial Sequence
  derived and/or modified sequence opt1 from FAM120C__Homo_sapiens__NP_060318
augggcgugcagggguuccaggaguuccuggagaagcgcugccccggcgccguggugcccguggaccuccugaagcuggcccggaccgugagccgccagcagcagcagcagcaccuccaccggcagcugccgcccaccgcggcccuggcccccggggcgccccgcgccgcccggggcuccgugccccuccagccgccccucccgcccgccgcccugggggccuacagcggcggcgcggggcccacgcgccaccaccaccccgcccaccacuuccaccaccacggccaggcccagcccgggcuccacccgccccugcccccgcccccgccgccccagcugcccggcgcccgggugcucgucgacgccggguccgcgcugccccgccuguacggcggcuaccagaccgacugggugugcgggggccaguggaacgccaugcucggguaccugagcgcccugugccaggccugcgccuaccccggcggcgacgggcucgagcugguggucauguuccccggcgggcugggcaaggaccggcucgcggagugggggcgccggugccaggccgagcgccagaccgcccagcugaucgugggccacgugggcaacaaggggacgcccccgccccgggccugguuccugccgcccgccugccucucccacugcguccgccuggcgcugauccgguuccgcgugaagguguuccagagccucgaggaccaccaccuggaggucguggccuucuuccgggagaacggcuuccacgggcugcucgcccacgacuccgaguacgcccuguacaacauccccagcuacuacuccagccacgcccugaagcucuccuggaacggcaagaaccugaccaccaaccaguuccugaugcaggagguggcgaagcagcucgggcugaagcgcaugaacuuccccaucuucgccgcccugcucggcaaccacauccugcccgacgaggaccuggccgcguuccacuggagccuccugggccccgagcacccccuggccucccucaagguccgggcccaccagcuggugcugccgcccugcgacguggucaucaaggccgugagcgaguacguguccagcaucaaggaccccuccaaccucgacgucguggggaaggacgucuucaagcagagccagucccgcaccgaggacaagaucgagcgguucaagaaggccguggaguacuacagcgugaccacgaagcugagcucccugcccgucggccccagcuuccugggguuccgcaacaaccgccucggcaacccgccccugccccggaaccagguggggaccaucuccgcgggcaagcccauguucagccaccaggugccccagaaggucaaguacccgccgcccuuccccgugggccccaacuccagccuccuguucuccagccacgcccugggggagucccacgccuucagcgaggaccccaugcugcagaacucccccuucgccaacugggccgugagcuacgacuccagcgcgucccaguuccccaacuaccuccccagcaaggccagcccgccccugggccccgacagcucccacagcagcuccagcgacggggacgagcccaacggcgccuccagcgaccacaucaccgaggccuuccaccaccagcccgaguggggcaaccccaaccgcgaccggggguccugggcccagcccgucgacaccggcgugagcgaggcgucccugggggacggcgagccccacaucccgagccuccuguccaugagcacgcgcaaccacauggacaucaccaucccgccccugcccccgguggcccccgagguccuccggguggccgagcaccgccaccggcgcgggcugauguaccccuacaucuaccacgugcugaccaagggcgagaucaagauccccgucugcaucgaggacgagugcaacauggagcucccgcccgccgcgcugcuguuccgguccgcccgccaguacguguacggcguccucuucagccuggccgagacccagcggaagauggagcgccuggccaugcggcgccggcuccccgucgaggugcccuccgugauccugaaggaguggagcgccuacaaggggaaguccccgcagacgcccgagcuggucagcgcgcucaccuuccgcgaguggaccugccccaaccugaagaagcuguggcucggcaaggccguggaggacaagaaccggcgcaugcgggccuuccuggccugcaugaaguccgacacccccagcaugcugaacccggccaacgugcccacgcaccuccugcugaugugcugcguccuccgcuacauggugcaguggcccgggggccgcauccugcaccggcacgagcuggacaccuuccucgcgcaggccgugagcacccagcuguacgagcccgaccgccugcaggagcucaagaucgagaagcuggacgcccgggggauccagcuggccgcccucuucauguccggcgucgacaccgcgcuguucgccaacgacgccugcggccagccggugcccugggagcacugcugccccuggaucuacuucgacgggaagcuguuccagagcaagcucaucaaggccggccgcgagcgggugucccuggucgagcugugcgacgggcaggcggaccucgccacgaagguggagaagaugcgccagagcauccuggagggcgugaacaugaaccacccgccgcccuccgcccugcuccccagccccaccuucgugccgcccauggugcccucccuguaccccgugagccuguacucccgggccauggggagcaugccccugccgccccagggccgcucccggggcuucgccgggcugcaccccaucccgccccagggcgggaagcuggagaucgcgggcauggucguggggcagugggccggcagccgcuccagccggggccgcggguccuucggcaugcaggucgucagcgucgggggccccggcaaggggcacggcaaggagcagaccgggcggggcuccaaggggcacaagaagggcaacaagcagggcagcuccgacggggugagcaagagccucgagcugcaccagggccgcucccggagccaggucaacgggaacuccggcgcccugaucaaggaggagaaguccgaccaccgccucccggcccccucccagugcgcccugagccgggacuccaacgagugcaacaacgggaaccgcuaccugcccaugaacaaccgggagaagaaccaccuccaggagcagaagcuggagaccguggcgcagcgcaaggaggacuga

SEQ ID NO: 29904 - RNA, 1368 nt, Artificial Sequence
  derived and/or modified sequence opt1 from FAM124B__Homo_sapiens__NP_001116251
auggacgagacccagggcccccuggccaugaccgugcaccuccuggccaacagcgggcacggcucccugcugcagcgcacgcuggaccagcugcucgacugcaucugcccggagguccggcuguuccaggugagcgagcgcgcgucccccgugaaguacugcgagaagucccacagcaagcggagccgcuuccccgggauguccguccuccuguuccugcacgagagccccggcgaggaccggcuguuccgcgugcucgacucccugcagcacagcccguggcagugcuaccccacccaggacacccgggggcgccugugccccuacuucuucgccaaccaggaguucuacucccucgacagccagcugcccaucuggggcgugcggcagguccacugcggcuccgagauccugcgcgugacccucuacugcagcuucgacaacuacgaggacgccauccggcuguacgagaugauccugcagcgcgaggccacgcuccagaaguccaacuucugcuucuucgugcuguacgccagcaaguccuucgcgcugcagcucagccugaagcagcugccgcccgggauguccgucgaccccaaggagagcagcgugcuccaguucaaggugcaggagaucggccagcuggucccccugcucccgaaccccugcaugcccaucuccagcacccgguggcagacccaggacuacgacgggaacaagauccugcuccaggugcagcugaaccccgagcugggcgugaagaacgggauccugggcgccggcaugcucccgcuggggucccgccugaccagcgucuccgccaagcggacgagcgagccccgcucccagcggaaccagggcaagcgcagccaggggcacucccucgagcugcccgagcccagcggcuccccgaccagcgaccggugcgccggcaccuccuggaagucccccgggcgcagcuuccaggugagcucccccgcgaugggcgcccaccuccaccugagcucccaccaccuggagagcggggcccggaugaaggugcugaaccgcgagaacagcuuccagaagcucgaggccgagaccaacgucgacacgggccugaccaucaucaacuccgagccccgccagaccuacuucgggggcuucccgcgggaccugcagaccagccagccgcccuucugccuccccgccuccagccugggcguggcgacguccaagaacaacagcgugcugaaggagcgcgucagcccccugccccucgccgggcagcgggaccugggcacccgcaagaccaucuccgagugccugcuccaccuccaggugcagggggaggagaaggaggaggacgaggaggaguucuucaucuga

SEQ ID NO: 29905 - RNA, 1566 nt, Artificial Sequence
  derived and/or modified sequence opt1 from FAM126A__Homo_sapiens__NP_115970
auguucaccagcgagaagggcguggucgaggaguggcuguccgaguucaagacccuccccgagacgagccugccgaacuacgccaccaaccugaaggacaaguccagccucguguccagccuguacaaggugauccaggagccccaguccgagcugcucgagcccgucugccaccagcuguucgaguucuaccgcagcggggaggagcagcugcuccaguucacccugcaguuccugcccgagcucaucuggugcuaccuggccguguccgcgagccgcaacgugcacuccagcggcugcaucgaggcccugcuccugggggucuacaaccuggagaucguggacaagcagggccacaccaaggugcucuccuucacgaucccgagccuguccaagcccagcgucuaccacgagcccuccagcaucggguccauggcccugaccgagagcgcccucagccagcacggccuguccaaggugguguacagcggcccccacccgcagcgcgagaugcugaccgcccagaaccgguucgagguccucaccuuccugcugcucugcuacaacgcggcccugacguacaugcccuccgugagccugcagucccucugccagaucugcagccgcaucugcgugugcggguacccccggcagcacguccgcaaguacaagggcaucuccagccggauccccguguccagcggguucauggugcagaugcugaccggcaucuacuucgccuucuacaacggggagugggaccuggcccagaaggcgcucgacgacaucaucuaccgcgcccagcuggagcuguacccggagccccuccuggucgccaacgccaucaaggccucccugccccacggccccaugaaguccaacaaggagggcacccggugcauccagguggagaucaccccgacgagcagccgcaucucccggaacgcggugaccagcauguccauccgcgggcaccgguggaagcgccacggcaacaccgagcucaccgggcaggaggagcugauggagaucagcgaggucgacgagggcuucuacucccgggccgccagcagcacgucccagagcggccuguccaacagcucccacaacugcagcaacaagcccuccaucgggaagaaccaccgccggagcggcggguccaagaccggcgggaaggagaaggagaccaccggcgagagcugcaaggaccacuucgcccgcaagcagacgcagcgggcccaguccgagaaccucgagcugcugagccucaagcgccugacccugaccaccucccagagccuccccaagcccuccagccacggccuggcgaagacggccgccaccguguucuccaagagcuucgagcaggucagcggggugaccgugccgcacaaccccuccagcgccgucggcugcggggccggcaccgacgcgaaccgguucuccgccugcagccugcaggaggagaagcugaucuacguguccgagcgcacggagcuccccaugaagcaccagagcgggcagcagcggcccccguccaucagcaucacccuguccaccgacuga

SEQ ID NO: 29906 - RNA, 2787 nt, Artificial Sequence
  derived and/or modified sequence opt1 from FAM129A__Homo_sapiens__NP_443198
augggcgggagcgccuccagccagcuggacgagggcaagugcgccuacauccgcgggaagaccgaggcggccaucaagaacuucucccccuacuacagccggcaguacuccguggccuucugcaaccacguccgcaccgagguggagcagcagcgggaccucacgagccaguuccugaagaccaagccgccccuggcccccggcaccauccucuacgaggccgagcugucccaguucagcgaggacaucaagaaguggaaggagcgcuacguggucgugaagaacgacuacgcgguggaguccuacgagaacaaggaggccuaccagcgcggggccgcccccaagugccggauccugccggcgggcggcaagguccucaccagcgaggacgaguacaaccugcuguccgaccggcacuuccccgacccccucgccagcuccgagaaggagaacacgcagcccuucguggugcugccgaaggaguuccccgucuaccuguggcagcccuucuuccgccacggguacuucugcuuccacgaggccgccgaccagaagcgguucagcgcccuccuguccgacugcgugcgccaccugaaccacgacuacaugaagcagaugaccuucgaggcgcaggccuuccucgaggccgugcaguucuuccggcaggagaagggccacuacgggagcugggagaugaucaccggcgacgagauccagauccuguccaaccuggucauggaggagcuccugcccacccugcagacggaccuccugccgaagaugaaggggaagaagaacgaccgcaagcggaccuggcugggccuccuggaggaggccuacacccuggugcagcaccaggugagcgagggccucuccgcccugaaggaggagugccgcgcgcugaccaaggggcucgagggcacgauccggagcgacauggaccagaucgucaacagcaagaacuaccugaucgggaagaucaaggccaugguggcccagcccgccgagaaguccugccuggagagcgugcagcccuuccucgccuccauccuggaggagcugaugggccccgucagcuccggcuucagcgaggugcgcgugcuguucgagaaggaggucaacgaggugucccagaacuuccagaccaccaaggacagcgugcagcugaaggagcaccuggaccggcucaugaaccugccgcugcacuccgucaagauggagcccugcuacaccaaggugaaccuccugcacgagcgccugcaggaccucaagagccgguuccgcuucccccacaucgaccuggucgugcagcggacgcagaacuacaugcaggagcugauggagaacgcgguguucaccuucgagcagcuccugagcccccaccuccagggggaggccuccaagaccgccgucgccaucgagaaggugaagcugcgcgugcucaagcaguacgacuacgacuccagcaccauccgcaagaagaucuuccaggaggcccugguccagaucacgcugccgaccgugcagaaggcgcucgccuccacgugcaagcccgagcugcagaaguacgagcaguucaucuucgccgaccacaccaacaugauccacguggagaacgucuacgaggagauccugcaccagauccuccuggacgagacccugaaggugaucaaggaggccgcgauccucaagaagcacaaccuguucgaggacaacauggcccugcccagcgaguccgugagcucccucaccgaccugaagcccccgaccggcagcaaccaggccagccccgcccggcgcgccuccgcgauccugcccgggguccucggcagcgagacccuguccaacgagguguuccaggagagcgaggaggagaagcagcccgaggugccguccagccuggccaagggggagucccucagccugcccggccccuccccgccgcccgacggcacggagcaggucaucaucagccggguggacgaccccguggucaaccccguggccaccgaggacaccgccgggcugcccgggaccugcuccagcgagcucgaguucgggggcacgcuggaggacgaggagcccgcccaggaggagcccgagccgaucaccgcguccgggagccugaaggcccuccgcaagcugcugaccgccuccguggagguccccguggacagcgcccccgugauggaggaggacaccaacggcgagucccacgucccccaggagaacgaggaggaggaggagaaggagccgagccaggccgcggccauccaccccgacaacugcgaggagagcgagguguccgagcgggaggcccagccgcccugccccgaggcccacggcgaggagcucgggggcuuccccgagguggggagccccgcguccccgcccgccagcggcgggcugacggaggagccccugggccccauggagggcgagcuccccggggaggccugcacccugaccgcccacgagggccgcgggggcaagugcaccgaggagggcgacgccucccagcaggaggggugcacccugggcagcgacccgaucugccucuccgagagccaggucuccgaggagcaggaggagaugggcggccagagcuccgcggcccaggccacggccagcgugaacgccgaggagaucaagguggcgcggauccacgagugccagugggucguggaggacgcccccaaccccgacgugcugcugucccacaaggacgacgucaaggagggggagggcggccaggagagcuucccggagcuccccuccgaggaguga

SEQ ID NO: 29907 - RNA, 2202 nt, Artificial Sequence
  derived and/or modified sequence opt1 from FAM129B__Homo_sapiens__NP_001030611
augggcuggaugggggagaagaccggcaagauccugaccgaguuccuccaguucuacgaggaccaguacgggguggcccuguucaacagcaugcgccacgagaucgagggcacggggcugccccaggcccagcuccuguggcggaaggucccgcuggacgagcgcaucguguucuccggcaaccucuuccagcaccaggaggacagcaagaaguggcggaaccgcuucucccuggugccccacaacuacggccugguccucuacgagaacaaggcggccuacgagcgccaggugccgccccgcgccgugaucaacagcgccggguacaagauccugaccuccgucgaccaguaccuggagcucaucggcaacagccugcccgggaccaccgccaaguccggcagcgcgcccauccugaagugccccacgcaguucccccucauccuguggcacccguacgcccggcacuacuacuucugcaugaugaccgaggccgagcaggacaaguggcaggccgugcugcaggacugcauccgccacugcaacaacgggauccccgaggacuccaagguggagggccccgcguucaccgacgccauccggauguaccgccagagcaaggagcucuacggcaccugggagaugcugugcgggaacgagguccagauccuguccaaccucgugauggaggagcugggccccgagcugaaggccgagcucgggccgcggcugaagggcaagccccaggagcggcagcggcaguggauccagaucagcgacgccguguaccacaugguguacgagcaggccaaggcgcgcuucgaggaggugcuguccaaggugcagcagguccagcccgccaugcaggccgugauccggacggacauggaccagaucaucaccagcaaggagcaccucgccuccaagauccgcgccuucauccugcccaaggcggaggugugcguccggaaccacgugcagccguacauccccagcauccuggaggcccucauggugcccaccucccagggcuucaccgagguccgcgacguguucuucaaggaggugacggacaugaaccugaacgucaucaacgagggcgggaucgacaagcugggggaguacauggagaagcucagccggcuggccuaccacccccugaagaugcaguccugcuacgagaagauggagagccuccgccuggacggccugcagcagcgguucgacgugagcuccaccagcgucuucaagcagcgcgcccagauccacaugcgcgagcagauggacaacgccguguacaccuucgagacccuccugcaccaggagcuggggaagggcccgacgaaggaggagcucugcaaguccauccagcgggugcuggagcgcguccugaagaaguacgacuacgacagcuccagcgugcggaagcgcuucuuccgggaggcgcuccugcagaucuccauccccuuccugcucaagaagcuggccccgaccugcaagagcgagcugccccgcuuccaggagcugaucuucgaggacuucgcccgguucauccucguggagaacaccuacgaggaggucgugcugcagaccgugaugaaggacauccugcaggccgucaaggaggccgcggugcagcgcaagcacaaccucuaccgggacuccauggugaugcacaacagcgaccccaaccugcaccuccuggccgagggcgcccccaucgacuggggcgaggaguacuccaacagcggcggcggcgggucccccagccccuccacgccggagagcgccacccuguccgagaagcgccggcgcgcgaagcaggucgugagcgugguccaggacgaggagguggggcugcccuucgaggccucccccgagagcccgccgcccgccagccccgacggggugaccgagauccgggggcuccuggcccagggccugcgccccgaguccccgccgcccgccgggccccuccugaacggcgcgcccgccggggagagcccccagcccaaggccgcccccgaggccuccagcccgcccgcgagcccccugcagcaccuccugcccggcaaggccgucgaccugggcccgcccaagcccuccgaccaggagaccggggagcaggucuccagccccuccagccaccccgcccuccacacgaccaccgaggacuccgccggcgugcagaccgaguucuga

SEQ ID NO: 29908 - RNA, 1494 nt, Artificial Sequence
  derived and/or modified sequence opt1 from FAM134B__Homo_sapiens__NP_001030022
auggccagccccgccccgcccgagcacgcggaggagggcugccccgcccccgccgccgaggagcaggccccgcccuccccgcccccgccccaggcgagccccgccgagcgccagcagcaggaggaggaggcccaggaggccggggcggccgagggcgccgggcuccagguggaggaggccgccggccgggcggccgccgccgucaccuggcuccugggggagcccgugcuguggcucggcugccgcgccgacgagcugcuguccuggaagcggccgcuccgcagccugcugggcuucguggcggccaaccuccuguucugguuccuggcccucacccccuggcgggucuaccaccugaucuccgugaugauccuggggcgcgugaucaugcagaucaucaaggacaugguccucagccggacgcgcggcgcccagcuguggcggucccugagcgaguccugggaggugaucaacagcaagcccgacgagcgcccccggcucucccacugcaucgccgagagcuggaugaacuucuccaucuuccugcaggagaugagccuguucaagcagcagucccccgggaaguucugccugcuggugugcagcgucugcaccuucuucaccauccugggcuccuacauccccggggugauccucagcuaccugcugcuccugugcgcguuccugugcccccucuucaagugcaacgacaucggccagaagaucuacuccaagaucaagagcgugcugcugaagcucgacuucggcaucggggaguacaucaaccagaagaagcgcgagcggagcgaggccgacaaggagaagucccacaaggacgacagcgagcuggacuucuccgcccugugccccaagaucagccucaccgucgccgccaaggagcuguccgugagcgacacggacguguccgaggucagcuggaccgacaacggcaccuucaaccuguccgagggguacaccccgcagacggacaccagcgacgaccucgaccgccccuccgaggagguguucagccgggaccuguccgacuuccccagccuggagaacggcaugggcaccaacgacgaggacgagcucucccuggggcugcccaccgagcucaagcgcaagaaggagcagcuggacagcggccaccggccguccaaggagacgcagagcgcggccgggcugacccucccccugaacuccgaccagaccuuccaccugaugagcaaccuggccggcgacgugaucaccgccgcggucacggccgccaucaaggaccagcucgagggggugcagcaggcccugagccaggccgcgcccauccccgaggaggacaccgacaccgaggagggcgacgacuucgagcugcucgaccaguccgagcuggaccagaucgagagcgagcugggccucacccaggaccaggaggccgaggcccagcagaacaagaaguccagcggguuccuguccaaccugcucggcgggcacuga

SEQ ID NO: 29909 - RNA, 3960 nt, Artificial Sequence
  derived and/or modified sequence opt1 from FAM135A__Homo_sapiens__NP_001099001
augaccgaggugcaggccauggucgaguucagcguggagcugaacaaguucuacaacguggaccucuuccagcgcggcuucuaccagauccgggccuccaugaagauccccagccgcaucccgcaccgggucgaggcgucccugcugcacgccaccgggaugacgcucgccuuccccgccagcgugcacgacucccugaucugcagcaagaccuuccagauccuguacaagaacgaggaggugguccucaacgacgugaugaucuucaaggugaagaugcugcuggacgagcgcaagaucgaggagacccucgaggagaugaacuuccugcugucccucgaccugcacuucaccgacggcgacuacagcgccgacgaccugaacgcgcuccagcugaucuccagccggacgcugaagcuccacuucagcccccaccgcgggcugcaccaccacgucaacgugauguucgacuacuuccaccugagcguggucuccgugaccgugcacgccagccucgucgcccugcaccagccccugaucuccuucccgcggcccgugaagaccaccuggcucaaccgcaacgcccccgcgcagaacaaggacagcgugauccccacgcuggaguccgucguguucggcaucaacuacaccaagcagcugagcccggacgggugcuccuucaucaucgccgacagcuuccuccaccacgccuaccgguuccacuacacccugugcgccacccugcuccuggccuucaagggccugcacagcuacuucaucacggugaccgaggagauccccuccugccagaagcucgagcuggaggagauggacgucgaggcgcgccugaccgagcucugcgaggaggugaagaagaucgagaaccccgacgagcuggccgagcugaucaacaugaaccucgcccagcugugcagccugcucauggcccuguggggccaguuccuggaggugaucacccuccacgaggagcugcggauccugcucgcccaggagcaccacacgcugcgcguccggcgcuucuccgaggcguucuucugcuucgagcacccccgggaggccgccaucgccuaccaggagcugcacgcccagagccaccuccagaugugcaccgcgaucaagaacaccuccuucugcagcucccugccgccccugcccaucgagugcagcgagcuggacggggaccucaacucccugcccaucaucuucgaggaccgcuaccuggacagcgugaccgagggcaagcucgacaucucccaggacgacagcgagaucacgcagauggagcacaaccuggccucccggcgcagcuccgacgacugccacgaccaccagaccaccccgagccuggggguccggaccaucgagaucaagcccuccaacaaggaccccuucagcggcgagaacaucacggugaagcucgggcccuggaccgagcugcgccaggaggagauccugguggacaaccuccugccgaacuucgagucccuggagagcaacggcaagagcaaguccaucgagaucaccuucgagaaggaggcccuccaggaggccaagugccugagcaucggcgagucccugaccaagcuccggagcaaccugcccgcccccuccacgaaggaguaccacgucguggugagcggggacaccaucaagcugcccgacaucuccgcgaccuacgccagcucccgcuucagcgacuccggcgucgagagcgagccguccagcuucgccacccaccccaacacggaccucguguucgagaccgugcaggggcagggccccugcaacuccgagcgccuguucccccagcugcucaugaagccggacuacaacgucaaguucagccugggcaaccacugcaccgaguccaccagcgccaucagcgagauccaguccagccugacguccaucaacagccuccccuccgacgacgagcugagccccgacgagaacuccaagaaguccguggugccggagugccaccugaacgacuccaagaccguccucaaccuggggaccaccgaccugcccaagugcgacgacaccaagaaguccagcaucacgcuccagcagcagagcgugguguucuccggcaaccuggacaacgagaccgucgcgauccacagccugaacuccagcaucaaggacccccuccaguucguguucuccgacgaggagaccagcuccgacgucaagagcagcugcuccagcaagcccaaccuggacaccaugugcaagggguuccaguccccggacaagagcaacaacuccacgggcaccgccaucacccugaacagcaagcucaucugccuggggacccccugcgugaucuccggcagcaucuccagcaacacggacguguccgaggaccggaccaugaagaagaacagcgacgugcugaaccucacccagauguacuccgagauccccaccgucgagagcgagacgcaccugggcaccuccgaccccuucagcgccuccaccgacaucgugaagcaggggcugguggagaacuacuucggcagccaguccagcaccgacaucagcgacacgugcgccgucuccuacagcaacgcccucuccccgcagaaggagaccagcgagaaggagaucuccaaccugcagcaggagcaggacaaggaggacgaggaggaggagcaggaccagcagauggugcagaacggguacuacgaggagaccgacuacagcgcgcuggacggcaccaucaacgcccacuacacgucccgcgacgagcucauggaggagcggcugaccaagagcgagaagaucaacuccgacuaccugcgcgacgggaucaacaugcccaccgugugcaccagcggcugccucuccuuccccagcgcgccccgggaguccccgugcaacgucaaguacagcuccaagagcaaguucgacgccaucacgaagcagcccuccagcaccuccuacaacuucaccagcagcaucuccugguacgagagcucccccaagccccagauccaggccuuccugcaggccaaggaggagcugaagcuccugaagcugccgggcuucauguacagcgaggugccccuccuggccuccagcgugcccuacuucuccgucgaggaggaggacgggagcgaggacggcgugcaccugaucgugugcguccacgggcucgacggcaacuccgccgaccugcgccuggugaagaccuacaucgagcucgggcugcccggcggccggaucgacuuccugaugagcgagcgcaaccagaacgacacguucgccgacuucgacuccaugaccgaccggcuccuggacgagaucauccaguacauccagaucuacagccugaccguguccaagaucagcuucaucgggcacucccucggcaaccugaucauccgcagcguccugacccggccgcgcuucaaguacuaccucaacaagcugcacacguuccugucccucagcgggccccaccugggcacccuguacaacuccagcgcccucgugaacaccggccugugguucaugcagaaguggaagaaguccgggagccugcuccagcugaccugccgggaccacagcgacccccgccagacguuccuguacaagcucuccaacaaggcgggccugcacuacuucaagaacgugguccugguggggagccuccaggaccgguacgugcccuaccacuccgcccgcaucgagaugugcaagaccgcccugaaggacaagcagagcggccagaucuacuccgagaugauccacaaccugcuccggccgguccugcagagcaaggacugcaaccuggugcgcuacaacgugaucaacgcccuccccaacaccgcggacucccugaucgggcgggccgcccacaucgccguccuggacagcgagaucuuccuggagaaguucuuccucguggccgcgcugaaguacuuccaguga

SEQ ID NO: 29910 - RNA, 4221 nt, Artificial Sequence
  derived and/or modified sequence opt1 from FAM135B__Homo_sapiens__NP_056996
augagcgagauccagggcaccguggaguucuccgucgagcugcacaaguucuacaacguggaccucuuccagcgcggguacuaccagauccgggugacccugaaggucagcucccgcaucccccaccggcugagcgccuccaucgccggccagacggagagcuccagccuccacuccgcgugcgugcacgacagcaccgugcacucccgcgucuuccagauccuguaccggaacgaggaggugccgaucaacgacgccguggucuuccgcgugcaccuccugcucgggggcgagcggauggaggacgcccugagcgagguggacuuccagcugaaggucgaccugcacuucaccgacuccgagcagcagcugcgcgacguggccggggcccccauggugagcucccggacccucggccugcacuuccacccccgcaacggccugcaccaccagguccccgugauguucgacuacuuccaccucagcgugaucuccgucacggugcacgcggcccugguggcccugcagcagccgcucaucagcuucacccggcccgggcgcggcuccuggcuggggaagggcgggcccgacaccggccaggagcagagcaucaucagccuggagaaccucgucuucggcgccggguacugcaagcccaccuccagcgagggcuccuucuacaucacgagcgagaacugcaugcagcacgcgcacaaguggcaccgggaccugugccugcuccugcugcacgccuaccgcgggcuccggcugcacuuccuggugaucaugcgcgacaucccggagcucccccacaccgagcuggaggcccuggccguggaggagacccucucccagcugugcagcgagcugcagaugcucaacaaccccgagaagaucgccgagcagaucuccaaggaccuggcguggcugaccagccacaugaugacgcucuggacccaguuccuggacaccgucacccugcacucccaggugacgaccuaccucacccaggagcaccacacccugcggguccgccgguucagcgaggccuucuucuacauggagcaccagaagcuggccgugcucacguuccaggagaaccugauccagacccacucccagcugagccucgacauccgcaacuccgaguaccugaccagcaugcccccgcugcccgccgagugccuggacaucgacggcgacuggaacacccuccccgugaucuucgaggaccgguacgucgacugccccgccacgggccacaaccuguccguguacccgaacuucgacgugcccgucaccagccccaccaucaugaaccugaaggacaaggaggacaacugcauggugaacuccaaccucagcuuccgcgaggaccuggugcuguccaccaucaagcccagccagauggacagcgacgaggaggucauccgcugcccggagcccggggagaacguggcgacgcagaaccacauggacaugugcuccgagagccagguguacaucuccaucggcgaguuccagaacaaggccgggguccccgaggacgagugcuggaccggccagaccagcgacgccgggaccuaccccguggccgacguggacacgucccggcgcagcccgggccccgaggacggccaggcccccguccucaccuacaucgacgugaaguccagcaacaagaaccccucccgggcggagccgcugguggccuucaacgcccagcacgagagccgcuccagccgggacaaguacgggcuggaccgcaccggccucuccaaggucguggucgggggcagccaccagaacgccaucuccagcgacaagaccacgcugcacgagcuguccacccucgggaagggcaucgaccaggagggcaagauggugcugcugagccucaagcugacccccagcgagcccugcgacccgcuguccagcacccuccgggagccccuggacauccgcuccagccugaaggacucccacaccgaggagcaggaggagcucagcgugcuguccggggugaucaagcggagcuccagcaucaucuccgacagcggcaucgaguccgagcccagcuccgucgccuggagcgaggcgcgcucccgggcccuggagcuccccagcgaccgcgaggugcugcacccguucgugcggcgccacgcccugcaccggaacucccucgagggcgggcacacggagagcaacaccagccugcccuccgggauccaggccagccugaccuccaucagcucccuccccuucgaggaggacgagcgcgaggucgcgcugaccaagcugaccaagagcguguccgcgccccacaucagcuccccggaggaggccgccgaggacgccgacaccaagcagcaggacggcggcuucgccgagcccagcgacaugcacuccaagagccaggggucccccggcagcugcucccagcucugcggggacagcggcaccgacgccggcgccgaccacccccugguggagaucguccuggacgccgacaaccagcaggggccgggcuacaucgacauccccaaggggaagggcaagcaguucgacgcccaggggcacugccuccccgacggccggaccgagaacacgcccggcguggagaccaaggggcugaaccugaagaucccgcgcgugaucgcgcucgagaacccccggacccgcucccugcaccgcgcccuggaggagacccccaagggcaugcccaaggaccucaacgucgggcagcaggcccugagcaacuccggcaucagcgagguggaggggcugagccagcaccaggugccggagcucuccugcacgagcgccgccgacgcgaucaaccggaacuccaccggccagcagagccaguccggcagccccugcaucauggacgacaccgccuucaaccgcggggucaacgccuuccccgaggccaagcacaaggcgggcaccgugugccccacggugacccacuccguccacagccaggugcugaagaaccaggagcugaaggccgggaccuccaucaugggcagccaccucaccuccgccgagacguucacccuggacagccugaaggccguggaggucgugaaccucuccgugagcugcaccgccacgugccugccguucuccagcguccccaaggagacgcccgcgcgggccggguucuccagcaagcagacccuguucccgaucacccaccagccccucggcuccuucggcguggugagcacccacagcuccacgcuggacgaggaggucagcgagcgcauguucuccuucuaccaggccaaggagaaguucaagaaggagcugaagaucgagggguuccucuacagcgaccugaccgugcuggccuccgacauccccuacuucccgcccgaggaggaggaggagaaccucgaggacggcauccaccugguggucugcgugcacgggcuggacggcaacagcgccgaccuccggcuggucaagaccuucaucgagcuggggcuccccggcggcaagcuggacuuccugauguccgagaagaaccagauggacaccuucgcggacuucgacacgaugaccgaccgccuccuggacgagaucauccagcacauccagcuguacaaccucagcaucucccggaucagcuucaucgggcacucccugggcaacaucaucauccgcagcgugcugacccggccccgcuuccgguacuaccucaacaagcugcacaccuuccugucccucagcgggccccaccugggcacgcuguacaacaacuccacccucgugagcaccggccuguggcugaugcagaagcucaagaaguccgggagccugcugcagcucaccuuccgcgacaacgccgaccugcggaagugcuuccuguaccagcucucccagaagaccggccugcaguacuucaagaacgucgugcugguggccagcccgcaggaccgcuacguccccuuccacagcgcccggaucgagaugugcaagacggcccucaaggaccgccacaccgggcccguguacgcggagaugaucaacaaccugcugggcccccugguggaggccaaggacugcacccucauccggcacaacgucuuccacgcccugccgaacaccgccaacacgcugaucgggcgcgcggcccacaucgccgugcucgacuccgagcuguuccuggagaaguucuuccucguggccggccugaacuacuucaaguga

SEQ ID NO: 29911 - RNA, 417 nt, Artificial Sequence
  derived and/or modified sequence opt1 from FAM136A__Homo_sapiens__NP_116211
auggccgagcugcagcagcuccgcgugcaggaggccgucgagagcauggugaagucccuggagcgggagaacauccgcaagaugcagggccugauguuccggugcagcgcguccugcugcgaggacagccaggccuccaugaagcagguccaccagugcaucgagcgcugccacgugccccucgcccaggcccaggcccuggugaccagcgagcuggagaaguuccaggaccggcucgcgcgcugcaccaugcacugcaacgacaaggccaaggacuccaucgacgccgggagcaaggagcuccaggugaagcagcagcuggacuccugcgucacgaagugcguggacgaccacaugcaccugaucccgaccaugaccaagaagaugaaggaggcccugcugagcaucggcaaguga

SEQ ID NO: 29912 - RNA, 2094 nt, Artificial Sequence
  derived and/or modified sequence opt1 from FAM13A__Homo_sapiens__NP_001015045
auggccugcgagaucaugccccugcagagcucccaggaggacgagcgcccgcucagccccuucuaccuguccgcccacgugccccaggucagcaacguguccgcgaccggcgagcugcucgagcggaccauccgcagcgccguggagcagcaccuguucgacgucaacaacuccgggggccagagcuccgaggacagcgaguccgggacgcugagcgccuccagcgccaccuccgcccggcagcgccggcgccagagcaaggagcaggacgaggugcggcacggccgcgacaaggggcucaucaacaaggagaacacccccuccggcuucaaccaccuggacgacugcauccugaacacccaggagguggagaagguccacaagaacacguucggcugcgcgggggagcggagcaagccgaagcgccagaaguccagcaccaagcucagcgagcugcacgacaaccaggacggccuggugaacauggagucccucaacagcacccggucccacgagcgcaccgggcccgacgacuucgaguggaugagcgacgagcggaagggcaacgagaaggacgggggccacacgcagcacuucgagucccccaccaugaagauccaggagcaccccagccuguccgacaccaagcagcagcgcaaccaggacgccggcgaccaggaggagagcuucguguccgaggucccgcagagcgaccugaccgcccucugcgacgagaagaacugggaggagcccauccccgccuucuccagcuggcagcgggagaacuccgacagcgacgaggcgcaccugagcccccaggccgggcgccugauccggcagcuccuggacgaggacuccgacccgaugcugagcccccgcuucuacgccuacggccagucccggcaguaccucgacgacacggaggugccgcccuccccgcccaacagccacagcuucaugcgccggcgcuccagcucccuggggagcuacgacgacgagcaggaggaccugacccccgcccagcucacccgccggauccagucccugaagaagaagauccgcaaguucgaggaccgguucgaggaggagaagaaguaccgccccagccacuccgacaaggccgcgaaccccgaggugcugaaguggaccaacgaccucgccaaguuccggcgccagcugaaggagagcaagcugaagaucuccgaggaggaccucacgccccggaugcgccagcggagcaacacccugcccaaguccuucggcagccagcuggagaaggaggacgagaagaagcaggagcucgucgacaaggccaucaagcccuccguggaggccacccuggagagcauccagcgcaagcugcaggagaagcgggccgaguccagccgcccggaggacaucaaggacaugaccaaggaccagaucgcgaacgagaagguggcccuccagaaggcccugcuguacuacgaguccauccacggccggcccgucacgaagaacgagcgccaggugaugaagccccucuacgaccgguaccgccuggugaagcagauccugagccgggccaacaccauccccaucaucgggagcccguccagcaagcgccggagcccccuccugcagcccaucaucgagggcgagaccgccuccuucuucaaggagaucaaggaggaggaggagggguccgaggacgacagcaacgucaagccggacuucauggugacccugaagacggacuucuccgcgcgcugcuuccucgaccaguucgaggacgacgccgacggcuucaucagccccauggacgacaagauccccuccaagugcagccaggacaccgggcuguccaaccugcacgccgccagcauccccgagcuccuggagcaccuccaggagaugcgcgaggagaagaagcggauccgcaagaagcugcgggacuucgaggacaacuucuuccgccagaacggccggaacgugcagaaggaggaccgcaccccgauggccgaggaguacuccgaguacaagcacaucaaggcgaagcugcggcugcuggagguccucaucagcaagcgcgacaccgacuccaagagcauguga

SEQ ID NO: 29913 - RNA, 1464 nt, Artificial Sequence
  derived and/or modified sequence opt1 from FAM13C__Homo_sapiens__NP_001001971
auguucagcugcuucugcuucucccugcaggacaacagcuucuccagcaccaccgugacggagugcgacgaggaccccgucucccuccacgaggaccagaccgacugcagcucccugcgcgacgagaacaacaaggagaacuacccggacgccggcgcccugguggaggagcacgcgccgcccagcugggagccccagcagcagaacguggaggccaccguccucguggacuccgugcugcggcccagcauggggaacuucaagucccgcaagcccaagagcaucuucaaggccgaguccggccggagccacggggagucccaggagaccgagcacgucgugagcucccagagcgagugccaggugcgcgccggcacgcccgcccacgagagcccccagaacaacgcguucaagugccaggagaccguccggcugcagccgcgcaucgaccagcggaccgccaucucccccaaggacgccuucgagacccgccaggaccucaacgaggaggaggccgcccaggugcacggggugaaggaccccgcgcccgccagcacgcaguccguccuggccgacggcaccgacagcgccgacccgucccccgugcacaaggacggccagaacgaggcggacagcgcccccgaggaccugcacuccguggggaccagccggcuccuguaccacaucaccgacggcgacaacccccugcucuccccgcgcugcagcaucuucucccagagccagcgguucaaccuggaccccgaguccgcccccagcccgcccuccacgcagcaguucaugaugccccgcagcuccagccggugcuccugcggggacggcaaggagccccagaccaucacccagcugaccaagcacauccagagccucaagcgcaagauccggaaguucgaggagaaguucgagcaggagaagaaguaccgcgucacgaagcaggacaagaaccugaucaagccccuguacgaccgguaccgcaucaucaagcagauccucuccaccccgagccugauccccaccauccaggaggaggaggacagcgacgaggaccggccccaggggucccagcagcccagccuggccgacccggccucccaccuccccgugggcgaccaccugaccuacagcaacgagacggagcccgugcgcgcgcugcucccggacgagaagaaggaggucaagccgcccgcccuguccaugagcaaccugcacgaggccaccaugcccgugcuccuggaccaccuccgggagacccgcgccgacaagaagcgccugcggaaggcccugcgcgaguucgaggagcaguucuucaagcagaccggccggagcccccagaaggaggaccgcauccccauggcggacgaguacuacgaguacaagcacaucaaggccaagcugcggcuccuggaggugcugaucuccaagcaggacgucgccaagacgaucuga

SEQ ID NO: 29914 - RNA, 1449 nt, Artificial Sequence
  derived and/or modified sequence opt1 from FAM149A__Homo_sapiens__NP_056213
augcuguucgagggcaaggugaacccccagacccagagccuccuggccgagugcggggaguggacccgccggucccugcaccuccgcguccugggccggcagcugauccucccgacggacaagggggugcagcacuuccagggcagcacccccgccuccgcggugcaccgcccgccccugagcgccugcgggcacuccagcaacauccgggagcugugcaucuccggcagccagaucguccccgccgcccucuccgccagcgcgcugcccggccccgacgacaccgggguggccgaccugaccgcccgcuccagccucgaggaggagguguaccacgucgacggcaagaucgaggaguacuucgccuucgaccggaaggaggacgacgacgagugccuggagcagaagcccgcgcagccggggcgcaaguggcggaagcugggccucccgcccgugagcccccgcgacugcgugaaggacgccgucgccgccgagguguucgaccacguguggacgaacauggucgagcugcuggaggagcucauccggaagcacugggagaccacccugaccgaggggaagaagcagcgcgagacgcugaagguggccggcaaccgguucccccacgugcucgucccccacgcgcacgccgacggcgccuccgggccgcccuccggccacgccgaggcccacgggaucagccuggcgucccgccugaacccgccccagauccaccacuucagcuccagcuucuacagcgacaugaacggcgugaugaccauccaggccaagccccuccagcggcgccccgccuacuucgccgaccggacccagaacgagaaggaggacaaggccuccggcgggggcgcgggggcccugagcuccgcgccccaccgccugggccgggccagcgacacccacgggcucucccccagcgccaagaagacgcccgugcccuggcgccugccgucccuggccagcgacucccagcggcucaagacccccaacaucuacagcgacgagguccugcgcggcaccaagcugcccaccggcguggaccacauggccagcccccucgugcagacgucccgcucccgguucccgccccuggucaccgagacccgcgggcagaacaccgccgugcccggcugccggcuggugagcuaccgcgggcggcaccuccagaaccgcguccuguccgccaugccggacggcacggagcggagccgccugcgggagcgcaccgcgacccucgagcggcugucccgccccagcaccacgcacaccuuccggcaguccgacacgccccgcaagagcagccugacccagauggaguucgccgcccacaccuggaccgggcaguccauccucaccggcagccaguacgugcccaaguccuuccagcggaccacgcugaccuucaagcgccgguuccaggucaccagcuga

SEQ ID NO: 29915 - RNA, 459 nt, Artificial Sequence
  derived and/or modified sequence opt1 from FAM150B__Homo_sapiens__NP_001002919
augcgcggccccgggcacccgcugcuccugggccugcuccuggugcugggggccgccggccgggggcgcggcggcgcggagccccgggagcccgccgacgggcaggcccuccugcgccuggucguggagcucgugcaggagcugcggaagcaccacagcgccgagcacaagggccugcagcuccuggggcgcgacugcgcccugggccgggcggaggccgccgggcucggccccuccccggagcagcgcgucgagaucgugccccgggaccugcgcaugaaggacaaguuccugaagcaccucaccggcccccuguacuucagccccaagugcuccaagcacuuccaccggcuguaccacaacacccgcgacugcacgaucccggccuacuacaagcggugcgcgcgccuccugacccggcuggccgugagccccgucugcauggaggacaagcaguga

SEQ ID NO: 29916 - RNA, 1377 nt, Artificial Sequence
  derived and/or modified sequence opt1 from FAM155A__Homo_sapiens__NP_001073865
augacccgcggcgccuggaugugccggcaguacgacgacgggcugaagaucuggcucgccgcgccccgcgagaacgagaagccguucaucgacagcgagcgggcccagaaguggcgccugucccuggccagccuccuguucuucaccgugcugcucuccgaccaccugugguucugcgccgaggccaagcugacgcgggcgcgcgacaaggagcaccagcagcagcagcggcagcagcagcagcagcagcagcagcagcgccagcggcagcagcagcagcagcagcgccggcagcaggagcccagcuggcccgcccuccuggccuccaugggcgagagcucccccgccgcgcaggcccaccgccugcucagcgccuccagcuccccgacccugccgcccagccccggggacggcgggggcggcgggggcaaggggaaccggggcaaggacgaccgcgggaaggcccuguuccucggcaacuccgccaagcccgucuggcggcuggagaccugcuacccccagggcgcgagcuccgggcagugcuucaccguggagaacgccgacgccgugugcgcccgcaacuggagccggggcgccgccgggggcgacggccaggagguccgcuccaagcaccccacgccccuguggaaccucagcgacuucuaccuguccuucugcaacagcuacacccugugggagcuguucagcgggcucuccagcccgaacacccugaacugcucccucgacguggugcugaaggagggcggggagaugaccacgugccggcagugcgucgaggcguaccaggacuacgaccaccacgcccaggagaaguacgaggaguucgagagcgugcugcacaaguaccuccaguccgaggaguacagcgugaaguccugccccgaggacugcaagaucgucuacaaggccuggcugugcagccaguacuucgaggugacccaguucaacugccgcaagaccauccccugcaagcaguacugccuggaggugcagacccggugccccuucauccucccggacaacgacgaggucaucuacggcgggcuguccagcuucaucugcacgggccuguacgagaccuuccucaccaacgacgagcccgagugcugcgacgugcgccgcgaggagaaguccaacaaccccagcaagggcaccguggagaaguccgggagcugccaccggacgucccugaccgucagcuccgccacccgccugugcaacagccggcucaagcugugcgugcuggugcucauccugcugcacaccguccucacggcguccgccgcccagaacaccgccggccugagcuucgggggcaucaacacccuggaggagaacagcaccaacgaggaguga

SEQ ID NO: 29917 - RNA, 2217 nt, Artificial Sequence
  derived and/or modified sequence opt1 from FAM160B1__Homo_sapiens__NP_001128523
auguucagcaaguucaccuccauccugcagcacgccguggaggcccucgcgcccagccugccgcugcaggaggacuucgucuaccacuggaaggccaucacccacuacuacaucgagacguccgacgacaaggcccccgugaccgacaccaacauccccagccaccucgagcagaugcuggacauccuggugcaggaggagaacgagcgcgaguccggcgagaccgggcccugcauggaguaccuccugcaccacaagauccuggagacgcucuacacccugggcaaggccgacugcccgcccgggaugaagcagcagguccugguguucuacaccaagcuccugggccggauccgccagccccugcucccccacaucaacgugcaccggccgguccagaagcugauccgccugugcggggaggugcucgccacccccacggagaacgaggagauccaguuccugugcaucgugugcgcgaagcugaagcaggaccccuaccucgucaacuucuuccuggagaacaagaugaagucccuggccagcaagggcgugcccaacgugaucagcgaggacacccucaagggccaggacucccugagcaccgacaccgggcagucccggcagccggaggagcugagcggcgccacggggauggagcagaccgagcucgaggacgagccgccccaccagauggaccaccuguccaccagccuggacaaccucuccgucaccagccugcccgaggccuccguggugugccccaaccaggacuacaaccuggucaacagccuccugaaccugacgcgcucccccgacggccggaucgcggugaaggccugcgaggggcucaugcugcuggugagccuccccgagcccgccgccgccaagugccugacccagagcacgugccugugcgagcuccugaccgaccgccuggcgucccucuacaaggcccugccgcagagcgucgacccccuggacaucgagaccguggaggccaucaacuggggccucgacuccuacagccacaaggaggacgccuccgccuuccccggcaagcgggcgcugaucagcuuccuguccugguucgacuacugcgaccagcugaucaaggaggcccagaagaccgccgccguggcccucgcgaaggccguccacgagcgcuucuucaucggggugauggagccccagcugaugcagaccagcgagaugggcauccugaccuccacggcccuccugcaccggaucgugcgccaggucaccagcgacgugcugcuccaggagauggucuucuucauccugggggagcagcgggagccggagacccuggccgagaucucccgccacccccuccggcaccgccugaucgagcacugcgaccacaucagcgacgagaucuccaucaugacccugcggauguucgagcaccuccugcagaagcccaacgagcacauccuguacaaccucgugcugcgcaaccuggaggagcggaacuacacggaguacaagccccucugcccggaggacaaggacguggucgagaacggccugaucgccggcgcgguggaccuggaggaggacccccucuucaccgacaucagccccgagaacacccugccgaaccaggaguggcuguccagcuccccgcccgccacccccgaccaccccaagaacgacgggaagacggaggugcacaagaucgucaacagcuuccucugccuggugcccgacgacgccaaguccagcuaccacguggagggcaccggguacgacaccuaccugcgcgacgcccaccggcaguuccgcgacuacugcgcgaucugccuccgcugggaguggcccggcagccccaaggcccuggagaagugcaaccuggaggccgccuucuucgaggggcacuuccucaagguccuguucgaccggaugggccgcauccuggaccagccguacgacgugaaccuccaggugaccuccguccugagccggcugucccucuucccccacccccacauccacgaguaccugcuggaccccuacgugaaccucgccccgggcugccgcagccuguucuccgugaucguccggguggugggggaccugaugcuccgcauccagcggauccaggacuucacgcccaagcugcugcucguccgcaagcggcugcugggccucgagcccgaggggcccaugcagacccugccgagcuggugguga

SEQ ID NO: 29918 - RNA, 2151 nt, Artificial Sequence
  derived and/or modified sequence opt1 from FAM161A__Homo_sapiens__NP_001188472
auggccaccagccaccgcguggccaagcuggucgcguccagccuccagacccccgugaacccgaucacgggcgcccggguggcccaguacgagcgcgaggacccccugaaggcccuggccgcggccgaggccauccucgaggacgaggaggaggagaaggucgcccagcccgcgggggccuccgccgaccugaacaccagcuucuccggcguggacgagcacgcccccaucagcuacgaggacuucgugaacuucccggacauccaccacuccaacgaggaguacuucaagaaggucgaggagcugaaggccgcgcacaucgagaccauggccaagcucgagaagauguaccaggacaagcugcaccugaaggaggugcagcccguggucauccgggaggacagccucuccgacagcucccgcagcguguccgagaagaacagcuaccaccccgugucccugaugaccagcuucuccgagcccgaccuggggcagagcuccagccucuacgucagcuccagcgaggaggagcugccgaaccuggagaaggaguacccccggaagaaccgcaugaugacguacgccaaggagcucaucaacaacauguggaccgacuucugcguggaggacuacauccggugcaaggacaccggcuuccacgccgccgagaagcgccggaagaagcgcaaggagugggugcccaccaucacgguccccgagccguuccagaugaugauccgggagcagaagaagaaggaggaguccaugaaguccaaguccgacaucgagauggugcacaaggcgcugaagaagcaggaggaggaccccgaguacaagaagaaguuccgcgccaaccccgugcccgccagcgucuuccugccgcucuaccacgaccuggugaagcagaaggaggagcggcgccggucccugaaggagaaguccaaggaggcccuccuggccagccagaagcccuucaaguucaucgcgcgcgaggagcagaagcgggccgcccgcgagaagcagcugcgggacuuccucaaguacaagaagaagaccaaccgcuucaaggcccggcccaucccccgcagcaccuacggguccaccacgaacgacaagcugaaggaggaggagcuguaccgcaaccuccggacccagcugcgcgcccaggagcaccuccagaacagcuccccgcugcccugccggagcgcgugcggcugccgcaacccccggugccccgagcaggccgugaagcugaagugcaagcacaagguccgcugcccgacccccgacuucgaggaccugcccgagcgguaccagaagcaccucuccgagcacaagagccccaagcugcugaccgugugcaagccguucgaccuccacgccagcccccacgccagcaucaagcgcgagaagauccuggcggacaucgaggccgacgaggagaaccugaaggagacgcgguggcccuaccucuccccgcgccgcaagagccccgugcggugcgccggcgucaaccccgugcccugcaacugcaacccgcccguccccaccgugagcucccgggggcgcgagcaggccgugcggcgcagccuggaggagaagaagaugcuggaggaggagcggaaccgcauccucaccaagcagaagcagcggaugaaggagcugcagaagcugcucaccacgcgcgccaaggcguacgacucccaccagagccuggcccagaucuccaagagccgcgucaagugccugcggaaguccgagaaggagcgcaugcgggaguaccagcgcgagcucgaggagcgggaggagaagcugaagaagcgcccccugcuguucgagcggguggcccagaagaacgcccgcauggccgcggagaagcacuacagcaacacccucaaggcccugggcaucuccgacgaguucgugagcaagaaggggcaguccggcaagguccuggaguacuucaacaaccaggagaccaagagcgugaccgaggacaaggaguccuucaacgaggaggagaagaucgaggagcgggagaacggggaggagaacuacuucaucgacacgaacagccaggacuccuacaaggagaaggacgaggccaacgaggagagcgaggaggagaaguccguggaggagagccacuga

SEQ ID NO: 29919 - RNA, 504 nt, Artificial Sequence
  derived and/or modified sequence opt1 from FAM163A__Homo_sapiens__NP_775780
augaccgccggcaccguggucaucaccgggggcauccuggccaccgugauccuccugugcaucaucgccgugcugugcuacugccgccuccaguacuacugcugcaagaaguccgggaccgaggucgccgacgaggaggaggagcgggagcacgaccugcccacccacccgcgcggccccacgugcaacgccugcagcagccaggcccuggacgggcggggcucccucgcgccccugaccagcgagcccugcucccagccgugcggcguggccgccagccacugcacgaccugcucccccuacagcucccccuucuacauccgcacggccgacauggugcccaacgggggcgggggcgagcggcugagcuucgccccgaccuacuacaaggagggcgggccgcccucccucaagcuggcggcgccccagagcuaccccgucaccuggcccggcuccgggcgcgaggccuucaccaacccccgggccaucagcacggacguguga

SEQ ID NO: 29920 - RNA, 501 nt, Artificial Sequence
  derived and/or modified sequence opt1 from FAM163B__Homo_sapiens__NP_001073984
augaccgccggcaccguggucaucacggggggcauccuggccaccgugauccuccugugcaucaucgcggugcugugcuacugccgccuccaguacuacugcugcaagaaggacgagagcgaggaggacgaggaggagcccgacuucgccguccacucccaccugccgccccugcacagcaaccggaaccucgugcugaccaacgggcccgcccuguaccccaccgccuccacgagcuucucccagaagagcccgcaggcccgcgcgcucugccgguccugcagccacugcgagccccccaccuucuuccugcaggagcccccggaggaggaggaggacgugcugaacggcggggagcgcguccucuacaaguccgugagccaggaggacguggagcugccccccggcggcuucgggggccugcaggcccucaaccccaaccggcuguccgccaugcgcgaggccuucgcgcggagccgcuccaucagcaccgacgucuga

SEQ ID NO: 29921 - RNA, 645 nt, Artificial Sequence
  derived and/or modified sequence opt1 from FAM167A__Homo_sapiens__NP_444509
augagcgugccccagauccacgucgaggaggugggcgccgaggagggggccggcgcggccgccccgcccgacgaccaccuccgcucccugaaggcccugaccgagaagcugcggcucgagacccgccggcccagcuaccuggaguggcaggcccgccuggaggagcacaccuggcccuucccgcggcccgcggccgagccccaggccucccucgaggagggggagcgcggcgggcaggagccccugcugccgcuccgggaggccggccagcacccgcccagcgcgcgcuccgccagccagggcgcccggccccuguccaccgggaagcuggagggcuuccagagcaucgacgaggccaucgccuggcuccgcaaggagcugaccgagaugcggcugcaggaccagcagcucgcgcgccagcugaugcggcugcgcggggacaucaacaagcucaagaucgagcacacgugccggcugcaccgccggaugcugaacgacgccaccuacgagcucgaggagcgcgacgagcuggccgaccuguucugcgacagcccccucgccuccuccuucagccuguccacgccccugaagcucaucggcgugaccaagaugaacaucaacagccggcgcuucucccugugcuga

SEQ ID NO: 29922 - RNA, 735 nt, Artificial Sequence
  derived and/or modified sequence opt1 from FAM168A__Homo_sapiens__NP_001272979
augaaccccguguacagcccgguccagcccggcgcccccuacgggaaccccaagaacauggccuacaccggcuacccgaccgcguaccccgccgccgcccccgccuacaaccccucccuguacccgacgaacagccccuccuacgcgcccgaguuccaguuccuccacagcgccuacgccacccugcugaugaagcaggccuggccccagaacuccagcuccugcgggaccgagggcaccuuccaccucccgguggacacggggaccgagaaccgcaccuaccaggcgagcuccgccgccuuccgguacaccgccggcacgcccuacaaggugccgcccacccagagcaacaccgcgcccccgcccuacucccccagccccaaccccuaccagaccgccauguaccccauccgcuccgccuacccccagcagaaccuguacgcccagggcgccuacuacacgcagccggucuacgccgcgcagccccacgugauccaccacaccaccgugguccagcccaacagcauccccuccgccaucuacccggcccccguggccgcgccccggaccaacgggguggccaugggcauggucgccgggacgaccauggccaugagcgccggcacccugcucaccacgccgcagcacaccgccaucggggcgcaccccguguccaugcccaccuaccgcgcccagggcacccccgccuacagcuacgugccgccccacugguga

SEQ ID NO: 29923 - RNA, 588 nt, Artificial Sequence
  derived and/or modified sequence opt1 from FAM168B__Homo_sapiens__NP_001009993
augaaccccguguacagcccgggcuccagcgggguccccuacgccaacgccaagggcaucggguaccccgcgggcuuccccaugggguacgccgccgccgccccggcguacucccccaacauguaccccggcgccaaccccaccuuccagaccggcuacacgccggggacccccuacaaggugagcugcucccccaccagcggcgccgugcccccguacuccagcucccccaaccccuaccagaccgccgucuaccccgugcgcagcgcguacccgcagcagucccccuacgcccagcaggggacguacuacacccagccccuguacgccgcgcccccgcacgugauccaccacaccaccgucgugcagcccaacggcaugcccgccacgguguaccccgccccgaucccgccgccccgggggaacggcgucaccaugggcaugguggccgggaccaccauggccaugagcgccggcacgcuccugaccgcccacucccccacccccguggcgccccaccccgucaccgugcccacguaccgcgcccccgggacccccaccuacagcuacgugccgccccagugguga

SEQ ID NO: 29924 - RNA, 579 nt, Artificial Sequence
  derived and/or modified sequence opt1 from FAM169B__Homo_sapiens__NP_872368
augaaggugcagagcuucggcgagcgcgucgugcuguucauccucaacgccaucaucuucgggcggcuggagcgcaaccuggacgacgacgacauguucuuccucccccacuccgugaaggagcaggccaagauccuguggcggcgcggcgcggccgucggguucuacaccaccaagaugaagggccggcugugcggggacggcacgggcgccugcuaccuccugccgguguucgacaccguguucauccgccggaagcacuggcaccgcgggcugggcaccgccaugcuccgggacuucugcgagaccuuccccgaggacgaggcccugggggucagcugcuccaugagccccgcgauguaccaggcccaccccggcaacuccgaggacgugagccgccacgcccggacgucccagaacgaccgcccgcggcagcccgcccccggggacggcagcaaggagcgcaugugcggcgaggagcuggaggacaccaaggacgaccccgagugcgggguggaggaggaggacgcgggccucgccgggcagccgcccggcaagcugacccgguccagccccuga

SEQ ID NO: 29925 - RNA, 849 nt, Artificial Sequence
  derived and/or modified sequence opt1 from FAM170A__Homo_sapiens__NP_001157463
augaagcgccggcagaagcgcaagcaccuggagaacgaggagagccaggagaccgccgagaagggcgggggcauccagcggauccaccgcgacuccccgcagccccagagcccccucgcccaggugcaggagcgcggggagaccccgccccggucccagcacgucagccuguccagcuacuccagcuacaagacgugcguguccagccugugcgugaacaaggaggagcggggcaugaagaucuacuacaugcagguccagaugaacaaggggguggcgguguccugggagaccgaggagacccucgagagccuggagaagcagccccgcauggaggaggucacccuguccgagguggugcgggucggcacgccgcccagcgacguguccacccgcaaccuccugagcgacuccgagcccagcggcgaggagaaggagcacgaggagcggaccgaguccgacagccugcccgggagccccaccguggaggacacgccccgcgccaagacccccgacuggcucgucaccauggagaacggcuuccggugcauggccugcugccgcguguucaccacgauggaggcccugcaggagcacgugcaguucgggauccgggagggcuucuccugccacgucuuccaccugaccauggcccagcucaccgggaacauggagagcgaguccacccaggacgagcaggaggaggagaacggcaacgagaaggaggaggaggagaagccggaggcgaaggaggaggagggccagcccacggaggaggaccuggggcugcgccggagcuggucccagugccccggcugcguguuccacagccccaaggaccgcaacuga

SEQ ID NO: 29926 - RNA, 1113 nt, Artificial Sequence
  derived and/or modified sequence opt1 from FAM172A__Homo_sapiens__NP_001156889
augaagaaggacgagcccccgcuggacuuccccgacacccucgagggcuucgaguacgccuucaacgagaaggggcagcugcgccacaucaagaccggcgagcccuucguguucaacuaccgggaggaccugcaccgcuggaaccagaagcgguacgaggcccucggggagaucaucacgaaguacgucuacgagcugcuggagaaggacugcaaccucaagaaggugagcauccccguggacgcgaccgaguccgagcccaagagcuucaucuucauguccgaggacgcccugaccaacccgcagaagcugaugguccucauccacggcagcgggguggugcgcgccggccagugggcccggcgccugaucaucaacgaggaccuggacuccggcacccagauccccuucaucaagcgggccgucgcggagggguacggcgugaucgugcucaaccccaacgagaacuacaucgaggucgagaagccgaagauccacgugcagagcuccagcgacuccagcgacgagcccgccgagaagcgcgagcggaaggacaagguguccaaggagacgaagaagcgccgggacuucuacgagaaguaccgcaacccccagcgggagaaggagaugaugcagcuguacauccgcgagaacgggagccccgaggagcacgccaucuacgucugggaccacuucaucgcccaggcggccgccgagaacguguucuucguggcccacuccuacggcgggcuggccuucgucgagcucaugauccagcgggaggcggacgugaagaacaaggugaccgccgucgcccugaccgacagcgugcacaacguguggcaccaggaggccggcaagaccauccgcgaguggaugcgggagaacugcugcaacugggucuccagcuccgagccgcuggacacgagcguggaguccaugcuccccgacugcccccgcgugagcgccggcaccgaccggcacgagcugaccagcuggaaguccuuccccagcaucuucaaguucuucaccgaggcguccgaggccaagacgagcucccugaagccggccgucacccgccggagccaccgcaucaagcacgaggagcucuga

SEQ ID NO: 29927 - RNA, 702 nt, Artificial Sequence
  derived and/or modified sequence opt1 from FAM173B__Homo_sapiens__NP_954584
auggagggcgggggcgggaucccccuggagacccucaaggaggagagccagucccgccacgugcugccggccagcuucgaggucaacucccugcagaaguccaacuggggcuuccuccugaccgggcuggugggcggcacgcucguggccgucuacgcgguggccacccccuucgugacccccgcccugcggaaggucugccugcccuucgugccggccaccacgaagcagaucgagaacguggucaagaugcuccgcugccggcgcgggagccugguggacaucggcagcggggacggccggaucgugaucgccgcggccaagaagggguucaccgccgucggcuacgagcugaaccccuggcucgugugguacucccgcuaccgggccuggcgcgagggcgugcacgggagcgcgaaguucuacaucuccgaccuguggaaggucaccuucagccaguacuccaacguggugaucuucggcgucccccagaugaugcugcagcucgagaagaagcuggagcgggagcuggaggacgacgcccgcgugaucgccugccgguuccccuucccgcacuggacccccgaccacgugacgggggagggcaucgacaccgucugggccuacgacgccagcaccuuccgcggccgggagaagcgccccugcaccuccaugcacuuccagcuccccauccaggcguga

SEQ ID NO: 29928 - RNA, 573 nt, Artificial Sequence
  derived and/or modified sequence opt1 from FAM174A__Homo_sapiens__NP_940909
augaaggccagccagugcugcugcugccugucccaccuccuggccagcgugcugcuccugcugcuccugcccgagcuguccggcccgcucgcgguccugcugcaggccgccgaggccgcccccgggcucggcccgcccgacccccgcccccggacccugccgccccugccgcccgggcccacccccgcgcagcagcccggccgcgggcucgccgaggccgccggcccccggggcagcgagggcgggaacggguccaaccccguggcgggccuggagaccgacgaccacgggggcaaggccggcgaggggagcgugggcgggggccuggccgucucccccaacccgggcgacaagcccaugacccagcgcgcccucaccgugcugaugguggucagcggggccgugcugguguacuucgucgugcggaccgugcgcaugcggcgccggaaccgcaagacgcggcgcuacggcguccucgacaccaacaucgagaacauggagcugacgccccuggagcaggacgacgaggacgacgacaacacccucuucgacgcgaaccacccccggcgcuga

SEQ ID NO: 29929 - RNA, 1230 nt, Artificial Sequence
  derived and/or modified sequence opt1 from FAM175A__Homo_sapiens__NP_620775
auggagggcgagagcaccuccgccgugcugagcggguucguccucggcgcccuggcguuccagcaccugaacaccgacuccgacacggagggguuccuccugggcgaggugaagggggaggccaagaacagcaucaccgacucccagauggacgacguggaggucguguacaccaucgacauccagaaguacauccccugcuaccagcuguucagcuucuacaacuccagcggcgaggugaacgagcaggcccucaagaagauccuguccaacgucaagaagaacguggugggcugguacaaguuccgccggcacagcgaccagaucaugaccuuccgcgagcggcugcuccacaagaaccugcaggagcacuucuccaaccaggaccuggucuuccuccugcugacgccgagcaucaucaccgaguccugcagcacccaccgccucgagcacucccuguacaagccccagaaggggcuguuccaccgggugccccucguggucgccaaccugggcaugagcgagcagcugggguacaagaccguguccggcagcugcauguccacgggguucagccgcgccgugcagacccacagcuccaaguucuucgaggaggacggcagccucaaggagguccacaagaucaacgagauguacgcgucccugcaggaggagcucaagagcaucugcaagaagguggaggacuccgagcaggccguggacaagcuggucaaggacgugaaccggcugaagcgcgagaucgagaagcggcgcggcgcccagauccaggccgcgcgggagaagaacauccagaaggacccccaggagaacaucuuccugugccaggcccuccgcaccuucuucccgaacagcgaguuccugcacuccugcgugaugagccugaagaaccggcacgucuccaagagcuccugcaacuacaaccaccaccucgacgugguggacaaccugacccugauggucgagcacacggacauccccgaggccagccccgccuccacgccccagaucaucaagcacaaggcccucgaccuggacgaccgcuggcaguucaagcggagccgccugcucgacacccaggacaagcgguccaaggcggacaccgggagcuccaaccaggacaaggccagcaagauguccagcccggagaccgacgaggagaucgagaagaugaagggcuucggggaguacagccgcucccccaccuucuga

SEQ ID NO: 29930 - RNA, 1248 nt, Artificial Sequence
  derived and/or modified sequence opt1 from FAM175B__Homo_sapiens__NP_115558
auggccgccagcaucuccggcuacaccuucagcgcggugugcuuccacuccgccaacagcaacgccgaccacgagggguuccugcucggcgagguccgccaggaggagaccuucuccaucagcgacucccagaucagcaacacggaguuccuccaggugaucgagauccacaaccaccagcccugcuccaagcuguucagcuucuacgacuacgccuccaaggugaacgaggagagccucgaccggauccugaaggaccgccggaagaaggucaucgggugguaccgcuuccggcgcaacacccagcagcagauguccuaccgggagcagguccugcacaagcagcucacccgcauccugggcgugccggaccugguguuccuccuguucagcuucaucuccaccgccaacaacagcacgcacgcgcuggaguacgugcuguuccggcccaaccgccgguacaaccagcgcaucucccuggccauccccaaccuggggaacaccagccagcaggaguacaagguguccagcguccccaacaccagccaguccuacgccaaggugaucaaggagcacggcaccgacuucuucgacaaggacggcgugaugaaggacauccgggccaucuaccaggucuacaacgcgcuccaggagaaggugcaggccgugugcgccgacgucgagaaguccgagcgcgugguggaguccugccaggccgaggucaacaagcugcggcgccagaucacgcagcggaagaacgagaaggagcaggagcgccggcugcagcaggccgugcucagccgccagaugccguccgagagccuggaccccgcguucagcccccggaugcccagcuccggguucgccgccgagggccgcagcacccugggggacgccgaggccuccgacccgcccccgcccuacagcgacuuccaccccaacaaccaggaguccacccucagccacucccgcauggagcggagcguguucaugccccgcccccaggcggucggcuccagcaacuacgccuccaccagcgccgggcugaaguaccccggcagcggcgccgaccugccgccgccccagcgggccgcgggggacuccggcgaggacagcgacgacuccgacuacgagaaccucaucgaccccacggagcccagcaacuccgaguacagccacuccaaggacagccgccccauggcccaccccgacgaggacccccggaacacccagaccucccagaucuga

SEQ ID NO: 29931 - RNA, 642 nt, Artificial Sequence
  derived and/or modified sequence opt1 from FAM177A1__Homo_sapiens__NP_001072987
auggaccaggagcccgucggcggggucgagcgcggcgaggccguggccgcgagcggggccgccgccgccgcggccuucggcgaguccgccgggcagaugagcaacgagcggggcuucgagaacguggagcugggcgucaucgggaagaagaagaaggugccgcgccgggugauccacuucgucuccggcgagaccauggaggaguacagcaccgacgaggacgagguggacgggcucgagaagaaggacgugcugcccacggucgaccccaccaagcugaccuggggccccuaccucugguucuacaugcugcgcgccgcgaccuccacgcugagcgugugcgacuuccucggggagaagaucgccuccgugcugggcaucagcaccccgaaguaccaguacgccaucgacgaguacuaccggaugaagaaggaggaggaggaggaggaggaggagaaccgcauguccgaggaggccgagaagcaguaccagcagaacaagcugcagaccgacagcaucguccagaccgaccagcccgagacggugaucuccagcuccuucgugaacgucaacuucgagauggagggcgacagcgaggugaucauggaguccaagcagaaccccgugagcgugcccccguga

SEQ ID NO: 29932 - RNA, 477 nt, Artificial Sequence
  derived and/or modified sequence opt1 from FAM177B__Homo_sapiens__NP_997351
auggagaucgacggcuuccagcagcuggaccucgagaaguccgugcccagcaagaagaccaccccgaagcgcaucauccacuucgucgacggggacaucauggaggaguacagcacggaggaggaggaggaggaggagaaggaggagcaguccaccaacagcacccuggaccccuccaagcugagcuggggccccuaccuccgguucugggccgggcgcaucgccuccaccagcuucuccacgugcgaguuccugggcgggcgguucgcgguguucuucggccugacccagcccaaguaccaguacgugcucaacgaguucuaccgcauccagaacaagaaguccgacaacaagagcgagcggcgcggcagcaaggcccaggccgccgaggucccgaacgagaagugccaccuggaggccggggugcaggaguacggcaccauccagcaggacgugaccgaggcgaucccccaguga

SEQ ID NO: 29933 - RNA, 3561 nt, Artificial Sequence
  derived and/or modified sequence opt1 from FAM178A__Homo_sapiens__NP_001129595
augacccgccggugcaugcccgcccgcccgggcuuccccagcucccccgcccccgggagcuccccgccccggugccaccuccgccccggcagcaccgcgcacgccgccgccgggaagcggacggagucccccggcgaccgcaagcagagcaucaucgacuucuucaagccggccuccaagcaggaccggcacaugcuggacagcccccagaaguccaacaucaaguacgggggcagccgccuguccaucaccggcaccgagcaguucgagcggaagcugagcucccccaaggagagcaagcccaagcgcgugccgcccgagaagucccccaucaucgaggcguucaugaagggggucaaggagcaccacgaggaccacggcauccacgagagccggcgccccugccucucccuggccagcaaguaccuggccaaggggaccaacaucuacgugccguccagcuaccaccuccccaaggagaugaagucccugaagaagaagcaccggagccccgagcgccgcaagagccuguucauccacgagaacaacgagaagaacgaccgggaccggggcaagacgaacgccgacuccaagaagcagaccaccguggcggaggccgacaucuucaacaacagcucccgcagccucuccagccgguccagccugucccgccaccaccccgaggagagcccgcugggggccaaguuccagcucucccuggccagcuacugccgggagcgcgagcugaagcgccuccggaaggagcagauggagcagcgcaucaacuccgagaacagcuucuccgaggccagcucccugagccucaagagcuccaucgagcggaaguacaagccccgccaggagcagcggaagcagaacgacaucauccccggcaagaacaaccugagcaacgucgagaacggccaccugucccgcaagcggagcuccagcgacuccugggagcccaccagcgcgggguccaagcagaacaaguucccggagaagcgcaagcggaacagcguggacuccgaccucaagagcacgcgcgaguccaugauccccaaggcccgggagagcuuccuggagaagcgccccgacggcccccaccagaaggagaaguucaucaagcacaucgcccugaagaccccgggggacgugcugcggcucgaggacaucuccaaggagcccagcgacgagaccgacggcuccagcgccggccuggcccccagcaacuccgggaacagcggccaccacuccacccgcaacagcgaccagauccaggucgcggggacgaaggagaccaagaugcagaagccgcaccucccccugucccaggagaaguccgccaucaagaaggccagcaaccugcagaagaacaagaccgccagcuccaccacgaaggagaaggagaccaagcugccccuccugagccgggugcccuccgccggcagcucccuggugccgcucaacgcgaagaacugcgcccugcccgucagcaagaaggacaaggagcgcuccagcuccaaggagugcagcgggcacuccaccgagagcaccaagcacaaggagcacaaggccaagacgaacaaggccgacagcaacguguccagcggcaagaucuccggcgggccccugcggagcgaguacggcacccccaccaaguccccgcccgccgcgcucgaggugguccccugcauccccagcccggccgcccccuccgacaaggcccccagcgagggggaguccagcggcaacuccaacgcggggagcuccgcccugaagcgcaagcugcggggcgacuucgacagcgacgaggagucccucggcuacaaccuggacagcgacgaggaggaggagacccugaagucccucgaggagaucauggcccugaacuucaaccagacgcccgccgccaccgggaagccgcccgcgcugagcaagggccuccgcucccagagcagcgacuacaccgggcacgugcaccccggcaccuacacgaacacccuggagcgccuggugaaggagauggaggacacccagcggcucgacgagcugcagaagcagcugcaggaggacauccgccaggggcggggcaucaagucccccauccgcaucggcgaggaggacagcaccgacgacgaggacgggcugcucgaggagcacaaggaguuccugaagaaguucuccgucacgaucgacgccaucccggaccaccaccccggcgaggagaucuucaacuuccugaacagcgggaagaucuucaaccaguacacccucgaccugcgggacuccggcuucaucggccagagcgccguggagaagcugauccucaaguccgggaagaccgaccagaucuuccugaccacgcagggcuuccugaccagcgccuaccacuacgugcagugccccguccccgugcucaaguggcuguuccgcaugauguccgugcacaccgacugcaucgucagcgugcagauccuguccacccucauggagaucaccauccggaacgacacguucagcgacuccccgguguggcccuggauccccagccuguccgacgucgccgcgguguucuucaacauggggaucgacuuccgcagccuguucccgcucgagaaccugcagcccgacuucaacgaggacuaccuggucuccgagacccagaccaccagccggggcaaggaguccgaggacagcagcuacaagcccaucuucuccacgcuccccgagaccaacauccugaacguggugaaguuccuggggcucugcaccagcauccacccggagggcuaccaggaccgcgagaucaugcugcugauccucaugcuguucaagaugucccuggagaagcagcucaagcagaucccccuggucgacuuccagagccugcucaucaaccugaugaagaacauccgggacuggaacaccaaggugcccgagcugugccucggcaucaacgagcuguccagccacccccacaaccugcucuggcuggugcagcuggucccgaacuggacgucccgcgggcggcagcuccgccagugccugagccuggugaucaucuccaagcuccuggacgagaagcacgaggacgugcccaacgccagcaaccugcaggucuccgugcuccaccgguaccuggugcagaugaagcccagcgaccugcucaagaagaugguccugaagaagaaggccgagcagcccgacggcaucaucgacgacucccugcaccucgagcuggagaagcaggccuacuaccugaccuacauccuccugcaccuggugggggaggugagcugcucccacagcuucuccagcggccagcgcaagcacuucguccuccugugcggggcccuggagaagcacgugaagugcgacauccgggaggacgcgcgccucuucuaccggaccaaggugaaggaccuggucgcccgcauccacggcaaguggcaggagaucauccagaacugccggccgacccagguguccuucugcuacacgaucagcugcauccugaacagcuucgccgaguggcacuccagcuacugccucaaguga

SEQ ID NO: 29934 - RNA, 2040 nt, Artificial Sequence
  derived and/or modified sequence opt1 from FAM178B__Homo_sapiens__NP_001116118
auguggccccgccugccgggggccgggcucgcgccccagcugcggcgccaggaccagcggcugcacuucaccggccagaugagccacgggcuccagauggccggcccccaggagaccgugcuggcccugccccuccgcgaggggguccaggccgccgccacggugccgauccugcuguacaaccucgaggacggccuguccgaccacccccuggaccagggcccccggugccccgcgcgccggccgugcagccccgccuccgcccccgcccccaccagcccgaagaagcccaagauccaggcgcccggggagaccuuccccaccgacugguccccgccgcccguggaguuccucaacccccgcguccugcaggccagccgggaggcccccgcccagcgcugggugggcguggucgggccccagggccugcggcgccucgccggggagcugcccgaggagcuggagcaggagcaccucgaccuggaccccaagcggggccuggcgcucccggagaagcuguucuggaacacguccggccugagccagcaggccgccgcccccgaguucuccuggggcgggagcggguccuacuucaacaaccucgacuaccugcugcaggagaagcgcgagcaggcccucgagcaggagcgggagcgccugcugcuccaggagugccugaaccugaacagccucgaccuggacgaggaggaggugccccugacccccgagcaccggaugcucguggagaaguacuccgucagccugcagaccaucccgcccgugcaccccggcgagaccguguuccugccgcgcugccacccccuccccugcauccuggacuccagccugcucaagccccggucccaccuggagggccuguuccucagcuccccgcccgcgcagcagcugagcuuccugcgcagcgggcuccugaacauccuguaccugcacaugcccgacugccccgucucccuccugcaguggcuguuccagcuccugacguggccgcccgagaccagccugggcgccuucgggcuccugugggaccugaucguggacggcaucuuccuccagcccgacgaggacaagcaccuguggugccccucccugcaggaggugcgggaggccuuccacagccucggggcccacuccccggcccuguacccccugggccccuucuggcacggcgggcgcguccuccccggcgaggcggggcugaacgagaacgaggagcaggacgccccgcaggagaucgcccuggacaucagccucggccacaucuacaaguuccuggcccugugcgcccaggcgcagcccggggccuacaccgacgagaaccucaugggccugaucgagcugcucugccgcaccucccuggacgugggccugcggcuccugcccaagguggaccugcagcagcuccugcugcuccugcuggagaacauccgcgaguggcccgggaagcuccaggagcugugcugcacgcugagcugggucuccgaccaccaccacaaccuccuggcccuggugcaguucuucccggacaugaccagccggucccgccggcuccgcagccagcugucccugguggucaucgcccggaugcucggccagcaggagaugcugccccuguggcaggagaagacccagcucagcucccugagccgccugcucgggcugaugcggcccuccagccugcgccaguaccucgacuccgugccccugccgcccugccaggagcagcagcccaaggcgagcgccgagcuggaccacaaggccugcuaccucugccacagccugcugaugcucgccggcguggucguguccugccaggacaucaccccggaccaguggggcgagcugcagcugcucugcaugcagcuggaccggcacaucagcacgcagauccgcgagagcccccaggccaugcaccggaccaugcugaaggaccucgcgacccagaccuacauccgcuggcaggagcugcugacgcacugccagccccaggcccaguacuucucccccuggaaggacaucuga

SEQ ID NO: 29935 - RNA, 5163 nt, Artificial Sequence
  derived and/or modified sequence opt1 from FAM179B__Homo_sapiens__NP_055906
auggccgccgcccccagcgcccugcuccugcugccgcccuuccccgugcucagcaccuaccggcugcagagccggagccgccccagcgcccccgagaccgacgacagccgggucggcgggaucaugcgcggcgagaagaacuacuacuuccgcggggccgccggcgaccacgggagcugccccaccaccaccagcccccuggcgagcgcccuccugaugcccuccgaggccgugagcuccagcugguccgagagcggcggcgggcuguccggcggggacgaggaggacacccgccuccugcagcugcuccggaccgcccgcgaccccagcgaggcguuccaggcccugcaggccgcccugccccggcgcggcgggcggcucggcuucccccgccggaaggaggcccuguaccgcgcgcugggccgggugcucgucgagggcggguccgacgagaagcgccugugccugcagcuccugagcgacgugcugcgggggcagggcgaggccggccagcucgaggaggccuucucccuggcccugcucccccagcugguggucagccugcgcgaggagaacccggcccuccggaaggacgcgcugcagauccugcacaucugccucaagcgcagccccggggaggugcugcggacccugauccagcagggccucgaguccaccgacgcccgccugcgcgccagcaccgcccugcuccugcccauccugcucacgaccgaggaccugcugcucgggcuggaccugaccgaggugaucaucucccucgcccggaagcugggcgaccaggagaccgaggaggagagcgagacggcguucuccgcccugcagcagaucggggagcgccugggccaggaccgguuccagagcuacaucucccgccuccccagcgcccugcggcgccacuacaaccggcgccuggagucccaguucggcagccaggucccguacuaccucgagcuggaggccuccggguuccccgaggacccccugcccugcgccgugacccucagcaacuccaaccugaaguucggcaucaucccgcaggagcugcacagccggcuccuggaccaggaggacuacaagaaccgcacccaggcgguggaggagcugaagcagguccucgggaaguucaaccccuccagcacgccccacuccagccuggugggcuucaucucccugcucuacaaccugcuggacgacagcaacuucaaggugguccacgggacgcucgaggugcugcaccuccuggugauccggcugggcgagcagguccagcaguuccugggccccgugaucgccgccagcgugaagguccuggccgacaacaagcuggugaucaagcaggaguacaugaagaucuuccugaagcucaugaaggagguggggccgcagcagguccugugccugcuccuggagcaccugaagcacaagcacucccgcgugcgggaggaggucgugaacaucugcaucugcagccuccugaccuaccccuccgaggacuucgaccugcccaagcucagcuucgaccuggcgcccgcccugguggacuccaagcgccggguccgccaggccgcccucgaggccuucgcggugcuggccagcuccaugggcagcgggaagaccuccauccuguucaaggccguggacaccgucgagcuccaggacaacggcgacggggugaugaacgccgugcaggcccggcuggcgcgcaagacgcugccgcggcucaccgagcagggcuucgucgaguacgccgugcugaugcccagcuccgccggcgggcgcagcaaccaccuggcccacggcgccgacaccgacuggcuccuggcggggaaccgcacccaguccgcccacugccacugcggcgaccacgugcgggacagcaugcacaucuacggcuccuacagccccacgaucugcacccgccggguccuguccgccgggaagggcaagaacaagcucccgugggagaacgagcagcccgggaucaugggcgagaaccagaccagcaccagcaaggacaucgagcaguucuccacguacgacuucauccccagcgccaagcugaagcugucccaggggaugcccgugaacgacgaccucugcuucagccgcaagcgggugucccgcaaccuguuccagaacagccgggacuucaacccggacugccugccccucugcgcggccggcaccaccggcacccaccagacgaaccuguccgggaagugcgcccagcugggcuucagccagaucugcgggaagaccggcuccgucgggagcgaccuccaguuccugggcaccaccuccagccaccaggagaagguguacgccucccugaacuucggcagcaagacgcagcagaccuucgggucccagaccgagugcaccagcuccaacggccagaaccccagccccggggccuacauccucccguccuaccccgugagcagcccccgcaccucccccaagcacacgagcccgcugaucaucucccccaagaagucccaggacaacuccgucaacuucagcaacuccuggccccucaagagcuucgagggccucuccaagcccagcccgcagaagaagcuggugucccagaaguccuccgaccccaccgggcggaaccacggcgagaacagccaggagaagccgcccgugcagcugaccccggcgcucguccgcucccccagcucccggcgcggccugaacgggaccaagcccgugcccccgaucccccggggcaucagccugcuccccgacaaggccgaccuguccacgguggggcacaagaagaaggagccggacgacaucuggaagugcgagaaggacagccugcccaucgaccucagcgagcugaacuucaaggacaaggaccuggaccaggaggagaugcacuccagccuccgcucccugcggaacagcgccgccaagaagcgcgccaagcuguccggcagcaccuccgaccucgagagccccgacuccgcgaugaagcuggaccugaccauggacagccccucccucagcuccagcccgaacaucaacuccuacagcgaguccggggucuacagccaggagucccugaccagcagccuguccacgacgccccagggcaagcggaucaugagcgacaucuuccccaccuucggcuccaagcccugcccgacccgccucagcuccgccaagaagaagaucagccacaucgccgagcagucccccagcgccggguccagcuccaacccccagcagaucagcuccuucgacuucacgaccaccaaggcccugagcgaggacuccgugguggucgugggcaaggggguguucggcagccuguccagcgcgcccgcgaccugcucccagagcgucaucagcuccguggagaacggcgacacguucagcaucaagcaguccaucgagccgcccagcgggaucuacggccgguccgugcagcagaacaucagcuccuaccucgacgucgagaacgagaaggacgccaaggugagcaucuccaagagcaccuacaacaagaugcgccagaagcggaaggaggagaaggagcuguuccacaacaaggacugcgagaagaaggagaagaacuccugggagcgcaugcgccacaccgggaccgagaagauggccagcgaguccgagacgcccaccggcgcgaucagccaguacaaggagcggaugcccuccgugacccacagcccggagaucauggaccuguccgagcuccgccccuucagcaagcccgagaucgcccugaccgaggcccugcggcugcucgccgacgaggacugggagaagaagaucgaggggcugaacuucauccgcugccuggccgcguuccacuccgagauccucaacacgaagcugcacgagaccaacuucgccgucgugcaggaggugaagaaccugcggagcggcgucagccgcgccgccguggugugccucuccgaccuguucaccuaccugaagaaguccauggaccaggagcucgacaccacggucaaggugcugcugcacaaggccggcgaguccaacaccuucauccgggaggacguggacaaggcgcuccgcgccauggucaacaacgugacccccgcccgggccguggucagccugaucaacgggggccagcgcuacuacgggcggaagaugcuguucuucaugaugugccacccgaacuucgagaagaugcucgagaaguacgugcccuccaaggaccugcccuacaucaaggacagcgugcgcaaccugcagcagaagggccucggggagaucccccuggacaccccguccgccaagggccggcgcagccacacgggcuccgucgggaacacccggagcuccagcgugucccgcgacgcguucaacagcgccgagcgggccgucaccgaggugcgcgaggugacccggaaguccgucccccgcaacagccuggaguccgccgaguaccucaagcugaucacgggccugcucaacgccaaggacuuccgcgaccggaucaacgggaucaagcagcugcugagcgacaccgagaacaaccaggaccucguggugggcaacaucgucaagaucuucgacgcguucaagagccgccugcacgacuccaacagcaaggugaaccugguggcccucgagaccaugcacaagaugaucccccugcugcgggaccaccucucccccaucaucaacaugcugaucccggccaucgucgacaacaaccugaacagcaagaaccccgggaucuacgccgcggccaccaacguggugcaggcccucucccagcacgucgacaacuaccugcugcuccagcccuucugcaccaaggcccaguuccugaacggcaaggccaagcaggacaugacggagaagcuggcggacaucgugaccgagcucuaccagcgcaagccgcacgccaccgagcagaaggugcuggucgugcuguggcaccuccugggcaacaugaccaacagcgggucccugcccggcgccgggggcaacauccggacggccaccgccaagcucagcaaggcgcuguucgcccagaugggccagaaccugcucaaccaggccgccucccagccgccccacaucaagaagucccuggaggagcugcucgacaugaccauccugaacgagcuguga

SEQ ID NO: 29936 - RNA, 522 nt, Artificial Sequence
  derived and/or modified sequence opt1 from FAM180A__Homo_sapiens__NP_995327
augcacuggaagaugcugcuccugcugcuccuguacuacaacgccgaggccagcaugugccaccgcuggucccgggcggugcuguuccccgccgcccaccgcccgaagcggagcuccagccucccccugaaccccguccugcagaccucccucgaggagguggagcugcuguacgaguuccuccuggccgagcuggagaucagccccgaccuccagaucuccaucaaggacgaggagcuggccagccugcgcaaggcguccgacuuccggaccgugugcaacaacgucauccccaagagcaucccggacauccgccggcucuccgccagccuguccagccaccccggcauccugaagaaggaggacuucgagcgcacggugcucacccuggccuacaccgccuaccggaccgcgcugucccacgggcaccagaaggacaucugggcccagagccucgugucccuguuccaggcccugcgccacgaccucaugcggagcucccagcccggcgucccgcccuga

SEQ ID NO: 29937 - RNA, 2916 nt, Artificial Sequence
  derived and/or modified sequence opt1 from FAM184A__Homo_sapiens__NP_001093881
augaagcagcaggcccugaccgaguucgaggccuacaagcaccgcguggaggacaugcagcucugcgcggaggcccagcacguccagcggaucgugaccaugagccgcgagguggaggagauccggcgcaaguucgaggagaagcugcgguccuucggccagcugcagguccaguucgagaaggacaagcgccucgcccuggaggaccugcaggccgcccaccggcgcgagauccaggagcuccucaagagccagcaggaccacuccgcgagcgugaacaaggggcaggagaaggccgaggagcugcaccggauggagguggagucccugaacaagaugcuggaggagcugcgccucgagcggaagaagcugaucgaggacuacgagggcaagcugaacaaggcccagagcuucuacgagcgcgagcucgacacgcugaagcggucccagcuguucaccgccgagagccuccaggcguccaaggagaaggaggccgaccugcgcaaggaguuccaggggcaggaggccauccugcggaagaccaucggcaagcucaagaccgagcugcagaugguccaggacgaggccgggagccugcucgacaagugccagaagcugcagacggcccuggcgaucgccgagaacaacguccaggugcuccagaagcagcuggacgacgccaaggagggcgagauggcccugcucuccaagcacaaggagguggagagcgagcuggccgcggcccgcgagcggcugcagcagcaggccuccgaccucgugcugaaggccagccacaucggcaugcugcaggccacccagaugacccaggaggugaccaucaaggaccucgaguccgagaagucccgcgucaacgagcggcugagccagcuggaggaggagcgcgcguuccuccggagcaagacgcagucccuggacgaggagcagaagcagcagauccuggagcucgagaagaaggugaacgaggccaagcgcacccagcaggaguacuacgagcgcgagcugaagaaccugcagagccggcucgaggaggaggugacccagcugaacgaggcccacagcaagacccuggaggagcucgccuggaagcaccacauggccaucgaggcgguccacuccaacgccauccgcgacaagaagaagcugcagauggaccuggaggagcagcacaacaaggacaagcugaaccucgaggaggacaagaaccagcugcagcaggagcuggagaaccucaaggaggugcuggaggacaagcugaacacggccaaccaggagaucgggcaccuccaggacauggugcgcaagagcgagcagggccugggguccgccgagggccugaucgcgagccuccaggacucccaggagcggcugcagaacgagcuggaccucaccaaggacagccugaaggagaccaaggacgcccugcucaacgucgagggggagcuggagcaggagcggcagcagcacgaggagaccaucgccgccaugaaggaggaggagaagcugaagguggacaagauggcccacgaccucgagaucaaguggacggagaaccugcgccaggagugcuccaagcugcgggaggagcuccgccugcagcacgaggaggacaagaaguccgcgaugagccagcugcuccagcugaaggaccgggagaagaacgccgcccgcgacagcuggcagaagaagguggaggaccugcucaaccagaucucccugcugaagcagaaccucgagauccagcugagccagucccagaccagccugcagcagcuccaggcccaguucacccaggagcggcagcgccugacccaggagcuggaggagcucgaggagcagcaccagcagcggcacaagucccugaaggaggcccacguccuggcguuccagacgauggaggaggagaaggagaaggagcagcgcgcccucgagaaccaccuccagcagaagcacagcgccgagcugcagucccugaaggacgcccaccgggagagcauggagggcuuccgcaucgagauggagcaggagcugcagacccugcgguucgagcucgaggacgagggcaaggccaugcuggcgucccugcgcagcgagcucaaccaccagcacgccgccgccaucgaccugcugcggcacaaccaccaccaggagcucgcggccgccaagauggagcuggagcgcagcaucgacaucucccgccggcagagcaaggagcacaucugccgcaucaccgaccugcaggaggagcuccggcaccgcgagcaccacaucuccgagcuggacaaggaggugcagcaccuccacgagaacaucagcgcccugaccaaggagcuggaguucaaggggaaggagauccugcggauccgcuccgagagcaaccagcagauccggcucgaggagauggaggagaaguaccugaugcgcgaguccaagcccgaggacauccagaugaucacggagcugaaggccaugcucaccgagcgggaccagaucaucaagaagcugaucgaggacaacaaguucuaccagcuggagcucgugaaccgcgagaccaacuucaacaaggucuucaacagcuccccgaccgugggcgucaucaacccccuggcgaagcagaagaagaagaacgacaagagccccacgaaccgguucguguccgugcccaaccugagcgcccucgaguccgggggcgucggcaacgggcacccgaaccgccuggaccccauccccaacagccccgugcacgacaucgaguucaacuccagcaagccgcugccccagcccgugcccccgaagggccccaagaccuuccucucccccgcccagagcgaggccagccccgucgccuccccggacccccagcggcaggagugguucgcgcgcuacuucaccuucuga

SEQ ID NO: 29938 - RNA, 3183 nt, Artificial Sequence
  derived and/or modified sequence opt1 from FAM184B__Homo_sapiens__NP_056503
auggccagcgcccugaacuccaagaucaacccgcccgggaccugccaggggagcaaggcggacggcggggccggcuggcgcauggacugcgacccccagaugcacgugaagaugugcaagaagaucgcccagcucaccaaggucaucuacgcccugaacacgcggcaggacgaggccgaggcguccauggaggcccugcgcgaggcccaccaggaggagcuccagaacgccguggcggagaccaaggcccggcugcugcaggagcaggggugcgccgaggaggaggcccuccugcagcgcauccaggcccuggagagcgcgcucgagcugcagaagcggcugaccgaggaggcccucgccgaguccgccagcugccgccuggagaccaaggagcgggagcugcgcguggaggccgagcacgcggagcggguccucacgcugucccgcgagaugcuggagcucaaggccgacuacgagcggcgccugcagcaccugaccagccacgaggccacgccccagggccggcucccccaggaguccccggagaccaagagcgagcccggccaggggcccgagaugcaggaggugcugcuggaggugcagcgccuccgggucgagaaccagcagcuguccaaggacuacgcccgcaaggccgaggagcugcaggcgaccuacgagcgggagaacgaggccauccgccaggccaugcagcagagcgugucccaggcccucuggcaguggcaggagaaggagagcgaccugcggaagaacuuccaggugcaggaguccgcccugcaggcgcagguccgcaagcucgagggcgaccuggagcaccgggggcgcaagaucagcgaccugaagaaguacgcccagaagcucaaggagcgcauccaggaccuggacgugcagcugaaggaggcccggcaggagaacuccgagcucaagggcaccgccaagaagcugggggagaagcuggcgguggccaaggaccgcaugaugcuccaggagugccggggcacccagcagaccgacgccaugaagacggagcuggucagcgagaacaaggugcugcgcgaggagaacgaccucgaggccggcaaccugcacccccagcaggaccaguccugccugaaggagugcccgugcaugaagggcggcaccgacaugcagaccaagaaggaggccagcgcggagaccgaguacaugaagcagcaguacgaggaggaccuccggaagaucaagcaccagacggaggaggagaagaagcaccugaaggaccagcuggugaagcgccucgaggaccuggucaagaagcacaccguggagaucaagagcgugcgguccagcgucgaggccgagcgcaagaagcugcagcgggagguggaggcccagcuggaggaggugcgcaagaaguccgagaaggagaucaagcagcucgaggaggagaaggccgcccugaacgucaagcugcagaacagccuccuggaggugcugcggcucgaggaguucauccagcagaacaagacccgccccaccggggcggaggagagcccccaggagcugggccggcagcacugcuccauccuggagacgcaggaccccugccucaagcuggacgagaccuccccgcgcggcgaggaguaccaggacaagcuggccgccgaggaggggaccagcuccgacgaggaggagcggaccaaggugcuccugaaggagggcagcgacccccagccgccccuggggucccuccugaaggagaagacgagcaagauccagcgccuggaggaggacuggcagucccagaaggccaagcuccaggcccaggucagccagaugcagcaggcgcuggagcagugcaccuccaacuaccgggaggaccugcaggcccucaagcagcugagcgaccuggagcgcgagaagcuccagcgggagcugcaggagaccacccagcagaaccacgccaugaaggcccagcuggaggcgucccaccagcgcgcccuccgcaugcuggagaaggcccggcaccaggagcugaaggccacggaggagcgccucaagaaggagagcucccacagccugcagauccagcaccagacccaccggcuggagcuccaggcccuggaggagaaggcgcgccaggagcugcaggaggagcgggagcgcaugcaggcccagcaggcccuccugcuggagagccuccggcaggagcuguccgagcagcaggccgccugcagcggccaccagaaggaccuggaggcgcuccaggccgagcugcgcgcccuggggcggcagcaggccuccagccagugccccggcgacuccaaggaccacaucaucgccaccgaggagcgcggcgggcccggccaggcggggagcccgcccggcgccgccgggcagggcuccggcgaggggugcggccucugggaggagaacgcccagcugcaggacgcggugcggcgccugcgggccgaggucgagcagcaccagcaggaggcccagaagcuccgcgaccagcggcgcuuccuggaggagacccagcaggcccagcgggcccgcgagguggagacgcugcggcaggagcaccgcaaggagaugcaggcgaugguggccgacuucagcuccgcccaggcccagcuccaggcccggcuggcggcccuggaggccgagcucaaggacagcggggagaagcccggcaagggggccucccgccccgaggaccugcagcugaucggccgccuccagacccggcugaaggagcgcgaggacaucaucaagcagcugaccgaggagcggcgcuuccacuacgccgcguuccccagcgccaugucccaccggaaccgcagcuucuccuucaacccccacccgggcuaccucacccccagcaugaagaagaagaaggucgaggacgugcccucccggguggucagcgugcccaaccuggccagcuacgccaagaacuuccuguccggggaccucagcucccgcaucaacgccccgcccaucacgaccagccccucccuggacccgagccccuccugcggccggaccuacaagcccaaccagagcaccgacgcgaagaccgccacgcgcacccccgacggggagaccgcccaggccaaggaggugcagcagaagcagggcuccccgcaccaggagugguucaccaaguacuucagcuucuga

SEQ ID NO: 29939 - RNA, 1110 nt, Artificial Sequence
  derived and/or modified sequence opt1 from FAM187B__Homo_sapiens__NP_689694
augcccccgaugcuguggcuccugcugcacuucgccgcccccgcgcucggcuucuacuucagcaucuccugccccagcgggaagcagugccagcaggcccugcuguccggcaacgacauccuccuguacugcaacagcuccggggcccacugguacuaccuguucacccagggcaagaaggggcgccucaccagccugacgaacaucuccaacauggagaucaugcccgagggcagccugcucaucaaggacccgcugcccucccagaccggccuguaccacugcuggaacaagaacgggcgccaggugguccaguacgagaucgacuuccaggacgugaccacccuccacaucacgcacaaggaccugggccagcggccccugcagaacgagacccuccaccuggggagcaagcagcugaucuucaccuggugggagcccuggcaggacugcaaccggugcgaggagccgggcgagugcaagcgccucggguaccgguacaucgaggagccccuggaggaggccaugcccugcuggcuguaccucggcgaggugcuggucugguccagccgccugcggcccgagcuccagguggaggccugccacgugcagugcaccaacaacacgcagcugcgcgucgacuacgugaucuucgacaacuuccggcuggacgagaagaccgaguucguguggcucgacugcccgcugggcuccauguaccgccccgucaacuggcgggcgaacgacacgccccugaccugggagagccagcucuccgggcaggacuucaccaccuuccuggaccccagcaccggcgggcgccagcuccagguguuccagccggccguguacaagugcuucguccagcaggagcugguggcccaguucaagcccgccgcgucccuggagacccuggaggcccaguggcgggagaacgacgcccaguggcgcgaggcccggaaggcccuccgcggccgggcggacagcgugcugaagggccugaagcucguccugcugguggugacgguccucgcccugcugggggcccuccugaagugcauccaccccucccccggccgccggagcacccaggugcugguggucaaguga

SEQ ID NO: 29940 - RNA, 1338 nt, Artificial Sequence
  derived and/or modified sequence opt1 from FAM188A__Homo_sapiens__NP_079224
augagcgagcugaccaaggagcucauggagcugguguggggcaccaaguccagccccgggcuguccgacacgaucuucugccgcuggacccagggcuucgucuucagcgaguccgaggggagcgcccucgagcaguucgagggcgggccgugcgccgugaucgcgcccgugcaggccuuccugcugaagaagcuccuguucuccagcgagaaguccagcuggcgggacugcuccgaggaggagcagaaggagcugcucugccacacccugugcgacauccuggagagcgccugcugcgaccacuccggcagcuacugccucgucuccuggcugcgcggcaagaccacggaggagaccgccagcaucuccgggagccccgccgaguccagcugccagguggagcacagcuccgcgcuggccguggaggagcucggcuucgagcgguuccacgcccugauccagaagcgcagcuuccggucccugcccgagcucaaggacgccguccuggaccaguacagcaugugggggaacaaguucggcgugcugcuguuccuguacuccgugcugcucaccaaggggaucgagaacaucaagaacgagaucgaggacgcgagcgagccgcugaucgaccccgucuacggccacggcucccagagccugaucaaccuccugcugaccgggcacgccguguccaacgugugggacggcgaccgcgagugcagcgggaugaagcuccugggcauccacgagcaggccgccgucggcuuccugacgcucauggaggcccugcgguacugcaaggugggguccuaccucaagagccccaaguuccccaucuggaucgugggcuccgagacccaccucaccgucuucuucgcgaaggacauggcccugguggccccggaggcccccagcgagcaggcccgccggguguuccagaccuacgaccccgaggacaacggguucauccccgacucccugcucgaggacgucaugaaggcgcuggaccuggugagcgacccggaguacaucaaccucaugaagaacaagcuggaccccgagggccuggggaucauccuccugggccccuuccugcaggaguucuuccccgaccagggcuccagcgggccggaguccuucacgguguaccacuacaacggccucaagcagagcaacuacaacgagaaggucauguacguggaggggaccgccguggucaugggcuucgaggaccccaugcugcagaccgacgacacccccaucaagcgcugccugcagacgaaguggcccuacaucgagcugcucuggaccaccgaccggagcccgucccugaacuga

SEQ ID NO: 29941 - RNA, 2274 nt, Artificial Sequence
  derived and/or modified sequence opt1 from FAM188B__Homo_sapiens__NP_115598
auggacagccuguucguggaggaggucgccgccucccucgugcgcgaguuccugagccggaagggccugaagaagaccugcgugaccauggaccaggagcgcccccgguccgaccucagcaucaacaaccgcaacgaccugcggaagguccugcaccucgaguuccuguacaaggagaacaaggcgaaggagaacccgcugaagacgucccucgagcugaucacccgcuacuuccuggaccacuucgggaacaccgccaacaacuucacccaggacacgcccauccccgcccucagcgugcccaagaagaacaacaaggugccgucccggugcagcgagaccacccuggucaacaucuacgaccuguccgacgaggacgccggcuggcgcaccagccucuccgagacgagcaaggcccggcacgacaaccuggacggggacgugcugggcaacuucguguccagcaagcgcccgccccacaaguccaagcccaugcagaccguccccggggagacccccgugcucaccagcgcgugggagaagaucgacaagcugcacuccgagcccagccuggacgugaagcggaugggcgagaacucccgccccaagagcggccucaucguccgggggaugaugagcggcccgaucgccuccagcccccaggacuccuuccaccgccacuaccugcggcgcagcucccccagcuccagcuccacgcagccccaggaggagagccggaaggugccggagcuguucgugugcacccagcaggacauccucgccuccagcaacuccagccccucccgcaccagccuggggcagcuguccgagcucaccgucgagcggcagaagacgaccgccagcuccccgccccaccuccccagcaagcgccugccgcccugggaccgggcgcgcccccgcgaccccagcgaggacacccccgccguggacggcuccaccgacacggaccggaugccccucaagcuguaccugcccgggggcaacagccgcaugacccaggagcggcucgagcgcgccuucaagcggcagggcucccagccggcccccgugcgcaagaaccagcugcugcccagcgacaaggucgacggggagcucggcgcccugcggcuggaggacguggaggacgagcucauccgcgaggaggugauccuguccccgguccccagcgugcugaagcuccagaccgcguccaagcccaucgaccugagcguggccaaggagaucaagacccugcuguucggguccagcuucugcugcuucaacgaggaguggaagcugcaguccuucagcuucuccaacacggccagccugaaguacggcaucguccagaacaagggcgggcccugcggcgugcucgccgccguccaggggugcgugcugcagaagcugcuguucgagggcgacuccaaggcggacugcgcccaggggcuccagccgagcgacgcccaccggacccgcugccuggugcuggcccucgccgacaucgucuggcgggcgggcggccgcgagcgggccgugguggcccuggccucccgcacccagcaguucagccccaccgggaaguacaaggccgacggcguccuggagacgcucacccugcacagccugaccugcuacgaggaccucgugaccuuccugcagcaguccauccaccaguucgagguggggcccuacggcugcauccugcucacgcugagcgcgauccugucccggagcaccgagcucauccgccaggacuucgacguccccaccucccaccugaucggggcccacggcuacugcacccaggagcuggugaaccuccugcugacgggcaaggccgugagcaacgucuucaacgacgugguggagcucgacuccggggacggcaacaucacccugcugcgggggaucgccgcgcgcagcgacaucggcuuccucucccuguucgagcacuacaacaugugccaggucgggugcuuccugaagaccccgcgguuccccaucuggguggugugcagcgagucccacuucagcauccucuucucccugcagcccggccugcuccgcgacuggcgcaccgagcggcuguucgaccuguacuacuacgacggccucgccaaccagcaggagcagauccgccugaccaucgacacgacccagaccaucagcgaggacaccgacaacgaccuggugcccccgcucgagcugugcauccggacgaaguggaagggggccuccgucaacuggaacggcagcgaccccauccuguga

SEQ ID NO: 29942 - RNA, 1953 nt, Artificial Sequence
  derived and/or modified sequence opt1 from FAM189B__Homo_sapiens__NP_001254537
augaugcccagcccguccgacagcucccgcagccugaccucccggcccagcacccgcggccucacgcaccuccggcugcaccgccccuggcuccaggcccugcugacccucgggcuggugcagguccugcucggcauccugguggugaccuucuccauggucgccagcuccgugaccacgaccgagagcaucaagcgguccugccccagcugggcgggguucuccaucagcuucuucucccugcucagcgugcugugcgucaugcuguccauggccggcagcgugcucuccugcaagaacgcccagcuggcccgcgacuuccagcagugcagccuggaggggaaggugugcgucugcugcccgagcgugccccuccugcggcccugccccgaguccggccaggagcugaagguggccccgaacagcacgugcgacgaggcgcgcggcgcccucaagaaccugcuguucuccgucugcgggcucaccaucugcgccgccaucaucugcacccuguccgcgaucgugugcugcauccagaucuucucccuggaccucgugcacacccagcuggcccccgagcggagcgucuccggcccccuggggccccucggcugcaccagcccgccgcccgcgccccugcugcacaccaugcucgaccuggaggaguucgugccgcccgugcccccgccgcccuacuacccgcccgaguacacgugcagcagcgagaccgacgcccaguccaucaccuacaacgggagcauggacucccccgugccccuguaccccaccgacugcccgcccagcuacgaggccgugaugggccugcgcggcgacucccaggccacgcuguucgacccccagcugcacgacgggagcugcaucugcgagcggguggccuccaucgucgacgugagcauggacuccggcagccucgugcugagcgccaucggggaccugcccggcggcuccagccccuccgaggacagcugccuccuggagcugcagggguccguccgcagcguggacuacguccucuuccgguccauccagcgcagccgggccggcuacugccugucccuggacugcgggcuccgcggccccuucgaggagagcccccugccccggcgcccgccccgggccgcgcgcuccuacagcugcuccgcccccgaggcgcccccgccccugggggcccccaccgccgcccggagcugccaccgccuggagggcuggcccccgugggugggccccugcuuccccgagcuccgccggcgcgugccccgcgggggcgggcggccggccgccgccccgcccacccgggcccccacccgccgguucuccgacagcuccggcagccugacgccgcccgggcaccgcccgccccaccccgcguccccgccgccccugcuccugccccggagccacagcgaccccggcaucaccaccuccagcgacaccgccgacuuccgcgaccuguacacgaagguccucgaggaggaggccgccuccgugagcuccgcggacaccggccugugcagcgaggccugccuguuccggcucgcccgcugccccucccccaagcugcugcgggcccgcagcgccgagaagcggcgccccgugcccaccuuccagaaggucccccuccccuccgggcccgcgcccgcccacagccugggcgaccugaagggguccuggcccggccgggggcucgugacccgcuuccugcagaucagccggaaggcccccgaccccuccggcacgggcgcccacgggcacaagcaggucccccgcagccuguggggccgccccgggcgggagucccuccaccuccgcagcugcggcgaccuguccagcagcuccagccugcggcgccugcuguccggccggcgccucgagcgggggacccgcccgcacagccugucccugaacggcgggagccgggagaccggccucuga

SEQ ID NO: 29943 - RNA, 2469 nt, Artificial Sequence
  derived and/or modified sequence opt1 from FAM193B__Homo_sapiens__NP_001177875
augacccgccggcgcagccggcccuccggcggggccggccgccgggagcgcgcccgggcggccgggccgcagaagccccaggcccccgagcccccgcccccgcccagccuggaggccggcgccggggcgggcccgcccgaggcccccgccgagcccgaccacgacggcccccgcgaggacgacgagcccaaccucgugcccgggccccaggucccgcccgccuccagccagcccgugcagaccugcugccugcugugccaccgggagcgcaagggcugggaggaggggcccucccagaacggccucgugcugcagggggagaagcugccgcccgacuucaugcccaagcucgucaagaaccugcugggcgagaugccccucugggugugccagagcugccggaaguccauggaggaggacgagcgccagacgggccgggagcacgcgguggccaucagccugucccacaccagcugcaagucccagagcugcggggacgacucccacagcuccagcuccagcuccagcagcuccagcuccagcuccagcuccagcugcccgggcaacuccggggacugggaccccagcuccuuccugagcgcccacaagcucuccggccuguggaacagcccccacuccagcggcgccaugcccggguccagccugggcuccccgcccaccauccccggggaggccuucccggucagcgagcaccaccagcacagcgaccucaccgcgccgcccaacucccccacgggccaccacccccagcccgccagccugauccccucccaccccagcuccuucgggagcccgccccacccccaccuccugcccaccaccccggccgcccccuuccccgcccaggcguccgagugccccguggccgccgccaccgccccgcacacgcccggccccugccagagcucccaccuccccagcaccuccaugccgcugcugaagaugcccccgcccuucagcggcugcucccaccccugcagcgggcacugcggcgggcacugcuccggcccccugcugcccccgcccagcucccagccccuccccagcacccaccgcgacccggggugcaagggccacaaguucgcgcacagcggccuggccugccagcugccccagcccugcgaggccgacgaggggcucggcgaggaggaggacuccagcuccgagcggagcuccugcaccagcuccagcacgcaccagcgcgacgggaaguucugcgacugcugcuacugcgaguucuucggccacaacgccgagaaggagaaggcccagcuggcggccgaggcccugaagcaggccaaccggguguccgggagccgcgagccccggccggcgcgcgagcggcuccuggaguggcccgaccgcgagcuggaccgcgucaacuccuuccucagcucccggcugcaggagaucaagaacaccgugaaggacagcauccgcgccuccuucagcgugugcgagcuguccauggacagcaacggcuucuccaaggagggcgccgccgagcccgagccccagagccucccgcccagcaaccuguccgggagcuccgagcagcagcccgacaucaaccuggaccucagcccccugacccugggcuccccgcagaaccacacccuccaggcccccggggagcccgcgcccccgugggccgagaugcggggcccccacccgcccuggacggagguccgcgggcccccgcccggcaucgugcccgagaacggccuggugcggcgccugaacaccguccccaaccucagccgggugaucugggugaagacccccaagcccggguacccguccagcgaggagcccuccagcaaggagguccccuccugcaagcaggagcugcccgagccggugagcuccggcgggaagccccagaagggcaagcgccagggcagccaggccaagaaguccgaggccagccccgcgccccggccgcccgccucccuggaggugcccagcgccaaggggcaggucgccggccccaagcagccggggcgcgugcucgagcugcccaaggugggcuccugcgccgaggccggggagggcagccggggcagccgccccgggcccggcugggcgggguccccgaagaccgagaaggagaagggcagcuccuggcggaacuggcccggggaggccaaggcccgcccccaggagcaggagagcguccagcccuccggcccggcccggccccagagccugccccagggcaaggggcgcucccggcgcagccggaacaagcaggagaagcccgcguccagccuggacgacguguuccucccgaaggacauggacggcgucgagauggacgagacggaccgcgagguggaguacuucaagcgcuucugccuggacuccgccaagcagacccggcagaagguggccgucaacuggaccaacuucagccugaagaagaccacgcccuccaccgcccaguga

SEQ ID NO: 29944 - RNA, 1440 nt, Artificial Sequence
  derived and/or modified sequence opt1 from FAM196A__Homo_sapiens__NP_001034851
auggugagcaaggacaccggcaagugcauccugaccacguccgagagcgaggucgagcccgccgccugccucgcgcuggagaugaaguacgcccuggacccgaaccgccagaucaagaagcggaacaaggcccuccaggugcgcuucaaggacaucugcgaggcccagaacgagcagcgggacacccagcuguccagcgggcagcugggcgagaagcgcgaggccaagcccguguccugccgggcggccuaccgcaaguacaugaccguccccgcccggcgcagcauccccaacgugaccaaguccacgggggugcagaccagcccggaccucaagaagugcuaccagaccuucccccuggaccggaagaagggcaaccugaagucccuccccgccgcggaccccuucaagagccagaacaacggguuccugaccgacgccaaggagaagaacgaggccggcccgauggaggaggcccgccccugcggcgccgggcggguccacaagacgaccgcgcugguguuccacuccaaccagcacaugaacaccguggaccagccccucggcgucaacugcaccgagcccugcaagagcccggagccccuguccuacggggaggccgcccugcagaacagcacgcgcccgcccuccgaggagcccgacuaccagcuccugggccgggccaagcaggaccgcgggcggcccaacagcgaggagcccgcgcccccggcccugcgccggguguucaagaccgagguggccaccgucuacgcccccgcccucuccgcccgcgcgcccgagcccggccugagcgacuccgccgccgccagccaguggagccugugcccggccgacgacgagcggcgccgggcgacccaccucaacggccugcaggcccccuccgagacggcccuggccugcagcccgcccaugcagugccucucccccgagugcagcgagcagcccucccagacccacacgcccccggggcugggcaaccagcccagccccaccgcgguggccgccggggaggagugccagcgcaucgugccccacaccgaggucguggaccugaaggcccagcuccagaugauggagaaccugaucuccagcucccaggagaccaucaaggugcugcucggcgucauccaggagcuggagaagggcgaggcccaccgcgaggggcugagcuaccggaccggccaggacaccgcgaacugcgacacgugccgcaacuccgccugcaucaucuacagcguggagcucgacuucaagcagcaggaggacaagcugcagccggugcugcggaagcuccaccccaucgaggagacccaggucauccccucccccuacagccaggagaccuacuccagcaccccgaagcagaaguccaagacggagagcaagaagcacgggcgcuggaagcugugguuccuguga

SEQ ID NO: 29945 - RNA, 1608 nt, Artificial Sequence
  derived and/or modified sequence opt1 from FAM196B__Homo_sapiens__NP_001123363
auggcccagcagaacaugaaggugcgccccguccugcucaagcggaacagccuggaguccguggaguucgugaagcagccccaccaccgccggagcaagucccagcagguccgcuucaaggaggacggcaccaccaagaaccccaccgggcuggccgagguggacgugcagacccccgaggaccccgcggucaugggcaagacccaggccacccggcaccaccucccgcccacguacagccuguccuucccccgcagccagaaggccgggggcuuccggaacaucgccauccagaccucccccagccugcgcaagcacuucccgguguucaagcggaagcgccucaccgccuccaagagccugguggagaugcccaccgcgucccagagcgccauccaggucaacgggaaccuguccgagcaggacaucgugagcuccgaccucgccuaccugcggcuggcccagcaccucgaggacggcccccgccgggugaaggucagccacgcguuccugccccgcgugccgaaggugcaguccaacggccccgucagcaucugccuggaggccgggacguggcggucccucgagaaggccaccgccgccauccaggugcccgacgacaucuaccacagccccagcugggaggcgcgcgaguccgcccugagcccggaccgguccgccgaggugagcaacuccauccacccccuggacgacacccgccccggcgacgggcggcgcgucacgccccucgacagcgagaaguccaccagcugccugaacgccaccuccguggccagccacaccccgggcaccgaggagcugaagcccgagcuccugcugcccaaggacaacuccgacgacaaggaccucgggagccuguccagccaguccaaggagacgugcgugcccagcuccccgcggacccacagcucccccagccagggcagccacucccagcccgcgcaccccggccgcgccagcgacugcccguccagcuccaacaaccaccagaaccuggucagccucaagaccaacuccgccagcaaguccgcccccgggugccaggagcagaccgccaacaaccccacggagagcgacacccuggaguucccgaacugccccggcuccaaccaccuccccagcucccugagccgcuccgagaccaagcugcagagcaaccgggagaucuccgacaucaaccagauccaccuggcgcgcggggagcucugcgaccugcagggccggcugcagagcguggaggagagccuccacuccaaccaggagaagaucaaggugcugcugaacgucauccaggaccucgagaaggcccgcgcccugaccgagggccggaacuucuaccgcacggggcaggaccugaacaacugcagcacgugccagaacaccgccugcaucaucuacuccguggaguacgacuuccggcagcaggagggccgcuuccacgagguccuccagagccuggaggaggccgagcccguggaggaggcguccccgccgcccaagagccccgccgagccgcccgcccccgagaagcaggaccugcggcgcaagaccaagaaggugaagaagaagugcuucugguggaucuga

SEQ ID NO: 29946 - RNA, 1584 nt, Artificial Sequence
  derived and/or modified sequence opt1 from FAM198B__Homo_sapiens__NP_001026870
augaccugccccgacaagccgggccagcugaucaacugguucaucugcagccucugcgugccccgcguccggaagcugugguccagccgccggccccgcacccggcgcaaccugcuccuggggacggccugcgccaucuaccugggcuuccucgugucccagguggggcgggcgagccugcagcacggccaggccgccgagaaggggccccaccgcucccgggacaccgccgagccgagcuuccccgagaucccccuggacggcacccucgcgcccccggagucccagggcaacgggagcacccugcagcccaacgucguguacaucacgcugcgcuccaagcggagcaagcccgccaacauccgcggcaccgugaagcccaagcggcgcaagaagcacgccgucgccuccgccgcgccggggcaggaggcccucgugggccccagccugcagccccaggaggccgcccgggaggccgacgcgguggcccccggguacgcccagggcgccaaccuggucaagaucggcgagcgcccguggcggcucgugcgcgggcccggcgugcgggccgggggccccgacuuccugcagcccuccagccgcgaguccaacauccggaucuacagcgaguccgcgccgagcuggcuguccaaggacgacauccgccgcaugcggcuccuggccgacagcgccgucgccggccugcgccccgugagcucccggagcggggcccgccuccuggugcuggagggcggggcgcccggcgccguccuccggugcgggcccuccccgugcggccugcugaagcagccccucgacaugagcgagguguucgccuuccaccuggaccgcauccugggccucaaccggacccugcccuccgugagccgcaaggccgaguucauccaggccgcggccgccgccugccuguccaugcggcucgcguucuucaucuuccccgccugggaggacaugcgcgucccggggaagugcugcaucggccacgcccggcugaccugggggacguaccagcagcugcucaagcagaagugcuggcagaacggccgcgugcccaagcccgagagcgggugcaccgagauccaccaccacgagugguccaagauggcccuguucgacuuccugcuccagaucuacaaccggcuggacaccaacugcugcggcuuccgcccgcggaaggaggacgccugcgugcagaacggccugcgccccaagugcgacgaccaggggagcgcggcccucgcccacaucauccagcggaagcacgacccccgccaccuggucuucaucgacaacaagggcuucuucgaccgguccgaggacaaccugaacuucaagcuccuggaggggaucaaggaguuccccgccagcgccguguccgugcugaagucccagcaccuccgccagaagcugcugcagagccuguuccucgacaaggucuacugggagagccagggcgggcgccagggcaucgagaagcugaucgacgugaucgagcaccgggcgaagauccugaucaccuacaucaacgcccacggcgucaaggugcucccgaugaacgaguga

SEQ ID NO: 29947 - RNA, 402 nt, Artificial Sequence
  derived and/or modified sequence opt1 from FAM19A1__Homo_sapiens__NP_998774
auggccauggugagcgccauguccuggguccuguaccucuggaucagcgcgugcgccaugcugcugugccacggcucccuccagcacaccuuccagcagcaccaccuccaccgccccgagggcgggaccugcgaggugaucgccgcccaccggugcugcaacaagaaccgcaucgaggagcggagccagacggugaagugcuccugccugccggggaaggucgccggcaccacccgcaaccggcccagcugcguggacgcguccaucgugaucgggaagugguggugcgagauggagcccugccuggagggcgaggagugcaagacccugcccgacaacagcggcuggaugugcgccacggggaacaagaucaagaccacccgcauccacccgcggaccuga

SEQ ID NO: 29948 - RNA, 396 nt, Artificial Sequence
  derived and/or modified sequence opt1 from FAM19A2__Homo_sapiens__NP_848634
augagcaagcgcuaccugcagaaggccaccaagggcaagcuccugaucaucaucuucaucgugacccugugggggaaggucguguccagcgccaaccaccacaaggcgcaccacgugaagacggggaccugcgaggucguggcccuccaccggugcugcaacaagaacaagaucgaggagcgcucccagaccgugaagugcagcugcuuccccggccaggucgccggcaccacgcgggccgccccguccugcguggacgcgagcaucguggagcagaagugguggugccacaugcagcccugccuggagggggaggagugcaagguccugcccgaccgcaagggcugguccugcagcuccggcaacaaggugaagaccacccgggugacccacuga

SEQ ID NO: 29949 - RNA, 423 nt, Artificial Sequence
  derived and/or modified sequence opt1 from FAM19A4__Homo_sapiens__NP_001005527
augcgcagcccccggaugcgcgugugcgccaaguccguccugcucagccacuggcuguuccuggccuacgugcucauggugugcugcaagcugauguccgcgagcucccagcaccuccggggccacgccgggcaccaccagaucaagcaggggaccugcgaggucguggccgugcaccgcugcugcaacaagaaccggaucgaggagcgcagccagaccgucaagugcuccugcuucccgggccagguggccggcacgacccgggcccagcccagcugcguggaggcguccaucgucauccagaagugguggugccacaugaaccccugccuggagggggaggacugcaaggugcugcccgacuacagcggcugguccugcagcuccggcaacaaggugaagaccaccaaggucacgcgcuga

SEQ ID NO: 29950 - RNA, 399 nt, Artificial Sequence
  derived and/or modified sequence opt1 from FAM19A5__Homo_sapiens__NP_001076436
auggcccccagcccgcgcaccggcucccggcaggacgccaccgcgcugcccagcauguccagcacguucugggccuucaugauccucgccucccugcugaucgccuacugcagccagcucgccgcggggaccugcgagaucgugacccuggaccgcgacuccagccagccccggcgcaccaucgcccggcagacggcccgcugcgccugccggaagggccagaucgcggggaccacccgcgcccggcccgccugcgucgacgcccgcaucaucaagaccaagcaguggugcgacaugcugccgugccucgagggcgaggggugcgaccugcugaucaaccgguccggcuggacgugcacccagcccggcgggcgcaucaagaccaccacggugagcuga

SEQ ID NO: 29951 - RNA, 702 nt, Artificial Sequence
  derived and/or modified sequence opt1 from FAM204A__Homo_sapiens__NP_071346
auguggagcggccugcucccgcccgggcugaacgaguccgacgccgagagcaacuccgaggacgaggccacccuggagaacagcggccucaaccugcaggaggacaaggaggacgaguccauccgcaagaccgagaucaucgacuucagcacggacgagcccaagaccgagaccgaguccaacgugaacgcguacgaggagugccccagcgggauccccaucgacauguggaacaaguuccaggagcugcacaagaagcacuccgagcagaaguccaccacgagccgguuccgcggcaagcggcgcaagcggagccgcaaggacaagcucaagaacgagaaggagcugcacuccgagcccagcuccaacgagacccaguggaaggagcugacccaguacuucggggucaacgaccgguucgacccgcccgugaagcgcaagaagguggagaaguccggccucgagaagcggaucgaccaggccgucgaggaguggaacaucgagaaggccgaggagcugagcaaccagcuggccacccgcgagcucggcgugaagaucgccaaggcgguggccugccacaacuucgucaaggccaagaaggagguggagaacagccaggccgcgcggaagaagaagaagcuggccuggggguucgaggccaagaagcgcugggagacgaaguccaacaugggcuacauguga

SEQ ID NO: 29952 - RNA, 4008 nt, Artificial Sequence
  derived and/or modified sequence opt1 from FAM205A__Homo_sapiens__NP_001135389
augcugagccccaccuucgugcucugggaggucggcuacccgcuguacaucuacggguccaucuucaucgugaucgugaucaucuggcaggucaagcgcagccaccacgagcuguccagcgagcccaagcgguccugcugccgcugccaccagaaggugcggcagcgcgcccgggacgccgcgagcaccgcccgccggcgcucccgggaggaggccgagaagccccagaagcuccugagcaucaucaagucccagggcuggcugccccucgagcgcagcgugcggcgcauccugugcgccgacccgugcugccagaucugcaacuccgucgcccuggagauccagcagcuccuggugggggagaacaaccagaucagccugacgcucuccggcccccugcaggggagcuccugccuggagaugcucagcaccuccagcaugucccuggaccagagccuggaguuccacagcuggcacacccgggagcucucccugagcuccgugacccccacgcugagccagcucaccgaccagaagucccugacccagagcgcggcccaguccaccuacgccgacggcauccaggacuacugggccgaccaccuccagcucggccaggaguuccagguccccgacgugcugcgcgggccgaacacgaucgcgagcucccggaucgagaagccccgcgcgccccugaaccaggaggagaugacccagagcaaccccucccucgugcagggcaaccaggggcagcaccaccugaacagccaggucucccugcucagccugaacccggagacccugaaccggaugcaccccauggcccuccacauggugcugcccgcccaccuccccuuccuguccccggaggugcugcgccugcucgagguccacgugaagaaguggaugcacuuccagcgguggggccugccccgccggguggaggagagccugcgccagcucaugcccaacccgccccuguacuaccagcccgggaacgaccagcccgucuccuucaaccugaagaacacgccccaggugagccuccaccgcuucgagaccaucucccugcagaccuggugcagcugcguggccggccagccgauccagaccuucugggucagcgagugguccaccaugaaccccgagcagcggcaccacugccagcagacgcccaaccccauggcgcuggcccucccgagccccgcccugaaggcccuguccggcccccacccgcagagcgggggccaggacaacgacuccgggagcgaccugcagcagaaguacucccagcuguucugcggccugcccagccugcacuccgagagccucguggccaccuucaugggcucccaggggcugcccaagaucgagaacgugcccaagccgccccugaaggaccccuuccucuucaacgagcugagcuucccccagcugcucccgaagaccagcccccaguccgcgccgcccuccagcccccugucccccaacuggaugagccccagcgaccaccagcgcgcccagaucaacguccccuuccugacccucgccgaguacgaggcccuggaguggcaccuccugcagcggcagcugcagcugcaguggggcuggccggccgcgcuccagcgcucccagcacacgcagugccugaugcagcacgagcccugcgggaaggcccagagccccgagaccaccaccgccucccagacgggcaagagcaucuccgugcugacccgggagcuccuguucuuccccgagcacgcccgcaagcugcucgaguuccacauccagaagcagcugauccggcaccgcugggggcugccgcagaagauccagcagagcauccagcuccugcugaccuccaccgaccagcagacggucagcuccagcuccaccgcccucgcgaacgugagcaucccccagcccguggcccuggaggccaacggcgccugcgacguccugucccccaucgcggccccggugagcaucccccggccccaccuccugacccaggugaaggccauccugcagucccacaucgacagcaagugcggccagauccaccaggggaagaucccggccugcguccaccgcuccugggacugccggaucagcggcgugcucgccguggcgcccuuccccugcauccccgagucccaguuccuggagcugcagaccgccagcgacccggaccuccaccacaaggucaugcccuggaugcccacggcccuggaccagcagcagcaggcccugcccgggaccgugaccgagcacccgaagcuccugcgcgugcugagcgucgaggccaucgagaagcucgagaccacgcugcggcacaagcaccuggcguuccucuccggccugcccgcccuguacuacguggcccucccccgcgcccuggcccccgcggugaccagccaguccgucaucaccgagauggagccgagccccguggagauccccgccgagccccugauccagaugguguccuucgaggagcagugcaucagccucgggccgugcccccagggcaacaacgaguccugcaccgacgucgccaaggaguuccagcccgccgugcccgugaagggcaccauggagacgcugccgcuggagagccagacccaccccaccagcccccacucccuccagacccacauccugacgaagcugaacuuccaccuccggaagaagguccuggagauccagugggggauccccauccgcgcgcggaagucccgcgagcagaccguggccgccccggagaacaucagcacccagaagucccuggagagccucaaccaccagggcgagacccugcugcaggagcuccccaucccgcccgacacgcugcccgcccccaaccccgagggggugcaccugaaggagcagcucgccaacgaccugaaggcgguccagcagaaccagaagcaguccaacagcaaggccgugccgcagggcuccgcccacagcguguccaagaucagccagcccagcggggacaugaccgaggcccacaugcccugcguccagguggaggccaacgugaacaagcccucccuggaggagccgugcggccccgagccccagagccccuccaagagcaaggacccggcgcacguccccaugcucgccggcaaccgggaggaccccgaggagaccaaggccgcccgcgaccaccgcgagggggacgccggcuucgggcgguccagcacccgcgaggagcggcgccccgcggaggaccagcggccggccggcaugcugcccaacaagacgccccgcggcuccuggcgguggagccgcuccuuccaccuggccgaccccugccagcacagcccgcagcaccacccccagcucaagcugccccagcugcccccgcgggugcccggggagaaggaguccgagaaggaccuccaggacagccagaccaagcugaccgugauccuggagcccgccaccauccccgagaacgcgcagacgguccucccgcaggccucccagggccagcccuuccugagccagcccacccaggccaagccccugcaggggcagacccuccagggccaggugcugcacgggcuggugaugccgguccacgcccagaagaagcccucccucaccgagagcuccuuccgcaacaagaucaagugcuuccugcagcacaucaaccccaagacgaagggcaagggccacgaggacagcauguucuccgccgcggccaagguggccaagacccggaaggagaacguggccaagagccuggccccggccaagagccccgucgggcgcuccaagaccgagaagcccaccggcugcagcaaggcccagucccggcccgcccagaagcucguggggccggccuuccuggacggcccccagagccuggacgacaagcuccgccugcacucccggcagcccgggagcgccuccgcgcugggcuacccccgccacugcccgcggcacugcccccgcgaggccugcgccaacaagcccggccaccccacguga

SEQ ID NO: 29953 - RNA, 1212 nt, Artificial Sequence
  derived and/or modified sequence opt1 from FAM20A__Homo_sapiens__NP_001230675
auguaccgcgagcagaugaaccugaccagccucgacccgccccugcagcugcggcucgaggccuccugggugcaguuccaccugggcaucaaccgccacgggcuguacagccgguccagccccgucguguccaagcuccugcaggacaugcgccacuuccccaccaucagcgccgacuacucccaggacgagaaggcgcugcucggcgccugcgacugcacgcagaucgugaagcccagcgggguccaccugaagcuggugcuccgguucuccgacuucggcaaggccauguucaagccgaugcgccagcagcgggacgaggagacccccguggacuucuucuacuucaucgacuuccagcgccacaacgccgagaucgccgcguuccaccuggaccggauccuggacuuccgccgggucccgcccaccguggggcgcaucgugaacgucaccaaggagauccucgaggugacgaagaacgagauccugcagagcguguucuucgucucccccgccagcaacgugugcuucuucgccaagugccccuacaugugcaagaccgaguacgccgugugcggcaacccccaccuccuggagggcucccugagcgcguuccugcccucccucaaccuggccccgcggcugagcguccccaaccccuggauccgcuccuacacccucgccgggaaggaggagugggaggugaacccccuguacugcgacaccgugaagcagaucuacccguacaacaacagccagcggcugcucaacgucaucgacauggccaucuucgacuuccugaucggcaacauggaccgccaccacuacgagauguucacgaaguucggggacgacggcuuccugauccaccucgacaacgcccggggguucggccgccacucccacgacgagaucagcauccugagcccccugucccagugcugcaugaucaagaagaagacccuccugcaccuccagcugcuggcgcaggccgacuaccggcugagcgacgugaugcgcgagucccuccuggaggaccagcugagccccgugcucaccgagccccaccuccuggcccuggaccggcgccugcagaccauccugcgcacggucgagggcugcaucguggcccacgggcagcaguccgugaucgucgacggcccgguggagcagcucgcccccgacagcgggcaggcgaaccugaccuccuga

SEQ ID NO: 29954 - RNA, 1230 nt, Artificial Sequence
  derived and/or modified sequence opt1 from FAM20B__Homo_sapiens__NP_055679
augaagcugaagcagcgcgugguccuccuggccauccugcucgugaucuucaucuucaccaagguguuccugaucgacaaccuggacaccagcgccgcgaaccgggaggaccagcgcgccuuccaccggaugaugacgggccuccgcgucgagcuggcccccaagcuggaccacacccuccaguccccgugggagaucgccgcccaguggguggugccccgggaggucuaccccgaggagacccccgagcugggggcggugaugcacgccauggccaccaagaagaucaucaaggccgacgugggcuacaaggggacgcagcugaaggcgcuccugauccuggagggcgggcagaaggucguguucaagccgaagcgcuacagccgggaccacguggucgagggcgagcccuacgccggcuacgaccgccacaacgccgagguggccgccuuccaccucgaccggauccugggguuccaccgcgcgccccugguggucggccgguucgugaaccuccgcaccgagaucaagcccguggccaccgagcagcugcuguccaccuuccucacggucgggaacaacacgugcuucuacggcaagugcuacuacugccgggagaccgagccggccugcgccgacggggacaucauggagggcagcgugacccuguggcugcccgacguguggccccuccagaagcaccgccaccccuggggccggaccuaccgcgaggggaagcuggcccggugggaguacgacgaguccuacugcgacgcggucaagaagaccagcccguacgacuccggcccccgccugcucgacaucaucgacaccgccguguucgacuaccugaucgggaacgccgaccggcaccacuacgagagcuuccaggacgacgagggcgccuccaugcugauccuccuggacaacgccaagagcuucggcaaccccucccuggacgagcgcagcauccucgcgccccuguaccagugcugcaucauccggguguccaccuggaaccgccugaacuaccucaagaacgggguccucaagagcgcccugaaguccgccauggcccacgacccgaucagccccgugcuguccgacccccaccuggacgccgucgaccagcgccugcucagcgugcuggcgacggugaagcagugcaccgaccaguucggcauggacaccguccugguggaggaccggaugccccucucccaccuguga

SEQ ID NO: 29955 - RNA, 1755 nt, Artificial Sequence
  derived and/or modified sequence opt1 from FAM20C__Homo_sapiens__NP_064608
augaagaugaugcuggugcgccgguuccgcguccucauccugaugguguuccugguggccugcgcccuccacaucgcgcuggaccugcucccccggcuggagcgccggggcgcccgcccgagcggggagcccggcugcuccugcgcccagcccgccgccgaggucgcggcccccgggugggcccaggugcggggccgcccgggggagccgcccgccgcgagcuccgccgccggcgacgccggcuggcccaacaagcacacccugcggauccuccaggacuucagcuccgacccgagcuccaaccugagcucccacagccuggagaagcucccgcccgccgcggagcccgccgagcgcgcccugcgggggcgcgaccccggcgcccugcggccccacgaccccgcccaccgcccccuccugcgggacccggggccccgccgguccgagagcccgcccggccccgggggcgacgcgucccugcucgcccgccuguucgagcacccccuguaccggguggccgucccgccccucaccgaggaggacgugcuguucaacgugaacagcgacacgcgccugucccccaaggccgccgagaaccccgacuggccccacgcgggcgccgagggggccgaguuccucagccccggcgaggccgccgucgacuccuaccccaacuggcugaaguuccacaucgggaucaaccgguacgagcuguacagccgccacaaccccgcgaucgaggcccuccugcacgaccuguccagccagcgcaucaccagcguggccaugaaguccggcggcacccagcucaagcugaucaugaccuuccagaacuacgggcaggcccuguucaagcccaugaagcagacgcgggagcaggagaccccgcccgacuucuucuacuucagcgacuacgagcgccacaacgcggagaucgccgccuuccaccucgaccggauccuggacuuccgccgggugccgcccgucgccggccgcauggugaacaugaccaaggagauccgggacgugacccgcgacaagaagcuguggcggacguucuucaucucccccgccaacaacaucugcuucuacggggagugcagcuacuacugcuccaccgagcacgcgcucugcggcaagcccgaccagaucgaggggagccuggccgccuuccugcccgaccucucccuggccaagcgcaagaccuggcggaaccccuggcgccggagcuaccacaagcgcaagaaggccgagugggaggucgacccggacuacugcgaggaggugaagcagaccccgcccuacgacuccagccaccggauccuggacgugauggacaugacgaucuucgacuuccucaugggcaacauggaccgccaccacuacgagaccuucgagaaguucggcaacgagaccuucaucauccaccuggacaacgggcggggcuucgggaaguacucccacgacgagcugagcauccucgucccccugcagcagugcugccgcauccggaaguccaccuaccugcgccuccagcugcuggcgaaggaggaguacaagcugagccuccugauggccgagucccugcgcggcgaccagguggcccccgugcucuaccagccccaccuggaggcccuggaccggcgccuccgggucgugcugaaggccgugcgcgacugcgucgagcggaacgggcugcacagcguggucgacgacgaccucgacacggagcaccgcgcggccuccgcccgguga

SEQ ID NO: 29956 - RNA, 579 nt, Artificial Sequence
  derived and/or modified sequence opt1 from FAM210B__Homo_sapiens__NP_543011
auggccggccugcucgcccugcuggggcccgcgggccgcgugggggcccggguccgcccgcgggccaccuggcuccugggcgccaccgcccccugcgcgcccccgccccuggcccucgcccugcugccgccccgccucgacgcccggcugcugcgcacggcgcgcggggacugccggggccaccaggaccccagccaggccaccggcaccaccggguccagcguguccugcacggaggagaagaagcagagcaagucccagcagcucaagaagaucuuccaggaguacggcaccgugggggucagccugcacaucggcaucucccugaucagccucgggaucuucuacauggugguguccagcggcgucgacaugcccgccauccugcugaagcucggcuucaaggagucccuggugcagagcaagauggccgccgggaccuccaccuucguggucgcguacgccauccacaagcuguucgcccccgugcggaucagcaucacgcucguguccgucccccugaucgugcgcuacuuccggaaggugggcuucuucaagcccccggccgccaagcccuga

SEQ ID NO: 29957 - RNA, 690 nt, Artificial Sequence
  derived and/or modified sequence opt1 from FAM213A__Homo_sapiens__NP_001230707
augagcuuccugcaggaccccuccuucuucaccaugggcauguggagcaucggggccggcgcccucggggcggccgcccuggcccugcuccuggccaacaccgacguguuccuguccaagccgcagaaggcggcccucgaguaccuggaggacaucgaccugaagacgcucgagaaggagccccgcaccuucaaggccaaggagcugugggagaagaacggcgccgucaucauggcggugcggcgccccgggugcuuccugugccgggaggaggccgccgaccucagcucccucaagagcaugcuggaccagcugggcgugccccuguacgccgucgugaaggagcacauccgcaccgaggugaaggacuuccagccguacuucaagggcgagaucuuccuggacgagaagaagaaguucuacgggccccagcggcgcaagaugauguucaugggcuucauccggcucggggucugguacaacuucuuccgcgccuggaacggcggguucuccggcaaccuggagggcgagggguucauccugggcgggguguucguggucggcagcggcaagcaggggauccuccuggagcaccgggagaaggaguucggcgacaaggugaaccugcucuccgugcuggaggcggccaagaugaucaagccccagacccuggccagcgagaagaaguga

SEQ ID NO: 29958 - RNA, 3252 nt, Artificial Sequence
  derived and/or modified sequence opt1 from FAM214A__Homo_sapiens__NP_001273424
augguguucagcggcaacaaggggcugcaccgcgaggacacccucgacgaguacuucgaguacgacgccgaggaguuccuggucucccuggcccuccugaucaccgagggccggacgcccgagugcagcgugaaggggcgcaccgaguccuuccacugcccgcccgcgcagagcugcuaccccgugaccaccaagcacgagugcuccgacaagcuggcccagugccggcaggcccgccggacgcgcagcgaggucacccuccuguggaagaacaaccugcccaucaugguggagaugaugcuccugccggacugcugcuacuccgacgacggccccaccaccgaggggaucgaccugaacgaccccgccaucaagcaggacgcccuccugcuggagcgguggauccucgagcccgugccgcgccagaacggcgaccgguucaucgaggagaagacgcugcugcucgcgguccgcagcuucguguucuucucccagcugagcgccuggcuguccgugagccacggcgccaucccccggaacauccucuaccgcaucuccgccgcggacgucgaccugcaguggaacuucagccagacccccaucgagcacguguuccccgugccgaacgucucccacaacguggcccugaaggugagcguccagucccucccccggcagagcaacuaccccgugcugaccugcuccauccacaccaacaucgggcuguacgagaagcgcauccagcagcacaagcucaagacgcaccagcaccacaaccccaacgaggccgagcagugcggcaccaacagcagccagcggcugugcuccaagcagaccuggaccauggccccggagagcgugcugcacgccaaguccgggcccagccccgaguacacggcggccgucaagaacaucaagcucuaccccggcaccggguccaagagcgaccacggcaccucccaggccaacauccugggcuucagcgggaucggcgacaucaagucccaggagaccagcgugcgcacgcugaaguccuucagcaugguggacuccagcaucuccaaccggcagagcuucuggcaguccgccggggagaccaacccgcucaucggcagccugauccaggagcgccaggagaucaucgcccggaucgcgcagcaccugauccacugcgaccccuccaccagccacgucagcggccgccccuucaacacccaggaguccagcucccuccacagcaagcuguuccgggugucccaggagaacgagaacguggggaagggcaaggaggccuucagcaugacguucgggucccccgaguucagcuccccggaggacaccaacgagggcaagauccgccugaagcccgagacgccccgcagcgagaccugcaucuccaacgacuucuacagccacaugcccgucggggagaccaacccgcucaucggcucccugcugcaggagcggcaggacgugaucgcccgcaucgcccagcaccucgagcacaucgaccccaccgccagccacaucccccggcaguccuucaacaugcacgacagcuccagcgucgcgagcaagguguuccgcuccagcuacgaggacaagaaccugcugaagaagaacaaggacgaguccagcguguccaucagccacaccaagugcucccuccugggcgacaucagcgacgggaagaaccuggucccgaacaagugcuucaccuccuucaagaacaacagcaaggagaagugcucccucaagcaccagacgcggaaccagugccagaacaaccccagcgagaucauccaguccaccuaccaggagacccagaacaagagcuccagccuguccaccagcuccauccugagccagcacaaggagaacaaccuggaccucacgagccgcuucaaggagcaggagauguccaacggcaucgacaagcaguacagcaacugcaccaccaucgacaagcagaucugcaccaacaaguacaaggagaagaucaucaacgagaacuacaaccccaaguucuucgggaaccugcaguccgacgacagcaagaagaacgacuccaagaucaaggugaccgugcuggagaugagcgaguaccucaacaaguacgaguccaugagcuccaacaaggacagcaagcggcccaagacgugcgagcagaacacccagcugaacuccaucgagaacuaccugaacaaggacaacgagggcuucaagugcaagaaguccgaccagcucaagaacgagcaggacaagcaggaggacccgaccaacgagaagucccagaacuacagccagcgccgguccaucaaggacugccugagcacgugcgagcagcccaagaacaccgagguccugcgcaccacccucaagcacuccaacguguggcggaagcacaacuuccacagccuggacgggaccuccacgcgcgccuuccacccccagaccggccugccccuccugagcagcccggugccccagcggaagacccaguccggcugcuucgaccuggacagcucccuccugcaccucaagagcuucuccagccgcagcccccggcccugccugaacaucgaggacgacccggacauccacgagaagcccuuccugagcuccagcgccccgcccaucaccucccugagccuccuggggaacuucgaggaguccguccugaacuaccgcuucgacccccucggcaucguggacggguucacggccgaggugggcgccagcggggcguucugccccacccaccugacccugcccgucgagguguccuucuacagcguguccgacgacaacgcccccagcccguacaugggcgucaucacccucgagucccugggcaagcggggguaccgcgugccgcccagcggcacgauccaggugacccuguucaaccccaacaagaccgucgugaagauguucguggucaucuacgaccuccgggacaugcccgccaaccaccagaccuuccugcgccagcgcacguucagcgugcccgugaagcaggaggucaagcgguccgugaacaaggagaacauccgccacaccgaggagcggcugcuccgcuaccugauccaccuccgguuccagagcuccaagagcgggaagaucuaccugcaccgcgacgugcggcugcuguucucccgcaagagcauggaggucgacuccggcgccgcguacgagcucaagagcuacaccgagucccccaccaacccgcaguucagcccccggugcuga

SEQ ID NO: 29959 - RNA, 822 nt, Artificial Sequence
  derived and/or modified sequence opt1 from FAM216A__Homo_sapiens__NP_037432
augcugggccagcuccugccccacaccgcccgcgggcugggcgccgcggagaugccggggcagggccccgggagcgacuggaccgagcgguccagcuccgccgagccgcccgccguggccggcacggagggcgggggcgggggcagcgccggguacuccugcuaccagaacagcaagggcuccgaccgcaucaaggacggcuacaaggucaacagccacaucgcgaagcuccaggagcuguggaagaccccgcagaaccagaccauccaccuguccaagagcaugauggaggccuccuucuucaagcaccccgaccucaccacggggcagaagcgguaccugugcagcaucgccaagaucuacaacgccaacuaccugaagaugcucaugaagcgccaguacaugcacgugcugcagcacuccagccagaagcccggcgugcugacccaccaccggucccgccucagcucccgguacagccagaagcagcacuaccccugcaccaccuggcgccaccagcuggagcgggaggacuccgggagcagcgacaucgcggccgccuccgcccccgagaugcugauccagcacagccucuggcgccccguccggaacaaggagggcaucaagacgggcuacgccuccaagacccgcugcaagagccugaagaucuuccggcgcccccggaagcuguucaugcagaccguguccagcgacgacuccgagagccacauguccgaggagaagaaggaggaggaccuccugaacaacuucaugcagagcauguccaucgaggagcagggggagcaccugaugcucaccuga

SEQ ID NO: 29960 - RNA, 780 nt, Artificial Sequence
  derived and/or modified sequence opt1 from FAM220A__Homo_sapiens__NP_001032240
augcgcgaccggcgcggcccccuggggaccugccucgcccaggugcagcaggccggcgggggcgacagcgacaagcuguccugcagccugaagaagcggaugccggaggggcccuggcccgcggacgcccccuccuggaugaacaagccggucguggacggcaacagccaguccgaggcccucagccuggagaugcgcaaggaccccuccggcgccgggcuguggcuccacagcggcgggcccgugcugcccuacguccgggaguccgugcgccggaacccggccagcgcggccacccccuccacggccgugggccuguuccccgcccccaccgagugcuucgcgcgcgucagcugcuccgggguggaggcccucggccggcgcgacuggcugggcgggggcccgcgggccaccgacgggcaccgcggccagugccccaagggcgagccccgggugagccgccugccccggcaccagaaggucccggagaugggguccuuccaggacgacccgcccagcgccuuccccaagggccucggguccgagcuggagcccgccugccugcacagcauccucuccgcgacccugcacguguaccccgaggugcugcucagcgaggagacgaagcgcaucuuccuggaccggcugaagcccauguucagcaagcagaccaucgaguucaagaagaugcucaaguccaccagcgacggccugcagaucacccuggggcuccuggcccugcagcccuucgagcucgccaacacgcugugccacuccuga

SEQ ID NO: 29961 - RNA, 1527 nt, Artificial Sequence
  derived and/or modified sequence opt1 from FAM227B__Homo_sapiens__NP_689860
auggccggccagcggaccugccagcgccgcagcucccgggccgggcccggcaagaugcaggagccgcccaagagcaucgaggaguuccugaaguuccagaacugggacuacuggccccgcgagauccacuuccgggacgacgacaagugguccugcacccucaagaagaucaaggaggacagcuccuucgugagcaucuacacgcaccugugggagaacgucccccgcaucuucgaggcgcugcucaucauggaguccaagcugaaggaguacagccugauccuccagaaccacaccuccgagaucuucaaguggaaguccaugaucuccgagaccagcuccuaccggaagcuggagcgcuacggggaguuccugaagaaguaccacaagaagaagaagaucaugcucagcgacgagauggagaccgagaagaacaucgagggcugcuccuucacgggguucaaggccaacgagcugacccagcugccgcggcaccucgacgccgagcagaucuaccuguucauccugaaggcccacaacuucgacgagcgcguguucaagaucuggaagacccacuuccucagcgaggccuccaucgcgcugcugcacgacagcuucugguggugguuccuccacaaguuccggcccgaccgcgagaaccaggacugccuguucgaccggaucuccgagagcuacgugacccuguucaugagcaucccccucucccgcaaggacgccuucuuccagaucuaccccgacugccuggcccaggccaucuacgcgacguuccacgaggccuucccggagagcuccuaccuguucaacgacgaguucaaggaggaccucggcaacaacaucuuccuguggugcagcggccugaagccccagaagggguucuggauccacuggaagcucaaggagcuguccaccaccaccauccacggcagcaagaaggcccccgccaaguccgucaaggagcggaucgccgacagccaggagcacaucuccacgagcaucgacuucaacaucaucaagauccugaacaacccccgcgcguacacccucccgaucuccaaggaggagagccggcugucccgccuggccaccaagagccacuacuccagcaccgggcccgaguucaaccggguccucuucaacuucggcgggcagagcccccugauccuguacuaccucaagaugcacgagcuggccggcaucagcaaggcccccaagaagacgaagaucaagcugaccaagaucuuccaggagccgcuccccgcccccaccuaccgcgacgugaucaaggaggcgaagcggcaguucgcccgcaaccagaaggacuuccgcauccugcaggccaaggccaccaagaagccccacgaggugaagcaggacuucgagaaguuccugcacaagcuccgguccgaggccgagaucgagcgcgagugcguggcgagccugagcuccagcuccagcuccagcccguccagcacggacaacuacaacuucgaggaggaggaguacuga

SEQ ID NO: 29962 - RNA, 339 nt, Artificial Sequence
  derived and/or modified sequence opt1 from FAM32A__Homo_sapiens__NP_054796
auggaggccuacgagcagguccagaagggcccccugaagcucaaggggguggccgagcugggcgugaccaagcgcaagaagaagaagaaggacaaggacaaggcgaagcugcucgaggccauggggaccagcaagaagaacgaggaggagaagcggcgcggccuggacaagcggacgccggcccaggccgccuucgagaagaugcaggagaagcgccagauggagcggauccugaagaaggcguccaagacccacaagcagcgcguggaggacuucaaccggcaccucgacacccugaccgagcacuacgacauccccaaggucagcuggacgaaguga

SEQ ID NO: 29963 - RNA, 579 nt, Artificial Sequence
  derived and/or modified sequence opt1 from FAM3A__Homo_sapiens__NP_001164604
augcgccuggccggccccgagagcuccgugaccgccgcgccgcgggcccgcaaguacaagugcgggcucccccagcccugccccgaggagcaccuggccuuccgggucgugagcggcgccgccaacgugaucgggccgaagaucugccuggaggacaagaugcucauguccagcgucaaggacaacgugggccgcgggcugaacaucgcgcuggugaacggcgucuccggcgagcucaucgaggcccgggccuucgacaugugggccggggacgugaacgaccugcugaaguucauccgcccccuccacgagggcacccugguguucgucgcgagcuacgacgaccccgccacgaagaugaacgaggagacccggaagcuguucuccgagcucgggagccgcaacgccaaggagcuggccuuccgggacuccuggguguucgugggcgccaaggggguccagaacaagagccccuucgagcagcacgugaagaacuccaagcacagcaacaaguacgagggcuggccggaggcgcuggagauggagggcugcaucccccgccgguccaccgccagcuga

SEQ ID NO: 29964 - RNA, 708 nt, Artificial Sequence
  derived and/or modified sequence opt1 from FAM3B__Homo_sapiens__NP_478066
augcgcccccuggccggcgggcuccugaagguggucuucgugguguucgccagccugugcgcgugguacuccggcuaccuccuggccgagcugaucccggacgcgccccucagcuccgccgccuacagcauccgguccaucggggagcgccccguccugaaggcccccgugccgaagcggcagaagugcgaccacuggacccccugccccagcgacaccuacgccuaccgccugcucuccggcgggggccggagcaaguacgccaagaucugcuucgaggacaaccugcugaugggcgagcagcucgggaacguggcccgcggcaucaacaucgcgaucgucaacuacgugacggggaacgugaccgccacccggugcuucgacauguacgagggcgacaacuccgggcccaugaccaaguucauccagagcgccgccccgaagucccugcuguucauggucacguacgacgacggcagcacccgccucaacaacgacgccaagaacgcgaucgaggcccugggcuccaaggagauccggaacaugaaguuccgcagcuccuggguguucaucgccgccaaggggcuggagcuccccagcgagauccagcgggagaagaucaaccacuccgacgccaagaacaaccgcuacagcggcuggcccgcggagauccagaucgaggggugcauccccaaggagcgguccuga

SEQ ID NO: 29965 - RNA, 684 nt, Artificial Sequence
  derived and/or modified sequence opt1 from FAM3C__Homo_sapiens__NP_055703
augcgcguggccggcgccgcgaagcuggucguggccguggccgucuuccuccugaccuucuacgugaucagccagguguucgagaucaagauggacgccucccuggggaaccucuucgcccggagcgcgcuggacaccgccgcccgcuccacgaagcccccgcgguacaagugcggcaucagcaaggccugccccgagaagcacuucgcguucaagauggccuccggggccgccaacgucgugggccccaagaucugccuggaggacaacgugcucaugagcggggucaagaacaacgugggccgcggcaucaacguggcccuggcgaacgggaagaccggcgagguccuggacaccaaguacuucgacauguggggcggggacguggcccccuucaucgaguuccucaaggccauccaggacgggaccaucgugcugaugggcacguacgacgacggcgccaccaagcugaacgacgaggcccggcgccucaucgcggaccugggguccaccagcaucaccaaccugggcuuccgggacaacugggucuucugcgggggcaagggcaucaagacgaaguccccguucgagcagcacaucaagaacaacaaggacaccaacaaguacgagggguggcccgaggugguggagauggagggcugcaucccccagaagcaggacuga

SEQ ID NO: 29966 - RNA, 675 nt, Artificial Sequence
  derived and/or modified sequence opt1 from FAM3D__Homo_sapiens__NP_620160
augcgcgugagcggcguccugcggcuccuggcccugaucuucgccaucgugaccaccuggauguucauccgcuccuacaugagcuucuccaugaagacgauccggcucccccgcuggcuggcggccagcccgaccaaggagauccaggugaagaaguacaagugcgggcugaucaagcccugccccgccaacuacuucgccuucaagaucugcuccggcgccgcgaacgucguggggcccaccaugugcuucgaggaccggaugaucaugagcccggugaagaacaacgucggccgcgggcucaacaucgcccuggugaacggcaccacgggcgccgugcuggggcagaaggccuucgacauguacuccggcgacgucaugcaccucgugaaguuccugaaggagauccccgggggcgcgcuggugcucgucgccagcuacgacgaccccgggaccaagaugaacgacgagucccggaagcuguucagcgaccugggcuccagcuacgccaagcagcucggcuuccgcgacuccuggguguucaucggggccaaggaccugcggggcaagagccccuucgagcaguuccugaagaacuccccggacaccaacaaguacgagggguggcccgagcuccuggagauggagggcugcaugccgcccaagcccuucuga

SEQ ID NO: 29967 - RNA, 1329 nt, Artificial Sequence
  derived and/or modified sequence opt1 from FAM46A__Homo_sapiens__NP_060103
auggccgagggcgagggguacuucgccaugagcgaggacgagcuggcgugcucccccuacaucccgcucggcggggacuucggcgggggcgacuucggcgggggcgacuucgggggcggggacuucggcggcgggggcagcuucgggggccacugccuggacuacugcgagucccccaccgcccacugcaacgugcugaacugggagcagguccagcgccucgacggcauccugagcgagaccauccccauccacgggcggggcaacuuccccacgcuggagcuccagccgucccugaucgugaaggugguccgccggcgccuggccgagaagcggaucggggugcgcgacgugcggcucaacggcagcgccgccucccacguccugcaccaggacagcgggcugggcuacaaggaccucgaccugaucuucugcgcggaccugcgcggcgagggggaguuccagaccgugaaggacgugguccucgacugccugcuggacuuccuccccgagggcgugaacaaggagaagaucacgccccugacccugaaggaggccuacgugcagaagauggucaaggugugcaacgacuccgaccgguggagccucaucucccugagcaacaacuccgggaagaacguggagcugaaguucgucgacagccuccgccggcaguucgaguucuccguggacagcuuccagaucaagcuggacucccugcuccuguucuacgagugcagcgagaaccccaugaccgagaccuuccacccgaccaucaucggcgaguccguguacggggacuuccaggaggccuucgaccaccugugcaacaagaucaucgccacccgcaaccccgaggagauccggggcggcgggcuccugaaguacugcaaccugcucguccgcggcuuccggcccgcgagcgacgagaucaagacgcugcagcgcuacaugugcagccgguucuucaucgacuucuccgacaucggggagcagcagcgcaagcuggagagcuaccuccagaaccacuucgugggccuggaggaccggaaguacgaguaccugaugacccuccacgggguggucaacgaguccaccgugugccugaugggccacgagcgccggcagacccugaaccucaucacgaugcuggccauccgcgugcuggccgaccagaacgucauccccaacguggccaacgugaccugcuacuaccagccggcccccuacgucgcggacgccaacuucagcaacuacuacaucgcccaggugcagcccgucuucacgugccagcagcagaccuacuccaccuggcuccccugcaacuga

SEQ ID NO: 29968 - RNA, 1170 nt, Artificial Sequence
  derived and/or modified sequence opt1 from FAM46D__Homo_sapiens__NP_689843
augagcgagauccgcuucaccaaccugaccugggaccaggugaucacgcucgaccagguccuggacgaggugauccccauccacggcaaggggaacuucccgaccauggaggugaagcccaaggacaucauccacgucgugaaggaccagcugaucggccaggggaucaucgugaaggacgcccggcucaacggcuccgucgccagcuacauccuggcgucccacaacgggaucagcuacaaggaccuggacgugaucuucggcguggagcuccccggcaacgaggaguuccaggucgugaaggacgccgugcuggacugccugcucgacuuccugcccaaggacgucaagaaggagaagcuguccccggacaucaugaaggacgccuacgugcagaagcucgugaaggucugcaacgggcacgacugcuggagccugaucucccugagcaacaacaccggcaagaaccucgagcugaaguucguguccagccugcgccggcaguucgaguucuccguggacagcuuccagaucguccucgaccccaugcuggacuucuacuccgacaagaacgccaagcugaccaaggagagcuaccccgugguggucgccgaguccauguacggggacuuccaggaggcgaugacgcaccuccagcacaagcugaucugcacccgcaagcccgaggagauccggggcgggggccugcucaaguacugcagccugcuggugcacggcuucaagccggccugcauguccgagaucaagaaccucgagcgcuacaugugcagccgguucuucaucgacuucccccacaucgaggagcagcagaagaagaucgaguccuaccugcacaaccacuucaucggggagggcaugaccaaguacgacuaccugaugacccuccacgggguggucaacgagagcacggugugccugaugagcuacgagcgccggcagauccugcaccucaucaccaugauggcccugaagguccugggcgagcucaacauccugcccaacacccagaaggugaccugcuucuaccagcccgccccguacuucgcggccgaggcccgcuaccccaucuacgugauccccgagcccccgcccgucuccuuccagcccuaccacccccugcacuuccggggcagcaacgggauguccuga

SEQ ID NO: 29969 - RNA, 972 nt, Artificial Sequence
  derived and/or modified sequence opt1 from FAM49A__Homo_sapiens__NP_110424
augggcaaccugcucaaggugcugacccgcgagaucgagaacuacccccacuucuuccuggacuucgagaacgcccagccgaccgagggggagcgggagaucuggaaccagaucagcgccguccuccaggacuccgagagcauccuggcggaccugcaggccuacaagggcgccgggcccgagauccgcgacgccauccagaaccccaacgacauccagcuccaggagaaggccuggaacgcggugugcccccuggugguccggcugaagcgcuucuacgaguucuccauccggcucgagaaggcccugcagagccugcucgagucccugacgugcccgcccuacacccccacccagcaccuggagcgcgagcaggcccucgccaaggaguucgcggagauccugcacuucacccugcgguucgacgagcucaagaugcgcaaccccgccauccagaacgacuucagcuacuaccggcgcacgaucucccggaaccgcaucaacaacaugcaccuggacaucgagaacgaggugaacaacgagauggccaaccggaugagccuguucuacgccgaggccaccccgaugcucaagacccuguccaacgcgaccaugcacuucgugagcgagaacaagacgcugcccaucgagaacaccaccgacugccucuccaccaugacgagcgucugcaaggugaugcuggagacccccgaguaccgcucccgguucaccagcgaggagacccugauguucugcaugcgcgugauggucggcgugaucauccucuacgaccacgugcaccccgucggggccuucugcaagacguccaagaucgacaugaagggcugcaucaaggugcugaaggagcaggccccggacagcguggagggccugcucaacgcccugcgguucaccaccaagcaccugaacgacgaguccaccagcaagcagauccgcgccaugcuccaguga

SEQ ID NO: 29970 - RNA, 975 nt, Artificial Sequence
  derived and/or modified sequence opt1 from FAM49B__Homo_sapiens__NP_001243692
augggcaaccugcucaaggugcugaccugcaccgaccuggagcaggggcccaacuucuuccucgacuucgagaacgcccagccgacggagagcgagaaggagaucuacaaccaggucaacguggugcugaaggacgccgagggcauccuggaggaccuccaguccuaccgcggggcgggccacgagauccgggaggccauccagcaccccgccgacgagaagcugcaggagaaggccuggggcgccgucgugccccugguggggaagcucaagaaguucuacgaguucagccagcgccuggaggcggcccugcggggccuccugggggcccugaccuccacccccuacagcccgacccagcaccucgagcgcgagcaggcccuggcgaagcaguucgccgagauccugcacuucacgcuccgguucgacgagcugaagaugaccaaccccgccauccagaacgacuucuccuacuaccgccggacccugagccgcaugcggaucaacaacguccccgccgagggcgagaacgaggugaacaacgagcucgccaaccgcaugucccuguucuacgcggaggccacccccaugcugaagacgcucagcgacgccaccaccaaguucguguccgagaacaagaaccugccgaucgagaacaccacggacugccugagcaccauggccuccgucugccgggugaugcucgagacccccgaguaccgcagccgguucaccaacgaggagacgguguccuucugccugcgcgucauggugggggugaucauccuguacgaccacguccaccccgugggcgccuucgcgaagaccagcaagaucgacaugaaggggugcaucaaggugcucaaggaccagcccccgaacuccgucgagggccugcugaacgcccuccgguacaccaccaagcaccugaacgacgagacgaccagcaagcagaucaaguccaugcugcaguga

SEQ ID NO: 29971 - RNA, 978 nt, Artificial Sequence
  derived and/or modified sequence opt1 from FAM50B__Homo_sapiens__NP_036267
auggcccaguacaagggcaccaugcgcgaggccgggcgggcgaugcaccuccugaagaagcgcgagcggcagcgcgagcagauggaggugcugaagcagcggaucgccgaggagaccauccugaagucccaggucgacaagcgcuucagcgcccacuacgacgccguggaggccgagcucaagagcuccacggugggccuggucacccugaacgacaugaaggcgcggcaggaggcccucgugcgcgagcgggagcgccagcuggccaagcggcagcaccuggaggagcagcgccuccagcaggagcggcagcgcgagcaggagcagcggcgcgagcggaagcgcaagaucagcugccuguccuucgcccuggacgaccucgacgaccaggcggacgccgccgaggcccggcgcgccgggaaccugggcaagaaccccgacguggacaccagcuuccugccggaccgggaccgcgaggaggaggagaaccgccuccgggaggagcugcgccaggagugggaggcgcagcgggagaaggucaaggacgaggagauggaggugaccuucuccuacugggacgggagcggccaccgccggacggugcgcguccggaagggcaacaccgugcagcaguuccugaagaaggcccuccaggggcugcgcaaggacuuccuggagcuccgguccgccggcguggagcagcugauguucaucaaggaggaccugauccucccccacuaccacaccuucuacgacuucaucaucgcccgcgcccggggcaagagcgggccccuguucuccuucgacguccacgacgacgugcgccugcucagcgacgcgaccauggagaaggacgagucccacgccgggaaggugguccugcggagcugguacgagaagaacaagcacaucuuccccgccucccgcugggaggccuacgacccggagaagaagugggacaaguacacgauccgguga

SEQ ID NO: 29972 - RNA, 1269 nt, Artificial Sequence
  derived and/or modified sequence opt1 from FAM53B__Homo_sapiens__NP_055476
auggugaugguccugagcgagucccucagcacccgcggcgccgacuccaucgccugcgggaccuucagccgggagcugcacacgcccaagaagaugucccagggcccgacccuguucagcugcgggaucauggagaacgaccgcuggcgggaccucgaccgcaagugcccccugcagaucgaccagcccuccaccagcaucugggagugccugcccgagaaggacuccagccucuggcaccgggaggcggugaccgccugcgccgugacgucccugaucaaggaccugagcaucuccgaccacaacggcaacccgagcgccccgcccuccaagcgccagugccggagccucuccuucagcgacgagauguccagcugccgcaccagcuggcggccccugggguccaaggucuggacccccguggagaagcgccggugcuacagcggcggcuccgugcagcgcuacagcaacggguucuccaccaugcagcggagcuccagcuucucccugcccagccgcgccaacguccucuccagccccugcgaccaggcgggccugcaccaccgguucgggggccagcccugccagggggugccgggcuccgcccccugcggccaggccggggacacguggagccccgaccugcaccccgugggcgggggccgccucgaccugcagcggucccugagcugcucccacgagcaguucagcuucgucgaguacugcccgcccuccgccaacagcacccccgcgagcacccccgagcucgcccgccgguccagcggccugucccgcagccggucccagccgugcgugcugaacgacaagaaggugggggucaagcgccgccggcccgaggaggugcaggagcagcgccccagccucgaccuggccaagauggcccagaacugccagaccuucuccagccuguccugccucagcgccggcacggaggacugcgggccccaguccccguucgcgcggcacgugagcaacacccgcgccuggaccgcccugcuguccgccagcggccccgggggccggacccccgccggcacgcccgucccggagccccugcccccguccuucgacgaccaccucgcgugccaggaggaccugagcugcgaggaguccgacagcugcgcccucgacgaggacugcgggcgccgggccgagcccgccgccgcguggcgcgaccggggcgcccccgggaacagccugugcucccuggacggcgagcucgacaucgagcagaucgagaagaacuga

SEQ ID NO: 29973 - RNA, 774 nt, Artificial Sequence
  derived and/or modified sequence opt1 from FAM57A__Homo_sapiens__NP_079068
augcugcucacccuggccggcggggcccuguucuuccccggccucuucgcgcugugcaccugggcccugcgccggagccagccgggguggucccgcacggacugcgugaugaucagcacccggcucgucuccagcgugcacgccgugcuggccaccggcuccgggaucgucaucauccgcagcugcgacgacgugaucaccggccggcacuggcuggcccgcgaguacgugugguuccucauccccuacaugaucuacgacuccuacgcgauguaccugugcgaguggugccggacgcgcgaccagaaccgggcccccagccugacccuccgcaacuuccugucccggaaccgccugaugaucacccaccacgccgucauccucuucgugcuggugcccgucgcccagcggcugcgcggcgaccucggggacuucuucgugggcugcaucuucaccgcggagcugagcacgccguucgugucccuggggcggguccucauccagcugaagcagcagcacacccugcucuacaaggugaacggcauccugacccuggccaccuuccucagcugccgcauccugcuguuccccuucauguacugguccuacgggcggcagcagggccucagccugcuccaggugcccuucuccauccccuucuacugcaacgucgccaacgccuuccucguggccccgcagaucuacugguucugccugcugugccgcaaggcggugcggcuguucgacacgccccaggccaagaaggacggcuga

SEQ ID NO: 29974 - RNA, 687 nt, Artificial Sequence
  derived and/or modified sequence opt1 from FAM58A__Homo_sapiens__NP_001124469
auggaggcccccgagggcgggggcgggggcccggccgcgcgcgggcccgagggccagcccgcccccgaggcccgggugcacuuccgcgucgcccgguucaucauggaggccggcgugaagcuggggaugcgcagcaucccgaucgcgaccgccugcaccaucuaccacaaguucuucugcgagacgaaccucgacgccuacgaccccuaccugaucgccauguccagcaucuaccuggcgggcaagguggaggagcagcaccuccggacccgcgacaucaucaacgucuccaaccgguacuucaaccccagcggggagccccuggagcuggacucccgcuucugggagcuccgggacagcaucgugcagugcgagcugcugaugcuccgcgugcugcgguuccaggucuccuuccagcacccgcacaaguaccugcuccacuaccuggugagccugcagaacuggcucaaccgccacuccuggcagcggacccccguggccgucaccgccugggcccugcugcgcgacagcuaccacggcgcccucugccugcgguuccaggcgcagcacaucgccguggccgugcuguaccucgcccugcaggucuacgggguggaggugcccgccgaggucgaggcggagaagcccugguggcagaucuacacgauggacaccgagaucccguga

SEQ ID NO: 29975 - RNA, 666 nt, Artificial Sequence
  derived and/or modified sequence opt1 from FAM60A__Homo_sapiens__NP_001129284
auguucggcuuccacaagcccaagauguaccgcagcaucgaggggugcugcaucugccgggccaaguccagcuccagccgcuucaccgacuccaagcgguacgagaaggacuuccagagcugcuucggccugcacgagacccgcuccggggacaucugcaacgccugcgugcuccuggucaagcgguggaagaagcugccggcgggcagcaagaagaacuggaaccacgugguggacgcccgcgccgggcccucccucaagacgacccugaagcccaagaaggucaagacccugagcggcaaccggaucaaguccaaccagaucagcaagcuccagaaggaguucaagcgccacaacuccgacgcccacagcaccacguccagcgccucccccgcgcagagcccgugcuacuccaaccagagcgacgacggcagcgacaccgagauggccuccgggagcaaccggacccccguguucuccuuccuggaccugaccuacuggaagcgccagaagaucugcugcggcaucaucuacaaggggcgguucggcgaggugcucaucgacacgcaccuguucaagcccugcugcagcaacaagaaggccgccgcggagaagcccgaggagcaggggccggagccccugcccaucuccacccaggagugguga

SEQ ID NO: 29976 - RNA, 1866 nt, Artificial Sequence
  derived and/or modified sequence opt1 from FAM63B__Homo_sapiens__NP_001035540
auggagagcucccccgagagccugcagccgcucgagcacggcguggccgccgggcccgcguccggcaccgggagcucccaggagggccugcaggagacccgccuggccgccggggacggccccggcgucugggccgccgagacgagcgggggcaacgggcucggcgcggccgccgcccggcgcucccugcccgacagcgcguccccggccgggagccccgaggugcccggccccugcuccagcuccgccggccuggaccucaaggacagcgggcuggaguccccggccgccgcggaggcgccccugcggggccaguacaaggugaccgccagccccgagaccgccgucgccggggugggccacgagcucggcaccgccggggacgccggcgcccgccccgaccuggccgggacgugccaggccgagcugaccgcggccggcuccgaggagccgagcuccgccgggggccucagcagcuccugcagcgaccccuccccgcccggcgagagccccucccuggacagccuggaguccuucagcaaccuccacuccuuccccagcuccugcgaguucaacagcgaggagggggccgagaaccgggugcccgaggaggaggagggcgccgcgguccugcccggggccgugccgcugugcaaggaggaggagggcgaggagaccgcccaggugcucgccgcguccaaggagcgcuuccccgggcagagcgucuaccacaucaaguggauccaguggaaggaggagaacacccccaucaucacgcagaacgagaacggccccugcccgcugcuggccauccucaacgugcugcugcucgccuggaaggugaagcugccgcccaugauggagaucaucaccgccgagcagcugauggaguaccucggcgacuacaugcuggacgccaagcccaaggagaucuccgagauccagcggcugaacuacgagcagaacaugagcgacgcgauggccauccuccacaagcugcagaccgggcuggacgucaacgugcgcuucaccggcgugcgggucuucgaguacacgcccgagugcaucguguucgaccuccuggacaucccccuguaccacggguggcucguggacccccagaucgacgacaucgucaaggccgugggcaacugcuccuacaaccagcugguggagaagaucaucagcugcaagcaguccgacaacagcgagcuggucagcgagggguucguggccgagcaguuccucaacaacaccgccacccagcugaccuaccacggccugugcgagcucacguccaccgugcaggagggcgagcugugcgucuucuuccgcaacaaccacuucagcaccaugaccaaguacaaggggcagcuguaccuccuggugacggaccagggcuuccugaccgaggagaaggucgugugggagucccuccacaacguggacggggacggcaacuucugcgacagcgaguuccaccuccggccgcccuccgaccccgagaccgucuacaagggccagcaggaccagaucgaccaggacuaccugauggcgcugagccugcagcaggagcagcagucccaggagaucaacugggagcagauccccgaggggaucagcgaccuggagcuggccaagaagcuccaggaggaggaggaccgccgggccucccaguacuaccaggagcaggagcaggccgccgcggccgccgccgcggccagcacccaggcccagcagggccagccggcccaggccucccccagcuccgggcgccagagcggcaacuccgagcggaagcgcaaggagccccgggagaaggacaaggagaaggagaaggagaagaacagcugcgugauccuguga

SEQ ID NO: 29977 - RNA, 747 nt, Artificial Sequence
  derived and/or modified sequence opt1 from FAM64A__Homo_sapiens__NP_001182157
auggccagccgcuggcagaacaugggcaccuccgugcggcgccggagccugcagcaccaggagcagcucgaggacuccaaggagcugcagcccgucgugagccaccaggagaccuccgugggggcccugggcagccucugccgccaguuccagcggcgccugccgcugcgggcggucaaccucaaccugcgcgccgggcccuccuggaagcggcuggagacgcccgagcccggccagcaggggcuccaggccgccgcccgcagcgcgaaguccgcccugggcgccgugagccagcggauccaggaguccugccagagcggcaccaaguggcugguggagacccaggucaaggcccgccggcgcaagcgcggggcgcagaagggcuccgggagcccgacccacucccucagccagaaguccacgcggcugagcggcgccgcccccgcccacuccgccgcggaccccugggagaaggagcaccaccggcugagcgugcgcauggggagccacgcccacccccuccggcgcucccggcgcgaggccgccuuccgcagcccguacuccagcaccgagccccugugcucccccagcgaguccgacagcgaccuggagcccgugggcgccggcauccagcaccuccagaagcugucccaggagcuggacgaggcgaucauggccgaggagcggaagcaggcccucagcgaccgccagggguucauccugaaggacgucuacgccuccccguga

SEQ ID NO: 29978 - RNA, 3144 nt, Artificial Sequence
  derived and/or modified sequence opt1 from FAM65B__Homo_sapiens__NP_001273374
augcaguucuucgacgccgaggagcugcucguggacgaggaggacgacgucuucggcgaggggcugcccacccgccugccggagaucaugcucgugggcagccaguccuucagccccgggggccccaacgggaucauccggucccagagcuucgccggcuucuccggccugcaggagcgccggagccgcugcaacuccuucaucgagaacagcuccgcgcugaagaagccccaggccaagcucaagaagaugcacaaccuggggcacaagaacaacaacccgcccaaggagccccagcccaagcggguggaggaggucuaccgcgcccugaagaacggccucgacgaguaccuggaggugcaccagaccgagcuggacaagcucacggcccagcugaaggacaugaagcggaacagccgccugggggugcucuacgaccuggacaagcagaucaagaccaucgagcgguacaugcgccggcuggaguuccacaucuccaaggucgacgagcucuacgaggccuacugcauccagcgccggcugcaggacggcgcgagcaagaugaagcaggccuucgccaccuccccggccagcaaggcggcccgcgagucccugaccgagaucaaccggagcuucaaggaguacacggagaacaugugcaccaucgagguggagcucgagaaccugcugggggaguucuccaucaagaugaagggccucgccggcuucgcccgccugugccccggggaccaguacgagaucuucaugaaguacggccggcagcgcuggaagcugaaggggaagaucgaggugaacggcaagcagagcugggacggcgaggagaccgucuuccucccccugaucgugggguucaucuccaucaaggugaccgagcugaagggccucgccacgcacauccuggucgggagcgugaccugcgagaccaaggagcuguucgcggcccggccccagguggucgccguggacaucaacgaccucggcaccaucaagcugaaccuggagaucacgugguacccguucgacguggaggacaugaccgccagcuccggggccggcaacaaggcggccgcccuccagcgccggaugagcauguacucccagggcacccccgagacccccacguucaaggaccacagcuucuucuccaaccugcccgacgacaucuucgagaacgggaaggccgccgaggagaagaugccgcugagccucuccuucagcgaccugcccaacggcgacugcgcgcugaccucccacagcaccgggucccccagcaacuccaccaaccccgagaucacgaucaccccggccgaguucaaccucagcucccuggccagccagaacgagggcauggacgacaccuccagcgccuccagccgcaacagccugggggagggccaggagcccaagucccaccucaaggaggaggaccccgaggagccccgcaagccggccagcgcgcccuccgaggccugccggcgccagagcuccggcgccggggccgagcaccuguuccuggagaacgacgucgcggaggcccuccugcaggagagcgaggaggccuccgagcugaagcccguggagcuggacaccagcgagggcaacaucacgaagcagcucgugaagcggcugaccuccgccgagguccccauggccaccgaccgccugcucagcgagggguccgugggcggggagagcgagggcugccgguccuuccuggacggcagccuggaggacgcguucaacgggcuccugcuggcccucgagccgcacaaggagcaguacaaggaguuccaggaccugaaccaggaggugaugaaccuggacgacauccucaagugcaagcccgccgucucccgcagccgguccagcagccugucccugaccguggagagcgcccucgaguccuucgacuuccugaacacgagcgacuucgacgaggaggaggacggcgacgaggucugcaacgucgggggcggcgccgacuccguguucagcgacaccgagaccgagaagcacuccuaccgcagcgugcaccccgaggcgcgggggcaccuguccgaggcccucaccgaggacacgggcguggggaccagcguggccggcuccccgcugccccugaccaccgggaacgagagccucgacaucacgaucguccgccaccuccaguacugcacccagcuggugcagcagaucguguucuccagcaagacccccuucgucgcccggucccugcuggagaagcugagccgccagauccaggugauggagaagcucgccgcgguguccgacgagaacaucggcaacaucagcuccgucguggaggccauccccgaguuccacaagaagcugagccugcucagcuucuggaccaagugcugcuccccggugggcgucuaccacagccccgccgaccgggugaugaagcagcuggaggccuccuucgcgcgcaccgugaacaaggaguaccccgggcuggccgaccccgucuuccggacgcucgugagccagauccuggaccgcgccgagccgcugcucuccagcucccugagcuccgagguggucaccguguuccaguacuacagcuacuucaccucccacggcgugagcgaccuggaguccuaccucagccagcuggcccggcaggucuccauggugcagacccugcagagccuccgcgacgagaagcugcugcagacgauguccgaccucgcccccagcaaccugcuggcgcagcaggaggugcuccggacccuggcccugcuccugacccgcgaggacaacgaggucuccgaggccgugacccuguaccucgccgccgcgagcaagaaccagcacuuccgcgagaaggcccugcuguacuacugcgaggcccucacgaagaccaaccugcagcugcagaaggccgccugccucgcgcugaagauccuggaggccaccgagagcaucaagaugcucgugacccugugccaguccgacacggaggagauccggaacgucgccagcgagacccugcucucccugggggaggacggccgccuggccuacgagcagcucgacaaguucccccgggacugcgugaaggucgggggccgccacggcaccgagguggcgaccgccuucuga

SEQ ID NO: 29979 - RNA, 1260 nt, Artificial Sequence
  derived and/or modified sequence opt1 from FAM69C__Homo_sapiens__NP_001037834
auggcccgcgccgcgggcgcccgggggcccgccggcuggugccgccggcgcgggcggugcggccgcgggacccugcucgccuucgccgcguggaccgccggcugggugcuggccgccgcgcugcuccugcgggcccacccgggcguccugagcgagcgcugcacggacgagaagucccggcgcauccucgccgcccugugccaggacuaccagggcgggacccuggccggggaccucugcgaggaccugugcguggcgggcgagcugcuguuccagcggugccugcacuacaaccgcgggaagaaggugcugcaggccgacuggcggggccgccccgucgugcucaagagcaaggaggaggccuucuccagcuucccgccccugucccugcucgaggaggaggccggcgagggcgggcaggacaugcccgaggccgagcugcugcucaugguggcgggggaggucaagagcgcccugggccuggagcucuccaacagcucccugggccccugguggcccgggcggcgcggcccccgguggcgcgggcagcuggccagccucugggcccugcugcagcaggaggaguacguguacuucucccuccugcaggaccugagcccgcacgugcuccccguccugggcuccugcgggcacuucuacgccguggaguuccuggcggccggcagcccccaccaccgggcccucuucccccuggaccgcgccccgggcgcccccgggggcgggcaggcgaaggccaucuccgacaucgcccugagcuuccucgacauggugaaccacuucgacuccgacuucagccaccggcugcaccugugcgacaucaagcccgagaacuucgccauccgcuccgacuucaccgucguggcgaucgacguggacauggccuucuucgagcccaagaugcgcgagauccucgagcagaacugcaccggcgacgaggacugcaacuucuucgacugcuucagccggugcgaccugcgcgucaacaagugcggggcccagcgggugaacaacaaccuccaggugaucugcgacaagaucuuccgccacugguucagcgccccgcucaaguccagcgccgucuccuuccagcugcagcugcagcuccaggaggcggugcaggagugcgccgaccccggcgugcccagcggcaacacgcggcgcgccgccuccagcgucuucuggaagcugcggcagcugcugcaggccacccuccgcgagcugcaggaggcggagaaguga

SEQ ID NO: 29980 - RNA, 1035 nt, Artificial Sequence
  derived and/or modified sequence opt1 from FAM71F1__Homo_sapiens__NP_115988
augcugagcuccuucccccaccgcaagaccuggcgcaagagcaagaagaccgugaaggucacgcgguccuaccccaccuuccccagccucaacgccugggaggaguuccggggccugcugcccguggacggggagcccaacccgggcgccgggcucggcguggaggaggggcugcugugccgcgucgugcacucccccgaguucaaccucuuccuggacagcguggucuucgaguccaacuucauccaggugaagcggggccgcaacuggcgggacguguacaaggcgagcaacaccauggcccugggcgucaccuccagcgugcccugccucccccugccgaacauccugcucauggccuccgugaaguggcaccaggggcagaaccagacguggaaccgccccagcaucgcccccaacaucuuccugaagcggauccugccccuccgcuucgucgagcuccaggugugcgaccacuaccagcggauccugcagcugcgcaccgugaccgagaagaucuacuaccugaagcugcacccggaccaccccgagaccgucuuccacuucuggauccggcucgugcagauccugcagaagggccuguccaucacgaccaaggacccccgcauccucgugacccacugccugguccccaagaacugcagcuccccgagcggggacuccaagcuggugcagaagaagcuccaggccagccagcccuccgagagccugauccagcugaugaccaagggcgagagcgaggcgcucucccagaucuucgccgaccugcaccagcagaaccagcugagcuuccgguccagccgcaagguggagacgaacaagaacuccagcgggaaggacuccagccgggaggacuccauccccugcacgugcgaccuccgcuggcgggccagcuucaccuacggcgagugggagcgcgagaaccccuccggccugcagccgcugagccuccuguccacccuggccgcgagcaccgggccccagcucgccccgcccaucggcaacuccaucuga

SEQ ID NO: 29981 - RNA, 930 nt, Artificial Sequence
  derived and/or modified sequence opt1 from FAM71F2__Homo_sapiens__NP_001012457
augagcaagauccgcggccugcccccggaggugcgggagcccgggcccggcgucgagcucgggguggagaacggccugcugugccagcucauccacucccccgaguucaaccuguucagcaacuccguggucuucgagagcaacuucauccagacccacgugccggaggccgacuuccaggugaccaagcccgggaacuggcgcgacgucugcgagggcuccgccacggugauccugggcgugaccagcuccguccccagccucccccugccgaacgugcugcucauggcgaacgugaccuggccccaggggcccuucaccacgugguccacccccggcgacgccccggucaucaaccugagccggcugcucccccugaaguacguggagcugcgcaucuacgaccggcuccagcgcauccugcgggugcgcaccgucaccgagaagaucuacuaccugaagcuccacgagaagcaccccgagaucguguuccaguucugggugcggcuggucaagauccugcagaaggggcucuccaucacgaccaaggacccccgcaucaaguucacccacugccuggugccgaagaugcccaccaacagcacggagaccacccccgagaacucccugcucagcagcccccagccguccgagccccuggugcugcucgccgccgagcagaccuccggcagcuucucccagcugagcgggaagccccagcugacggccgaccggaacaacgacaccgcgaucgagaucgacaacugcagcuccuacaagauccccagcccggucgccucccccaucaaccucaacauccccaugcgcgccgcccugagccacucccugugggagcaggaggacuggaacgagcaccuccuccaggugcacaucgcgagcuaccugggcgagcacuuccugggcgccuga

SEQ ID NO: 29982 - RNA, 330 nt, Artificial Sequence
  derived and/or modified sequence opt1 from FAM72B__Homo_sapiens__NP_001307078
augagcaccaacaucugcuccuucaaggacagcgccguggacuucaccggccgcugcuacuucacgaagaucugcaagugcaagcugaaggacaucgccugccucaagugcgggaacaucgucggcuaccacgugaucgugcccugcuccagcugccugccguccugcaacaacgggcacuucuggauguuccacagccaggcggucuacgacaucaaccggcuggacuccaccggcgugaacauccuccugugggggaaccugcccgagaucgaggagagcaccgacgaggacgugcucaacaucuccgccgaggagugcauccgcuga

SEQ ID NO: 29983 - RNA, 786 nt, Artificial Sequence
  derived and/or modified sequence opt1 from FAM78B__Homo_sapiens__NP_001017961
augggcugcauccagagcaucacgugcaaggcccgcauccggcgcgagaacaucguggucuacgacgugugcgccaccaucgaccagugccccacccggaucgaggagaccucccccaucgugcugcgcuacaagacccccuacuucaaggcgagcgcccgggucgugaugccgcccaucccccgccacgagaccuggguggucggguggauccaggccugcaaccagauggaguucuucaacacguacuccgaccucggcaugagcuccugggagcugcccgaccugcgggaggggcgcgugaaggccaucagcgacuccgacggcgugagcuaccccugguacgggaacaccaccgagaccgucacgcucgugggccccaccaacaagaucucccgguucagcguguccaugaacgacaacuucuacccgagcgucaccugggccgugcccguguccgacagcaacgucccccugcugacccgcaucaagcgggaccaguccuucacgaccuggcucguggcgaugaacaccaccacgaaggagaagaucauccugcagaccaucaaguggcgcaugcggguggacaucgaggucgacccccugcagcuccugggccagcgcgcccggcugguggggcgcacccagcaggagcagccgcggauccucagccgcauggagcccaucccgcccaacgcccuggugaagcccaacgccaacgacgcgcagguccugauguggcggcccaagcgcggcccgccccucguggugaucccgcccaaguga

SEQ ID NO: 29984 - RNA, 1359 nt, Artificial Sequence
  derived and/or modified sequence opt1 from FAM81B__Homo_sapiens__NP_689761
augcagcugcaguuccucggcacccuggccagcuccgagaagcgcaagaagucccagcggcuguucuucaagaacaucaagagcaccaagaacaaggccgggaaggcgagcaucauguccagcgacacgaacgugaacaaguccgccagccccaccgccaccgccgaggagcagccggucgagcccgacggcccccuccccggguccgacaacaaccaggagaagaaggugcgccugagcccggccaagauguccaccaagaacagcacggaccugguggaguacgucgacaagucccacgcguuccuccccaucauccccaacacccagcggggccagcuggaggaccgccugaacaaccaggcccggaccaucgccuuccuccuggagcaggccuuccgcaucaaggaggacaucagcgcgugccugcaggggacccacggcuuccggaaggaggagucccucgcccgcaagcugcuggagagccacauccagacgaucaccuccaucgugaagaagcucagccagaacaucgagauccuggaggaccagauccgggcccgcgaccaggccgccaccggcaccaacuucgcggugcacgagaucaacaucaagcaccuccagggggucggcgaccugcgggggcgcguggcccggugcgacuccagcaucgugaagcugagcggcgacauccaccuguuccgccaggagcaccggcagaucgagaaggccauccaggaguucguccccgcccucgagacgcuguccaagaaccuggacaugaaggugaugcagcuccuggggaagaucgagaccgccagcuccgagcagaccagcaaccugaagauggugcagggcgacuaccgccacgagaugaaccuccuggaguucaaguuccacucccugagcuccaaccucuacgaggaggucgagaacaacaagaaguggaccgagaaccaguuccugaaguaccggaaggaccaccugggccacaucaacgagugccucaaggugcugcaggagaagcuggagaaguccgagaacaagauggaggagaagcuccugcagcugagcagcaagguggagaacuucaucaacacgcagaagcaggagacccagcucuccaaggucaagcacauggagaacaagcugagcaagaagauggagcagauggagaagcagaucuggggcgagcuggagaccaugcagaacgaguaccaguccggguucaagagcauccacgacucccucagcucccugcagcagauccagaagaccaagauggaccuggagaaguacaaggugcagaaggaccucaagaagcugcagcgcaagaucguggagcugcaggaggucuga

SEQ ID NO: 29985 - RNA, 885 nt, Artificial Sequence
  derived and/or modified sequence opt1 from FAM83A__Homo_sapiens__NP_001275516
augagccgcucccggcaccugggcaagauccgcaagcggcucgaggacgugaagucccaguggguccgccccgcccgggccgacuucuccgacaacgagagcgcgcgccuggccaccgacgcccugcucgacgggggcuccgaggccuacuggcgggugcugagccaggagggggagguggacuuccuguccagcgucgaggcccaguacauccaggcgcaggcccgcgagccgcccugcccgcccgacacccucggcggggccgaggccggccccaagggccuggacuccagcucccugcagagcgggacguacuuccccguggcguccgagggcagcgagcccgcccuccugcacuccugggccagcgccgagaagcccuaccugaaggagaaguccagcgccaccguguacuuccagaccgucaagcacaacaacauccgggaccucgugcgccggugcaucacccgcacgucccagaacaucagcauccggagcguggagggggagaucuacugcgcgaaguccggccgcaaguucgccgggcagauccgggagaaguucaucaucagcgacuggcgcuucguccuguccggcagcuacuccuucaccuggcugugcggccacgugcaccggaacauccucagcaaguucaccgggcaggccguggagcuguucgacgaggaguuccgccaccuguacgccuccagcaagccggucaugggccucaagagcccccggcugguggcccccgugcccccgggggcggcccccgccaacggccgccugagcuccagcuccggcagcgccuccgaccggaccagcuccaaccccuucagcgggcgcuccgccggcagccaccccgggacgcgcaccgacggcuga

SEQ ID NO: 29986 - RNA, 3036 nt, Artificial Sequence
  derived and/or modified sequence opt1 from FAM83B__Homo_sapiens__NP_001010872
auggagaccagcuccaugcugagcucccucaacgacgagugcaagagcgacaacuacaucgagccccacuacaaggagugguaccgcguggccaucgacauccugaucgagcacggccuggaggccuaccaggaguuccucguccaggagcggguguccgacuuccuggcggaggaggagaucaacuacauccugaagaacgugcagaaggucgcccagagcaccgcccacgggacggacgacuccugcgacgacacccucagcuccggcaccuacuggccgguggagagcgacguggaggcccccaaccuggaccugggguggcccuacgucaugcccggccuccucgggggcacccacaucgaccugcuguuccacccgccccgcgcccaccuccugacgaucaaggagaccauccggaagaugaucaaggaggcgcgcaaggugaucgcccuggugauggacaucuucaccgacgucgacaucuucaaggagaucguggaggccuccacccggggcgugagcgucuacauccugcuggacgaguccaacuucaaccacuuccucaacaugacggagaagcaggggugcagcgugcagcgccugcggaacauccgcgugcggaccgucaagggccaggacuaccuguccaagaccggggccaaguuccacggcaagauggagcagaaguuccuccugguggacugccagaaggugauguacgggagcuacuccuacauguggagcuucgagaaggcgcaccuguccaugguccagaucaucaccggccagcucguggagagcuucgacgaggaguuccgcacgcuguacgcccggagcugcgugcccuccagcuucgcccaggaggaguccgcccgcgucaagcacggcaaggcccugugggagaacgggaccuaccagcacagcguguccagccucgcguccgugagcucccagcggaaccuguucggccgccaggacaagauccacaagcuggacagcuccuacuucaagaaccgggggaucuacacccucaacgagcacgacaaguacaacauccgcagccacggcuacaagccccacuucgucccgaacuucaacggccccaacgccauccggcaguuccagcccaaccagaucaacgagaacuggaagcgccacuccuacgccggggagcagcccgagaccgugccguaccugcugcucaaccgggcccugaaccgcacgaacaacccgcccggcaacuggaagaagcccagcgacucccugagcgucgccuccagcucccgggagggguacgugagccaccacaacaccccggcgcagagcuucgccaaccgccucgcccagcgcaagaccaccaaccuggccgaccggaacuccaacgugcgccggagcuucaacggcacggacaaccacauccgcuuccugcagcagcggaugcccacccucgagcacaccaccaaguccuuccugcgcaacuggcggaucgagagcuaccugaacgaccacuccgaggccacgcccgacagcaacggguccgcgcucggcgaccgcuucgagggcuacgacaaccccgagaaccugaaggccaacgcccuguacacccacagccggcuccgcuccagccuggucuucaagccgacccugcccgagcagaaggaggugaacuccugcaccacggggagcuccaacagcaccaucaucggcucccaggggagcgagacccccaaggaggugcccgacaccccgacgaacguccagcaccucaccgacaagccccugcccgaguccauccccaagcugccgcugcagagcgaggcccccaagaugcacacccuccaggugcccgagaaccacagcguggcccugaaccagaccacgaacggccacaccgaguccaacaacuacaucuacaagacccugggggucaacaagcagaccgagaaccucaagaaccagcagaccgagaaccugcugaagcggcgcagcuucccccucuucgacaacuccaaggcgaaccuggaccccggcaacagcaagcacuacguguacuccacgcugacccggaaccgcgugcggcagcccgagaagcccaaggaggaccuccucaagagcuccaagagcaugcacaacgucacccacaaccuggaggaggacgaggaggaggugaccaagcgcaacuccccgagcggcacgaccaccaaguccgugagcaucgccgcccugcuggacgucaacaaggaggaguccaacaaggagcuggccagcaagaaggaggugaaggggucccccagcuuccucaagaagggcucccagaagcugcggagccugcucucccugacccccgacaagaaggagaaccugagcaagaacaaggcgcccgccuucuaccgccucugcagcuccagcgacacgcugguguccgagggggaggagaaccagaagccgaagaaguccgacaccaaggucgacuccagcccccggcgcaagcacuccagcuccagcaacucccagggcagcauccacaaguccaaggaggacgugaccgugagccccucccaggagaucaacgcgcccccggacgagaacaagcgcacccccagccccgggcccgucgaguccaaguuccuggagcgggccggcgacgccagcgccccgcgcuucaacacggagcagauccaguaccgggacucccgcgagaucaacgccguggugacccccgagcggcgccccaccagcagcccccggccgaccuccagcgagcuccugcgcucccacagcacggaccggcgcgucuacucccgguucgagcccuucugcaagaucgagagcuccauccagcccaccagcaacaugcccaacaccuccaucaaccgcccggagaucaagagcgccaccaugggcaacuccuacgggcggagcagcccccugcucaacuacaacacgggcguguaccgcagcuaccagcccaacgagaacaaguuccggggguucaugcagaaguucggcaacuucauccacaagaacaaguga

SEQ ID NO: 29987 - RNA, 1758 nt, Artificial Sequence
  derived and/or modified sequence opt1 from FAM83D__Homo_sapiens__NP_112181
auggcccugcucagcgagggccuggacgaggugcccgccgcgugccuguccccgugcgggccgcccaaccccaccgagcuguucagcgagucccgccggcucgcccuggaggagcucgucgccggcgggcccgaggccuucgccgcguuccugcgccgggagcgccuggcccgguuccucaaccccgacgaggugcacgccauccugcgcgccgcggagcggcccggcgaggagggggccgccgccgccgcggccgccgaggacagcuucggcuccagccacgacugcuccagcggcaccuacuuccccgagcaguccgaccuggagccgccccuccuggagcugggguggcccgccuucuaccagggcgccuaccgcggggcgacgcggguggagacccacuuccagccccgcggcgccggggagggcggcccguacgggugcaaggacgcccuccggcagcagcugcgcagcgcccgggaggucaucgccguggugauggacgucuucaccgacaucgacaucuuccgcgaccugcaggagaucugccggaagcagggcguggcgguguacauccuccuggaccaggcccugcucucccaguuccuggacaugugcauggaccugaagguccaccccgagcaggagaagcucaugaccgugcgcacgaucaccgggaacaucuacuacgcccggagcggcaccaagaucaucggcaaggugcacgagaaguucacccugaucgacgggauccgcgucgccacgggcuccuacagcuucaccuggaccgacgggaagcugaacuccagcaaccucgugauccuguccggccagguggucgagcacuucgaccuggaguuccggauccucuacgcccagagcaagcccaucucccccaagcugcugagccacuuccagagcuccaacaaguucgaccaccucaccaaccgcaagccgcagagcaaggagcugacgcuggggaaccuccugcggaugcgccuggcgcgccucuccagcacgccccggaaggccgaccuggaccccgagaugcccgccgagggcaaggccgagcgcaagccgcacgacugcgaguccagcaccguguccgaggaggacuacuucagcucccaccgggacgagcugcagagccgcaaggcgaucgacgccgccacccagaccgagcccggcgaggagaugcccgggcucuccgugagcgaggucggcacccagaccuccaucaccacggccugcgccgggacccagaccgcggugaucacccggaucgccagcucccagacgaccaucuggagccgcuccaccaccacgcagaccgacauggacgagaacauccuguucccccggggcacccagagcaccgagggguccccggugagcaagaugagcgucucccgcagcuccagccugaaguccagcuccagcguguccagccagggcuccguggccagcuccacgggcagccccgccuccauccggaccaccgacuuccacaaccccggguaccccaaguaccucggcaccccgcaccuggagcuguaccucagcgacucccugcgcaaccugaacaaggagcggcaguuccacuucgccgggauccgcagccggcugaaccacaugcucgcgaugcugagccgccggacgcuguucaccgagaaccaccucggccugcacuccgggaacuucagccgcgucaaccugcucgccgugcgggacgucgcccuguaccccuccuaccaguga

SEQ ID NO: 29988 - RNA, 3558 nt, Artificial Sequence
  derived and/or modified sequence opt1 from FAM83H__Homo_sapiens__XP_006725151
auggcccccggcccgaacauggcccgccggagccaguccagcucccagggggacaacccccuggcgcccggcuaccugcccccgcacuacaaggaguacuaccgccucgccguggacgcccuggccgagggcgggagcgaggccuacucccgguuccucgcgaccgagggggcccccgacuuccugugccccgaggagcuggagcacgucagccgccaccuccggcccccgcaguacgugacccgcgagccgcccgagggcucccugcuggacguggacauggacggcagcuccgggacguacuggcccgucaacagcgaccaggccgugcccgagcucgaccugggcuggccccugaccuucggguuccagggcaccgaggugaccacgcucguccagccgccgccgcccgacucccccagcaucaaggacgaggcccggcgcaugauccgguccgcgcagcaggucguggccgucgugauggacauguucaccgacguggaccugcugagcgagguccucgaggccgccgcccgccgggugcccguguacauccugcuggacgagaugaacgcgcagcacuuccucgacauggccgacaagugccgcgucaaccugcagcacguggacuuccugcgggugcgcaccgucgccgggcccaccuacuacugccggacgggcaaguccuucaagggccacgugaaggagaaguuccuccugguggacugcgccgucgugaugagcggguccuacagcuucaugugguccuucgagaagauccaccgcagccuggcccacguguuccagggcgagcucgucagcuccuucgacgaggaguuccggauccuguucgcgcagagcgagccccuggugcccuccgccgccgcccucgcccgcauggacgcguacgcccuggcccccuacgccggggccggcccccuggucggcgugcccggggugggcgcgcccacccccuucagcuucccgaagcgggcccaccuccuguucccgccgccccgcgaggaggggcugggcuuccccuccuuccucgaccccgaccggcacuuccugagcgccuuccgccgcgaggagcccccgcggaugcccgggggcgcccuggagccccacgcgggccuccgcccccugucccggcgccuggaggccgaggccgggccggccggcgagcucgccggggcgcggggcuucuuccaggcccgccaccuggagauggacgccuucaagcggcacagcuucgccaccgagggggccggcgcgguggagaacuucgccgccgcccgccaggugucccggcagaccuuccugagccacggcgacgacuuccgcuuccagacgucccacuuccaccgggaccagcucuaccagcagcaguaccagugggacccccagcugacccccgcccgcccccaggggcuguucgagaagcuccggggcgggcgcgcgggcuucgccgaccccgacgacuucacccugggggccggcccccgguuccccgagcugggccccgacgggcaccagcgccucgacuacgugccgagcuccgccagccgggagguccgccacggcuccgaccccgcguucgcccccgggccccggggccuggagccgagcggcgcgccccgccccaaccugacccagcgcuuccccugccaggccgccgcccggccggggcccgaccccgccccggaggccgagcccgagcgccggggcgggcccgagggccgcgccgggcugcggcgcuggcggcucgccuccuaccugagcggcugccacggcgaggacgggggcgacgacgggcugcccgcgccgauggaggccgaggccuacgaggacgacgugcucgcccccggcgggcgcgcccccgcgggcgaccugcugcccuccgccuuccgggugccggccgccuuccccacgaagguccccgugcccggcccggggagcggcgggaacggccccgagcgcgaggggcccgaggagcccggccucgcgaagcaggacagcuuccggucccgccugaacccgcuggugcagcggagcucccgccuccggagcucccugaucuucagcaccucccaggccgagggcgccgccggggccgcggccgccaccgagaagguccagcugcuccacaaggagcagaccgugagcgagacgcugggccccgggggcgaggccgugcgcuccgccgcgagcaccaaggucgccgagcugcucgagaaguacaaggggcccgcccgggaccccggcggcggggccggcgccaucaccguggcgucccacagcaaggccguggucucccaggccuggcgcgaggagguggccgccccgggggcggugggcggcgagcggcgcagccuggaguccugccugcucgaccugcgggacagcuucgcccagcagcugcaccaggaggccgagcgccagcccggggccgcgucccucaccgccgcccagcugcuggacacgcucggccgcagcgggagcgaccggcugcccucccgcuuccugagcgcccagucccacagcaccagcccccagggccucgacuccccgcugccccuggagggguccggcgcccaccagguccuccacaacgagagcaagggcucccccaccagcgcguaccccgagcggaagggguccccgacccccggcuucagcacgcgccgggggucccccaccaccggcuucaucgagcagaaggggagcccgaccuccgccuaccccgagcgccggggcagccccgugcccccggugcccgagcgccgguccagccccgugcccccgguccccgagcgccggggcucccugacgcugaccaucagcggggagagccccaaggccggccccgccgaggaggggccguccggccccauggaggugcuccgcaaggggagccugcggcugcgccagcuccugucccccaagggcgagcggcgcauggaggacgagggcggguuccccgucccgcaggagaacggccagcccgagagcccccggcgccugucccucgggcagggcgacagcaccgaggccgcgaccgaggagcggggcccccgcgcccgccuguccagcgccacggccaacgcccuguacuccagcaaccuccgggacgacaccaaggcgauccuggagcagaucuccgcccacgggcagaagcaccgcgccgugccggcccccagccccggccccacccacaacuccccggagcuggggcggccgcccgcggccggcgugcucgcccccgacaugagcgacaaggacaagugcuccgccaucuuccgcagcgacucccuggggacccagggccggcugagccgcacccuccccgccuccgcggaggagcgggaccgccugcugcggcgcauggagagcaugcggaaggagaagcgcgucuacagccgguucgagguguucugcaagaaggaggaggccuccagccccggcgccggggagggccccgccgaggaggggacgcgcgacuccaaggugggcaaguucgucccgaagauccucgggaccuucaagagcaagaaguga

SEQ ID NO: 29989 - RNA, 879 nt, Artificial Sequence
  derived and/or modified sequence opt1 from FAM84A__Homo_sapiens__NP_660158
augggcaaccagcuggaccgcaucacccaccucaacuacagcgagcugcccaccggggaccccuccggcaucgagaaggacgagcugcgggugggggucgccuacuucuucagcgacgacgaggaggaccucgacgagcgcggccagcccgacaaguucggggugaaggccccgcccggcugcacgcccugccccgagucccccagccggcaccaccaccaccuccugcaccagcuggugcugaacgagacccaguucuccgcguuccgcggccaggagugcaucuucagcaaggucuccgggggcccccagggggccgaccugagcguguacgccgugaccgcccucccggcccugugcgagcccggcgaccugcucgagcugcuguggcuccagcccgcgcccgagccgcccgcccccgcgccccacugggccgucuacgucgggggcggccagaucauccaccuccaccagggggagauccggcaggacucccuguacgaggccggcgccgccaacguggggcgcguggugaacagcugguaccgguaccgcccgcugguggccgagcuggucgugcagaacgccugcggccaccugggccucaaguccgaggagaucugcuggaccaacagcgaguccuucgcggccuggugccgguucgggaagcgcgaguucaaggccggcggggaggugcccgccggcacgcagccgccccagcagcaguacuaccugaagguccaccugggggagaacaaggugcacaccgcccgguuccacagccucgaggaccugauccgcgagaagcggcgcaucgacgcguccggccggcugcgcgugcuccaggagcuggccgaccuggucgacgacaaggaguga

SEQ ID NO: 29990 - RNA, 933 nt, Artificial Sequence
  derived and/or modified sequence opt1 from FAM84B__Homo_sapiens__NP_777571
augggcaaccagguggagaagcugacccaccugagcuacaaggagguccccaccgccgacccgaccgggguggaccgcgacgacggcccccggaucgggguguccuacaucuucagcaacgacgacgaggacgucgagccccagcccccgccccagggccccgacgggggcggccugcccgacgggggcgacgggccgcccccgccccagccccagcccuacgacccccgccugcacgagguggagugcuccguguucuaccgggacgagugcaucuaccagaaguccuucgcccccggcagcgcggcccucagcaccuacaccccggagaaccugcugaacaagugcaagcccggggaccucgucgaguucgugucccaggcccaguacccccacugggccguguacgucggcaacuuccagguggugcaccuccaccgccuggaggucaucaacagcuuccugaccgacgccucccagggccggcgcgggcggguggugaacgaccuguaccgcuacaagccccugagcuccagcgcggucgugcggaacgcccucgcccacgugggcgccaaggagcgcgagcuguccuggcggaacagcgaguccuucgcggccuggugccgcuacgggaagcgggaguucaagaucggcggcgagcugcgcaucgggaagcagccguaccggcuccagauccagcugagcgcccagcgcucccacacgcuggaguuccagagccucgaggaccugaucauggagaagcggcgcaacgaccagaucggccgggccgccguccugcaggagcucgcgacccaccuccaccccgccgagcccgaggagggggacuccaacguggcccgcaccacgcccccgcccggccggccgcccgcccccagcagcgaggaggaggacggggaggccguggcgcacuga

SEQ ID NO: 29991 - RNA, 555 nt, Artificial Sequence
  derived and/or modified sequence opt1 from FAM89A__Homo_sapiens__NP_940954
augagcggcgcccgcgccgcgcccggggccgccggcaacggggccgugcggggccugcgcgucgacgggcucccgccccugcccaagucccugagcggccuccugcacuccgccagcggcgggggcgcguccgggggcuggcggcaccuggagcgccucuacgcccagaagucccggauccaggacgagcugagccgcgggggccccggcgggggcggggcccgggccgcggcccugcccgccaagccgcccaaccucgacgccgcccuggcgcugcuccgcaaggagauggugggccugcggcagcuggacaugagccuccugugccagcuguacucccucuacgagagcauccaggaguacaagggcgccugccaggccgccuccagccccgacugcaccuacgcccuggagaacggguucuucgacgaggaggaggaguacuuccaggagcagaacucccugcacgaccgccgggaccgcggcccgccccgggaccucagccugcccguguccagccuguccagcuccgacuggauccucgagagcaucuga

SEQ ID NO: 29992 - RNA, 756 nt, Artificial Sequence
  derived and/or modified sequence opt1 from FAM92A1__Homo_sapiens__NP_001269963
augaugcgccggacccuggagaaccgcaacgcccagaccaagcagcuccagaccgccgugagcaacgucgagaagcacuucggcgagcugugccagaucuucgcggccuacgugcggaagaccgcccgccugcgggacaaggccgaccuccuggugaacgagaucaacgccuacgcggccaccgagacgccccaccugaagcucgggcugaugaacuucgccgacgaguucgccaagcugcaggacuaccgccaggcggaggucgagcggcucgaggccaaggugguggagccgcugaagaccuacggcaccaucgucaagaugaagcgcgacgaccugaaggccacccucaccgcccggaaccgcgaggccaagcagcugacgcagcuggagcggacccgccagcggaaccccuccgaccgccacgugaucagccaggcggagaccgagcuccagcgggccgccauggacgccucccgcaccagccggcaccuggaggagacgaucaacaacuucgagcgccagaagaugaaggacaucaagguguuccggaacucccuguacgcccccgacuacagcucccgccucgacaucguccgggcgaacagcaagagcccccugcagcgcucccuguccgccaagugcgugagcgggaccggccagguguccacgugccgccuccggaaggaccagcaggccgaggacgacgaggacgacgagcuggacgucaccgaggaggagaacuuccugaaguga

SEQ ID NO: 29993 - RNA, 915 nt, Artificial Sequence
  derived and/or modified sequence opt1 from FAM92B__Homo_sapiens__NP_940893
augaacaucguguucagccgcgacucccagguccgggugauggagaacaccguggccaacaccgagaaguacuucggccaguucugcagccugcucgccgcguacacgcgcaagaccgcccggcugcgcgacaaggccgaccagcuggucaagcagcucaucgacuucgccaacuccgagaaccccgagcugcgggccaccaugcgcggguucgcggaggaccuggccaaggugcaggacuaccggcaggcccagguggagcgccucgagaccaaggucgugaacccgcugaagcuguacggcgcccagaucaagcagacgcgggcggagaucaagaaguucaagcacgugcagaaccacgagaucaagcagcucgagaagcuggagaagcugcgccagaagucccccagcgaccagcagaugaucagccaggccgagacccggguccagcgcgccgccguggacuccagccggaccacccuccagcuggaggagacgguggacggguuccagcgccagaagcugaaggaccuccagaaguucuucugcgacuucgucaccaucgagaugguguuccacgccaaggcgguggaggucuacuccagcgccuuccagacccuggagaaguacgaccuggagcgggaccuccuggacuuccgcgccaagaugcagggcguguacgggcacuacgacacccggcugcucgccaacacguccccgccgcccagcgugcugcagucccuggccagccagggcacccuccagguccagcugucccgcgcgaacgaggaccccgagcacccccacgccaaccacggccgguucagccugugcgaguggguggugaaggggcagcccgcccacugcgucugcggccagggcgggcaccucaugcugcccgggcacucccuguga

SEQ ID NO: 29994 - RNA, 561 nt, Artificial Sequence
  derived and/or modified sequence opt1 from FAM9B__Homo_sapiens__NP_995321
auggccgccuggggcaagaagcacgcggggaaggaccccgugcgcgacgagugcgaggagcggaaccgcuucaccgagacccgggaggaggacgucacggacgagcacggcgagcgcgagccguucgccgagaccgacgagcacaccggggccaacaccaagaagcccgaggacacggccgaggaccugaccgccaagcggaagcgcaugaagauggacaagaccugcagcaagaccaagaacaaguccaagcacgcgcuccggaagaagcagcugaagcgccagaagcgggacuacauccacagccugaagcuccugaacgugcuggaggaguacaucacggacgagcagaaggaggaggaggaggaggagggcgaggaggaggagcucauccgcaucuuccaggagcagcagaagaaguggcagcaguaccgguccgugcgccgggagcgccugaaggagaugaagcugcuccgggaccaguucgucaaggcccuggaggacuucgaggaccugugcgaccgcguguucagcgacgaggacuccgagcucgacaacuga

SEQ ID NO: 29995 - RNA, 1602 nt, Artificial Sequence
  derived and/or modified sequence opt1 from FAN1__Homo_sapiens__NP_001139568
augaugagcgagggcaagcccccggacaagaagcgcccccggcgcucccugagcaucuccaagaacaagaagaaggccagcaacuccaucaucagcugcuucaacaacgccccgcccgcgaagcucgccugccccgugugcuccaagauggucccccgguacgaccugaaccgccaccuggacgagaugugcgccaacaacgacuucguccagguggaccccggccagguggggcucaucaacagcaacguguccaugguggaccugaccagcgucacccuggaggacgugacgcccaagaaguccccgccgcccaagaccaaccucacccccgggcagagcgacuccgccaagcgggaggugaagcagaagaucagccccuacuucaaguccaacgacgucgugugcaagaaccaggacgagcugcgcaaccggagcgugaaggucaucugccugggcucccucgccagcaagcugucccgcaaguacgugaaggcgaagaaguccaucgacaaggacgaggaguucgccgggagcagcccccagagcuccaagagcaccguggucaagucccugaucgacaacagcuccgagaucgaggacgaggaccagauccucgagaacagcucccagaaggagaacguguucaagugcgacagccugaaggaggagugcauccccgagcacauggugcggggcuccaagaucauggaggccgagagccagaaggccacgcgcgagugcgagaaguccgcgcugacccccggcuucagcgacaacgccaucaugcuguucuccccggacuucacccugcggaacacccucaagagcacguccgaggacagccucgucaagcaggagugcaucaaggaggugguggagaagcgcgaggccugccacugcgaggaggucaagaugaccguggccuccgaggccaagauccagcugagcgacagcgaggcgaagucccacagcuccgccgacgacgccagcgccugguccaacauccaggaggcgccccugcaggacgacagcugccucaacaacgacaucccccacuccaucccccuggagcaggggagcuccugcaacggcccggggcagaccaccggccaccccuacuaccugcggagcuuccucgugguccugaagacggugcuggagaacgaggacgacaugcuccuguucgacgagcaggagaaggggaucgucaccaaguucuaccagcuguccgccaccggccagaagcucuacgugcgccuguuccagcggaagcugagcuggaucaagaugaccaagcucgaguacgaggagaucgcccuggaccugacgcccgugaucgaggagcucaccaacgccggcuuccugcagaccgaguccgagcugcaggagcucagcgagguccuggagcugcucuccgcccccgagcucaagagccuggccaagaccuuccaccuggugaacccgaacgggcagaagcagcagcugguggacgcguuccugaagcucgccaagcagcgcuccgucugcacguggggcaagaacaagcccgggaucggcgccgugauccugaagcgguucugcuggcugcugcuccaguga

SEQ ID NO: 29996 - RNA, 4368 nt, Artificial Sequence
  derived and/or modified sequence opt1 from FANCA__Homo_sapiens__NP_000126
augagcgacuccugggugcccaacagcgccuccggccaggacccggggggccgccggcgcgccugggcggagcugcucgccgggcgggucaagcgcgagaaguacaaccccgagcgggcccagaagcugaaggagagcgccgugcgccugcuccggucccaccaggaccugaacgcccugcuccuggagguggagggcccccugugcaagaagcucagccuguccaaggucaucgacugcgacagcuccgaggcguacgccaaccacagcuccagcuucaucggguccgcccugcaggaccaggccagccgccucggcgugcccgugggcauccuguccgcggggauggucgccagcuccgugggccagaucugcaccgccccggccgagaccagccaccccgugcugcucacggucgagcagcggaagaagcuguccagccugcucgaguucgcccaguaccugcuggcgcacagcauguucucccgccucagcuucugccaggagcuguggaagauccaguccagccugcuccuggaggccguguggcaccugcacgugcaggggaucgucucccuccaggagcugcuggagagccaccccgacaugcacgccgugggcuccuggcucuuccggaaccugugcugccugugcgagcagauggaggccagcugccagcacgccgacguggcgcgcgccaugcucuccgacuucguccagauguucgugcugcggggguuccagaagaacagcgaccugcgccggaccguggagcccgagaagaugccgcaggucaccguggacgugcuccagcgcaugcugaucuucgcccuggacgcccucgccgcgggcguccaggaggaguccagcacccacaagaucgugcggugcugguucggcguguucuccgggcacacgcugggcagcgucaucuccaccgacccccugaagcgcuucuucagccacacccucacccagauccugacgcacucccccgugcugaaggccagcgacgccguccagaugcagcgggagugguccuucgcccgcacccacccccuccugaccagccuguaccggcgccucuucgugaugcugagcgccgaggagcugguggggcaccugcaggagguccucgagacccaggaggugcacuggcagcgcgugcuguccuucgucagcgcgcugguggugugcuucccggaggcccagcagcuccuggaggacugggucgcccggcugauggcccaggcguucgaguccugccagcucgacagcauggugacggccuuccuggugguccgccaggccgcccuggagggccccuccgccuuccucagcuacgcggacugguucaaggccuccuucggcagcacccggggguaccacggcugcuccaagaaggcccugguguuccuguucaccuuccucagcgagcuggugcccuucgaguccccccgcuaccugcagguccacauccuccacccgccccuggugcccgggaaguaccggagccugcucaccgacuacaucucccuggccaagacgcgccuggccgaccucaaggugagcaucgagaacaugggccuguacgaggaccuguccagcgcgggggacaucaccgagccccacucccaggcccuccaggacgucgagaaggccaucaugguguucgagcacaccggcaacaucccggugaccgucauggaggccagcaucuuccggcgccccuacuacgugagccacuuccugcccgcccugcucacgccccgggugcugccgaagguccccgacucccgcguggcguucaucgagagccugaagcgggccgacaagaucccccccucccucuacagcaccuacugccaggccugcuccgccgcggaggagaagccggaggacgccgcccugggcgugcgcgccgagcccaacagcgccgaggagccccuggggcagcucaccgcggcccugggcgagcugcgggccuccaugaccgacccgagccagcgcgacgucaucuccgcccagguggccgugaucagcgagcggcuccgcgcgguccuggggcacaacgaggacgacuccagcguggagaucuccaagauccagcugagcaucaacacgccccggcucgagccccgcgagcacauggccguggaccugcugcucaccuccuucugccagaaccugauggccgccagcuccgucgcccccccggagcggcagggccccugggcggcccuguucgugcgcaccaugugcgggcgcgugcuccccgccguccugacccggcugugccagcuccugcgccaccagggccccagccuguccgccccgcacgugcucggccuggcggcccuggccgugcaccucggggagagccggagcgcccugcccgaggucgacgugggcccccccgccccgggggcgggccugcccgugcccgcccucuucgacucccugcugacgugccgcacccgggacagccucuucuucugccugaaguucugcaccgccgccaucuccuacagccugugcaaguucuccagccagucccgcgacacccucugcagcugccugucccccgggcugaucaagaaguuccaguuccucauguuccggcuguucagcgaggcccgccagccgcuguccgaggaggacgucgcgagccucuccuggcggccccugcaccugcccagcgccgacuggcagcgcgccgcccucucccuguggacgcaccggaccuuccgcgaggugcugaaggaggaggacgugcaccucaccuaccaggacuggcugcaccuggagcucgagauccagcccgaggccgacgcgcugagcgacaccgagcggcaggacuuccaccagugggccauccacgagcacuuccugccggaguccagcgccuccggcggcugcgacggggaccuccaggccgccugcacgauccuggucaacgcgcugauggacuuccaccagagcagccgcuccuacgaccacagcgagaacuccgaccucguguucggcgggcggaccggcaacgaggacaucaucagccgccugcaggagaugguggccgaccuggagcuccagcaggaccugaucgucccccugggccacacccccucccaggagcacuuccucuucgagaucuuccggcgccggcugcaggcccugaccagcgggugguccguggccgcgagccuccagcgccagcgggagcugcugauguacaagcgcauccugcuccgccugcccuccagcgugcugugcggcuccagcuuccaggccgagcagccgaucaccgcccggugcgagcaguucuuccaccucgucaacuccgagaugcgcaacuucugcagccacgggggcgcccugacgcaggacaucaccgcccacuucuuccgggggcugcucaacgcgugccugcgcucccgggaccccagccugaugguggacuucauccucgccaagugccagaccaagugcccccugauccugaccuccgcccucgucugguggccgagccuggagcccgugcugcucugccgcuggcggcgccacugccaguccccccugccccgggagcugcagaagcuccaggagggccgccaguucgccagcgacuuccugagcccggaggccgcgucccccgcccccaaccccgacuggcugagcgccgccgcccuccacuucgcgauccagcaggugcgggaggagaacauccgcaagcagcugaagaagcuggacugcgagcgggaggagcuccuggucuuccuguucuucuucucccucaugggccugcugagcucccaccucacgagcaacuccaccaccgaccugccgaaggccuuccacgugugcgccgccauccuggagugccucgagaagcgcaagaucagcuggcuggcgcuguuccagcucaccgaguccgaccugcggcuggggcgccuccugcugcggguggcccccgaccagcacacgcgccuccugcccuucgccuucuacagccugcucuccuacuuccacgaggacgccgccauccgggaggaggcguuccugcacgucgccguggacauguaccugaagcucgugcagcuguucgucgccggcgacaccagcaccgugucccccccggccgggcgcagccuggagcucaagggccaggggaaccccguggagcugaucaccaaggcccgccuguuccuccugcagcugaucccccggugccccaagaaguccuucagccacgucgcggagcuccuggccgaccgcggcgacugcgacccggagguguccgccgcccugcagagccggcagcaggccgcgcccgacgccgaccucucccaggagccccaccuguucuga

SEQ ID NO: 29997 - RNA, 2580 nt, Artificial Sequence
  derived and/or modified sequence opt1 from FANCB__Homo_sapiens__NP_001018123
augaccagcaagcaggccauguccagcaacgagcaggagcgccugcucugcuacaacggcgaggugcuggucuuccagcuguccaaggggaacuucgccgacaaggagcccaccaagacgccgauccuccacgugcggcgcaugguguucgaccggggcaccaaggucuucgugcagaaguccaccggguucuucaccaucaaggaggagaacucccaccugaagaucaugugcugcaacugcgugagcgacuuccgcacgggcaucaaccugcccuacaucgucaucgagaagaacaagaagaacaacguguucgaguacuuccuccugauccugcacuccaccaacaaguucgagaugcggcucagcuucaagcugggguacgagaugaaggacggccugcgcgugcucaacggcccccugauccuguggcggcacgucaaggcguucuucuucaucuccagccagaccgggaaggugguguccgucagcggcaacuucuccagcauccagugggccggggagaucgagaaccucggcauggugcugcuggggcucaaggagugcugccuguccgaggaggagugcacccaggagcccagcaaguccgacuacgccaucuggaacacgaaguucugcguguacagccuggagucccaggagguccucagcgacaucuacaucaucccgcccgccuacagcuccguggugaccuacguccacaucugcgccaccgagaucaucaagaaccagcugcgcaucagccugaucgcgcucacccggaagaaccagcugaucuccuuccagaacggcacgcccaagaacgugugccagcugcccuucggcgacccgugcgccgugcagcucauggacagcgggggcgggaaccuguucuucgucguguccuucaucagcaacaacgccugcgccguguggaaggaguccuuccaggucgcggccaagugggagaagcugagccucgugcugaucgacgacuucaucggcuccggcaccgagcagguccugcuccuguucaaggacagccugaacuccgacugccucaccagcuucaagaucaccgaccuggggaagaucaacuacuccagcgagcccuccgacugcaacgaggacgaccuguucgaggacaagcaggagaaccgcuaccucguggugccgccccuggagacgggccugaaggucugcuucagcuccuuccgggagcuccgccagcaccuccugcugaaggagaagaucaucagcaaguccuacaaggcccugaucaaccuggugcaggggaaggacgacaacaccagcagcgccgaggagaaggagugccucgugccccugugcggcgaggaggagaacuccguccacauccuggacgagaagcugagcgacaacuuccaggacuccgagcagcucguggagaagaucugguaccgggugaucgacgacagccuggucgugggggugaagaccaccuccagccugaagcucucccugaacgacgucacgcugagccuccugauggaccaggcccacgacucccgcuuccggcugcucaagugccagaaccgcgugaucaagcugagcaccaaccccuuccccgcgcccuaccugaugccgugcgagaucggccucgaggccaagcgggugacccugacccccgacuccaagaaggaggagagcuucgucugcgagcaccccuccaagaaggagugcgugcagaucaucacggccgugaccagccugagcccccuccugaccuucagcaaguucugcugcaccguccugcuccagaucauggagcgcgaguccggcaacugcccgaaggaccgguacguggugugcgggcgcgucuuccugagccuggaggaccucagcacgggcaaguaccugcugaccuuccccaagaagaagcccaucgagcacauggaggaccucuucgcccugcuggccgcguuccacaaguccugcuuccagaucaccagccccggguacgcccucaacuccaugaagguguggcugcuggagcacaugaagugcgagaucaucaaggaguucccggagguguacuucugcgagcggcccggcagcuucuacgggacccucuucacguggaagcagcgcacccccuucgagggcauccugaucaucuacucccgcaaccagaccgucauguuccagugccugcacaaccucauccggauccugcccaucaacugcuuccugaagaaccucaagagcggcuccgagaacuuccugaucgacaacauggccuucacccuggagaaggagcucgugacgcugagcucccugagcuccgccaucgccaagcacgagagcaacuucaugcagcgcugcgagguguccaagggcaagagcuccgucguggcggccgcccucagcgaccggcgcgagaacauccacccguaccggaaggagcugcagcgcgagaagaagaagaugcugcagaccaaccucaagguguccggggcccuguaccgggagaucacccugaaggucgccgaggugcagcucaagagcgacuucgcggcccagaagcuguccaaccuguga

SEQ ID NO: 29998 - RNA, 1677 nt, Artificial Sequence
  derived and/or modified sequence opt1 from FANCC__Homo_sapiens__NP_001230672
auggcccaggacagcguggaccuguccugcgacuaccaguucuggaugcagaagcucagcgucugggaccaggccuccacccuggagacccagcaggacacgugccugcacguggcgcaguuccaggaguuccuccgcaagauguacgaggcccugaaggagauggacagcaacaccgugaucgagcgguuccccaccaucggccagcugcucgccaaggccugcuggaacccguucauccuggccuacgacgagucccagaagauccugaucuggugccucugcugccugaucaacaaggagccccagaacagcgggcaguccaagcugaacagcuggauccagggcguccucucccacauccugagcgcgcugcgcuucgacaaggagguggcccucuucacccaggggcugggcuacgcccccaucgacuacuaccccgggcugcucaagaacauggugcugucccuggccagcgagcuccgggagaaccaccugaacggcuucaacacgcagcgccggauggcgccggagcgcgucgccucccugagccgggugugcgugccccucaucacccugaccgacgucgacccccugguggaggcccuccugaucugccacggccgcgagccccaggagauccugcagccggaguucuucgaggccgugaacgaggccauccuccugaagaagaucucccugcccaugagcgcggucgugugccucuggcugcggcaccuccccucccuggagaaggccaugcugcaccuguucgagaagcucaucagcuccgagcgcaacugccugcggcgcaucgagugcuucaucaaggacagcagccugccccaggccgccugccacccggccaucuuccggguggucgacgagauguuccgcugcgcgcuccuggagaccgacggggcccuggagaucaucgccacgauccagguguucacccagugcuucguggaggcccucgagaaggccuccaagcagcugcgguucgcgcugaagaccuacuuccccuacaccagccccucccucgccaugguccugcugcaggacccccaggacaucccgcgcggccacuggcugcagacgcucaagcacaucagcgagcugcugcgggaggccguggaggaccagacccacggguccugcggcgggcccuucgagagcugguuccucuucauccacuucggcggcugggccgagaugguggccgagcagcugcugauguccgcggccgagccgcccaccgcccuccuguggcugcucgccuucuacuacgggccccgcgacggccggcagcagcgcgcgcagaccaugguccaggugaaggccgugcuggggcaccuccuggccaugagccgguccagcucccugagcgcccaggaccugcagacggucgccggccagggcaccgacaccgaccuccgcgcgcccgcccagcagcugauccgccaccuccugcugaacuuccugcucugggcccccgggggccacaccaucgccugggacgugaucacgcugauggcccacaccgcggagaucacccacgagaucaucggguuccuggaccagacccucuaccgguggaaccgccugggcaucgagagcccccgguccgagaagcuggcccgcgagcuccugaaggagcugcggacgcaggucuga

SEQ ID NO: 29999 - RNA, 4356 nt, Artificial Sequence
  derived and/or modified sequence opt1 from FANCD2__Homo_sapiens__NP_001018125
auggugagcaagcgccggcuguccaagagcgaggacaaggagucccucaccgaggacgccagcaagacccgcaagcagccccuguccaagaagacgaagaagucccacaucgccaacgaggucgaggagaacgacagcaucuucgugaagcugcucaagaucagcggcaucauccugaagaccggggagucccagaaccagcuggcgguggaccagaucgccuuccagaagaagcuguuccagacccugcggcgccacccgagcuaccccaagaucaucgaggaguucgucuccggccuggagagcuacaucgaggacgaggacuccuuccggaacugccuccugagcugcgagcgccugcaggacgaggaggccuccaugggggccagcuacuccaagagccucaucaagcugcugcucggcaucgacauccugcagcccgccaucaucaagacccuguucgagaagcuccccgaguacuucuucgagaacaagaacuccgacgagaucaacaucccgcggcugaucgugagccagcugaaguggcucgaccgcguggucgacgggaaggaccugacgaccaagaucaugcagcugaucagcaucgcgcccgagaaccuccagcacgacaucaucaccucccugcccgagauccugggcgacagccagcacgccgacgugggcaaggagcucuccgaccugcugaucgagaacaccagccucacggugcccauccuggacguccuguccagccuccggcuggacccgaacuuccugcucaaggugcgccagcuggugauggacaagcuguccagcauccggcucgaggaccugcccgucaucaucaaguucauccugcacuccgugaccgccauggacacccucgaggugaucagcgagcugcgcgagaagcuggaccuccagcacugcguccugcccucccggcugcaggccagccaggugaagcucaaguccaaggggcgcgcgagcuccagcggcaaccaggaguccagcgggcaguccugcaucauccugcuguucgacgugaucaagagcgccauccgguacgagaagaccaucagcgaggccuggaucaaggccaucgagaacacggccuccgucagcgagcacaagguguucgaccuggugaugcuguucaucaucuacuccaccaacacccagaccaagaaguacaucgaccgcguccugcggaacaagauccgcagcggcugcauccaggagcagcugcuccaguccacguucagcgugcacuaccuggugcugaaggacaugugcuccagcauccucucccuggcgcagagccugcuccacucccuggaccagagcaucaucuccuucgggagccugcucuacaaguacgccuucaaguucuucgacaccuacugccagcaggaggucgugggcgcccuggucacccacaucugcuccggcaacgaggccgagguggacaccgcccuggacgugcuccuggagcuggucgugcucaaccccagcgcgaugaugaugaacgccguguucgucaaggggauccuggacuaccuggacaacaucuccccgcagcagauccggaagcuguucuacgugcucagcacgcuggccuucagcaagcagaacgaggccuccagccacauccaggacgacaugcaccucgugauccgcaagcagcuguccagcaccgucuucaaguacaagcugaucggcaucaucggggccgugaccauggcgggcaucauggccgccgaccgguccgagagccccucccucacccaggagcgcgccaaccugagcgacgagcagugcacccaggugaccucccugcuccagcugguccacagcugcuccgagcagagcccccaggccuccgcgcuguacuacgacgaguucgccaaccucauccagcacgagaagcuggaccccaaggcccuggagugggugggccacaccaucugcaacgacuuccaggacgccuucguggucgacagcugcguggugccggagggggacuuccccuuccccgucaaggcgcucuacggccuggaggaguacgacacccaggacgggaucgccaucaaccugcucccccugcuguucucccaggacuucgccaaggacggcgggccggugacgagccaggaguccggccagaagcucgugagcccccugugccuggcccccuacuuccgccuccugcggcugugcgucgagcgccagcacaacggcaaccucgaggagaucgacgggcugcuggacugccccaucuuccucaccgaccuggagccgggcgagaagcuggaguccaugagcgccaaggagcggagcuucaugugcucccucaucuuccugacccugaacugguuccgcgagaucgugaacgcguucugccaggagaccagccccgagaugaaggggaaggugcucacgcggcugaagcacaucgucgagcugcagaucauccucgagaaguaccuggccgugacccccgacuacgugcccccgcugggcaacuucgacgucgagacccucgacaucacgccccacacggugaccgccaucuccgccaagauccgcaagaaggggaagaucgagcggaagcagaagaccgacggcagcaagaccuccagcuccgacacccugagcgaggagaagaacuccgagugcgaccccacgccgagccaccgcggccagcugaacaaggaguucaccgggaaggaggagaagaccucccuccugcugcacaacagccacgccuucuuccgggagcucgacaucgagguguucuccauccugcacugcggccuggucaccaaguucauccucgacacggagaugcacaccgaggcgaccgagguggugcagcuggggccgcccgagcuccucuuccugcuggaggaccucagccagaagcuggaguccaugcugaccccgcccaucgcccgccggguccccuuccucaagaacaagggcagccgcaacaucggguucucccaccuccagcagcggagcgcccaggagaucgugcacugcguguuccagcugcucacgcccaugugcaaccaccuggagaacauccacaacuacuuccagugccuggccgccgagaaccacggcgucguggacggccccggggugaagguccaggaguaccacaucauguccagcugcuaccagcgccuccugcagaucuuccacggccuguucgcguggagcggguucucccagcccgagaaccagaaccuccuguacagcgcccugcacgugcucuccagccggcugaagcagggcgagcacucccagccccuggaggagcugcucagccaguccgugcacuaccugcagaacuuccaccagagcauccccuccuuccagugcgcccuguaccucauccgccugcugauggucauccucgagaaguccaccgccagcgcgcagaacaaggagaagaucgccagccuggcccggcaguuccugugccgcguguggcccuccggcgacaaggagaaguccaacaucagcaacgaccagcuccacgcccugcugugcaucuaccucgagcacaccgagagcauccugaaggccaucgaggagaucgcgggggugggcgucccggagcugaucaacucccccaaggacgccagcuccagcaccuuccccacgcucacccggcacaccuucgugguguucuuccgcgucaugauggccgagcuggagaagaccgugaagaagaucgagcccgggacggccgccgacagccagcagauccacgaggagaagcugcucuacuggaacauggcggugcgcgacuucuccauccugaucaaccugaucaaggucuucgacagccacccggugcuccacgucugccugaaguacggccggcuguucguggaggccuuccucaagcagugcaugccccugcuggacuucuccuuccgcaagcaccgggaggacgugcucagccugcuggagaccuuccagcucgacacccgccugcugcaccaccucugcgggcacuccaagauccaccaggacacccggcugacgcagcacgucccccugcucaagaagacccuggagcugcucgugugccgcgugaaggccaugcugacccugaacaacugccgggaggccuucuggcucggcaaccugaagaaccgcgaccugcagggcgaggagaucaagagccagaacucccaggagagcaccgccgacgaguccgaggacgacaugagcucccaggcgagcaaguccaaggccacggaggacggggaggaggacgaggucagcgccggcgagaaggagcaggacuccgacgagagcuacgacgacuccgacuga

SEQ ID NO: 30000 - RNA, 1611 nt, Artificial Sequence
  derived and/or modified sequence opt1 from FANCE__Homo_sapiens__NP_068741
auggccacccccgacgccggccugccgggggcggagggcguggagcccgcccccugggcccagcucgaggcccccgcccgccugcugcuccaggcgcugcaggccgggccggagggcgcccggcgcgggcugggcguccuccgggcccugggcagccgcgggugggagcccuucgacuggggccggcugcucgaggcgcugugccgcgaggagcccguggugcaggggcccgacggccggcuggagcucaagccgcugcugcuccgccugccccggaucugccagcgcaaccugaugucccuccugauggccguccggcccagccugcccgaguccgggcuccugagcgugcugcagaucgcccagcaggaccucgccccggaccccgacgccuggcugcgcgcgcugggcgagcuccugcggcgcgaccugggcguggggaccuccauggagggcgccagcccccucuccgagcggugccagcgccagcugcagagccugugccgggggcucggccugggcgggcgccggcugaaguccccgcaggcccccgaccccgaggaggaggagaaccgcgacagccagcagcccggcaagcggcgcaaggacuccgaggaggaggccgccagccccgaggggaagcgcgucccgaagcggcuccgcugcugggaggaggaggaggaccacgagaaggagcggcccgagcacaagucccuggagagccuggcggacggcggguccgccagccccaucaaggaccagcccgugauggccgugaagacgggcgaggacggcuccaaccucgacgacgccaaggggcuggccgagagccuggagcucccgaaggcgauccaggaccagcugccccgccugcagcagcuccugaagacccuggaggagggccucgaggggcuggaggacgccccgcccgucgagcugcagcugcuccacgagugcucccccagccagauggaccugcugugcgcccagcuccagcugccccagcugagcgaccucggccugcugcggcucugcaccuggcugcuggcccucucccccgaccugagccuguccaacgccaccgugcucacgcgcagccuguuccuggggcggauccucucccugaccagcuccgcgagccgccugcucaccaccgcccugacguccuucugcgccaaguacaccuacccggugugcagcgcccugcucgaccccguccugcaggcgcccggcaccggccccgcccagaccgagcugcucugcugccuggugaagauggagucccuggagccggacgcccaggugcucaugcuggggcagauccuggagcuccccuggaaggaggagacguuccugguccugcagagccuccuggagcgccagguggagaugacccccgagaaguucuccgugcugauggagaagcucugcaagaagggccuggccgccaccaccagcauggcguacgccaagcugaugcucacggucaugaccaaguaccaggccaacaucaccgagacccagcggcuggggcuggccauggcccucgagcccaacacgaccuuccugcggaagucccugaaggcggcccucaagcaccugggcccguga

SEQ ID NO: 30001 - RNA, 1125 nt, Artificial Sequence
  derived and/or modified sequence opt1 from FANCF__Homo_sapiens__NP_073562
auggagagccugcuccagcaccuggaccgcuucuccgagcugcucgccgugagcuccaccaccuacgucagcacgugggaccccgccaccgugcggcgcgcgcugcagugggcccgguaccugcgccacauccaccggcgcuucggccggcacgggcccauccgcaccgcccucgagcggcgccugcacaaccaguggcggcaggagggcggguucggccgcgggcccgugcccggccuggccaacuuccaggcccucggccacugcgacguccugcugucccuccggcugcuggagaaccgcgcgcucggggacgccgcccgguaccaccuggugcagcagcuguuccccggcccgggggugcgcgacgccgacgaggagacccuccaggagagccuggcgcggcuggcccgccggcgcuccgccguccacaugcuccgguucaacggcuaccgcgagaaccccaaccugcaggaggacagccugaugaagacgcaggccgagcuccugcuggagcgccuccaggagguggggaaggccgaggcggagcggcccgcccgcuuccuguccagccugugggagcggcucccccagaacaacuuccugaaggugaucgccgucgcccugcuccagccgccccugucccgccggccccaggaggagcuggagcccggcauccacaagagcccgggcgaggggucccaggugcucgugcacuggcugcugggcaacagcgaggucuucgccgcguucugccgcgcccuccccgccgggcugcugacccucgugaccucccggcaccccgcccugagccccguguaccugggccuccugaccgacuggggccagcgccugcacuacgaccuccagaaggggaucugggucggcacggagucccaggacgugccgugggaggagcugcacaaccgguuccagagccugugccaggccccgccgccccugaaggacaaggugcucaccgcgcuggagaccugcaaggcccaggacggggacuucgagguccccggccuguccaucuggaccgaccuccugcuggcccuccgcagcggggccuuccggaagcgccaggugcugggccugagcgccggccucuccagcguguga

SEQ ID NO: 30002 - RNA, 1869 nt, Artificial Sequence
  derived and/or modified sequence opt1 from FANCG__Homo_sapiens__NP_004620
augagccgccagaccaccuccgugggcagcuccugccuggaccucuggcgggagaagaacgaccgccugguccggcaggccaagguggcccagaacagcgggcugacgcuccgccggcagcagcuggcgcaggacgcccuggagggccuccgcgggcugcugcacucccuccagggccugcccgccgccgugccgguccugccccucgagcugaccgugaccugcaacuucaucauccugcgggccagccucgcgcagggguucaccgaggaccaggcccaggacauccagcgcucccuggagcgggugcuggagacgcaggagcagcagggcccccgccucgagcagggccugcgggagcugugggacagcguccuccgcgccuccugccugcugcccgagcuccugagcgcccugcaccggcucguggggcugcaggcggcccuguggcucuccgccgaccgccugggcgaccuggcccuccugcuggagacccucaacgggagccaguccggcgccagcaaggaccugcugcuccugcugaagaccugguccccgcccgcggaggagcucgacgcgccccugacccugcaggacgcccaggggcucaaggacgugcugcugacggccuucgccuaccggcagggccuccaggagcugaucaccggcaaccccgacaaggcccugagcucccugcacgaggccgccagcgggcucugcccgcgccccguccugguccagguguacaccgcccugggcuccugccaccggaagauggggaacccccagcgcgcccuccuguaccugguggcggcccucaaggagggcagcgccugggggcccccgcugcuggaggccagccggcucuaccagcagcugggcgacaccacggccgagcuggagucccucgagcugcugguggaggcgcucaacgugcccugcagcuccaaggcgccccaguuccugaucgaggucgagcugcuccugcccccgcccgaccuggccagcccccuccacugcggcacccagucccagaccaagcacauccuggccagccgcugccugcagaccgggcgggccggcgacgccgccgagcacuaccucgaccugcuggcccuccugcuggacuccagcgagccccgcuucuccccgccgcccagcccgcccgggcccugcaugcccgagguguuccucgaggccgcgguggcccugauccaggccggccgcgcccaggacgcccugacgcucugcgaggagcugcugucccggaccagcucccuccugcccaagaugagccgccugugggaggacgcgcggaagggcaccaaggagcuccccuacugcccccugugggucuccgccacccaccuccugcaggggcaggccugggugcagcugggcgcccagaagguggccaucagcgaguucucccgcugccuggagcuccuguuccgggcgacgcccgaggagaaggagcagggggccgccuucaacugcgagcagggcugcaagagcgacgccgcgcugcagcagcuccgcgccgccgcccugaucucccgggggcuggagugggucgccagcggccaggacaccaaggcgcuccaggacuuccugcugagcgugcagaugugcccgggcaaccgcgacaccuacuuccaccuccugcagacccugaagcggcucgaccgccgggacgaggccacggcccugugguggcgccuggaggcccagaccaaggggucccacgaggacgcccucuggagccugccccuguaccucgaguccuaccugagcuggauccggcccuccgaccgcgacgcguuccuggaggaguuccggaccagccuccccaaguccugcgaccuguga

SEQ ID NO: 30003 - RNA, 3987 nt, Artificial Sequence
  derived and/or modified sequence opt1 from FANCI__Homo_sapiens__NP_001106849
auggaccagaagauccugagccucgccgccgagaagaccgcggacaagcugcaggaguuccugcagacccuccgcgagggcgaccugacgaaccugcuccagaaccaggccgugaaggggaaggucgccggcgcccugcugcgggccaucuucaaggggucccccugcagcgaggaggcgggcacccuccgccggcgcaagaucuacacgugcugcauccagcugguggaguccggggaccugcagaaggagaucgccagcgagaucaucggccuccugaugcuggaggcccaccacuucccgggcccccuccugguggagcuggccaacgaguucaucuccgcgguccgggaggggagccucgugaacggcaagucccuggagcugcuccccaucauccugaccgcccuggccaccaagaaggagaaccucgccuacgggaagggcgugcugagcggggaggagugcaagaagcagcugaucaacacccucugcuccggccgcugggaccagcaguacgucauccagcugaccagcauguucaaggacgugccccugaccgccgaggagguggaguucgucguggagaaggcgcucuccauguucagcaagaugaaccugcaggagaucccgccccugguguaccagcuccugguccuguccagcaagggcucccgcaagagcgugcucgaggggaucaucgccuucuucuccgcccuggacaagcagcacaacgaggagcagagcggcgacgagcugcucgacguggucacggugcccuccggggagcugcggcacguggagggcaccaucauccugcacaucgucuucgccaucaagcucgacuacgagcugggccgggagcuggugaagcaccucaagguggggcagcagggcgacagcaacaacaaccugagccccuucuccaucgcccugcuccugagcgucacccgcauccagcgguuccaggaccaggugcuggaccugcucaagaccuccguggucaagagcuucaaggaccugcagcugcuccagggguccaaguuccugcagaaccuggugccgcaccgcagcuacgucuccacgaugauccucgagguggugaagaacagcguccacuccugggaccacgugacccagggccugguggagcugggguucauccucauggacagcuacggccccaagaagguccuggacggcaagaccaucgagaccucccccagccugucccggaugcccaaccagcacgcgugcaagcucggggccaacauccugcuggagacguucaagauccacgagaugauccgccaggagauccucgagcagguccugaaccggguggugacccgcgccagcuccccgaucagccacuuccuggaccuccuguccaacaucgugauguacgcgccccuggugcuccagagcugcuccagcaaggucaccgaggccuucgacuaccugagcuuccugccccuccagaccgugcagcggcugcugaaggccgugcagccccuccugaaggucuccaugagcaugcgcgacugccugauccucgugcugcggaaggccauguucgccaaccagcuggacgcccgcaaguccgccguggcgggcuuccuccugcugcucaagaacuucaagguccuggggagccuguccagcucccagugcagccagucccucagcgugucccaggugcacgucgacgugcacagccacuacaacuccguggccaacgagacguucugccuggagaucauggacagccugcggcgcugccucucccagcaggccgacguccgccugaugcuguacgagggcuucuacgacgugcuccggcgcaacagccagcuggccaacuccgugaugcagacccugcucagccagcugaagcaguucuacgagccgaagcccgaccugcucccgccccugaagcuggaggcgugcauccucacccagggggacaagaucagccugcaggagccccuggacuaccuccugugcugcauccagcacugccuggccugguacaagaacaccgucaucccccuccagcagggcgaggaggaggaggaggaggaggaggccuucuacgaggaccuggacgacauccuggaguccaucacgaaccggaugaucaagagcgagcucgaggacuucgagcuggacaaguccgccgacuucagccaguccaccagcaucggcaucaagaacaacaucugcgccuuccuggugaugggggugugcgagguccucaucgaguacaacuucuccaucagcuccuucagcaagaaccgcuucgaggacauccugucccuguucaugugcuacaagaagcucagcgacauccugaacgagaaggcgggcaaggccaagaccaagauggccaacaagaccuccgacagccugcucuccaugaaguucgugagcucccugcugacggcccucuuccgggacagcauccagucccaccaggagagccugagcgugcugcgcuccagcaacgaguucaugcgguacgccgucaacguggcgcuccagaaggugcagcagcugaaggagaccgggcacgucuccggccccgacgggcagaaccccgagaagaucuuccagaaccugugcgacaucacccgcgugcuccuguggcgguacaccagcaucccgacguccguggaggagagcggcaagaaggagaagggcaaguccaucagccugcucugccuggaggggcugcagaagaucuucuccgccguccagcaguucuaccagcccaagauccagcaguuccuccgcgcccuggacgugaccgacaaggagggcgaggagcgggaggacgccgacgugagcgucacccagcgcaccgccuuccagauccggcaguuccagcgcucccugcucaaccugcugagcucccaggaggaggacuucaacagcaaggaggcgcuccugcuggugacggugcugaccucccucagcaagcugcuggagcccuccagcccccaguucguccagaugcucuccuggaccagcaagaucugcaaggagaacagccgggaggacgcccuguucugcaagucccugaugaaccuccuguucagccugcacguguccuacaagagcccggugauccuccugcgcgaccugucccaggacauccacgggcaccucggcgacaucgaccaggacgucgagguggagaagaccaaccacuucgccaucgugaaccugcggaccgccgcgcccacggucugccugcucgugcugagccaggccgagaagguccuggaggagguggacuggcucaucaccaagcugaagggccaggugucccaggagacccugagcgaggaggccuccagccaggccacccuccccaaccagccggucgagaaggccaucaucaugcagcuggggacgcugcucaccuucuuccacgagcuggugcagaccgcgcugcccuccggcagcugcguggacacccuccugaaggaccugugcaagauguacacgacccucaccgcccugguccgcuacuaccuccaggugugccaguccagcgggggcauccccaagaacauggagaagcuggugaagcuguccgggagccaccugacgccccucugcuacuccuucaucagcuacguccagaacaaguccaagagccugaacuacaccggcgagaagaaggagaagccggccgccguggccaccgcgauggcccgggugcugcgcgagaccaagcccauccccaaccucaucuucgccaucgagcaguacgagaaguuccugauccaccugagcaagaaguccaaggucaaccucaugcagcacaugaagcugagcaccucccgcgacuucaagaucaagggcaacauccuggacauggugcuccgggaggacggggaggacgagaacgaggagggcacggccagcgagcacgggggccagaacaaggagcccgccaagaagaagcgcaagaaguga

SEQ ID NO: 30004 - RNA, 1143 nt, Artificial Sequence
  derived and/or modified sequence opt1 from FANCL__Homo_sapiens__NP_001108108
auggccgugaccgaggccagccugcuccgccagugcccccugcugcucccgcagaaccgguccaagaccgucuacgagggcuucaucagcgcgcaggggcgcgacuuccaccuccggaucgugcugcccgaggaccuccagcugaagaacgcccgccugcucugcuccuggcagcugcggacgauccugagcggcuaccaccgcaucgugcagcagcggaugcagcacucccccgaccucaugagcuucaugauggagcugaagaugcugcucgaggucgcccugaagaaccgccaggagcuguacgcccugcccccgccgccccaguucuacuccagccugaucgaggagaucgggacccugggcugggacaagcucguguacgccgacacgugcuucuccaccaucaagcugaaggcggaggacgccagcgggcgggagcaccugaucacccucaagcugaaggccaaguaccccgccgagucccccgacuacuucguggacuuccccguccccuucugcgcgagcuggacgccccaggugaacuccccgcagagcucccugaucagcaucuacucccaguuccucgccgccaucgagagccugaaggccuucugggacgugauggacgagaucgacgagaagaccuggguccuggagcccgagaagccgccccgcuccgccaccgcgcggcgcaucgcccucggcaacaacgugagcaucaacaucgagguggacccccggcaccccaccaugcugcccgagugcuucuuccugggcgccgaccacgucgugaagccccucgggaucaagcugagccgcaacauccaccugugggacccggagaacuccgugcuccagaaccugaaggacguccuggagaucgacuuccccgcccgggccauccucgagaaguccgacuucaccauggacugcggcaucugcuacgcguaccagcuggacgggaccauccccgaccaggugugcgacaacagccagugcggccagcccuuccaccagaucugccuguacgaguggcuccgcgggcugcugaccagccggcaguccuucaacaucaucuucggcgagugcccguacugcagcaagcccaucacgcucaagauguccggccgcaagcacuga

SEQ ID NO: 30005 - RNA, 6147 nt, Artificial Sequence
  derived and/or modified sequence opt1 from FANCM__Homo_sapiens__NP_065988
augagcggccgccagcggacccuguuccagaccugggggagcagcaucagccgcagcagcggcacccccgggugcagcuccggcaccgagcggccccagagccccggguccagcaaggcgccccugcccgccgccgccgaggcccagcuggaguccgacgacgacgugcugcucguggccgccuacgaggccgagcgccagcugugccuggagaacggcggcuucugcaccagcgccggggcccucuggaucuacccgaccaacugccccgugcgggacuaccagcugcacaucucccgcgccgcgcuguucugcaacacccucgugugccugcccaccggccuggggaagaccuucaucgccgccgucgugauguacaacuucuaccggugguuccccagcggcaagguggucuucauggcccccaccaagccccucgugacccagcagaucgaggccugcuaccaggugauggggaucccccagucccacauggcggagaugaccggcagcacccaggccuccacccgcaaggagaucuggugcagcaagcggguccuguuccugacgccccaggugauggugaacgaccucucccgcggcgccugcccggccgccgagaucaagugccuggucaucgacgaggcgcacaaggcccuggggaacuacgccuacugccagguggugcgggagcucgucaaguacaccaaccacuuccgcauccuggcccugagcgccacccccggcagcgacaucaaggcggugcagcaggucaucaccaaccuccugaucgggcagaucgagcugcgguccgaggacagccccgacauccucaccuacucccacgagcgcaaggucgagaagcugaucgugccccugggcgaggagcucgccgccauccagaagaccuacauccagauccuggagagcuucgcccggucccugauccagcgcaacgugcucaugcggcgcgacaucccgaaccugaccaaguaccagaucauccuggcccgggaccaguuccgcaagaaccccagccccaacaucgucggcauccagcaggggaucaucgagggcgaguucgcgaucugcaucucccucuaccacggguacgagcugcugcagcagaugggcaugcggagccucuacuucuuccugugcgggaucauggacggcaccaagggcaugacgcgcuccaagaacgagcuggggcgcaacgaggacuucaugaagcucuacaaccaccuggagugcauguucgcccggacccgcagcaccuccgccaacggcaucagcgccauccagcagggggacaagaacaagaaguucguguacucccaccccaagcugaagaagcucgaggagguggucaucgagcacuucaagagcuggaacgcggagaacaccacggagaagaagcgggacgagacccgcgugaugaucuucuccagcuuccgggacuccguccaggagaucgccgagaugcugagccagcaccagccgaucauccgcgugaugaccuucgugggccacgccuccggcaaguccaccaagggcuucacgcagaaggagcagcuggaggucgugaagcaguuccgggacggcggguacaacacccucguguccacgugcgucggcgaggaggggcuggacaucggcgagguggaccugaucaucugcuucgacucccagaagucccccauccgccucgugcagcggauggggcgcaccggccggaagcgccagggccggaucgucaucauccuguccgaggggcgcgaggagcggaucuacaaccagagccaguccaacaagcgcagcaucuacaaggccaucuccagcaaccgccaggugcugcacuucuaccagcgcagcccccggauggugcccgacggcaucaacccgaagcugcacaagauguucaucacccacggggucuacgagcccgagaagcccagccgcaaccuccagcgcaaguccagcaucuucuccuaccgggacggcaugcgccagagcucccugaagaaggacugguuccugagcgaggaggaguucaagcucuggaaccggcuguaccgccugcgggacuccgacgagaucaaggagaucacccucccccaggugcaguucagcagccugcagaacgaggagaacaagccggcccaggaguccaccaccggcauccaccagcugagccucuccgaguggcgccuguggcaggaccacccccugcccacgcaccagguggaccacagcgaccggugccgccacuucaucgggcucaugcagaugaucgagggcaugcggcacgaggagggggagugcuccuacgagcuggaggucgagagcuaccugcagauggaggacgugaccuccaccuucaucgcgccgcgcaacgagagcaacaaccucgccuccgacaccuucaucacccacaagaaguccuccuucaucaagaacaucaaccagggcagcuccagcuccgugaucgagagcgacgaggagugcgccgagaucgucaagcagacgcacaucaagcccaccaagaucgugucccugaagaagaaggugagcaaggagaucaagaaggaccagcugaagaaggagaacaaccacgggaucaucgacuccgucgacaacgaccggaacagcaccguggagaacaucuuccaggaggaccuccccaacgacaagcgcaccagcgacacggacgagaucgccgcgaccugcaccaucaacgagaacgugaucaaggagcccugcguccugcugaccgagugccaguucacgaacaaguccaccagcucccucgcgggcaacgugcuggacagcggcuacaacuccuucaacgacgagaaguccguguccagcaaccuguuccucccguucgaggaggagcuguacaucguccggaccgacgaccaguucuacaacugccacucccugaccaaggaggugcucgccaacguggagcgcuuccugagcuacagcccgccgccccugagcgggcucuccgaccuggaguacgagaucgccaagggcacggcccuggagaaccuccuguuccugccgugcgccgagcaccuccggagcgacaagugcacgugccugcugucccacagcgcggucaacucccagcagaaccucgagcugaacagccugaagugcaucaacuaccccuccgagaaguccugccucuacgacauccccaacgacaacaucagcgacgagcccucccugugcgacugcgacgugcacaagcacaaccagaacgagaaccuggugccgaacaaccgcguccagauccaccggagccccgcccagaaccucgugggggagaacaaccacgacguggacaacuccgaccugcccguccugagcaccgaccaggacgagucccuccugcuguucgaggacgugaacaccgaguucgacgacgugagccucagcccccugaacagcaaguccgagagccugccggucuccgacaagacggccaucagcgagacgccccucgugucccaguuccugaucagcgacgagcugcuccuggacaacaacuccgagcugcaggaccagaucacccgcgacgccaacagcuucaagucccgggaccagcgcggcgugcaggaggagaaggucaagaaccacgaggacaucuucgacugcagccgggaccucuucuccgugaccuucgaccugggguucugcagccccgacagcgacgacgagauccuggagcacacguccgacagcaaccgcccccucgacgaccuguacggccgcuaccuggagaucaaggagaucuccgacgcgaacuacgugagcaaccaggcccucaucccgcgggaccacuccaagaacuucaccagcggcaccgucaucauccccuccaacgaggacaugcagaaccccaacuacgugcaccucccccugagcgccgccaagaacgaggagcuccuguccccgggguacagccaguucucccugcccgugcagaagaaggucaugagcacgccccucuccaagagcaacacgcugaacuccuucagcaagauccgcaaggagauccugaagaccccggacuccagcaaggagaaggugaaccuccagcgguucaaggaggcccugaacuccaccuucgacuacagcgaguucagccuggagaaguccaagagcuccggccccauguaccuccacaagagcugccacuccguggaggacgggcagcugcugaccagcaacgaguccgaggacgacgagaucuuccgccggaaggucaagcgcgcgaagggcaacgugcucaacagccccgaggaccagaagaacuccgaggucgacagcccccugcacgccgugaagaagcggcgcuucccgaucaaccgguccgagcugagcuccagcgacgaguccgagaacuuccccaagcccugcagccagcucgaggacuucaaggugugcaacgggaacgcccgccggggcaucaagguccccaagcgccagucccaccugaagcacguggcccggaaguuccuggacgacgaggccgagcucagcgaggaggacgcggaguacguguccagcgacgagaacgacgagagcgagaacgagcaggacuccagccugcuggacuuccucaacgacgagacgcagcugucccaggccaucaacgacagcgagaugcgcgccaucuacaugaagucccugcggagcccgaugaugaacaacaaguacaagaugauccacaagacccacaagaacaucaacaucuucucccagauccccgagcaggacgagaccuaccucgaggacagcuucugcgucgacgaggaggaguccugcaagggccagagcuccgaggaggaggugugcguggacuucaaccugaucaccgacgacugcuucgccaacagcaagaaguacaagacgcgccgggccgucaugcugaaggagaugauggagcagaacugcgcgcacuccaagaagaagcugagccgcaucauccuccccgacgacuccagcgaggaggagaacaacgugaacgacaagcgggaguccaacaucgccgugaaccccagcaccgucaagaagaacaagcagcaggaccacugccugaacagcgugccguccgggagcuccgcccagagcaaggugcgcuccacgccccgggucaacccccuggccaagcagagcaagcagaccucccucaaccugaaggacacgaucagcgagguguccgacuucaagccccagaaccacaacgaggugcagagcaccaccccgcccuucaccaccgucgacucccagaaggacugccggaaguuccccgugccccagaaggacggcagcgcgcuggaggacuccagcacguccggggccagcugcuccaagagccgcccgcaccucgccggcacccacaccucccugcggcugccccaggaggggaaggggaccugcauccucgugggcgggcacgagaucacgagcggccuggaggucaucagcucccugcgcgccauccacgggcuccagguggaggugugcccccugaacggcugcgacuacaucgucagcaaccggauggugguggagcgccggucccagagcgagaugcugaacuccgucaacaagaacaaguucaucgagcagauccagcaccuccagagcauguucgagcgcaucugcgugaucguggagaaggaccgggagaagaccggcgacaccucccgcauguuccggcgcaccaagagcuacgacucccugcugacgacccucaucggggccggcauccggauccuguucagcuccugccaggaggagaccgcggaccugcucaaggagcugagccuggucgagcagcgcaagaacguggggauccacgugcccaccgucgugaacuccaacaagagcgaggcccuccaguucuaccuguccaucccgaacaucagcuacaucacggcccugaacaugugccaccaguucuccagcgugaagcggauggccaacuccagccuccaggagaucagcauguacgcccaggucacccaccagaaggcggaggagaucuaccgcuacauccacuacguguucgacauccagaugcugcccaacgaccugaaccaggaccggcucaaguccgacaucuga

SEQ ID NO: 30006 - RNA, 1038 nt, Artificial Sequence
  derived and/or modified sequence opt1 from FANK1__Homo_sapiens__NP_660278
auggagccccagaagaucaugccgcccagcaagccccacccgcccguggucggcaaggugacccaccacuccaucgagcuguacugggaccucgagaagaaggccaagcgccaggggccccaggagcagugguuccgguucagcaucgaggaggaggaccccaagaugcacaccuacggcaucaucuacacgggguacgccaccaagcacguggucgagggccuggagccccgcacccuguaccgguuccgccucaaggugaccuccccgagcggggagugcgaguacagcccccuggugagcgucuccacgacccgggagcccaucagcuccgagcaccuccaccgcgcggugagcgugaacgacgaggaccugcugguccggauccugcagggcggccgcgugaagguggacguccccaacaaguucggguucaccgcccucaugguggccgcccagaagggcuacacccggcuggugaagauccuggucuccaacgggacggacgugaaccucaagaacggcagcgggaaggacucccugaugcuggccugcuacgcgggccaccucgacguggucaaguaccugcgccggcacggcgccagcuggcaggcccgcgaccucgggggcugcaccgcccugcacugggcggccgacgggggccacugcuccgugaucgaguggaugaucaaggacggcugcgagguggacgucguggacaccgggagcggcuggaccccgcugaugcggguguccgccgucagcgggaaccagcgcguggccucccugcucaucgacgccggcgcgaacgucaacgugaaggaccggaacgggaagacgccccugaugguggccguccugaacaaccacgaggagcucgugcagcugcugcucgacaagggcgccgacgccagcgugaagaacgaguucggcaaggggguccuggagauggcccgcguguucgaccggcagagcguggucucccugcucgaggagcgcaagaagaagcagcggcccaagaaguccugcgugugcuga

SEQ ID NO: 30007 - RNA, 2208 nt, Artificial Sequence
  derived and/or modified sequence opt1 from FAP__Homo_sapiens__NP_001278736
augaagaccugggugaagaucgucuucggcguggccaccagcgccgugcuggcgcuccuggucaugugcaucgugcugcgccccucccgggugcacaacagcgaggagaacacgaugcgcgcccucacccugaaggacauccugaacgggaccuucuccuacaagaccuucuucccgaacuggaucagcggccaggaguaccuccaccaguccgccgacaacaacaucguccuguacaacaucgagacggggcagagcuacaccauccuguccaaccggaccaugcucuggcgcuacagcuacaccgccacguacuacaucuacgaccuguccaacggcgaguucgugcgggggaacgagcugccccgccccauccaguaccucugcuggagccccgugggcuccaagcuggccuacgucuaccagaacaacaucuaccugaagcagcggccgggcgacccgcccuuccagaucaccuucaacgggcgcgagaacaagaucuucaacggcauccccgacuggguguacgaggaggagaugcucgcgaccaaguacgcccugugguggagccccaacgggaaguuccuggccuacgccgaguucaacgacaccgacauccccgugaucgcguacuccuacuacggcgacgagcaguacccccggacgaucaacauccccuacccgaaggccggggccaagaaccccgucgugcgcaucuucaucaucgacaccaccuaccccgccuacgugggcccccaggaggucccggugcccgccaugaucgcgagcuccgacuacuacuucagcuggcucaccugggugacggacgagcgggucugccugcaguggcugaagcgcgugcagaacguguccguccucagcaucugcgacuuccgggaggacuggcagaccugggacugccccaagacccaggagcacaucgaggagucccgcaccggcugggccgggggcuucuucgugagcacgcccguguucagcuacgacgccaucuccuacuacaagaucuucagcgacaaggacggguacaagcacauccacuacaucaaggacaccgucgagaacgccauccagaucaccuccggcaagugggaggccaucaacaucuuccgggugacccaggacagccuguucuacuccagcaacgaguucgaggaguacccgggccgccggaacaucuaccgcaucuccaucgggagcuacccgcccuccaagaagugcgucacgugccaccuccggaaggagcgcugccaguacuacaccgcgagcuucuccgacuacgccaaguacuacgcccucgugugcuacggccccgggauccccaucagcacccugcacgacggccggaccgaccaggagaucaagauccuggaggagaacaaggagcucgagaacgcccugaagaacauccagcugcccaaggaggagaucaagaagcucgagguggacgagaucacgcugugguacaagaugauccugccgccccaguucgaccgcuccaagaaguacccccuccugauccaggucuacgggggccccugcagccaguccgugcgcagcguguucgccgucaacuggaucuccuaccuggcgagcaaggagggcauggugaucgcccucguggacgggcggggcaccgccuuccagggggacaagcugcuguacgccgucuaccgcaagcucggcguguacgagguggaggaccagaucaccgccguccggaaguucaucgagaugggguucaucgacgagaagcgcaucgcgaucuggggcugguccuacggcggguacgugagcagccuggcccuggccuccggcaccgggcuguucaagugcggcaucgccguggcgcccgucagcuccugggaguacuacgccagcguguacacggagcgguucauggggcugccgaccaaggacgacaaccuggagcacuacaagaacuccaccgugauggcccgcgccgaguacuuccggaacgucgacuaccuccugauccacggcaccgccgacgacaacgugcacuuccagaacagcgcgcagaucgccaaggcccuggugaacgcccaggucgacuuccaggccaugugguacuccgaccagaaccacggccucagcgggcuguccacgaaccaccuguacacccacaugacccacuuccugaagcagugcuucagccucuccgacuga

SEQ ID NO: 30008 - RNA, 1548 nt, Artificial Sequence
  derived and/or modified sequence opt1 from FAR1__Homo_sapiens__NP_115604
auggugagcauccccgaguacuacgagggcaagaacguccugcucaccggggccaccggcuuccuggggaaggugcugcucgagaagcugcugcgcuccugcccgaaggugaacagcgucuacgugcucgugcggcagaaggccggccagacgccccaggagcgcgucgaggaggugcuguccgggaagcuguucgaccggcuccgcgacgagaaccccgacuuccgggagaagaucaucgcgaucaacagcgagcugacccagcccaagcuggcccucuccgaggaggacaaggaggugaucaucgacagcaccaacaucaucuuccacugcgccgccaccguccgcuucaacgagaaccugcgggacgccgugcagcugaacgugaucgcgacgcgccagcucauccugcuggcccagcagaugaagaaccucgaggucuucaugcacguguccaccgccuacgccuacugcaaccggaagcacaucgacgagguggucuacccgccgcccguggaccccaagaagcugaucgacagccuggaguggauggacgacggccucgugaacgacaucacccccaagcugaucggcgaccgccccaacaccuacaucuacacgaaggcgcuggccgaguacgucgugcagcaggagggggccaagcucaacguggccaucguccggcccuccaucgugggcgccagcuggaaggagcccuucccgggguggaucgacaacuucaacggccccuccgggcuguucaucgcggccggcaagggcauccugcgcaccauccgggccagcaacaacgcccucgccgaccuggugcccgucgacguggucgugaacaugucccuggcggccgccugguacagcggggugaaccgcccccggaacaucauggucuacaacugcaccaccggcuccacgaacccguuccacuggggcgagguggaguaccacgugaucagcaccuucaagcgcaacccccucgagcaggccuuccggcgccccaacgucaaccugaccuccaaccaccuccuguaccacuacuggaucgccgugagccacaaggcgcccgccuuccuguacgacaucuaccugcggaugaccgggcgcuccccgcggaugaugaagacgaucacccgccuccacaaggccaugguguuccuggaguacuucaccagcaacagcugggucuggaacaccgagaacgugaacaugcugaugaaccagcucaaccccgaggacaagaagacguucaacaucgacgugcgccagcugcacugggccgaguacaucgagaacuacugccugggcaccaagaaguacguccucaacgaggagauguccgggcugcccgccgcgcggaagcaccugaacaagcuccgcaacauccgguacggcuucaacaccauccuggugauccugaucuggcgcaucuucaucgcccggagccagauggcccgcaacaucugguacuucguggucucccucugcuacaaguuccugagcuacuuccgggccuccagcaccaugcgcuacuga

SEQ ID NO: 30009 - RNA, 390 nt, Artificial Sequence
  derived and/or modified sequence opt1 from FARP1__Homo_sapiens__NP_001001715
augggcgagaucgagcagcgccccaccccggggagccggcugggcgcccccgagaacuccgggaucagcacccucgagcgcggccagaagcccccgcccacgcccuccgggaagcuggugagcaucaagauccagaugcuggacgacacccaggaggccuucgagguccccaugguguccagcuccagcuuccucaaggcgaccggcuccagcuggaccggcugggugcugcggugcuccaugaagcccaagcaccacagccaccugaucgagaaguucggggaggaccgcauccucacgcaccugaccggcuccaucagcuacaccaacugggccgggucccggagccuggccgucaccgugacggaggagcuccugaaccuguucuga

SEQ ID NO: 30010 - RNA, 1944 nt, Artificial Sequence
  derived and/or modified sequence opt1 from FARP2__Homo_sapiens__NP_001269912
augggcgagaucgaggggaccuaccgcgugcugcagaccgccggcaugcggcucggggcccagacgcccgucggcgugagcacccuggagccggggcagacccugcucccccgcaugcaggagaagcaccuccaccuccgggugaagcugcuggacaacaccauggagaucuucgacaucgagcccaagugcgacggccagguccugcucacccagguguggaagcgccugaaccugguggagugcgacuacuucggcauggaguuccagaacacgcaguccuacuggaucuggcucgagcccaugaagccgaucauccggcagauccgccggcccaagaacgucgugcugcgccuggcggugaaguucuucccgcccgaccccgggcagcuccaggaggaguacacccgguaccuguucgcccugcagcucaagcgcgaccugcuggaggagcggcugaccugcgccgacacgaccgccgcccugcugaccagccaccuccugcaguccgagaucggcgacuacgacgagacccuggaccgcgagcaccucaaggucaacgaguaccugcccgggcagcagcacugccuggagaagauccucgaguuccaccagaagcacgugggccagacgcccgcggagagcgacuuccaggugcuggagaucgcccggaagcuggagauguacgggauccgcuuccacauggccuccgaccgggagggcaccaagauccagcucgccgucagccacaugggcgugcugguguuccaggggaccaccaagaucaacacguucaacugguccaagguccgcaagcugagcuucaagcggaagcgcuuccucaucaagcugcaccccgaggugcacggcccguaccaggacacccuggaguuccuccuggggucccgggacgagugcaagaacuucuggaagaucugcguggaguaccacaccuucuuccgccugcucgaccagcccaagcccaaggcgaaggccgucuucuucagccggggcuccagcuuccgcuacuccggccgcacccagaagcagcugguggacuacuucaaggacagcgggaugaagcggauccccuacgagcgccggcacuccaagacgcacaccagcgugcgcgcccugaccgccgaccucccgaagcaguccaucagcuuccccgagggccugcggacccccgccucccccagcagcgcgaacgccuucuacucccugagcccguccacgcucguccccagcgggcugcccgaguucaaggacuccagcuccagccugaccgacccccagguguccuacgucaagagcccggccgccgagcgccgguccggcgccguggccgggggccccgacacccccagcgcgcagccccugggcccgcccgcccuccagcccgggccgggccuguccaccaagagcccccagcccucccccagcucccgcaagagcccgcugucccucagccccgccuuccaggugccccuggggcccgccgagcagggcagcuccccgcugcucagccccguccuguccgacgccgggggcgcgggcauggacugcgaggagccccggcacaagcgcgugcccgccgacgaggccuacuucaucgugaaggagauccuggccacggagcggaccuaccucaaggaccuggaggucaucaccgugugguuccgcagcgcgguggucaaggaggacgccaugccggccacccugaugacgcuccuguucuccaacaucgaccccaucuacgaguuccaccggggguuccugcgcgagguggagcagcggcucgcccugugggagggccccagcaaggcgcacaccaaggggucccaccagcgcaucggcgacauccugcuccggaacaugcgccagcugaagguguuccagcugcacgaggggcacgucgccggcgugaccaagauggaguga

SEQ ID NO: 30011 - RNA, 1356 nt, Artificial Sequence
  derived and/or modified sequence opt1 from FARS2__Homo_sapiens__NP_001305801
auggugggcagcgcccugcgccgcggggcccacgcguacgucuaccucguguccaaggccagccacaucucccggggccaccagcaccaggccugggggagccggcccccggccgccgagugcgcgacccagcgcgcccccggcuccguggucgagcugcugggcaagagcuacccccaggacgaccacuccaaccucacccggaaggugcugacgcgcguggggcggaaccugcacaaccagcagcaccacccccucuggcugaucaaggagcgcgucaaggagcacuucuacaagcaguacgugggccgguucgggaccccgcuguucagcguguacgacaaccucucccccgucgugaccaccuggcagaacuucgacagccugcugauccccgccgaccaccccucccgcaagaagggcgacaacuacuaccucaaccggacgcacaugcugcgcgcccacaccagcgcgcaccagugggaccugcuccacgccgggcuggacgccuuccugguggucggcgacguguaccggcgcgaccagaucgacucccagcacuacccgaucuuccaccagcucgaggccgugcggcuguucagcaagcacgagcuguucgccgggaucaaggacggcgagucccuccagcuguucgagcagagcucccgcagcgcgcacaagcaggagacccacaccauggaggccgucaagcugguggaguucgaccucaagcagacgcugacccggcugauggcccaccucuucggcgacgagcuggagauccgcuggguggacugcuacuuccccuucacccaccccuccuucgagauggagaucaacuuccacggggaguggcuggagguccucggcugcggggugauggagcagcagcuggugaacagcgccggcgcccaggaccggaucggcugggcguucgggcugggccucgagcgccuggccaugauccuguacgacauccccgacauccgccucuucuggugcgaggacgagcgguuccugaagcaguucugcgucagcaacaucaaccagaaggugaaguuccagccgcuguccaaguaccccgccgugaucaacgacaucagcuucuggcuccccuccgagaacuacgccgagaacgacuucuacgaccugguccgcaccaucgggggcgaccugguggagaaggucgaccucaucgacaaguucgugcaccccaagacgcacaagaccagccacugcuaccggaucaccuaccgccacauggagcggacccugucccagcgcgaggugcggcacauccaccaggcccugcaggaggcggccguccagcuccuggggguggagggccgcuucuga

SEQ ID NO: 30012 - RNA, 1527 nt, Artificial Sequence
  derived and/or modified sequence opt1 from FARSA__Homo_sapiens__NP_004452
auggccgacggccagguggccgagcugcuccugcgccggcuggaggcgagcgacgggggccucgacuccgccgagcuggccgccgagcuggggauggagcaccaggccgucgugggcgcggugaagucccuccaggcccugggggaggucaucgaggccgagcugcgcuccaccaagcacugggagcucaccgccgagggcgaggagaucgcgcgggagggcagccacgaggcccgcguguuccgguccaucccgcccgaggggcuggcccagagcgagcugaugcgccuccccuccggcaaggugggguucagcaaggccauguccaacaaguggauccgggucgacaagagcgccgcggacggcccccgcguguuccggguggucgacuccauggaggacgaggugcagcgccggcugcagcuggugcgcgggggccaggccgagaagcucggcgagaaggagcggagcgagcugcgcaagcggaagcugcucgccgaggucacgcugaagaccuacuggguguccaaggggagcgccuucuccaccagcaucuccaagcaggagaccgagcugagccccgagaugaucuccagcggcagcuggcgcgaccggcccuucaagcccuacaacuuccucgcccacggggugcugcccgacuccggccaccuccacccccuccugaagguccgcagccaguuccggcagaucuuccuggagaugggcuucacggagaugccgaccgacaacuucaucgaguccagcuucuggaacuucgacgcgcuguuccagccccagcagcaccccgcccgcgaccagcacgacaccuucuuccugcgggaccccgccgaggcccugcagcucccgauggacuacgugcagcgcgugaagcgcacccacucccagggcggguacgggagccagggcuacaaguacaacuggaagcuggacgaggcccggaagaaccugcuccgcacgcacaccaccuccgcgagcgcccgggcccuguaccgccuggcccagaagaagcccuucacccccgucaaguacuucuccaucgaccggguguuccgcaacgagacgcucgacgccacccaccuggcggaguuccaccagaucgaggggguggucgccgaccacggccugacccucggccaccugaugggggugcugcgggaguucuucaccaagcucggcaucacgcagcugcgcuucaagcccgccuacaacccguacaccgagcccagcauggagguguucuccuaccaccaggggcugaagaagugggucgaggugggcaacagcggggucuuccggcccgagaugcuccugcccaugggccugccggagaacguguccgugaucgccuggggccucagccuggagcgccccaccaugaucaaguacgggaucaacaacauccgggagcuggucggccacaaggugaaccugcagaugguguacgacagcccccucugccgccuggacgcggagccccggccgccgcccacccaggaggccgccuga

SEQ ID NO: 30013 - RNA, 1008 nt, Artificial Sequence
  derived and/or modified sequence opt1 from FAS__Homo_sapiens__NP_000034
augcugggcaucuggacccuccugccccuggugcucaccagcgucgcccgccuguccagcaaguccgugaacgcccaggugacggacaucaacagcaaggggcuggagcuccggaagaccgucaccaccguggagacgcagaaccuggagggccugcaccacgacgggcaguucugccacaagccgugcccgcccggcgagcgcaaggcgcgggacugcaccgugaacggggacgagcccgacugcguccccugccaggagggcaaggaguacaccgacaaggcccacuucuccagcaagugccgccggugccgccucugcgacgagggccacgggcuggagguggagaucaacugcacccggacgcagaacaccaagugccgcugcaagcccaacuucuucugcaacuccaccgugugcgagcacugcgaccccugcaccaagugcgagcacggcaucaucaaggagugcacgcugaccagcaacaccaagugcaaggaggaggggucccggagcaaccucggcuggcugugccugcuccugcugcccaucccgcucaucgucugggugaagcgcaaggaggugcagaagaccugccggaagcaccgcaaggagaaccaggggucccacgagagccccacgcugaaccccgagaccgucgccaucaaccuguccgacguggaccucagcaaguacaucaccaccaucgccggcgugaugacgcugucccaggucaagggcuucgugcggaagaacggggugaacgaggccaagaucgacgagaucaagaacgacaacguccaggacaccgcggagcagaaggugcagcugcuccgcaacuggcaccagcugcacggcaagaaggaggccuacgacacccugaucaaggaccucaagaaggccaaccugugcacccuggccgagaagauccagacgaucauccucaaggacaucaccagcgacuccgagaacagcaacuuccggaacgagauccagucccugguguga

SEQ ID NO: 30014 - RNA, 846 nt, Artificial Sequence
  derived and/or modified sequence opt1 from FASLG__Homo_sapiens__NP_000630
augcagcagcccuucaacuacccguacccccagaucuacuggguggacagcuccgccagcucccccugggcccccccgggcaccguccugcccugccccaccagcgugccccgccggccggggcagcgccggcccccccccccgcccccccccccgccccucccccccccgcccccccccccgccccugcccccccugccgcuccccccccugaagaagcgcggcaaccacuccacggggcugugccuccuggugauguucuucaugguccugguggcgcucgugggccuggggcugggcauguuccagcucuuccaccugcagaaggagcuggccgagcuccgggagagcaccucccagaugcacaccgccagcucccuggagaagcagaucggccacccgagccccccccccgagaagaaggagcugcgcaaggucgcccaccucaccgggaaguccaacagccgguccaugccgcuggagugggaggacacguacggcaucgugcugcucagcggggugaaguacaagaagggcgggcuggucaucaacgagaccggccuguacuucguguacuccaagguguacuuccgcggccagagcugcaacaaccucccccugucccacaaggucuacaugcggaacagcaaguacccccaggaccuggugaugauggaggggaagaugauguccuacugcaccaccggccagaugugggcccgcagcagcuaccucggggcgguguucaaccugacguccgccgaccaccuguacgucaacgugagcgagcucucccuggugaacuucgaggagagccagaccuucuucggccuguacaagcucuga

SEQ ID NO: 30015 - RNA, 7536 nt, Artificial Sequence
  derived and/or modified sequence opt1 from FASN__Homo_sapiens__NP_004095
auggaggagguggugaucgccggcaugagcgggaagcugcccgagagcgagaaccugcaggaguucugggacaaccugaucggcgggguggacauggugaccgacgacgaccggcgguggaaggccggccuguacgggcugccgcgccggagcggcaagcugaaggaccugucccgcuucgacgccagcuucuucggcgugcaccccaagcaggcccacaccauggacccccagcugcggcugcugcucgaggugacguacgaggccaucguggacgggggcaucaaccccgacucccugcgcgggacccacaccggcgugugggugggggugagcggcuccgagaccagcgaggcccugucccgggacccggagacgcucgucggcuacagcaugguggggugccagcgcgccaugauggccaaccggcuguccuucuucuucgacuuccgcggccccagcaucgcccuggacaccgccugcuccagcucccucauggcccugcagaacgcguaccaggccauccacagcgggcagugccccgccgccaucgugggcggcaucaacguccugcucaagcccaacaccuccgugcaguuccugcggcuggggaugcucagcccggaggggaccugcaaggccuucgacacggcggggaacggcuacugccgcuccgaggggguggucgccgugcugcugaccaagaagucccucgcccggcgcguguacgccaccauccugaacgccggcaccaacacggacggcuucaaggagcagggggucaccuuccccagcggcgacauccaggagcagcugauccggucccucuaccagagcgcggggguggcccccgaguccuucgaguacaucgaggcccacggcaccgggaccaaggugggcgacccccaggagcugaacggcaucacgcgcgcccugugcgccacccggcaggagccgcuccugaucgggagcaccaaguccaacaugggccaccccgagcccgcgagcgggcuggccgcccucgccaagguccugcugucccucgagcacggccugugggcccccaaccugcacuuccacagcccgaaccccgagauccccgcgcuccuggacgggcgccuccaggugguggaccagccccucccgguccggggcggcaacguggggaucaacuccuucggcuucgggggcagcaacguccacaucauccugcgccccaacacccagccgccgcccgcccccgcgccccacgccacgcugccccggcuccugcgcgcguccggccgcacccccgaggccgugcagaagcugcucgagcaggggcugcggcacagccaggaccuggccuuccuguccaugcucaacgacaucgccgccgugcccgcgaccgccaugcccuuccgcggcuacgccguccucggcggcgagcgcgggggcccggaggugcagcagguccccgccggcgagcgcccccugugguucaucugcagcgggaugggcacccaguggcgggggaugggccucucccugaugcgccuggaccgguuccgcgacagcauccuccgguccgacgaggccgucaagcccuucgggcugaaggugagccagcugcuccuguccacggacgagagcaccuucgacgacaucgugcacagcuucgucucccugaccgcgauccagaucggccucaucgaccugcugagcugcaugggccuccgcccggacgggaucgugggccacucccugggggagguggccugcggcuacgccgacgggugccugagccaggaggaggccguccucgccgcguacuggcggggccagugcaucaaggaggcccaccucccgcccggcgccauggccgcgguggggcuguccugggaggagugcaagcagcgcugcccgcccggcgugguccccgccugccacaacagcaaggacaccgugacgaucuccgggccccaggcccccguguucgaguucgucgagcagcuccggaaggagggcguguucgccaaggaggugcgcaccgggggcauggccuuccacagcuacuucauggaggcgaucgccccgccccugcugcaggagcucaagaaggucauccgggagcccaagccccgcuccgcccgguggcugagcaccuccaucccggaggcccaguggcacagcucccuggcccgcaccagcuccgcggaguacaacgugaacaaccucgugagccccguccuguuccaggaggcccuguggcacgugcccgagcacgccgugguccucgagaucgcgccccacgcccugcugcaggcggugcucaagcggggccugaagccguccugcacgaucaucccccugaugaagaaggaccaccgcgacaaccucgaguucuuccuggccgggaucggccgccugcaccucagcgggaucgacgccaaccccaacgcccuguucccgcccguggaguuccccgcgccccggggcacgccccugaucagcccccucaucaagugggaccacucccuggccugggacguccccgccgccgaggacuuccccaacggcagcggguccccgagcgccgcgaucuacaacaucgacaccuccagcgagucccccgaccacuaccugguggaccacacccucgacggccgcgugcuguuccccgccaccggguaccugagcaucgucuggaagacccucgcccgggcccugggccuggggguggagcagcuccccguggucuucgaggacguggugcugcaccaggccaccauccugccgaagaccggcaccgucucccucgaggugcgccugcuggaggcgagccgggccuucgagguguccgagaacggcaaccucgucgugagcgggaagguguaccagugggacgaccccgacccccgccuguucgaccaccccgaguccccgacgcccaaccccaccgagccccuguuccucgcccaggccgaggucuacaaggagcugcggcugcgcggcuacgacuacgggccgcacuuccagggcauccucgaggccagccuggagggggacuccggccggcugcucuggaaggacaacugggugagcuucauggacaccaugcugcagauguccauccugggcagcgcgaagcacgggcucuaccugcccacccgcgugacggccauccacaucgaccccgccacccaccggcagaagcuguacacccuccaggacaaggcccaggucgccgacgugguggucucccgcuggcugcgggugaccgucgcgggcggggugcacaucagcggccugcacacggagagcgcgccccgccggcagcaggagcagcaggucccgauccucgagaaguucugcuucacgccccacaccgaggaggggugccuguccgagcgcgccgcccugcaggaggagcuccagcugugcaagggccugguccaggcgcuccagaccaaggugacccagcagggccugaagauggugguccccgggcuggacggcgcccagaucccccgggacccgagccagcaggagcucccccgccugcuguccgccgccugccggcuccagcugaacgggaaccugcagcucgagcuggcccaggugcuggcgcaggagcgccccaagcuccccgaggacccgcugcugagcggccugcucgacucccccgcccugaaggccugccuggacaccgccguggagaacaugcccagccucaagaugaaggucguggaggugcuggccggccacgggcaccuguacucccggaucccgggccuccugagcccccacccccugcuccagcuguccuacaccgcgaccgaccgccacccccaggcccuggaggccgcccaggccgagcuccagcagcacgacgucgcgcaggggcagugggacccggccgaccccgcccccagcgcccugggcuccgcggaccugcucgugugcaacugcgccguggccgcccugggggaccccgccagcgcgcuguccaacauggucgccgcccuccgcgagggcggcuuccugcugcuccacacgcugcugcgggggcacccgcucggcgacaucguggccuuccugaccagcaccgagccccaguacgggcagggcauccugucccaggacgccugggagagccucuucucccgcgugagccugcggcuggucgggcucaagaaguccuucuacggcagcacccuguuccugugccgccggcccacgccccaggacagcccgaucuuccuccccguggacgacaccuccuuccgcuggguggagagccugaagggcauccuggcggacgaggacuccagccggcccgucuggcucaaggccaucaacugcgccaccuccgggguggugggccuggucaacugccugcgccgggagcccgggggcaaccgccuccggugcgugcugcugagcaaccucuccagcaccucccacgugccggaggucgaccccgggagcgccgagcugcagaaggugcugcagggcgaccucgugaugaacgucuaccgcgacggcgccuggggcgccuuccggcacuuccugcuggaggaggacaagcccgaggagcccacggcccacgccuucguguccacccucacccgcggggaccugagcuccauccggugggugugcagcucccugcgccacgcccagccgaccugccccggggcgcagcucugcacggucuacuacgccagccugaacuuccgggacaucaugcuggccaccggcaagcucucccccgacgccauccccgggaaguggaccagccaggacucccugcugggcauggaguucagcggccgcgacgccagcgggaagcgggugaugggccucgugccggcgaaggggcuggccaccuccguccugcucagccccgacuuccugugggacgugcccuccaacuggacgcuggaggaggccgccagcgugcccgucguguacuccaccgccuacuacgcgcucgugguccgcggccgcgugcggccgggcgagacccugcugauccacagcggguccggcggggugggccaggccgccaucgccaucgcccucagccuggggugccgcgucuucaccacggugggcuccgcggagaagcgggccuaccugcaggcccgcuucccccagcucgacagcaccuccuucgccaacagccgggacaccuccuucgagcagcacgugcuguggcacaccggcgggaagggcgucgaccuggugcucaacagccuggccgaggagaagcugcaggcguccgugcgcugccucgccacccacgggcgguuccuggagaucggcaaguucgaccugagccagaaccacccccucgggauggccaucuuccugaagaacgucacguuccacggcgugcugcucgacgccuucuucaacgaguccagcgcggacuggcgcgaggucugggcccuggugcaggccggcauccgggacggggugguccgcccgcugaagugcaccguguuccacggcgcccagguggaggacgccuuccgguacauggcgcaggggaagcacaucggcaaggucguggugcagguccucgccgaggagcccgaggccgugcugaagggggccaagcccaagcugauguccgccaucagcaagaccuucugccccgcgcacaagagcuacaucaucgccggcggccucgggggcuucgggcuggagcuggcccaguggcucauccagcgcggcgugcagaagcugguccugaccucccggagcgggauccgcacgggcuaccaggccaagcagguccggcgcuggcggcgccagggcgugcagguccagguguccaccagcaacaucuccagccucgagggggcccggggccugaucgcggaggccgcccagcuggggccggugggcggcgucuucaaccucgccguggugcugcgcgacgggcugcucgagaaccagacccccgaguucuuccaggacgucugcaagcccaaguacuccggcacccugaaccuggaccgggugacgcgcgaggcgugccccgagcuggacuacuucguggucuucagcuccgugagcugcgggcgcggcaacgccgggcaguccaacuacggcuucgccaacagcgccauggagcggaucugcgagaagcgccggcacgagggccucccggggcuggccgugcaguggggcgcgaucggggacgucggcauccugguggagaccauguccaccaacgacaccaucgugagcgggacgcucccccagcgcauggccuccugccuggagguccuggaccucuuccugaaccagccccacauggugcugagcuccuucgugcucgccgagaaggccgccgcguaccgggaccgcgacagccagcgggaccuggucgaggccguggcccacauccugggcauccgcgaccucgccgccgugaaccuggacuccagccuggcggaccucggccuggacagccugauguccgucgaggugcggcagacccucgagcgcgagcugaaccuggugcucagcguccgggaggugcgccagcugacccugcggaagcuccaggagcuguccagcaaggccgacgaggccuccgagcuggccugccccaccccgaaggaggacgggcucgcgcagcagcagacgcagcugaaccugcgcagccuccuggugaaccccgagggccccacccugaugcggcucaacuccguccagagcuccgagcgcccccuguuccuggugcacccgaucgaggggagcaccaccguguuccacucccucgccagccggcuguccauccccacguacggccugcagugcacccgcgccgcgccccucgacagcauccacucccuggccgccuacuacaucgacugcauccggcagguccagcccgaggggccguaccgcguggccggcuacagcuacggcgccugcguggccuucgagaugugcucccagcugcaggcccagcagagccccgcgcccacccacaacagccucuuccuguucgacgggucccccaccuacguccuggccuacacgcagagcuaccgcgccaagcucaccccgggcugcgaggccgaggccgagaccgaggcgaucugcuucuucgugcagcaguucaccgacauggagcacaaccgggugcuggaggcccugcucccccugaaggggcuggaggagcgcgucgccgccgccguggaccucaucaucaagucccaccagggccuggaccggcaggagcugagcuucgcggcccgcuccuucuacuacaagcuccgggccgccgagcaguacacgcccaaggcgaaguaccacggcaacgucaugcugcugcgcgccaagaccgggggcgccuacggggaggaccucggcgccgacuacaaccugagccaggugugcgacgggaagguguccguccacgugaucgagggcgaccaccggacccugcucgagggcagcgggcuggaguccaucaucagcaucauccacuccagccuggccgagccgcgcguguccguccgggagggcuga

SEQ ID NO: 30016 - RNA, 2133 nt, Artificial Sequence
  derived and/or modified sequence opt1 from FASTKD2__Homo_sapiens__NP_055744
augcugaccacccucaagcccuucggcagcguguccgucgagagcaagaugaacaacaaggccggguccuucuucuggaaccugcgccaguucagcacgcugguguccaccagccggaccaugcgccucugcugccugggccugugcaagccgaagaucgugcacuccaacuggaacauccucaacaacuuccacaaccggaugcagagcaccgacaucauccgcuaccuguuccaggacgccuucaucuucaaguccgacgucggguuccagacgaagggcaucagcacccugaccgcgcuccggaucgagcgccugcuguacgccaagcggcuguucuucgacuccaagcagagccuggugcccguggacaaguccgacgacgagcugaagaaggucaaccucaaccacgaggugagcaacgaggacgugcugaccaaggagacgaagcccaaccgcaucuccagccggaagcuguccgaggagugcaacagccucuccgacguccuggacgccuucagcaaggcccccaccuucccgagcuccaacuacuucaccgccauguggaccaucgcgaagcgccugagcgacgaccagaagcgguucgagaagcgccucauguucucccaccccgccuucaaccagcugugcgagcacaugaugcgggaggccaagaucaugcaguacaaguaccugcuguucagccugcacgccaucgugaagcuggggaucccccagaacacgauccucgugcagacccugcugcgcgucacccaggagcggaucaacgagugcgacgagaucugccucuccgugcugagcaccgugcuggaggcgauggagcccugcaagaacguccacgugcuccgcacgggcuuccggauccugguggaccagcaggucuggaagaucgaggacguguucacccuccagguggucaugaagugcaucggcaaggacgccccgaucgcccucaagcgcaagcuggagaugaaggcccugcgggagcucgaccgcuucuccgugcugaacagccagcacauguucgaggugcuggccgcgaugaaccaccggucccucauccugcuggacgagugcagcaaggucgugcucgacaacauccacgggugcccccugcgcaucaugaucaacauccugcaguccugcaaggaccuccaguaccacaaccuggaccuguucaagggccuggccgacuacgucgccgccaccuucgacaucuggaaguuccgcaagguccucuucauccugauccuguucgagaaccucggguuccggcccgugggccugauggaccuguucaugaagcgcaucguggaggaccccgagagccucaacaugaagaacauccuguccauccugcacaccuacagcucccucaaccacguguacaagugccagaacaaggagcaguucguggaggucauggccagcgcgcugacgggguaccugcacaccaucuccagcgagaaccuccuggacgccguguacuccuucugccugaugaacuacuucccgcucgcccccuucaaccagcugcugcagaaggacaucaucagcgagcuccugaccagcgacgacaugaagaacgccuacaagcugcacacccucgacacgugccugaagcuggacgacaccguguaccuccgggacaucgcccugucccugccccagcucccccgcgagcugccgagcucccacaccaacgcgaaggucgccgaggugcugagcucccuccugggcggcgaggggcacuucagcaaggacgugcaccucccccacaacuaccacaucgacuucgagauccggauggacaccaaccgcaaccagguccucccccuguccgacguggacacgaccagcgccaccgacauccagcggguggccguccugugcgugucccgcagcgccuacugccucggcuccagccacccccggggguuccuggcgaugaagaugcgccaccugaacgccaugggcuuccacgugauccucgucaacaacugggagauggacaagcuggagauggaggacgccgugaccuuccugaagacgaagaucuacuccguggaggcccucccggucgcggccgugaacgugcagagcacccaguga

SEQ ID NO: 30017 - RNA, 1569 nt, Artificial Sequence
  derived and/or modified sequence opt1 from FASTK__Homo_sapiens__NP_001245390
augcgccggccccgcggcgagccggggccccgggccccgcgccccaccgagggcgcgaccugcgcggggcccggcgagagcuggucccccagccccaacuccaugcugcgggugcuccugagcgcccagacgucccccgcccgccugagcgggcuccugcugaucccgcccguccagcccugcugccucggccccuccaaguggggcgaccggccggucgggggcgggcccagcgccggccccgugcaggggcugcagcgccugcucgagcaggccaagucccccggcgagcugcugcgguggcucggccagaacccgagcaaggugcgcgcgcaccacuacuccguggcccugcggcgccuggggcagcuccugggcagccggccccggcccccgcccguggagcaggucacccugcaggaccucucccagcugaucauccgcaacugccccagcuucgacauccacaccauccacgugugccugcaccucgccgugcugcugggguuccccuccgacggcccccucgucugcgcccuggagcaggagcgccggcugcgccucccgcccaagccgccgccgccccugcagccccugcuccgggaggcccgccccgaggagcugacgccccacgugauggugcugcucgcccagcaccuggcccggcaccgccugcgcgagccccagcuccuggaggccaucgcccacuuccuggucgugcaggagacccagcucagcuccaaggugguccagaagcuggugcugcccuucggccggcucaacuaccugccccuggagcagcaguucaugcccugccucgagcgcauccuggcgcgggaggccgggguggcgccccuggccaccgucaacauccucaugagccugugccagcugcgcugccugcccuuccgggcccuccacuucguguucuccccgggcuucaucaacuacaucagcgggacgccccacgcccugaucgugcgccgguaccugagccuccuggacaccgccgucgagcuggagcuccccggcuaccgcgggccccggcugccgcgccggcagcagguccccaucuucccccagccccugaucaccgaccgcgcccggugcaaguacucccacaaggacaucguggccgagggccuccgccagcugcugggcgaggagaaguaccggcaggaccucaccgugccgcccggguacugcaccgacuuccugcugugcgccagcuccagcggcgcggugcuccccguccgcacccaggaccccuuccugccguacccgccccgguccugcccccaggggcaggccgccagcuccgccacgacccgcgaccccgcccagcggguggugcugguccuccgcgagcgcuggcacuucugccgggacggccgcgugcugcuggggagccgggcgcuccgcgagcggcaccugggccugaugggcuaccagcuccugccccugcccuucgaggagcucgagucccagcgcgggcugccgcagcucaagagcuaccugcggcagaagcugcaggcccugggccuccgcugggggcccgagggcggguga

SEQ ID NO: 30018 - RNA, 13767 nt, Artificial Sequence
  derived and/or modified sequence opt1 from FAT1__Homo_sapiens__XP_006714202
augggccgccaccuggcccugcugcugcuccugcugcuccuguuccagcacuucggggacuccgacggcucccagcggcuggagcagacgccccugcaguucacccaccuggaguacaacgugaccgugcaggagaacuccgccgccaagaccuacguggggcaccccgugaagaugggcguguacaucacccaccccgccugggaggugcgcuacaagaucguguccggggacagcgagaaccuguucaaggccgaggaguacauccucggcgacuucugcuuccugcggauccgcaccaagggcgggaacacggccauccugaaccgggaggugaaggaccacuacacccucaucgugaaggcccuggagaagaacaccaacguggaggcccgcaccaagguccggguccaggugcuggacacgaacgaccuccgcccccuguucucccccaccagcuacuccgucagccugcccgagaacaccgccauccggaccuccaucgcccgcgugagcgccacggacgccgacaucggcaccaacggggaguucuacuacuccuucaaggaccggaccgacauguucgccauccaccccaccagcggcgugaucguccucacggggcgccuggacuaccuggagaccaagcucuacgagauggagauccuggccgccgaccggggcaugaagcuguacggcuccagcgggaucuccagcauggccaagcucaccgugcacaucgagcaggcgaacgagugcgcccccgugaucaccgccgucacgcugucccccagcgagcuggaccgcgaccccgccuacgccaucgugaccguggacgacugcgaccagggcgcgaacggggacaucgccucccucagcaucgucgccggcgaccugcugcagcaguuccggaccgugcgcagcuuccccggcuccaaggaguacaaggugaaggccaucgggggcaucgacugggacagccaccccuucggguacaaccucacccugcaggccaaggacaagggcacgccgccccaguucuccagcgucaaggugauccacgucaccagcccccaguucaaggcggggcccgugaaguucgagaaggacguguaccgggccgagaucagcgaguucgcgccgcccaacacccccgucgugauggugaaggccauccccgccuacucccaccuccgguacgucuucaagagcacccccggcaaggcgaaguucucccucaacuacaacacgggccugaucagcauccuggagcccgugaagcggcagcaggccgcccacuucgagcucgaggugaccaccuccgaccgcaaggccagcaccaagguccuggugaaggugcugggggcgaacuccaacccgcccgaguucacgcagaccgccuacaaggccgccuucgacgagaacguccccaucggcaccaccgugaugagccucuccgccguggaccccgacgagggggagaacggcuacgucacguacagcaucgcgaaccugaaccacgugcccuucgccaucgaccacuucaccggggccguguccaccagcgagaaccuggacuacgagcucaugccccgggucuacacccugcgcauccgcgccuccgacuggggccugcccuaccggcgcgagguggaggugcucgccaccaucacgcugaacaaccugaacgacaacacgccccuguucgagaagaucaacugcgagggcaccaucccccgggaccucggggucggcgagcagaucaccaccgugagcgcgaucgacgccgacgagcugcagcuggugcaguaccagaucgaggccgggaacgagcucgacuucuucagccugaaccccaacuccggcguccugagccucaagcgcucccugauggacgggcugggcgccaaggugagcuuccacucccuccggaucaccgccaccgacggcgagaacuucgcgacgccccuguacaucaacaucaccguggccgccagccacaagcuggucaaccuccagugcgaggagaccgggguggccaagaugcuggcggagaagcugcuccaggccaacaagcugcacaaccagggcgagguggaggacaucuucuucgacucccacagcgucaacgcccacaucccccaguuccgcuccacccugcccaccgggauccaggugaaggagaaccagcccgugggcagcuccgucaucuucaugaacagcacggaccucgacaccggcuucaacgggaagcugguguacgccguguccggcgggaacgaggacagcugcuucaugaucgacauggagaccggcaugcugaagauccucagcccccuggaccgggagaccacggacaaguacacccugaacaucaccgucuacgaccucgggaucccccagaaggccgcguggcgccugcugcacgugguggucguggacgccaacgacaacccgcccgaguuccuccaggaguccuacuucguggaggucuccgaggacaaggaggugcacagcgagaucauccagguggaggccaccgacaaggaccugggcccgaacggccacgucacguacagcaucgugaccgacaccgacaccuucuccaucgacagcgugacgggggucgugaacaucgcccggccccuggaccgcgagcuccagcacgagcacucccugaagaucgaggcccgggaccaggcgcgcgaggagccccagcuguucagcaccguggucgugaaggucucccucgaggacgugaacgacaacccgcccaccuucaucccgcccaacuaccgggugaagguccgcgaggaccugcccgagggcaccgugaucauguggcuggaggcccacgaccccgaccucgggcagagcggccaggugcgguacucccugcuggaccacggggagggcaacuucgacgucgacaagcucagcggcgccgugcgcaucgugcagcagcuggacuucgagaagaagcaggucuacaaccugacggugcgggccaaggacaaggggaagcccgugucccucagcagcacgugcuacgucgagguggagguggucgacgugaacgagaaccugcacccgcccguguucuccuccuucgucgagaagggcaccgugaaggaggacgccccgguggggagccuggucaugaccguguccgcgcacgacgaggacgcccgccgggacggcgagauccgcuacagcauccgcgacggguccggcgugggcgucuucaagaucggggaggagaccggcgugaucgagaccagcgaccggcucgaccgcgaguccaccagccacuacuggcugaccguguucgccacggaccagggggucgugccccugagcuccuucaucgagaucuacaucgagguggaggacgucaacgacaacgcgccccagaccagcgagcccguguacuacccggagaucauggagaacucccccaaggacgugagcgucgugcagaucgaggccuucgaccccgacuccagcuccaacgacaagcucauguacaagaucaccagcggcaacccgcagggguucuucuccauccaccccaagaccggccugaucaccacgaccagccggaagcuggaccgcgagcagcaggacgagcacauccucgaggugaccgucaccgacaacggcagcccgcccaagagcacgaucgcccgggugaucgugaagauccuggacgagaacgacaacaagccgcaguuccugcagaaguucuacaagauccgccuccccgagcgggagaagcccgaccgcgagcggaacgcccgccgggagccccuguaccacgucaucgccaccgacaaggacgaggggccgaacgccgagaucuccuacagcaucgaggacggcaacgagcacgggaaguucuucaucgagcccaagaccggcgugguguccagcaagcgcuucuccgcggccggcgaguacgacauccugagcaucaaggccgucgacaacgggcggccccagaaguccagcaccacgcgccuccacaucgaguggaucagcaagcccaagccgucccuggagcccaucagcuucgaggaguccuucuucaccuucaccgugauggagagcgaccccguggcccacaugaucggcgucaucuccguggagcccccggggaucccccugugguucgacaucaccggcgggaacuacgacagccacuucgacguggacaagggcacgggcaccaucaucgucgccaagccccucgacgcggagcagaaguccaacuacaaccugaccguggaggccaccgacgggacgaccaccauccugacccagguguucaucaaggucaucgacacgaacgaccaccggccccaguucagcaccuccaaguacgagguggucaucccggaggacaccgcccccgagaccgagauccuccagaucagcgccguggaccaggacgagaagaacaagcugaucuacacgcugcaguccagccgcgacccccucucccugaagaaguuccggcuggaccccgccaccggcagccucuacaccuccgagaagcuggaccacgaggcggugcaccagcacacccugacggucauggugcgcgaccaggacgugcccgucaagcggaacuucgcccgcaucguggugaacgucagcgacaccaacgaccacgcccccugguucaccgccagcagcuacaaggggcggguguacgaguccgccgcggugggcagcgucgugcuccaggugaccgcccuggacaaggacaaggggaagaacgccgagguccuguacagcaucgaguccggcaacaucggcaacagcuucaugaucgaccccgugcucggguccaucaagacggccaaggagcuggaccgcagcaaccaggcggaguacgaccugauggugaaggccaccgacaagggcagcccgcccaugagcgagaucaccuccguccgcaucuucgugaccaucgccgacaacgccagccccaaguucacguccaaggaguacagcguggagcucuccgagaccgucagcaucggguccuucgugggcauggugaccgcccacagccaguccagcgucguguacgagaucaaggacgggaacaccggcgacgcguucgacaucaacccccacuccggcaccaucaucacgcagaaggcccuggacuucgagacccugcccaucuacacccucaucauccaggggaccaacauggccggccugagcacgaacaccaccgugcugguccaccuccaggacgagaacgacaacgcccccguguucaugcaggccgaguacaccgggcugaucuccgagagcgcgagcaucaacuccgugguccugacggaccggaacgugccccucgugauccgcgccgccgacgccgacaaggacagcaacgcccugcuggucuaccacaucguggagcccuccgugcacaccuacuucgcgaucgacagcuccaccggcgccauccacaccguccucagccuggacuacgaggagacguccaucuuccacuucaccguccaggugcacgacaugggcaccccgcggcuguucgccgaguacgccgcgaacgucaccgugcacgugaucgacaucaacgacugcccgcccgucuucgccaagccccucuacgaggccagccugcugcugccgacguacaagggggugaaggugaucaccgucaacgccaccgacgccgacuccagcgcguucucccagcucaucuacagcaucaccgagggcaacaucggggagaaguucuccauggacuacaagacgggcgcccugaccgugcagaacaccacccagcugcgcagccgguacgagcucacggugcgcgccuccgacgggcgguucgccggccugaccagcgucaagaucaacgugaaggaguccaaggagagccaccugaaguucacccaggacguguacuccgccgucgugaaggagaacagcaccgaggcggagacgcucgccgucaucaccgccaucggcaaccccaucaacgagccccuguucuaccacauccugaaccccgaccgccgguucaagaucagccgcaccuccggggugcucagcaccacgggcaccccguucgaccgggagcagcaggaggccuucgacguggucguggaggugaccgaggagcacaagcccuccgccgucgcgcacgugguggucaaggugaucguggaggaccagaacgacaacgcccccgucuucgugaaccugcccuacuacgccguggucaagguggacaccgagguggggcacgucauccgcuacgugacggccguggaccgggacagcggccgcaacggggagguccacuacuaccugaaggagcaccacgagcacuuccagaucggcccgcucggcgagaucucccugaagaagcaguucgagcuggacacccucaacaaggaguaccuggugaccguggucgcgaaggacgggggcaaccccgccuucagcgccgaggugaucgugcccaucaccgucaugaacaaggccaugcccguguucgagaagccguucuacuccgccgagaucgcggagagcauccaggugcacucccccgucgugcacgugcaggccaacagccccgaggggcugaaggucuucuacuccaucacggacggcgaccccuucagccaguucaccaucaacuucaacaccggggugaucaacgugaucgccccgcucgacuucgaggcccaccccgccuacaagcuguccauccgggcgaccgacagccugaccggcgcccacgccgaggucuucguggacaucaucguggacgacaucaacgacaacccgcccgucuucgcccagcaguccuacgccgugacgcucagcgaggcguccgugaucggcaccagcgucguccaggugcgcgccaccgacagcgacuccgagccgaaccgggggaucagcuaccagauguucggcaaccacuccaagagccacgaccacuuccacgucgacuccagcaccgggcugaucucccugcuccgcacgcuggacuacgagcagagccggcagcacaccaucuucgugcgcgccguggacggcgggaugcccacccuguccagcgacgucaucgugaccguggacgucacggaccucaacgacaacccgccccuguucgagcagcagaucuacgaggcccgcaucuccgagcacgcgccccacggccacuucgugaccugcgucaaggcguacgacgccgacagcuccgacaucgacaagcugcaguacagcauccucuccggcaacgaccacaagcacuucgugaucgacagcgccaccgggaucaucacccuguccaaccugcaccggcacgcccucaagcccuucuacagccugaaccuguccgugagcgacggcgucuuccgcagcuccacccaggugcacgugaccgucaucgggggcaaccuccacagccccgcguuccugcagaacgaguacgagguggagcuggccgagaacgcgccccuccacacccuggugauggaggucaagaccacggacggcgacuccgggaucuacggccacgugaccuaccacaucgugaacgacuucgccaaggaccgguucuacaucaacgagcgcgggcagaucuucacccuggagaagcucgaccgggagacccccgccgagaaggucaucagcgugcgccugauggccaaggacgccggcgggaagguggccuucugcacggucaacgugauccugaccgacgacaacgacaacgcgccccaguuccgggccaccaaguacgaggugaacaucggcuccagcgcggccaagggcaccuccgucgugaaggugcucgccagcgacgccgacgagggguccaacgccgacaucacguacgcgaucgaggccgacagcgaguccgucaaggagaaccuggagaucaacaagcugagcggcgugaucaccaccaaggagucccucaucgggcuggagaacgaguucuucaccuucuucgugcgcgccgucgacaacggcagccccuccaaggagagcguggugcuggucuacgugaagauccucccgcccgagaugcagcugcccaaguucuccgagcccuucuacacguucaccgugagcgaggacgucccgaucgggaccgagaucgaccugauccgggccgagcacuccggcaccgugcucuacagccuggugaagggcaacacgcccgagagcaaccgcgacgaguccuucgucaucgaccggcagagcgggcgccugaagcucgagaagucccuggaccacgagaccaccaagugguaccaguucagcauccuggcgcggugcacccaggacgaccacgagaugguggccuccguggacgucagcauccaggugaaggacgccaacgacaacucccccguguucgagagcucccccuacgaggccuucaucgucgagaaccucccgggcgggagccgcgugauccagauccgggccuccgacgcggacagcggcacgaacggccaggugauguacucccuggaccagagccaguccgucgaggugaucgagagcuucgccaucaacauggagaccggcuggaucaccacccugaaggagcucgaccacgagaagcgcgacaacuaccagaucaagguggucgccuccgaccacggcgagaagauccagcugagcuccaccgccaucguggacgugacggucaccgacgugaacgacuccccgccccgguucaccgccgagaucuacaaggggaccgugagcgaggacgacccccagggcggggucaucgcgauccuguccacgaccgacgccgacagcgaggagaucaaccgccaggugaccuacuucaucaccggcggggacccgcucggccaguucgccgucgagacgauccagaacgaguggaagguguacgugaagaagccccuggaccgggagaagcgcgacaacuaccugcucaccaucaccgccaccgacggcacguucuccagcaaggccaucgucgaggugaaggugcuggacgcgaacgacaacucccccgucugcgagaagacccuguacagcgacaccauccccgaggacgugcucccggggaagcugaucaugcagaucuccgccaccgacgccgacauccggagcaacgccgagaucacguacacccugcucggcuccggggcggagaaguucaagcugaaccccgacaccggcgagcugaagaccagcacgccccucgaccgcgaggagcaggccguguaccaccuccugguccgcgccaccgacggcgggggccgguucugccaggccuccaucgugcugacccuggaggacgugaacgacaacgccccggaguucagcgcggaccccuacgccaucaccgucuucgagaacacggagcccgggacccugcucacccgcgugcaggccaccgacgccgacgccggccugaaccggaagauccuguacucccucaucgacagcgcggacgggcaguucuccaucaacgagcugagcggcaucauccagcuggagaagccccucgaccgcgagcugcaggccguguacacgcugucccucaaggccgucgaccagggccugccgcggcgccugaccgccaccgggaccgugaucgugagcguccucgacaucaacgacaacccgcccguguucgaguaccgggaguacggcgccacgguguccgaggacauccuggucgggaccgaggugcuccagguguacgcggccagccgcgacaucgaggccaacgccgagaucaccuacagcaucaucuccggcaacgagcacgggaaguucagcaucgacuccaagaccggcgccgucuucaucaucgagaaccucgacuacgagagcucccacgaguacuaccugacgguggaggcgaccgacggcgggacccccagccuguccgacguggccaccgucaacgugaacgugaccgacaucaacgacaacacgccggucuucagccaggacaccuacaccaccgugaucuccgaggacgccgugcuggagcagagcgucaucacggugauggccgacgacgcggacggccccuccaacagccacauccacuacuccaucaucgacgggaaccagggcagcuccuucaccaucgaccccgugcgcggggaggucaaggugaccaagcuccuggaccgcgagaccaucagcggcuacacgcugaccgugcaggccuccgacaacggcuccccgccccgggucaacaccaccacggugaacaucgacguguccgacgucaacgacaacgcccccguguucagccgcgggaacuacagcgugaucauccaggagaacaagcccgucggcuucuccgugcuccagcugguggucaccgacgaggacagcucccacaacgggccgcccuucuucuucaccaucgugaccggcaacgacgagaaggccuucgaggugaacccccagggcguccugcucacgagcuccgccaucaagcggaaggagaaggaccacuaccugcuccaggugaaggucgcggacaacgggaagccccagcucagcucccugaccuacaucgacauccgcgugaucgaggagagcaucuacccgcccgccauccugccccucgagaucuucaucaccuccagcggcgaggaguacuccgggggcgugaucgggaagauccacgccaccgaccaggacgucuacgacacgcugaccuacagccuggacccccagauggacaaccucuucuccgugagcuccaccggcggcaagcugaucgcccacaagaagcuggacaucgggcaguaccuccugaacgugagcgucaccgacggcaaguucacgaccguggccgacaucaccgugcacauccggcaggucacccaggagaugcugaaccacacgaucgcgauccgcuucgccaaccucacccccgaggaguucgugggggacuacuggcggaacuuccagcgcgcccugcggaacauccugggcgugcgccgcaacgacauccagaucgucucccuccagagcagcgagccccacccccaccuggacgugcuccuguucguggagaagcccggguccgcccagaucagcaccaagcagcugcugcacaagaucaacuccagcgucaccgacaucgaggagaucaucggcgugcggauccucaacguguuccagaagcugugcgccggccuggacugccccuggaaguucugcgacgagaaggucuccguggacgagagcgugauguccacgcacagcaccgcgcgccucuccuucgucacgccccggcaccaccgcgccgccgugugccugugcaaggaggggcggugcccgcccgugcaccacggcugcgaggacgacccgugccccgaggggagcgagugcgucuccgaccccugggaggagaagcacacgugcgugugccccagcggccgcuucgggcagugcccgggcuccagcuccaugacccugaccggcaacagcuacgugaaguaccggcucaccgagaacgagaacaagcuggagaugaagcugaccaugcgccuccggaccuacuccacgcacgccgucgugauguacgcgcgcgggaccgacuacagcauccuggagauccaccacggccggcugcaguacaaguucgacugcggguccggccccgggaucgugagcguccagagcauccaggugaacgacggccaguggcacgccguggcccucgaggucaacggcaacuacgcccgccuggugcuggaccaggugcacaccgccuccgggaccgcgcccggcacgcucaagacccugaaccuggacaacuacgucuucuucgggggccacauccggcagcagggcacccgccacgggcggagcccccaggugggcaacggguuccgcggcugcauggacuccaucuaccucaacgggcaggagcugccgcugaacagcaagccccgguccuacgcccacaucgaggagagcguggacgucucccccggcugcuuccucaccgccacggaggacugcgccagcaaccccugccagaacggcggggugugcaacccgucccccgccggcggguacuacugcaagugcagcgcgcuguacaucggcacccacugcgagaucuccgugaaccccugcagcuccaagcccugccuguacggcgggaccugcgucguggacaacggcggguucgugugccagugccgcgggcucuacaccgggcagcggugccagcugagcccguacugcaaggacgagcccugcaagaacggcgggacgugcuucgacucccuggacggcgccgucugccagugcgacagcggcuuccgcggggagcggugccaguccgacaucgacgagugcagcggcaaccccugccuccacggggcccugugcgagaacacccacggcuccuaccacugcaacugcagccacgaguaccgcggccgccacugcgaggacgccgcccccaaccaguacgugagcaccccguggaacaucgggcuggcggagggcaucgggaucguggucuucguggccggcaucuuccuccugguggucguguucguccugugccggaagaugaucucccgcaagaagaagcaccaggccgagcccaaggacaagcaccucgggcccgccaccgccuuccugcagcggcccuacuucgacagcaagcugaacaagaacaucuacuccgacaucccgccccaggugcccgugcgccccaucagcuacacgccguccauccccagcgacucccggaacaaccucgaccgcaacagcuucgagggcuccgcgauccccgagcacccggaguucagcaccuucaaccccgaguccguccacggccaccggaaggccguggccgugugcagcgucgcccccaaccugcccccgccgccgcccuccaacagcccguccgacagcgacuccauccagaagcccagcugggacuucgacuacgacaccaaggugguggaccuggaccccugccucuccaagaagccccuggaggagaagccgagccagcccuacagcgcgcgcgagucccugagcgagguccagucccucagcuccuuccagagcgaguccugcgacgacaacggguaccacugggacaccagcgacuggaugcccuccgugccccugccggacauccaggaguuccccaacuacgaggugaucgacgagcagacgccccuguacagcgccgaccccaacgccaucgacaccgacuacuacccgggcggguacgacaucgaguccgacuucccgccgccgcccgaggacuuccccgccgccgacgagcugccgccccugccgcccgaguucagcaaccaguucgaguccauccacccgccccgggacaugcccgcggccggcagccugggguccagcucccgcaaccggcagcgcuucaaccucaaccaguaccugcccaacuucuacccccuggacaugagcgagccccagaccaagggcaccggcgagaacuccacgugccgggagccccacgcccccuacccgcccggguaccagcgccacuucgaggcccccgccgucgagagcaugcccaugagcguguacgcguccaccgccagcugcuccgacgugagcgccugcugcgaggucgaguccgaggugaugaugagcgacuacgaguccggcgacgacgggcacuucgaggaggugaccaucccgccccucgacagccagcagcacaccgaggucuga

SEQ ID NO: 30019 - RNA, 13050 nt, Artificial Sequence
  derived and/or modified sequence opt1 from FAT2__Homo_sapiens__XP_011535905
augaccaucgcccugcugggcuucgccaucuuccugcugcacugcgcgaccugcgagaagccccucgaggggauccuguccuccuccgccuggcacuucacccacucccacuacaacgccaccaucuacgagaacagcucccccaagaccuacguggagagcuucgagaagaugggcaucuaccuggccgagccccagugggccgugcgcuaccggaucaucuccggggacguggccaacguguucaagaccgaggaguacguggugggcaacuucugcuuccuccgcauccggaccaaguccuccaacaccgcccugcugaaccgcgaggugcgggacagcuacacccucaucauccaggccaccgagaagacccuggagcuggaggcccucacccgcgucguggugcacauccuggaccagaacgaccugaagccccucuucagcccgcccagcuaccgggucaccaucuccgaggacaugccccucaagucccccaucugcaaggugaccgccaccgacgccgaccuggggcagaacgccgaguucuacuacgccuucaacacccgcuccgagauguucgccauccaccccaccagcggcguggucaccguggccggcaagcucaacgugaccuggcgggggaagcacgagcugcagguccuggccguggaccgcaugcggaagaucuccgagggcaacggguucggcagccucgccgcccuggugguccacguggagcccgcccugcgcaagccgcccgccaucgccuccguggucgugacgccgcccgacagcaacgacgggaccaccuacgccacggugcucgucgacgccaacagcuccggcgccgagguggagagcgucgagguggugggcggggaccccggcaagcacuucaaggccaucaaguccuacgcccggagcaacgaguucucccuggucagcgugaaggacaucaacuggauggaguaccugcacggguucaaccucucccugcaggcccgcagcggcuccggccccuacuucuacagccagauccggggguuccaccucccgcccuccaagcucagcucccugaaguucgagaaggccguguaccgcguccagcugagcgaguucagcccgcccggcagccggguggugaugguccgcgugacccccgccuuccccaaccuccaguacgugcugaagcccuccagcgagaacgucggguucaagcugaacgcccggaccggccucaucaccacgaccaagcugauggacuuccacgaccgcgcccacuaccagcugcacauccggaccucccccgggcaggccagcaccgugguggucaucgacaucguggacugcaacaaccacgcgccccuguucaaccgcagcuccuacgacggcacgcuggacgagaacaucccgcccggcaccagcgugcuggccgucaccgccaccgaccgcgaccacggggagaacggcuacgugacguacuccaucgccgggcccaaggcccuccccuucagcaucgaccccuaccugggcaucaucuccaccagcaagcccauggacuacgagcugaugaagcggaucuacaccuuccgcgugcgggccuccgacugggggagccccuuccgccgggagaaggaggucuccaucuuccuccagcugcgcaaccugaacgacaaccagccgauguucgaggaggugaacugcaccggcagcauccggcaggacuggcccgugggcaaguccaucaugacgaugagcgccaucgacgucgacgagcuccagaaccugaaguacgagaucguguccgggaacgagcuggaguacuucgaccugaaccacuucagcggcgugaucucccucaagcgccccuucaucaaccugaccgccgggcagcccaccagcuacucccugaagaucaccgccagcgacggcaagaacuacgccagcccgaccacgcucaacaucaccgucgugaaggacccccacuucgaggugcccgugaccugcgacaagaccggggugcugacgcaguucaccaagaccauccugcacuucaucggccuccagaaccaggaguccagcgacgaggaguucaccucccugagcacguaccagaucaaccacuacacgccccaguucgaggaccacuucccgcaguccaucgacgugcuggagagcguccccaucaacacgccccuggcccggcuggccgccaccgaccccgacgccggcuucaacgggaagcugguguacgugaucgccgacggcaacgaggaggggugcuucgacaucgagcucgagacgggccugcugaccgucgccgcgccgcucgacuacgaggccaccaacuucuacauccugaacgugaccguguacgaccugggcacgccccagaaguccagcuggaagcuccugaccgucaacgugaaggacuggaacgacaacgcgccccgcuucccgcccggcggguaccagcugaccaucuccgaggacaccgagguggggacgaccaucgccgagcucaccaccaaggacgcggacagcgaggacaacgggcggguccgcuacacgcugcugucccccaccgagaaguucagccuccacccccugaccggggagcugguggugaccggccaccucgaccgggaguccgagccccgcuacauccugaaggucgaggcccgggaccagccgagcaagggccaccagcuguucuccgugacggaccucaucaucacccuggaggacgugaacgacaacagcccccagugcaucaccgagcacaaccgccugaagguccccgaggaccugccgcccgggaccgugcugacguuccuggacgccuccgaccccgaccucggccccgccggggaggugcgguacguccugauggacggcgcccacgggaccuuccgcguggaccugaugaccggcgcgcucauccuggagcgggagcuggacuucgagcgccgcgccggcuacaaccucagccugugggccuccgacgggggccggccccuggcccgccggacccucugccacgucgaggugaucgugcuggacgucaacgagaaccugcacccgccccacuucgccagcuucgugcaccaggggcagguccaggagaacagccccuccggcacgcaggucaucgugguggcggcccaggacgacgacagcgggcucgacggcgagcugcaguacuuccugcgcgccggcaccgggcucgccgccuucuccaucaaccaggacaccggcaugauccagacccuggcgccgcuggaccgggaguucgccagcuacuacuggcucaccguccuggccguggaccgcggguccgugccccugagcuccgucacggagguguacaucgaggugaccgacgccaacgacaacccgccccagaugagccaggcggucuucuacccguccauccaggaggacgcccccgugggcaccagcgugcuccagcuggacgccugggaccccgacuccagcuccaaggggaagcugaccuucaacaucacgagcggcaacuacaugggcuucuucaugauccaccccgucaccgggcuccuguccaccgcccagcagcuggaccgggagaacaaggacgagcacauccucgaggugaccgugcuggacaacggcgagccgagccugaaguccacgagccgcgucgugguggggauccucgacgucaacgacaacccgcccaucuucucccacaagcuguucaacgugcggcugcccgagcgccucagcccggugagccccggccccgucuaccggcugguggccuccgaccuggacgagggccucaacgggcgcgugaccuacagcaucgaggacuccgacgaggaggcguucagcaucgaccuggucaccggcgugguguccagcuccagcaccuucacggccggggaguacaacauccugaccaucaaggccaccgacuccggccagcccccgcucagcgccuccguccggcugcacaucgaguggauccccuggccccgccccagcuccaucccgcuggccuucgacgagaccuacuacagcuucacggugauggagaccgaccccgugaaccacauggucggggugaucuccguggagggccggcccggccucuucugguucaacaucagcgggggcgacaaggacauggacuucgacaucgagaagaccaccggguccaucgucaucgcgcgcccccuggacacgcggcgccggagcaacuacaaccugaccguggaggugaccgacggcucccgcaccaucgccacgcagguccacaucuucaugaucgccaacaucaaccaccaccggccgcaguuccucgagacccgcuacgaggugcgcgugccccaggacaccguccccgggguggagcugcugcgggugcaggccaucgaccaggacaagggcaagagccucaucuacaccauccacggcagccaggaccccggguccgccagccuguuccagcuggaccccuccagcggcguccucgugacgguggggaagcuggaccugggcuccgggcccagccagcacacccucaccgucauggugcgcgaccaggagauccccaucaagcggaacuucgucugggugaccauccacguggaggacggcaaccugcacccgccccgcuucacgcagcugcacuacgaggcguccguccccgacaccaucgcccccggcaccgagcuccuccaggugcgggccauggacgccgaccgcggggugaacgccgagguccacuacagccugcugaagggcaacuccgagggguucuucaacaucaacgcgcuccugggcaucaucacccuggcccagaagcucgaccaggccaaccacgccccgcacacgcugaccgugaaggcggaggaccagggcagcccccaguggcacgaccuggccaccgugaucauccacgucuaccccuccgaccggagcgcccccaucuucuccaagagcgaguacuucguggagaucccggaguccauccccguggggagccccauccuccuggucuccgccaugagccccuccgaggugaccuacgagcugcgcgagggcaacaaggacgggguguucagcaugaacagcuacuccggccucaucagcacccagaagaagcuggaccacgagaagaucuccagcuaccagcugaagauccggggguccaacauggccggcgcguucacggacgucauggugguggucgacaucaucgacgagaacgacaacgccccgauguuccucaagagcaccuucgugggccagaucuccgaggccgcgccccuguacagcaugaucauggacaagaacaacaaccccuucgugauccacgccuccgacagcgacaaggaggcgaacucccugcucgucuacaagauccuggagcccgaggcccugaaguucuucaagaucgacccgagcauggggacccucaccaucguguccgagauggacuacgagagcaugcccuccuuccaguucugcguguacguccacgaccagggcagccccgugcuguucgcgccccgcccggcccaggugaucauccacguccgggacgugaacgacagcccgccccgcuucagcgagcagaucuacgagguggccaucgucgggcccauccacccgggcauggagcugcucauggugcgggcguccgacgaggacagcgaggugaacuacagcaucaagacggggaacgccgacgaggccgucaccauccaccccgugaccggcuccaucagcgugcugaaccccgccuuccugggccucucccgcaagcugaccauccgggcgagcgacgggcuguaccaggacacggcccucgucaagaucucccugacccaggugcuggacaagagccuccaguucgaccaggacguguacugggccgccgucaaggagaaccugcaggaccgcaaggcccuggugauccucggcgcgcaggggaaccaccugaacgacacccuguccuacuuccuccugaacggcaccgacauguuccacauggugcagagcgccgggguccugcagacgcggggcguggccuucgaccgcgagcagcaggacacccacgagcucgccguggagguccgggacaaccgcaccccgcagcgcguggcccagggccuggugcgggucuccaucgaggacgugaacgacaacccgcccaaguucaagcaccuccccuacuacaccaucauccaggacgggacggagccgggcgacguccuguuccaggucagcgcgaccgacgaggaccuggggaccaacggcgccgugaccuacgaguucgccgaggacuacacguacuuccgcaucgaccccuaccugggggacaucucccucaagaagcccuucgacuaccaggcccugaacaaguaccaccugaaggucaucgcccgggacggcggcacccccagccuccaguccgaggaggaggugcuggugaccguccgcaacaagagcaacccgcuguuccagucccccuacuacaaggugcgggugcccgagaacaucacccucuacacgcccauccugcacacccaggcgcgcagcccggaggggcugcggcucaucuacaacaucgucgaggaggagccccugaugcuguucaccaccgacuucaagacgggcgugcucaccgugaccgggccccuggacuacgaguccaagaccaagcacgucuucacggugcgcgccaccgacaccgcccugggcagcuucagcgaggccaccguggagguccucguggaggacgugaacgacaacccgcccacguucucccagcuggucuacaccaccagcaucuccgagggccugcccgcgcagacccccgugauccagcuccuggccagcgaccaggacuccgggcggaaccgcgacgugagcuaccagaucgucgaggacggcuccgacgugagcaaguucuuccagaucaacggguccacgggcgagaugagcaccgugcaggagcuggacuacgaggcccagcagcacuuccacgucaaggugcgggccauggacaagggggacccgccccucaccggcgagacccugguggucgugaacguguccgacaucaacgacaacccgcccgaguuccgccagccccaguacgaggccaacgucagcgagcuggcgaccugcggccaccucgugcugaaggugcaggccaucgaccccgacucccgggacacgagccgccuggaguaccucauccuguccgggaaccaggaccggcacuucuucaucaacagcuccagcggcaucaucuccauguucaaccugugcaagaagcaccucgacagcagcuacaaccugcgcgucggggccuccgacggcguguuccgggccaccgugcccgucuacaucaacaccaccaacgccaacaaguacagccccgaguuccagcagcaccuguacgaggcggagcucgccgagaacgccaugguggggacgaaggugaucgaccugcuggccaucgacaaggacuccggccccuacggcaccaucgacuacaccaucaucaacaagcucgccagcgagaaguucuccaucaaccccaacgggcagaucgcgacccugcagaagcuggaccgcgagaacagcacggagcgggucaucgccaucaaggugauggcccgcgacggcgggggccggguggccuucugcaccgucaagaucauccucaccgacgagaacgacaacccgccccaguucaaggccuccgaguacaccgugagcauccaguccaacgugagcaaggacuccccggucauccaggugcuggcguacgacgccgacgaggggcagaacgccgacgugacguacagcgucaaccccgaggaccuggugaaggacgugaucgagaucaaccccgucaccggcguggugaaggucaaggacucccucgugggccuggagaaccagacccuggacuucuucaucaaggcccaggacgggggcccgccccacuggaacagccucguccccgugcgccuccaggugguccccaagaaggugucccugcccaaguucagcgagccccucuacaccuucuccgcgcccgaggaccugcccgaggggagcgagaucggcaucgugaaggccgucgccgcccaggaccccgugaucuacucccuggugcgcgggacgaccccggagagcaacaaggacggcgucuucagccucgaccccgacaccggcgugaucaaggugcggaagcccauggaccacgaguccaccaagcuguaccagaucgacgucauggcccacugccugcagaacacggacguggugagccucgucuccgugaacauccaggugggggacgucaacgacaaccgccccguguucgaggcggacccguacaaggccgugcugaccgagaacaugcccgucggcaccagcgugauccaggugaccgccaucgacaaggacacggggcgggacggccaggucuccuaccgccugagcgccgaccccggcuccaacgugcacgagcuguucgccaucgacagcgaguccggguggaucaccacccuccaggagcuggacugcgagaccugccagacguaccacuuccacguggucgcguacgaccacggccagaccauccagcugagcucccaggcccucguccaggugagcaucaccgacgagaacgacaacgcgccccgguucgccuccgaggaguaccgcgggagcgucguggagaacuccgagccgggcgagcugguggccacccugaagacgcucgacgcggacaucagcgagcagaaccgccaggugaccugcuacaucaccgagggggacccccugggccaguucggcaucucccaggugggggacgaguggcggaucagcucccggaagacccuggaccgcgagcacacggccaaguaccuccugcgggugaccgccagcgacggcaaguuccaggccagcgucaccguggagaucuucgugcuggacgucaacgacaacagcccccagugcagccagcuccuguacaccgggaaggugcacgaggacguguuccccggccacuucauccugaaggucuccgcgaccgaccucgacacggacaccaacgcccagaucaccuacagccugcacgggccgggcgcccacgaguucaagcuggacccccacaccggcgagcucacgacccugaccgcccuggaccgcgagcggaaggacguguucaaccucguggccaaggcgaccgacgggggcgggcgcuccugccaggccgacaucacgcugcacgucgaggacgugaacgacaacgcgccccgguucuucccgagccacugcgccguggccgucuucgacaacaccaccgugaagacccccguggccgucguguucgcccgcgaccccgaccagggcgccaacgcccaggucguguacucccugcccgacagcgccgaggggcacuucuccaucgacgcgacgaccggcgugauccggcucgagaagccgcugcagguccgcccccaggcgccccuggagcucaccgugcgggccagcgaccugggcacccccaucccgcuguccacgcucgggaccgugaccgucagcguggugggccuggaggacuaccugcccgucuuccucaacaccgagcacuccguccaggugcccgaggacgcgccgcccgggacggagguccugcagcuggcgacccucacccgccccggcgccgagaagaccggcuaccgcguggugagcgggaacgagcagggccgguuccgccuggacgcccggacggggauccuguacgucaacgccucccucgacuucgagaccagccccaaguacuuccuguccaucgagugcagccgcaaguccagcagcucccugagcgacgugaccaccgugauggucaacaucacggacgugaacgagcaccggccccaguucccccaggaccccuacuccacccgcgugcucgagaacgcccuggucggcgacgugauccugaccgugagcgcgaccgacgaggacgggccccucaacuccgacaucacguacagccugaucggcggcaaccagcuggggcacuucaccauccaccccaagaagggcgagcuccaggucgccaaggcccuggaccgggagcaggccuccagcuacucccugaagcuccgcgccaccgacagcgggcagccgccccugcacgaggacaccgacaucgcgauccagguggccgacgugaacgacaacccgccccgguucuuccagcugaacuacuccacgaccguccaggagaacagcccgaucggcuccaaggugcuccagcugauccugagcgaccccgacucccccgagaacgggcccccguacagcuuccgcaucaccaagggcaacaacggcuccgccuuccgggugacccccgacggguggcucgucaccgccgagggccugagccgccgggcccaggagugguaccagcugcagauccaggcguccgacagcgggaucccgccccucagcucccugacgagcgugcgcgugcacgucaccgagcagucccacuacgcccccagcgcccugccccucgagaucuucaucaccgugggcgaggacgaguuccagggcggcauggugggcaagauccacgccaccgaccgggacccccaggacacgcugaccuacucccuggccgaggaggagacccucgggcgccacuucagcgucggcgcgcccgacgggaagaucaucgccgcccagggccugccccgggggcacuacuccuucaacgugaccgugagcgacggcacguucaccaccaccgccggcguccacguguacguguggcacgucgggcaggaggcgcugcagcaggccauguggaugggcuucuaccagcucacgcccgaggagcugguguccgaccacuggcgcaaccugcagcgguuccucagccacaagcuggacaucaagcgcgccaacauccaccuggccucccuccagcccgccgaggcgguggccggggucgacgugcugcugguguucgagggccacagcggcaccuucuacgaguuccaggagcucgccuccaucaucacccacagcgccaaggagauggagcacuccgucggggugcagaugcggagcgccaugccgauggugcccugccagggcccgaccugccaggggcagaucugccacaacacgguccaccuggaccccaaggugggcccgaccuacuccaccgcgcgccugagcauccucacgccccgccaccaccuccagcggagcugcuccugcaacgggacggccacccgcuucagcggccaguccuacguccgguaccgcgcccccgccgcccggaacuggcacauccacuucuaccugaagacccuccagccccaggcgauccugcuguucaccaacgagacggccagcgugucccucaagcuggccagcggcgugccgcagcuggaguaccacugccucgggggcuucuacgggaaccuguccagccagcgccacgucaacgaccacgaguggcacuccauccugguggaggagauggacgccagcauccggcucaugguggacuccaugggcaacaccagccuggucgugcccgagaacugccgcgggcugcggcccgagcgccaccuccugcugggcggccugauccuccugcacuccagcuccaacgugagccagggguucgagggcugccuggacgcggucguggugaacgaggaggcccucgaccugcuggcccccgggaagaccgucgccggccuccuggagacccaggcccugacgcagugcugccuccacuccgacuacugcagccagaacacgugccugaacgggggcaagugcuccuggacccacggcgcgggguacgugugcaagugcccgccccaguucagcggcaagcacugcgagcaggggcgggagaacugcaccuucgcccccugccuggagggcggcacgugcauccucagccccaagggggccuccugcaacugcccgcaccccuacaccggcgaccgcugcgagauggaggcccgggggugcagcgagggccacugccuggugacccccgagauccagcgcggggacuggggccagcaggagcugcucaucaucaccgucgccguggcguucaucaucaucuccacggugggccugcuguucuacugccggcgcugcaagagccacaagcccgucgccauggaggacccggaccuccuggcccgguccguggggguggacacccaggccaugcccgccaucgagcugaacccccucagcgcguccagcugcaacaaccugaaccagccggagcccuccaaggccagcguccccaacgagcuggugaccuucggccccaacuccaagcagcgcccgguggucugcagcgugccgccccggcugccgcccgccgccgugcccucccacagcgacaacgagcccgucaucaagcgcaccugguccagcgaggagaugguguaccccgggggcgccaugguguggccgcccaccuacucccgcaacgagcggugggaguacccccacagcgaggucacgcaggggccccugccgcccuccgcgcaccgccacagcacccccguggugaugcccgagcccaacggccuguacggcggguuccccuucccccucgagauggagaacaagcgggcgccccugccgccccgcuacagcaaccagaaccuggaggaccucaugcccucccggccgcccagcccccgcgagcggcuggucgcccccugccugaacgaguacaccgccaucuccuacuaccacagccaguuccgccagggcgggggcgggccgugccucgcggacggcggcuacaagggggugggcaugcggcugucccgcgccgggcccagcuacgccgugugcgaggucgagggcgcgccccuggccgggcagggccagccccgggugccgcccaacuacgagggcuccgacaugguggagagcgacuacggguccugcgaggaggucauguucuga

SEQ ID NO: 30020 - RNA, 13674 nt, Artificial Sequence
  derived and/or modified sequence opt1 from FAT3__Homo_sapiens__NP_001008781
auggacaucaucaugggccacugcguggggacccggccgcccgccugcugccugauccugcugcuguucaagcugcuggccaccgucagccagggccugcccgggacgggcccccucggguuccacuucacccacuccaucuacaacgccaccguguacgagaacagcgccgcccggaccuacgugaacucccagagccgcaugggcaucacccugaucgaccuguccugggacaucaaguaccggaucgugagcggcgacgaggagggguucuucaaggccgaggaggugaucaucgccgacuucugcuuccuccgcauccggaccaagggcgggaacuccgccauccugaaccgcgagauccaggacaacuaccugcucaucgugaagggcagcguccgcggggaggaccuggaggccuggaccaaggugaacauccaggugcuggacaugaacgaccuccgcccccuguucucccccaccaccuacagcgucaccaucgccgaguccacgccccugcggaccagcguggcccaggugaccgcgaccgacgccgacaucggcuccaacggcgaguucuacuacuacuucaagaacaaggucgaccucuucagcgugcaccccaccuccggggugaucagccuguccggccgccugaacuacgacgagaagaaccgguacgaccucgagauccuggccgucgaccgcgggaugaagcuguacggcaacaacggcgugagcuccaccgccaagcucuacgugcacaucgagcggaucaacgagcacgcccccacgauccacgucgugacccacgugcccuucagccuggagaaggagcccaccuacgcggucgugaccguggacgaccuggacgacggggccaacggcgagaucgagagcgucuccaucguggccggggacccccucgaccaguucuuccuggccaaggagggcaaguggcugaacgaguacaagaucaaggagcgcaagcagaucgacugggagagcuuccccuacggguacaaccucacgcugcaggccaaggacaagggcagcccccagaagugcagcgcgcugaaggccgucuacaucggcaaccccacccgggacaccgugcccauccgcuucgagaaggagguguacgacgucuccaucagcgaguucagcccgcccggggugguggucgccaucgugaagcucagccccgagcccaucgacguggaguacaagcugucccccggcgaggacgccgucuacuucaagaucaacccccggagcgggcugaucgugaccgcccgcccccucaacacggugaagaaggaggucuacaagcuggaggugaccaacaaggagggcgaccugaaggcccaggugaccaucuccaucgaggacgccaacgaccacacccccgaguuccagcagccccucuacgacgccuacgucaacgagagcgugcccguggggacguccguccugaccgugagcgccuccgacaaggacaagggcgagaacggcuacaucaccuacagcaucgccucccugaaccuccugcccuucgugaucaaccaguucaccggggucaucagcacgaccgaggagcuggacuucgaguccagccccgagaucuaccgguucaucgugcgcgcgagcgacuggggcucccccuaccggcacgagagcgaggugaacgucaccauccgcaucgggaacgugaacgacaacagcccccuguucgagaagguggccugccagggcgucaucuccuacgacuuccccgucggcgggcacaucaccgccguguccgccaucgacaucgacgagcuggagcuggucaaguacaagaucaucagcgggaacgagcucggguucuucuaccugaaccccgacuccggcgugcugcagcugaagaagucccucacgaacuccgggaucaagaacggcaacuucgcgcugcgcaucaccgccaccgacggcgagaaccuggccgaccccaugagcaucaacaucuccgugcuccacgggaaggucagcuccaagagcuucuccugccgggagacccgcguggcccagaagcuggccgagaagcugcucaucaaggcgaaggccaacggcaagcugaaccuggaggacggguuccucgacuucuacagcaucaaccggcagggccccuacuucgacaaguccuuccccagcgacguggccgucaaggaggaccugcccgugggggccaacauccugaagaucaaggccuacgacgcggacagcggcuucaacggcaaggugcuguucaccaucuccgacgggaacacggacagcugcuucaacaucgacauggagaccggccagcugaagguccugaugcccauggaccgcgagcacaccgaccucuaccugcugaacaucaccaucuacgaccucgggaacccccagaaguccagcuggcggcugcugacgaucaacguggaggacgccaacgacaacucccccguguucauccaggacagcuacuccgucaacauccucgagagcuccggcaucgggaccgagaucauccagguggaggcccgcgacaaggaccugggcagcaacggcgaggugaccuacuccguccugaccgacacgcagcaguucgccaucaacagcuccaccgggaucguguacguggccgaccagcucgaccgggagagcaaggcgaacuacucccugaagaucgaggcccgcgacaaggccgagagcggccagcagcuguucuccgucgugacccucaagguguuccuggacgacgucaacgacugcagccccgccuucaucccguccagcuacagcgugaagguccuggaggaccuccccguggggaccgugaucgcguggcuggagacgcacgaccccgaccugggccucgggggccagguccgguacucccuggugaacgacuacaacggccgcuucgagaucgacaaggccagcggggccauccggcuguccaaggagcucgacuacgagaagcagcaguucuacaaccugaccgugcgcgccaaggacaagggccggcccgucagccuguccagcguguccuucguggaggucgaggugguggacgucaacgagaaccuccacaccccguacuuccccgacuucgccgugguggggagcgucaaggagaacucccgcaucggcaccagcgugcuccaggugacggcgcgggacgaggacuccgggcgcgacggcgagauccaguacagcauccgggacggcuccgggcugggccgcuucagcaucgacgacgaguccggggucaucaccgccgccgacauccucgaccgggagaccaugggcagcuacuggcugaccguguacgccacggaccgcggcguggucccccuguacuccaccaucgagguguacaucgagguggaggacgucaacgacaacgcgccccugaccagcgagccgaucuacuaccccguggugauggagaacucccccaaggacgucagcgugauccagauccaggcggaggaccccgacagcuccagcaacgagaagcugaccuaccgcaucacguccgggaacccgcagaacuucuucgccaucaacaucaagaccggccugaucaccaccacgagccggaagcucgaccgcgagcagcaggccgagcacuuccuggaggugaccgucaccgacgggggccccucccccaagcagagcaccaucuggguggugguccaggugcuggacgagaacgacaacaagccccaguucccggagaagguguaccagaucaagcuccccgagcgggaccgcaagaagcgcggggagcccaucuaccgcgccuucgccuucgaccgggacgagggcccgaacgcggagaucuccuacagcaucgucgacggcaacgacgacgggaaguucuucaucgaccccaagacgggcaugguguccagccgcaagcaguucaccgccggguccuacgacauccugaccaucaaggccguggacaacggccggccccagaaguccuccaccgcccgccugcacaucgaguggaucaagaagcccccgcccagccccaucccccucacguucgacgagccguucuacaacuucaccgucauggaguccgaccgggugaccgagaucgugggggucgugagcgugcagcccgcgaacacgccccugugguucgacaucgucggcggcaacuucgacuccgccuucgacgccgagaagggggugggcaccaucgugaucgccaagccccuggacgccgagcagcgcagcaucuacaacauguccgucgaggugacggacgggaccaacguggcggucacccagguguucaucaagguccucgacaacaacgacaacggcccggaguucagccagcccaacuacgacgugaccaucagcgaggacgugcugcccgacacggagauccugcagaucgaggccaccgaccgggacgagaagcacaagcucuccuacaccguccacagcuccaucgacagcaucuccaugcgcaaguuccggaucgaccccagcaccggggugcuguacacggccgagcgccuggaccacgaggcccaggacaagcacauccucaacaucauggugcgggaccaggaguucccguaccgccggaaccuggcccgcgucaucgugaacguggaggacgcgaacgaccacucccccuacuucaccaacccccuguacgaggccagcgucuucgaguccgccgcccucggcagcgccgugcuccaggugaccgcgcuggacaaggacaagggcgagaacgccgagcucaucuacaccaucgaggccgggaacacgggcaacauguucaagaucgagcccguccuggggaucaucaccaucugcaaggagccggacaugaccaccaugggccaguucgugcuguccaucaaggugacggaccagggcuccccgcccauguccgccaccgccaucguccggaucagcgugaccauguccgacaacagccaccccaaguucauccacaaggacuaccaggcggaggugaacgagaacgucgacaucgggaccuccgugauccucaucagcgccaucucccagagcacgcugaucuacgaggugaaggacggcgacaucaacgggaucuucaccaucaacccguacagcggcgucaucaccacccagaaggcccuggacuacgagcgcacguccagcuaccagcucaucauccaggccaccaacauggcggggauggccuccaacgccaccgugaacauccagaucguggacgagaacgacaacgcccccgucuuccuguucagccaguacuccggcagccuguccgaggccgcgcccaucaacagcaucgugcgcucccucgacaacagcccccuggugauccgggccaccgacgccgacuccaaccgcaacgcccugcucgucuaccagaucguggagagcacggccaagaaguucuucaccguggacuccagcaccggcgcgauccggaccaucgccaaccuggaccacgagacgaucgcccacuuccacuuccacguccacgugcgcgacuccgggagcccgcagcugaccgccgagucccccguggaggucaacaucgaggugaccgacgugaacgacaacccgcccgucuucacccaggccguguucgagacgauccuccugcugcccaccuacgugggcgucgaggugcucaaggugagcgcgaccgaccccgacuccgaggucccgcccgagcugaccuacagccugauggaggggagccucgaccacuuccugaucgacuccaacagcggcgugcugaccaucaagaacaacaaccucuccaaggaccacuacaugcugaucgugaaggucagcgacgggaaguucuacuccacgagcauggugaccaucauggugaaggaggccauggacuccggccugcacuucacccagagcuucuacuccaccagcaucuccgagaacaacacgaacaucaccaaggucgccaucgugaacgccgugggcaaccggcugaacgagccccucaaguacagcauccugaaccccgggaacaaguucaagaucaaguccaccagcggcgucauccagaccacgggggugcccuucgaccgcgaggagcaggagcuguacgagcucgucguggaggcgucccgggagcuggaccaccuccggguggcccgggucguggugcgcgucaacaucgaggacaucaacgacaacagcccgguguucgugggccugcccuacuacgccgccguccagguggacgccgagcccgggacccugaucuaccaggugaccgcgaucgacaaggacaagggccccaacggcgaggucaccuacgugcugcaggacgacuacgggcacuucgagaucaacccgaacuccggcaacgugauccucaaggaggccuucaacagcgaccugagcaacaucgaguacggggucacgauccuggccaaggacggcgggaagcccucccucagcaccuccguggagcugcccaucaccaucgugaacaaggccaugcccgucuucgacaagccguucuacaccgccagcgugaacgaggacauccggaugaacacgcccauccuguccaucaacgcgaccagccccgagggccagggcaucaucuacaucaucaucgacggggaccccuucaagcaguucaacaucgacuucgacaccggcgugcucaaggucguguccccgcuggacuacgaggugaccagcgccuacaagcugacgauccgcgccuccgacgcccucaccggggcccgggcggaggucaccguggaccugcuggugaacgacgucaacgacaacccgcccaucuucgaccagcccaccuacaacacgacccucagcgaggccucccugaucggcacccccgugcuccagguggucagcaucgacgccgacuccgagaacaacaagauggugcacuaccagaucgugcaggacaccuacaacagcacggacuacuuccacaucgacuccagcuccggccucauccugaccgcccgcaugcuggaccacgagcucguccagcacugcacccugaaggugcggagcaucgacuccggguuccccagccugagcuccgaggugcucguccacaucuacaucagcgacgugaacgacaacccgcccguguucaaccagcugaucuacgaguccuacgucagcgagcuggcgccgcgcggccacuucgugaccugcgugcaggccuccgacgccgacagcuccgacuucgaccggcucgaguacagcauccuguccgggaacgaccgcacgagcuuccugauggacuccaagagcggcgucaucacccucuccaaccaccggaagcagcgcauggagccccuguacagccugaacguguccgugagcgacggccuguucaccuccaccgcccagguccacauccgcgugcugggcgccaaccuguacagccccgcguucucccagagcacguacguggccgagguccgggagaacguggccgccggcaccaaggugauccacguccgcgccaccgacggggacccgggcaccuacgggcagaucagcuacgcgaucaucaacgacuucgccaaggaccgguuccucaucgacuccaacggccaggugaucacgaccgagcgccuggaccgggagaacccccuggagggggacgucagcaucuucgugcgcgcccucgacggcggcgggcggaccaccuucugcaccgugcgcgucaucgugguggacgagaacgacaacgcgccccaguucaugacggucgaguaccgggccuccgugcgcgcggacgugggccgggggcaccuggucacccaggugcaggccaucgaccccgacgacggcgccaacagccgcaucaccuacucccuguacagcgaggccuccgugagcgucgccgaccuccuggagaucgacccggacaacggguggauggugaccaagggcaacuucaaccagcugaagaacacggugcucuccuucuucgucaaggcgguggacggcgggauccccgugaagcacagccugauccccgucuacauccacgugcugcccccggagaccuuccuccccuccuucacccagagccaguacuccuucaccaucgccgaggacacggccaucggcagcaccguggacacccugcggauccugcccucccagaacgucugguucagcaccgugaacggggagcgccccgagaacaacaagggcgggaucuucgugaucgagcaggagacgggcaccaucaagcucgacaagcggcuggaccgcgagaccuccccggccuuccacuucaaggucgcggccaccaucccccuggacaagguggacaucguguucacggucgacguggacaucaaggugcucgaccugaacgacaacaagcccgucuucgagaccagcuccuacgacaccaucaucauggagggcaugcccguggggaccaagcugacccaggugcgggccaucgacauggacuggggcgccaacgggcaggucaccuacagccuccacagcgacucccagccggagaaggugauggaggccuucaacaucgacagcaacaccggcuggaucuccacccugaaggaccuggaccacgagacggaccccaccuucaccuucagcguggucgcguccgaccucggcgaggccuucagccuguccagcaccgcccugguguccgugcgcgucacggacaucaacgacaacgcccccguguucgcccaggagguguaccgggggaacgucaaggagagcgacccgcccggcgaggugguggcgguccucuccaccugggaccgcgacaccagcgacgugaaccgccagguguccuaccacaucaccgggggcaacccccgcgggcgcuucgcccugggccugguccagagcgaguggaagguguacgugaagcggccccucgaccgcgaggagcaggacaucuacuuccugaacaucacggccaccgacggccuguucgucacccaggccaugguggaggucuccgugagcgacgugaacgacaacucccccgucugcgaccagguggccuacaccgcgcuccugccggaggacauccccagcaacaagaucauccugaagguguccgccaaggacgccgacaucgggagcaacggcuacauccgguacagccucuacggguccggcaacagcgaguucuuccuggaccccgaguccggggagcugaagacgcucgcccugcuggaccgcgagcggaucccggucuacagccucauggcgaaggccaccgacggcggcgggcgcuucugccaguccaacauccaccugauccuggaggacgugaacgacaacccgcccguguucagcuccgaccacuacaacacgugcgucuacgagaacaccgccaccaaggcccuccugacgcgggugcaggccguggaccccgacaucggcaucaaccgcaaggucguguacagccuggcggacuccgccgggggcguguucagcaucgacuccagcuccgggaucaucauccucgagcagccgcuggaccgggagcagcagagcuccuacaacaucagcguccgcgccaccgaccagucccccggccagagccuguccagccucaccaccgugacgaucaccgugcuggacaucaacgacaacccgcccgucuucgagcggcgcgacuaccuggugaccgugccggaggacaccagccccggcacgcagguccucgccguguucgccaccuccaaggacaucgggaccaacgcggagaucaccuaccugauccggagcggcaacgagcaggggaaguucaagaucaaccccaagacgggcggcaucuccgugagcgagguccuggacuacgagcucugcaagcgcuucuaccuggugguggaggccaaggacgggggcacccccgcccuguccgccgucgccaccgugaacaucaaccugaccgacgugaacgacaacccgcccaaguucagccaggacgucuacuccgcggugaucagcgaggacgcccucgugggggacuccgucauccugcugaucgccgaggacguggacagccagcccaacggccagauccacuucuccaucgugaacggggaccgggacaacgaguucacggucgaccccgugcucggccuggugaaggucaagaagaagcuggaccgcgagcgggugagcggcuacucccuccuggugcaggccgucgacagcgggaucccggcgauguccagcaccgccaccgugaacaucgacaucuccgacgugaacgacaacagccccgucuucacccccgccaacuacacggccgugauccaggagaacaagcccgugggcaccagcauccugcagcucgucgugaccgaccgcgacuccuuccacaacgggccgcccuucagcuucuccauccugagcggcaacgaggaggaggaguucgugcuggacccccacgggauccuccgguccgccgucguguuccagcacaccgagagccuggaguacguccugugcgugcaggcgaaggacuccggcaagccccagcaggucagccacacguacauccgcguccgcgugaucgaggaguccacccacaagccgaccgccaucccccucgagaucuucaucgugaccauggaggacgacuuccccggcggggucaucggcaagauccacgccacggaccaggacauguacgacgugcugaccuucgcccucaagagcgagcagaagucccucuucaaggugaacagccacgacgggaagaucaucgcccugggcgggcuggacuccggcaaguacguccucaacgugagcguguccgacggccgguuccagguccccaucgacguggugguccacguggagcagcuggugcacgagaugcugcagaacaccgucaccauccgcuucgagaacgugagcccggaggacuucguggggcuccacaugcacggcuuccggcgcacgcugcggaacgcgguccugacccagaagcaggacucccuccgcaucaucagcauccagcccguggccgggaccaaccagcuggacaugcuguucgccguggagaugcacuccagcgaguucuacaagcccgccuaccucauccagaagcugagcaacgcccggcgccaccuggagaacaucaugcggaucuccgcgauccucgagaagaacugcagcggccuggacugccaggagcagcacugcgagcaggggcugucccucgacagccacgcccugaugaccuacuccacggcccgcaucagcuucgucugcccgcgguucuaccgcaacgugcggugcacgugcaacggcggccugugccccggguccaacgaccccugcguggagaagcccugcccgggcgacaugcagugcgucagcuacgaggccucccgccggcccuuccucugccagugcccgcccgggaagcugggcgagugcagcggccacaccucccugagcuucgccgggaacuccuacaucaaguaccgccucagcgagaacuccaaggaggaggacuucaagcuggcgcugcggcuccgcacccugcagagcaacggcaucaucauguacacccgggccaacccgugcaucauccugaagaucguggacgggaagcucugguuccagcuggacugcggcuccgggcccggcauccugggcaucagcgggcgcgccgugaacgacggcuccuggcacagcgucuuccucgagcugaaccggaacuucacgagccugucccucgacgacagcuacguggagcgccgccgggcgccccuguacuuccagacccuguccaccgagagcuccaucuacuucggggcgcucgugcaggccgacaacauccgcagccugaccgacacgcgggucacccaggugcuguccggcuuccaggggugccucgacagcgugauccugaacaacaacgagcugccccuccagaacaagcgcuccagcuucgccgaggucgugggccugaccgagcugaagcucggcugcgugcuguacccggacgccugcaagcggucccccugccagcacgggggcagcugcaccgggcugcccuccggcggguaccagugcacgugccucagccaguucaccggccgcaacugcgaguccgagaucaccgccugcuuccccaacccgugccggaacggcgggagcugcgaccccaucggcaacaccuucaucugcaacugcaaggcggggcugacgggcgugaccugcgaggaggacaucaacgagugcgagcgcgaggagugcgagaacggcggguccugcgugaacguguucggcagcuuccugugcaacugcacccccggguacgucggccaguacugcgggcuccggcccgugguggucccgaacauccaggccggccacuccuacgugggcaaggaggagcugaucgggaucgccgugguccuguucgugaucuucauccucgugguccuguucaucguguuccgcaagaaggucuuccggaagaacuacagccgcaacaacaucacccuggugcaggaccccgccacggccgcgcuccugaacaagagcaacggcauccccuuccggaaccugcgcggguccggcgacgggcggaacguguaccaggaggucggcccgccccaggugcccgugcgccccauggccuacacccccugcuuccagagcgacucccggagcaaccucgacaagaucgucgacggccucgggggcgagcaccaggagaugaccaccuuccaccccgagagcccccggauccugacggcccggcgcggggugguggucugcagcguggcccccaaccucccggccgugucccccugccgcagcgacugcgacuccauccggaagaacggcugggacgcggggaccgagaacaagggcgucgacgaccccggcgaggugaccugcuucgccgggagcaacaagggcuccaacagcgaggugcagucccugagcuccuuccagagcgacuccggggacgacaacgccuaccacugggacaccagcgacuggaugcccggcgcccgccuguccgacaucgaggaggucccgaacuacgagaaccaggacgggggcagcgcgcaccagggcagcacgcgggagcucgaguccgacuacuaccucgggggcuacgacaucgacagcgaguacccgccgccccacgaggaggaguuccugucccaggaccagcucccgccgccccugcccgaggacuucccggaccaguacgaggcccugccgcccagccagcccgugucccucgccagcacccuguccccggacugccgccggcgcccccaguuccaccccagccaguaccugcccccgcaccccuuccccaacgagaccgaccucguggggcccccggccuccugcgaguucagcaccuucgccgucuccaugaaccagggcacggagcccaccggccccgcggacagcgugucccugagccugcacaacucccgggggaccagcuccagcgacguguccgccaacugcggcuucgacgacagcgaggucgccaugagcgacuacgaguccgugggggagcugagccucgccucccugcacauccccuucguggagacccagcaccagacgcaggucuga

SEQ ID NO: 30021 - RNA, 14946 nt, Artificial Sequence
  derived and/or modified sequence opt1 from FAT4__Homo_sapiens__NP_078858
auggaccuggcccccgaccgcgccaccgggcggcccuggcugccccugcacacccugagcgugagccagcugcugcgcguguucuggcugcucagccugcugcccgggcaggccugggugcacggggccgagccccgccaggucuuccaggugcucgaggagcagccgcccgggacccugguggggaccauccagacccgccccggguucaccuaccggcugagcgagagccacgcccucuucgccaucaacagcagcaccggggcccuguacaccaccuccaccaucgaccgcgagagccugcccuccgacgugaucaaccucgucgugcugagcuccgcccccaccuaccccaccgaggugcggguccuggugcgcgaccucaacgacaacgcccccguguuccccgaccccagcaucgucgugaccuucaaggaggacuccagcuccggccgccaggugauccuggacaccgccaccgacagcgacaucggguccaacggcgucgaccaccgcagcuaccggaucauccgcgggaacgaggccggccgguuccgccuggacaucacccucaaccccuccggggagggcgccuuccugcaccuggugagcaagggcgggcucgaccgggaggugacgccccaguaccagcugcuggucgagguggaggacaagggcgagcccaagcgccggggguaccuccaggugaacgucaccgugcaggacaucaacgacaacccgcccguguucggcagcucccacuaccaggccggcguccccgaggacgccguggucgggagcuccgugcuccagguggccgccgccgacgccgacgagggcaccaacgccgacauccgcuaccggcugcaggacgaggggacccccuuccagauggaccccgagaccggccucaucaccguccgcgagccccuggacuucgaggcccggcgccaguacagccugaccgugcaggccauggaccgcggggugcccucccucaccggccgggcggaggcccugauccagcugcucgacgucaacgacaacgaccccguggugaaguuccgcuacuuccccgccaccagccgguacgccuccgucgacgagaacgcccaggugggcaccguggucgcgcugcugacggugaccgacgccgacagccccgccgccaacgggaacaucuccgugcagauccucggcgggaacgagcagcgccacuucgagguccagagcuccaaggugcccaaccugagccugaucaagguggccuccgcgcucgaccgggagcgcauccccagcuacaaccugaccgucuccgugagcgacaacuacggcgccccgcccggggccgccgugcaggcgcgguccagcgucgccucccuggugaucuucgugaacgacaucaacgaccacccgcccgucuucagccagcaggucuaccgcgugaaccucagcgaggaggcgccgcccggcuccuacgucagcggcaucuccgccaccgacggggacagcggccugaacgccaaccugcgguacuccaucgugagcgggaacggccucgggugguuccacaucuccgagcacagcggccuggugacgaccggcuccagcgggggccuggaccgcgagcuggcgucccagaucguccucaacaucagcgcccgggaccagggggugcaccccaagguguccuacgcccagcuggucgugacccugcucgacgugaacgacgagaagcccgucuucagccagcccgagggcuacgacguguccguggucgagaacgcccccaccggcacggagcugcugaugcuccgcgccaccgacggggaccugggcgacaacgggaccgugcgguucagccugcaggaggcggagaccgaccgccgguccuuccgccucgaccccgugagcggccggcugagcacgaucuccagccuggaccgcgaggagcaggccuucuacucccuccugguccuggccaccgaccucgggagcccgccccaguccagcauggcccggaucaacgugucccugcuggacaucaacgacaacagccccguguucuaccccguccaguacuucgcccacaucaaggagaacgagcccggcggcuccuacaucaccaccgugagcgcgaccgaccccgaccucgggacgaacggcaccgugaaguacuccaucagcgccggggaccgcucccgcuuccaggucaacgcccagagcggcgugaucuccacccggauggcccuggaccgcgaggagaagaccgcguaccagcugcagaucguggccacggacgggggcaaccuccagagccccaaccaggccaucgucaccaucaccgugcuggacacccaggacaacccgcccgucuucucccagguggccuacagcuucguggucuucgagaacguggcccugggcuaccacgugggguccgucagcgcgagcacgauggaccucaacuccaacaucagcuaccugaucaccaccggcgaccagaaggggauguucgccaucaaccaggugaccggccagcugacgaccgccaacgugaucgaccgggaggagcaguccuucuaccagcucaaggucguggccagcgggggcaccgugaccggcgacacgauggucaacaucaccgugaaggaccugaacgacaacagcccccacuuccugcaggccaucgagagcgugaacgucguggagaacuggcaggcggggcacuccaucuuccaggccaaggccguggaccccgacgagggcgucaacgggauggugcucuacagccugaagcagaaccccaagaaccuguucgccaucaacgagaagaacggcaccaucucccuccuggggccccuggacgugcacgccggcagcuaccagaucgagauccucgcguccgacaugggcgucccccagcugagcuccagcgugauccugaccguguacguccacgacgugaacgacaacucccccguguucgaccagcucagcuacgaggucacgcuguccgagagcgagcccgugaacucccgcuucuucaaggugcaggccagcgacaaggacagcggggccaacggcgagaucgccuacaccaucgcggaggggaacaccggcgacgccuucggcaucuucccggacgggcagcuguacaucaaguccgagcucgaccgggagcugcaggaccgcuacguccugauggugguggccagcgaccgggccgucgagccccucuccgccaccgugaacgugacggucauccuggaggacgugaacgacaaccgcccccuguucaacagcaccaacuacaccuucuacuucgaggaggagcagcgggcgggcuccuucguggggaaggucagcgccguggacaaggacuucggcccgaacggggaggugcgcuacuccuucgagaugguccagcccgacuucgagcuccacgccaucagcggcgagaucaccaacacgcaccaguucgaccgggagucccugaugcgccggcgcggcaccgccguguucagcuucaccgugaucgccaccgaccaggggaucccccagccccugaaggaccaggcgacgguccacguguacaugaaggacaucaacgacaacgccccgaaguuccucaaggacuucuaccaggccaccaucuccgagagcgccgccaaccugacccaggugcugcgggucuccgcgagcgacguggacgagggcaacaacgggcucauccacuacuccaucaucaagggcaacgaggagcgccaguucgccaucgacagcaccuccggccaggugacgcugaucggcaagcuggacuacgaggccacccccgccuacagccucgucauccaggccguggacuccggcaccaucccccugaacuccacgugcacccugaacaucgacauccucgacgagaacgacaacacccccagcuucccgaaguccacccuguucgucgacgugcuggagaacaugcggaucggggagcucgugagcuccgucaccgcgaccgacagcgacuccggcgacaacgccgaccuguacuacagcaucacggggaccaacaaccacggcaccuucuccaucagccccaacaccggguccaucuuccuggccaagaagcucgacuucgagacgcagagccuguacaagcugaacaucaccgccaaggaccagggccggccgccccgguccagcaccauguccguggugauccacguccgcgacuucaacgacaacccgcccagcuucccgcccggcgacaucuucaaguccaucguggagaacaucccgaucgggaccagcgugaucuccgucacggcgcacgaccccgacgccgacaucaacggccagcucagcuacaccaucauccagcagaugccccgggggaaccacuucaccaucgacgaggugaagggcaccaucuacacgaacgccgagaucgaccgcgaguucgccaaccuguucgagcugaccgugaaggccaacgaccaggcgguccccaucgagacccgccgguacgcccucaagaacgugaccauccuggugacggaccugaacgacaacgucccgauguucaucucccagaacgcccucgccgccgaccccagcgcggugaucggcagcgugcugaccaccaucauggccgccgaccccgacgagggggccaacggcgagaucgaguacgagaucaucaacggggacaccgacacguucaucgucgaccgcuacuccggcgaccugcggguggccagcgcgcucgugcccucccagcugaucuacaaccugaucgucagcgccaccgaccucgggccggagcgccggaaguccaccaccgagcugacgaucauccugcagggccucgacggccccguguucacccagcccaaguacaucaccauccugaaggagggggagcccaucggcaccaacgugaucagcaucgaggccgccuccccgcgcgggagcgaggcgcccgucgaguacuacaucguguccgugcggugcgaggagaagacggucggccgccuguucaccaucgggcggcacaccggcaucauccagaccgccgccauccucgaccgcgagcagggcgccugccuguaccugguggacguguacgccaucgagaaguccacggcguucccccggacccagcgcgccgaggucgagaucacccuccaggacaucaacgacaacccgcccguguuccccaccgacaugcuggaccugaccguggaggagaacaucggggacggcuccaagaucaugcagcucacggccauggacgccgacgagggggccaacgcgcuggucaccuacaccaucaucagcggcgccgacgacuccuuccggaucgaccccgagagcggggaccugaucgccacccgccggcuggaccgcgagcggcgcuccaaguacagccuccuggugcgggccgacgacggccugcaguccagcgacaugcgcaucaacaucacgguguccgacgucaacgaccacaccccgaaguucagccgccccguguacagcuucgacauccccgaggacaccauccccggcucccucguggccgcgauccuggccaccgacgacgacagcggggucaacggcgagaucacguacaucgugaacgaggacgacgaggacgggaucuucuuccugaacccgaucaccggcguguucaaccucacccggcugcuggacuacgagguccagcaguacuacauccucaccgugcgcgccgaggacgggggcggccaguucacgaccauccggguguacuucaacauccuggacgucaacgacaacccgcccaucuucucccugaacagcuacuccaccagccucauggagaaccugcccgugggguccaccgugcuggucuucaacgugacggacgccgacgacggcaucaacagccagcucaccuacuccaucgcgagcggggacucccugggccaguucaccguggacaagaacggcguccugaaggugcucaaggcccuggaccgcgagagccaguccuucuacaaccuggucguccaggugcacgaccucccgcagauccccgccagccgguucaccuccacggcccaggucagcaucauccugcuggacgugaacgacaacccgcccaccuuccucuccccgaagcugaccuacauccccgagaacacccccaucgacacgguggucuucaaggcccaggcgaccgaccccgacagcgggccgaacagcuacaucgaguacacccugcucaacccccugggcaacaaguucuccaucgggaccaucgacggcgaggugcgccugacgggggagcucgaccgggaggaggugagcaacuacacccugaccgucguggccaccgacaagggccagcccucccugagcuccagcacggagguggucgugauggugcucgacaucaacgacaacaaccccaucuucgcccaggcccuguacaaggucgagaucaacgagaacacccugaccggcaccgacaucauccagguguucgccgcggacggggacgagggcacgaacggccaggugcgcuacggcaucgucaacgggaacaccaaccaggaguuccggaucgacuccgugaccggcgccaucaccguggccaagccgcucgaccgcgagaagacgcccaccuaccaccugaccguccaggccaccgaccggggcagcacgccccggacggacaccuccaccgugagcaucgugcugcucgacaucaacgacuucguccccguguucgagcuguccccguacagcgugaacguccccgagaaccuggggacccucccccggacgauccuccaggugguggcccgcgacgacgaccggggcuccaacagcaagcuguccuacguccucuucgggggcaacgaggacaacgcguucacccugagcgccuccggggagcugggcgugacccagagccucgaccgcgagaccaaggagcgguucgugcugaugaucacggccaccgacuccggcagcccggcccugaccgggaccggcacgaucaacgucaucguggacgacgugaacgacaacguccccaccuucgccagcaaggcguacuucaccaccauccccgaggacgcccccacggggaccgacgugcuccuggugaacgccuccgacgccgacgcgagcaagaacgccgucauccgcaucaucggcgggaacucccaguucaccaucaacccgagcaccggccagaucaucacguccgcccugcucgaccgggagaccaaggacaacuacacccuggugguggucugcagcgacgccggcucccccgagccccugagcuccagcaccuccgugcucgugacggucaccgacgugaacgacaacccgccccgcuuccagcaccaccccuacgugacccacauccccagccccacccugcccggguccuucgucuucgccgugacggugaccgacgcggacaucggccccaacagcgagcugcacuacucccucagcgggcggaacuccgagaaguuccacaucgacccccugcgcggcgccaucauggccgccggcccccugaacggggccagcgaggucaccuucuccgugcacgucaaggacggcgggagcuucccgaagaccgacagcacgaccgugaccgugcgcuucgucaacaaggcggacuuccccaaggugcgggccaaggagcagaccuucauguuccccgagaaccagcccguguccagccucgucacgaccaucaccggcuccagccugcgcggggagccgauguccuacuacaucgccagcggcaaccugggcaacaccuuccagaucgaccagcucaccggccagguguccaucagccagccccuggacuucgagaagauccagaaguacguggucuggaucgaggcccgggacggcggguucccgcccuucuccagcuacgagaagcuggacaucacggugcucgacgugaacgacaacgccccgaucuucaaggaggaccccuucaucuccgagauccuggagaaccugagcccccgcaagauccucaccgucuccgcgauggacaaggacagcggcccgaacgggcagcuggacuacgagaucgugaacggcaacauggagaacuccuucagcaucaaccacgccaccggcgagauccgguccgugcgcccccuggaccgggagaaggucagccacuacgugcucaccaucaaguccagcgacaaggggagccccucccagagcacguccgugaaggucaugaucaacauccuggacgagaacgacaacgcgccccgcuucagccagaucuucuccgcccacgugccggagaacagcccccugggcuacaccgugacccgggucaccacguccgacgaggacaucgggaucaacgcgaucagccgcuacuccaucauggacgccagccuccccuucaccaucaaccccuccaccggcgacaucgugaucagccggccgcugaaccgcgaggacaccgaccgguaccgcauccggguguccgcccacgacagcggguggacggucuccaccgacgugaccaucuucgugaccgacaucaacgacaacgcgccccgcuucagccggacguccuacuaccuggacugccccgagcucaccgagaucggcagcaaggucacccagguguucgccaccgaccccgacgagggcuccaacggccagguguucuacuucaucaagagccagagcgaguacuuccgcaucaacgcgacgaccggcgagaucuucaacaagcagauccugaaguaccagaacgucaccggguucuccaacgugaacaucaaccggcacagcuucaucgugaccuccagcgaccgcggcaagccgucccugaucagcgagacgaccgucaccaucaacaucguggacuccaacgacaacgcgccccaguuccucaagagcaaguacuucacccccgugacgaagaacgucaaggugggcaccaagcugauccgcgugaccgccaucgacgacaaggacuucgggcugaacuccgaggucgaguacuucaucagcaacgacaaccaccucggcaaguucaagcuggacaacgacaccggguggaucuccguggccagcucccugaucagcgaccucaaccagaacuucuucaucacggugaccgccaaggacaagggcaacccgccccuguccagccaggcgaccguccacaucaccgugacggaggagaacuaccacacccccgaguucucccagagccacauguccgccaccauccccgagagccacagcaucggguccaucgugcggaccgucagcgcccgcgaccgggacgccgccaugaacggccugaucaaguacuccaucagcuccggcaacgaggaggggaucuucgcgaucaacagcuccaccggcauccucacgcuggccaaggcccuggacuacgagcucugccagaagcacgagaugaccaucagcgccaucgacgggggcuggguggcgcgcaccggguacugcuccgugaccgucaacgugaucgacgugaacgacaacagccccgucuuccuguccgacgacuacuuccccacggugcuggagaacgcccccagcggcaccaccgucauccaccucaacgccaccgacgccgacuccggcacgaacgccgugaucgcguacaccgugcagagcuccgacagcgaccuguucgucaucgaccccaacaccggggugaucaccacgcagggcuuccuggacuucgagaccaagcaguccuaccaccugaccgugaaggccuucaacguccccgacgaggagcggugcagcuucgccaccgugaacauccagcucaaggggacgaacgaguacgugccgcgcuucgucagcaagcuguacuacuucgagaucuccgaggccgcccccaagggcaccaucgugggggagguguucgcgagcgaccgggaccugggcaccgacggcgagguccacuaccucaucuucgggaacucccgcaagaagggcuuccagaucaacaagaagaccgggcagaucuacgugagcggcauccuggaccgggagaaggaggagcgcgugucccugaagguccucgccaagaacuucgggagcauccggggcgccgacaucgacgaggugacggugaacgucaccgugcuggacgccaacgacccgcccaucuucacccugaacaucuacuccgugcagaucagcgagggcgucccgaucgggacccacgugacguucguguccgccuucgacagcgacuccauccccagcuggucccgcuucagcuacuucaucggcuccgggaacgagaacggcgcguucagcaucaacccccagaccggccagaucaccgucaccgccgagcucgaccgggagacgcugccgaucuacaaccuguccgugcucgccguggacagcgggacccccuccgccaccggcagcgccagccugcuggucacccucgaggacaucaacgacaacgggcccaugcugacgguguccgagggcgaggugauggagaacaagcgccccgggacccuggucaugacccuccagagcaccgacccggaccugccgcccaaccagggccccuucacguacuaccugcucuccaccggcccggcgaccagcuacuucucccugagcaccgccggggugcuguccaccacgcgggagaucgaccgcgagcagaucgccgacuucuaccucagcguggucaccaaggacuccggcgugccccagaugagcuccaccgggaccgugcacaucacggucaucgaccagaacgacaaccccagccagucccggaccguggagaucuucgugaacuacuacggcaaccuguuccccgggggcauccugggcagcgucaagccgcaggaccccgacgugcucgacuccuuccacugcagccugaccuccggggugaccagccuguucuccauccccggcgggacgugcgaccucaacagccagccccgcagcaccgacggcaccuucgaccugaccguccuguccaacgacggggugcacagcacggugaccuccaacauccgggucuucuucgccggcuucagcaacgcgaccguggacaacuccauccuccugcgccugggcgugccgaccgucaaggacuuccucacgaaccacuaccugcacuuccugcggaucgccagcucccagcucaccgggcugggcaccgccgugcagcuguacagcgccuacgaggagaacaaccgcaccuuccuccuggccgcggugaagcgcaaccacaaccaguacgucaaccccuccgggguggccacguucuucgagagcaucaaggagauccugcuccggcaguccggcgucaagguggagagcguggaccacgacuccugcguccacggccccugccagaacgggggcagcugccugcgccggcuggccguguccagcgugcucaagucccgcgagagccugcccgucaucaucguggccaacgagccgcugcagcccuuccucugcaagugccugcccggguacgccggcuccuggugcgagaucgacaucgacgagugccugcccagcccgugccacagcggcgggaccugccacaaccucgugggcggguucuccugcagcugccccgacggguucaccgggcgggcgugcgagcgcgacaucaacgagugccugcagucccccugcaagaacggcgccaucugccagaacuuccccgggagcuucaacugcgucugcaagaccggcuacacgggcaagaugugcgaguccagcgugaacuacugcgagugcaacccgugcuucaacgggggcuccugccagagcgggguggacuccuacuacugccacugccccuucggcgucuucgggaagcacugcgagcugaacagcuacggcuucgaggagcucuccuacauggaguuccccagccuggacccgaacaacaacuacaucuacgugaaguucgccaccaucaagucccacgcccugcuccuguacaacuacgacaaccagaccggcgaccgggccgaguuccuggcgcucgagaucgccgaggagcgccugcgguucagcuacaaccugggguccggcaccuacaagcucacgaccaugaagaaggugagcgacgggcacuuccacaccgucaucgcccgccgggccggcauggcggccucccugaccguggacagcugcuccgagaaccaggagcccggguacugcacggugagcaacgucgccgugagcgacgacuggacccuggacgugcagcccaaccgcgucaccgugggcggcauccggucccucgagcccauccugcagcgccgggggcacguggagagccacgacuucgucggcugcaucauggaguucgccgugaacgggcgcccgcuggagcccucccaggcccucgcggcccagggcauccuggaccagugcccccggcuggagggcgccugcacccgcagccccugccagcacgggggcacgugcauggacuacugguccuggcagcagugccacugcaaggaggggcucaccggcaaguacugcgagaaguccgugaccccggacaccgcccugucccuggaggggaagggccggcucgacuaccacaugagccagaacgagaagcgcgaguaccugcugcgccagucccuccggggcgccaugcuggagcccuucggggucaacagccuggaggugaaguuccgcacccgguccgagaacggcgugcucauccacauccaggagagcuccaacuacacgaccgucaagaucaagaacgggaagguguacuucaccagcgacgcgggcaucgccgggaagguggagcgcaacauccccgaggucuacguggccgacggccacuggcacaccuuccugaucggcaagaacgggacggccaccgugcuguccgucgaccggaucuacaaccgcgacaucauccaccccacccaggacuucggcgggcucgacgugcugaccaucagccugggcgggaucccgcccaaccaggcccaccgggacgcgcagacggccggcuucgacggcugcaucgccuccaugugguacgggggcgagagccuccccuucuccgggaagcacagccuggccagcaucuccaagaccgaccccagcgugaagaucggcugccgcggcccgaacaucugcgccuccaaccccugcuggggcgaccugcucugcaucaaccagugguacgcguaccggugcgugccgcccggcgacugcgccagccacccgugccagaacgggggcuccugcgagcccgggcugcacagcggcuucacgugcuccugccccgacagccacaccggccgcacgugcgagauggugguggccugccuggggguccucugcccccagggcaaggugugcaaggccggguccccggcgggccacgugugcguccugagccaggggcccgaggagaucucccugccccugugggccgugcccgccaucgugggcagcugcgccaccguccucgcccugcuggugcucucccugauccugugcaaccagugccggggcaagaaggcgaagaacccgaaggaggagaagaagcccaaggagaagaagaagaaggggagcgagaacguggccuucgacgaccccgacaacaucccgcccuacggcgacgacaugaccguccgcaagcagcccgaggggaaccccaagccggacaucaucgagcgggagaaccccuaccucaucuacgacgagaccgacaucccccacaacuccgagacgauccccagcgccccgcuggccucccccgagcaggagaucgagcacuacgacaucgacaacgccagcagcaucgcgcccuccgacgccgacaucauccagcacuacaagcaguuccgcagccacacccccaaguucuccauccagcggcacagcccgcugggcuucgcccgccagucccccaugccccucggggccagcucccugaccuaccagcccagcuacggccagggccugcggaccuccagccucucccacagcgccugcccgacgcccaacccccugucccgccacagccccgcgccguucuccaagagcuccaccuucuaccggaacagccccgcccgcgagcugcaccuccccauccgggacgggaacacccuggagaugcacggcgacacgugccagcccgggaucuucaacuacgccacgcgccugggccgccgguccaagagcccgcaggccauggcgagccacgggucccgccccggcagccggcucaagcagcccaucggccagaucccgcuggaguccuccccgcccguggggcuguccaucgaggaggucgagcgccucaacacgccccggccgcgcaaccccagcaucugcuccgccgaccacggccggagcuccagcgaggaggacugccgccggccccugucccgcacccggaaccccgccgacgggaucccggcccccgagagcuccagcgacuccgacagccacgaguccuucacgugcagcgagauggaguacgaccgcgagaagcccaugguguacacgucccggaugcccaagcugagccaggugaacgagagcgacgccgacgacgaggacaacuacggcgcgcgccucaagccgcggcgcuaccacggccggcgcgccgagggcgggcccgucgggacccaggccgccgcccccggcaccgcggacaacacccugcccaugaagcuggggcagcaggccggcacguucaacugggacaaccuccugaacuggggcccgggguucggccacuacguggacguguucaaggaccuggccucccuccccgagaaggccgccgcgaacgaggaggggaaggccggcaccaccaagcccguccccaaggacggggaggccgagcaguacguguga

SEQ ID NO: 30022 - RNA, 552 nt, Artificial Sequence
  derived and/or modified sequence opt1 from FATE1__Homo_sapiens__NP_149076
auggccggcgggcccccgaacaccaaggccgagauggagaugagccuggcggaggagcucaaccacggccgccagggggagaaccaggagcaccuggugaucgccgagaugauggagcugggcucccggagccgcggggccucccagaagaagcagaagcucgagcagaaggccgccggcagcgcguccgccaagcgggucuggaacaugaccgccacgcgccccaagaagaugggcagccagcugcccaagccccggaugcugcgcgaguccgggcacggcgacgcccaccuccaggaguacgcggggaacuuccagggcauccgguuccacuacgaccgcaacccggggaccgacgccguggcccagaccagccuggaggaguucaacgugcuggagauggaggucaugcggcgccagcucuacgccgugaaccggcgccugcgggcccuggaggagcagggcgcgaccuggcgccaccgggagacgcucaucaucgccgugcuggucuccgccagcaucgccaaccuguggcucuggaugaaccaguga

SEQ ID NO: 30023 - RNA, 402 nt, Artificial Sequence
  derived and/or modified sequence opt1 from FAU__Homo_sapiens__NP_001988
augcagcuguucgugcgcgcccaggagcuccacaccuucgaggucaccggccaggagacgguggcccagaucaaggcgcacguggccagccuggaggggaucgcccccgaggaccaggucgugcugcucgccggcgccccgcuggaggacgaggcgacccuggggcagugcggcguggaggcccucaccacccuggaggucgccgggcggaugcugggcggcaaggugcacgggucccucgcccgcgcgggcaaggugcgggggcagacgcccaaggucgccaagcaggagaagaagaagaagaagaccggccgcgccaagcggcgcaugcaguacaaccggcgcuucgugaacgugguccccaccuucgggaagaagaagggccccaacgccaacagcuga

SEQ ID NO: 30024 - RNA, 3402 nt, Artificial Sequence
  derived and/or modified sequence opt1 from FBF1__Homo_sapiens__NP_001074011
auggcccccaagaccaagaagggcugcaaggugacccugccggagaagcccgucaagcucgccagccacacgcgcgacaccaccggggugucccagauguuccccagcuccaaggcgcggaccaagagccugcugggcgacgacguguucuccacgauggccgggcucgaggaggccgacgccgaggucagcggcaucuccgaggccgacccccaggcgcugcugcaggccaugaaggaccucgacgggauggacgccgacauccugggccugaagaaguccaacuccgccccgagcaagaaggcggccaaggaccccggcaagggggagcuccccaaccaccccaagccggccggcggggccauccccaccaagaagucccugcccagccccuccagcuccggccaccagaaccgccgguucagcuccgaggaccuggaggacccgcuccgcgggcugcugagcuacgacgagggcggcaucaccaagcagccgcccgugacccaguccaagacggccagcgacaagagccccuccaccgugcgggaccaggggcccagcaucccccucacccccggcgacacccccauccgcaagaaggaggagcugcuguucgacgacggggacgacaucauggcgacgcucggcuucggcgacuccccgaaggccgagaagcggcagaucggggaccaggagggcccccgccccgcccggagcacccuggacgagcugcucgggcgcggcauggccaccaagcugcuggcccggcccgggaccggcgagcaccgcgaguucaagcucgacaagaaguaccagcggccgcaggacuccgaggacauguggggcgacgaggacuucacguucggggcguaccagcccaccgucgugagcuccgagggccgccagagccggcgccaguccgugcgguucuucgccgacagcggggccgaccccaagggcgagcccggguccaagcagagcccgcccauggccuccagccccauccagccgcgcaagggcggcgccgacuggcuggggcugaaggacgaggaccucgaccuguuccccgcgucccccacccgggaggcccaccgcgagagcuccguccccgugaccccgagcgugcccccgcccgccucccagcacagcacgcccgccggccugccgcccagccgggccaagccgcccaccgagggggcgggcucccccgccaaggccagccaggccuccaagcuccgcgcgagcaaggaggagaaggaggacuggcugucccacgcccugagccgcaagaagucccaggggcucgcccgggagcagcacgccggcaccagcgagggccugcaccuggccgggaccgcgggccacccgcccuccgggagccagccccucacguccacccagggccuggagcacgccgccgccggcgggagcuccggcaccaccgcccgcgagcggcccugcguccgccccggggugagcggcucccccgugacgcagaaccacgcggccagcgcccugcccaccgggucccccaagcggggcaccgcccccggcgaccucagcgccaccgagcccgcgacgugcuucccgagcacccagaagcccaccgagcccuccgucccggugcagccccugcugcccgagagccucgcccgcucccugcugcccagcaccgaguaccagaagcagcuccuggccgcccaggugcagcugcagugcuccccggcggagcuccaggccgagcugcugcacagccaggcccggcuggccgagcucgaggcccagguccgcaagcuggagcuggagcgggcgcagcacgagcuccugcuggggucccuccagcagcagcaccaggccgaccuggagcugaucgagagcgcccaccgcucccggaucaaggugcucgagacgagcuaccagcagcgcgaggagcggcugcgccgggagaacgaggagcuguccgcccgcuaccucagccagugccaggaggccgagcaggcgcgggccgagcugaccgcccagcaccagcgccggcuggccgccaucgcgcaggagaaggaccaggagauggagcgccuccgcgagcugcagcgggccuccauccuggacaugcgccgggaccacgaggagcagcuccagcgccugaagcugcucaaggaccgggagguggacgccgccaccagcgcgaccucccacacccgcagccugaacuccaucauccaccagauggagaaguucagcuccagccugcacgagcucagcucccgggucgaggccagccaccugacgaccucccaggagcgcgagcugggcauccggcagcgcgacgagcagcuccgggcccugcaggagcgccuggggcagcagcagcgggacauggaggaggagcgcagccggcagcaggaggugaucggcaagauggaggcccgccucaacgagcagucccggcugcuggagcaggagcgcuggcgggugaccgccgagcagagcaaggcggaguccaugcagcgcgcccucgaggagcagcggaaggucaccgcccagcagauggccauggagcgcgccgagcuggagcgcgccaagagcgcgcugcucgaggagcagaaguccgugaugcugaagugcggggaggagcggcgccggcuggccgccgagugggccgaguucagcgcgcagcagaagcucuccaaggagcgcgccgagcgggaggccgagcgcgcccugcaggucgacacgcagcgggagggcacccugaucagccucgccaaggagcaggcggagcugaagauccgcgccuccgagcugcgggccgaggagaagcagcucgccgcggagcgcgccgcccuggagcaggagcggcaggagcugcgccucgagaaggagcggaucaacgccaccgcccugcgcgugaagcugcgggcggaggagguggagagcauguccaaggucgccagcgagaaguacgaggagggcgagcgcgcccuccgggaggcccagcagguccaggccgagcagcaggcgcgccugcaggccgugcagcagcagcaggagcggcugcgcaagcaggagcagcacaugcaccaggagcaccucucccuggcccagcagcgccugcagcucgaccgggcccgccaggaccugcccagcucccuggugggccucuucccccgggcccaggggcccgcggccagcagccaguccgcccugaugccgcccgcccccaccacgcgcuggugcagccagcccccgaccgggcuggaccccagcccccuccaccuccacgcgcggcuggcccugcugcgccacauggccgagcaggaccgggacuuccuggagaacgagcaguucuuccucgagacccugaagaagggcagcuacaaccugaccucccacagcgccuga

SEQ ID NO: 30025 - RNA, 966 nt, Artificial Sequence
  derived and/or modified sequence opt1 from FBL__Homo_sapiens__NP_001427
augaagcccggcuucagcccgcgcgggggcggguucggcgggcggggcggcuucggggaccgcggcgggcggggcgggcgcggcggcuucgggggcgggcggggccgcggcgggggcuuccgggggcgcggccgcgggggcggcgggggcgggggcgggggcggcgggggcgggcggggcgggggcggcuuccacuccgggggcaaccgggggcgcggccggggcgggaagcgcggcaaccagagcgggaagaacgugauggucgagccccaccggcacgagggcguguucaucugccgcgggaaggaggacgcccuggugaccaagaaccucguccccggcgaguccguguacggcgagaagcgggugagcaucuccgagggggacgacaagaucgaguaccgcgccuggaaccccuuccggagcaagcuggcggccgccauccugggcggggucgaccagauccacaucaagccgggcgccaaggugcucuaccugggggccgcguccggcaccacggugagccacgucuccgacaucgugggccccgacgggcugguguacgccgucgaguucagccaccgcuccggccgggaccucaucaaccuggccaagaagcgcaccaacaucauccccgugaucgaggacgcccgccacccccacaaguaccggaugcugaucgcgaugguggacgucaucuucgccgacguggcccagccggaccagacccgcaucguggcccucaacgcccacaccuuccugcggaacgggggccacuucgucaucagcaucaaggcgaacugcaucgacuccacggccagcgccgaggccguguucgccuccgaggugaagaagaugcagcaggagaacaugaagccccaggagcagcugacccucgagcccuacgagcgcgaccacgcggucguggugggggucuaccggcccccgcccaaggugaagaacuga

SEQ ID NO: 30026 - RNA, 945 nt, Artificial Sequence
  derived and/or modified sequence opt1 from FBLIM1__Homo_sapiens__XP_011539920
auggccagcaagcccgagaagcgcguggccuccagcgucuucaucacccuggcgccgccccggcgcgacguggccguggccgaggagguccggcaggccgugugcgaggcccgccggggccgccccugggaggcgcccgccccgaugaagacccccgaggccgggcucgccggccggcccucccccuggacgaccccggggcgcgcggccgccaccgugcccgccgcccccaugcagcuguucaacggcgggugccccccgcccccccccguccuggacggcgaggacgugcucccggaccuggaccugcuccccccccccccgcccccccccccggugcugcugcccagcgaggaggaggcgcccgcccccaugggcgccucccucaucgccgaccuggagcagcugcaccucagcccgccccccccgcccccccaggcccccgcggaggggccguccguccagcccggcccccugcggcccauggaggaggagcugccgcccccccccgccgagccgguggagaagggggccagcaccgacaucugcgccuucugccacaagacgguguccccccgcgagcucgccgucgaggcgaugaagcggcaguaccacgcccagugcuucaccugccgcaccugccggcgccagcuggccggccagagcuucuaccagaaggacgggcggccccugugcgagcccugcuaccaggacacccucgagcgcugcggcaagugcggcgagguggugcgggaccacaucauccgcgcccuggggcaggccuuccacccguccugcuucacgugcgucaccugcgcgcggugcaucggcgacgagagcuucgcccuggggucccagaacgagguguacugccucgacgacuucuaccgcaccgccggcagcuccugccugagcuccccccggaccaaggccgcgacgcccuga

SEQ ID NO: 30027 - RNA, 2052 nt, Artificial Sequence
  derived and/or modified sequence opt1 from FBLN1__Homo_sapiens__NP_001987
auggagcgcgccgcccccagccggcgcgugccgcugccccuccugcugcucggcgggcuggcgcugcucgccgccggcgucgacgccgacgugcugcuggaggccugcugcgcggacgggcaccggauggccacccaccagaaggacugcucccuccccuacgccaccgagagcaaggagugccgcauggugcaggagcagugcugccacucccagcuggaggagcugcacugcgccacgggcaucagccucgcgaacgagcaggaccggugcgccacgccccacggggacaacgccucccuggaggccaccuucgucaagcgcugcugccacugcugccugcucggccgggccgcgcaggcccagggccagagcugcgaguacucccugauggugggguaccagugcggccagguguuccgcgccugcugcgucaagagccaggagaccggggaccuggacgugggcgggcuccaggagaccgacaagaucaucgagguggaggaggagcaggaggacccguaccugaacgaccggugccgcggcggcgggcccugcaagcagcagugccgggacaccggcgacgaggucgugugcuccugcuucgugggguaccagcugcucagcgacggcgucuccugcgaggacgugaacgagugcaucaccggcagccacuccugccgccugggggagagcugcaucaacaccgugggcuccuuccggugccagcgcgacagcuccugcgggacgggcuacgagcugaccgaggacaacagcugcaaggacaucgacgagugcgaguccgggauccacaacugccuccccgacuucaucugccagaacacccugggcagcuuccggugccgccccaagcugcagugcaagagcggcuucauccaggacgcccucgggaacugcaucgacaucaacgagugccuguccaucagcgccccgugccccaucggccacacgugcaucaacaccgagggguccuacacgugccagaagaacguccccaacugcggccggggguaccaccugaacgaggagggcacccgcugcguggacguggacgagugcgcgcccccggccgagcccugcggcaaggggcaccggugcgucaacagccccggcuccuuccgcugcgagugcaagaccggguacuacuucgacggcaucagccggaugugcguggacgugaacgagugccagcgcuaccccgggcgccucugcggccacaagugcgagaacacccugggcuccuaccugugcagcugcuccgucggguuccggcucagcguggacggccgcuccugcgaggacaucaacgagugcagcuccagcccgugcucccaggagugcgccaacguguacgggagcuaccagugcuacugccggcgcggcuaccagcuguccgacgucgacggcgugaccugcgaggacaucgacgagugcgcccugcccaccgggggccacaucugcagcuaccggugcaucaacauccccggguccuuccagugcagcugccccagcuccggcuaccgccucgccccgaacgggcggaacugccaggacaucgacgagugcgucaccggcauccacaacugcagcaucaacgagacgugcuucaacauccagggcggguuccgcugccuggcguucgagugccccgagaacuaccggcgcuccgccgccacccggugcgagcgccugcccugccacgagaaccgggagugcagcaagcucccccugcgcaucaccuacuaccaccuguccuucccgaccaacauccaggcccccgccgugguguuccggaugggccccagcuccgcgguccccggggacagcaugcagcucgccaucacgggcgggaacgaggagggcuucuucaccacccgcaagguguccccgcacagcggcguggucgcccugaccaagcccgugcccgagccgcgggaccugcuccugacggugaagauggaccugucccgccacgggaccgucagcuccuucguggccaagcuguucaucuucgugagcgcggagcucuga

SEQ ID NO: 30028 - RNA, 3696 nt, Artificial Sequence
  derived and/or modified sequence opt1 from FBLN2__Homo_sapiens__NP_001158507
auggugcugcucugggagcccgccggcgccuggcuggcgcuggggcucgcccuggcccugggcccgagcgucgccgccgcggccccccgccaggacugcaccgggguggagugccccccccucgagaacugcaucgaggaggcccuggagccgggcgccugcugcgcgaccugcgugcagcaggggugcgccugcgagggcuaccaguacuacgacugccugcagggcggguucguccggggccgcgugcccgccgggcaguccuacuucguggacuucggcagcacggagugcuccugcccccccgggggcggcaagaucagcugccaguucaugcucugcccggagcugccccccaacugcaucgaggccgucgugguggccgacuccugcccccagugcgggcaggucggcugcgugcacgcggggcacaaguacgccgccggccacaccgugcaccugccgcccugccgggccugccacugccccgacgccggcggggagcucaucugcuaccagcugcccggcugccacgggaacuucagcgacgcggaggagggcgacccggagcgccacuacgaggaccccuacuccuacgaccaggaggucgccgagguggaggccgccaccgcccuggggggcgaggugcaggcgggcgccguccaggccggggccggcgggccccccgccgcgcucggcgggggcagccagccgcuguccaccauccaggccccccccuggcccgccgugcugccgcggcccacggccgcggccgcccucggcccccccgccccggugcaggccaaggcgcgccgggucaccgaggacagcgaggaggaggaggaggaggaggaggagcgcgaggagauggccgugaccgagcagcuggccgccgggggccaccgggggcuggacggccuccccaccacggcccccgcggggccgucccugcccauccaggaggagcgcgccgaggccggcgcccgggccgaggcgggcgcccgccccgaggagaaccugauccucgacgcccaggccaccagccgguccaccgggcccgagggcgugacccacgcgccgagccuggggaaggccgcccugguccccacgcaggccgugcccggcuccccccgcgacccggugaagcccagcccccacaacauccucuccaccagccugcccgacgccgcguggaucccgcccacccgggaggucccccgcaagccccaggugcugccgcacucccacgucgaggaggacaccgaccccaacagcgugcacagcaucccccgguccagccccgagggcuccacgaaggaccucaucgagaccugcugcgccgccgggcagcagugggccaucgacaacgacgagugccuggagaucccggagagcggcaccgaggacaacgugugccgcaccgcccagcggcacugcugcgucuccuaccugcaggagaagagcugcauggcgggggugcucggcgccaaggagggggagacgugcggcgccgaggacaacgacuccugcggcaucagccuguacaagcagugcugcgacugcugcgggcugggccuccgcgugcgggccgaggggcaguccugcgagagcaaccccaaccugggcuaccccugcaaccacgucaugcuguccugcugcgagggggaggagccccucaucgugccggaggugcgccgcccccccgagccggccgcggccccccggcgcgucagcgaggccgagauggccggccgggaggcgcugucccugggcaccgaggccgagcuccccaacagccugcccggggacgaccaggacgagugccugcuccugccgggcgagcugugccagcaccucugcaucaacaccgugggguccuaccacugcgccugcuuccccggcuucagccugcaggacgacgggcgcaccugccggcccgagggccaccccccgcagcccgaggccccccaggagcccgcccugaaguccgaguucagccagguggcguccaacacgaucccgcugccccucccccagcccaacaccugcaaggacaacggcccgugcaagcaggucugcagcaccguggggggcagcgccaucugcuccugcuuccccggguacgccaucauggccgacggcgugagcugcgaggaccaggacgagugccugaugggggcccacgacugcucccgccggcaguucugcgucaacacccugggcagcuucuacugcgugaaccacacggugcucugcgcggacggcuacauccugaacgcccaccgcaagugcgucgacaucaacgagugcgugaccgaccugcacaccugcucccggggggagcacugcgugaacacccucggcagcuuccacugcuacaaggcccugacgugcgagcccggguacgcccugaaggacggcgagugcgaggacgucgacgagugcgccaugggcacccacaccugccagcccggguuccucugccagaacaccaagggcuccuucuacugccaggcgcgccagcggugcauggacggguuccugcaggacccggagggcaacugcguggacaucaacgagugcacgagccuguccgagcccugccgccccggguucagcugcaucaacaccgugggcuccuacaccugccagcggaacccccucaucugcgcccgcggcuaccacgccagcgacgacgggaccaagugcgucgacgugaacgagugcgagaccggcgugcaccggugcggggagggccaggucugccacaaccugccgggguccuaccgcugcgacugcaaggccggcuuccagcgggacgccuucggccgcgggugcaucgacgugaacgagugcugggcgagccccggccggcugugccagcacacgugcgagaacacccucggguccuaccgcugcagcugcgccuccggcuuccugcuggccgccgacgggaagcgcugcgaggacgugaacgagugcgaggcgcagcggugcagccaggagugcgccaacaucuacggcagcuaccagugcuacugccgccagggcuaccagcucgccgaggacgggcacaccugcaccgacaucgacgagugcgcccagggcgccgggauccugugcacguuccggugccugaacguccccggcuccuaccagugcgcgugccccgagcagggcuacaccaugaccgccaacgggcgcagcugcaaggacguggacgagugcgcccucggcacccacaacugcuccgaggccgagacgugccacaacauccaggggagcuuccggugccugcgcuucgagugcccgcccaacuacgugcaggucuccaagaccaagugcgagcggaccaccugccacgacuuccuggagugccagaacagccccgcccgcaucacgcacuaccagcucaacuuccagaccggccugcuggugccggcgcacaucuuccggaucgggcccgcccccgccuucaccggcgacaccaucgcccucaacaucaucaagggcaacgaggagggguacuucggcacgcgccggcugaacgccuacaccgggguggucuaccugcagcgcgcggugcucgagccccgggacuucgcccuggacguggagaugaagcuguggcgccagggcuccgucaccaccuuccucgccaagaugcacaucuucuucacgaccuucgcccuguga

SEQ ID NO: 30029 - RNA, 1347 nt, Artificial Sequence
  derived and/or modified sequence opt1 from FBLN5__Homo_sapiens__NP_006320
augcccggcaucaagcgcauccugaccgugaccauccucgcccugugccugccgagccccgggaacgcccaggcgcagugcacgaacggcuucgaccucgaccggcaguccgggcagugccuggacaucgacgagugccgcaccauccccgaggccugccggggcgacaugaugugcgucaaccagaacgggggcuaccugugcaucccccgcaccaacccgguguaccggggccccuacagcaaccccuacuccacccccuacagcgggccguaccccgccgccgccccgccccucuccgcgcccaacuaccccacgaucagccgcccccugaucugccgguucggcuaccagauggacgaguccaaccagugcguggacgucgacgagugcgccaccgacagccaccagugcaaccccacccagaucugcaucaacaccgagggcggguacacgugcuccugcaccgacggguacuggcugcucgagggccagugccuggacaucgacgagugccgcuacggcuacugccagcagcugugcgccaacgugccggggagcuacuccugcacgugcaaccccggcuucacccucaacgaggacgggcggagcugccaggacgugaacgagugcgccaccgagaaccccugcguccagaccugcgugaacaccuacggcuccuucaucugccgcugcgaccccggcuacgagcuggaggaggacggggugcacugcagcgacauggacgagugcuccuucagcgaguuccugugccagcacgagugcgucaaccagccgggcaccuacuucugcuccugcccgcccggguacauccuccuggacgacaaccggagcugccaggacaucaacgagugcgagcaccgcaaccacacgugcaaccugcagcagaccugcuacaaccuccagggcggguucaagugcaucgaccccauccggugcgaggagcccuaccugcgcaucuccgacaaccggugcaugugccccgcggagaaccccggcugccgcgaccagcccuucaccauccuguaccgggacauggacguggugagcggccgcagcgucccggccgacaucuuccagaugcaggccaccacgcgguaccccggggccuacuacaucuuccagaucaaguccggcaacgaggggcgcgaguucuacaugcggcagaccggccccaucagcgccacccucgugaugacccgcccgaucaaggggccccgcgagauccagcuggaccuggagaugaucacggugaacaccgucaucaacuuccggggcuccagcgugauccgccuccggaucuacgugucccaguaccccuucuga

SEQ ID NO: 30030 - RNA, 8616 nt, Artificial Sequence
  derived and/or modified sequence opt1 from FBN1__Homo_sapiens__NP_000129
augcgccggggccgccugcucgagaucgcccugggcuucaccgugcugcucgccuccuacaccucccacggcgcggacgccaaccuggaggccgggaacgucaaggagacccgggccagccgcgccaagcggcgcggcgggggcggccacgacgcgcugaaggggcccaacgugugcggcucccgguacaacgccuacugcugccccggguggaagacccuccccggcgggaaccagugcaucgugcccaucugccgccacagcugcggcgacggcuucugcucccggcccaacaugugcacgugcccgagcgggcagaucgcccccuccugcggcagccgcuccauccagcacugcaacauccggugcaugaacgggggcagcugcuccgacgaccacugccugugccagaagggcuacaucgggacccacugcggccagcccgucugcgagagcgggugccugaacggcgggcgcugcguggcccccaaccggugcgcgugcaccuacggcuucaccggcccccagugcgagcgcgacuaccggaccgggcccugcuucaccgugaucuccaaccagaugugccagggccagcucagcgggaucgucugcaccaagacccugugcugcgccaccgugggccgcgccugggggcaccccugcgagaugugccccgcccagccccaccccugccggcgcggcuucauccccaacauccggaccggcgccugccaggacguggacgagugccaggcgauccccgggcugugccagggcgggaacugcaucaacaccgucggcuccuucgagugcaagugccccgccgggcacaagcucaacgaggugagccagaagugcgaggacaucgacgagugcuccaccauccccggcaucugcgagggcggggagugcaccaacaccgugagcuccuacuucugcaagugcccgcccggcuucuacaccagccccgacgggacccgcugcaucgacguccggcccggcuacugcuacaccgcccugaccaacggccgcugcagcaaccagcugccccaguccaucaccaagaugcagugcugcugcgacgccgggcgcugcuggagccccggcgugaccguggccccggagaugugccccauccgggcgaccgaggacuucaacaagcucugcuccguccccauggugauccccgggcgcccggaguacccgcccccgccccugggccccaucccgcccgugcugcccgugccgcccggguucccgcccggcccccagauccccgugccccggccgcccguggaguaccucuaccccagccgcgagccgccccggguccugcccgugaacgugaccgacuacugccagcugguccgcuaccucugccagaacggccggugcauccccaccccgggguccuaccgcugcgagugcaacaagggcuuccagcuggaccugcgcggcgagugcaucgacguggacgagugcgagaagaaccccugcgccggcggggagugcaucaacaaccagggcagcuacacgugccagugccgcgccggcuaccaguccacccucacccggacggagugccgcgacaucgacgagugccugcagaacgggcggaucugcaacaacggccgcugcaucaacaccgacgggagcuuccacugcgucugcaacgccggcuuccacgugacccgggacgggaagaacugcgaggacauggacgagugcuccauccgcaacaugugccugaacggcaugugcaucaacgaggacggcagcuucaagugcaucugcaagcccggguuccagcucgccuccgacggccgguacugcaaggacaucaacgagugcgagacccccgggaucugcaugaacggccgcugcgugaacacggacgggagcuaccggugcgagugcuucccgggccuggcggucggccuggacgggcgcgugugcguggacacccacaugcgcagcacgugcuacggcggguacaagcggggccagugcaucaagccccucuucggcgccgucaccaagagcgagugcugcugcgccuccaccgaguacgccuucggggagcccugccagccgugccccgcccagaacagcgcggaguaccaggcccugugcuccagcggccccgggaugaccuccgccggcagcgacaucaacgagugcgcccuggaccccgacaucugcccgaacgggaucugcgagaaccuccgcggcaccuacaagugcaucugcaacagcggcuacgagguggacuccaccgggaagaacugcguggacaucaacgagugcguccugaacagccugcucugcgacaacggccagugccggaacacccccggguccuucgugugcacgugccccaagggcuucaucuacaagcccgaccugaagaccugcgaggacaucgacgagugcgagagcuccccgugcaucaacggggugugcaagaacagccccggcuccuucaucugcgagugcagcuccgagagcacccuggaccccaccaagacgaucugcaucgagaccaucaaggggaccugcuggcagaccgucaucgacgggcgcugcgagaucaacaucaacggcgcgacgcucaagucccagugcugcagcucccugggggccgccuggggcagccccugcacccugugccagguggacccgaucugcgggaagggcuacucccggaucaagggcacccagugcgaggacaucgacgagugcgagguguuccccggggucugcaagaacggccucugcgugaacacccgcgggagcuucaagugccagugccccuccggcaugacgcuggacgccaccggccggaucugccuggacauccgccucgagaccugcuuccugcgguacgaggacgaggagugcacccugcccaucgccgggcgccaccggauggacgcgugcugcugcagcgugggcgccgccugggggacggaggagugcgaggagugccccaugcgcaacacccccgaguacgaggagcucugcccccggggccccggguucgccaccaaggagaucaccaacggcaagccguucuucaaggacaucaacgagugcaagaugauccccagccugugcacgcacggcaagugccgcaacaccaucggguccuucaagugccggugcgacagcggcuucgcccuggacuccgaggagcgcaacugcaccgacaucgacgagugccggaucagccccgaccugugcgggcgcggccagugcgucaacacccccggggacuucgagugcaagugcgacgagggcuacgaguccggcuucaugaugaugaagaacugcauggacaucgacgagugccagcgggacccgcuccugugccgcgggggcgugugccacaacacggaggggagcuaccggugcgagugcccgcccggccaccagcugucccccaacaucagcgcgugcaucgacaucaacgagugcgagcucuccgcccaccugugcccgaacgggcgcugcgugaaccugaucggcaaguaccagugcgccugcaaccccggcuaccacagcacccccgaccgccucuucugcgucgacaucgacgagugcuccaucaugaacgggggcugcgagaccuucugcaccaacagcgagggguccuacgagugcagcugccagccgggcuucgcccugaugcccgaccagcgguccugcacggacaucgacgagugcgaggacaaccccaacaucugcgacgggggccagugcaccaacauccccggcgaguaccgcugccugugcuacgacggguucauggccagcgaggacaugaagaccugcguggacgugaacgagugcgaccucaacccgaacaucugccuguccggcacgugcgagaacacgaaggggagcuucaucugccacugcgacaugggcuacuccggcaagaaggggaagaccggcugcaccgacaucaacgagugcgagaucggggcgcacaacugcggcaagcacgccgucugcaccaacacggccgggagcuucaagugcagcugcucccccggcuggaucggcgacgggaucaagugcaccgaccuggacgagugcagcaacggcacccacaugugcucccagcacgccgacugcaagaacaccauggggagcuaccggugccucugcaaggagggcuacaccggggacggcuucacgugcaccgaccuggacgagugcuccgagaaccugaaccucugcggcaacgggcagugccugaacgcgcccggcggguaccgcugcgagugcgacaugggcuucgugcccagcgccgacgggaaggccugcgaggacaucgacgagugcucccugccgaacaucugcguguucgggaccugccacaaccuccccggccuguuccggugcgagugcgagaucggcuacgagcuggaccgcagcggcgggaacugcaccgacgucaacgagugccucgaccccacgaccugcaucuccggcaacugcgugaacacccccgggagcuacaucugcgacugcccgcccgacuucgagcugaaccccacccgggugggcugcgucgacacgcgcuccggcaacugcuaccuggacauccggccccgcggggacaacggcgacaccgccugcagcaacgagaucggggugggcguguccaaggccagcugcugcugcucccucggcaaggcgugggggaccccgugcgagaugugccccgccgucaacaccagcgaguacaagauccugugccccggcggggagggcuuccggcccaacccgaucacggugauccuggaggacaucgacgagugccaggagcuccccgggcugugccagggcggcaagugcaucaacaccuucggguccuuccagugccgcugccccaccggcuacuaccugaacgaggacacccgggugugcgacgacgucaacgagugcgagacgcccgggaucugcggcccggggaccugcuacaacaccgugggcaacuacacgugcaucugcccgcccgacuacaugcaggucaacggcgggaacaacugcauggacaugcgccggagccucugcuaccgcaacuacuacgccgacaaccagacgugcgacggcgagcugcuguucaacaugaccaagaagaugugcugcugcuccuacaacaucgggcgggccuggaacaagcccugcgagcagugcccgauccccagcaccgacgaguucgccacccucugcggcagccagcgccccggguucgucaucgacaucuacacgggccugccgguggacaucgacgagugccgggagauccccggcgugugcgagaacggggucugcaucaacauggugggcuccuuccgcugcgagugccccgugggguucuucuacaacgacaagcugcucgucugcgaggacaucgacgagugccagaacggccccgugugccagcgcaacgcggagugcaucaacaccgccggcagcuaccggugcgacugcaagccgggguaccgcuucaccuccaccggccagugcaacgaccggaacgagugccaggagauccccaacaucugcagccacgggcagugcaucgacacggugggcuccuucuacugccugugccacaccggguucaagaccaacgacgaccagaccaugugccuggacaucaacgagugcgagcgcgacgccugcggcaacggcacgugccggaacaccaucgggagcuucaacugccgcugcaaccacggcuucauccucucccacaacaacgacugcaucgacgucgacgagugcgccagcgggaacggcaaccugugccggaacgggcagugcaucaacaccgugggcuccuuccagugccagugcaacgagggcuacgagguggcccccgacgggcggaccugcgucgacaucaacgagugccugcucgagccccggaagugcgcgccgggcacgugccagaaccuggacgggagcuaccgcugcaucugcccgcccggcuacucccugcagaacgagaagugcgaggacaucgacgagugcguggaggagcccgagaucugcgcccucgggaccugcagcaacaccgagggcuccuucaagugccugugcccggagggcuucagccuguccagcuccgggcggcgcugccaggaccuccggaugagcuacugcuacgccaaguucgagggcgggaagugcuccagccccaagagccgcaaccacuccaagcaggagugcugcugcgcccugaagggcgagggguggggcgaccccugcgagcugugccccaccgagccggacgaggcguuccggcagaucugccccuacggcagcgggaucaucgucggccccgacgacuccgccguggacauggacgagugcaaggagcccgacgugugcaagcacgggcagugcaucaacaccgacggcagcuaccgcugcgagugcccguucggcuacauccucgccgggaacgagugcgucgacacggacgagugcuccgugggcaaccccugcgggaacgggaccugcaagaacgugaucgggggcuucgagugcacgugcgaggagggcuucgagcccgggcccaugaugaccugcgaggacaucaacgagugcgcccagaacccgcugcugugcgccuuccggugcgucaacacguacggcagcuacgagugcaagugccccgugggguacgugcuccgcgaggaccggcgcaugugcaaggacgaggacgagugcgaggagggcaagcacgacugcaccgagaagcagauggagugcaagaaccugaucgggaccuacaugugcaucugcggccccggcuaccagcggcgcccggacggggagggcugcgucgacgagaacgagugccagaccaagcccgggaucugcgagaacggccgcugccugaacacgcggggguccuacacgugcgagugcaacgacggcuucaccgcgagccccaaccaggacgagugccucgacaaccgcgagggcuacugcuucaccgaggugcugcagaacaugugccagaucggguccagcaaccggaaccccgugacgaaguccgagugcugcugcgacggcgggcgcggcuggggcccgcacugcgagaucugccccuuccaggggaccgucgccuucaagaagcugugcccccacggccggggguucaugaccaacggcgccgacaucgacgagugcaaggugauccacgacgugugccgcaacggggagugcgucaacgaccggggcagcuaccacugcaucugcaagaccggcuacacgcccgacaucaccgggaccuccugcguggaccucaacgagugcaaccaggccccgaagcccugcaacuucaucugcaagaacaccgagggcagcuaccagugcuccugccccaagggguacauccugcaggaggacggccgcagcugcaaggaccuggacgagugcgccacgaagcagcacaacugccaguuccucugcgugaacaccaucgggggcuucacgugcaagugcccgcccggcuucacccagcaccacacguccugcaucgacaacaacgagugcaccagcgacaucaaccugugcggguccaagggcaucugccagaacacccccgggagcuucacgugcgagugccagcggggcuucagccuggaccagaccggguccagcugcgaggacgucgacgagugcgagggcaaccaccgcugccagcacggcugccagaacaucaucgggggcuaccggugcuccugcccccagggguaccuccagcacuaccaguggaaccagugcguggacgagaacgagugccugagcgcgcacaucugcggcggggccuccugccacaacacccugggcagcuacaagugcaugugccccgccggcuuccaguacgagcaguucuccgggggcugccaggacaucaacgagugcgggagcgcccaggcccccugcuccuacggcugcagcaacaccgagggcggguaccucugcggcugcccgcccggguacuuccgcaucggccaggggcacugcguguccggcaugggcauggggcggggcaaccccgagccgcccgucagcggggagauggacgacaacucccugagccccgaggcgugcuacgagugcaagaucaacggcuaccccaagcgcgggcggaagcgccgguccaccaacgagacggacgccagcaacaucgaggaccaguccgagaccgaggccaacgugagccuggccuccugggacguggagaagaccgccaucuucgcguucaacaucagccacgucagcaacaaggugcgcauccucgagcugcugccggcccucaccacgcugaccaaccacaaccgguaccugaucgaguccggcaacgaggacggcuucuucaagaucaaccagaaggaggggaucagcuaccuccacuucaccaagaagaagcccguggccggcaccuacucccugcagaucagcuccacgccccuguacaagaagaaggagcucaaccagcuggaggacaaguacgacaaggacuaccugagcggggagcucggcgacaaccugaagaugaagauccagguccugcuccacuga

SEQ ID NO: 30031 - RNA, 8739 nt, Artificial Sequence
  derived and/or modified sequence opt1 from FBN2__Homo_sapiens__NP_001990
augggccgccggcggcggcugugccugcagcuguacuuccuguggcucgggugcguggugcugugggcgcagggcaccgccgggcagccccagccgccgccgcccaagccgccccgcccccagcccccgccccagcagguccggagcgcgaccgccggcuccgagggcggguuccuggcccccgaguaccgcgaggagggcgccgccguggcgagccggguccgccggcgcgggcagcaggacgugcuccggggccccaacgugugcgggucccgcuuccacagcuacugcugccccggcuggaagacgcugcccgggggcaaccagugcaucguccccaucugccggaacuccugcggcgacggguucugcagccgccccaacaugugcacgugcuccagcggccagaucuccagcacgugcggguccaagagcauccagcagugcuccgugcggugcaugaacggcgggaccugcgccgacgaccacugccagugccagaagggcuacaucggcaccuacugcgggcagcccgugugcgagaacggcugccagaacgggggccgcugcaucggccccaaccggugcgccugcgucuacggguucaccggcccccagugcgagcgcgacuaccggaccgggcccugcuucacccaggugaacaaccagaugugccagggccagcugaccgggaucgugugcaccaagacccucugcugcgccaccaucggccgcgcguggggccaccccugcgagaugugccccgcccagccccagcccugccggcgcggguucauccccaacauccgcaccggcgccugccaggacgucgacgagugccaggccauccccgggaucugccagggcgggaacugcaucaacaccgugggcagcuucgagugccggugccccgccggccacaagcaguccgagaccacccagaagugcgaggacaucgacgagugcagcaucauccccgggaucugcgagaccggcgagugcuccaacaccguggggagcuacuucugcgucugcccccgcggcuacgugaccuccaccgacggcagccggugcaucgaccagcgcaccgggaugugcuucagcggccuggugaacgggcggugcgcgcaggagcugcccggccgcaugaccaagaugcagugcugcugcgagcccgggcggugcuggggcaucggcaccauccccgaggccugccccguccgcggguccgaggaguaccggcgccucugcauggacggccugcccaugggcgggauccccgggagcgccggcucccggcccggcgggaccggcgggaacggcuucgcccccagcgggaacggcaacggcuacgggcccggcgggaccggcuucauccccauccccggcggcaacggcuucucccccggggugggcggggccggcgugggcgccggcgggcaggggcccaucaucaccggccugaccauccucaaccagaccaucgacaucugcaagcaccacgccaaccugugccugaacgggcgcugcauccccaccgucagcuccuaccggugcgagugcaacaugggcuacaagcaggacgccaacggcgacugcaucgacguggacgagugcaccagcaacccgugcaccaacggggacugcgugaacacccccggcuccuacuacugcaagugccacgccggguuccagcgcacgcccaccaagcaggccugcaucgacaucgacgagugcauccagaacggcguccucugcaagaacgggcggugcgugaacaccgacggcagcuuccagugcaucugcaacgcgggcuucgagcugaccacggacgggaagaacugcgucgaccacgacgagugcaccaccaccaacaugugccugaacggcaugugcaucaacgaggacggguccuucaagugcaucugcaagcccggcuucgugcucgccccgaacgggcgcuacugcaccgacguggacgagugccagacgcccggcaucugcaugaacggccacugcaucaacagcgagggguccuuccggugcgacugcccgcccggccuggccgucgggauggacggccgcgugugcguggacacccacaugcggagcacgugcuacggcgggaucaagaagggcgucugcgugcgcccguuccccggggccgugaccaaguccgagugcugcugcgccaaccccgacuacggcuucggggagcccugccagccgugccccgcgaagaacagcgccgaguuccacggccugugcuccagcggcgucgggaucacgguggacggccgcgacaucaacgagugcgcccucgaccccgacaucugcgccaacgggaucugcgagaaccugcggggcuccuaccgcugcaacugcaacagcggguacgagccggacgcgagcggccggaacugcaucgacaucgacgagugccuggugaaccgccuccugugcgacaacggccugugccggaacacccccggguccuacagcugcacgugcccgcccggcuacgucuuccgcaccgagacggagaccugcgaggacaucaacgagugcgaguccaacccgugcgugaacggggccugccggaacaaccucggcagcuucaacugcgagugcucccccgggagcaagcuguccagcaccggccugaucugcaucgacucccucaaggggaccugcuggcugaacauccaggacagccgcugcgaggugaacaucaacggggccacgcugaaguccgagugcugcgccacccucggcgccgcgugggggagccccugcgagcggugcgagcuggacaccgccugcccccgcggccuggcccggaucaagggggugaccugcgaggacgugaacgagugcgagguguucccgggcgucugccccaacggccgcugcgugaacuccaaggggagcuuccacugcgagugccccgagggccucacgcuggacgggaccggccgggugugccuggacauccgcauggagcagugcuaccucaagugggacgaggacgagugcauccaccccgucccgggcaaguuccggauggacgccugcugcugcgccgugggggcggccuggggcaccgagugcgaggagugccccaagcccgggaccaaggaguacgagacgcugugcccccgcggcgccggguucgccaaccggggcgacgugcugaccggccgcccguucuacaaggacaucaacgagugcaaggccuuccccgggaugugcaccuacggcaagugccggaacaccaucggguccuucaagugccgcugcaacagcggcuucgcgcucgacauggaggagcggaacugcacggacaucgacgagugccgcaucucccccgaccugugcgggagcggcaucugcgucaacacccccggcagcuucgagugcgagugcuucgagggguacgaguccggcuucaugaugaugaagaacugcauggacaucgacgagugcgagcgcaacccgcugcucugccgcggcgggaccugcgugaacaccgaggggagcuuccagugcgacugcccccugggccacgagcugucccccagccgcgaggacugcguggacaucaacgagugcucccugagcgacaaccucugccggaacggcaagugcgucaacaugaucgggacguaccagugcuccugcaaccccggcuaccaggccaccccggaccgccaggggugcaccgacaucgacgagugcaugaucaugaacggcgggugcgacacccagugcacgaacagcgagggcuccuacgagugcagcugcuccgagggcuacgcccugaugcccgacgggcggagcugcgccgacaucgacgagugcgagaacaaccccgacaucugcgacggcgggcagugcaccaacauccccggcgaguaccgcugccugugcuacgacggcuucauggcguccauggacaugaagaccugcaucgacgugaacgagugcgaccucaacagcaacaucugcauguucggggagugcgagaacaccaagggcuccuucaucugccacugccagcugggguacagcgugaagaagggcacgaccgggugcaccgacgucgacgagugcgagaucggcgcccacaacugcgacaugcacgccuccugccugaacaucccgggcagcuucaagugcuccugccgggagggguggaucggcaacgggaucaagugcaucgaccucgacgagugcagcaacggcacccaccagugcagcaucaacgcccagugcgugaacacccccggguccuaccgcugcgccugcagcgagggcuucacgggcgacggguucacgugcuccgacguggacgagugcgcggagaacaucaaccugugcgagaacggccagugccugaacguccccggggccuaccggugcgagugcgagaugggcuucaccccggccagcgacucccgcagcugccaggacaucgacgagugcuccuuccagaacaucugcguguucgggaccugcaacaaccuccccggcauguuccacugcaucugcgacgacggcuacgagcuggaccggaccggcggcaacugcaccgacaucgacgagugcgccgaccccaucaacugcgugaacgggcugugcgucaacacccccggccgcuacgagugcaacugcccgcccgacuuccagcucaaccccaccggcguggggugcguggacaaccgggucggcaacugcuaccugaaguucgggccccgcggcgacgggagccuguccugcaacacggagaucggcgugggcgugagccgguccagcugcugcugcucccucgggaaggccuggggcaacccgugcgagaccugcccgcccgucaacagcaccgaguacuacacccugugccccgggggcgagggguuccgcccgaaccccaucacgaucauccuggaggacaucgacgagugccaggagcuccccggccugugccagggcgggaacugcaucaacaccuucggcuccuuccagugcgagugcccccagggguacuaccugagcgaggacacccggaucugcgaggacaucgacgagugcuucgcgcacccgggcgugugcgggcccgggaccugcuacaacacgcucggcaacuacacgugcaucugcccgcccgaguacaugcaggucaacgggggccacaacugcauggacaugcgcaaguccuucugcuaccggagcuacaacgggacgaccugcgagaacgagcugccguucaacgucacgaagcgcaugugcugcugcaccuacaacgugggcaaggccuggaacaagcccugcgagcccugccccaccccggggaccgccgacuucaagacgaucugcggcaacauccccggcuucaccuucgacauccacaccgggaaggccguggacaucgacgagugcaaggagauccccggcaucugcgccaacggggucugcaucaaccagaucggcuccuuccgcugcgagugccccaccggcuucagcuacaacgaccugcuccuggugugcgaggacaucgacgagugcagcaacggggacaaccugugccagcggaacgcggacugcaucaacuccccgggcagcuaccgcugcgagugcgccgccggguucaagcucucccccaacggcgccugcguggaccggaacgagugccuggagauccccaacgucugcagccacgggcugugcguggaccuccagggcuccuaccagugcaucugccacaacggcuucaaggcgagccaggaccagacgaugugcauggacgucgacgagugcgagcgccacccgugcgggaacgggaccugcaagaacaccgugggguccuacaacugccugugcuaccccggcuucgagcugacccacaacaacgacugccucgacaucgacgagugcagcuccuucuucggccaggugugccggaacggccgcugcuucaacgagaucggcagcuucaagugccugugcaacgagggguacgagcugacgcccgacggcaagaacugcaucgacaccaacgagugcgucgcccuccccggguccugcagcccggggaccugccagaaccuggagggguccuuccggugcaucugcccgcccggcuacgaggucaagagcgagaacugcaucgacaucaacgagugcgacgaggaccccaacaucugccuguucggcuccugcaccaacacgcccggcggcuuccagugccucugcccgcccggguucgugcugagcgacaacggccgccggugcuucgacacccgccaguccuucugcuucaccaacuucgagaacggcaagugcagcgugcccaaggccuucaacaccaccaaggccaagugcugcugcuccaagaugcccggggagggcuggggcgaccccugcgagcugugccccaaggacgacgagguggccuuccaggaccucugccccuacggccacgggacggugccgagccugcacgacacccgggaggacgucaacgagugccuggagagccccggcaucugcuccaacggccagugcaucaacaccgacgggagcuuccgcugcgagugccccaugggcuacaaccucgacuacaccggggugcggugcguggacacggacgagugcuccaucggcaaccccugcgggaacgggaccugcaccaacgucaucggcagcuucgagugcaacugcaacgagggguucgagccgggccccaugaugaacugcgaggacaucaacgagugcgcgcagaacccccugcugugcgccuuccgcugcaugaacaccuucggguccuacgagugcacgugccccaucggcuacgcccuccgggaggaccagaagaugugcaaggaccuggacgagugcgccgaggggcugcacgacugcgagagccgcggcaugaugugcaagaaccucaucggcaccuucaugugcaucugcccgcccgggauggcccggcgccccgacggcgaggggugcguggacgagaacgagugccggaccaagccgggcaucugcgagaacgggcgcugcgugaacaucaucggcuccuaccggugcgagugcaacgagggcuuccagagcuccagcuccgggaccgagugccuggacaaccgccagggccugugcuucgcggagguccuccagacgaucugccagauggccagcuccagccgcaaccuggugaccaaguccgagugcugcugcgacgggggccggggcugggggcaccagugcgagcugugcccccuccccggcaccgcccaguacaagaagaucugcccccacgggccgggcuacaccacggacgggcgcgacaucgacgagugcaaggugaugcccaaccugugcaccaacggccagugcaucaacaccaugggcagcuuccggugcuucugcaaggucggguacaccacggacaucuccggcaccagcugcaucgaccuggacgagugcucccagagccccaagcccugcaacuacaucugcaagaacaccgaggggagcuaccagugcuccugcccgcgcggcuacgugcuccaggaggacgggaagaccugcaaggaccuggacgagugccagacgaagcagcacaacugccaguuccugugcgugaacacccucggcggcuucacgugcaagugcccgcccggguucacccagcaccacacggccugcaucgacaacaacgagugcggcagccagcccucccugugcggggccaagggcaucugccagaacaccccggggagcuucuccugcgagugccagcggggcuucagccuggacgcgaccggccucaacugcgaggacgucgacgagugcgacgggaaccaccgcugccagcacggcugccagaacauccucgggggcuaccggugcggcugcccccagggguacauccagcacuaccaguggaaccagugcguggacgagaacgagugcuccaaccccaacgccugcggcagcgccuccugcuacaacacccuggggagcuacaagugcgccugccccuccggcuucagcuucgaccaguucuccagcgccugccacgacgugaacgagugcuccagcuccaagaacccgugcaacuacgggugcagcaacacggagggcggcuaccucugcgggugcccgcccggcuacuaccgcgucgggcagggccacugcguguccgggaugggcuucaacaagggccaguaccugagccuggacaccgagguggacgaggagaacgcgcucagccccgaggccugcuacgagugcaagaucaacggguacuccaagaaggacagccggcagaagcgcuccauccacgagccggaccccaccgccgucgagcagaucagccuggaguccguggacauggacagccccgugaacaugaaguucaaccugucccaccucggcagcaaggagcacauccuggagcugcggcccgccauccagccgcucaacaaccacauccgcuacgucaucucccaggggaacgacgacagcguguuccggauccaccagcgcaacggccuguccuaccugcacaccgcgaagaagaagcucaugcccgggacguacacccuggagaucaccagcaucccccuguacaagaagaaggagcucaagaagcuggaggaguccaacgaggacgacuaccugcucggcgagcugggcgaggcccugcggaugcgccuccagauccagcuguacuga

SEQ ID NO: 30032 - RNA, 8430 nt, Artificial Sequence
  derived and/or modified sequence opt1 from FBN3__Homo_sapiens__NP_115823
augacccuggagggccucuaccuggcccgggggccccuggcccggcuccugcuggcguggagcgcccuccugugcauggccggcgggcagggccgcugggacggggcccuggaggccgcgggcccgggccgggugcgccggcgcgggucccccggcauccuccaggggcccaacgucugcggcagccgguuccacgccuacugcugccccggguggcgcaccuucccgggccggucccagugcguggugcccaucugccgccgggccugcggcgagggguucugcagccagcccaaccugugcacgugcgccgacggcacccuggcgcccuccugcggggucagccgcggcuccggcugcagcguguccugcaugaacggcgggaccugccgcggcgcgagcugccucugccagaagggcuacaccgggaccgugugcggccagccgaucugcgaccgcggcugccacaacgggggccggugcaucgggcccaaccgcugcgccugcgucuacggcuucauggggccccagugcgagcgggacuaccgcaccggccccugcuucggccagguggggccggagggcugccagcaccagcugaccgggcuggugugcaccaaggcccucugcugcgccaccgucggccgggcgugggggcugcccugcgagcugugccccgcccagccccacccgugccgccggggcuucauccccaacauccacaccggcgccugccaggacguggacgagugccaggccgugcccgggcucugccagggcggguccugcgucaacauggugggcagcuuccacugccgcugccccgugggccaccgccuguccgacagcuccgccgcgugcgaggacuaccgggccggggccugcuucagcguccuguucggcgggcgcugcgccggcgaccucgccgggcacuacacccggcgccagugcugcugcgaccggggccgcugcugggcggccggcccggugcccgagcugugcccgccccggggguccaacgaguuccagcagcugugcgcccagcgccucccgcugcugcccggccaccccggccucuuccccggccugcugggguucggcagcaacggcauggggccgccccucggccccgcccggcugaacccgcacggguccgacgcccgcggcauccccagccuggggcccggcaacagcaacaucggcaccgcgacccucaaccagaccaucgacaucugccggcacuucaccaaccugugccugaacgggcgcugccuccccaccccguccagcuaccggugcgagugcaacgugggcuacacccaggacguccgcggggagugcaucgacguggacgagugcaccuccagccccugccaccacggcgacugcgugaacauccccgggaccuaccacugccggugcuaccccggcuuccaggccaccccgacccgccaggccugcgucgacguggacgagugcaucguguccggcgggcugugccaccugggccggugcgucaacaccgaggggagcuuccagugcgugugcaacgccggcuucgagcucucccccgacggcaagaacugcgucgaccacaacgagugcgcgaccagcaccaugugcgugaacggggugugccugaacgaggacggcuccuucagcugccugugcaagcccggguuccuccuggcccccggcgggcacuacugcauggacaucgacgagugccagacgccgggcaucugcgucaacggccacugcaccaacaccgagggguccuuccgcugccagugccugggcgggcucgccgugggcaccgacgggcgggugugcgucgacacgcacgugcgcuccacgugcuacggcgccaucgagaagggcuccugcgcccgccccuuccccgggaccgugaccaagagcgagugcugcugcgcgaaccccgaccacggcuucggggagccgugccagcugugccccgccaaggacuccgccgaguuccaggcccugugcagcuccggccucgggaucaccaccgacggccgggacaucaacgagugcgcccuggaccccgaggucugcgcgaacggcgugugcgagaaccugcgcgggagcuaccggugcgugugcaaccugggcuacgaggccggggccuccggcaaggacugcaccgacgucgacgagugcgcccucaacagccugcugugcgacaacggcuggugccagaacagccccggguccuacagcugcuccugcccgcccggcuuccacuucuggcaggacaccgagaucugcaaggacguggacgagugccucagcucccccugcgugagcggggucugccgcaaccuggccggcuccuacacgugcaagugcgggcccggcagccggcuggacccguccggcaccuucugccucgacagcaccaaggggaccugcuggcugaagauccaggagucccgcugcgaggugaaccugcagggcgcgagccuccgguccgagugcugcgccacccugggggccgccuggggcagccccugcgagcgcugcgagaucgaccccgcgugcgcccggggguucgcccgcaugacgggcgugaccugcgacgacgucaacgagugcgaguccuucccgggcgugugccccaacgggcggugcgugaacaccgccggcagcuuccgcugcgagugccccgaggggcugaugcucgacgccuccggccggcugugcgucgacgugcgccuggagcccugcuuccuccggugggacgaggacgagugcggggugacccugccgggcaaguaccgcauggacgucugcugcugcagcaucggcgcgguguggggcguggagugcgaggccugccccgaccccgagagccuggaguucgccucccucugcccccggggccugggguucgccagccgcgacuuccuguccggccggccguucuacaaggacgucaacgagugcaagguguuccccgggcucugcacgcacgggaccugccgcaacaccgugggcagcuuccacugcgccugcgccggcggguucgcccuggacgcccaggagcggaacugcaccgacaucgacgagugccgcaucucccccgaccugugcgggcagggcacgugcgucaacacccccggcagcuucgagugcgagugcuucccgggguacgaguccggcuucaugcucaugaagaacugcauggacguggacgagugcgcccgcgacccccugcugugccgcggcgggaccugcaccaacacggacgggagcuacaagugccagugcccgcccggccacgagcucaccgccaagggcaccgcgugcgaggacaucgacgagugcucccugagcgacgggcugugcccgcacggccagugcgugaacgucaucggggccuuccagugcuccugccacgccggcuuccagagcacccccgaccgccaggggugcguggacaucaacgagugccgggugcagaacggcggcugcgacguccacugcaucaacacggagggguccuaccgcugcagcugcggccagggguacucccucaugcccgacggccgggccugcgcggacguggacgagugcgaggagaacccccgcgugugcgaccaggggcacugcaccaacaugccgggcggccaccggugccugugcuacgacggguucauggccacccccgacaugcggaccugcgucgacguggacgagugcgaccugaacccccacaucugccuccacggcgacugcgagaacacgaaggggagcuucgugugccacugccagcugggcuacaugguccggaagggggccaccggcugcuccgacguggacgagugcgaggugggcgggcacaacugcgacagccacgccuccugccugaacauccccggcagcuucagcugccgcugccucccggggugggucggcgacggcuucgagugccacgaccuggacgagugcgugucccaggagcaccggugcagcccccgcggggacugccugaacgugcccggcuccuaccggugcacgugccgccagggguucgccggcgacggguucuucugcgaggaccgggacgagugcgcggagaacgucgaccucugcgacaacggccagugccugaacgcccccggcggguaccgcugcgagugcgagaugggcuucgacccgaccgaggaccaccgggccugccaggacguggacgagugcgcccaggggaaccugugcgccuucggcagcugcgagaaccuccccgggauguuccgcugcaucugcaacggcggcuacgagcuggaccgcggcggcgggaacugcacggacaucaacgagugcgcggaccccgugaacugcaucaacggcgucugcaucaacaccccgggguccuaccugugcagcugcccccaggacuucgagcucaaccccuccggcgugggcugcgucgacacccgcgccgggaacugcuuccuggagacccacgaccgcggcgacagcgggaucuccugcagcgccgagaucggcgugggcgugacgcgggccuccugcugcugcagccuggggcgcgccuggggcaaccccugcgagcucugcccgauggcgaacaccaccgaguaccggacccugugccccgggggcgagggguuccagcccaaccgcaucacggucauccuggaggacaucgacgagugccaggagcuccccggccugugccagggcggggacugcgugaacaccuucggcuccuuccagugcgagugcccgcccggguaccaccugagcgagcacacccggaucugcgaggacaucgacgagugcuccacccacagcggcaucugcgggcccggcacgugcuacaacacccucggcaacuacacgugcgugugccccgccgaguaccugcaggucaacgggggcaacaacugcauggacaugcgcaaguccgugugcuuccggcacuacaacgggaccugccagaacgagcuggccuucaacgugacccgcaagaugugcugcugcagcuacaacaucggccaggccuggaaccggccgugcgaggccugccccacgcccaucucccccgacuaccagauccucugcgggaaccaggcgccgggcuuccugaccgacauccacaccggcaagccccuggacaucgacgagugcggggagauccccgccaucugcgccaacggcaucugcaucaaccagaucgggagcuuccgcugcgagugccccgccggcuucaacuacaacagcauccuccuggcgugcgaggacgucgacgagugcgggucccgggagagcccgugccagcagaacgccgacugcaucaacauccccggcuccuaccgcugcaagugcacccggggcuacaagcugagccccgggggcgccugcguggggcgcaacgagugccgggagauccccaacgugugcucccacggcgacugcauggacacggagggcagcuacaugugccucugccaccgcggguuccaggccuccgccgaccagacccugugcauggacaucgacgagugcgaccggcagccgugcggcaacgggaccugcaagaacaucaucggcagcuacaacugccugugcuuccccggguucgucgugacccacaacggcgacugcguggacuucgacgagugcacgacccucgucggccaggugugccgcuucgggcacugccugaacaccgcgggcuccuuccacugccugugccaggacggguucgagcucaccgccgacggcaagaacugcguggacacgaacgagugccugagccuggccgggaccugccuccccgggaccugccagaaccuggagggcuccuuccggugcaucugcccgcccggguuccagguccagagcgaccacugcaucgacaucgacgagugcuccgaggagcccaaccugugccucuucgggaccugcacgaacagccccggguccuuccagugccugugcccgcccggcuucgugcugagcgacaacgggcaccgcugcuucgacacccggcaguccuucugcuucacccgcuucgaggccggcaagugcagcgugcccaaggccuucaacaccacgaagacccgcugcugcugcuccaagcggcccggcgagggguggggcgaccccugcgagcucugcccccaggaggggagcgcggccuuccaggagcugugccccuucggccacggcgccguccccgggccggacgacagccgcgaggacgugaacgagugcgccgagaaccccggcgugugcaccaacggggucugcgugaacaccgacggcuccuuccggugcgagugccccuucggguacagccuggacuucacgggcaucaacugcguggacaccgacgagugcuccgucggccaccccugcgggcaggggaccugcaccaacgugaucgggggcuucgagugcgccugcgcggacggguucgagccgggccucaugaugacgugcgaggacaucgacgagugcagccugaacccccugcucugcgccuuccgcugccacaacaccgagggcuccuaccugugcacgugccccgccggguacacccugcgggaggacggcgccaugugccgcgacguggacgagugcgcggacgggcagcaggacugccacgcccggggcauggagugcaagaaccucaucgggacguucgccugcgucugcccgcccggcaugcgcccccugcccggcagcggggagggcugcaccgacgacaacgagugccacgcccagcccgaccugugcgugaacgggcggugcgugaacaccgccggcuccuuccgcugcgacugcgacgagggguuccagccgagccccacccucacggagugccacgacauccggcagggccccugcuucgcggagguccugcagaccaugugccgcucccugagcuccagcuccgaggccgugacccgggccgagugcugcugcggcgggggccgcggguggggcccccggugcgagcucugcccgcugcccggcaccagcgccuaccgcaagcugugcccccacggguccggcuacaccgccgaggggcgggacguggacgagugccgcaugcuggcgcaccucugcgcccacggcgagugcaucaacagccugggguccuuccggugccacugccaggccggcuacacgccggacgccaccgccacgaccugccuggacauggacgagugcagccagguccccaagcccugcacguuccucugcaagaacaccaagggcuccuuccugugcagcugcccccgcggguaccugcucgaggaggacggccggaccugcaaggaccuggacgagugcaccagccggcagcacaacugccaguuccugugcgugaacacggugggggcguucacgugccgcugcccgcccggcuucacccagcaccaccaggccugcuucgacaacgacgagugcuccgcccagcccgggcccugcggcgcccacggccacugccacaacaccccggggagcuuccggugcgagugccaccagggcuucacgcucgucuccagcgggcacggcugcgaggacgugaacgagugcgacgggccccaccgcugccagcacggcugccagaaccagcugggcggguaccggugcuccugcccccagggcuucacccagcacagccagugggcgcagugcguggacgagaacgagugcgcccugagcccgcccacgugcgggagcgccuccugccgcaacacccucggcggcuuccggugcgucugccccagcggguucgacuucgaccaggcccugggcgggugccaggagguggacgagugcgccggccgccgggggcccugcuccuacagcugcgcgaacacccccggcggcuuccugugcgggugcccccagggcuacuuccgcgccgggcagggccacugcguguccgggcucggcuucagccccggcccccaggacacccccgacaaggaggagcugcuguccagcgaggccugcuacgagugcaagaucaacgggcucuccccgcgggaccgcccccggcgcagcgcccaccgggaccaccaggucaaccuggccacccuggacuccgaggcgcuccugacccugggccucaaccugagccaccuggggcgcgccgagcggauccucgagcugcgccccgcccuggagggccucgaggggcggauccgcuacgugaucgugcggggcaacgagcagggcuucuuccgcaugcaccaccuccgcggggucagcucccugcagcugggccggcgccggcccgggccgggcacguaccgccuggagguggugagccacauggccgggcccuggggcguccagcccgagggccagcccgggccguggggccaggcccugcggcucaaggugcagcugcagcugcucuga

SEQ ID NO: 30033 - RNA, 1017 nt, Artificial Sequence
  derived and/or modified sequence opt1 from FBP1__Homo_sapiens__NP_000498
auggccgaccaggcccccuucgacaccgacgugaacacccugacgcgcuucgucauggaggagggccggaaggcgcgcgggaccggcgagcucacccagcugcugaacagccucugcaccgccgugaaggccaucuccagcgccgugcggaaggccgggaucgcgcaccuguacggcaucgccggguccacgaacgucaccggcgaccaggugaagaagcuggacgugcucagcaacgaccuggucaugaacaugcugaaguccagcuucgcgaccugcgugcucguguccgaggaggacaagcacgccaucaucgucgagccggagaagcgcggcaaguacguggugugcuucgacccccuggacgggagcuccaacaucgacugccuggucagcgugggcaccaucuucgggaucuaccggaagaaguccacggacgagcccagcgagaaggacgcccuccagcccggccgcaaccugguggccgccggguacgcccuguacggcuccgccaccaugcucguccuggcgauggacugcggcgugaacugcuucaugcuggacccggccaucggggaguucauccucguggacaaggacgucaagaucaagaagaagggcaagaucuacagccugaacgagggguacgcccgggacuucgaccccgccgugaccgaguacauccagcgcaagaaguucccgcccgacaacuccgcccccuacggcgcgcgguacgugggcagcauggucgccgacgugcaccgcacccugguguacgggggcaucuuccucuaccccgccaacaagaagucccccaacgggaagcugcggcugcucuacgagugcaaccccauggccuacgucauggagaaggccggcgggauggcgacgaccggcaaggaggccgugcuggacgucaucccgaccgacauccaccagcgcgcccccgugauccugggcagccccgacgacgugcucgaguuccugaaggucuacgagaagcacuccgcccaguga

SEQ ID NO: 30034 - RNA, 1020 nt, Artificial Sequence
  derived and/or modified sequence opt1 from FBP2__Homo_sapiens__NP_003828
augaccgaccgcagccccuucgagaccgacaugcugacgcucacccgguacgugauggagaagggccgccaggccaaggggaccggcgagcugacccagcugcucaacuccaugcugacggccaucaaggcgaucagcuccgccguccggaaggccgggcuggcccaccucuacggcaucgccgggagcgugaacgugaccggcgacgaggucaagaagcuggacgugcuguccaacagccucgugaucaacaugguccaguccagcuacuccacgugcgugcuggugagcgaggagaacaaggacgcgaucaucaccgccaaggagaagcgcggcaaguacgucgugugcuucgacccgcuggacggguccagcaacaucgacugccucgccuccaucggcaccaucuucgccaucuaccggaagaccagcgaggacgagcccuccgagaaggacgcgcugcagugcgggcgcaacaucguggccgccggcuacgcccuguacgggagcgccacccucgucgcgcuguccaccggccagggcguggaccuguucaugcucgaccccgcccugggggaguucgugcuggucgagaaggacgugaagaucaagaagaagggcaagaucuacagccucaacgagggguacgccaaguacuucgacgccgccacgaccgaguacgugcagaagaagaaguuccccgaggacggcuccgcgccguacggcgcccgguacgucgggagcaugguggccgacgugcaccgcacccuggucuacggcgggaucuuccuguaccccgccaaccagaagucccccaagggcaagcuccggcugcuguacgagugcaaccccguggccuacaucaucgagcaggccgggggccucgcgaccacgggcacccagccggugcuggacgucaagcccgaggccauccaccagcgcgugccccugauccucgggagccccgaggacguccaggaguaccugaccugcgugcagaagaaccaggccggcagcuga

SEQ ID NO: 30035 - RNA, 2943 nt, Artificial Sequence
  derived and/or modified sequence opt1 from FBRS__Homo_sapiens__NP_001098549
auggagaccgccgccgcggccgcccccggcccggggugggccgccgagggcgagcgccggcgccggcgcugcagccggcgcgaccgggaccgcgagcagcggcgccggcgcgggcccggcggggacgcgccccgggcccugcucgccgccccccgcggcuccagcuccagcuccagcccgcccccccccgcgcggccgugguccagcgccuccagcggcgagcgccccgggggcccccggcgccggcgcccccggccgcgcccccgccccccccggccgcgcgcccggaagcgccccgccggguccggcagccggggggaggaggaggaggaggaggaggaggagggcggcgccgacgacggggaggcggaggaggagcccgaggaggaggaggaggaggaggaggaccugaucgacggcuucgccaucgccuccuucgccacccuggaggcccuccagaaggacgcgagccugcagcccccggagcgccuggagcaccggcucaagcacuccgggaagcgcaagcggggcggcagcuccggggccacgggcgagcccggggacagcuccgaccgcgagcccggccggcccccgggggaccgcgcccggaaguggcccaacaagcgccggcgcaaggaggccagcagccggcacucccuggaggccggcuacaucugcgacgcggagagcgaccuggacgagcgcguguccgacgacgaccucgaccccagcuucaccgucuccaccagcaaggccuccggcccccacggggccuucaacggcaacugcgaggccaagcugagcguggugccgaaggucuccgggcuggagcggagccaggagcagccccccggcccggacccccuccuggugcccuuccccccgaaggagcccccccccccgcccgugccccgccccccggucuccccccccgccccccugccggcgacccccagccucccccccccgccccagccccagcugcagcugcgcgugucccccuucgggcuccggacgagcccguacggcuccagccuggaccuguccaccggcagcuccagccgcccccccccgaaggcccccgccccccccguggcccagccgccccccagcuccagcuccagcuccagcuccagcuccagcgcguccagcuccagcgcccagcucacccaccggcccccgacccccucccugccccugccccucagcacgcacuccuucccgccccccgggcugcgccccccgccccccccccaccacccgagccuguucagccccggccccacccuccccccgccccccccccugcugcaggucccggggcaccccggcgccuccgccgccaacgcgcucagcgagcaggaccugaucgggcaggaccugaacucccgguaccucaacgcccagggcggccccgagguggugggggccggcgggagcgcccgcccgcuggccuuccaguuccaccagcacaaccaccagcaccagcacacccaccagcacacccaccagcacuucacgcccuacccccccggccugcucccgccccacggcccccacauguucgagaaguaccccgggaagauggagggccuguuccggcacaacccguacaccgcguucccccccgccguccccgggcugccgcccggccucccccccgccguguccuucgggagccugcagggcgccuuccagccgaaguccaccaaccccgagcugcccccccgccucggcccggugcccagcgggcugucccagaagggcacccagauccccgaccacuuccggcccccgcugcgcaagcccgggaaguggugcgccaugcacguccggguggcguacaugauccuccgccaccaggagaagaugaagggcgacagccacaagcuggacuuccggaacgaccugcuccccugccugcccgggccguacggcgcccugccccccggccaggagcugucccacccggccagccucuucacggccaccggggcggugcacgccgccgccaaccccuucaccgccgcgcccggcgcccacgggcccuuccuguccccgagcacccacaucgaccccuucggccgccccacguccuucgccagccuggccgcccucuccaacggggcguucggcggccuggggagccccaccuucaacuccggcgccgucuucgcccagaaggagagcccgggggccccccccgccuucgcgagccccccggaccccuggggccggcugcaccgcuccccccucaccuuccccgccugggugcggccgcccgaggccgcccgcacccccgggagcgacaaggagcggcccguggagcgccgggagccguccaucacgaaggaggagaaggaccgcgaccugcccuucagccgcccccagcugcgggucucccccgcgaccccgaaggcccgcgccggcgaggagggcccccggcccaccaaggagagcgugcgcgugaaggaggagcggaaggaggaggccgccgcggccgccgccgccgcggccgccgccgccgcggccgccgccgccgcggccaccgggccgcagggccuccaccugcuguucgagcgcccccggccccccccguuccucgggcccuccccccccgaccgcugcgccggcuuccuggagccgacguggcuggccgcgcccccccggcucgcccgccccccgcgguucuacgaggccggcgaggagcugaccgggcccggcgccgucgccgcggcccgccuguacgggcucgagcccgcccacccccugcuguacagccggcucgccccgcccccccccccggccgcggcccccggcaccccccaccugcuguccaagacccccccgggggcccuccugggcgccccccccccccuggugccggccccccgccccagcuccccgccccggggccccgggcccgcgcgcgccgaccgguga

SEQ ID NO: 30036 - RNA, 903 nt, Artificial Sequence
  derived and/or modified sequence opt1 from FBXL15__Homo_sapiens__NP_077302
auggagcccccgauggagcccagcggcggggagcaggagcccggcgccgugcgcuuccuggaccugcccugggaggacguccugcugccgcacgugcucaaccgggugccccugcgccagcugcuccggcugcagcgcgucucccgggccuuccgcagccuggugcagcuccaccuggcggggcugcggcgcuucgacgccgcccaggugggcccccagaucccccgggccgcccucgcgcgccugcugcgggacgccgaggggcuccaggagcuggcccuggccccgugccacgaguggcucuccgacgaggaccugguccccgugcuggcgcgcaacccccagcuccggagcguggcccugggcggcugcgggcagcugucccgccgggcccucggcgcccuggccgaggggugcccccgccugcagcggcucagccuggcgcacugcgacugggucgacggccuggcccuccgcgggcuggccgaccggugcccggcccuggaggagcucgaccugaccgccugccgccagcugaaggacgaggcgaucguguaccucgcccagcggcgcggcgccggccugcgcucccugagccucgccgugaacgccaacgucggggacgcggccgugcaggagcuggcccggaacugccccgagcugcaccaccucgaccugaccggcugccugcgcgugggguccgacggcguccggacgcucgccgaguacugccccgugcugcgcagccugcgggugcgccacugccaccacgucgccgaguccagccucucccggcugcgcaagcggggcguggacaucgacguggagcccccgcugcaccaggcgcugguccuccugcaggacauggccggguucgcccccuucgugaaccuccagguguga

SEQ ID NO: 30037 - RNA, 2106 nt, Artificial Sequence
  derived and/or modified sequence opt1 from FBXL17__Homo_sapiens__NP_001156787
augggccaccugcucagcaaggagccccgcaaccggccgucccagaagcgcccccggugcugcagcuggugccgccggcgccggccccugcugcgccucccccggcgcaccccggccaaggugcccccccagcccgccgcgccgcggucccgcgacugcuucuuccgggggcccugcaugcugugcuucaucguccacagccccggcgcccccgccccggccgggcccgaggaggagcccccccuguccccgcccccccgcgacggcgccuacgcggccgccagcuccagccagcaccucgcccggcgcuacgcggcccuggccgccgaggacugcgccgcggccgcccggcgcuuccugcucuccagcgccgccgcggccgccgccgccgcggccuccgccagcucccccgccagcugcugcaaggagcuggggcuggccgcggccgccgccugggagcagcagggccggucccucuuccuggcgagccugggcccggugcgcuuccucgggccccccgccgccgugcagcuguuccggggccccaccccgucccccgccgagcugcccacgcccccggagauggucugcaagcgcaagggggccggcgugcccgcgugcacccccugcaagcagccgcgcugcgggggcggcgggugcggcgggggcggcgggggcgggggcgggggcggccccgccgggggcggggccagccccccccggccgcccgacgccggcugcugccaggcccccgagcagcccccgcagccccucugcccccccccguccagccccaccagcgagggggcgcccaccgaggccggcggcgacgccgugcgcgccgggggcacggccccccuguccgcgcagcagcagcacgagugcggggacgccgacugccgggagagcccggagaaccccugcgacugccaccgcgagccccccccggagacccccgacaucaaccagcugccccccuccauccuccugaagaucuucagcaaccugucccucgacgagcggugccugagcgccucccuggucugcaaguacuggcgcgaccucugccuggacuuccaguucuggaagcagcuggaccucagcucccggcagcaggugaccgacgagcugcuggagaagaucgccagccgcucccagaacaucaucgagaucaacaucagcgacugccgguccaugagcgacaacggcgugugcguccucgcguucaagugcccggggcugcugcgcuacaccgccuaccggugcaagcagcucuccgacacgagcaucaucgccguggccucccacugcccccugcugcagaaggugcacgucggcaaccaggacaagcucaccgacgagggccugaagcagcuggggagcaagugccgcgagcucaaggacauccacuucggccagugcuacaagaucuccgacgaggggaugaucgugaucgccaagggcugccugaagcugcagcggaucuacaugcaggagaacaagcucgugaccgaccagagcgucaaggcguucgccgagcacugccccgagcugcaguacgugggcuucauggggugcagcgugaccuccaagggcgucauccaccugacgaagcuccgcaaccugagcucccuggaccugcggcacaucaccgagcucgacaacgagaccgugauggagaucgugaagcgcugcaagaaccugagcucccugaaccucugccugaacuggaucaucaacgaccggugcgucgaggugaucgccaaggaggggcagaaccugaaggagcucuaccuggugagcugcaagaucaccgacuacgcccugaucgccaucggccgcuacuccaugacgaucgagaccgucgacgugggguggugcaaggagaucaccgaccagggcgcgacccucaucgcccagagcuccaagagccugcgguaccugggccucaugcgcugcgacaaggucaacgaggugacgguggagcagcugguccagcaguacccgcacaucaccuucuccaccgugcugcaggacugcaagcgcacccucgagcgggccuaccagaugggguggacgcccaacaugagcgccgccuccagcuga

SEQ ID NO: 30038 - RNA, 2085 nt, Artificial Sequence
  derived and/or modified sequence opt1 from FBXL19__Homo_sapiens__NP_001093254
augggcaugaaggugcccgggaagggcgagagcgggccguccgcccugcucaccccgcccaugagcuccagcucccgcggccccggggccggcgcgcggcgccggcgcacccggugccgccggugccgcgccugcguccggacggagugcggcgacugccacuucugccgcgacaugaagaaguucgggggccccgggcggaugaagcagagcugccugcugcgccagugcaccgcccccgugcucccccacaccgccgugugccugcugugcggcgaggccgggaaggaggacaccgucgagggcgaggaggagaaguucggccucucccugauggagugcacgaucugcaacgagaucgugcaccccgggugccugaagaugggcaaggcggagggggugaucaacgccgagaucccgaacugcugggagugcccccggugcacccaggagggccgcaccagcaaggacuccggcgaggggcccggccggcgccgggccgacaacggggaggagggcgccagccucggguccggcuggaagcugaccgaggagcccccgcugcccccgccgccgccccgccggaagggcccccuccccgcggggcccccgcccgaggacguccccggcccgcccaagcgcaaggagcgggaggccgggaacgagccgcccacgccccgcaagaaggugaagggcgggcgcgagcggcaccugaagaaggugggcggcgacgccugccugcuccgcgggagcgaccccggcgggcccggccugcugccgccccggguccucaaccccucccaggccuucagcuccugccaccccgggcugccgcccgagaacugggagaagcccaagccgccccuggccagcgcggagggccccgccgugcccucccccagcccccagcgcgagaagcucgagcgguucaagcgcaugugccagcugcuggagcgggugcccgacaccuccagcagcuccagcgacuccgacagcgacuccgacagcuccggcaccagccucuccgaggacgaggcccccggggaggcccgcaacggccggcgccccgcccgggggagcuccggcgagaaggagaaccgcggcgggcggcgcgcgguccggcccggcagcgggggcccccugcuguccuggccccucgggcccgccccgccgccccgcccgccccagcuggagcggcacguggugcgcccgccgccccggagccccgagcccgacacccugccccucgccgccggcuccgaccacccccugccccgcgccgcguggcugcgcgucuuccagcaccucggcccccgggagcugugcaucugcaugcgcgugugccggacguggagccgcuggugcuacgacaagcggcuguggccccgcauggaccucucccggcgcaagagccugaccccgcccaugcuguccggggugguccggcgccagccccgggcccucgaccugagcuggaccggcgugagcaagaagcagcugauguggcuccugaaccgccugcaggggcuccaggagcuggugcuguccggcugcagcuggcucuccgucagcgcccugggguccgcgccccugcccgcccugcggcuccuggaccugcgcuggaucgaggacgugaaggacagccagcuccgggagcugcugcugcccccgcccgacaccaagcccggccagacggagucccgcggccggcuccaggggguggccgagcugcgccucgccggccuggagcugaccgacgccagccuccggcugcugcuccgccacgcgccccagcuguccgcccuggaccucagccacugcgcccacgucggggaccccuccgugcaccuccugaccgcccccaccagcccgcugcgggagacgcugguccaccugaaccucgccggcugccaccgccugaccgaccacugccugccccucuuccgccggugcccccgccugcggcgccuggaccuccgguccugccgccagcugagccccgaggccugcgcgcggcuggccgccgccgggccgcccggccccuuccgcugccccgaggagaagcuccugcugaaggacuccuga

SEQ ID NO: 30039 - RNA, 1215 nt, Artificial Sequence
  derived and/or modified sequence opt1 from FBXL20__Homo_sapiens__NP_001171835
augcgccgggacgugaacggcgucaccaagagccgcuucgagauguucuccaacagcgacgaggccgugaucaacaagaagcugcccaaggagcuccugcugcggaucuucuccuuccucgacguggucacccugugccgcugcgcccaggugagccgggcguggaacgugcuggcccucgacggguccaacuggcagcgcaucgaccuguucgacuuccagcgggacaucgagggccgcgucguggagaacaucagcaagcggugcgggggcuuccugcgcaagcucucccugcgggggugccugggcgugggcgacaacgcccuccgcacguucgcccagaacugccggaacaucgagguccugaaccugaacgggugcaccaagaccaccgacgccgagggcugcccgcuccuggagcagcugaacaucagcuggugcgaccaggugacgaaggacgggauccaggcgcucgugcgcggcugcgggggccugaaggcccuguuccucaagggcugcacccagcuggaggacgaggcccugaaguacaucggggcccacugccccgagcucgucacccugaaccugcagaccugccuccagaucacggacgagggccugaucaccaucugccgggggugccacaagcugcagucccucugcgcgagcggcugcuccaacaucaccgacgccauccugaacgcccugggccagaacugcccccgccuccggauccuggagguggcccgcugcagccagcugaccgacgugggguucacgacccucgcccggaacugccacgagcuggagaagauggaccuggaggagugcguccagaucaccgacuccacccucauccagcugagcauccacugcccccgccuccaggugcugucccugagccacugcgagcugaucacggacgacggcauccggcaccucgggaacggcgcgugcgcccacgaccagcuggaggugaucgagcuggacaacugcccgcucaucaccgacgccucccuggagcaccucaagagcugccacucccuggagcgcaucgagcuguacgacugccagcagaucacccgcgccgggaucaagcggcugcgcacccaccuccccaacaucaagguccacgccuacuucgcgcccgugacgcccccgcccagcgugggcggcagccggcagcgcuucugccggugcugcaucauccuguga

SEQ ID NO: 30040 - RNA, 1068 nt, Artificial Sequence
  derived and/or modified sequence opt1 from FBXL2__Homo_sapiens__NP_001165184
augguguucagcaacaacgacgagggccugaucaacaagaagcuccccaaggagcugcugcuccgcaucuucuccuuccuggacaucgucacccugugccggugcgcccagaucagcaaggccuggaacauccucgcgcuggacggguccaacuggcagcgcaucgaccuguucaacuuccagaccgacguggagggccggguggucgagaacaucagcaagcgcugcgggggcuuccuccggaagcugucccugcgcgggugcaucggcgugggcgacagcucccucaagacguucgcccagaacugccggaacaucgagcaccugaaccugaacgggugcaccaagaucaccgacagcacgugcuacucccucagccgcuucugcuccaagcugaagcacauccagaacuacugccacgagcuggugagccucaaccugcaguccugcagccggaucaccgacgagggcgucgugcagaucugccgcgggugccaccggcugcaggcccucugccuguccggcugcagcaaccugaccgacgccucccucaccgcccuggggcugaacugcccgcgccuccagauccuggaggcggcccggugcagccaccugaccgacgccggcuucacgcuccuggcccgcaacugccacgagcuggagaagauggaccucgaggagugcauccugaucaccgacuccacccugauccagcucagcauccacugccccaagcugcaggcgcugagccucucccacugcgagcugaucaccgacgacggcauccugcaccucagcaacuccacgugcgggcacgagcggcugcgcgugcuggagcucgacaacugccugcugaucaccgacgucgcccucgagcaccuggagaacugccggggccuggagcgccuggagcucuacgacugccagcaggucacccgggccgggaucaagcgcaugcgggcccagcugccccacgugaaggugcacgccuacuucgcgcccgugaccccgcccacggccguggccggcagcggccagcgccugugccgcugcugcgucauccucuga

SEQ ID NO: 30041 - RNA, 1287 nt, Artificial Sequence
  derived and/or modified sequence opt1 from FBXL3__Homo_sapiens__NP_036290
augaagcgcggcgggcgggacagcgaccgcaacuccagcgaggagggcaccgccgagaaguccaagaagcugcggaccacgaacgagcacagccagaccugcgacugggggaaccuccugcaggacaucauccuccagguguucaaguaccugccccugcuggaccgcgcccacgcgucccaggucugccggaacuggaaccagguguuccacaugccggaccucuggcgcugcuucgaguucgagcugaaccagcccgccaccagcuaccugaaggccacccaccccgagcucaucaagcagaucaucaagcggcacuccaaccaccuccaguacgugagcuucaaggucgacuccagcaaggaguccgccgaggccgcgugcgacauccugagccagcuggugaacugcucccugaagacgcugggccucaucagcaccgcccgccccuccuucauggaccugcccaagagccacuucaucuccgcccugaccguggucuucgugaacagcaagucccucagcagccugaagaucgacgacaccccgguggacgaccccucccugaagguccucguggccaacaacagcgacacgcugaagcugcucaagauguccagcugcccccacguguccccggcggggauccugugcgucgccgaccagugccacggccugcgggagcucgcccugaacuaccaccuccugagcgacgagcugcugcucgcccuguccagcgagaagcacgugcgccuggagcaccuccggaucgacguggucuccgagaaccccggccagacccacuuccacaccauccagaaguccagcugggacgccuucauccgccacagccccaaggugaaccuggugauguacuucuuccuguacgaggaggaguucgaccccuucuuccgguacgagaucccggcgacccaccucuacuucgggcgcuccgucagcaaggacgugcugggccggguggggaugacgugcccccgccuggucgagcucguggugugcgccaacggccugcggccccuggacgaggagcucauccgcaucgccgagcggugcaagaaccuguccgccaucgggcugggcgagugcgaggucagcugcuccgccuucguggaguucgucaagaugugcggcgggcgccucagccagcuguccaucauggaggaggugcugauccccgaccagaaguacagccuggagcagauccacugggaggugagcaagcaccucggccgggucugguucccggacaugaugcccaccugguga

SEQ ID NO: 30042 - RNA, 1866 nt, Artificial Sequence
  derived and/or modified sequence opt1 from FBXL4__Homo_sapiens__NP_001265645
augagccccguguucccgaugcugaccguccucaccauguucuacuacaucugccugcgccggcgcgcccggacggccacccgcggcgagaugaugaacacccaccgggcgaucgaguccaacagccagaccagcccccugaacgccgagguggugcaguacgccaaggaggucguggacuucagcucccacuacgggagcgagaacuccaugagcuacacgauguggaaccucgccggcgugcccaacgucuuccccuccagcggggacuucacccagaccgccguguuccgcaccuacggcacguggugggaccagugcccguccgcgagccugcccuucaagcggaccccgcccaacuuccagucccaggacuacguggagcugaccuucgagcagcaggucuaccccaccgccgugcacgugcucgagacguaccaccccggggccgucauccgcauccuggccugcagcgcgaaccccuacucccccaacccgcccgccgaggugcggugggagauccuguggagcgagcgccccaccaaggugaacgccucccaggcccggcaguucaagcccugcaucaagcagaucaacuucccgaccaaccucauccgccuggaggucaacagcucccugcucgaguacuacaccgagcuggacgccguggugcugcacggcgucaaggacaagcccgugcucagccugaagacgagccugaucgacaugaacgacaucgaggacgacgcguacgccgagaaggacggcugcgggauggacucccucaacaagaaguucagcuccgccgugcugggcgaggggcccaacaacggcuacuucgacaagcugcccuacgagcucauccagcugauccugaaccaccucacccugccggaccugugccggcucgcccagaccugcaagcugcugagccagcacugcugcgacccccuccaguacauccaccugaaccugcagcccuacugggccaagcucgacgacaccucccuggaguuccugcagagccgcugcacgcucguccaguggcugaaccuguccuggaccgggaaccggggcuucaucagcguggcgggcuucucccgcuuccucaaggugugcgggagcgagcugguccggcuggagcucuccugcagccacuuccugaacgagaccugccuggaggugaucuccgagaugugccccaaccuccaggcccugaaccugagcuccugcgacaagcucccgccccaggccuucaaccacaucgccaagcugugcagccugaagcgccugguccucuaccggaccaagguggagcagacggcccugcuguccauccucaacuucugcagcgagcugcagcaccugucccucggcagcugcgugaugaucgaggacuacgacgucaucgcgagcaugaucggggccaagugcaagaagcugcgcacccuggaccucuggcggugcaagaacaucaccgagaacggcaucgccgagcuggccuccggcugcccccugcucgaggagcuggaccugggguggugccccacccuccagagcuccacgggcugcuucacccgccuggcccaccagcugccgaaccuccagaagcuguuccugaccgcgaaccgcagcgugugcgacaccgacaucgacgagcucgccugcaacugcacgcggcugcagcagcuggacauccucgggacccgcauggugucccccgccagccugcggaagcugcucgaguccugcaaggaccugagccugcucgacgucuccuucugcagccagaucgacaaccgcgccgugcuggagcugaacgcguccuuccccaagguguucaucaagaaguccuucacccaguga

SEQ ID NO: 30043 - RNA, 2025 nt, Artificial Sequence
  derived and/or modified sequence opt1 from FBXL5__Homo_sapiens__NP_001180464
auggcccccuucccggaggagguggacgucuucaccgcgccccacuggcgcaugaagcagcuggugggccucuacugcgacaagagccuguacgccaccuucaaggaguucaagaugcacgagcagaucgagaacgaguacaucaucgggcugcuccagcagcggucccagacgaucuacaacgugcacagcgacaacaagcuguccgagaugcugagccucuucgagaagggccugaagaacgucaagaacgaguacgagcagcugaacuacgccaagcagcucaaggagcgccuggaggccuucacccgggacuuccugccccacaugaaggaggaggaggagguguuccagcccaugcucauggaguacuucaccuacgaggagcugaaggacaucaagaagaaggugaucgcccagcacugcucccagaaggacaccgccgagcugcuccgcgggcugagccuguggaaccacgcggaggagcggcagaaguucuucaaguacuccgucgacgagaaguccgacaaggaggccgaggugagcgagcacagcacgggcaucacccaccucccgcccgaggugaugcuguccaucuucagcuaccugaacccccaggagcucugccgcugcucccaggucagcaugaaguggucccagcugaccaagaccgggagccuguggaagcaccucuaccccgugcacugggcccggggcgacugguacuccggcccggccacggagcuggacaccgagcccgacgacgagugggugaagaaccgcaaggacgagagccgggcguuccacgagugggacgaggacgccgacaucgacgaguccgaggagagcgccgaggagagcaucgccaucuccaucgcccagauggagaagcgccugcuccacgggcugauccacaacguccugcccuacgugggcaccagcgugaagacccucguccuggcguacuccagcgccguguccagcaagauggugcggcagauccuggagcucugccccaaccuggagcaccuggaccucacgcagaccgacaucuccgacagcgccuucgacuccuggagcuggcuggggugcugccagucccugcgccaccucgaccugagcggcugcgagaagaucaccgacgucgcccuggagaagaucucccgggcccucgggauccugaccagccaccaguccggcuuccugaagacgagcaccuccaagaucaccagcaccgcguggaagaacaaggacaucacgaugcaguccaccaagcaguacgccugccuccacgaccugaccaacaagggcaucggggaggagaucgacaacgagcacccguggaccaagcccgugagcagcgagaacuucacgucccccuacguguggaugcuggacgccgaggaccucgccgacaucgaggacaccgucgaguggcgccaccggaacguggagagccugugcgugauggagaccgccuccaacuucagcugcuccaccagcggcugcuucuccaaggacaucgucgggcugcgcacgagcgugugcuggcagcagcacugcgcgucccccgccuucgccuacugcggccacagcuucugcugcaccggcaccgcccugcggaccauguccagccucccggaguccagcgccaugugccgcaaggcggcccggacgcgccugccccgggggaaggaccugaucuacuucggcuccgagaaguccgaccaggagaccgggcgcguccuccuguuccugagccucagcggcugcuaccagaucaccgaccacgggcugcgcgugcugacccucggcggcgggcugcccuaccuggagcaccucaaccugagcggcugccugacgaucaccggggccggccuccaggaccugguguccgccugccccagccugaacgacgaguacuucuacuacugcgacaacaucaacgggccgcacgcggacaccgccuccggcugccagaaccuccagugcggcuuccgggccugcugccgcagcggggaguga

SEQ ID NO: 30044 - RNA, 1476 nt, Artificial Sequence
  derived and/or modified sequence opt1 from FBXL7__Homo_sapiens__NP_036436
augggcgccaacaacgggaagcaguacggcagcgaggggaagggcuccagcuccaucagcuccgacgugagcuccagcaccgaccacacccccacgaaggcccagaagaacgucgcgaccuccgaggacagcgaccuguccaugcgcacccucagcaccccgucccccgcccugaucugcccgcccaaccugcccggguuccagaacggccggggcagcuccacgagcuccagcuccaucaccggggagaccguggccauggugcacagcccgccgcccacccgccucacgcacccccugauccggcuggccagccgcccccagaaggagcaggccuccaucgaccggcuccccgaccacagcaugguccagaucuucuccuuccugcccaccaaccagcugugccgcugcgcgcgggugugccgccggugguacaaccucgccugggacccccgccuguggcggaccauccgccugaccggcgagacgaucaacguggaccgggcccucaagguccugacccgccggcugugccaggacacccccaacgugugccucaugcuggagaccgugacggucagcgggugccgccggcugaccgaccgcggccucuacaccaucgcccagugcugccccgagcugcggcgccuggagguguccgggugcuacaacaucagcaacgaggcgguguucgacgucgugucccucugccccaaccuggagcaccuggacgugagcggcugcuccaaggugaccugcaucagccucacgcgggaggccuccaucaagcugagcccgcugcacggcaagcagaucuccauccgcuaccucgacaugaccgacugcuucguccuggaggacgaggggcugcacaccaucgccgcccacugcacccagcucacgcaccuguaccugcgccggugcgugcgccucaccgacgagggccugcgguaccuggucaucuacugcgccagcaucaaggagcucuccgugagcgacugccgcuucguguccgacuucgggcugcgggagaucgcgaagcuggagagccgccuccgguaccuguccaucgcccacugcggccgcgucaccgacgugggcauccgguacguggccaaguacugcagcaagcugcgcuaccucaacgcccgggggugcgagggcaucaccgaccacggggucgaguaccuggccaagaacugcacgaagcucaagagccuggacaucggcaagugcccccugguguccgacaccgggcuggagugccucgcgcugaacugcuucaaccugaagcgccugagccucaaguccugcgagagcaucaccggccagggccugcagaucgucgccgccaacugcuucgaccugcagacccucaacgugcaggacugcgagguguccgucgaggcccugcgguucgugaagcgccacugcaagcggugcgugaucgagcacacgaaccccgccuucuucuga

SEQ ID NO: 30045 - RNA, 1962 nt, Artificial Sequence
  derived and/or modified sequence opt1 from FBXO10__Homo_sapiens__XP_005251496
auggaggccggcgggcugccccucgagcuguggcgcaugauccuggccuaccuccaccucccggaccugggccggugcagccuggugugccgcgcgugguacgagcugauccugucccucgacagcacccgguggcgccagcugugccuggggugcaccgagugccggcaccccaacuggcccaaccagcccgacgucgagccggaguccuggcgcgaggccuucaagcagcacuaccucgccagcaagacguggaccaagaacgcccuggaccuggaguccagcaucugcuucucccucuuccggcgccggcgcgagcggcgcacccugagcgugggccccgggcgggaguucgacucccugggcagcgcccucgcgauggccucccuguacgaccgcaucgugcuguuccccggcgucuacgaggagcagggggagaucauccucaaggugcccguggagaucgucggccaggggaagcugggcgagguggcccugcucgccagcaucgaccagcacugcuccaccacgcggcugugcaaccugguguucaccccggcgugguucagccccaucauguacaagaccaccuccgggcacguccaguucgacaacugcaacuucgagaacggccacauccaggugcacggccccgggacgugccaggugaaguucugcaccuucaagaacacccacaucuuccuccacaacgucccccugugcgugcuggagaacugcgaguucgugggcagcgagaacaacuccgucaccguggaggggcacccgagcgccgacaagaacugggccuacaaguaccuccugggccugaucaaguccagccccacguuccuccccaccgaggacagcgacuuccugaugucccuggaccucgagagccgcgaccaggccuggucccccaagaccugcgacaucgugaucgagggcagccaguccccgaccagccccgccuccagcucccccaagcccgggagcaaggcgggcucccaggaggccgaggucgggagcgacggcgagcggguggcccagacgccggacuccagcgacgggggccugucccccagcggcgaggacgaggacgaggaccagcugauguaccgccucuccuaccaggugcaggggccccggcccguccugggcgggagcuuccugggcccgccccuccccggggccuccauccagcugcccagcugccuggugcucaacagccugcagcaggagcugcagaaggacaaggaggccauggcgcucgccaacuccgugcagggcugccugauccgcaagugccuguuccgggacggcaagggcggggucuucgugugcagccacgggcgcgccaagauggagggcaacaucuuccgcaaccugaccuacgccguccggugcauccacaacuccaagaucaucaugcuccgcaacgacaucuaccggugccgcgccagcgggaucuuccugcggcuggagggcggcgggcucaucgcgggcaacaacaucuaccacaacgccgaggccgggguggacauccgcaagaaguccaacccgcugauccugugcaaccagauccaccacggccuccggagcggcaucgugguccuggggaacggcaaggggaucauccgcaacaaccagaucuucuccaacaaggaggccggcaucuacauccuguaccacgggaaccccguggugagcggcaaccacaucuucaagggccgggccgcggggaucgccgucaacgagaacggcaaggggcucaucaccgagaacgugauccgcgagaaccaguggggcgggguggacauccggcgcggcggcauccccguccugcgguccaaccugaucugcuucggguacagcgacggcgugguggucggggacgagggcaaggggcucaucgagggcaacaccaucuacgagaacggcaaguacaacgggaagacgcgcuga

SEQ ID NO: 30046 - RNA, 2784 nt, Artificial Sequence
  derived and/or modified sequence opt1 from FBXO11__Homo_sapiens__NP_001177203
augaacagcgugcgcgccgccaaccggcgcccccggcgcgucucccggccgcgccccgugcagcagcagcagcagcagcccccccagcagccgcccccccagcccccgcagcagcagcccccccagcagcagcccccgccccccccccagcagcagcagcagcagcagccgcccccccccccgcccccccccccgccccugccccaggagcggaacaacgugggcgagcgcgacgacgacguccccgcggacaugguggccgaggagagcgggccgggcgcccagaacucccccuaccagcuccggcgcaagacccugcugcccaagcggaccgccugcccgacgaagaacagcauggagggggccuccaccagcaccaccgagaacuucggccaccgcgcgaagcgggcccgcguguccgggaagagccaggaccucuccgccgcccccgcggagcaguaccugcaggagaagcugcccgacgaggucgugcucaagaucuucagcuaccugcuggagcaggaccucugccgggccgccugcgugugcaagcgcuucuccgagcuggccaacgaccccauccuguggaagcggcucuacauggaggucuucgaguacacgcgcccgaugaugcaccccgagcccggcaaguucuaccagaucaaccccgaggaguacgagcacccgaaccccuggaaggagagcuuccagcagcuguacaagggcgcccacgugaagcccggguucgcggagcacuucuacuccaaccccgcccgguacaagggccgcgagaacaugcuguacuacgacaccaucgaggacgcccucgggggcgugcaggaggcccacuucgacgggcugaucuucguccacagcggcaucuacaccgacgaguggaucuacaucgaguccccgaucaccaugaucggcgccgcgcccgggaagguggccgacaaggugaucaucgagaacacgcgggacagcaccuucgucuucauggagggcuccgaggacgccuacgugggguacaugaccauccgcuucaaccccgacgacaagagcgcccagcaccacaacgcccaccacugccuggagaucaccgugaacugcucccccaucaucgaccacugcaucauccgcagcacgugcaccgucggcagcgcggugugcguguccggccagggggccugcccgaccaucaagcacugcaacaucagcgacugcgagaacgucggccucuacaucaccgaccacgcccaggggaucuacgaggacaacgagaucuccaacaacgcccuggccggcaucugggugaagaaccacgggaaccccaucauccggcgcaaccacauccaccacggccgggacgugggcgucuucacguucgaccacgggaugggcuacuucgagagcugcaacauccaccgcaaccggaucgcgggguucgaggugaaggccuacgccaaccccaccgucgugcgcugcgagauccaccacggccagaccgggggcaucuacgugcacgagaagggccgggggcaguucaucgagaacaagaucuacgccaacaacuucgcgggcgucuggaucaccuccaacagcgaccccacgauccgcgggaacuccaucuucaacggcaaccaggggggcguguacaucuucggcgacgggcggggccugaucgaggggaacgacaucuacggcaacgcccucgccggcauccagauccgcaccaacagcugcccgaucgugcggcacaacaagauccacgacgggcagcacggcgggaucuacguccacgagaagggccagggggugaucgaggagaacgagguguacuccaacacccuggccggcgucugggugaccacgggcagcacccccgugcugcgccggaaccgcauccacuccgggaagcaggucggcguguacuucuacgacaacgggcacggcgugcucgaggacaacgacaucuacaaccacauguacagcgggguccagauccggaccggcuccaaccccaagauccgccggaacaagaucuggggcgggcagaacggcgggauccugguguacaacagcggccuggggugcaucgaggacaacgagaucuucgacaacgccauggcgggcguguggaucaagaccgacuccaaccccacgcuccgccggaacaagauccacgacggccgcgacgggggcaucugcaucuucaacgggggccgcgggcugcuggaggagaacgacaucuuccggaacgcccaggccggcguccucaucagcaccaacucccacccgauccugcgcaagaaccggaucuucgacggcuucgccgccgggaucgagaucaccaaccacgcgaccgccacgcuggagggcaaccagaucuucaacaaccgcuucgggggccucuuccuggccagcggcgugaacgugaccaugaaggacaacaagaucaugaacaaccaggacgccaucgagaaggccgucucccgggggcagugccuguacaagaucagcagcuacaccuccuaccccaugcacgacuucuaccgcugccacaccugcaacacgaccgaccggaacgcgaucugcgugaacugcaucaagaagugccaccagggccacgacguggaguucauccgccacgaccgguucuucugcgacugcggggccggcacccucagcaaccccugcacccuggccggggagccgacccacgacacggacacccuguacgacuccgccccccccaucgagagcaacacccuccagcacaacuga

SEQ ID NO: 30047 - RNA, 1533 nt, Artificial Sequence
  derived and/or modified sequence opt1 from FBXO15__Homo_sapiens__NP_001136430
auggccaccggccgcgggcggauccugcagcagcacuggcucggccugcagacccugcgcgggcccagccggggcgggggcgccgcgcgcggccgggcccgcgccuucgggugccggaagggcccgggggugaagcucuccgccggcagcgccgcgcugcgcugccacgccgggggcggccagcacugggaguccagcuucuccugcugcagcggguuccuggacggcaugcccuccgagauccuccugaagaucuucagcuaccuggacgccgucucccuccugugcacggggugcgugagccggcgcuucuaccaccuggccaacgacaacuucaucuggaucggcaucuacuccaccgcguucagccccgcccgguccaacuggaaguucaacagcguggagaagaucgccauguccaugagcuuccucuccguccaggacaaggaggccggcuacuggaagaaggaguacaucaccaagcagaucgccagcgugaaggcggcccuggccgacauccugaagcccgugaacccguacaccgggcuccccgucaagacgaaggaggcccugcgcaucuucggccuggggugggccaucauccucaaggagaagggcgggaaggaguacaucauggagcacguggaccuguccaucaacgacaccagcgugaccgucaucugguacggcaagaaguggcccugccuggcgagccucuccacccuggaccugugcggcaugacgcccguguucaccgacugguacaagaccccgaccaagcaccggcuccgcuggcacagccugaucgccaaguacaaccugucccaccucacgaucagcaccaugaucgggugcgaccggcugauccgcaucuucugccugcaccccggccuccuggugggggucuggaagaaggaggaggagcuggccuucgugauggccaaccuccacuuccaccaccugguggagcgguccacccugggcagcgccaccauccccuacgagcugcccccgcacucccccuuccucgacgacagccccgaguacgggcugcacggcuaccagcuccacgucgaccugcacuccggcgggguguucuaccugugcggcacguuccgcaaccucuucaccaagcgggggaacaucgagaacggccacgugaagcugaucgucauccaccugaagaacaaccgcgagcaccucccccugaucgggaaggugggccugagcuggaagaccgacaucuucgacggcugcaucaaguccugcagcaugauggacgugacccuccuggacgagcacgggaagccguucuggugcuucuccagccccgucugccugcggucccccgcgacgcccagcgacuccagcuccuuccugggccagaccuacaacguggacuacguggacgccgaggggcgcguccacguggagcucgucuggauccgcgagaccgaggaguaccugaucgugaaccuggugcucuaccugagcaucgccaagaucaaccacugguucggcaccgaguacuga

SEQ ID NO: 30048 - RNA, 837 nt, Artificial Sequence
  derived and/or modified sequence opt1 from FBXO17__Homo_sapiens__NP_079183
augggcgcccgccugagccggcgccggcuccccgccgacccgucccuggcgcuggacgcccucccgcccgagcugcuggugcagguccucagccacgugccgccccgcucccuggugacccggugccgccccgucugccgggccuggcgcgacaucguggacgggcccaccguguggcugcuccagcuggcccgggaccgcagcgccgagggccgggcgcuguacgccgucgcccagcgcugccuccccuccaacgaggacaaggaggaguucccccugugcgcccuggcgcgguacugccuccgcgcccccuucgggcggaaccugaucuucaacagcugcggcgagcagggguuccgcggcugggagguggagcacggcgggaacggcugggccaucgagaagaaccugacgcccgugcccggggccccgucccagaccugcuucgucaccagcuucgaguggugcuccaagcggcagcucguggaccuggugauggagggcgucuggcaggagcugcucgacagcgcccagaucgagaucugcguggcggacugguggggcgcccgcgagaacugcgggugcguguaccagcugcggguccgccugcucgacguguacgagaaggagguggucaaguucuccgccagccccgaccccgugcugcaguggaccgagcggggcugccgccaggugucccacgucuucacgaacuucgggaagggcauccgcuacgugagcuucgagcaguacgggcgggacguguccagcugggucggccacuacggcgcccuggugacccacuccagcguccgcgugcggauccgccucuccuga

SEQ ID NO: 30049 - RNA, 2961 nt, Artificial Sequence
  derived and/or modified sequence opt1 from FBXO18__Homo_sapiens__NP_001245381
auggccaagagcaacuccgugggccaggacagcugccaggacuccgagggggacaugaucuuccccgccgagagcuccugcgcgcugccgcaggagggcagcgccgggcccggcucccccgggagcgcgcccccgucccgcaagcggagcugguccagcgaggaggaguccaaccaggccaccggcaccagccgcugggacggcgucuccaagaaggcgccccggcaccaccucagcgugcccugcacgcgcccccgggaggcccgccaggaggccgaggacuccaccagccggcuguccgccgagagcggggagaccgaccaggacgccggcgacguggggccggaccccauccccgacagcuacuacggccugcucgggacccugcccugccaggaggcccugucccacaucugcagccucccguccgagguccugcgccacguguucgccuuccugcccguggaggaccucuacuggaaccugagccuggucugccaccucuggcgggagaucaucuccgacccccuguucauccccuggaagaagcuguaccaccgcuaccucaugaacgaggagcaggccgugagcaagguggacggcauccuguccaacugcggcaucgagaaggagagcgaccugugcguccucaaccugauccgguacacggccaccaccaagugcuccccgagcguggaccccgagcgcgugcuguggucccuccgggaccacccccugcugcccgaggccgaggcgugcguccgccagcaccucccggaccuguacgccgccgccgggggcgugaacaucugggcccugguggcggccgucgugcuccugagcuccagcgugaacgacauccagcggcugcuguucugccugcgccggcccuccagcaccgucacgaugcccgacgugaccgagacccuguacugcaucgccgugcuccuguacgccaugcgcgagaaggggaucaacaucuccaaccggauccacuacaacaucuucuacugccuguaccuccaggagaacagcugcacccaggccacgaaggucaaggaggagcccuccguguggccgggcaagaagaccauccagcugacccacgagcagcagcugauccucaaccacaagauggagccccuccagguggucaagaucauggcguucgccggcaccgggaagacgagcacccuggugaaguacgccgagaaguggagccagucccgcuuccucuacgucaccuucaacaagagcaucgccaagcaggccgagcggguguuccccuccaacgugaucugcaagaccuuccacagcauggcguacggccacaucgggcgcaaguaccaguccaagaagaagcugaaccuguucaagcucacgcccuucauggucaacagcgugcuggccgagggcaagggcggguucauccgcgccaagcuggugugcaagacccucgagaacuucuucgccuccgcggacgaggagcugaccaucgaccacgucccgaucuggugcaagaacagccagggccagcgggugaugguggagcaguccgagaagcugaacgggguccuggaggccagccgccucugggacaacaugcggaagcugggcgagugcaccgaggaggcccaccagaugacgcacgacggguaccugaagcucuggcagcuguccaagcccagccuggccuccuucgacgccaucuucguggacgaggcgcaggacugcacccccgccaucaugaacaucgugcucagccagccgugcggcaagaucuucgucggggacccccaccagcagaucuacaccuuccgcggcgccgugaacgcccuguucaccgugccccacacgcacgucuucuaccugacccaguccuuccgguucggcguggagaucgccuacgugggggcgaccauccucgacgucugcaagcgcgugcggaagaagacccuggugggcgggaaccaccagagcggcauccgcggggacgccaagggccaggucgcccugcucucccggacgaacgccaacguguucgacgaggccgugcgcgucaccgagggcgaguuccccagccggauccaccugaucgggggcaucaagagcuucgggcuggaccgcaucaucgacaucuggauccuccugcagccggaggaggagcggcgcaagcagaaccuggugaucaaggacaaguucauccggcgcugggugcacaaggagggcuucuccggcuucaagcgguacgucaccgcggccgaggacaaggagcucgaggccaagaucgccgugguggagaaguacaacauccgcauccccgagcugguccagcggaucgagaagugccacaucgaggaccuggacuucgcggagauggagagccaccacguggggcaggccggccucgagcugcccaccuccgaguacauccuggggacggugcacaaggccaagggccucgaguucgacaccguccacgugcuggacgacuucgugaagguccccugcgcccgccacaaccugccgcagcucccccacuuccgcguggagagcuucuccgaggacgaguggaaccugcuguacguggccgucacccgggcgaagaagcgccucaucaugaccaagagccuggagaacauccugacccucgccggggaguacuuccugcaggccgagcugacguccaacgugcucaagaccggcgugguccggugcugcgugggccagugcaacaacgccauccccguggacaccguccugaccaugaagaagcugcccaucacguacagcaaccgcaaggagaacaagggcggguaccucugccacuccugcgccgagcagcggaucgggccgcuggcguuccugaccgccagccccgagcagguccgcgccauggagcggaccguggagaacaucgugcucccccgccacgaggcccugcuguuccucguguucuga

SEQ ID NO: 30050 - RNA, 540 nt, Artificial Sequence
  derived and/or modified sequence opt1 from FBXO28__Homo_sapiens__NP_001129587
auggccgccgcggccgaggagcgcauggccgaggagggcgggggcgggcagggcgacgggggcagcucccuggccagcggcuccacccagcggcagcccccgccgcccgcgccccagcacccccagcccgggagccaggcccuccccgcccccgcccuggccccggaccagcugccccagaacaacacccucguggcgcugcccaucgucgccaucgagaacauccuguccuucaugagcuacgacgagaucucccagcuccgccuggugugcaagcggauggaccuggugugccagcgcaugcucaaccagggcuuccugaaggucgagcgguaccacaaccugugccagaagcaggucaaggcccagcucccccgccgggagagcgagcgccggaaccacucccuggcccgccacgccgacauccuggcggccguggagacgcggcucagccugcugaacaugaccuucaugaaguacguggacuccaaccucugcugcuucaucccggggaaguuccaggaccgccugcagcccuga

SEQ ID NO: 30051 - RNA, 2238 nt, Artificial Sequence
  derived and/or modified sequence opt1 from FBXO30__Homo_sapiens__XP_005267216
auggaggaggagcugcagcacagccacugcgugaacugcgucucccgccggugcaugacccgccccgagccgggcaucagcugcgaccucaucgggugcccccuggugugcggcgccguguuccacuccugcaaggccgacgagcaccggcugcucugccccuucgagcgcguccccugccugaacagcgacuucgggugcccguucaccauggcgcggaacaagguggccgagcaccuggagaugugccccgccuccguggucugcugcacgauggaguggaaccgcuggcccgugagcuacgccgaccggaaguccuacgagaaccucagccgcgacguggacgaggucgcccagcuggacauggcgcuggcccuccaggaccagcggaugcugcuggagucccucaagguggccaccaugaugagcaaggccaccgacaagguguccaagccccgcgagcagaucagcgucaaguccagcgugccggagaucccccacgcgaacggccugguguccgucgacgaggagagcuacggggcccuguaccaggccaccguggagacgacccggucccucgccgccgcgcuggacauccugaacaccgccacccgcgacaucggcaugcucaacacgagcgugcccaacgacauggacgagcagcagaacgcccgggagucccuggaggaccagaaccugaaggaccaggaccaccucuacgaggaggagaucggcgccgucgggggcaucgacuacaacgacaccaaccagaacgcccagagcgagcagaacgggagcuccgaccugcugugcgaccucaacaccagcuccuacgacaccagcgcgcugugcaacggcuucccccuggagaacaucugcacccaggugaucgaccagaaccagaaccuccacggggacuccaagcagagcaaccugacgaacggcgacugcguggccuccagcgacggcaccuccaagccgagcuccagccuggccgucgccgcccagcuccgcgagaucauccccuccagcgcgcugcccaacgggaccgugcagcacauccugaugcccgacgacgagggcgagggggagcucugcuggaagaagguggaccugggcgacgucaagaacguggacguccuguccuucagccacgccccguccuucaacuuccucagcaacuccugcuggagcaagcccaaggaggacaaggccguggacacgagcgaccuggagguggccgaggaccccaugggccugcaggggaucgaccucaucaccgccgcgcugcuguucugccucggcgacucccccgggggccgggggaucagcgacucccgcauggccgacaucuaccacaucgacgucggcacccagaccuucagccugccguccgccauccuggccacgagcaccauggugggcgagaucgcguccgccagcgccugcgaccacgccaacccccagcucuccaaccccagccccuuccagacccuggggcuggaccucgugcuggagugcgucgcccgguaccagccgaagcagcgcuccauguucaccuucgugugcggccagcuguuccggcgcaaggaguucagcucccacuucaagaacgugcacggggacauccacgcgggccugaacggguggauggagcagcggugcccccucgccuacuacggcugcacguacagccagcgccgcuucugccccuccauccagggcgccaagaucauccacgaccggcaccuccgcagcuucgggguccagcccugcguguccaccgugcuggucgagccggcccggaacugcgugcugggccugcacaacgaccaccugagcagccuccccuucgaggugcugcagcacaucgccggguuccuggacggcuucucccucugccagcugagcugcgucuccaagcugaugcgcgacgugugcgggagccuccugcagucccggggcauggugauccugcaguggggcaagcgcaaguaccccgaggggaacagcuccuggcagaucaaggagaaggucuggcgguucagcaccgcguucugcuccgugaacgaguggaaguucgccgacauccucagcauggccgaccaccugaagaagugcuccuacaacguggucgagaagcgcgaggaggccaucccgcugcccugcaugugcgugacccgggagcucacgaaggagggccgcagccugcgguccgugcugaagcccguccucuga

SEQ ID NO: 30052 - RNA, 1104 nt, Artificial Sequence
  derived and/or modified sequence opt1 from FBXO31__Homo_sapiens__NP_001269612
auguaccugcccccgcacgacccccacguggacgaccccaugcgcuucaagccccucuuccggauccaccugauggagcgcaaggccgccaccgucgagugcauguacggccacaaggggccgcaccacggccacauccagaucgugaagaaggacgaguucagcaccaagugcaaccagacggaccaccaccggauguccgggggccgccaggaggaguuccggaccuggcugcgcgaggagugggggcggacccucgaggacaucuuccacgagcacaugcaggagcugauccugaugaaguucaucuacaccagccaguacgacaacugccucacguaccgccggaucuaccugccgcccucccgccccgacgaccugaucaagcccggccucuucaagggcaccuacgggagccacggccuggagaucgugaugcuguccuuccacgggcggcgcgcgcggggcaccaagaucaccggggaccccaacauccccgccggccagcagacggucgagaucgaccuccgccaccggauccagcugcccgaccuggagaaccagcgcaacuucaacgagcucagccggaucgugcuggaggugcgcgagcggguccgccaggagcagcaggagggcgggcacgaggccggcgaggggcggggccgccagggcccgcgcgagucccagcccagccccgcccagccccgggccgaggcgccguccaaggggcccgacggcacccccggggaggacggcggggagcccggcgacgccguggccgccgcggagcagccggcccagugcggccaggggcagcccuucgugcugcccgucggcgugagcucccgcaacgaggacuacccccggaccugccgcaugugcuucuacgggaccggccucaucgccgggcacggcuucacgagcccggagcggacccccggcguguucauccuguucgacgaggaccgcuucggguucgucuggcuggagcucaaguccuucagccuguacucccgggugcaggccaccuuccgcaacgccgacgcgcccagcccccaggccuucgacgagaugcugaagaacauccagucccucaccagcuga

SEQ ID NO: 30053 - RNA, 789 nt, Artificial Sequence
  derived and/or modified sequence opt1 from FBXO32__Homo_sapiens__NP_001229392
augcccuuccugggccaggacuggcgcagcccggggcagaacugggugaagaccgccgacggcuggaagcgguuccucgacgagaaguccgggagcuucgucuccgaccugagcuccuacugcaacaaggagguguacaacaaggagaaccuguucaacagccucaacuacgacguggccgcgaagaagcgcaagaaggacaugcugaacuccaagaccaagacgcaguacuuccaccaggagaaguggaucuacguccacaagggcagcaccaaggagcggcacggguacugcacccugggcgaggccuucaaccgccucgacuucuccaccgccauccuggacagccggcgcuucaacuacguggugcggcccgccuucaagggccugacguucaccgaccucccccugugccugcagcucaacaucaugcagcgccuguccgacgggcgggaccuggucagccucggccaggccgcgcccgaccugcacgugcuguccgaggaccgccuccuguggaagaagcugugccaguaccacuucagcgagcggcagauccgcaagcggcucauccuguccgacaaggggcagcuggacuggaagaagauguacuucaagcucgugcgcugcuacccgcggaaggagcaguacggcgacacccugcagcugugcaagcacugccacauccucagcuggaaggggaccgaccaccccugcacggccaacaaccccgaguccugcagcgucucccugagcccccaggacuucaucaaccuguucaaguucuga

SEQ ID NO: 30054 - RNA, 1668 nt, Artificial Sequence
  derived and/or modified sequence opt1 from FBXO33__Homo_sapiens__NP_976046
augcuccuguuccugagcgugccccagccgcgcccgcccggcgcccggacccgcgccggggcggcccgggucgcccgcuggcggcgccugcggcuccagcagcugcgccggcugcgcggccuccugcgggugcugcgcgggcggcccggcgccgggucccgccggcgcggccggauggcccucugcggccaggcggccggggccgccagccugcccuccgagcugaucgugcacaucuucagcuuccuccccgcgcccgaccgccugcgggccuccgccagcugcucccacuggcgcgagugccuguucuaccccgcccucuggccgcagcugcggaucugccugcgcgucagccccgccgagcagccccgccucgaguuccugaugcggaagugcggcugguucgugcgcgagcugcggguggaguucgcggccgagaacuaccucuccgggggcgggcccggcgacggcgggggcgccgacaccgggacgggcggcgaggaggucgaggcccugcagcugagcgcccgcuggcucgaggugcugcggaccuaccuggagcucgugcugugcguccugguguccauccgcaacaaccggaaccuccagaaguucagccuguucggggacaucuccgugcugcagcagcagggcagccucuccaacaccuaccugagcaaggucgacccggacgggaagaagaucaagcagauccagcagcuguucgaggagauccucuccaacagccgccagcugaaguggcuguccugcggcuucaugcucgagaucgugacccccacgagccugagcucccugagcaacgcgguggccaacaccauggagcaccucucccugcuggacaacaacauccccgggaacagcacccucaucaccgccgucgagcuggagcgguucgugaaccugcacucccucgcccuggacuucugcgacuucacggccgagauggcgcgcgugcugaccgacagcaaccacgucccccugcagcggcucucccugcuggugcacaacgugagcgucaugcacaagucccucgacaacaugccgaacgacgagcacuggaaggcccugagccgcaaguccaccagcuuccggguguacaucauggccuucgacaucaaguccgaggacaugcugaagauccucaagcccagcaucccccuggagcgcauccacuucgacuccuacaucacgugcgugagcggcgccaucgucgaccugaucucccggcaguacgacaaguuccucacccacuucauccugaugaacgacgugaucgacaccagcggcuuccccgaccuguccgacaaccgcaacgaggacccgcucguccugcuggccuggcggugcaccaagcucagccugcuggcgauccacggguacaccgugugggcccacaaccucaucgccaucgcccgccugcggggcagcgaccugaaggugcucgaggucacggaggaguccaucgacuucgaccagggggagcuggcggaccaggacguggaccccgugcacaaccugaucgagcaggucagccucggccuggggcagcccuggcacgccgugauggacaucgagucccugagcguguucaccgagcccaaccgccacuucuaccgcgagaugcaguccuucagcgaggacaucuga

SEQ ID NO: 30055 - RNA, 2832 nt, Artificial Sequence
  derived and/or modified sequence opt1 from FBXO38__Homo_sapiens__NP_001258652
augggcccccgcaagaaguccgugaagaccugcaucaugaacaacgagaucccggaggagaugaccgccgacgagacgaaggacuacaugaaccagcugagccacgagguccucugccacaucuuccgguaccugccccugcaggacaucaugugcauggagugccucagccgcaagcugaaggaggccgugacccuguaccuccgggugguccgcgugguggaccugugcgcggggcgguggugggaguacaugcccuccggcuucaccgacgccagcuuccugacccuccugaagaagaugcccgacgucgagcagcuguacgggcuccacccgcgcuaccuggagcggcgccgggugcgcggccacgaggccuucuccauccccggggugcuggaggcccuccaggccugccccaaccuggucggcguggagacgagccaccuggagcucguggaguccaucuggaccuacaugccccacguccacauccugggcaaguuccggaaccgcaacggggcguucccgaucccgcccgagaacaagcugaagauccccaucggcgccaagauccagacccuccaccuggugggggugaacguccccgagauccccugcauccccaugcugcggcaccucuacaugaagugggugcgccugaccaagccccagccguucaaggacuuccugugcaucagccuccggacguucgugaugcgcaacugcgccggccccaccaacucccugaaguacgucccccuggugaccgggcucgccagcgcgcggaaccuggagcaccuggagauggugcgcguccccuuccucggcggccugauccagcacgugguggaggacuccuggcggagcgggggcuuccgcaaccugcacaccaucguccucggggccugcaagaacgcccuggagguggaccugggcuaccucaucaucacggccgcccggcgccugcacgagguccgcauccagccgucccugaccaaggacggcguguucagcgcgcucaagauggccgagcuggaguucccccaguucgagacccugcaccucggguacguggacgaguuccugcugcagucccggauggccaacgccgaccucgucaaguacggccuggccgacgugguggagaaccccgggaucaucaccgacaucggcaugaaggcggucaacgagguguucagcugcaucaaguaccuggccaucuacaacugcccccaccuccacaacccguacaacuggaucuccgaccacagccgcuggacgcggcugguggacaucaaccugguccgcugccacgcccugaagcucgacuccuucgggcaguucaucgagcugcugcccagccucgaguucaucagccuggaccagauguuccgggagccgcccaagggcugcgcccgcgugggccuguccgccgggaccggcaucggggugagcuccgcgcucgucagcaaccagaacuccaacaacgacgacaacaacgcccagaacaacaacgccaacauccacgacaacaaccaccaccaccccgacgacagcgacgaggagaacgacuuccggcaggaccugcagcccggcgagcagcaguucgccgccgacgcgcugaacgagauggaggacaucgugcaggaggacggggagguggucgccgaguccggcaacaacacccccgcccacagccaggccaucaucccgguggacguggacgaggagcaggcgggccccuccgggcuccagcgcgucgugaagcccaccagcaucacggugcacgacuccgagagcgacgacgaggaggacucccuggagcugcaggaggucuggauccccaagaacggcacccggcgcuacagcgagcgggaggagaagaccggggaguccgugcagagccgcgagcucuccgagguggccaagaccaagccgcggcacgccaugaagcgcaagcggacggccgacaagagcaccuccaccagcgaccccgucaucgaggacgaccacguccaggugcuggugcucaagagcaagaaccuggugggcgugaccaugacgaacugcgggaucaccgaccugguccugaaggacugccccaagaugauguucauccacgccacccgcugccgggugcucaagcaccugaagguggagaacgcgcccaucgucaaccgcuucgacuacgcccagugcaagaagcugaacauggaccaggugcucgaccagauccugcggaugccgcccgagcgcaaccgcaucaucuaccugcggcccaugcagcaggucgacacccucacgcuggagcagaagcuguucuccggccccuacccguaccacaucugcaucauccacgaguucagcaacccgcccaacgugcgcaacaaggugcggauccgcuccuggauggacaccaucgccaacaucaaccaggagcucaucaaguacgaguucuuccccgaggccacccggagcgaggaggaccugaagaaguaccccaaguaccccuggggccgcgagaucuacacccuggaggggguggucgacggcgcccccuacuccaugaucagcgacuuccccuggcuccggucccugcgcgcggccgagccgaacagcuucgcccgguacgacuucgaggacgacgaggaguccacgaucuacgcgccccgccggaaggggcagcugagcgccgacaucugcauggagaccaucggcgaggagaucuccgagaugcgccagaugaagaagggcguguuccagcggguggucgccaucuucauccacuacugcgacgugaacggggagcccguggaggacgacuacaucuga

SEQ ID NO: 30056 - RNA, 1416 nt, Artificial Sequence
  derived and/or modified sequence opt1 from FBXO3__Homo_sapiens__NP_036307
auggccgccauggagaccgagaccgcgccccugacgcucgagagccugccgaccgacccccugcuccugauccuguccuuccucgacuaccgcgaccugaucaacugcugcuacgugagccggcgccugucccagcucagcucccacgacccccuguggcggcgccacugcaagaaguacuggcugaucagcgaggaggagaagacccagaagaaccagugcuggaagucccucuucaucgacaccuacagcgacgucggccgguacaucgaccacuacgccgccaucaagaaggccugggacgaccugaagaaguaccuggagccccgcugcccgcggauggugcucucccugaaggagggggcccgcgaggaggaccuggacgcgguggaggcccagaucggcugcaagcuccccgacgacuaccggugcagcuaccgcauccacaacgggcagaagcuggucgugcccggccugcucggguccauggcccugagcaaccacuaccgguccgaggaccugcucgacguggacacggccgcgggcggcuuccagcagcgccaggggcugaaguacugccugccccucaccuucugcauccacaccggccugagccaguacaucgccgucgaggccgccgaggggcggaacaagaacgagguguucuaccagugcccggaccagauggcccgcaaccccgcggccaucgacauguucaucaucggcgccaccuucacggacugguucaccuccuacgugaagaacgucgugagcgggggcuuccccaucauccgggaccagaucuuccgcuacgugcacgaccccgagugcgucgccaccaccggcgacaucacgguguccgugagcaccuccuuccugccggagcucagcagcguccacccgccccacuacuucuucaccuaccggauccgcaucgagauguccaaggacgcccugcccgagaaggcgugccagcuggacagccgguacuggcgcaucaccaacgccaagggggacguggaggaggugcagggccccggggucgugggcgaguuccccaucaucucccccggccggguguacgaguacacgagcugcaccaccuucuccaccacgagcggguacauggagggcuacuacaccuuccacuuccucuacuucaaggacaagaucuucaacgucgccaucccccgcuuccacauggccugcccgaccuuccgcguguccaucgcccggcuggagauggggcccgacgaguacgaggagauggaggaggaggaggaggaggaggaggaggaggacgaggacgacgacagcgcggacauggacgaguccgacgaggacgacgaggaggagcgccggcgccggguguucgacguccccauccgccggcgccggugcagccgccuguucuga

SEQ ID NO: 30057 - RNA, 2130 nt, Artificial Sequence
  derived and/or modified sequence opt1 from FBXO40__Homo_sapiens__NP_057382
augggcaaggcccgccggagcccgcccgggcaccaccgccacugcgagggcugcuucaaccggcacugccacauccccguggagcccaacaccuccugccuggucaucagcugccaccuccugugcggggccaccuuccacaugugcaaggaggcggagcaccagcugcucugcccccuggagcaggucccgugccugaacuccgaguacggcugcccccucagcaugucccgccacaagcuggccaagcaccuccaggugugccccgccagcguggugugcugcuccauggaguggaaccgguggcccaacguggacagcgagacgacccuccacgagaacaucaugaaggagaccccguccgaggagugccuggacaccgcccuggcccuccaggaccagaagguccuguuccgcagccugaagaugguggagcuguuccccgagacgcgggaggcgaccgaggaggagcccaccaugaacggggagaccuccguggaggagaugggcggcgccgucgggggcguggacaucgggcuggugccccacggccugagcgccacgaacggggagauggccgagcucucccaggaggagcgcgagguccuggcgaagaccaaggagggcauggaccuggugaaguucggccagugggagaacaucuucagcaaggagcacgccgccuccgcccucaccaacagcuccgccagcugcgaguccaagaacaagaacgacagcgagaaggagcagaucagcuccgggcacaacaugguggagggcgagggggcgccgaagaagaaggagccccaggagaaccagaagcagcaggacguccggaccgccauggagacgaccggccuggcccccuggcaggacggcgugcuggagcgccucaagaccgccguggacgccaaggacuacaacauguaccugguccacaacgggcggaugcugauccacuucggccagaugcccgcgugcaccccgaaggagcgcgacuucguguacgggaagcucgaggcccaggaggugaagacggucuacaccuucaaggugcccgugagcuacugcggcaagcgggcccgccugggggacgccaugcuguccugcaagcccagcgagcacaaggccgucgacaccuccgaccucggcaucaccguggaggaccugcccaagagcgaccugaucaagacgacccuccagugcgcgcuggagcgggagcugaagggccacgucaucuccgagagccgcuccaucgacgggcuguucauggacuucgccacccagaccuacaacuucgagccggagcaguucagcuccggcacggugcuggccgaccugaccgccgccacccccgggggccuccacguggagcugcacagcgagugcgucacccggcgccacaacaaguccagcuccgcguucacguucacgugcaacaaguucuuccggcgcgacgaguucccccugcacuucaagaacgugcacaccgacauccagagcugccucaacgggugguuccagcaccggugcccccuggccuaccugggcugcaccuucgugcagaaccacuuccgcccgcccggccagaaggccaaggucaucuacucccaggagcucaagaccuucgccaucaagcccgagguggcgcccgagcugagcgaggggcgcaagaacaaccaccuccucggccacgggggcaagucccagaacagccugaccagccugccgcuggagauccucaaguacaucgccggguuccuggacuccgugagccuggcccagcucucccaggucagcgugcugaugcggaacaucugcgccacccugcuccaggagcgcggcauggugcugcugcaguggaagaagaagcgguacucccacggcgggaccagcuggcgcguccaccgggagaucuggcaguucuccagccucuucuccaagaucaagagcugggaguucaacgaggugacguccaugagcgagcaccugaaguccugccccuucaacaucguggagcacaagaccgaccccauccugcucaccagcaugugccagccgcgcgagcaggcccgggagucccuggucagcaccuuccgcauccggccccgcggccgguacguguccuga

SEQ ID NO: 30058 - RNA, 1359 nt, Artificial Sequence
  derived and/or modified sequence opt1 from FBXO47__Homo_sapiens__XP_011523166
auggccagccgcaucaacaccaacuucacccugauccccaaccagaagcuccggcgcuccaaccggcagaccagcugcuacuccaagacccugggcagcggguuccagccgaucuccaccuucggcaacuucaaggcccugccccucgagaucuuccagaucauccugaaguaccugagcgugaaggacaucuccaugcucagcauggucuccaagaccgugagccagcacaucaucaacuacaucuccacgagcuccgggagcaagcgccugcugcuccaggacuuccacaaccuggagcugcccgaccggcgccaggacuccgcgauccucgagcacuaccggagccugggccuccuguucaagcgcugcacccugcugcuccccaccaaggagcggcugaaguacauccacaagauccugaccgagguguccugcuucaaguucaacgggugcgccgccccgaugcagugccucggccugacgugcuacggcauguuccugcagacccucaccgccgggugggacgagcuggagugccaccgcgucuacaacuuccugugcgagcucaccaaccugugccggaagauccagauggccgugugcagcaagcccggcuccgcgcagaagcuggagcuccgcauccggcuguucugccgcaacgugcugcucgaccacuggacgcaccggagcgacagcgccuucuggcugacccgcauccugaagcccuggcccauggucaaccaggcccggcuccuguacaucaucuucgggccgaucagcccccaggacggccaggugguguggcaggagaugaucgaggagcccaccgacgaguucucccugaaggggcucgccgacgcgaucaagcugcuguacgacgccuccaccaaggaguggacggccgacgacgucaucagccucguggacgagcuguccguggucccccgcgaguggcugcucgagaacaacgcccggcugcugaugcucagcggcaacaacaucugcuucuccuucauggccagcaaggcggugaacggccgcaccaucgagcuggcccggcugguggucuuccuggcccucgugugcgagaaggagcuguacugcauggacuggaccgugaagaugaugcagaaggucugcaagguguucuccaccccgguggagcgcaagaacuuccugcagaacgucgccaacgccuucgcgugcgugaucauggagaugcuccagagcaucauguccggggaccgcgacgaggacgaccggagcuuccugaaccuguuccaccucgugcacgcccaggccaacuuccacaaggagguccuguaccugacgaugaacacgccccucuccaccuga

SEQ ID NO: 30059 - RNA, 1164 nt, Artificial Sequence
  derived and/or modified sequence opt1 from FBXO4__Homo_sapiens__NP_036308
auggccggcagcgagccccgcuccgggaccaacagcccgcccccgcccuucuccgacuggggccggcuggaggccgcgauccucagcggguggaagaccuucuggcaguccgugagcaaggagcgcgucgcccggacgaccucccgcgaggagguggacgaggccgccagcacccugacccggcugcccaucgacgugcagcucuacauccuguccuuccugagcccccacgaccucugccagcugggcuccacgaaccacuacuggaacgagaccguccgcgaccccauccuguggcgguacuuccuccugcgcgaccugcccagcugguccagcguggacuggaagucccucccggaccuggagauccugaagaagcccaucagcgaggugaccgacggggccuucuucgacuacauggcggucuaccggaugugcugccccuacacccgccgggccuccaagagcucccgccccauguacggcgccgugacgagcuuccuccacagccugaucauccagaacgagccgcgguucgccauguucggccccgggcuggaggagcucaacaccucccuggugcugagccucauguccagcgaggagcugugccccaccgcgggccugccccagcgccagaucgacgggaucggcuccggggucaacuuccagcucaacaaccagcacaaguucaacauccugauccuguacagcaccacgcggaaggagcgcgaccgggcccgcgaggagcacaccuccgccgugaacaagauguucagccggcacaacgagggcgacgaccagcagggcucccgcuacagcgugaucccgcagauccagaaggucugcgaggugguggacggguucaucuacgucgccaacgccgaggcgcacaagcggcacgaguggcaggacgaguucucccacaucauggccaugaccgaccccgccuucggcagcuccgggcgcccccuccuggugcugagcugcaucucccagggcgacgugaagcgcaugcccugcuucuaccucgcccacgagcugcaccugaaccuccugaaccacccguggcugguccaggacaccgaggccgagacgcucaccggcuuccugaacgggaucgaguggauccuggaggagguggagagcaagcgggcgcgcuga

SEQ ID NO: 30060 - RNA, 1206 nt, Artificial Sequence
  derived and/or modified sequence opt1 from FBXO5__Homo_sapiens__NP_001135994
augaagugcgacuucaacugcaaccacgugcacagcggccugaagcucgucaagcccgacgacaucgggcgccugguguccuacaccccggccuaccuggagggcagcugcaaggacugcaucaaggacuacgagcggcucuccugcaucgggagccccaucgugagcccccgcaucguccagcuggagaccgaguccaagcggcugcacaacaaggagaaccagcacgugcagcagacgcucaacuccaccaacgagaucgaggcccuggagaccagccgccuguacgaggacuccggcuacagcuccuucagccuccaguccgggcugagcgagcacgaggagggcucccugcucgaggagaacuucggcgacagccugcaguccugccugcuccagauccagagccccgaccaguacccgaacaagaaccugcugcccgugcuccacuucgagaaggucgugugcuccacccugaagaagaacgcgaagcggaaccccaagguggaccgcgagaugcugaaggagaucaucgcccgggggaacuuccgccuccagaacaucaucggccggaagauggggcuggagugcgucgacauccugagcgagcuguuccgccggggccuccgccacgugcuggccacgauccucgcccagcugagcgacauggaccugaucaacguguccaaggucagcaccaccuggaagaagauccucgaggacgacaagggggccuuccagcuguacuccaaggcgauccagcgggugaccgagaacaacaacaaguucagcccccacgccuccacgcgcgaguacgugauguuccggaccccgcuggccagcguccagaaguccgccgcgcagaccagccucaagaaggacgcccagaccaagcuguccaaccagggcgaccagaagggcagcacguacucccgccacaacgaguucagcgagguggccaagacccugaagaagaacgagucccucaaggccugcauccggugcaacagccccgccaaguacgacugcuaccugcagcgcgcgaccugcaagcgggaggggugcggcuucgacuacugcaccaagugccugugcaacuaccacacgaccaaggacugcuccgacgggaagcuccugaaggccagcugcaagaucggcccccugcccggcaccaagaaguccaagaagaaccuccgccggcuguga

SEQ ID NO: 30061 - RNA, 1332 nt, Artificial Sequence
  derived and/or modified sequence opt1 from FBXO7__Homo_sapiens__NP_001028196
auggcccggcccccgggcgggagcggcccccugcucgacuccgagcacagcucccugcagaacaacgagcagcccagccuggccaccuccagcaaccagaccuccaugcaggacgagcagcccagcgacuccuuccaggggcaggcggcccagagcggcguguggaacgacgacuccaugcucgggccgagccagaacuucgaggccgaguccauccaggacaacgcccacauggccgagggcacgggcuucuaccccagcgagcccaugcugugcuccgagagcgucgagggccaggugccccacucccuggagacccucuaccagagcgcggacugcuccgacgccaacgacgcccugaucgugcugauccaccuccugaugcuggagagcggguacaucccgcaggggaccgaggccaaggcgcucagcaugcccgagaaguggaagcuguccggcgucuacaagcugcaguacaugcacccccucugcgaggggagcuccgccacccugacgugcgugccccugggcaaccucaucguggucaacgccacccugaagaucaacaacgagauccgcagcgugaagcgccugcagcuccugccggaguccuucaucugcaaggagaagcugggcgagaacguggccaacaucuacaaggaccuccagaagcugagccggcuguucaaggaccagcucgucuacccccugcuggccuucacccgccaggcgcucaaccugcccgacguguucgggcuggugguccucccccuggagcugaagcuccggaucuuccgccugcuggacgugcgguccgugcucagccuguccgccgucugccgcgaccuguucaccgccagcaacgacccgcuccuguggcgguuccuguaccuccgcgacuuccgggacaacacggugcgcgugcaggacaccgacuggaaggagcuguaccggaagcgccacauccagcggaaggagucccccaagggccgcuucgucaugcugcuccccagcuccacccacaccauccccuucuacccgaacccccugcacccccggcccuucccgagcucccgccugccgcccgggaucaucggcggcgaguacgaccagcggcccacgcugcccuacgugggggaccccaucagcucccucauccccggcccgggggagacccccagccaguucccgccccugcgcccccgguucgaccccgugggcccccugcccgggccgaaccccauccuccccggccgcggcgggcccaacgaccgcuucccguuccggcccucccgcggccggcccaccgacgggcgccugagcuucauguga

SEQ ID NO: 30062 - RNA, 960 nt, Artificial Sequence
  derived and/or modified sequence opt1 from FBXO8__Homo_sapiens__NP_036312
augggccaggggcuguggcgcgugguccggaaccagcagcuccagcaggagggcuacagcgagcagggguaccugacccgcgagcagucccggcgcauggccgccagcaacaucuccaacaccaaccaccggaagcagguccagggcgggaucgacaucuaccaccuccugaaggcgcgcaagagcaaggagcaggagggcuucaucaaccuggagaugcugcccccggagcucuccuucacgauccugagcuaccugaacgccaccgaccucugccuggccuccugcguguggcaggaccuggccaacgacgagcuccuguggcagggccugugcaagagcaccugggggcacugcuccaucuacaacaagaacccgccccucggcuucagcuuccggaagcuguacaugcagcuggacgaggggucccucaccuucaacgccaaccccgacgagggcgugaacuacuucaugagcaaggggauccuggacgacucccccaaggagaucgcgaaguucaucuucugcacgcgcacccugaacuggaagaagcuccggaucuaccuggacgagcgccgggacgugcuggacgaccucgugacccugcacaacuuccgcaaccaguuccugcccaacgcccuccgggaguucuuccgccacauccacgcccccgaggagcggggcgaguaccuggagacccugaucacgaaguucagccaccgcuucugcgccugcaaccccgaccucaugcgggagcugggccuguccccggacgcggucuacgugcucugcuacagccugauccugcucuccaucgaccugaccagcccccacgugaagaacaagauguccaagcgcgaguucauccggaacacccgccgggccgcccagaacaucagcgaggacuucgucgggcaccuguacgacaacaucuaccucaucggccacguggccgccuga

SEQ ID NO: 30063 - RNA, 1344 nt, Artificial Sequence
  derived and/or modified sequence opt1 from FBXO9__Homo_sapiens__NP_036479
augcccgacaucaucuggguguucccgccccaggccgaggccgaggaggacugccacagcgacaccguccgcgcggacgacgacgaggagaacgagucccccgccgagaccgaccugcaggcccagcuccagauguuccgggcccaguggauguucgagcuggcccccggcgugagcuccagcaaccuggagaaccgcccgugccgggcggcccgcgggucccuccagaagacgagcgccgacaccaagggcaagcaggagcaggccaaggaggagaaggcgcgggagcuguuccugaaggccguggaggaggagcagaacggggcccucuacgaggccaucaaguucuaccgccgggccaugcagcugguccccgacaucgaguucaagaucaccuacacccgcucccccgacggcgacggggugggcaacagcuacaucgaggacaacgacgacgacuccaagauggcggaccugcucagcuacuuccagcagcagcugacguuccaggaguccgugcugaagcucugccagcccgagcuggagagcucccagauccacaucagcguccugccgauggaggugcucauguacaucuuccgguggguggucuccagcgaccuggaccugcgcucccucgagcagcugagccuggugugccggggcuucuacaucugcgcccgcgaccccgagaucuggcggcucgccugccugaaggugugggggcgcuccugcaucaagcugguccccuacaccagcuggcgggagauguuccucgagcgcccccgggugcgcuucgacggcguguacaucagcaagaccaccuacauccggcagggggagcagucccuggacggcuucuaccgcgccuggcaccaggucgaguacuaccgguacauccgcuucuucccggacgggcacgugaugaugcugacgacccccgaggagccccagagcaucgugccccgccuccggacccgcaacacccggacggacgccauccugcugggccacuaccgccucucccaggacaccgacaaccagaccaaggucuucgcggugaucaccaagaagaaggaggagaagccgcuggacuacaaguaccgguacuuccgccgggugcccguccaggaggccgaccagagcuuccacgugggccugcagcucugcuccagcgggcaccagcgcuucaacaagcugaucuggauccaccacuccugccacaucacguacaagagcaccggcgagaccgccguguccgccuucgagaucgacaagauguacacgccccuguucuucgcccggguccgcagcuacaccgcguucuccgagcggccccucuga

SEQ ID NO: 30064 - RNA, 1629 nt, Artificial Sequence
  derived and/or modified sequence opt1 from FBXW11__Homo_sapiens__NP_036432
auggagcccgacagcgugaucgaggacaagaccaucgagcugaugugcuccgucccgcgcagccucuggcugggcugcgccaaccugguggaguccaugugcgcccucagcugccugcaguccaugcccagcgugcggugccugcagaucuccaacgggaccagcuccgucaucgugagccgcaagcggcccuccgagggcaacuaccagaaggagaaggaccucugcaucaaguacuucgaccaguggagcgaguccgaccagguggaguucgucgagcaccugaucagccgcaugugccacuaccagcacgggcacaucaacuccuaccugaagcccaugcuccagcgggacuucaucacggcgcugccggagcagggccuggaccacaucgccgagaacauccucagcuaccuggacgcccgcucccugugcgccgccgagcucgugugcaaggaguggcagcgggugaucagcgaggggaugcuguggaagaagcugaucgagcgcaugguccggaccgacccccucuggaagggccuguccgagcgccggggcugggaccaguaccuguucaagaaccgccccaccgacgggcccccgaacagcuucuaccggagccucuaccccaagaucauccaggacaucgagaccaucgaguccaacuggcgcugcggccggcacaaccugcagcgcauccagugccggagcgagaacuccaaggggguguacugccugcaguacgacgacgagaagaucaucagcggccuccgcgacaacuccaucaagaucugggacaagacgagccuggagugccugaaggugcucaccgggcacaccggcuccguccugugccugcaguacgacgagcgggugaucgugaccggcagcuccgacagcacgguccgcgugugggacgugaacaccggggagguccucaacacccugauccaccacaacgaggcggugcugcaccuccgguucuccaacggccugauggugaccugcagcaaggaccgcuccaucgccgucugggacauggccagcgccacggacaucacccugcgccgggugcucguggggcaccgcgcggccgucaacguggucgacuucgacgacaaguacaucguguccgccagcggcgaccggaccaucaaggugugguccaccagcacgugcgaguucguccgcacccugaacggccacaagcgggggaucgccugccugcaguaccgcgaccggcucgugguguccggcagcagcgacaacaccauccgccugugggacaucgagugcggggccugccugcggguccucgagggccacgaggagcuggugcgcugcauccgguucgacaacaagcgcaucguguccggggcguacgacggcaagaucaaggucugggaccugcaggccgcccucgacccccgggcccccgccagcacccugugccugcgcacgcucguggagcacuccggccggguguuccgccugcaguucgacgaguuccagaucaucagcuccagccacgacgacaccauccugaucugggacuuccugaacgucccgcccuccgcgcagaacgagacccggagccccucccgcaccuacacguacaucagccgguga

SEQ ID NO: 30065 - RNA, 1239 nt, Artificial Sequence
  derived and/or modified sequence opt1 from FBXW4__Homo_sapiens__NP_071322
auggccgccgcggccggcgaggaggaggaggaggaggaggccgcccgcgagagcgccgcgcggcccgccgccgggccggcccuguggcgccuccccgaggagcugcugcuccugaucugcuccuaccuggacaugcgggcgcucggccgccuggcccaggugugccgguggcugcgccgguucaccagcugcgaccuccuguggcgccggaucgcccgcgccucccugaacagcggguucacccggcucggcaccgaccugaugaccuccguccccgugaaggagcgcgugaaggucagccagaacuggcggcuggggcgcugccgggagggcauccuccugaaguggcgcugcucccagaugcccuggaugcagcuggaggacgacagccucuacaucucccaggccaacuucauccuggcguaccaguuccggccggacggcgccagccugaaccgccggccccucgggguguucgccggccacgacgaggacgugugccacuucguccuggccaacucccacaucgugagcgccgggggcgacgggaagaucggcauccacaagauccacuccaccuucaccgugaaguacagcgcgcacgagcaggaggucaacugcguggacugcaagggcgggaucaucguguccggcagccgcgaccggacggccaaggucuggccccuggccuccgggcgccucggccagugccugcacaccauccagaccgaggaccgcguguggagcaucgccaucagcccccugcucuccagcuucgugaccggcacggccugcugcgggcacuucuccccgcugcggaucugggaccugaacagcggccagcucaugacccaccugggguccgacuucccgcccggcgcggggguccuggacgugauguacgagagccccuucacccuccuguccugcggcuacgacaccuacgugcgcuacugggaccugcggacgagcguccgcaagugcgugauggagugggaggagccccacgacuccacccucuacugccugcagaccgacggcaaccaccuccuggccaccgggagcuccuacuacggcgugguccggcugugggaccgccggcagcgcgccugccugcacgccuucccccucacgagcacgccccuguccagccccguguacugccugcggcucaccaccaagcaccuguacgccgcgcuguccuacaaccuccacgugcuggacuuccagaacccguga

SEQ ID NO: 30066 - RNA, 1884 nt, Artificial Sequence
  derived and/or modified sequence opt1 from FBXW7__Homo_sapiens__NP_060785
augugcgugccccgcagcggccugauccucuccugcaucugccuguacugcgggguccugcucccggugcugcugcccaaccuccccuuccugaccugccugagcauguccacccucgagagcgugacguaccugcccgagaagggccuguacugccagcggcucccguccagccgcacccacgggggcaccgagucccugaaggggaagaacaccgagaacaugggcuucuacggcacgcugaagaugaucuucuacaagaugaagcggaagcucgaccacgggagcgagguccgcuccuucagccugggcaagaagcccugcaagguguccgaguacaccagcaccaccgggcuggugcccugcuccgccacgcccaccaccuucggcgaccuccgggccgcgaacgggcagggccagcagcgccggcgcaucaccagcguccagccgcccacgggccugcaggaguggcugaagauguuccaguccuggagcgggcccgagaagcuccuggcccuggacgagcucaucgacuccugcgagcccacccaggugaagcacaugaugcaggucaucgagccgcaguuccagcgggacuucaucagccugcugcccaaggagcucgcccuguacgugcuguccuuccucgagcccaaggaccugcugcaggccgcccagaccugccgcuacuggcggauccucgcggaggacaaccugcuguggcgcgagaagugcaaggaggagggcaucgacgagccccuccacaucaagcggcgcaaggugaucaagccgggguucauccacagccccuggaaguccgccuacauccggcagcaccgcaucgacaccaacuggcggcgcggcgagcucaagagccccaaggugcugaagggccacgacgaccacgucaucacgugccugcaguucugcgggaaccggaucgugagcggcuccgacgacaacacccugaagguguggagcgccgucaccgggaagugccugcgcacccucgugggccacaccgggggcgugugguccagccagaugcgggacaacaucaucaucuccggcagcacggaccgcacccugaaggucuggaacgccgagaccggggagugcauccacacgcuguacggccacaccuccaccgugcgcugcaugcaccuccacgagaagcggguggucagcgggucccgcgacgcgacccugcgggugugggacaucgagacgggccagugccugcacgugcucauggggcacgucgccgccgugcgcugcguccaguacgacggccggcgcguggugagcggcgccuacgacuucauggucaaggugugggaccccgagaccgagaccugccugcacacccugcaggggcacacgaaccggguguacucccugcaguucgacggcauccacgucgugagcgggucccucgacaccagcauccgcgugugggacgucgagaccggcaacugcauccacacccugacggggcaccagucccugaccagcggcauggagcucaaggacaacauccugguguccggcaacgccgacagcaccgugaagaucugggacaucaagaccgggcagugccugcagacccuccagggcccgaacaagcaccagagcgcggucacgugccugcaguucaacaagaacuucgugaucaccuccagcgacgacgggaccgugaagcugugggaccucaagaccggcgaguucauccggaaccuggucacgcuggaguccggcgggagcggcggggugguguggcgcauccgggccuccaacaccaagcucgucugcgccgugggcagccgcaacgggaccgaggagaccaagcugcuggugcucgacuucgacgucgacaugaaguga

SEQ ID NO: 30067 - RNA, 1599 nt, Artificial Sequence
  derived and/or modified sequence opt1 from FBXW8__Homo_sapiens__NP_036306
auggacgacuacagccuggacgaguuccgccggcgcuggcaggaggagcucgcccaggcccaggcgcccaagaagcggcgccggccggaggccgccgagcgccgggcccgccggcccgagaacgagaugaacgacgugcccuucuucgacauccagcugcccuacgagcuggccaucaacaucuuccaguaccucgaccgcaaggagcugggccggugcgcgcaggucuccaagaccuggaaggugaucgccgaggacgaggugcugugguaccgccucugccagcaggaggggcaccuccccgacagcuccaucagcgacuacuccugcuggaagcugaucuuccaggagugccgggccaaggagcacaugcugcgcaccaacuggaagaaccggaagggcgccgucagcgagcuggagcacgugcccgacacggugcugugcgacguccacucccacgacgggguggugaucgcgggcuacaccagcggggacguccgcgugugggacacccggaccugggacuacguggcccccuuccucgaguccgaggacgaggaggacgagcccggcaugcagccgaacgucagcuucgugcgcaucaacuccagccuggccguggccgccuacgaggacggcuuccugaacaucugggaccuccggacggggaaguaccccguccaccgcuucgagcacgacgcgcggauccaggcccuggcccugucccaggacgacgccaccguggccaccgcgagcgccuucgacguggucaugcucucccccaacgaggagggcuacuggcagaucgccgccgaguucgaggugcccaagcuggugcaguaccuggagaucgucccggagacccgccgcuaccccguggccguggcggccgccggggaccucauguaccugcugaaggccgaggacagcgcccggacgcuccuguacgcgcacggcccgcccgugaccugccuggacgucuccgccaaccaggucgccuucggggugcagggccucggcuggguguacgaggggagcaagauccuggucuacucccuggaggccggccgccggcuccugaagcuggggaacgugcuccgcgacuucacgugcgugaaccugagcgacagcccgcccaaccugauggucuccggcaacauggacggccgggugcgcauccacgaccuccggagcgggaacaucgcgcugucccugagcgcccaccagcuccgcguguccgccguccagauggacgacuggaagaucgugagcggcggggaggagggccugguguccgucugggacuaccggaugaaccagaagcugugggagguguacagcgggcaccccgugcagcacaucuccuucagcucccacagccucaucaccgccaacguccccuaccagaccgugaugcgcaacgccgaccuggacuccuucaccacccaccggcgccaccggggccugauccgcgcguacgaguucgccguggaccagcucgccuuccagagcccgcugcccgucugccgguccagcugcgacgccauggccacccacuacuacgaccuggcgcucgccuuccccuacaaccacguguga

SEQ ID NO: 30068 - RNA, 864 nt, Artificial Sequence
  derived and/or modified sequence opt1 from FCAR__Homo_sapiens__NP_001991
auggaccccaagcagaccacccugcucugccuggugcugugccucggccagcgcauccaggcccaggagggggacuucccgaugcccuucaucagcgccaaguccagccccgucaucccccuggacggcuccgugaagauccagugccaggcgauccgggaggccuaccugacgcagcucaugaucaucaagaacagcaccuaccgcgagaucgggcggcgccugaaguucuggaacgagaccgacccggaguucgugaucgaccacauggacgccaacaaggccggccgguaccagugccaguaccgcaucgggcacuaccgguuccgcuacuccgacacccuggagcucgucgugacgggccuguacggcaagcccuuccugagcgccgaccgggggcucgugcugaugcccggcgagaacaucucccugaccugcagcuccgcgcacauccccuucgaccgcuucagccucgccaaggagggggagcugucccugccgcagcaccagagcggcgagcaccccgccaacuucucccucgggcccgucgaccugaacgugagcggcaucuaccggugcuacggcugguacaaccgcucccccuaccuguggagcuucccguccaacgcccucgagcugguggucaccgacagcauccaccaggacuacaccacgcagaaccugauccggauggcgguggccgggcucgugcuggucgcccugcucgccauccugguggagaacuggcacucccacaccgcccugaacaaggaggcgagcgccgacguggccgagcccagcuggucccagcagaugugccagcccggccucaccuucgcccgcacccccagcgucugcaaguga

SEQ ID NO: 30069 - RNA, 774 nt, Artificial Sequence
  derived and/or modified sequence opt1 from FCER1A__Homo_sapiens__NP_001992
auggcccccgccauggagagcccgacccugcucugcguggcgcugcuguucuucgcccccgacggcgugcucgccgugccccagaagcccaaggugucccugaacccgcccuggaaccgcaucuucaagggggagaacgucacccugacgugcaacggcaacaacuucuucgaggugagcuccaccaagugguuccacaacgggagccucuccgaggagaccaacagcucccugaacaucgugaacgccaaguucgaggacagcggcgaguacaagugccagcaccagcaggucaacgaguccgagcccguguaccuggagguguucagcgacuggcuccugcugcaggccuccgcggaggucgugauggaggggcagccccucuuccugcggugccacggcuggcgcaacugggacguguacaaggucaucuacuacaaggacggcgaggcccugaaguacugguacgagaaccacaacaucagcaucaccaacgccacgguggaggacuccgggaccuacuacugcaccggcaagguguggcagcucgacuacgagagcgagccgcugaacaucaccgucaucaaggcgccccgggagaaguacuggcugcaguucuucaucccccuccugguggugauccuguucgccgucgacacgggccucuucaucuccacccagcagcaggucaccuuccugcugaagaucaagcgcacccggaagggguuccgccuccugaacccccacccgaagcccaaccccaagaacaacuga

SEQ ID NO: 30070 - RNA, 261 nt, Artificial Sequence
  derived and/or modified sequence opt1 from FCER1G__Homo_sapiens__NP_004097
augauccccgccgugguccugcuccugcugcuccugguggagcaggccgcggcccugggcgagccccagcucugcuacauccuggacgccauccuguuccucuacgggaucgugcugacccugcucuacugccgccugaagauccagguccggaaggccgccaucaccagcuacgagaaguccgacggcguguacacggggcugagcacccgcaaccaggagaccuacgagacccucaagcacgagaagccgccccaguga

SEQ ID NO: 30071 - RNA, 963 nt, Artificial Sequence
  derived and/or modified sequence opt1 from FCER2__Homo_sapiens__NP_001193948
augaacccgcccagccaggagaucgaggagcugccccgccggcgcugcugccggcgcggcacccagaucgugcuccuggggcuggucaccgccgcccucugggccggccugcugacgcuccugcugcucuggcacugggacaccacccagucccugaagcagcuggaggagcgggccgcccgcaacgugagccagguguccaagaaccucgagagccaccacggggaccagauggcccagaagucccagagcacccagaucucccaggagcuggaggagcugcgggccgagcagcagcgccucaagagccaggaccuggagcuguccuggaaccucaacggccugcaggcggaccugagcuccuucaagagccaggagcucaacgagcggaacgaggccuccgaccugcuggagcgccuccgggaggaggucacgaagcugcgcauggagcuccaggugagcuccggguucgugugcaacacgugccccgagaaguggaucaacuuccagcggaagugcuacuacuucggcaagggcaccaagcaguggguccacgcccgcuacgccugcgacgacauggaggggcagcuggugagcauccacucccccgaggagcaggacuuccugaccaagcacgcgagccacaccggcuccuggaucgggcugcggaaccucgaccugaagggcgaguucaucuggguggacgggagccacgucgacuacagcaacugggccccgggcgagcccaccucccgcagccagggcgaggacugcgugaugaugcggggguccggccgcuggaacgacgccuucugcgaccggaagcugggggccugggugugcgaccgccucgcgaccugcaccccgcccgccagcgagggcuccgccgagagcaugggccccgacucccggcccgaccccgacgggcgccugcccacgccgagcgcgccccugcacuccuga

SEQ ID NO: 30072 - RNA, 16218 nt, Artificial Sequence
  derived and/or modified sequence opt1 from FCGBP__Homo_sapiens__NP_003881
augggcgcccuguggagcugguggauccucugggccggggccacccugcuguggggccucacccaggaggccagcguggaccugaagaacaccgggcgcgaggaguuccugaccgccuuccuccagaacuaccagcuggccuacagcaaggccuacccccggcugcucaucuccagccuguccgagagccccgccuccgugagcauccugucccaggccgacaacaccagcaagaaggugaccgugcggcccggcgaguccgugauggugaacaucagcgccaaggccgagaugaucggguccaagaucuuccagcacgccguggugauccacagcgacuacgccaucuccgugcaggcccucaacgccaagcccgacaccgccgagcugacccugcuccggcccauccaggcccugggcaccgaguacuucgugcugaccccgcccggcaccagcgcccgcaacgugaaggaguucgccgugguggccggggccgccggcgccuccgugagcgugacccucaagggguccgugaccuucaacggcaaguucuaccccgccggggacguccugcgggugacccugcagcccuacaacguggcccagcuccagagcagcgucgaccuguccggcagcaaggugaccgccuccagccccguggcgguccuguccggccacagcugcgcccagaagcacacgaccugcaaccacgugguggagcagcuccugcccaccuccgccugggggacccacuacgucgugcccacccuggccagccagucccgcuacgaccucgccuucgucguggcgagccaggccaccaagcugaccuacaaccacggcgggaucaccggcucccggggccugcaggccggggacguggucgaguucgaggugcgccccagcuggccccucuaccuguccgccaacgugggcauccagguccuccuguucgggaccggcgcgauccggaacgaggugaccuacgaccccuaccuggugcugauccccgacgucgccgccuacugccccgccuacguggucaagagcguccccgggugcgagggcguggcccucguggucgcgcagaccaaggccaucuccggccugaccaucgacgggcacgccgugggcgccaagcugaccugggaggccgugcccgggagcgaguucuccuacgcggaggucgagcucggcaccgccgacaugauccacaccgccgaggccaccaccaaccuggggcugcucaccuucggccuggccaaggcgaucggcuacgccaccgccgccgacugcgggcgcaccgugcugagccccguggagcccuccugcgagggcaugcagugcgcggccgggcagcggugccaggucgugggcgggaaggccggcugcguggccgagagcaccgccgucugccgcgcgcagggcgacccccacuacaccaccuucgacgggcggcgcuacgacaugauggggaccugcagcuacaccaugguggagcucugcuccgaggacgacacccugcccgccuucagcguggaggccaagaacgagcaccgggggucccgccgggucagcuacgugggccuggugaccguccgcgccuacucccacagcgugucccucacccggggcgaggugggguucguccugguggacaaccagcgcagccggcugcccgugucccugagcgagggccgccuccgcgucuaccaguccgggccccgggccgugguggagcuggucuucggccugguggugacguacgacugggacugccagcucgcgcugagccugcccgcccgcuuccaggaccaggucugcgggcucugcggcaacuacaacggcgaccccgccgacgacuuccugacccccgacggggcccuggcccccgacgcgguggaguucgccuccagcuggaagcucgacgacggcgacuaccugugcgaggacgggugccagaacaacugccccgccugcacccccggccaggcccagcacuacgagggggaccggcugugcggcaugcucaccaagcuggacggccccuucgcggugugccacgacacgcuggacccccgccccuuccucgagcagugcgucuacgaccugugcguggucggcggggagcggcugucccucugccgcgggcugagcgccuacgcccaggccugccuggagcucggcaucuccgucggggacuggcggagccccgccaacugcccccugagcugccccgcgaacucccgcuacgagcugugcggccccgccugccccaccagcugcaacggcgccgccgcccccuccaacugcagcgggcggcccugcguggagggcugcgugugccuccccggguucgucgcguccggcggggccugcgugcccgccagcuccugcggcugcaccuuccagggccugcagcuggcccccgggcaggaggucugggccgacgagcucugccagcgccggugcacgugcaacggcgcgacgcaccaggugaccugccgcgacaagcagagcugccccgccggggagcggugcuccgugcagaacggccugcugggcugcuaccccgaccgcuucgggaccugccagggcagcggggacccccacuacgucuccuucgacggccggcgcuucgacuucauggggaccugcacguaccuccuggugggcagcugcggccagaacgccgcccugcccgccuuccgggugcucgucgagaacgagcaccgcgggucccagaccgugagcuacacccgggcggugcgcgucgaggcccgcggcgugaagguggccguccggcgcgaguaccccggccaggugcugguggacgacguccugcaguaccuccccuuccaggccgcggacggccagguccagguguuccggcaggggcgcgacgccgucgugcggaccgacuucggccugacggugaccuacgacuggaacgcccgcgucaccgccaaggugcccuccagcuacgccgaggcgcugugcggccucugcgggaacuucaacggcgaccccgccgacgaccuggcccugcgcggcggcgggcaggccgccaacgcgcucgccuucgggaacuccuggcaggaggagacccgcccgggcugcggggccacggagcccggcgacugccccaagcuggacagccugguggcccagcagcuccaguccaagaacgagugcgggauccuggccgaccccaagggcccguuccgggagugccacagcaagcuggacccccagggcgcgguccgcgacugcguguacgaccggugccuccugcccgggcagagcggcccgcugugcgacgcccucgccaccuacgccgcggccugccaggccgccggggccaccgugcaccccuggcgcuccgaggagcugugcccccugagcugcccgccccacucccacuacgaggcgugcagcuacggcugcccccucuccugcggggaccugcccguccccggcggcugcgggagcgagugccacgagggcugcgugugcgacgagggguucgcccuguccggcgagagcugccucccgcuggccuccugcgggugcgugcaccagggcaccuaccacccgcccggccagacguucuaccccgggccgggcugcgacagccugugccacugccaggagggcgggcucgucuccugcgagagcuccagcugcgggccccacgaggccugccagcccuccggcggcagccuggggugcguggccgugggcuccagcacgugccaggcguccggggacccccacuacaccaccuucgacggccggcgcuucgacuucauggggaccugcgucuacgugcuggcccagaccugcggcacccggccgggccuccaccgcuucgccgugcugcaggagaacgucgccugggggaacggccgggugagcgugacccgcgucaucacgguccagguggccaacuucacccugcggcucgagcagcgccaguggaaggucaccgugaacgggguggacaugaagcugcccgucgugcuggcgaacggccagauccgggccagccagcacggcuccgacguggucaucgagaccgacuucgggcuccgcguggccuacgaccugguguacuacguccgcgugacgguccccggcaacuacuaccagcagaugugcgggcugugcggcaacuacaacggggaccccaaggacgacuuccagaagccgaacggcagccaggccggcaacgcgaacgaguucgggaacuccugggaggagguggugcccgacagccccugccugccgcccacccccugcccgcccggcuccgaggacugcauccccagccacaagugcccgcccgagcuggagaagaaguaccagaaggaggaguucugcgggcugcucuccagcccgaccggcccccuguccagcugccacaagcuggucgacccccaggggccccucaaggacugcaucuucgaccugugccugggcggcgggaaccucuccauccugugcagcaacauccacgccuacguguccgccugccaggccgccggcgggcacguggagccguggcggaccgagaccuucugccccauggagugcccgcccaacagccacuacgagcugugcgcggacacgugcucccucggcugcagcgcccuguccgccccgccccagugccaggacgggugcgccgagggcugccagugcgacagcggcuuccuguacaacgggcaggccugcguccccauccagcagugcggcugcuaccacaacgggguguacuacgagcccgagcagaccgugcucaucgacaacugccgccagcagugcacgugccacgcgggcaaggggauggucugccaggagcacuccugcaagccgggccaggugugccagcccagcggcgggauccugagcugcgugaccaaggaccccugccacggcgucacgugccggccccaggagaccugcaaggagcagggcgggcagggcgugugccugccgaacuacgaggcgaccugcuggcucuggggcgacccccacuaccacuccuucgacggccgcaaguucgacuuccaggggaccugcaacuacgugcuggccacgaccggcugccccggggucagcacccagggccugacccccuucacggugaccaccaagaaccagaaccggggcaacccggccguguccuacguccgcguggugaccgucgccgcgcucgggacgaacaucagcauccacaaggacgagaucggcaaggugcgggugaacgggguccugaccgcccugcccguguccguggccgacggccgcaucagcgucacccagggggccuccaaggcccugcucguggcggacuucggccuccaggugagcuacgacuggaacuggcgggucgacgugacccugcccuccuccuaccacggcgccgugugcggccucugcggcaacauggaccgcaaccccaacaacgaccaggucuucccgaacgggacgcuggcccccuccauccccaucuggggcgggagcuggcgggcccccggcugggacccgcugugcugggacgagugccgcggcuccugcccgaccugccccgaggaccggcucgagcaguacgaggggccgggcuucugcgggccccuggcgcccggcaccggcgggcccuucaccacgugccacgcccacgugccgcccgagagcuucuucaagggcugcgugcuggacgucugcaugggcggcggggaccgcgacauccucugcaaggcccuggccuccuacguggccgcgugccaggccgccgggguggucaucgaggacuggcgggcccaggugggcugcgagaucacgugccccgagaacagccacuacgaggugugcgggucccccugcccggccagcugccccucccccgcgccccugaccaccccggccgucugcgagggccccugcguggaggggugccagugcgacgccggcuucgugcucagcgccgaccgcugcgucccccugaacaacgggugcggcugcugggccaacggcacguaccacgaggcggggagcgaguucugggccgacgggaccugcucccaguggugccggugcgggcccggcgggggcagccuggugugcaccccggccuccugcggccucggggaggugugcggccugcugcccagcgggcagcacggcugccagcccgucuccaccgccgagugccaggcguggggcgacccccacuacgugacgcucgacggccaccgcuucaacuuccaggggaccugcgaguaccugcugagcgccccgugccacgggccgccccugggcgccgagaacuucaccgugaccgucgccaacgagcaccgggggucccaggccgugagcuacacgcgcuccgucacccugcagaucuacaaccacagccugacccucuccgcgcgcuggccccggaagcuccagguggacggcguguucgucacccugccguuccagcucgacagccugcugcacgcccaccucuccggcgccgacgugguggucaccacgaccagcgggcugucccuggccuucgacggcgacagcuucgugcgccuccgggugcccgccgcguacgccgggucccugugcggccugugcgggaacuacaaccaggaccccgccgacgaccucaaggccgucggcggcaagccggccggguggcaggucggcggggcgcagggcugcggggagugcgugagcaagcccugccccucccccugcaccccggagcagcaggagagcuucggcggccccgacgccugcggggucaucagcgccaccgacggcccccuggcccccugccacgggcuggugccgcccgcgcaguacuuccagggcugccuccuggacgccugccaggugcaggggcaccccggcggccugugccccgccgucgccacguacguggccgcgugccaggccgccggggcccagcuccgcgaguggcggcgcccggacuucugccccuuccagugccccgcccacucccacuacgagcugugcggcgacagcugccccggguccugcccgagccuguccgcgcccgagggcugcgagagcgccugccgggagggcugcgugugcgacgccggguucguccucuccggcgacacgugcgugcccguggggcagugcggcugccugcacgacgaccgcuacuacccccuggggcagaccuucuacccgggccccggcugcgacagccucugccggugccgcgagggcggggaggucuccugcgagcccagcuccugcgggccccacgagaccugccggccgagcggcgggucccugggcugcguggccgugggcagcacgaccugccaggccuccggggacccccacuacaccaccuucgacggccgccgguucgacuucauggggacgugcgucuacgugcuggcgcagaccugcggcacccgccccgggcuccaccgguucgccgugcugcaggagaacgucgccuggggcaacggccgcgugagcgugacccgggucaucacgguccagguggccaacuucacccugcgccucgagcagcggcaguggaaggucaccgugaacgggguggacaugaagcugcccgucgugcuggccaacggccagauccgcgcgucccagcacgggagcgacguggucaucgagaccgacuucggccuccggguggccuacgaccugguguacuacguccgcgugacggugccggggaacuacuaccagcugaugugcggccucugcggcaacuacaacggggaccccaaggacgacuuccagaagcccaacggcagccaggccgggaacgccaacgaguucggcaacuccugggaggaggucgugccggacagccccugccugccgcccccgaccugcccgcccggcuccgaggggugcauccccagcgaggagugcccgcccgagcuggagaagaaguaccagaaggaggaguucugcggccuccuguccagccccaccgggccccuguccagcugccacaagcucguggacccccagggcccccugaaggacugcaucuucgaccugugccucgggggcggcaaccuguccauccugugcagcaacauccacgcguacgucuccgccugccaggccgccgggggccagguggagcccuggcgcaacgagaccuucugccccauggagugcccgcagaacagccacuacgagcucugcgccgacacgugcucccuggggugcagcgcgcuguccgcgccccugcagugccccgacggcugcgccgaggggugccagugcgacagcggcuuccuguacaacggccaggccugcgugcccauccagcagugcgggugcuaccacaacggcgccuacuacgagccggagcagaccguccugaucgacaacugccggcagcagugcacgugccacguggggaaggucguggugugccaggagcacuccugcaagcccggccaggucugccagcccagcgggggcauccucuccugcgugaacaaggaccccugccacggcgugaccugccgcccgcaggagacgugcaaggagcagggcgggcagggggucugccugcccaacuacgaggcgaccugcuggcuguggggcgacccccacuaccacagcuucgacggccggaaguucgacuuccaggggaccugcaacuacgugcucgccaccacgggcugccccggggugagcacccagggccugaccccguucaccgucacgaccaagaaccagaaccgcgggaaccccgccguguccuacgugcgggucgugaccguggccgcccugggcaccaacaucagcauccacaaggacgagaucggcaagguccgcgugaacggggugcucacggcgcugcccgucuccguggccgacggccggaucagcgugacccagggggccuccaaggcccugcucgucgcggacuucggccuccaggugagcuacgacuggaacuggcgcguggacgucacccugccguccagcuaccacggggccgugugcggccucugcggcaacauggaccggaaccccaacaacgaccagguguuccccaacgggacccuggcccccuccaucccgaucuggggcgggagcuggcgcgcccccggcugggacccccugugcugggacgagugccggggguccugcccgaccugcccggaggaccgccucgagcaguacgagggccccggcuucugcgggccccuggcccccggcaccggcgggccguucacgaccugccacgcgcacgugccgcccgagagcuucuucaaggggugcgugcuggacgugugcaugggcggcggggaccgggacauccucugcaaggcccuggccuccuacgucgccgccugccaggcggccggcguggugaucgaggacuggcgcgcccaggucgggugcgagaucacgugccccgagaacagccacuacgaggugugcggcccgcccugccccgccuccugccccagcccggcgccccugacgacccccgcggugugcgagggccccugcgucgaggggugccagugcgacgccggcuucgugcucuccgccgaccggugcgugccgcugaacaacgggugcggcugcugggccaacgggaccuaccacgaggccggcagcgaguucugggcggacgggaccugcucccaguggugccgcugcgggcccggcgggggcagccuggucugcacgcccgccagcugcgggcugggcgaggugugcggccuccugcccuccgggcagcacggcugccagccggugagcaccgccgagugccaggccuggggcgacccccacuacgucacccuggacggccaccgguucgacuuccaggggaccugcgaguaccuccuguccgcgcccugccacggcccgccccugggcgccgagaacuucacggugaccguggccaacgagcaccgcgggagccaggccgucuccuacacccggagcgugacccuccagaucuacaaccacucccugacgcugagcgcccgcuggccccgcaagcuccagguggacggcgucuucgugacccugcccuuccagcuggacucccuccugcacgcgcaccugagcggggccgacguggucgugaccaccacguccggccucagccuggccuucgacggggacuccuucguccggcugcgcgugccggccgccuacgcgggcagccucugcggccugugcgggaacuacaaccaggaccccgccgacgaccugaaggccgugggcgggaagcccgccggcuggcaggucggcggggcccagggcugcggggagugcguguccaagcccugcccgagccccugcacccccgagcagcaggaguccuucggcgggcccgacgcgugcggcgugaucagcgccaccgacggcccgcucgcccccugccacgggcuggugccgcccgcccaguacuuccagggcugccugcucgacgcgugccaggugcaggggcacccgggcgggcugugccccgccguggccaccuacgucgccgccugccaggcggccggcgcccagcugcgggaguggcgccggcccgacuucugccccuuccagugcccggcccacucccacuacgagcucugcggcgacagcugccccgggagcugccccucccugagcgcccccgagggcugcgaguccgcgugccgcgaggggugcgugugcgacgccggcuucgugcugagcggggacacgugcgucccggugggccagugcggcugccuccacgacgaccgguacuacccccuggggcagaccuucuaccccggcccggggugcgacucccugugccgcugccgggagggcggcgaggugagcugcgagcccuccagcugcgggccccacgagaccugccgccccuccggcgggagccucggcugcgucgccgugggguccaccacgugccaggccagcggcgacccgcacuacaccaccuucgacggccaccgguucgacuucauggggaccugcguguacguccuggcccagacgugcggcacccgccccgggcugcaccgguucgcggugcuccaggagaacguggccuggggcaacgggcgcgucuccgugacccgggugaucaccguccagguggccaacuucacgcugcgccuggagcagcggcaguggaaggugaccgucaacggcguggacaugaagcuccccgugguccuggccaacggccagauccgcgcgagccagcacggguccgacguggugaucgagaccgacuucggccugcgggucgccuacgaccucguguacuacgugcgcgucaccgugcccgggaacuacuaccagcugaugugcggccugugcgggaacuacaacggcgacccgaaggacgacuuccagaagcccaacggcagccaggccgggaacgccaacgaguucggcaacuccugggaggaggugguccccgacagccccugccucccgccgccgaccugcccgcccggguccgccggcugcauccccagcgacaagugcccgcccgagcuggagaagaaguaccagaaggaggaguucugcgggcugcucagcucccccacgggcccccugagcuccugccacaagcugguggacccccagggcccccucaaggacugcaucuucgaccugugccucgggggcgggaaccucagcauccugugcuccaacauccacgcguacgugagcgccugccaggccgccggcggccacgucgagccguggcggaacgagaccuucugccccauggagugcccccagaacucccacuacgagcugugcgccgacacgugcagccucgggugcuccgcgcugagcgcgccccugcagugcccggacggcugcgccgaggggugccagugcgacuccggcuuccucuacaacgggcaggccugcgugcccauccagcagugcggcugcuaccacaacggcguguacuacgagcccgagcagaccguccugaucgacaacugccgccagcagugcacgugccacguggggaagguggucgugugccaggagcacagcugcaagccgggccaggugugccagcccuccgggggcauccugagcugcgucaccaaggaccccugccacggggugaccugccgcccccaggagaccugcaaggagcagggcggccagggggucugccucccgaacuacgaggccacgugcuggcuguggggcgacccccacuaccacuccuucgacgggcggaaguucgacuuccaggggaccugcaacuacgugcuggcgaccaccgggugccccggcgugagcacgcagggccucacccccuucaccgucaccacgaagaaccagaaccgcgggaacccggccguguccuacgugcgggucgugaccguggccgcccugggcaccaacaucagcauccacaaggacgagaucgggaagguccgcgugaacggcgugcugaccgcccuccccgucuccguggcggacggccggaucagcguggcccagggggccagcaaggcccugcuggucgcggacuucggccuccagguguccuacgacuggaacuggcgcguggacgucacgcugcccagcuccuaccacggggccgugugcggccugugcgggaacauggaccggaaccccaacaacgaccagguguucccgaacggcacccucgcccccagcauccccaucuggggcggguccuggcgcgcccccggcugggacccgcugugcugggacgagugccgggggagcugcccgaccugccccgaggaccgccuggagcaguacgagggccccggguucugcggcccgcucuccagcggcaccgggggccccuucacgaccugccacgcccacgucccgcccgaguccuucuucaaggggugcgugcuggacgugugcaugggcgggggcgaccgggacauccugugcaaggcgcucgccagcuacgucgccgccugccaggccgcgggcguggugaucgaggacuggcgcgcccaggucgggugcgagaucacgugccccgagaacucccacuacgaggugugcgggccgcccugccccgccagcugcccgucccccgcgccccugaccacgccggccgugugcgaggggcccugcgucgagggcugccagugcgacgcgggguucgugcugagcgccgaccggugcgugccccucaacaacggcugcggcugcugggccaacgggaccuaccacgaggccggcuccgaguucugggcggacgggaccugcagccaguggugccgcugcggccccggcgggggcucccuggucugcaccccggccagcugcgggcugggcgaggugugcgggcuccugcccagcggccagcacggcugccagcccguguccacggccgagugccaggccuggggcgacccccacuacgucacccuggacggccaccgguucgacuuccaggggaccugcgaguaccuccugagcgccccgugccacgggccgccccugggggcggagaacuucaccgugacgguggccaacgagcaccgcggcucccaggccgucagcuacacccgguccgugacccuccagaucuacaaccacagccugacccuguccgcccgcuggccccggaagcuccagguggacggcgucuucguggcccugccguuccagcuggacagccugcuccacgcgcaccuguccggggccgacguggucgugaccacgaccagcggccugucccucgccuucgacggggacagcuucgugcgccugcgcguccccgccgccuacgcggccucccugugcggccucugcgggaacuacaaccaggaccccgccgacgaccugaaggccgugggcggcaagcccgcgggguggcaggucggcggggcccagggcugcggcgagugcgucagcaagccgugccccucccccugcacccccgagcagcaggagagcuucgggggcccggacgccugcggggugaucuccgccaccgacggcccccuggcccccugccacgggcucgugccgcccgcgcaguacuuccagggcugccugcuggacgccugccaggugcagggccaccccgggggccucugccccgccguggccacguacgucgccgcgugccaggccgccggggcccagcugggcgaguggcggcgccccgacuucugcccccugcagugccccgcccacagccacuacgagcucugcggggacuccugccccgugagcugcccgagccuguccgcgcccgagggcugcgagagcgccugccgggagggcugcgugugcgacgccggguucguccuguccggcgacacgugcgugcccguggggcagugcggcugccuccacgacgggcgcuacuacccccugggcgaggucuucuacccgggccccgagugcgagcggcgcugcgagugcgggcccggcgggcacgugaccugccaggagggcgccgccugcgggccccacgaggagugccggcuggaggacggcgugcaggcgugccacgccaccggcugcgggcgcugccucgccaacggcgggauccacuacaucacgcuggacggccgggucuacgaccugcacggcagcugcuccuacgugcucgcccaggugugccacccgaagcccggggacgaggacuucagcaucguccuggagaagaacgcggccggcgaccugcagcgccuccuggugaccguggccgggcaggucgugucccuggcccagggccagcaggucaccgucgacggggaggccguggcgcuccccguggccgucggccgggugcgcgugaccgccgagggccggaacaugguccugcagacgaccaaggggcugcgccuccuguucgacggcgacgcccaccuccugaugagcauccccuccccguuccgggggcgccugugcggccugugcgggaacuucaacggcaacuggagcgacgacuucgugcuccccaacggcuccgccgcgagcuccguggagaccuucggggccgccuggcgggcccccggcagcuccaaggggugcggcgaggggugcggcccccagggcugcccggucugccuggccgaggagaccgcgcccuacgagagcaacgaggccugcgggcagcugcgcaacccccagggccccuucgccacgugccaggccgugcucuccccgagcgaguacuuccggcagugcguguacgaccugugcgcgcagaagggggacaaggccuuccugugccgcucccucgccgccuacaccgccgcgugccaggccgccggcgucgccgugaagcccuggcggaccgacagcuucugcccccugcacugccccgcccacagccacuacuccaucugcacccgcacgugccagggcagcugcgcggcccuguccgggcucaccggcugcaccacccgcugcuucgaggggugcgagugcgacgaccgguuccugcugagccagggcgugugcaucccgguccaggacugcgggugcacgcacaacggccgcuaccuccccgugaacuccagccugcugaccuccgacugcagcgagcggugcuccugcagcuccagcuccggccugaccugccaggccgccgggugcccgcccggccgcgugugcgaggucaaggccgaggcgcggaacugcugggccacccgcgggcugugcgugcugagcgugggcgccaaccucacgaccuucgacggggcccggggcgccaccaccucccccggcgucuacgagcugagcucccgcugccccgggcugcagaacacgauccccugguaccgggugguggcggagguccagaucugccacggcaagaccgaggccgugggccaggugcacaucuucuuccaggacggcauggucacccucacccccaacaagggggugugggugaacggccugcgcgucgaccugcccgccgagaagcucgccagcguguccgugagccggacgcccgacggcagccugcugguccgccagaaggcgggggugcaggucuggcucggcgccaacgggaagguggccgugaucgucuccaacgaccacgccggcaagcugugcggggccugcggcaacuucgacggcgaccagaccaacgacuggcacgacagccaggagaagcccgcgauggagaaguggcgggcccaggacuucuccccgugcuacggguga

SEQ ID NO: 30073 - RNA, 954 nt, Artificial Sequence
  derived and/or modified sequence opt1 from FCGR2A__Homo_sapiens__NP_001129691
augaccauggagacccagaugagccagaacgugugcccccgcaaccuguggcuccugcagccccugacgguccuccugcugcucgccuccgccgacagccaggcggccgccccgcccaaggccgugcugaagcuggagccgcccuggaucaacgugcuccaggaggacuccgucacccugaccugccagggcgcccggagccccgaguccgacagcauccagugguuccacaacgggaaccugauccccacccacacgcagcccuccuaccgcuucaaggcgaacaacaacgacagcggcgaguacacgugccagaccgggcagaccucccucagcgaccccgugcaccugaccgugcuguccgaguggcucguccugcagacgccccaccuggaguuccaggagggcgagaccaucaugcuccggugccacagcuggaaggacaagccccuggugaaggugaccuucuuccagaacgggaagucccagaaguucagccaccuggaccccaccuucuccaucccgcaggccaaccacagccacuccggcgacuaccacugcaccggcaacaucggguacacccucuucagcuccaagcccgucaccaucacgguccaggugcccagcaugggcagcuccagccccauggggaucaucguggccguggugaucgccaccgcggucgccgccaucguggccgccguggucgcgcugaucuacugccgcaagaagcggaucuccgccaacagcaccgacccggugaaggccgcccaguucgagccgcccggccgccagaugaucgccauccggaagcgccagcuggaggagaccaacaacgacuacgagacggcggacgggggcuacaugacccucaacccccgggcccccaccgacgacgacaagaacaucuaccugacccugccgcccaacgaccacgugaacuccaacaacuga

SEQ ID NO: 30074 - RNA, 873 nt, Artificial Sequence
  derived and/or modified sequence opt1 from FCGR2B__Homo_sapiens__NP_001002273
augggcauccugagcuuccuccccgugcuggccaccgaguccgacugggccgacugcaagagcccgcagcccugggggcacaugcugcucuggaccgcgguccuguuccuggcccccguggccggcacgcccgccccgcccaaggccgugcucaagcuggagccccaguggaucaacguccugcaggaggacuccgugacccugaccugccgcgggacccacagccccgaguccgacagcauccagugguuccacaacggcaaccucaucccgacgcacacccagcccuccuaccgguucaaggcgaacaacaacgacagcggggaguacacgugccagaccggccagaccucccugagcgaccccgugcaccucaccguccuguccgaguggcuggugcuccagacgccccaccuggaguuccaggagggcgagaccaucgugcugcgcugccacagcuggaaggacaagccgcucgucaaggugaccuucuuccagaacgggaaguccaagaaguucagccgguccgaccccaacuucagcaucccccaggccaaccacucccacagcggcgacuaccacugcaccgggaacaucggcuacacccuguacuccagcaagcccgugaccaucacgguccaggccccgagcuccagccccauggggaucaucguggccguggucaccggcaucgcgguggccgccaucguggccgccgucguggcgcugaucuacugccgcaagaagcggaucuccgccaaccccaccaaccccgacgaggccgacaaggugggcgccgagaacaccaucacguacagccuccugaugcacccggacgcccuggaggagcccgacgaccagaaccgcaucuga

SEQ ID NO: 30075 - RNA, 873 nt, Artificial Sequence
  derived and/or modified sequence opt1 from FCGR3A__Homo_sapiens__NP_000560
augggcgggggcgccggggagcgccuguucaccagcuccugccucgugggccuggucccccuggggcuccggaucagccuggugaccugcccccugcagugcggcaucauguggcagcuccugcugcccacggcccuccugcugcucguguccgcgggcaugcgcaccgaggaccugcccaaggccgucguguuccuggagccccagugguaccgggugcucgagaaggacagcgucacccugaagugccagggggccuacuccccggaggacaacagcacccagugguuccacaacgagucccugaucagcucccaggccagcuccuacuucaucgacgccgcgacgguggacgacagcggcgaguaccgcugccagaccaaccucuccacccugagcgaccccgugcagcuggagguccacaucggguggcuccugcugcaggcgccccgguggguguucaaggaggaggaccccauccaccuccgcugccacuccuggaagaacaccgcccugcacaaggugacguaccugcagaacggcaaggggcggaaguacuuccaccacaacagcgacuucuacaucccgaaggccacccucaaggacuccggcagcuacuucugccgcggccuguucggguccaagaacgucagcagcgagaccgugaacaucaccaucacgcagggccuggccguguccaccaucagcuccuucuucccgcccggguaccaggucagcuucugccucgugauggugcugcuguucgccgucgacaccggccucuacuucuccgugaagaccaacauccggagcuccacgcgcgacuggaaggaccacaaguucaaguggcggaaggacccccaggacaaguga

SEQ ID NO: 30076 - RNA, 702 nt, Artificial Sequence
  derived and/or modified sequence opt1 from FCGR3B__Homo_sapiens__NP_000561
auguggcagcugcuccugcccaccgcccugcuccugcuggugagcgccggcaugcgcaccgaggaccucccgaaggcggucguguuccuggagccccagugguacuccgugcuggagaaggacagcgucacgcucaagugccagggggccuacucccccgaggacaacagcacccagugguuccacaacgagaaccugaucuccagccaggccuccagcuacuucaucgacgccgccaccgugaacgacuccggcgaguaccggugccagaccaaccugagcacgcucuccgaccccgugcagcuggagguccacaucggguggcugcuccugcaggcgccgcgcuggguguucaaggaggaggaccccauccaccuccggugccacagcuggaagaacaccgcccugcacaaggugaccuaccugcagaacggcaaggaccgcaaguacuuccaccacaacuccgacuuccacauccccaaggccacccugaaggacagcggguccuacuucugccggggccucgucggcagcaagaacguguccagcgagacggugaacaucaccaucacccaggggcuggccgucuccaccaucagcagcuucuccccgcccggcuaccaggugagcuucugccuggugaugguccuccuguucgcgguggacacggggcuguacuucuccgugaagaccaacaucuga

SEQ ID NO: 30077 - RNA, 1098 nt, Artificial Sequence
  derived and/or modified sequence opt1 from FCGRT__Homo_sapiens__NP_001129491
augggcgugccccgcccgcagcccugggcccuggggcuccugcuguuccuccugcccggcagccugggggccgagucccaccucagccugcuguaccaccucaccgcggucuccagccccgccccgggcacccccgccuucuggguguccggguggcugggcccccagcaguaccugagcuacaacucccuccggggcgaggccgagcccugcggggccugggugugggagaaccaggucagcugguacugggagaaggagacgaccgaccugcgcaucaaggagaagcuguuccucgaggcguucaaggcccugggcgggaagggcccguacacccugcaggggcuccugggcugcgagcugggccccgacaacaccuccgugcccacggccaaguucgcccucaacggggaggaguucaugaacuucgaccugaagcagggcaccuggggcggggacuggcccgaggcgcuggccaucagccagcgguggcagcagcaggacaaggccgccaacaaggagcucaccuuccugcuguucuccugcccgcaccgccuccgggagcaccuggagcgcggccgggggaaccuggaguggaaggagccgcccagcaugcgccucaaggcccggcccuccagccccggcuucuccgugcugaccugcagcgcguucuccuucuacccgcccgagcugcagcuccgcuuccugcggaacgggcuggccgccggcacggggcagggcgacuucggccccaacagcgacggguccuuccacgccagcagcucccucaccgucaagagcggcgacgagcaccacuacugcugcaucgugcagcacgccgggcuggcgcagccccugcgcguggagcucgagucccccgccaagagcuccguccugguggugggcaucgucaucggggugcugcuccugaccgccgccgccgugggcggcgcgcugcucuggcggcgcaugcggagcgggcugcccgcccccuggaucucccugcgcggcgacgacaccgggguccuccugccgacgcccggcgaggcccaggacgccgaccugaaggacgugaacgugauccccgccaccgcguga

SEQ ID NO: 30078 - RNA, 2676 nt, Artificial Sequence
  derived and/or modified sequence opt1 from FCHO1__Homo_sapiens__NP_001154829
augagcuacuucggcgagcacuucuggggggagaagaaccacggcuucgaggugcuguaccacuccgucaagcaggggcccaucagcaccaaggagcucgccgacuucauccgcgagcgggccaccaucgaggagacguacuccaaggcgauggccaagcugagcaagcuggccuccaacggcaccccgauggggaccuucgccccccucugggagguguuccgcgugagcuccgacaagcuggcccugugccaccucgagcugacccggaagcugcaggaccucaucaaggacguccugcgcuacggcgaggagcagcugaagacgcacaagaagugcaaggaggagguggugagcacccucgacgcgguccaggugcuguccggcgugagccagcugcuccccaagucccgggagaacuaccugaaccgcugcauggaccaggagcggcugcgccgggagagcaccucccagaaggagauggacaaggccgagaccaagacgaagaaggccgccgagagccuccgccgguccgucgagaaguacaacagcgcgcgcgccgacuucgagcagaagaugcuggacuccgcccugcgguuccaggccauggaggagacccaccuccgccacaugaaggcccugcuggggagcuacgcgcacuccguggaggacacccacgugcagaucggccagguccacgaggaguucaagcagaacaucgagaacgugagcguggagaugcuccugcggaaguucgccgagagcaaggggaccggccgcgagaagcccgggccgcuggacuucgaggccuacuccgccgccgcgcuccaggaggccaugaagcggcugcgcggcgccaaggccuuccggcugcccggccucagccgccgggagcgcgagcccgagcccccggccgcggucgacuuccuggagcccgacuccgggacgugccccgagguggacgaggagggcuucaccgugcgccccgacgucacccagaacagcaccgccgagccgucccgguucagcuccagcgacuccgacuucgacgacgaggagccccgcaaguucuacgugcacaucaagcccgcccccgcccgggccccggcgugcagccccgaggccgccgccgcgcagcugcgcgccacggccgggucccucauccugccccccggcccgggcgggaccaugaagcggcacagcucccgcgacgccgccggcaagccccagcggccccgcagcgcgccccggaccuccagcugcgccgagcgccugcaguccgaggagcaggugagcaagaaccucuucgggccgccccuggaguccgccuucgaccacgaggacuucaccggcagcagcucccugggguucacgagcucccccagccccuucuccagcuccagcccggagaacgucgaggacuccggccucgacagccccucccacgccgcccccggcccgagccccgacuccugggugccccggcccgggaccccgcagagcccccccuccugccgcgcgcccccgcccgaggcccggggcauccgcgcccccccccugccggacagcccccagccccuggccuccagccccgggccguggggccucgaggcccuggcggggggcgaccugaugcccgcccccgccgaccccaccgcccgggagggccucgcggccccgccccgccggcugcgcagccggaagguguccugcccccugacccgcagcaacggggaccucucccgcagccugucccccagcccgcugggcuccagcgccgccuccacggcccuggagcggcccagcuuccucucccagaccgggcacggcgucagccgcgggcccuccccggugguccugggcagccaggacgcgcugcccaucgccaccgccuucaccgaguacgugcacgccuacuuccggggccacucccccagcugccucgcccgcgugacgggggagcugaccaugaccuuccccgcgggcaucguccggguguucuccgggaccccgcccccccccgugcugagcuuccgccucguccacacgaccgccaucgagcacuuccagccgaacgccgaccugcuguucuccgaccccagccagagcgaccccgagaccaaggacuucuggcucaacauggccgcccugaccgaggcgcugcagcggcaggccgagcagaaccccacggccuccuacuacaacguggugcuccugcgcuaccaguucagccggccgggcccccaguccgucccccugcagcucagcgcccacuggcagugcggcgcgacccugacccagguguccguggaguacggguaccgccccggcgccaccgccgucccgaccccccugacgaacgugcagauccuccugcccgugggggagcccgucaccaacgugcggcugcagccggccgccaccuggaaccucgaggagaagcgccugaccuggcggcugcccgacgugagcgaggcgggcggguccggccgccucagcgccuccugggagccccugagcggccccuccacgccgagccccgucgccgcccaguucaccuccgaggggaccacccugagcggcguggaccucgagcuggugggguccggcuaccggaugagccuggucaagcgccgguucgccacggcggcccccccccaggggugcaccugguga

SEQ ID NO: 30079 - RNA, 2334 nt, Artificial Sequence
  derived and/or modified sequence opt1 from FCHO2__Homo_sapiens__NP_001139504
auggugauggccuacuucgucgagaacuucuggggcgagaagaacagcggguucgacgugcuguaccacaacaugaagcacggccagaucuccaccaaggagcucgccgacuucgugcgcgagcgggcgaccaucgaggaggccuacagccgcuccaugacgaagcuggccaagagcgccuccaacuacagccagcuggggaccuucgcccccgucugggacguguucaagaccuccaccgagaagcucgcgaacugccaccuggaccuggugcggaagcuccaggagcugaucaaggagguccagaaguacggcgaggagcaggucaagagccacaagaagacgaaggaggagguggccgggacccuggaggccgugcagaccauccaguccaucacccaggcccuccagaaguccaaggagaacuacaacgcgaagugcguggagcaggagcgccugaagaaggagggcgccacgcagcgggagaucgagaaggccgccgucaagagcaagaaggccaccgacaccuacaagcuguacguggagaaguacgcgcucgccaaggccgacuucgagcagaagaugaccgagacggcccaggugcacgaggaguucaucaacaacauggccaacaccaccguggagagccugauccagaaguucgcggaguccaagggcaccgggaaggagcgcccgggccugaucgaguucgaggagugcgacacggccagcgccgucgaggggaucaagccccggaagcgcaagaccuucgcccuccccggcaucaucaagaaggagaaggacgccgaguccguggagugccccgacgcggacagccugaacaucccggacguggacgaggagggguacuccaucaagcccgagaccaaccagaacgacaccaaggagaaccacuucuacagcuccagcgacagcgacuccgaggacgaggagcccaagaaguaccggaucgagaucaagcccaugcacccgaacaacagccaccacacgauggccucccuggacgagcucaaggucagcaucggcaacaucacccugucccccgccaucagccgccacucccccgugcagaugaaccggaaccugagcaacgaggagcucaccaaguccaagcccagcgccccgcccaacgagaagggcaccuccgaccugcuggccugggacccccucuucgggcccagccuggacuccagcuccagcuccagccugacguccagcagcuccgcgcgcccgaccacgccccucagcgugggcaccaucgucccgccgccccggcccgccucccgccccaagcugaccagcgggaagcuguccggcaucaacgagaucccccggcccuucagcccgcccgugaccuccaacaccagcccgccgcccgccgcgccccucgcccgcgccgaguccagcuccagcaucuccagcuccgccagccuguccgccgccaacacccccacggugggcgucagccgggggcccagccccgugucccugggcaaccaggacacccuccccgucgcgguggcccugaccgagagcgugaacgccuacuucaagggggccgaccccaccaagugcaucgucaagaucacgggcgacaugaccauguccuuccccagcgggaucaucaagguguucaccuccaaccccacccccgccgugcugugcuuccgcgucaagaacaucagccggcucgagcagauccugccgaacgcgcagcugguguucuccgaccccagccagugcgacuccaacaccaaggacuucuggaugaacaugcaggccgugacggucuaccucaagaagcugagcgagcagaaccccgccgccuccuacuacaacguggacgugcugaaguaccaggucagcuccaacggcauccagagcacgccccucaaccuggccaccuacuggaagugcuccgcgagcaccaccgaccugcgcguggacuacaaguacaacccggaggccaugguggcccccuccguccucagcaacauccagguggugguccccguggacggcggggugaccaacaugcagucccugcccccggccaucuggaacgcggagcagaugaaggccuucuggaagcugagcagcaucuccgagaaguccgagaacggcgggagcggcagccuccgggccaaguucgaccuguccgaggggcccagcaagcccaccacccuggccguccaguuccuguccgagggcagcacgcucuccggcguggacuucgagcugguggggaccggcuaccgccugagccucaucaagaagcgcuucgccaccgggcgguaccuggcggacugcuga

SEQ ID NO: 30080 - RNA, 2223 nt, Artificial Sequence
  derived and/or modified sequence opt1 from FCHSD2__Homo_sapiens__NP_055639
augcagcccccgccccgcaaggugaaggucacccaggagcugaagaacauccagguggagcagaugaccaagcuccaggccaagcaccaggccgagugcgaccugcuggaggacaugcggacguucagccagaagaaggcggccaucgagcgcgaguacgcccagggcaugcagaagcucgccucccaguaccugaagcgggacuggcccggggugaaggccgacgaccgcaacgacuaccggagcauguaccccgucuggaaguccuuccuggagggcaccaugcaggucgcgcagagccgcaugaacaucugcgagaacuacaagaacuucaucuccgagcccgcccggaccgugcgcagccucaaggagcagcagcugaagcggugcguggaccagcugaccaagauccagacggagcuccaggagaccgugaaggaccuggccaaggggaagaagaaguacuucgagaccgagcagauggcccacgcggugcgcgagaaggccgacaucgaggccaaguccaagcugagccucuuccagucccggaucagccugcagaaggccuccgucaagcugaaggcccgccggagcgagugcaacuccaaggcgacccacgcccgcaacgacuaccuccugacgcuggccgccgccaacgcgcaccaggaccgguacuaccagaccgaccucgugaacaucaugaaggcccuggacggcaacguguacgaccaccugaaggacuaccucaucgccuucagccgcaccgagcuggagaccugccaggccguccagaacacguuccaguuccugcucgagaacuccagcaagguggugcgggacuacaaccugcagcuguuccuccaggagaacgccgucuuccacaagccccagcccuuccaguuccagcccugcgacuccgacaccagccgccagcuggaguccgagaccgggaccacggaggagcacagccugaacaaggaggcgcggaagugggccacccgcguggcccgggagcacaagaacaucgugcaccagcagcgcguccucaacgaccuggagugccacggcgccgccgugagcgagcagucccgcgcggagcuggagcagaagaucgacgaggcccgggagaacauccgcaaggccgagaucaucaagcucaaggccgaggcgcggcuggaccugcucaagcagaucggcgugagcgucgacaccuggcugaaguccgccaugaaccaggugauggaggagcuggagaacgagcgcugggcccggccgcccgccgugaccagcaacgggacgcuccacucccugaacgccgacaccgagcgcgaggagggcgaggaguucgaggacaacauggacgucuucgacgacagcuccagcucccccagcgggacccugcggaacuacccccugaccugcaagguggucuacuccuacaaggcgagccagccggacgagcucacgaucgaggagcacgaggugcuggaggugaucgaggacggcgacauggaggacugggucaaggcccgcaacaaggugggccaggugggguacguccccgagaaguaccuccaguuccccaccuccaacagccugcuguccaugcuccagagccuggccgcccuggacucccggagccacaccuccagcaacagcaccgaggccgagcugguguccggcagccucaacggggacgcguccgugugcuucgucaaggcccuguacgacuacgagggccagacggacgacgagcugagcuuccccgagggggccaucauccgcauccucaacaaggagaaccaggacgacgacggcuucugggagggcgaguucaacgggcggaucggcguguucccguccgugcuggucgaggagcugagcgccuccgagaacggggacacccccuggaugcgcgagauccagaucagccccucccccaagccgcacgccagccucccgccccugccccuguacgaccagccgcccuccagccccuaccccucccccgacaagcggagcucccucuacuucccccgcagccccuccgcgaacgagaagucccugcacgccgagagcccgggcuucagccaggccagccggcacacccccgagaccuccuacgggaagcugcgccccgugcgggccgcgcccccgccgcccacgcagaaccaccgccggcccgccgagaagaucgaggacguggagaucacccucgucuga

SEQ ID NO: 30081 - RNA, 981 nt, Artificial Sequence
  derived and/or modified sequence opt1 from FCN1__Homo_sapiens__NP_001994
auggagcugagcggcgccaccauggcccgcgggcucgcggugcugcugguccucuuccugcacaucaagaaccugcccgcccaggccgccgacacgugcccggaggugaagguggucggccucgagggguccgacaagcugaccauccugcggggcugccccgggcuccccggcgcccccggcccgaagggggaggcgggcgugaucggggagcgcggcgagcgggggcugcccggcgcccccggcaaggccgggcccgugggcccgaagggggaccgcggcgagaagggcaugcgcggggagaagggcgacgccgggcagagccaguccugcgcgaccggcccccggaacugcaaggaccugcucgaccggggguacuuccugagcggcuggcacaccaucuaccugcccgacugccgcccccucaccguccugugcgacauggacacggacggcgggggcuggaccguguuccagcggcgcauggacggguccguggacuucuaccgggacugggccgccuacaagcagggcuucgggagccagcugggcgaguucuggcucggcaacgacaacauccacgcccugaccgcccagggguccagcgagcugcgcgucgaccucguggacuucgagggcaaccaccaguucgcgaaguacaaguccuucaagguggccgacgaggccgagaaguacaagcugguccugggggccuucgugggcgggagcgccggcaacucccucaccggccacaacaacaacuucuucagcacgaaggaccaggacaacgacguguccagcuccaacugcgcggagaaguuccagggggccuggugguacgccgacugccacgccagcaaccugaacggccuguaccucauggggccgcacgaguccuacgccaacggcaucaacuggagcgcggccaagggcuacaaguacuccuacaaggucagcgagaugaaggugcggcccgccuga

SEQ ID NO: 30082 - RNA, 942 nt, Artificial Sequence
  derived and/or modified sequence opt1 from FCN2__Homo_sapiens__NP_004099
auggagcuggaccgcgccgugggcguccucggggccgcgacccugcugcucagcuuccugggcauggccugggcccugcaggccgccgacacgugccccgaggugaagaugguggggcucgagggcuccgacaagcugaccauccugcgggggugcccgggccuccccggcgcgcccgggcccaagggcgaggccgggaccaacggcaagcgcggggagcggggcccgcccggcccgcccgggaaggccggcccgcccgggcccaacggcgcccccggcgagccccagcccugccugaccgggccccggaccugcaaggaccugcucgaccgcggccacuuccugagcggguggcacacgaucuaccugcccgacugccgcccgcucaccguccugugcgacauggacaccgacggcgggggcuggaccguguuccagcggcgcguggacggcuccgucgacuucuaccgggacugggcgacguacaagcagggguucggcagccgccugggggaguucuggcucggcaacgacaacauccacgcccugaccgcccaggggaccuccgagcugcggguggaccucguggacuucgaggacaacuaccaguucgccaaguaccgcagcuucaaggucgccgacgaggcggagaaguacaaccuggugcugggcgccuucguggagggcuccgccggggacagccucaccuuccacaacaaccaguccuucagcacgaaggaccaggacaacgaccugaacaccggcaacugcgccgucauguuccagggggccuggugguacaagaacugccacguguccaaccugaacggccgguaccuccgcgggacccacggcagcuucgcgaacggcaucaacuggaaguccgggaagggcuacaacuacagcuacaagguguccgagaugaagguccggcccgccuga

SEQ ID NO: 30083 - RNA, 1101 nt, Artificial Sequence
  derived and/or modified sequence opt1 from FCRL1__Homo_sapiens__NP_001152869
augcugccccgccuccugcugcucaucugcgccccgcugugcgagcccgccgagcuguuccucaucgcgagccccucccaccccaccgagggcagcccggugacccugacgugcaagaugcccuuccugcaguccagcgacgcccaguuccaguucugcuucuuccgggacacccgcgcccucgggcccggcugguccagcucccccaagcugcagaucgccgccauguggaaggaggacaccgggagcuacuggugcgaggcgcagaccauggccuccaagguccugcggagccgccggucccagaucaacgugcaccgcgugccggucgccgacgugagccucgagacgcagccgcccggcggccaggugauggagggggaccggcugguccugaucugcuccguggccaugggcaccggggacaucaccuuccucugguacaagggcgcgguggggcugaaccugcagagcaagacccagcgcucccucacggccgaguacgagauccccagcguccgggaguccgacgccgagcaguacuacugcguggccgagaacggcuacgggcccagccccuccggccuggugagcaucaccguccgcauccccgugagccggcccauccugaugcuccgcgccccgcgggcgcaggccgccguggaggacguccuggagcugcacugcgaggcccuccgcggcuccccgcccauccuguacugguucuaccacgaggacaucacccuggggagccgguccgcccccagcggcgggggcgcguccuucaaccucagccugaccgaggagcacuccggcaacuacagcugcgaggccaacaacgggcugggcgcccagcgcuccgaggccgugacgcucaacuucaccgggcggcgcagcgcccgggacccccugcgcucccugcccagcccccucccccaggaguucaccuaccugaacuccccgacccccggccagcugcagcccaucuacgagaacgagccccgggagcagagcguggcgguccacgggcgccagcagcacuccagcgagcagaaggcccagaagccguggggccacaucuggcgcacgcgguuccccuga

SEQ ID NO: 30084 - RNA, 1335 nt, Artificial Sequence
  derived and/or modified sequence opt1 from FCRL2__Homo_sapiens__NP_001152960
augcugcucuggagccugcuggugaucuucgacgccgucaccgagcaggccgacucccucacccugguggcgcccagcuccguguucgagggcgacagcaucguccugaagugccagggggagcagaacuggaagauccagaagauggccuaccacaaggacaacaaggagcucuccguguucaagaaguucagcgacuuccugauccaguccgccgugcugagcgacuccggcaacuacuucugcagcacgaaggggcagcuguuccucugggacaagaccuccaacaucgucaagaucaaggugcaggagcuguuccagcgcccggugcucaccgccagcuccuuccagcccaucgagggcgggcccgucagccugaagugcgagacccggcugagcccccagcgccucgacgugcagcugcaguucugcuucuuccgggagaaccaggugcugggcuccggcugguccagcuccccggagcuccagaucagcgccgucuggagcgaggacacgggguccuacuggugcaaggcggagaccgugacccaccgcauccggaagcagagccugcagucccagauccacgugcagcgcauccccaucagcaacgucucccuggagauccgggcccccggcggccaggugaccgaggggcagaagcucauccugcugugcagcguggccgggggcacgggcaacgucaccuucuccugguaccgcgaggccaccgggaccagcaugggcaagaagacgcagcggucccucagcgcggagcuggagauccccgccgugaaggaguccgacgccgggaaguacuacugccgcgccgacaacggccacgugccgauccagagcaaggucgugaacauccccgugcggauccccgucucccgccccgugcugacccuccggagcccgggcgcccaggcggccgucggggaccugcuggagcuccacugcgaggcccugcgcggcuccccgcccauccuguaccaguucuaccacgaggacgugacccucgggaacagcuccgcccccagcggcgggggcgccuccuucaaccugagccugaccgcggagcacagcggcaacuacuccugcgaggccaacaacgggcucggcgcccagugcagcgaggccgugcccgucuccaucagcgggcccgacggcuaccggcgcgaccugaugacggccggggugcuguggggccucuucggcgugcugggguucaccggcgucgcgcugcuccuguacgcccuguuccacaagaucuccggggagagcuccgccaccaacgagccccggacccccaagagcuccacgcuccuguga

SEQ ID NO: 30085 - RNA, 2205 nt, Artificial Sequence
  derived and/or modified sequence opt1 from FCRL3__Homo_sapiens__XP_006711208
augcugcucuggcugcugcuccugauccugacccccggccgcgagcagagcgggguggccccgaaggccguccuccugcugaacccgcccugguccaccgcguucaagggcgagaagguggcccucaucugcagcuccaucagccacucccuggcccagggggacacguacugguaccacgacgagaagcugcucaagaucaagcacgacaagauccagaucaccgagcccggcaacuaccagugcaagacccgggggagcucccugagcgacgccgugcacgucgaguucucccccgacuggcugauccuccaggcccugcaccccguguucgagggcgacaacgugauccugcgcugccagggcaaggacaacaagaacacccaccagaaggucuacuacaaggacgggaagcagcuccccaacagcuacaaccuggagaagaucacggugaacuccgugagccgggacaacuccaaguaccacugcaccgcguaccgcaaguucuacauccuggacaucgaggucaccagcaagccccucaacauccaggugcaggagcuguuccugcacccggugcuccgggccuccagcuccacccccaucgagggcagccccaugacgcugaccugcgagacccagcugagcccccagcgcccggacguccagcuccaguucucccuguuccgggacagccagacccuggggcucggcuggucccgcagcccccggcugcagauccccgccauguggacggaggacuccgggagcuacuggugcgagguggagaccgugacccacuccaucaagaagcgcagccugcggucccagauccgcguccagcgggugcccgugagcaacgucaaccucgagauccgcccgaccggcggccagcugaucgagggggagaacauggugcugaucugcuccguggcccagggcagcgggacggucaccuucuccuggcacaaggagggccgggugcgcagccucggccggaagacccagcgcucccugcuggcggagcuccacgugcugaccgucaaggagagcgacgccgggcgguacuacugcgccgccgacaacgugcacucccccauccugagcacguggauccgcgucaccgugcggauccccgugucccaccccguccucaccuuccgcgccccgcgcgcgcacaccguggugggcgaccugcuggagcuccacugcgagagccugcggggguccccgcccauccuguaccgcuucuaccacgaggacgucacgcucggcaacagcagcgcccccuccgggggcggcgccagcuucaaccugucccugaccgccgagcacagcgggaacuacuccugcgacgccgacaacggccugggggcgcagcacagccacggcgugucccuccgggugaccguccccgugagccgccccgugcugacccugcgggcccccggggcccaggccgucgugggcgaccuccuggagcugcacugcgagucccuccgcggcagcuuccccauccuguacugguucuaccacgaggacgacacgcuggggaacaucuccgcccacagcggcgggggcgcguccuucaaccucagccugaccaccgagcacuccgggaacuacagcugcgaggccgacaacggccugggcgcccagcacuccaagguggucacccucaacgugacggggaccagccggaaccgcaccggccugaccgccgccgggaucacgggccuggugcucagcauccugguccuggcggccgccgccgcgcuccugcacuacgcccgggcccgccggaagccgggcgggcuguccgccaccggcaccagcucccacagccccuccgagugccaggagcccagcuccagccgcccgucccggaucgacccccaggagcccacccacagcaagccccucgccccgauggagcuggagcccauguacuccaacgugaaccccggggacagcaaccccaucuacucccagaucuggagcauccagcacaccaaggagaacuccgcgaacugcccgaugaugcaccaggagcacgaggagcugacggugcucuacagcgagcugaagaagacccaccccgacgacuccgccggcgaggccagcucccgcgggcgggcccacgaggaggacgacgaggagaacuacgagaacgucccccgcgugcugcucgccagcgaccacuga

SEQ ID NO: 30086 - RNA, 1548 nt, Artificial Sequence
  derived and/or modified sequence opt1 from FCRL4__Homo_sapiens__NP_112572
augcugcucugggccagccugcuggccuucgcgcccgugugcggccaguccgccgccgcccacaagccggucaucagcgugcacccgcccuggaccaccuucuucaagggggagcgcgugacgcugaccugcaacggcuuccaguucuacgccaccgagaagaccacgugguaccaccggcacuacuggggcgagaagcugacccugacccccgggaacacccucgagguccgcgaguccgggcuguaccggugccaggcgcgcggcagcccccgguccaaccccgugcgccuccucuucagcuccgacagccugauccugcaggcccccuacuccguguucgagggcgacacgcucguccugcggugccaccgccggcgcaaggagaagcugaccgccgugaaguacaccuggaacgggaacauccucagcaucuccaacaagagcugggaccugcugaucccccaggccuccagcaacaacaacggcaacuaccggugcaucggguacggcgacgagaacgacguguuccgcuccaacuucaagaucaucaagauccaggagcuguucccgcaccccgagcucaaggcgaccgacagccagcccacggaggggaacuccgucaaccugagcugcgagacccagcugcccccggagcgguccgacacgccccuccacuucaacuucuuccgcgacggcgaggugauccugagcgacuggagcaccuaccccgagcuccagcugcccaccguguggcgggagaacuccggcagcuacuggugcggggccgagaccguccgcggcaacauccacaagcacuccccgagccugcagauccacgugcagcggauccccguguccgggguccuccuggagacccagcccagcggcggccaggccguggagggggagaugcuggugcucgucugcuccguggccgagggcaccggggacacgaccuucagcuggcaccgcgaggacaugcaggagucccugggccggaagacccagcgcagccugcgggccgagcucgagcugcccgcgauccgccagucccacgccgggggcuacuacugcaccgccgacaacagcuacggcccggugcaguccaugguccugaacgugacggugcgcgagacccccgggaaccgggacggccucgucgccgccggggcgaccggcgggcugcugagcgcccuccugcuggccguggcccuccuguuccacugcuggcgccggcgcaaguccggcgucggcuuccugggggacgagacccggcucccgcccgcccccggccccggggagagcucccacagcaucugccccgcccagguggagcugcagucccuguacguggacguccaccccaagaagggcgaccucguguacagcgagauccagacgacccagcugggggaggaggaggaggcgaacaccagccgcacccugcuggaggacaaggacguguccgucguguacagcgaggugaagacgcagcacccggacaacuccgccggcaagaucagcuccaaggacgaggagagcuga

SEQ ID NO: 30087 - RNA, 2934 nt, Artificial Sequence
  derived and/or modified sequence opt1 from FCRL5__Homo_sapiens__NP_112571
augcugcucugggugauccugcugguccucgcccccgugagcggccaguucgcccgcaccccgcggcccaucaucuuccugcagccgcccuggaccacgguguuccagggggagcgcgucacccugaccugcaagggcuuccgguucuacagcccccagaagaccaagugguaccaccgcuaccucgggaaggagauccugcgggagacgcccgacaacauccuggaggugcaggaguccggcgaguaccgcugccaggcccaggggagcccccucuccucccccgugcaccuggacuucagcuccgccagccugauccuccaggccccgcuguccgucuucgagggcgacagcguggugcugcggugccgcgccaaggccgaggucacccucaacaacaccaucuacaagaacgacaacgugcuggcguuccugaacaagcggaccgacuuccacaucccccacgccugccucaaggacaacggcgccuaccgcugcacgggguacaaggaguccugcugccccgugagcuccaacaccgucaagauccaggugcaggagcccuucacccggccggugcugcgcgccagcuccuuccagcccaucagcggcaaccccgucacccugacgugcgagacccagcucucccuggagcggagcgacgugccccugcgcuuccgguucuuccgcgacgaccagacccucgggcugggcuggucccugagcccgaacuuccagaucaccgcgauguggagcaaggacuccggguucuacuggugcaaggccgccacgaugcccuacagcgugaucuccgacagcccccgguccuggauccagguccagauccccgccagccacccggugcucacccugucccccgagaaggcccugaacuucgagggcaccaaggugacccuccacugcgagacgcaggaggacagccugcgcacccuguaccgguucuaccacgagggcgucccccuccgccacaaguccgugcggugcgagcgcggggcgagcaucuccuucagccugaccaccgagaacuccggcaacuacuacugcacggccgacaacgggcugggcgccaagcccagcaaggccgugucccucagcgucaccgugccggucucccaccccgugcugaaccugagcucccccgaggaccucaucuucgagggcgccaaggugacccugcacugcgaggcgcagcgcgggagccugcccauccucuaccaguuccaccacgagggcgccgcccuggagcggcgcagcgccaacuccgccgggggcgucgcgaucagcuucucccugaccgccgagcacagcgggaacuacuacugcacggccgacaacggcuucggcccgcagcgguccaaggccgugagccucuccgugaccguccccgugagccaccccgugcugacccuguccagcgccgaggcgcucaccuucgagggggccacggucacccugcacugcgaggugcagcgcggcuccccgcagauccuguaccaguucuaccacgaggacaugccccuguggagcuccagcacccccuccguggggcgggucagcuucuccuucagccucaccgagggccacagcgggaacuacuacugcacggccgacaacggcuucggcccccagcgcuccgagguggugagccuguucgucaccgugccggugucccggcccauccugacccuccgcgucccccgggcccaggcgguggugggggaccugcuggagcuccacugcgaggcgccccgcggcagcccgcccauccuguacugguucuaccacgaggacgucacccugggguccagcuccgcccccagcggcggggaggccuccuucaaccucagccugaccgccgagcacuccggcaacuacagcugcgaggccaacaacggccugguggcccagcacuccgacacgaucagccucuccgugaucguccccgugagccggccgauccugaccuuccgcgcgccccgggcccaggccguggucggggaccugcucgagcugcacugcgaggcccugcgcggcuccagccccauccucuacugguucuaccacgaggacgugacccuggggaagaucuccgcccccagcggcggcggggccagcuucaaccugucccucaccacggagcacagcggcaucuacuccugcgaggccgacaacgggcuggaggcccagcggagcgagauggugacccugaaggucgcggugccggugucccgccccguccucacccugcgggcccccggcacccacgccgccgugggggaccugcucgagcugcacugcgaggcgcugcgcggcagcccccucauccuguaccgguucuuccacgaggacgugacgcugggcaaccgcuccagcccguccgggggcgccagccucaaccugucccugaccgccgagcacagcgggaacuacuccugcgaggccgacaacggccucggggcccagcgcagcgagaccgucacccuguacaucacgggccugaccgcgaaccgguccggccccuucgccaccgggguggccggcgggcuccugagcaucgccggccuggccgcgggggcccuccugcuguacugcuggcucucccgcaaggccggccggaagcccgccagcgaccccgcccgcuccccgagcgacagcgacucccaggagcccaccuaccacaacgugcccgcgugggaggagcugcagccggucuacacgaacgccaacccccggggcgagaacgugguguacagcgagguccgcaucauccaggagaagaagaagcacgccguggccuccgacccccggcaccuccgcaacaaggggagccccaucaucuacuccgaggugaaggucgcgagcaccccgguguccggcagccuguuccuggccuccagcgcgccccaccgguga

SEQ ID NO: 30088 - RNA, 1242 nt, Artificial Sequence
  derived and/or modified sequence opt1 from FCRL6__Homo_sapiens__NP_001271146
augcugcccagccucggcccgaugcugcuguggaccgccgugcuccuguucguccccugcguggggaagaccguguggcuguaccuccaggccuggcccaaccccgucuucgagggcgacgcgcugacgcugcgcugccagggguggaagaacaccccgcucucccaggugaaguucuaccgggacggcaaguuccugcacuucagcaaggagaaccagacccuguccaugggggccgccaccgugcagagccgcggccaguacuccugcagcggccaggucauguacaucccccagacguucacccagaccuccgagaccgccaugguccaggugcaggagcuguucccgccgcccgugcucagcgccauccccucccccgagccccgggaggggagccuggugacgcuccgcugccagaccaagcugcacccccugcgguccgcgcuccgccugcuguucagcuuccacaaggacggccacacccuccaggaccgggggccccaccccgagcugugcauccccggcgccaaggagggggacuccggccuguacuggugcgagguggccccggagggcgggcagguccagaagcagagcccccagcucgaggugcgcgugcaggcccccgucucccggcccgugcugacccugcaccacggcccggcggaccccgccgugggggacaugguccagcuccugugcgaggcccagcgcggcagcccgcccauccuguacuccuucuaccucgacgagaagaucgugggcaaccacagcgcccccugcgggggcacgaccucccugcuguuccccgucaagagcgagcaggacgccgggaacuacagcugcgaggcggagaacuccgugagccgggagcgcuccgagcccaagaagcucagccugaagggcucccaggugcuguucacccccgccagcaacuggcucgugccguggcugcccgccucccugcucgggcugauggucaucgccgccgcgcugcucguguacguccggagcuggcgcaaggccggcccccugccgucccagaucccgcccaccgcccccggcggggagcagugcccccuguacgccaacgugcaccaccagaagggcaaggacgaggggguggucuacagcguggugcaccggacguccaagcgcagcgaggcccgguccgcggaguucaccgucggccgcaaguucuaccaccucugcgggggcgagaugcccgccgcccaguga

SEQ ID NO: 30089 - RNA, 1149 nt, Artificial Sequence
  derived and/or modified sequence opt1 from FCRLA__Homo_sapiens__NP_001171795
augcugaagaagaucagcgugggcgucgccggggaccucaacaccgugaccaugaagcugggcugcgugcugauggccugggcgcucuaccugucccuggggguccucuggguggcccagaugcugcuggccgccggcugccacgccgcggccagcuucgagacgcuccagugcgaggggcccgugugcaccgaggaguccagcugccacaccgaggacgaccugaccgacgcccgcgaggccggcuuccaggucaaggcguacacguucuccgagccguuccaccugaucgugagcuacgacuggcucauccugcagggccccgccaagcccguguucgagggggaccugcucguccugcggugccaggccuggcaggacuggccccugacccaggugaccuucuaccgcgacggcuccgcccucgggccgcccggccccaaccgggaguucagcaucaccgugguccagaaggccgacuccgggcacuaccacugcagcggcaucuuccagucccccggcccggggauccccgagacggcgagcgugguggccaucaccguccaggagcuguuccccgcccccauccugcgcgccgugccguccgccgagccccaggcgggcagccccaugacccucuccugccagaccaagcugccccugcagcggagcgccgcccgccuccuguucuccuucuacaaggacgggcggaucgugcagagccgcggccuguccagcgaguuccagaucccgacggccagcgaggaccacuccggcagcuacuggugcgaggccgcgaccgaggacaaccaggucuggaagcagagcccccagcucgagauccgggugcagggggccuccuccagcgccgccccgcccacccugaaccccgcgccccagaaguccgccgcccccggcaccgcccccgaggaggccccggggccccugccgccgccgcccacgcccagcuccgaggaccccggcuucagcagcccccucgggaugcccgacccccaccuguaccaccagaugggccugcuccugaagcacaugcaggacgugcgcguccugcucggccaccuccugauggagcugcgggagcuguccgggcaccgcaagcccggcaccaccaaggcgaccgccgaguga

SEQ ID NO: 30090 - RNA, 957 nt, Artificial Sequence
  derived and/or modified sequence opt1 from FCRLB__Homo_sapiens__NP_001275758
auguggccccugaccgcccuccugcugcucgugccgagcuccggccaggccgcgacccuggagaagcccauccugagccuccacccccccuggacgaccaucuucaagggggagcgcgucacccugaagugcgacggcuaccacccgcugcuccuggagcugcagcccaucuccacccucugguaccuggggcaccugcuccugcccagccacaagaaguccaucgaggugcagacgcccggcguguaccggugccagacccgcggggccccggucagcgaccccauccaccuguccgugagcaacgacuggcucauccugcaggugcccuacgcccccgucuucgagggcgagccgcuggugcuccggugccgcggcugguacgacaagguggucuacaagcugcacuacuaccacgacgggcaggccgugcgguacuuccacuccagcgccaacuacaccgugcugcaggcgcgcgccuccgacagcggccgguaccagugcuccgggaccaugcgcauccccgucgagagcgcccccauguucuccgccaagguggcggugacgguccaggccgcccggugcgccgccagcaccggcgcgcccuccacccagagccgcuccccgcggagccgcagcuccaaccggaccggggcccgccggcuccccccccccgccgugagcggcaacgccgugcgcggcugcuccagccgggggcgcguccugccguggacgcggcccccccccccgccccagcugcacggcccccagcccuggcuccuggugaucgggcgcuucccguccgagagcccccggugccccgaccgcucccgcuggagcccgcccuccggcaccccccccccgcccggcugcagcucccggcgcgccgcgccccggcugcgcgggcaccccccggcccuccggcgccggcccuggaacaaccgccuggagcccuga

SEQ ID NO: 30091 - RNA, 1254 nt, Artificial Sequence
  derived and/or modified sequence opt1 from FDFT1__Homo_sapiens__NP_001274672
auggaguucgugaagugccugggccaccccgaggaguucuacaaccucguccgcuuccggaucgggggcaagcgcaaggugaugccgaagauggaccaggacagccuguccagcucccugaagaccugcuacaaguaccucaaccagaccagccgguccuucgccgccgugauccaggcgcuggacggggagaugcgcaacgccgucugcaucuucuaccuggugcuccgggcccuggacacgcuggaggacgacaugaccaucagcguggagaagaaggucccccuccugcacaacuuccacuccuuccuguaccagcccgacuggcgcuucauggagagcaaggagaaggaccgccaggugcucgaggacuuccccaccaucucccuggaguuccggaaccuggccgagaaguaccagaccgugaucgccgacaucugccggcgcaugggcaucgggauggcggaguuccucgacaagcacgucacgagcgagcaggagugggacaaguacugccacuacguggccggccuggugggcaucgggcugucccgccucuucagcgccuccgaguucgaggacccgcuggucggcgaggacaccgagcgggccaacagcauggggcuguuccuccagaagaccaacaucauccgggacuaccuggaggaccagcagggcgggcgcgaguucuggccccaggagguguggucccgguacgugaagaagcugggcgacuucgcgaagcccgagaacaucgaccucgccguccagugccugaacgagcugaucaccaacgcccuccaccacauccccgacgugaucacguaccugagccgccugcggaaccaguccguguucaacuucugcgccaucccgcaggucauggccaucgcgacccucgccgccugcuacaacaaccagcaggucuucaagggcgccgugaagauccgcaaggggcaggccgugacccugaugauggacgcgaccaacaugcccgccgugaaggccaucaucuaccaguacauggaggagaucuaccaccggauccccgacagcgaccccuccagcagcaagacgcgccagaucaucuccaccauccggacccagaaccugccgaacugccagcucaucagccgcucccacuacagccccaucuaccuguccuucgugaugcugcucgccgcccugagcuggcaguaccugaccacgcucucccaggucaccgaggacuacgugcagaccggcgagcacuga

SEQ ID NO: 30092 - RNA, 1260 nt, Artificial Sequence
  derived and/or modified sequence opt1 from FDPS__Homo_sapiens__NP_001129293
augccccugagccgcuggcuccgguccgugggcgucuuccugcugccggcccccuacugggcgccccgcgagcgguggcucgggagccugcgccggcccucccuggugcacggcuacccggugcucgccuggcacagcgcccgcugcuggugccaggccuggaccgaggagccccgggcccugugcuccagccugcgcaugaacggggaccagaacuccgacgucuacgcccaggagaagcaggacuucgugcagcacuucagccagaucgugcggguccucaccgaggacgagaugggccaccccgagaucggggacgcgaucgcccgccugaaggaggugcuggaguacaacgccaucggcggcaaguacaaccgggggcucacgguggucguggccuuccgcgagcugguggagccccggaagcaggacgcggacucccugcagcgcgccuggaccgucggcuggugcguggagcuccugcaggccuucuuccugguggccgacgacaucauggacagcucccucacccggcgcgggcagaucugcugguaccagaagccgggcgucgggcuggacgccaucaacgacgcgaaccugcucgaggccugcaucuaccggcugcugaagcucuacugccgcgagcagcccuacuaccugaaccugaucgagcuguuccuccagagcuccuaccagaccgagaucggccagacgcuggaccuccugaccgcgccccagggcaacguggaccuggugcgguucaccgagaagcgcuacaagagcaucgucaaguacaagaccgccuucuacuccuucuaccuccccaucgccgccgccauguacauggccgggaucgacggcgagaaggagcacgccaacgccaagaagauccugcuggagaugggggaguucuuccagauccaggacgacuaccucgaccuguucggcgacccgagcgugacgggcaagaucgggaccgacauccaggacaacaagugcuccuggcuggugguccagugccuccagcgggcgacccccgagcaguaccagauccugaaggagaacuacggccagaaggaggccgagaagguggcccgcgugaaggcccuguacgaggagcucgaccugcccgccgucuuccugcaguacgaggaggacagcuacucccacaucauggcgcucaucgagcaguacgccgcgccccugccgcccgccguguuccuggggcucgcccgcaagaucuacaagcggcgcaaguga

SEQ ID NO: 30093 - RNA, 555 nt, Artificial Sequence
  derived and/or modified sequence opt1 from FDX1__Homo_sapiens__NP_004100
auggccgccgcgggcggggcccgccugcuccgggccgccagcgccgugcugggcgggcccgcgggccgcuggcugcaccacgccgggucccgggccggcagcuccggccuccugcgcaaccgggggccgggcgggagcgccgaggcgucccgcagccuguccgucagcgcccgggcccgcuccagcuccgaggacaagaucaccgugcacuucaucaaccgggacggcgagacccucacgaccaaggggaaggugggcgacagccugcuggacgucgugguggagaacaaccucgacaucgacggcuucggggccugcgagggcacccuggccugcuccacgugccaccugaucuucgaggaccacaucuacgagaagcucgacgcgaucaccgacgaggagaacgacaugcuggaccuggccuacgggcucaccgaccgcagccggcugggcugccagaucugccugaccaaguccauggacaacaugaccguccgcgugcccgagacgguggccgacgcccggcagagcaucgacgucggcaagaccuccuga

SEQ ID NO: 30094 - RNA, 561 nt, Artificial Sequence
  derived and/or modified sequence opt1 from FDX1L__Homo_sapiens__NP_001026904
augcacgugauggccgccagcauggcccgcggcggggucuccgcccgggugcugcuccaggccgcccgcggcaccugguggaaccggcccgggggcaccagcggguccggcgagggcguggcccuggggacgacccgcaaguuccaggcgaccggcagccggccggccggggaggaggacgccggcgggcccgagcgccccggcgacgucgugaacguggucuucguggaccgguccggccagcgcauccccgugagcgggcgggucggcgacaacgugcugcaccucgcccagcgccacgggguggaccuggagggcgcgugcgaggccucccuggccugcagcacgugccacgucuacguguccgaggaccaccucgaccugcugccgccgcccgaggagcgggaggacgacaugcucgacauggcgccccugcugcaggagaacagccgccucggcugccagaucgugcugacccccgagcuggagggggccgaguucacccuccccaagaucacccggaacuucuacgucgacggccacgugcccaagccccacuga

SEQ ID NO: 30095 - RNA, 1605 nt, Artificial Sequence
  derived and/or modified sequence opt1 from FDXR__Homo_sapiens__NP_001244941
auggccagccgcugcuggcggugguggggcugguccgccuggccccgcacccggcugccgcccgcggggagcacccccuccuucugccaccacuucagcacgcaggagaagacgccccagaucugcguggucggcuccgggccggccggcuucuacaccgcccagcaccuccugaagcgcguggaggcccugugcagccagccccgggugcucaacucccccgcccugagcggggagggcgaggaccugggcgcgucccagccccucagccuggggccgaccuccugccaccccgucccccagcagcacccccaggcccacguggacaucuacgagaagcagccggugcccuucggccugguccgcuucgggguggcccccgaccaccccgaggugaagaacgucaucaacaccuucacccagaccgcccacagcggccggugcgcguucugggggaacguggaggugggccgcgacgucaccgugccggagcuccaggaggccuaccacgccgugguccuguccuacggcgccgaggaccaccgggcccuggagauccccggggaggagcuccccggcgugugcagcgcgcgcgccuucguggggugguacaacggccugcccgagaaccaggagcuggagccggaccucuccugcgacacggccgucauccugggccaggggaacguggcccuggacguggcccggauccuccugaccccgcccgagcaccuggagcgcaccgacaucaccaaggcggcccucggcguccugcggcagagccgcgugaagacgguguggcuggucgggcggcgcggcccccuccagguggccuucaccaucaaggagcugcgggagaugauccagcugcccggggcccgccccauccucgaccccgucgacuuccugggccugcaggacaagaucaaggaggugccccggccgcgcaagcggcucaccgagcugcugcuccgcaccgccacggagaagcccggccccgcggaggccgcccgccaggccuccgccagccgggcgugggggcugcgcuucuuccgguccccgcagcagguccugcccagccccgacggccgccgggccgccggggugcgccucgccgugacccggcuggagggcguggacgaggcgacccgcgccguccccaccggggacauggaggaccugccgugcggccucgugcugagcuccaucggcuacaagagccggcccguggaccccuccguccccuucgacagcaagcugggggugaucccgaacguggagggccgcgucauggacgugcccgggcucuacugcuccggcugggugaagcgggggcccacgggcgucaucgccaccaccaugaccgacagcuuccugacgggccagaugcugcuccaggaccugaaggccgggcugcuccccuccggcccgcgccccggguacgccgcgauccaggcccugcugagcucccggggcgugcgccccgugagcuucuccgacugggagaagcuggacgccgaggaggucgcccggggccaggggaccggcaagccccgcgagaagcucguggacccgcaggagaugcugcggcugcucgggcacuga

SEQ ID NO: 30096 - RNA, 1272 nt, Artificial Sequence
  derived and/or modified sequence opt1 from FECH__Homo_sapiens__NP_000131
augcgcagccugggcgccaacauggccgcggcccuccgggccgccggggugcugcugcgcgacccccucgccuccagcuccuggcgggucugccagccguggcgcuggaaguccggcgcggccgccgccgcggugaccaccgagacggcccagcacgcccagggggccaagccccaggugcagccccagaagcggaagcccaagaccggcauccugaugcugaacaugggcgggccggagacccucggcgacguccacgacuuccugcugcgccucuuccuggaccgggaccugaugacccuccccauccagaacaagcuggcccccuucaucgcgaagcgccggacgcccaagauccaggagcaguaccgccggaucgggggcgggagcccgaucaagaucuggaccagcaagcagggcgaggggauggugaagcugcucgacgagcugucccccaacaccgcgccccacaaguacuacaucggcuuccgcuacgugcacccccugaccgaggaggccaucgaggagauggagcgggacggccucgagcgcgccaucgccuucacgcaguacccgcaguacagcugcuccaccaccgggagcucccugaacgccaucuaccgguacuacaaccaggucggccgcaagcccaccaugaaguggagcacgaucgaccgguggcccacccaccaccuccugauccagugcuucgccgaccacauccugaaggagcuggaccacuucccccucgagaagcgcuccgagguggugauccuguucagcgcccacucccugccgaugagcgucgugaaccgcggggaccccuacccccaggagguguccgccaccguccagaaggugauggagcggcucgaguacugcaaccccuaccggcugguguggcagagcaaggucggcccgaugcccuggcugggcccccagaccgacgaguccaucaaggggcucugcgagcgcggccgcaagaacauccugcuggugcccaucgccuucacgagcgaccacaucgagacccucuacgagcuggacaucgaguacagccaggugcuggcgaaggagugcggggucgagaacauccggcgcgccgagucccucaacggcaacccgcuguucagcaaggcccuggccgaccucgugcacucccacauccagagcaacgagcugugcuccaagcagcugacccucagcugcccccugugcgugaaccccgucugccgggagaccaaguccuucuucacgagccagcagcuguga

SEQ ID NO: 30097 - RNA, 2010 nt, Artificial Sequence
  derived and/or modified sequence opt1 from FEM1A__Homo_sapiens__NP_061178
auggaccugcgcaccgccguguacaacgccgcgcgggacggcaagcuccagcugcugcagaagcuccugagcgggcgcucccgggaggagcuggacgagcucaccggcgaggucgccgggggcgggacgccccugcugaucgccgcccgcuacggccaccucgacgugguggaguaccuggucgaccggugcggcgccagcguggaggccgggggcuccgugcacuucgacggggagaccaucgagggcgccccgccccugugggccgccagcgcggccgggcaccucgacgucgugcgcucccugcugcggcgcggcgccagcgugaaccggaccacccgcacgaacuccacgccccuccgggccgccugcuucgacggccaccuggaggucgugcgcuaccuggugggggagcaccaggcggaccucgaggucgccaaccggcacggccacacgugccugaugaucagcugcuacaaggggcaccgcgagaucgcccgguaccugcucgagcagggcgcccaggugaaccgccgguccgccaagggcaacaccgcgcugcacgacugcgccgagagcgggucccuggagauccuccagcugcugcucggcugcaaggcccgcauggagcgggacggguacggcaugacgccccugcuggccgccagcgugaccgggcacaccaacaucgucgaguaccucauccaggagcagccgggccaggagcaggucgcgggcggggaggcccagcccggccugccccaggaggaccccuccaccagccaggggugcgcccagccgcagggcgcccccugcugcuccagcucccccgaggagccccugaacggggagagcuacgaguccugcugcccgaccagccgcgaggccgcgguggaggcccucgagcugcugggcgccaccuacguggacaagaagcgggaccuccugggcgcccugaagcacuggcgccgcgcgauggagcuccggcaccagggcggggaguaccugcccaagcccgagcccccgcagcuggugcucgccuacgacuacagccgcgaggugaacaccaccgaggagcuggaggcccugaucaccgaccccgacgagaugcggaugcaggcccuccugauccgcgagcggauccuggggcccucccaccccgacaccagcuacuacauccgcuaccggggcgccgucuacgcggacuccgggaacuucgagcgcugcauccggcucuggaaguacgcccuggacaugcagcagagcaaccuggagccgcugucccccaugaccgccagcuccuuccucagcuucgccgagcuguucuccuacgugcugcaggaccgcgccgcgaagggcagccucggcacccagaucggguucgccgaccugaugggcgugcugacgaaggggguccgggagguggagcgcgcccuccagcugccccgggagcccggcgacuccgcccaguucaccaaggcccuggcgaucauccuccaccuccuguaccugcuggagaaggucgagugcaccccgagccaggagcaccugaagcaccagaccguguaccgccuccugaagugcgcgccccggggcaagaacggguucacgccccugcacauggccguggacaaggacaccaccaacgucggccgcuaccccguggggcgguucccgucccuccacguggucaaggugcugcuggacugcggcgccgaccccgacagccgcgacuucgacaacaacacgccccuccacaucgcggcccagaacaacugcccggccaucaugaacgcccugaucgaggccggggcgcacauggacgccaccaacgccuucaagaagaccgccuacgagcugcucgacgagaagcugcuggcccggggcaccaugcagcccuucaacuacgugacccuccagugccuggcggcccgcgcccuggacaagaacaagauccccuacaagggcuucauccccgaggaccucgaggccuucaucgagcugcacuga

SEQ ID NO: 30098 - RNA, 1884 nt, Artificial Sequence
  derived and/or modified sequence opt1 from FEM1B__Homo_sapiens__NP_056137
auggagggccuggccggguacguguacaaggccgcgagcgagggcaagguccucacccuggccgcccugcuccugaaccgcuccgagagcgacauccgguaccugcucggguacgugucccagcagggcgggcagcgcagcacgccccugaucaucgccgcccggaacggccacgcgaaggugguccgccugcuccuggagcacuaccgggugcagacccagcagaccggcaccgugcgcuucgacggguacgucaucgacggcgccaccgcccuguggugcgccgcgggggccggccacuucgagguggugaagcuccuggucucccacggggccaacgugaaccacacgaccgugaccaacagcaccccgcugcgggccgccugcuucgacggccgccucgacaucgucaaguaccugguggagaacaacgcgaacaucuccaucgccaacaaguacgacaacacgugccugaugaucgccgccuacaagggccacaccgacgugguccgguaccuccuggagcagcgcgccgaccccaacgcgaaggcccacugcggggccaccgcccugcacuucgccgcggaggccggccacaucgacaucgugaaggagcucaucaaguggcgggccgccaucguggucaacgggcacggcaugacgccccugaagguggccgcggagagcugcaaggccgacguggucgagcugcuccugucccacgccgacugcgaccgccggagccgcaucgaggcccuggagcuccugggcgcguccuucgccaacgaccgggagaacuacgacaucaucaagaccuaccacuaccuguaccucgccaugcuggagcgcuuccaggacggggacaacauccuggagaaggaggugcugcccccgauccacgccuacggcaaccggaccgagugccgcaacccccaggagcuggagagcauccggcaggaccgcgacgcccugcacauggaggggcucaucgugcgggagcgcauccugggcgcggacaacaucgacgucucccaccccaucaucuaccgcggggccguguacgccgacaacauggaguucgagcagugcaucaagcuguggcuccacgcccugcaccuccggcagaagggcaaccgcaacacccacaaggaccuccugcgguucgcccaggucuucagccagaugauccaccugaacgagaccgugaaggcgcccgacaucgagugcgugcuccgcugcuccguccuggagaucgagcagagcaugaaccgggugaagaacaucuccgacgccgacgugcacaacgccauggacaacuacgagugcaaccuguacacguuccucuaccuggucugcaucagcaccaagacccagugcuccgaggaggaccagugcaagaucaacaagcagaucuacaaccugauccaccuggacccgcgcacccgggagggcuucacgcuccugcaccuggccgugaacagcaacacccccguggacgacuuccacaccaacgacgucugcagcuuccccaacgcccucgugaccaagcugcugcucgacugcggggcggaggugaacgccgucgacaacgagggcaacuccgcccugcacaucaucgugcaguacaaccgccccaucagcgacuuccugacgcuccacuccaucaucaucagccugguggaggccggggcgcacaccgacaugaccaacaagcagaacaagaccccgcuggacaaguccacgaccggcgucagcgagauccuccugaagacccagaugaagaugucccugaagugccucgccgcccgggccgugcgcgccaacgacaucaacuaccaggaccagaucccccggacccuggaggaguucgugggguuccacuga

SEQ ID NO: 30099 - RNA, 1854 nt, Artificial Sequence
  derived and/or modified sequence opt1 from FEM1C__Homo_sapiens__NP_064562
auggaccugaagaccgccguguucaacgccgcgcgcgacggcaagcuccggcugcugaccaagcuccuggccagcaaguccaaggaggaggucagcucccugaucagcgagaagacgaacggggccacgccccuccugauggccgcccgcuacggccaccuggacaugguggaguuccuccuggagcagugcuccgcgagcaucgaggucgggggcuccgugaacuucgacggggagaccaucgagggcgccccgccccugugggccgccagcgcggccggccaccucaagguggugcagucccugcugaaccacggggccagcgucaacaacaccacccucaccaacuccacgccccugcgggccgccugcuucgacggccaccuggagaucgugaaguaccucguggagcacaaggcggaccuggaggucagcaaccgccacgggcacacgugccugaugaucuccugcuacaagggccacaaggagaucgcccaguaccuccuggagaagggggccgacgugaaccggaaguccgugaagggcaacaccgcccugcacgacugcgccgaguccggcagccucgacaucaugaagaugcugcugauguacugcgcgaagauggagaaggacggguacggcaugacgccccuccuguccgccagcgucaccgggcacaccaacaucguggacuuccugacccaccacgcccagaccuccaagaccgagcgcaucaacgcccucgagcugcugggcgccaccuucguggacaagaagcgggaccuccugggcgcgcugaaguacuggaagaaggccaugaacaugcgcuacagcgaccggaccaacaucaucagcaagccggucccccagacccucaucauggccuacgacuacgccaaggaggugaacuccgccgaggagcuggaggggcugaucgcggaccccgacgagaugcgcaugcaggcccuccugauccgggagcgcauccugggccccagccacccggacaccuccuacuacauccgguaccgcggggccguguacgccgacagcggcaacuucaagcggugcaucaaccucuggaaguacgcgcuggacaugcagcaguccaaccuggacccccucagccccaugaccgccuccagccugcuguccuucgccgagcuguucagcuucaugcuccaggaccgcgccaaggggcugcugggcacgaccgucaccuucgacgaccucaugggcauccugugcaaguccgugcuggagaucgagcgggccaucaagcagacccagugccccgcggacccgcuccagcugaacaaggcccugagcaucauccuccaccugaucugccugcucgagaaggugcccugcacgcuggagcaggaccacuucaagaagcagaccaucuaccgcuuccugaagcuccacccccgggggaagaacaacuucagcccccugcaccuggccgucgacaagaacacgaccugcgugggccgcuacccggugugcaaguuccccagccuccaggucaccgccauccugaucgagugcggggccgacgugaacguccgggacuccgacgacaacagcccccugcacaucgcggcccucaacaaccaccccgacaucaugaaccugcugaucaaguccggcgcccacuucgacgccaccaaccuccacaagcagaccgccagcgaccugcuggacgagaaggagaucgcgaagaaccucauccagccgaucaaccacaccacgcugcagugccuggccgcccgcgugaucgugaaccaccgcaucuacuacaaggggcacauccccgagaagcucgagaccuucgucucccugcaccgguga

SEQ ID NO: 30100 - RNA, 1143 nt, Artificial Sequence
  derived and/or modified sequence opt1 from FEN1__Homo_sapiens__NP_004102
augggcauccaggggcuggccaagcucaucgccgacguggcgcccagcgccauccgcgagaacgacaucaaguccuacuucggccggaaggucgccaucgacgccagcauguccaucuaccaguuccugaucgccgugcgccagggcggggacgugcugcagaacgaggagggggagaccaccagccaccucaugggcauguucuaccggacgauccgcaugauggagaacggcaucaagccggucuacguguucgacgggaagccgccccagcugaaguccggcgagcuggcgaagcggagcgagcgccgggccgaggccgagaagcagcuccagcaggcccaggcggccggggccgagcaggagguggagaaguucaccaagcgccuggucaaggugaccaagcagcacaacgacgagugcaagcaccuccucucccugaugggcauccccuaccuggacgcccccagcgaggccgaggcguccugcgccgcccucgugaaggccgggaaggucuacgccgcggccaccgaggacauggacugccugacguucggcagccccgugcugaugcggcaccucaccgccuccgaggccaagaagcugcccauccaggaguuccaccugagccgcauccuccaggagcugggccugaaccaggagcaguucguggaccucugcauccugcugggguccgacuacugcgagagcauccggggcaucgggcccaagcgcgccgucgaccucauccagaagcacaaguccaucgaggagaucgugcggcgccuggacccgaacaaguaccccgugcccgagaacuggcugcacaaggaggcgcaccagcuguuccuggagcccgagguccuggacccggagagcguggagcucaagugguccgagcccaacgaggaggagcugaucaaguucaugugcggcgagaagcaguucagcgaggagcggauccgcuccggcgugaagcggcugagcaagagccgccagggguccacccagggccggcucgacgacuucuucaaggucaccgggagccuguccagcgccaagcgcaaggagcccgagcccaagggcuccacgaagaagaaggccaagaccggggccgccggcaaguucaagcggggcaaguga

SEQ ID NO: 30101 - RNA, 501 nt, Artificial Sequence
  derived and/or modified sequence opt1 from FERD3L__Homo_sapiens__NP_690862
auggccgccuaccccgagagcugcguggacaccaccguccuggacuucguggcggaccucucccuggccagcccgcgccggccccugcucugcgacuucgcccccggcgugucccugggggaccccgcccuggcccuccgcgagggccggccgcgccggauggcgcgcuucgaggagggggaccccgaggaggaggagugcgaggucgaccagggcgacggggaggaggaggaggaggaggagcggggccgcggcgugagccugcuggggcggcccaagcgcaagcgggugaucacguacgcccagcgccaggccgccaacauccgggagcgcaagcggauguucaaccucaacgaggcguucgaccagcugcgccggaagguccccaccuucgccuacgagaagcgccugucccggaucgagacccuccgccuggccaucguguacaucagcuucaugaccgagcugcucgaguccugcgagaagaaggagagcggcuga

SEQ ID NO: 30102 - RNA, 2469 nt, Artificial Sequence
  derived and/or modified sequence opt1 from FER__Homo_sapiens__NP_005237
augggcuucgggagcgaccugaagaacucccacgaggccgugcucaagcugcaggacugggagcugcgccuccuggagaccgugaagaaguucauggcccugcggaucaagagcgacaaggaguacgccuccacccuccagaaccugugcaaccagguggacaaggagagcacggugcagaugaacuacgucuccaacgugagcaaguccuggcugcucaugauccagcagaccgagcagcugagccgcaucaugaagacccacgccgaggaccugaacuccggcccccuccaccggcugaccaugaugaucaaggacaagcagcaggucaagaaguccuacaucggggugcaccagcagaucgaggccgagaugaucaaggugacgaagaccgagcuggagaagcucaagugcagcuaccgccagcugaucaaggagaugaacagcgccaaggagaaguacaaggaggcccuggcgaagggcaaggagaccgagaaggccaaggagcgguacgacaaggccaccaugaagcuccacaugcugcacaaccaguacgugcuggcccucaagggggcgcagcugcaccagaaccaguacuacgacaucacgcugccgcuccugcuggacucccuccagaagaugcaggaggagaugaucaaggcccugaagggcaucuucgacgaguacagccagaucaccucccuggucaccgaggagaucgugaacgugcacaaggagauccagaugagcgucgagcagaucgaccccuccaccgaguacaacaacuucaucgacgugcaccgcacgaccgccgccaaggagcaggagaucgaguucgacaccagccuccuggaggagaacgagaaccugcaggccaacgagaucauguggaacaaccucaccgcggagucccuccaggugaugcugaagacgcuggccgaggagcugaugcagacccagcagaugcugcucaacaaggaggaggccguccuggagcuggagaagcggaucgaggagagcagcgagaccugcgagaagaaguccgacaucgugcuccugcugagccagaagcaggcccucgaggagcugaagcaguccgugcagcagcugcgcugcaccgaggccaaguucagcgcgcagaaggagcuccuggagcagaagguccaggagaacgacggcaaggagcccccgcccguggugaacuacgaggaggacgcccgguccgucacgagcauggagcgcaaggagcggcuguccaaguucgagagcauccgccacuccaucgccgggaucauccggagccccaaguccgcccugggcagcuccgcccucagcgacaugaucuccaucagcgagaagccccuggcggagcaggacugguaccacggggccaucccccgcaucgaggcccaggagcugcucaagaagcagggcgacuuccuggugcgggagucccacgggaagccgggcgaguacgugcugagcgucuacuccgacggccagcgccggcacuucaucauccaguacguggacaacauguaccgcuucgaggggaccggcuucagcaacaucccccagcucaucgaccaccacuacaccaccaagcaggucaucacgaagaaguccgggguggugcugcugaaccccauccccaaggacaagaaguggauccucagccacgaggacgucauccugggcgagcugcucggcaaggggaacuucggcgagguguacaaggggacccugaaggacaagaccagcguggccgucaagaccugcaaggaggaccugccgcaggagcucaagaucaaguuccugcaggaggccaagauccugaagcaguacgaccaccccaacaucgugaagcucaucggcgugugcacgcagcggcagcccgucuacaucaucauggagcugguguccgggggcgacuuccugaccuuccuccgccggaagaaggacgagcugaagcugaagcagcucgugaaguucagccuggacgcggccgccggcaugcuguaccucgaguccaagaacugcauccaccgcgaccuggccgcgcgcaacugccuggucggggagaacaacgugcucaagaucagcgacuucggcaugucccggcaggaggacgggggcguguacagcuccagcgggcugaagcagauccccaucaaguggaccgccccggaggcccugaacuacggccgcuacuccagcgaguccgacgucuggagcuucggcauccuccugugggagaccuucucccugggggugugccccuaccccggcaugacgaaccagcaggcccgggagcaggucgagcgcggguaccggaugagcgcgccccagcacugcccggaggacaucuccaagaucaugaugaagugcugggacuacaagcccgagaaccgccccaaguucagcgagcuccagaaggagcugaccaucaucaagcggaagcugaccuga

SEQ ID NO: 30103 - RNA, 2034 nt, Artificial Sequence
  derived and/or modified sequence opt1 from FERMT1__Homo_sapiens__NP_060141
augcugagcuccaccgacuucaccuucgccagcugggagcucgugguccgcguggaccaccccaacgaggagcagcagaaggacgugacgcugcgggucuccggcgaccugcacgucgggggcgugaugcucaagcugguggagcagaucaacaucagccaggacugguccgacuucgcccuguggugggagcagaagcacugcuggcuccugaagacccacuggacccuggacaaguacggggugcaggcggacgccaagcuccuguucaccccgcagcacaagaugcugcgccuccggcugcccaaccugaagauggugcgccuccgggucagcuucuccgccgugguguucaaggccgucagcgacaucugcaagauccugaacauccgccgguccgaggagcugagccuccugaagcccuccggcgacuacuucaagaagaagaagaagaaggacaagaacaacaaggagcccaucaucgaggacauccugaaccucgagagcuccccgacggccagcggguccagcgugucccccggccuguacagcaagaccaugacccccaucuacgaccccaucaacggcaccccggcguccagcacgaugaccugguucagcgacagcccccugaccgagcagaacugcuccauccucgccuucucccagccgccccagagccccgaggcccuggccgacauguaccagccccgcucccugguggacaaggcgaagcucaacgccggguggcuggacagcucccggagccugauggagcagggcauccaggaggacgagcagcuccugcugcgcuucaaguacuacuccuucuucgaccucaaccccaaguacgacgccguccggaucaaccagcuguacgagcaggcccgcugggccauccugcucgaggagaucgacugcaccgaggaggagaugcugaucuucgcggcccugcaguaccacaucagcaagcucucccugagcgccgagacgcaggacuucgccggggaguccgagguggacgagaucgaggccgcgcugagcaaccucgaggugacccuggagggcgggaaggccgacucccugcucgaggacaucaccgacauccccaagcuggccgacaaccugaagcuguuccggccgaagaagcuccugcccaaggccuucaagcaguacugguucaucuucaaggacaccagcaucgccuacuucaagaacaaggagcuggagcagggcgagccccucgagaagcugaaccugcgcggcugcgaggucgugcccgacgugaacgucgcggggcggaaguucggcaucaagcuccugaucccgguggccgacgggaugaacgagauguaccugcgcugcgaccacgagaaccaguacgcccaguggauggccgccugcaugcucgcguccaagggcaagacgauggccgacagcuccuaccagcccgaggugcugaacauccugagcuuccuccggaugaagaaccgcaacagcgccucccaggucgccagcucccuggagaacauggacaugaaccccgagugcuucgugagcccccggugcgcgaagcgccacaaguccaagcagcuggccgcccggauccucgaggcccaccagaacgucgcccagaugccgcugguggaggcgaagcugcgcuucauccaggccuggcagagccuccccgaguucggccugaccuacuaccuggugcgcuucaagggguccaagaaggacgacauccucggcgucagcuacaaccggcugaucaagaucgacgccgccaccgggauccccgugaccacguggcgcuucaccaacaucaagcaguggaacgugaacugggagacccggcaggucgugaucgaguucgaccagaacguguucaccgccuucacgugccuguccgcggacugcaagaucguccacgaguacaucggcggguacaucuuccucagcacccgcuccaaggaccagaacgagacccuggacgaggaccuguuccacaagcucaccggcggccaggacuga

SEQ ID NO: 30104 - RNA, 2064 nt, Artificial Sequence
  derived and/or modified sequence opt1 from FERMT2__Homo_sapiens__NP_001128471
auggcccuggacggcauccgcaugcccgacgggugcuacgccgacggcaccugggagcucagcgugcacgucaccgaccugaaccgggacgugacgcugcgcgugaccggggagguccacaucggcggggugaugcucaagcugguggagaagcuggacgucaagaaggacugguccgaccacgcgcucuggugggagaagaagcggaccuggcugcugaagacccacuggacgcucgacaaguacggcauccaggccgacgccaagcugcaguucaccccgcagcacaagcugcuccgccugcagcugcccaacaugaaguacgugaaggugaaggucaacuucagcgaccggguguucaaggccguguccgacaucugcaagaccuucaacauccgccaccccgaggagcucagccugcugaagaagccccgggacccgaccaagaagaagaagaagaagcucgacgaccaguccgaggacgaggcccuggagcuggagggcccccucaucacgcccgggagcggcuccaucuacagcucccccgggcuguacagcaagaccaugaccccgaccuacgacgcgcacgacggcagcccccugucccccacguccgccugguucggggacagcgcccucuccgagggcaaccccggcauccuggccgucagccagccgaucaccucccccgagauccuggcgaagauguucaagccccaggcccuccuggacaaggccaagaucaaccagggguggcuggacagcucccgcagccucauggagcaggacgugaaggagaacgaggcccugcugcuccgguucaaguacuacagcuucuucgaccugaaccccaaguacgacgccauccgcaucaaccagcuguacgagcaggcgaagugggccauccuccuggaggagaucgagugcaccgaggaggagaugaugauguucgccgcccugcaguaccacaucaacaagcucuccaucaugaccagcgagaaccaccugaacaacuccgacaaggagguggacgaggucgacgccgcgcugagcgaccucgagaucacgcuggagggcgggaagaccuccaccauccugggcgacaucaccagcaucccggagcucgccgacuacaucaagguguucaagcccaagaagcugacgcugaagggcuacaagcaguacuggugcaccuucaaggacaccuccaucagcugcuacaaguccaaggaggagagcuccgggacccccgcccaccagaugaaccuccggggcugcgaggugacgcccgacgucaacaucagcgggcagaaguucaacaucaagcugcugaucccgguggccgagggcaugaacgagaucuggcugcgcugcgacaacgagaagcaguacgcccacuggauggcggccugccggcucgccuccaaggggaagaccauggccgacagcuccuacaaccuggaggugcagaacauccugagcuuccucaagaugcagcaccugaaccccgacccccagcugauccccgagcagaucaccaccgacaucacgccggagugccucgucagcccccgcuaccugaagaaguacaagaacaagcagcccggcuacauccgggaccugaucaccgcccgcauccucgaggcgcaccagaacguggcccagaugucccugaucgaggccaagaugcgguucauccaggccuggcagucccugcccgaguucggcaucacccacuucaucgcgcgcuuccagggcgggaagaaggaggagcucaucgggaucgccuacaaccggcugauccgcauggacgccagcaccggcgacgccaucaagacguggcgguucagcaacaugaagcaguggaacgugaacugggagaucaagauggucaccguggaguucgccgacgagguccgccuguccuucaucugcaccgagguggacugcaaggugguccacgaguucaucgggggcuacaucuuccucagcacccgcgcgaaggaccagaacgagucccuggacgaggagauguucuacaagcugacgagcggcuggguguga

SEQ ID NO: 30105 - RNA, 1992 nt, Artificial Sequence
  derived and/or modified sequence opt1 from FERMT3__Homo_sapiens__NP_113659
auggccggcaugaagaccgccagcggggacuacaucgacuccagcugggagcugcgcguguucgucggcgaggaggaccccgaggcggaguccgugacccuccgggugacgggggagagccacaucggcgggguccugcugaagaucguggagcagaucaaccgcaagcaggacugguccgaccacgccaucuggugggagcagaagcggcaguggcuccugcagacccacuggacccuggacaaguacggcauccucgccgacgcccgccuguucuucggcccgcagcaccggcccgugauccugcgccuccccaaccggcgcgcccugcggcugcgcgcgagcuucucccagccccucuuccaggccgucgccgccaucugccggcugcugagcauccgccacccggaggagcucucccugcugcgggcgcccgagaagaaggagaagaagaagaaggagaaggagcccgaggaggagcucuacgaccugagcaagguggugcuggccgggggcgucgcccccgcccucuuccgcgggaugccggcccacuucuccgacagcgcgcagaccgaggccugcuaccacaugcugucccggccccagcccccgcccgacccccugcuccugcagcgccugccccggcccagcucccucagcgacaagacgcagcugcacucccgcuggcuggacagcucccggugccucaugcagcagggcaucaaggccggggacgcccuguggcugcgcuucaaguacuacagcuucuucgaccucgacccgaagaccgaccccgugcggcugacccagcuguacgagcaggcccgcugggaccuccugcuggaggagaucgacugcaccgaggaggagaugaugguguucgcggcccuccaguaccacaucaacaagcugagccaguccggcgaggucggcgagcccgccgggacggaccccggccuggacgaccucgacguggcccugagcaaccuggaggugaagcucgagggguccgccccgaccgacguccuggacagccugaccaccauccccgagcucaaggaccaccuccgcaucuuccggccccgcaagcugacgcugaagggcuaccggcagcacugggugguguucaaggagaccacccuguccuacuacaagagccaggacgaggcgcccggcgacccgauccagcagcugaaccugaaggggugcgaggucgugcccgacgugaacgucuccggccagaaguucugcaucaagcuccuggugcccagccccgaggggauguccgagaucuaccugcgcugccaggacgagcagcaguacgcccgguggauggccggcugccgccucgccagcaaggggcggaccauggccgacuccagcuacacguccgaggugcaggcgauccuggccuuccugagccuccagcgcaccggcuccggcgggccgggcaaccacccccacgggcccgacgccagcgccgagggccugaacccguacgggcuggucgcgccccgguuccagcgcaaguucaaggccaagcagcucacgccccggauccuggaggcccaccagaacguggcccagcugucccucgccgaggcgcagcugcgcuucauccaggccuggcagagccugcccgacuucggcaucuccuacgucauggugcgguucaagggcagccgcaaggacgagauccucgggaucgccaacaaccggcugauccgcaucgaccuggccgugggcgacgucgugaagaccuggcgguucagcaacaugcgccaguggaacgugaacugggacauccggcaggucgccaucgaguucgacgagcacaucaacguggcguucuccugcgugagcgccuccugccgcaucguccacgaguacaucgggggcuacaucuuccucagcacccgcgagcgggcccgcggggaggagcuggacgaggaccuguuccuccagcugaccggcggccacgaggccuucuga

SEQ ID NO: 30106 - RNA, 2085 nt, Artificial Sequence
  derived and/or modified sequence opt1 from FES__Homo_sapiens__NP_001137257
augggcuucagcuccgagcugugcagcccccaggggcacggcgugcuccagcagaugcaggaggccgagcugcgccugcucgaggggaugcggaaguggauggcccagcgcgucaaguccgaccgggaguacgcgggccugcugcaccacaugagccuccaggacuccgggggccagagccgcgccaucuccccggacagccccaucucccagacccacagccaggacaucgagaagcugaagucccaguaccgggcccuggcccgcgacagcgcccaggcgaagcggaaguaccaggaggccuccaaggacaaggaccgcgacaaggccaaggacaaguacgugcggagccucuggaagcuguucgcccaccacaaccgcuacgugcugggcguccgggcggcccagcuccaccaccagcaccaccaccagcugcugcuccccgggcugcugcgcucccuccaggaccugcacgaggagauggccugcauccugaaggagauccuccaggaguaccuggagaucagcucccuggugcaggacgagguggucgccauccaccgggagauggccgcggccgccgcccgcauccagcccgaggccgaguaccagggcuuccuccggcaguacgggagcgcgccggacgugccgcccugcgugaccuucgacgagucccugcuggaggagggcgagccccucgagcccggggagcugcagcugaacgagcucacggucgagagcgugcagcacacccugaccagcgugaccgacgagcuggccgucgccacggagaugguguuccgccggcaggagauggugacccagcuccagcaggagcugcgcaacgaggaggagaacacccacccccgggagcgcguccagcugcucggcaagcgccaggugcugcaggaggcccugcagggccuccagguggcccugugcucccaggcgaagcugcaggcccagcaggagcuccugcagaccaagcuggagcaccucgggcccggcgagcccccgcccguccugcugcuccaggacgaccggcacagcacguccagcuccgagcaggagcgcgagggcgggcggacccccacccuggagauccucaagagccacaucuccggcaucuuccgccccaaguucagcaaccuguaccggcuggagggggagggcuucccguccaucccccugcugaucgaccaccuccugagcacccagcagccccugacgaagaaguccgggguggugcuccaccgcgccguccccaaggacaagugggugcugaaccacgaggaccuggugcucggcgagcagaucgggcggggcaacuucggcgaggucuucagcgggcgccugcgggccgacaacacccugguggccgucaaguccugccgcgagacccucccgcccgaccugaaggcgaaguuccugcaggaggcccggauccucaagcaguacagccaccccaacaucgugcgccugaucggcgugugcacccagaagcagcccaucuacaucgucauggagcuggugcagggcggggacuuccucacguuccugcggaccgagggggcccgccugcgggugaagacccuccugcagauggucggcgacgccgcggccggcauggaguaccuggaguccaagugcugcauccaccgcgaccucgccgcccggaacugccuggugaccgagaagaacgugcugaagaucagcgacuucgggaugucccgcgaggaggccgacggcgucuacgcggccagcgggggccuccgccaggugccggugaaguggacggcccccgaggcccugaacuacgggcgguacuccagcgagagcgacgucugguccuucggcauccugcucugggagaccuucagccugggcgccucccccuaccccaaccugagcaaccagcagacccgggaguucguggagaagggcgggcgccucccgugccccgagcugugccccgacgcgguguuccgccugauggagcagugcugggccuacgagccggggcagcggcccuccuucagcaccaucuaccaggagcuccaguccauccgcaagcggcaccgcuga

SEQ ID NO: 30107 - RNA, 717 nt, Artificial Sequence
  derived and/or modified sequence opt1 from FEV__Homo_sapiens__NP_059991
augcgccagagcggcgccucccagccccugcucaucaacauguaccugcccgaccccgugggggacggccuguucaaggacgggaagaaccccagcuggggcccccucuccccggccguccagaaggggagcggccagauccagcuguggcaguuccugcucgagcugcuggcggaccgggccaacgccggcugcaucgccugggagggcgggcacggggaguucaagcucaccgaccccgacgagguggcccgccgguggggcgagcgcaaguccaagcccaacaugaacuacgacaagcugagccgggcgcugcgcuacuacuacgacaagaacaucauguccaaggugcacgggaagcgguacgccuaccgcuucgacuuccagggccucgcccaggccugccagcccccgcccgcgcacgcccacgccgccgccgcggccgccgccgccgcggccgccgcccaggacggcgcccuguacaagcugcccgcggggcucgcgccccugccguuccccggccugagcaagcucaaccugauggccgccuccgccggggucgcccccgccggcuucagcuacuggcccggcccggggcccgccgccaccgcggccgccgccacggccgcgcuguaccccucccccagccuccagccgccgcccggccccuucggggccguggccgccgccucccaccugggcgggcacuaccacuga

SEQ ID NO: 30108 - RNA, 1179 nt, Artificial Sequence
  derived and/or modified sequence opt1 from FEZ1__Homo_sapiens__NP_005094
auggaggcgccccuggugagccucgacgaggaguucgaggaccugcgcccguccugcagcgaggaccccgaggagaagccccagugcuucuacggcuccagcccccaccaccuggaggacccgucccucagcgagcuggagaacuucuccagcgagaucaucuccuucaagagcauggaggaccuggucaacgaguucgacgagaagcucaacgugugcuuccggaacuacaacgccaagaccgagaaccuggcccccgugaagaaccagcugcagauccaggaggaggaggagacccuccaggacgaggaggucugggacgcccugacggacaacuacauccccucccugagcgaggacuggcgcgaccccaacaucgaggcccucaacgggaacugcuccgacaccgagauccacgagaaggaggaggaggaguucaacgagaaguccgagaacgacagcggcaucaacgaggagccgcugcugaccgccgaccaggugaucgaggagaucgaggagaugaugcagaacagccccgaccccgaggaggaggaggaggugcucgaggaggaggacgggggcgagaccuccagccaggccgacuccguccugcugcaggagaugcaggcgcucacgcagaccuucaacaacaacuggagcuacgaggggcugcggcacaugagcggcuccgagcugaccgagcuccuggaccagguggagggcgccauccgcgacuucagcgaggagcuggugcagcagcucgcccggcgcgacgagcuggaguucgagaaggaggucaagaacuccuucaucaccgugcugaucgaggugcagaacaagcagaaggagcagcgggagcucaugaagaagcgccggaaggagaaggggcugagccugcaguccagccgcaucgagaagggcaaccagaugccccucaagcgguucuccauggaggggaucagcaacauccugcaguccggcauccgccagacguucgggagcuccggcaccgacaagcaguaccugaacaccgucaucccguacgagaagaaggccagcccgcccuccguggaggaccuccagaugcugaccaacauccuguucgcgaugaaggaggacaacgagaaggugcccacgcuccugaccgacuacauccugaagguccucugccccaccuga

SEQ ID NO: 30109 - RNA, 1143 nt, Artificial Sequence
  derived and/or modified sequence opt1 from FEZ2__Homo_sapiens__NP_001036013
auggccgccgacggcgacuggcaggacuucuacgaguuccaggagcccgcgcgcagccugcucgaccaggagaacugcaacgccuccccggagcccggggccgaggccggcgccgaggccgggggcggggcggacggcuuccccgcccccgccugcagccuggaggagaagcugucccucugcuuccggccgagcgaccccggcgcggagccgccccgcaccgccgugcggcccaucaccgagcgcucccugcugcagggggacgagaucuggaacgcccucacggacaacuacggcaacgucaugcccguggacuggaaguccagccacacccggacccugcaccuccugacccugaaccugagcgagaaggggguguccgacagccuccuguucgacacguccgacgacgaggagcugcgcgagcagcucgacaugcacagcaucaucgucuccugcgugaacgacgagccccuguucaccgccgaccaggugaucgaggagaucgaggagaugaugcaggagagccccgacccggaggacgacgagacccccacccaguccgaccggcugagcaugcucucccaggagauccagacgcugaagcgcagcuccaccggcagcuacgaggagcgggucaagcgccugagcguguccgagcucaacgagauccuggaggagaucgagaccgccaucaaggaguacagcgaggagcuggugcagcagcucgcgcugcgggacgagcuggaguucgagaaggaggucaagaacuccuucaucagcgugcucaucgaggugcagaacaagcagaaggagcacaaggagaccgccaagaagaagaagaagcugaagaacggguccagccagaacggcaagaacgagcgcucccacaugcccggcacgcgguucagcauggaggggaucuccaacgucauccagaacggccugcgccacaccuucgggaacagcggcggcgagaagcaguaccucaccaccgugauccccuacgagaagaagaacgggccgcccuccguggaggaccugcagauccugacgaagauccuccgggccaugaaggaggacagcgagaagguccccucccugcugaccgacuacauccucaaggugcugugccccaccuga

SEQ ID NO: 30110 - RNA, 1428 nt, Artificial Sequence
  derived and/or modified sequence opt1 from FEZF1__Homo_sapiens__NP_001019784
auggacagcuccugccacaacgccaccaccaagaugcuggccacggcgcccgcccgcggcaacaugaugagcaccuccaagccccucgccuucagcaucgagcggaucauggcccgcacccccgagcccaaggcccugcccgugccccacuuccugcagggggcgcuccccaagggcgagcccaagcacucccugcaccugaacagcuccauccccugcaugaucccguucguccccguggccuacgacaccagccccaaggccggggugacgggcuccgagccccggaaggccagccucgaggcgccggccgcccccgccgccguccccuccgcgcccgccuucagcugcuccgaccugcugaacugcgcccucagccugaagggggaccuggcccgcgacgcccucccgcugcagcaguacaagcuggugcggccccgcguggucaaccacuccagcuuccacgcgaugggcgcccucugcuaccugaaccggggcgacgggcccugccaccccgccgccggcgugaacauccacccgguggccuccuacuuccugagcagcccccuccacccccagcccaagaccuaccuggcggagcgcaacaagcuggucgugccggccguggagaaguaccccuccggggucgccuucaaggaccucagccaggcccagcugcagcacuacaugaaggaguccgcccagcugcucagcgagaagaucgcguucaagaccuccgacuucagccggggcucccccaacgccaagcccaagguguucacgugcgaggugugcgggaaggucuucaacgcccacuacaaccugacccgccacaugccggugcacaccggcgcccggcccuucgugugcaaggucugcggcaagggguuccgccaggcgagcacccugugccggcacaagaucauccacacccaggagaagccccacaagugcaaccagugcggcaaggccuucaaccgcuccagcacgcucaacacccacacccggauccacgccggguacaagccguucgugugcgaguucugcggcaagggcuuccaccagaaggggaacuacaagaaccacaagcugacccacuccggcgagaagcaguucaagugcaacaucugcaacaaggccuuccaccagguguacaaccugacguuccacaugcacacccacaacgacaagaagcccuucacgugcccgaccugcgggaagggcuucugccgcaacuucgaccucaagaagcacguccggaagcugcacgacagcucccuggggcucgcccgcacccccgcgggcgagcccggcaccgagcccccgccgccccugccccagcagccgcccaugacccugccgccccuccagccgccccugcccacccccgggccccugcagcccggccuccaccaggggcaccaguga

SEQ ID NO: 30111 - RNA, 1380 nt, Artificial Sequence
  derived and/or modified sequence opt1 from FEZF2__Homo_sapiens__NP_060478
auggccagcuccgccagccuggagaccauggugcccccggcgugcccccgcgccggcgccucccccgccaccagcaagacgcucgccuucuccaucgagcggaucauggcgaagaccagcgagccccgcgccccguucgagccccggcccggggcccuggaggccgacggcucccaggggaagaagcugcucaaccugugcagcccccugccgugcaugaucccccuccagccccugggcuacgagguccccuccaagacccugcucagcuacuccgagcuguggaaguccagccugcgcgccgggggcggcgggggcgggggcgggggcggcgggggcgggggcggcggggccccggugugcggcgccagcgggcucugcaagaccaacugcggcgugugcugcaaggccgagcuggggcuggcccccuccgcgcuccccgccggccgggucaucaagccccaggugaucaaccaggccgugggccugccggccagcgggucccuguacuacuucaacuaccucgacagcacggccuacccgcccuccgagcugcugagcggccaccucuuccccagcgggcugcugaacgcgcaggccccggccgcccucgccgcgcaccccaagcuguuccugcucgagaacgccaagcuggccggccuggccgccgacaaguucccccaccccgcgccguacccccacaaggagcgccuccccgcgccccuggagcagguccugaaggagaacuccgcccucaccgccgagcgcgggggcgugaagggccacagcaagcugcccgggggcuccgcggacgggaagcccaagaacuucacgugcgaggugugcggcaaggucuucaacgcccacuacaaccugacccggcacaugcccgugcacaccggggcccggccguucgugugcaaggucugcggcaagggcuuccgccaggccagcacccucugccggcacaagaucauccacacccaggagaagccccacaagugcaaccagugcgggaaggccuucaaccgcuccagcacccugaacacgcacauccggauccacgcgggcuacaagcccuucgugugcgaguucugcgggaagggcuuccaccagaagggcaacuacaagaaccacaagcugacccacuccggggagaagcaguacaagugcaccaucugcaacaaggccuuccaccagguguacaaccucaccuuccacaugcacacgcacaacgacaagaagcccuucacgugcgcgaccugcggcaagggguucugccgcaacuucgaccugaagaagcacguccggaagcugcacgacagcgugggcccggccgcccccuccgccaaggaccucacccgcaccgugcagagcuga

SEQ ID NO: 30112 - RNA, 903 nt, Artificial Sequence
  derived and/or modified sequence opt1 from FFAR1__Homo_sapiens__NP_005294
auggaccugcccccgcagcucagcuucggccuguacguggccgccuucgcgcugggguucccccucaacguccuggccauccgcggcgccaccgcccacgcccggcugcgccucacccccucccugguguacgcgcugaaccucgggugcagcgaccugcugcucacggugucccugccccugaaggccgucgaggcccucgccagcggcgcguggccgcugcccgccucccugugccccguguucgccguggcccacuucuucccccucuacgccgggggcggcuuccuggcggcccugagcgccgggcgguaccucggcgccgccuucccgcugggguaccaggcguuccgccggcccugcuacuccuggggcgucugcgccgccaucugggcccuggugcucugccaccuggggcugguguucggccucgaggcccccggcggguggcuggaccacagcaacaccucccugggcaucaacacccccgucaacgggagcccggugugccucgaggcgugggaccccgccuccgccggccccgcccgcuucagccugucccugcuccuguucuuccugccccucgccaucaccgcguucugcuacgugggcugccugcgggcccuggcccgcagcgggcucacgcaccggcgcaagcugcgggccgcgugggucgccggcggggcccugcucacccugcugcucugcgugggcccguacaacgccuccaacguggccagcuuccuguaccccaaccucgggggcuccuggcgcaagcugggccugaucaccggggcguggagcgucgugcugaacccccuggugaccggcuaccucgggcggggccccgggcugaagacggucugcgccgcccgcacccagggcggcaagucccagaaguga

SEQ ID NO: 30113 - RNA, 993 nt, Artificial Sequence
  derived and/or modified sequence opt1 from FFAR2__Homo_sapiens__NP_005297
augcugcccgacuggaaguccagccucauccugauggccuacaucaucaucuuccugaccggccucccggccaaccugcuggcgcuccgcgccuucguggggcggauccgccagccccagcccgcccccguccacauccugcugcucagccugacccuggccgaccuccugcugcuccugcugcucccguucaagaucaucgaggccgcguccaacuuccggugguaccugcccaagguggugugcgcccugacgagcuucggcuucuacuccagcaucuacugcuccaccuggcuccuggccgggaucagcaucgagcgcuaccugggcgucgccuuccccgugcaguacaagcucucccggcgcccccuguacggggugaucgcggcccuggucgccugggugaugagcuucggccacugcaccaucgugaucaucguccaguaccucaacaccacggagcagguccgguccggcaacgagaucacgugcuacgagaacuucaccgacaaccagcuggacguggugcugccggugcgccucgagcugugccugguccucuucuucauccccauggccgugaccaucuucugcuacuggcgguucguguggaucaugcugagccagccccuggugggggcccagcgccggcgccgggcggucggccucgccguggugacccugcugaacuuccucgucugcuucgggcccuacaacgugucccaccuggugggcuaccaccagcgcaagagcccgugguggcgguccaucgccgucguguucagcucccugaacgccagccucgacccccugcuguucuacuucuccagcagcgucgugcgccgggccuucgggcgcggccuccaggugcugcggaaccagggcuccagccugcucgggcgccggggcaaggacaccgcggaggggaccaacgaggaccgcggcgucggccagggggagggcaugcccuccagcgacuucaccacggaguga

SEQ ID NO: 30114 - RNA, 1041 nt, Artificial Sequence
  derived and/or modified sequence opt1 from FFAR3__Homo_sapiens__NP_005295
auggacaccggccccgaccagagcuacuucuccgggaaccacugguucguguucagcgucuaccugcucaccuuccuggugggccugccgcucaaccugcuggcccucguggucuucguggggaagcugcagcgccggcccguggccgucgacgugcugcuccugaaccugacggcguccgaccuccugcugcuccuguuccugcccuuccgcaugguggaggccgccaacggcaugcacuggccccucccguucauccugugcccccugagcggguucaucuucuucaccaccaucuaccucaccgcccuguuccuggccgcggucuccaucgagcgguuccucagcguggcccacccccugugguacaagacgcgcccccggcugggccaggccggccucguguccgucgccugcuggcugcuggcgagcgcccacugcuccgugguguacgucaucgaguucagcggggacaucucccacagccagggcaccaacgggaccugcuaccucgaguuccgcaaggaccagcuggccauccugcucccggugcggcuggagauggccgugguccuguucguggugccccucaucaucaccuccuacugcuacagccgccuggucuggauccugggccgcgggggcucccaccggcggcagcgccggguggccggccuccuggcggccacgcugcucaacuuccuggugugcuucgggcccuacaacgucagccacguggucggcuacaucugcggggagucccccgccuggcgcaucuacgugacccugcucagcacccugaacuccugcguggacccguucgucuacuacuucagcagcuccggcuuccaggccgacuuccacgagcugcuccggcgccugugcggccugugggggcaguggcagcaggagagcuccauggagcugaaggagcagaagggcggggaggagcagcgggccgaccgccccgcggagcggaagaccagcgagcacucccagggcugcgggacgggcggccagguggccugcgccgagagcuga

SEQ ID NO: 30115 - RNA, 1086 nt, Artificial Sequence
  derived and/or modified sequence opt1 from FFAR4__Homo_sapiens__NP_001182684
augagccccgagugcgcccgcgccgcgggcgacgccccgcugcggucccucgagcaggccaaccgcacccgguuccccuucuucagcgacgugaagggggaccaccgccugguccuggccgccguggagaccacggugcucguccugaucuucgcggugucccugcucggcaacgugugcgcccugguccugguggcccggcgccggcgccgcggggccaccgcgugccucgugcugaaccuguucugcgccgaccuccuguucaucagcgccaucccccugguccucgccgugcgguggaccgaggccuggcugcugggccccguggcgugccaccuccuguucuacgucaugacccuguccgggagcgugacgauccucacccuggccgccgugucccuggagcggauggucugcaucgugcaccuccagcgcggcgugcggggcccggggcgccgggcccgcgccguccugcuggcgcucaucuggggcuacagcgccguggccgcccugccccugugcguguucuuccgggucgugccccagcgccuccccggggccgaccaggagaucuccaucugcacccugaucuggccgaccauccccggcgagaucagcugggacguguccuucgucacgcugaacuuccucgugcccgggcuggucaucgugaucagcuacuccaagauccugcagaucaccaaggcgagccggaagcgccucaccgugucccuggccuacagcgagucccaccagauccgggucagccagcaggacuuccgccuguuccgcacccucuuccugcugaugguguccuucuucaucauguggagccccaucaucaucacgauccuccugauccugauccagaacuucaagcaggaccucgugaucuggccgagccuguucuucugggucguggccuucaccuucgccaacuccgcccugaaccccauccucuacaacaugacccugugccggaacgaguggaagaagaucuucugcugcuucugguuccccgagaagggcgcgauccugaccgacacgagcgugaagcgcaacgaccuguccaucaucagcggcuga

SEQ ID NO: 30116 - RNA, 2601 nt, Artificial Sequence
  derived and/or modified sequence opt1 from FGA__Homo_sapiens__NP_000499
auguucagcaugcgcaucgugugccugguccucuccguggugggcaccgccuggaccgccgacagcggggagggcgacuuccuggcggagggcggcgggguccgggggccccgcgugguggagcggcaccaguccgccugcaaggacagcgacuggccguucugcuccgacgaggacuggaacuacaagugccccagcggcugccgcaugaaggggcugaucgacgaggucaaccaggacuucacgaaccggaucaacaagcucaagaacucccuguucgaguaccagaagaacaacaaggacagccacucccugaccaccaacaucauggagauccuccgcggcgacuucagcuccgccaacaaccgggacaacaccuacaaccgcgugagcgaggaccugcggucccgcaucgaggugcugaagcggaaggucaucgagaaggugcagcacauccagcuccugcagaagaacgugcgcgcccagcuggucgacaugaagcggcucgagguggacaucgacaucaagauccgcagcugccggggguccugcagccgcgcccuggcgcgggagguggaccugaaggacuacgaggaccagcagaagcagcucgagcaggucaucgccaaggaccugcugcccucccgcgaccggcagcaccucccccugaucaagaugaagccggugcccgaccuggugcccggcaacuucaagagccagcuccagaaggugcccccggaguggaaggcccugacggacaugccccagaugcgcauggagcuggagcggcccgggggcaacgagaucacccgcggcggguccaccagcuacggcaccgggagcgagacggagagcccccgcaacccguccuccgccggcagcuggaacuccggcagcuccgggcccggcagcaccgggaaccggaaccccggcuccagcgggaccggcggcaccgcgacguggaagcccggguccagcggcccgggguccaccggcagcuggaacuccgggagcuccggcaccggcagcaccgggaaccagaaccccggcagcccccgccccggguccacgggcaccuggaacccggggagcuccgagcggggcagcgccggccacuggaccuccgagagcuccgucagcggguccaccggccaguggcacagcgaguccgggagcuuccgccccgacucccccggcagcggcaacgcccggcccaacaacccggacugggggacguucgaggagguguccggcaacgucagccccgggacccgccgggaguaccacaccgagaagcucgugaccuccaagggcgacaaggagcugcgcacggggaaggagaaggugaccagcggcuccaccaccacgacccggcgcagcugcagcaagaccgucaccaagacggugaucggccccgacgggcacaaggaggucaccaaggagguggugaccuccgaggacggcagcgacugccccgaggccauggaccuggggacccucuccggcaucgggacgcuggacggcuuccggcaccgccacccggacgaggccgcguucuucgacaccgccagcaccggcaagaccuuccccggguucuucucccccaugcugggcgaguucgucagcgagaccgagucccgggggagcgaguccggcaucuucacgaacaccaaggagagcuccagccaccacccggggaucgccgaguuccccucccgcggcaagagcuccagcuacuccaagcaguucaccagcuccaccagcuacaaccggggcgacagcacguucgaguccaagagcuacaagauggccgacgaggccggguccgaggcggaccacgagggcacccacagcaccaagcgcgggcacgccaagucccggcccgugcgcgacugcgacgacgugcuccagacccaccccagcggcacgcaguccgggaucuucaacaucaagcugccgggcagcuccaagaucuucagcgucuacugcgaccaggagaccucccugggcggguggcuccugauccagcagcggauggacggcagccugaacuucaaccgcaccuggcaggacuacaagcgcggguucggcucccucaacgacgagggcgagggggaguucuggcugggcaacgacuaccugcaccuccugacccagcgggggagcgugcugcgcguggagcucgaggacugggccggcaacgaggccuacgccgaguaccacuuccgggucggguccgaggcggagggcuacgcccuccaggugagcuccuacgagggcacggccggggacgcccugaucgagggcagcguggaggagggggccgaguacaccucccacaacaacaugcaguucagcaccuucgaccgcgacgcggaccagugggaggagaacugcgccgaggucuacggcgggggcuggugguacaacaacugccaggccgccaaccugaacggcaucuacuaccccgggggcagcuacgacccccggaacaacucccccuacgagaucgagaacgggguggugugggucagcuuccgcggcgcggacuacucccugcgggccgugcgcaugaagauccggccgcuggugacccaguga

SEQ ID NO: 30117 - RNA, 1476 nt, Artificial Sequence
  derived and/or modified sequence opt1 from FGB__Homo_sapiens__NP_005132
augaagcgcauggugagcugguccuuccacaagcugaagaccaugaagcaccuccugcugcuccugcugugcgucuuccucgucaagagccagggcgugaacgacaacgaggagggguucuucuccgcccggggccaccgcccccuggacaagaagcgggaggaggccccgagccugcgccccgcgcccccgcccaucuccgggggcggguaccgggcccgccccgccaaggccgccgcgacccagaagaagguggagcggaaggcccccgacgccggcggcugccuccacgccgaccccgaccugggggugcugugcccgacgggcugccagcuccaggaggcgcugcugcagcaggagcgccccauccggaacagcguggacgagcucaacaacaacgucgaggccgugucccagaccagcuccagcuccuuccaguacauguaccugcugaaggaccucuggcagaagcgccagaagcaggucaaggacaacgagaacguggugaacgaguacagcuccgagcuggagaagcaccagcuguacaucgacgagaccgugaacagcaacauccccaccaaccuccggguccugcgcuccauccuggagaaccuccggagcaagauccagaagcuggaguccgacgugagcgcccagauggaguacugccgcacgcccugcaccguguccugcaacaucccggucgugagcgggaaggagugcgaggagaucauccggaagggcggggagaccagcgagauguaccugauccagcccgacuccagcgugaagcccuaccgcgucuacugcgacaugaacaccgagaacggcggcuggacggugauccagaaccggcaggacggguccguggacuucggccgcaagugggaccccuacaagcagggguucggcaacgucgccaccaacaccgacggcaagaacuacugcgggcucccgggcgaguacuggcuggggaacgacaagaucagccagcugacccggaugggccccacggagcuccugaucgagauggaggacuggaagggggacaaggugaaggcccacuacggcggcuucaccgugcagaacgaggcgaacaaguaccagaucuccgucaacaaguaccgcgggaccgccggcaacgcccugauggacggggccagccagcucaugggcgagaaccggaccaugacgauccacaacgggauguucuucuccaccuacgaccgcgacaacgacggcuggcugaccagcgacccccgcaagcagugcuccaaggaggacggcgggggcuggugguacaaccggugccacgccgcgaaccccaacgggcgcuacuacuggggcgggcaguacaccugggacauggccaagcacggcacggacgacggcguggucuggaugaacuggaaggggagcugguacuccaugcggaagaugagcaugaagauccgcccguucuucccccagcaguga

SEQ ID NO: 30118 - RNA, 2886 nt, Artificial Sequence
  derived and/or modified sequence opt1 from FGD1__Homo_sapiens__NP_004454
augcacggccaccgcgcccccgggggcgccgggccgagcgagcccgagcaccccgcgaccaacccgcccggcgccgccccgcccgccugcgccgacuccgaccccggggcgagcgagcccggccugcucgcccggcgcggcuccgggagcgcccugggcgggccccuggacccccaguucgugggccccuccgacaccagccucggggccgcgccgggccaccggguccugcccugcggccccagcccccagcaccaccgcgcccugcgguucuccuaccaccucgaggggucccagccgcgccccggccugcaccaggggaaccggauccuggucaagagccucucccuggaccccggccagagccuggagccccacccggagggcccccagcgccuccgguccgaccccgggcccccgacggagacccccagccagcgccccagcccccugaagcgggccccgggccccaagccccaggugccgcccaagcccuccuaccugcagaugccccgcaugccgccgccccucgagcccaucccgcccccgcccucccggccccugcccgccgacccccgcgucgccaaggggcuggcgccccgggccgaggccagccccuccagcgccgccgugagcucccucaucgagaaguucgagcgcgagcccgugaucgucgcgagcgaccggcccgugcccggcccgucccccgggccgcccgagcccgugaugcugccccagcccaccagccagccgcccgucccccagcugcccgagggcgaggccucccgcugccucuuccugcuggccccgggcccccgggacggggagaaggugcccaaccgcgacagcggcaucgacuccaucagcucccccagcaacuccgaggagaccugcuucgugagcgacgacgggccgcccucccacagccucugccccgggcccccggcccuggccuccguccccguggcgcuggccgacccccaccggcccggcagccaggagguggacuccgaccucgaggaggaggacgacgaggaggaggaggaggagaaggaccgcgagaucccggugccccugauggagcgccaggagagcguggagcugacggugcagcagaaggucuuccacaucgccaacgagcuccugcagaccgagaaggccuacgugucccggcugcaccuccuggaccagguguucugcgcccgccugcucgaggaggcgcggaaccgcagcagcuuccccgccgacgucgugcacggcaucuucuccaacaucugcagcaucuacugcuuccaccagcaguuccugcugcccgagcucgagaagcggauggaggagugggaccgcuacccgcggaucggcgacauccugcagaagcuggcccccuuccucaagauguacggggaguacgugaagaacuucgaccgcgccgucgagcuggugaacaccuggaccgagcgguccacgcaguucaaggucaucauccacgaggugcagaaggaggaggcgugcggcaaccugacccuccagcaccacaugcuggagcccgugcagcgcaucccccgguacgagcugcuccugaaggacuaccugcugaagcucccgcacgggagccccgacuccaaggacgcccagaagucccuggagcugaucgccaccgccgccgagcacagcaacgcggccauccgcaagauggagcggaugcacaagcuccugaaggucuacgagcugcucggcggggaggaggacaucgugagccccaccaaggagcugaucaaggagggccacauccugaagcucuccgccaagaacggcacgacccaggaccgcuaccugauccuguucaacgaccggcuccuguacugcgugccccgccugcggcuccuggggcagaaguucagcguccgcgcccggaucgacguggacggcauggagcugaaggaguccagcaaccucaaccugccgcgcaccuuccugguguccgggaagcagcgcagccucgagcugcaggcccggaccgaggaggagaagaaggacuggguccaggcgaucaacuccacgcugcucaagcacgagcagacccuggagaccuucaagcugcucaacagcaccaaccgcgaggacgaggacacgccgcccaacucccccaacguggaccugggcaagcgggcccccacccccauccgcgagaaggaggugaccaugugcaugcggugccaggagcccuucaacagcaucaccaagcgccggcaccacugcaaggccugcggccacgucgugugcgggaagugcagcgaguuccgcgcccggcugguguacgacaacaaccgcuccaaccgggucugcacggacugcuacguggcccuccacggcgugccggggagcucccccgcgugcagccagcacacgccccagcgccggcgcuccauccuggagaagcaggccagcgucgccgccgagaacuccgugaucugcagcuuccugcacuacauggagaagggcgggaagggcuggcacaaggcgugguucgugguccccgagaacgagccgcucgugcuguacaucuacggcgcgccccaggacgugaaggcccagcggucccugccccucaucggguucgaggucgggcccccggaggccggcgagcgccccgaccggcgccacguguucaagaucacccagagccaccuguccugguacuucagccccgagaccgaggagcugcagcggcgcuggauggccgugcucggccgggccgggcgcggcgacaccuucugccccggcccgacccuguccgaggaccgcgagauggaggaggcccccgucgccgcccugggggccaccgcggagccgcccgagagcccccagacccgggacaagacguga

SEQ ID NO: 30119 - RNA, 1968 nt, Artificial Sequence
  derived and/or modified sequence opt1 from FGD2__Homo_sapiens__NP_775829
augaagggcgccagcgaggagaagcuggccuccgugagcaaccucgucaccguguucgagaacucccgcacccccgaggcggccccgcgggggcagcgccuggaggacgugcaccaccggcccgagugccgcccgcccgagagccccggcccccgggagaagacgaacgucggggaggccgugggcuccgagccccgcaccgugagccggcgcuaccugaacucccucaagaacaagcugagcuccgaggccuggcgcaagagcugccagcccgucacccuguccgggagcggcacccaggagccggagaagaagaucgugcaggagcuccuggagacggagcaggccuacguggcgcggcugcaccuccuggaccaggucuucuuccaggagcugcucaagaccgcccgguccagcaaggccuuccccgaggacguggugcgcgucaucuucuccaacaucagcuccaucuaccaguuccacagccaguucuuccugcccgagcugcagcggcgccucgacgacuggaccgccaacccccggaucggcgacgugauccagaagcuggcgccguuccugaagauguacuccgaguacgugaagaacuucgagcgcgccgccgagcuccuggccaccuggacggacaagagcccccuguuccaggagguccucacccggauccagagcuccgaggccagcgggucccugacccugcagcaccacaugcucgagcccgugcagcgcaucccccgguacgagcugcugcucaaggaguacauccagaagcugccggcgcaggcccccgaccaggccgacgcccagaaggcccuggacaugaucuucagcgcggcccagcacuccaacgccgccaucaccgagauggagcgccuccaggaccugugggagguguaccagcggcugggccucgaggacgacaucgucgaccccagcaacacgcugcugcgcgaggggcccgugcucaagaucuccuuccgccggaacgacccgauggagcgcuaccuguuccuguucaacaacaugcuccuguacugcgugccccgggucauccaggugggcgcccaguuccaggugcgcacccggaucgacgucgcggggaugaaggugcgcgagcugauggacgccgaguucccccacagcuuccucgucuccggcaagcagcggacccuggagcugcaggcccgcagccaggaggagaugaucuccuggaugcaggccuuccaggccgcgaucgaccagaucgagaagcggaacgagaccuucaaggccgccgcccagggccccgagggggacauccaggagcaggagcuccagagcgaggagcugggccugcgcgcgccgcagugggugcgggacaagauggugacgaugugcaugcgcugccaggagcccuucaacgcccucacccggcgccggcaccacugccgcgccugcggguacgucgugugcgcccggugcuccgacuaccgcgccgagcugaaguacgacgacaaccggcccaaccgcgugugccugcacugcuacgcguuccugaccggcaacguccuccccgaggccaaggaggacaagcgccggggcauccuggagaaggggagcuccgccaccccggaccagagccugaugugcuccuuccuccagcugaucggcgacaaguggggcaagagcgggccccgcggguggugcgugaucccccgggacgacccgcuggugcucuacgucuacgccgcgccccaggacaugcgcgcccacacguccaucccccugcugggcuaccaggugaccgugggcccccagggggacccgcgggucuuccagcuccagcagagcggccagcuguacaccuucaaggccgagaccgaggagcugaaggggcgcugggugaaggccauggagcgggccgccagcggcuggucccccagcuggcccaacgacggggaccucuccgacuga

SEQ ID NO: 30120 - RNA, 2178 nt, Artificial Sequence
  derived and/or modified sequence opt1 from FGD3__Homo_sapiens__NP_001077005
auggagagcggccgcggguccagcacgcccccgggccccaucgccgcccuggggaugcccgacaccggccccggguccagcucccugggcaagcugcaggcgcugccggugggcccccgggcccacugcggggaccccgucagccucgccgccgccggcgacgggucccccgacaucggcccgaccggggagcugagcggcucccugaagauccccaaccgcgacagcggcaucgacucccccagcuccagcguggcgggggagaacuuccccugcgaggagggccucgaggccgggccgucccccaccgugcugggcgcccacgccgagauggcgcuggacagccagguccccaaggugacgccccaggaggaggccgacuccgacgugggcgaggagccggacagcgagaacacgccccagaaggccgacaaggacgccgggcucgcccagcacuccggcccccagaagcugcugcacaucgcgcaggagcuccugcacaccgaggagaccuacgucaagcggcugcaccuccuggaccagguguucugcacccgccugaccgacgccgggaucccgcccgaggugaucaugggcaucuucagcaacaucagcuccauccaccgguuccacgggcaguuccuccugcccgagcugaagacccgcaucaccgaggagugggacaccaacccccggcucggcgacauccugcagaagcuggcccccuuccucaagauguacggcgaguacgucaagaacuucgaccgcgccguggggcuggugagcaccuggacgcagcgguccccgcuguucaaggacgucgugcacagcauccagaagcaggaggugugcggcaaccucacccugcagcaccacaugcuggagcccguccagcgcgugccccgguacgagcuccugcugaaggacuaccucaagcgccugccccaggacgccccggaccggaaggacgcggagcgcucccuggagcucaucagcaccgccgccaaccacuccaacgccgccauccggaagguggagaagaugcacaagcugcuggaggucuacgagcagcucgggggcgaggaggacaucgugaaccccgcgaacgagcugaucaaggaggggcagauccagaagcugagcgccaagaacggcacgccccaggaccgccaccucuuccuguucaacuccaugauccuguacugcgugccgaagcuccggcugaugggccagaaguucagcguccgcgagaagauggacaucuccgggcuccaggugcaggacaucgugaagcccaacaccgcccacaccuucaucaucaccggccggaagcgcagccuggagcugcagacccggacggaggaggagaagaaggaguggauccagaucauccaggccaccaucgagaagcacaagcagaacuccgagaccuucaaggccuucgggggcgcguucagccaggacgaggaccccucccugagccccgacaugccgaucaccuccacgagccccgucgagcccguggucaccaccgagggguccagcggcgccgccggccuggagccccgcaagcucagcuccaagacccgccgggacaaggagaagcagagcugcaaguccugcggggagacguucaacagcaucaccaagcgccggcaccacugcaagcugugcggcgccgugaucugcgggaagugcuccgaguucaaggcggagaacagccgccagucccgggugugccgcgacugcuuccugacccagccggucgcccccgagagcaccgagaagacgcccaccgccgacccccagccgucccuccugugcggcccccugcggcucagcgaguccggcgagaccuggagcgaggugugggccgccauccccauguccgacccccaggugcugcaccuccagggcgggagccaggacgggcgccugccgcggaccaucccccugcccuccugcaagcugagcguccccgacccggaggagcgccucgacuccggccacguguggaagcugcagugggcgaagcagagcugguaccugagcgccuccagcgccgagcuccagcagcaguggcuggagacgcuguccaccgccgcccacggggacaccgcgcaggacagccccggcgcccuccagcuccaggugcccaugggcgccgccgcccccuga

SEQ ID NO: 30121 - RNA, 2637 nt, Artificial Sequence
  derived and/or modified sequence opt1 from FGD4__Homo_sapiens__NP_001291409
augaacuucaagcgcgugaagcccaacaucuuccugcucaaccagagccggcugaucaucuccaucugcgagaucaugagcaccgaccagggcuccuccacgugcccgaagaucgcccuggucccgcccugcuccaccagcuccaccaccacccucgugggggagaacgugagcgaggaggaggcccagggcaucaacgggaaccgccccgcgaagcacuccgccgccagcccgaagccccaggucccgcccaagccccugcaccuccagaacucccccagcuccaacauccaccagacgccccggcacaaggcccugcccagcgccaagccgcgcauggaggagaucaagcccgcguccgccagcugcguguccaaggagaagcccagcaagguguccgaccugaucagccgguucgagggcgggagcucccugagcaacuacuccgaccucaagaaggagagcgccgucaaccugaacgcgccccgcaccccgggccggcacggccugaccaccacgccccagcagaagcuccugucccagcaccucccccagcgccaggggaacgacaccgacaagacccagggcgcccagaccugcguggccaacggggugauggccgcccagaaccagauggagugcgaggaggagaaggccgcgacgcugagcuccgacaccagcauccaggccuccgagccccugcuggacacccacaucgucaacggcgagcgggacgagaccgccacggccccggccagccccaccaccgacuccugcgacgggaacgcgagcgacuccagcuaccgcacccccggcaucggccccgugcucccgcuggaggagcgcggggccgagacggagaccaaggugcaggagcgggagaacggcgagagcccccuggagcucgagcagcuggaccagcaccacgagaugaaggagaccaacgagcagaagcugcacaagaucgccaacgagcuccugcugaccgagcgggccuacgucaaccgccucgaccugcuggaccagguguucuacugcaagcuccuggaggaggccaaccgggggagcuuccccgcggagauggugaacaagaucuucuccaacaucagcuccaucaacgccuuccacagcaaguuccugcuccccgagcuggagaagcgcaugcaggagugggagacgaccccgcggaucggcgacauccugcagaagcucgcccccuuccugaagauguacggcgaguacgucaagggguucgacaacgccauggagcuggugaagaacaugaccgagcgcaucccccaguucaagagcguggucgaggagauccagaagcagaagaucugcggcucccucacccugcagcaccacaugcuggagccggugcagcggaucccccgcuacgagaugcuccugaaggacuaccugcggaagcucccgcccgacagccuggacuggaacgacgccaagaagucccuggagaucaucagcacggcggccucccacagcaacuccgccauccgcaagauggagaaccucaagaagcugcuggagaucuacgagaugcugggggaggaggaggacaucgugaaccccagcaacgagcucaucaaggagggccagauccugaagcuggccgcgcgcaacaccuccgcccaggagcgguaccucuuccuguucaacaacaugcugcucuacugcguccccaaguucagccuggugggguccaaguucaccgugcgcacccgggucggcaucgacggcaugaagaucguggagacgcagaacgaggaguacccccacaccuuccaggucagcgggaaggagcgcacccuggagcuccaggccuccagcgcccaggacaaggaggaguggaucaaggcccugcaggagaccaucgacgcguuccaccagcggcacgagacguuccgcaacgccaucgccaaggacaacgacauccacuccgaggugagcaccgccgagcugggcaagcgggcgccccgcuggauccgggacaacgaggugaccaugugcaugaagugcaaggagccguucaacgcccucacccgccggcgccaccacugccgggccugcggguacgucgugugcuggaagugcuccgacuacaaggcccagcuggaguacgacggcgggaagcugagcaaggugugcaaggacugcuaccagaucaucagcggcuucaccgacuccgaggagaagaagcgcaagggcauccucgagaucgagagcgccgaggucuccgggaacagcguggugugcuccuuccugcaguacauggagaaguccaagcccuggcagaaggccuggugcgucauccccaagcaggacccccuggugcucuacauguacggcgcgccgcaggacgugcgggcccaggccacgaucccccugcugggguacgucguggacgagaugccccgcagcgccgaccucccccacagcuucaagcugacccaguccaagagcgugcacuccuucgcggccgacagcgaggagcugaagcagaaguggcucaaggucauccugcuggccgugaccggcgagacccccgggggccccaacgagcaccccgccacgcucgacgaccaccccgagccgaagaagaaguccgagugcuga

SEQ ID NO: 30122 - RNA, 4389 nt, Artificial Sequence
  derived and/or modified sequence opt1 from FGD5__Homo_sapiens__NP_689749
auguuccgcggccccaagccgcccaucgcccccaagccccggcugaccgccccgaacgaguggcgcgcgagcguguaccucaacgacucccugaacaagugcagcaacgggcggcugcccugcgucgaccgcggccucgacgaggggccccgguccauccccaagugcagcgaguccgagaccgacgaggacuacaucguggugccgcgcgucccccugcgggaggacgagcccaaggacgagggcagcguggggaacaaggcccuggugucccccgagagcuccgccgaggaggaggaggagcgcgaggagggcggcgaggccugcgggcucgagggcacgggggccggcgaggacagcgucgcgccggccgcccccggggccggcgcgcugucccgggagggcgaggaggggaccgaccuggcccucgaggacgagggcgaggggugcgccgacgagcccggcacccuggagcaggucagccgcuccgaggaggaggagaagcuggugcagccccaccgggagugcagccucgaggacuccggcccgugggccggggagggcguguuccagagcgaccugcugcucccccacauccacggggaggaccaggagccgcccgacacccccggcgaggccgaggaggacgacgaggaggggugcgcguccacggaccccgccggcgccgacgagggcagcgggcccgaccgccccaccgaggacaugggccaggacgccgaggacaccuccgaggagccgcccgagaaggaggagcuggccggggugcaggaggcggagaccgccacggacugccccgaggugcuggaggagggcugcgaggaggccaccggggucaccggcggcgagcaggucgaccucagcgagcccccggaccacgagaagaagaccaaccaggagguggccgccgcgacgcuggaggaccacgcccaggacgagagcgccgaggaguccugccagaucgugcccuucgagaacgacugcauggaggacuucgugaccagccugaccgggucccccuacgaguucuucccgaccgagagcacguccuucugcagcgaguccugcagcccccucuccgagagcgccaagggccuggaguccgagcaggcccccaagcuggggcuccgggcggaggagaaccccauggugggcgcccugugcgggcagugcggcagccugcagggcggggccgccgagggcccggcggcccccgacgucguggugguccucgaggaggaggcccuggacgacgcccuggccaaccccuacgugaugggggugggccuccccggccaggcggccccgggggagggcgggcaggccgccuccgacgcccugggcggguacggcagcaaggaggagcugaacugcgaggcggagggcgggcucguccccgccgaccgcaagaacaccuccacccgggugcgcccccacagcggcaaggucgccggguacgugcccgagaccgugccggaggagacgggccccgaggccggguccagcgcccccggcaucggcggggcggccgaggaggucggcaagacccugcugucccucgaggggaagccccuggaggccagccgggcccugccggcgaagccccgcgccuucacccucuacccccggagcuucuccguggagggccgcgagauccccgugagcgucuaccaggagccggagggguccggccuggacgaccaccggaucaagcgcaaggaggacaaccugagccucuccugcgugaucggcagcuccgggagcuucucccagcgcaaccaccuccccagcuccggcaccagcacgcccuccagcaugguggacaucccgccgcccuucgaccuggccugcaucaccaagaagcccaucaccaaguccagccccucccuccugaucgagagcgacagccccgacaaguacaagaagaagaaguccagcuucaagcgguuccuggcccucaccuucaagaagaagacggagaacaagcugcacgucgacgugaacguguccagcucccgcagcuccagcgaguccagcuaccacgggcccucccggauccuggaggucgaccgccggagccuguccaacagcccccagcucaagucccgcaccggcaagcugcgggccagcgaguccccgagcucccugaucuucuaccgcgacgggaagcggaagggcgugcccuucagccgcaccgugagccgggucgaguccuucgaggaccgcagccggccgcccuuccucccccugccccugaccaagccccgcuccaucagcuuccccuccgcggacacgagcgacuacgagaacaucccggccaugaacuccgacuacgagaacauccagaucccgccccggcgccccgcccgggccggcgccuucaccaagcuguucgaggaccagagccgcgcgcuguccaccgccaacgagaacgacggguacguggacaugagcuccuucaacgccuucgagagcaagcagcaguccgccgaccaggacgccgagagcgcguacaccgagcccuacaaggugugccccaucuccagcgccgcccccaaggaggaccugacguccgacgaggagcagcggagcuccgaggaggaggacagcgccagccgcgaccccuccgucacccacaagguggagggccagagccgcgcgcucgugaucgcccaggagcugcuguccagcgagaaggccuacgucgagaugcuccagcaccugaaccuggacuuccacggggccgugaugcgggcccucgacgacauggaccacgagggccgcgacacccuggcgcgggaggagcugcgccagggccucuccgagcugccggccauccacgaccugcaccaggggauccucgaggagcuggaggagcggcugagcaacugggagucccagcagaagguggccgacgucuuccucgcccgcgagcagggcuucgaccaccacgccacccacauccugcaguucgaccgguaccuggggcuccugagcgagaacugccugcacagcccccgccucgcggccgccgugcgggaguucgagcaguccgugcagggcgggucccagaccgccaagcaccgccugcugcgggucgugcagcgccucuuccaguaccaggugcugcugacggacuaccucaacaaccugugccccgacagcgccgaguacgacaacacccagggcgcgcugucccucaucagcaaggucaccgaccgggccaacgacuccauggagcagggcgagaaccugcagaagcuggugcacaucgagcacagcgugcgcgggcagggcgaccuccugcagcccgggcgggaguuccugaaggagggcacccucaugaaggucacggggaagaaccgccggccgcgccaccuguuccugaugaacgacgugcuccuguacaccuacccccagaaggacggcaaguaccggcugaagaacacccucgccguggccaacaugaaggucucccgccccgugauggagaaggugcccuacgcccugaagaucgagaccagcgaguccugccugaugcucagcgcgagcuccugcgccgagcgggacgagugguacggcugccugagccgcgcccugccggaggacuacaaggcccaggcgcucgccgccuuccaccacuccgucgagauccgcgagcggcugggggugagccugggcgagcgcccgcccacgcucgugcccgucacccacgugaugaugugcaugaacugcgggugcgacuucucccugacccugcggcgccaccacugccacgccugcggcaagaucgugugccggaacugcagccgcaacaaguacccccucaaguaccugaaggaccggauggccaaggucugcgacgggugcuucggcgagcugaagaagcgcggccgggcggugcccgggcucaugcgcgagcggcccguguccaugagcuucccgcuguccagcccccgcuucuccggcagcgccuucuccagcgucuuccaguccaucaaccccagcaccuucaagaagcagaagaaggugcccuccgcccugacggagguggccgccagcggggagggcuccgcgaucagcggcuaccucagccggugcaagcgcgggaagcggcacuggaagaagcugugguucgucaucaagggcaaggugcuguacaccuacauggccuccgaggacaaggucgcccucgagagcaugccgcugcugggguucaccaucgcccccgagaaggaggagggcuccagcgagguggggcccaucuuccaccucuaccacaagaagacccuguucuacuccuucaaggccgaggacacgaacagcgcgcagcgcuggaucgaggccauggaggacgccuccgugcuguga

SEQ ID NO: 30123 - RNA, 4293 nt, Artificial Sequence
  derived and/or modified sequence opt1 from FGD6__Homo_sapiens__NP_060821
augaccagcgccgccgagaucaagaagcccccgguggcgcccaagcccaaguucgucguggccaacaacaagcccgccccgccgcccaucgcccccaagcccgacaucgugaucuccagcgucccccaguccaccaagaagaugaagcccgccaucgcgcccaagccgaaggugcugaagacgagccccgugcgcgagaucggccagucccccagccggaagaucaugcucaaccuggaggggcacaagcaggagcuggccgaguccaccgacaacuucaacugcaaguacgagggcaaccagagcaacgacuacaucucccccaugugcagcugcuccagcgagugcauccacaagcucgggcaccgcgagaaccugugcgucaagcagcuggugcucgagccgcuggagaugaacgagaaccuggagaacuccaagaucgacgagacccucaccaucaagacgcggagcaagugcgaccuguacggcgagaaggccaagaaccagggcggggugguccugaaggccuccgugcucgaggaggagcugaaggacgcgcugauccaccagaugccgcccuucaucagcgcccagaagcaccgccccaccgacucccccgagaugaacggcgggugcaacagcaacggccaguuccggaucgaguucgccgaccucucccccagccccagcuccuucgagaaggugcccgaccaccacagcugccaccuccagcugccguccgacgagugcgagcacuucgagaccugccaggacgacagcgagaaguccaacaacugcuuccagagcuccgagcucgaggcccuggagaacgggaagcgcagcacccugaucuccagcgacggcgucuccaagaaguccgaggugaaggaccucgggccccuggagauccaccuggugcccuacacgcccaaguucccgacccccaagccccggaagacccgcaccgcccggcuccugcgccagaagugcgucgacacgccgagcgagagcaccgaggagcccggcaacuccgacagcuccagcuccugccugaccgagaacagccucaagaucaacaagaucagcgugcugcaccagaacgugcugugcaagcaggagcaggucgacaagaugaagcucggcaacaaguccgagcugaacauggagagcaacuccgacgcgcaggaccuggugaacagccagaaggccaugugcaacgagaccacguccuucgagaagauggcccccagcuucgacaaggacuccaaccucagcuccgacagcaccaccguggacggguccagcaugucccuggccgucgacgagggcaccggguucauccggugcacggugagcaugucccugcccaagcagcucaagcugaccugcaacgagcaccuccagagcggccgcaaccugggcguguccgccccgcagaugcagaaggagagcgucaucaaggaggagaacagccugcggaucgugcccaagaagccccagcgccacucccugcccgcgaccgggguccucaagaaggccgccagcgaggagcugcuggagaaguccagcuacccguccagcgaggagaaguccagcgagaagucccucgagcggaaccaccuccagcaccugugcgcccagaaccgcggcgugagcuccagcuucgacaugcccaagcgggccuccgagaagcccguguggaagcugccccacccgauccugcccuucagcgggaaccccgaguuccugaaguccgucaccgugagcuccaacagcgagcccuccacggcgcugaccaagccgcgcgccaagagccucagcgccauggacguggagaagugcaccaagcccugcaaggacuccaccaagaagaacagcuucaagaagcugcuguccaugaagcucagcaucugcuucaugaaguccgacuuccagaaguucuggagcaaguccagccagcugggcgacacgaccaccgggcaccuguccagcggcgagcagaagggcaucgaguccgacuggcaggggcuccuggucggcgaggagaagcggagcaagcccaucaaggccuacuccaccgagaacuacagccuggagucccagaagaagcgcaagaagucccgggggcagacgagcgccgcgaacggccuccgcgccgagagccuggacgaccagaugcugucccgcgagagcagcucccaggcccccuacaagagcgugaccucccucugcgccccggaguacgagaacauccggcacuacgaggagauccccgaguacgagaaccugcccuucaucauggcgauccgcaagacccaggagcuggaguggcagaacagcuccagcauggaggacgccgacgccaacguguacgaggucgaggagcccuacgaggccccggacgggcagcuccagcugggcccccggcaccagcacuccagcuccggcgccagccaggaggagcagaacgaccuggggcucggcgaccugcccuccgacgaggaggagaucaucaacagcuccgacgaggacgacgugagcuccgagagcuccaagggggagccggacccccuggaggacaagcaggacgaggacaacggcaugaaguccaaggugcaccacaucgcgaaggagaucaugagcagcgagaaggucuucguggacgugcucaagcugcugcacaucgacuuccgcgacgccgucgcccacgccagccggcagcucgggaagcccgugaucgaggaccgcauccugaaccagauccuguacuaccucccccagcuguacgagcugaaccgggaccuccugaaggagcuggaggagcgcaugcuccacuggaccgagcagcagcggaucgccgacaucuucgugaagaagggcccguaccugaagauguacuccacguacaucaaggaguucgacaagaacaucgcgcugcucgacgagcagugcaagaagaaccccggcuucgccgccgucgugcgcgaguucgagaugagcccccggugcgccaaccuggcccugaagcacuaccuccugaagcccgugcagcgcaucccgcaguaccggcugcuccugaccgacuaccugaagaaccucaucgaggacgcgggggacuaccgcgacacccaggacgcccuggccgucgugaucgagguggccaaccacgcgaacgacaccaugaagcagggcgacaacuuccagaagcugaugcagauccaguacucccucaacgggcaccacgagaucguccagcccggccggguguuccugaaggagggcauccugaugaagcucagccgcaaggugaugcagccccggauguucuuccuguucaacgacgcccugcucuacaccacgcccguccaguccgggauguacaagcugaacaacaugcugagccucgccggcaugaaggugcgcaagccgacccaggaggccuaccagaacgagcugaagaucgaguccguggagcggagcuucauccuguccgccagcuccgcgaccgagcgcgacgaguggcucgaggccaucagccgcgccaucgaggaguacgccaagaagcggaucaccuucugccccucccgcagccuggacgaggccgacuccgagaacaaggaggaggucagcccccugggguccaaggcgcccaucuggaucccggacacgcgggccaccaugugcaugaucugcaccagcgaguucacccucacguggcgccggcaccacugccgcgccugcggcaagaucgugugccaggccugcuccagcaacaaguacgggcuggacuaccugaagaaccagcccgcccgggugugcgagcacugcuuccaggagcuccagaagcuggaccaccagcacagcccccgcaucggcucccccggcaaccacaagagcccguccagcgcgcuguccagcguccuccacuccauccccagcgggcggaagcagaagaagauccccgccgcccugaaggagguguccgccaacaccgaggacagcuccaugagcggcuaccuguaccgcuccaaggggaacaagaagcccuggaagcacuucugguucgugaucaagaacaagguccucuacaccuacgcggccagcgaggacguggccgcccuggagucccagccgcugcucggcuucaccgugauccaggucaaggacgagaacagcgaguccaagguguuccagcugcugcacaagaacaugcuguucuacguguucaaggccgaggacgcgcacagcgcccagaaguggaucgaggccuuccaggaggggacgauccuguga

SEQ ID NO: 30124 - RNA, 627 nt, Artificial Sequence
  derived and/or modified sequence opt1 from FGF10__Homo_sapiens__XP_005248321
auguggaaguggauccugacccacugcgccagcgccuucccccaccucccgggcugcugcugcugcugcuuccugcuccuguuccugguguccagcguccccgugaccugccaggcgcuggggcaggacauggugucccccgaggccacgaacagcuccagcuccagcuucuccagccccuccagcgccggccgccacguccgguccuacaaccaccuccagggggacgugcgcuggcggaagcuguucagcuucaccaaguacuuccugaagaucgagaagaacggcaagguguccgggaccaagaaggagaacugcccguacagcauccucgagaucaccuccgucgagaucggcgugguggccgucaaggccaucaacagcaacuacuaccuggcgaugaacaagaagggcaagcuguacggguccaaggaguucaacaacgacugcaagcucaaggagcgcaucgaggagaacggcuacaacacguacgccagcuucaacuggcagcacaacgggcggcagauguacguggcccugaacggcaagggggcgccccgccggggccagaagacccgccggaagaacaccagcgcccacuuccugcccauggugguccacuccuga

SEQ ID NO: 30125 - RNA, 678 nt, Artificial Sequence
  derived and/or modified sequence opt1 from FGF11__Homo_sapiens__NP_004103
auggccgcccuggcgagcucccucauccgccagaagcgggaggugcgcgagcccggcgggagccggccggucuccgcccagcgccgggugugcccccgcggcaccaagagccugugccagaagcagcugcucauccugcuguccaaggugcggcucugcgggggccgccccgcccggcccgaccgcgggccggagccccagcugaagggcaucgucaccaagcuguucugccggcagggcuucuaccuccaggccaaccccgacgggagcauccagggcacgcccgaggacaccuccagcuucacccacuucaaccugaucccgguggggcugcgcguggucaccauccaguccgccaagcucggccacuacauggcgaugaacgccgaggggcugcuguacagcagcccccacuucacggccgagugccgguucaaggagugcguguucgagaacuacuacgugcucuacgccuccgcgcuguaccgccagcggcgcuccggccgggccugguaccugggccucgacaaggaggggcaggucaugaagggcaaccgcgugaagaagaccaaggccgccgcccacuuccugcccaagcugcucgagguggcgauguaccaggagcccagccugcacuccgucccggaggccagccccuccagcccgcccgcccccuga

SEQ ID NO: 30126 - RNA, 546 nt, Artificial Sequence
  derived and/or modified sequence opt1 from FGF12__Homo_sapiens__NP_004104
auggagagcaaggagccccagcugaagggcaucgugacccgccucuucucccagcagggguacuuccugcagaugcacccggacggcaccaucgacgggacgaaggacgagaacagcgacuacacccuguucaaccucauccccgucggccugcgggugguggccauccagggggucaaggccucccuguacguggcgaugaacggcgagggcuaccucuacagcuccgacguguucacccccgagugcaaguucaaggagagcgucuucgagaacuacuacgugaucuacuccagcacccuguaccgccagcaggaguccgggcgggccugguuccugggccucaacaaggaggggcagaucaugaagggcaaccgcgugaagaagacgaagcccagcucccacuucgucccgaagcccaucgaggugugcauguaccgggagcccagccugcacgagaucggggagaagcagggccgcucccggaaguccagcggcacccccaccaugaacgggggcaagguggucaaccaggacagcaccuga

SEQ ID NO: 30127 - RNA, 600 nt, Artificial Sequence
  derived and/or modified sequence opt1 from FGF13__Homo_sapiens__NP_001132970
augagcggcaaggugaccaagcccaaggaggagaaggacgccuccaaggagccgcagcugaaggggaucgucaccaagcucuacagccgccagggcuaccaccuccagcugcaggccgacgggacgaucgacggcaccaaggacgaggacuccaccuacacccucuucaaccugauccccguggggcugcggguggucgcgauccagggcgugcagacgaagcucuaccuggccaugaacagcgagggcuaccuguacaccuccgagcuguucacccccgagugcaaguucaaggagagcguguucgagaacuacuacgucaccuacuccagcaugaucuaccgccagcagcaguccgggcggggcugguaccuggggcugaacaaggagggcgagaucaugaaggggaaccacgugaagaagaacaagcccgccgcccacuuccucccgaagccccugaagguggccauguacaaggagcccagccugcacgaccucacggaguucucccgcagcggcuccggcacccccaccaagagccgguccgucagcggggugcugaacggcgggaaguccaugagccacaacgaguccaccuga

SEQ ID NO: 30128 - RNA, 744 nt, Artificial Sequence
  derived and/or modified sequence opt1 from FGF14__Homo_sapiens__NP_004106
auggccgccgcgaucgccagcggccugauccgccagaagcggcaggcccgcgagcagcacugggaccggcccuccgccagccgccggcgcuccagcccguccaagaaccgggggcucugcaacggcaaccugguggacaucuucagcaagguccgcaucuucgggcugaagaagcggcgccuccggcgccaggacccccagcugaagggcaucgugacccggcuguacugccgccagggguacuaccuccagaugcaccccgacggcgcccuggacggcaccaaggacgacuccacgaacagcacccuguucaaccucauccccguggggcugcgggucguggcgauccagggcgugaagaccgggcuguacaucgccaugaacggcgagggguaccucuacccguccgagcuguucacccccgagugcaaguucaaggagagcgucuucgagaacuacuacgugaucuacuccagcaugcuguaccgccagcaggaguccggccgggccugguuccucggccugaacaaggaggggcaggccaugaagggcaaccgcgugaagaagacgaagcccgcggcccacuuccugcccaagccgcucgaggucgccauguaccgggagcccagccugcacgacgugggggagaccgugcccaagcccggcgucaccccguccaagagcaccuccgccagcgccaucaugaacggcgggaagcccgugaacaaguccaagacgaccuga

SEQ ID NO: 30129 - RNA, 624 nt, Artificial Sequence
  derived and/or modified sequence opt1 from FGF16__Homo_sapiens__NP_003859
auggccgaggugggcggggucuucgccagccuggacugggaccuccacggcuucuccagcucccuggggaacgugccccuggcggacagcccgggcuuccucaacgagcgccuggggcagaucgagggcaagcugcagcggggcucccccaccgacuucgcccaccucaaggggauccugcgccggcgccagcuguacugccggaccggcuuccaccucgagaucuuccccaacgggacggugcacggcacccgccacgaccacagccgguucgggauccuggaguucaucucccuggccgucggccucaucagcauccgcggcguggacuccgggcuguaccugggcaugaacgagcgcggggagcucuacggcagcaagaagcugacccgggagugcguguuccgggagcaguucgaggagaacugguacaacaccuacgccuccacgcuguacaagcacagcgacuccgagcgccaguacuacgucgcccucaacaaggacggcagcccccgggagggguaccgcaccaagcggcaccagaaguucacccacuuccugccgcgccccguggaccccuccaagcugcccagcaugucccgggaccucuuccacuaccgcuga

SEQ ID NO: 30130 - RNA, 618 nt, Artificial Sequence
  derived and/or modified sequence opt1 from FGF17__Homo_sapiens__NP_001291407
augggcgccgcccgccugcuccccaaccugacccugugccuccagcugcugauccucugcugccagacccaguacgugcgggaccagggggcgaugacggaccagcugagccgccggcagauccgcgaguaccagcuguacucccggaccagcggcaagcacguccaggugaccgggcgccggaucuccgccaccgccgaggacggcaacaaguucgccaagcucaucguggagacggacaccuucgggagccgcguccggaucaagggcgccgaguccgagaaguacaucugcaugaacaagcgcggcaagcugaucgggaagccgagcggcaaguccaaggacugcguguucaccgagaucgugcuggagaacaacuacaccgcguuccagaacgcccggcacgaggggugguucauggccuucacgcgccagggccggccccgccaggccagccggucccgccagaaccagcgggaggcgcacuucaucaagcgccucuaccaggggcagcugcccuuccccaaccacgccgagaagcagaagcaguucgaguucgucggcagcgccccgacccggcgcaccaagcggacccgccgcccccagccccugacguga

SEQ ID NO: 30131 - RNA, 624 nt, Artificial Sequence
  derived and/or modified sequence opt1 from FGF18__Homo_sapiens__NP_003853
auguacagcgcccccuccgccugcacgugccugugccuccacuuccugcugcucugcuuccaggugcagguccugguggcggaggagaacguggacuuccgcauccacgucgagaaccagacccgggcccgcgacgacgugagccggaagcagcugcgccucuaccagcuguacucccggaccagcggcaagcacauccaggugcuggggcgccggaucuccgcccgcggcgaggacggggacaaguacgcccagcuccuggucgagaccgacaccuucggcagccaggugcggaucaaggggaaggagaccgaguucuaccugugcaugaaccgcaagggcaagcucgugggcaagccggacgggacguccaaggagugcgucuucaucgagaaggugcuggagaacaacuacaccgcccugaugagcgcgaaguacuccggcugguacgugggguucaccaagaagggccggccccgcaaggggcccaagacccgggagaaccagcaggacguccacuucaugaagcgcuaccccaagggccagccggagcuccagaagcccuucaaguacacgaccgugaccaagcggagccgccggauccgccccacccaccccgccuga

SEQ ID NO: 30132 - RNA, 651 nt, Artificial Sequence
  derived and/or modified sequence opt1 from FGF19__Homo_sapiens__NP_005108
augcgcagcggcugcguggucgugcacguguggauccuggccgggcucuggcuggccgucgcgggccggccccuggccuucuccgacgccgggccgcacgugcacuacggcuggggcgaccccauccgccuccggcaccuguacaccagcgggccccacggccuguccagcugcuuccuccgcauccgggccgacgggguggucgacugcgcccgcggccaguccgcgcacagccugcuggagaucaaggccguggcccuccggaccguggccaucaaggggguccacuccgugcgcuaccugugcaugggcgcggacgggaagaugcagggccugcuccaguacagcgaggaggacugcgccuucgaggaggagauccggcccgacggcuacaacguguaccgcuccgagaagcaccggcugccggucagccuguccagcgccaagcagcgccagcucuacaagaaccggggguuccugccccugucccacuuccuccccaugcugcccauggugccggaggagcccgaggaccugcgcggccaccucgagagcgacauguucuccagcccccuggagacggacuccauggaccccuucgggcuggugaccggccucgaggccguccggagcccguccuucgagaaguga

SEQ ID NO: 30133 - RNA, 468 nt, Artificial Sequence
  derived and/or modified sequence opt1 from FGF1__Homo_sapiens__NP_001244139
auggccgagggcgagaucaccaccuucacggcccugaccgagaaguucaaccugcccccggggaacuacaagaagcccaagcuccuguacugcagcaacggcgggcacuuccuccgcauccugcccgacggcaccguggacgggacccgggaccgcuccgaccagcacauccagcugcagcucagcgcggaguccgucggcgagguguacaucaagagcacggagaccggccaguaccuggccauggacaccgacgggcugcucuacggcucccagacccccaacgaggagugccuguuccuggagcggcucgaggagaaccacuacaacacguacaucagcaagaagcacgccgagaagaacugguucguggggcugaagaagaacggcuccugcaagcgcgggccgcggacccacuacggccagaaggccauccuguuccucccccugcccgucagcuccgacuga

SEQ ID NO: 30134 - RNA, 636 nt, Artificial Sequence
  derived and/or modified sequence opt1 from FGF20__Homo_sapiens__NP_062825
auggcgccccuggccgaggugggcggguuccucggcgggcuggagggccuggggcagcaggucggcagccacuuccuccugccgcccgccggcgagcgcccgccccugcucggggagcggcgcuccgccgccgagcggagcgcccgcggcgggcccggcgccgcgcagcuggcccaccuccacgggauccugcggcgccggcagcuguacugccgcaccggcuuccaccuccagauccugcccgacggcuccgugcaggggacccggcaggaccacagccuguucggcauccuggaguucaucuccguggccgucgggcucgugagcauccgcggcguggacuccggccuguaccuggggaugaacgacaagggcgagcucuacgggagcgagaagcugacguccgagugcaucuuccgggagcaguucgaggagaacugguacaacaccuacagcuccaacaucuacaagcacggcgacaccgggcgccgguacuucgucgcccugaacaaggacggcacgccccgcgacggcgcgcggagcaagcgccaccagaaguucacccacuuccucccccggccgguggaccccgagcgcgugcccgagcuguacaaggaccugcucauguacaccuga

SEQ ID NO: 30135 - RNA, 630 nt, Artificial Sequence
  derived and/or modified sequence opt1 from FGF21__Homo_sapiens__XP_005258788
auggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcugcugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggcccucccagggccggagccccuccuacgccagcuga

SEQ ID NO: 30136 - RNA, 756 nt, Artificial Sequence
  derived and/or modified sequence opt1 from FGF23__Homo_sapiens__NP_065689
augcugggcgcccgccuccggcugugggugugcgcccugugcagcgucugcuccaugagcgugcuccgcgcguaccccaacgccuccccgcugcuggggagcuccuggggcgggcucauccaccuguacaccgccaccgcccggaacagcuaccaccuccagauccacaagaacggccacguggacggggcgccccaccagacgaucuacuccgcccugaugauccgcagcgaggacgccggcuucgucgugaucaccggcgugaugucccggcgcuaccugugcauggacuuccgggggaacaucuucggcagccacuacuucgaccccgagaacugccgcuuccagcaccagacccuggagaacggguacgacgucuaccacagcccccaguaccacuuccucgugucccugggccgggccaagcgcgccuuccugccggggaugaacccgccgcccuacucccaguuccucagccggcgcaacgagaucccccugauccacuucaacacccccaucccccggcgccacacgcgguccgcggaggacgacagcgagcgcgacccccugaacgugcucaagccccgggcccgcaugacccccgcccccgccuccugcagccaggagcugcccuccgccgaggacaacagcccgauggcgagcgacccccugggcgucgugcggggcgggcgcgugaacacccacgccggcgggaccggccccgagggcugccggcccuucgccaaguucaucuga

SEQ ID NO: 30137 - RNA, 867 nt, Artificial Sequence
  derived and/or modified sequence opt1 from FGF2__Homo_sapiens__NP_001997
auggugggcgucgggggcggggacguggaggacgugaccccgcgcccgggcgggugccagaucagcggccggggcgcccgcgggugcaacggcauccccggggccgcggccugggaggccgcccugccccggcgccggccccgccggcacccguccgucaacccccgcagccgggccgcgggcagcccccgcacccgggggcgccggacggaggagcgccccuccggcucccggcucggcgaccgcgggcggggccgcgcccugcccgggggccggcugggcgggcgcggccgggggcgcgcccccgagcgcgugggcgggcggggccgcggccgggggaccgccgcgccccgcgccgcccccgccgcccggggcagccgcccggggcccgcgggcaccauggccgccggguccaucaccacgcuccccgcccugcccgaggacggcggcagcggggccuucccgcccggccacuucaaggaccccaagcggcuguacugcaagaacgggggcuucuuccuccgcauccaccccgacgggcggguggacggcguccgcgagaaguccgacccgcacaucaagcugcagcugcaggcggaggagcggggcguggugagcaucaagggggucugcgccaaccgcuaccucgccaugaaggaggacggccggcugcuggccuccaagugcgugaccgacgagugcuucuucuucgagcgccucgagagcaacaacuacaacaccuaccggucccgcaaguacaccagcugguacguggcccugaagcggacggggcaguacaagcugggcuccaagaccggccccgggcagaaggcgauccucuuccugcccaugagcgccaaguccuga

SEQ ID NO: 30138 - RNA, 720 nt, Artificial Sequence
  derived and/or modified sequence opt1 from FGF3__Homo_sapiens__NP_005238
augggccugaucuggcuccugcugcucagccugcuggagcccggguggccggccgccggccccggggcgcgccuccggcgcgacgccggcgggcggggcggcguguacgagcaccugggcggggcgccccgccggcgcaagcuguacugcgccaccaaguaccaccuccagcugcaccccuccgggcgggucaacggcagccuggagaacuccgccuacagcauccucgagaucaccgccguggagguggggaucgucgccauccgcggccuguucuccggccgguaccuggccaugaacaagcgcgggcggcucuacgccagcgagcacuacuccgcggagugcgaguucguggagcgcauccacgagcugggcuacaacacguacgccagccggcuguaccgcaccguguccagcaccccgggggcccggcgccagcccuccgccgagcggcucugguacgucagcgugaacggcaagggccgcccccggcgcggguucaagacccggcgcacgcagaaguccagccuguuccugccccgcgugcucgaccaccgggaccacgagaugguccgccagcugcaguccggccugccgcggccgcccgggaagggcgugcagccccgccggcgccggcagaagcagagccccgacaaccucgagcccucccacgugcaggccagccgccuggggucccagcuggaggcgagcgcccacuga

SEQ ID NO: 30139 - RNA, 621 nt, Artificial Sequence
  derived and/or modified sequence opt1 from FGF4__Homo_sapiens__XP_006718538
augagcggccccgggaccgccgccguggcgcugcucccggccguccugcuggcccuccuggcccccugggccggccgcgggggcgcggccgcccccaccgcccccaacgggacgcuggaggcggagcucgagcggcgcugggagucccugguggcccugagccucgcccggcugccgguggccgcccagcccaaggaggcggccguccaguccggcgccggcgacuaccugcucgggaucaagcgccugcggcgccuguacugcaacgugggcaucggguuccaccuccaggcccugcccgacggccggaucgggggcgcccacgcggacacccgcgacagccugcucgagcugucccccguggagcggggcgucgugagcaucuucgggguggccucccgcuucuucgucgccaugagcuccaagggcaagcuguacgggagcccguucuucaccgacgagugcaccuucaaggagauccuccugcccaacaacuacaacgccuacgaguccuacaaguaccccggcauguucaucgcccugagcaagaacggcaagacgaagaaggggaaccgggugucccccaccaugaaggugacccacuuccucccgcgccuguga

SEQ ID NO: 30140 - RNA, 807 nt, Artificial Sequence
  derived and/or modified sequence opt1 from FGF5__Homo_sapiens__NP_004455
augagccuguccuuccuccugcugcuguucuucagccaccugauccuguccgccugggcccacggcgagaagcgccucgcgcccaaggggcagccgggccccgccgccaccgaccggaacccccgcgggagcuccagccggcaguccagcuccagcgccauguccagcuccagcgccuccagcucccccgcggccagccugggcucccaggggagcggccuggagcagagcuccuuccaguggagcccguccggccgccggaccgggagccucuacugccgcgugggcaucggguuccaccuccagaucuaccccgacggcaaggucaacgggucccacgaggccaacaugcugagcgugcucgagaucuucgccgugucccagggcaucgucggcauccgcgggguguucagcaacaaguuccuggcgauguccaagaagggcaagcugcacgccagcgccaaguucacggacgacugcaaguuccgggagcgguuccaggagaacuccuacaacaccuacgccagcgccauccaccgcaccgagaagaccgggcgggagugguacguggcgcucaacaagcgcggcaaggccaagcggggcugcagcccccgcgucaagccccagcacaucuccacgcacuuccugccgcgguucaagcaguccgagcagcccgagcugagcuucaccgugaccgugcccgagaagaagaagcccccgucccccaucaagcccaagaucccccucagcgccccgcgcaagaacaccaacuccgucaaguaccggcugaaguuccgcuucggguga

SEQ ID NO: 30141 - RNA, 627 nt, Artificial Sequence
  derived and/or modified sequence opt1 from FGF6__Homo_sapiens__NP_066276
auggcccugggccagaagcuguucaucaccaugagccgcggggccggccggcugcaggggacccugugggcgcucguguuccugggcauccuggucgggaugguggugcccuccccggccggcacgcgcgccaacaacacccuccuggacagccggggcugggggacccugcucucccgcagccgggccggccuggccggggagaucgcgggcgucaacugggaguccggguaccuggugggcaucaagcgccagcggcgccucuacugcaacgugggcaucggguuccaccuccagguccugcccgacggccggaucagcgggacccacgaggagaaccccuacucccuccuggagaucagcacgguggagcgcggcguggucucccuguucggcgugcggagcgcccucuucguggccaugaacuccaaggggcgccuguacgccacccccagcuuccaggaggagugcaaguuccgggagacccugcucccgaacaacuacaacgcguacgaguccgaccuguaccagggcaccuacaucgcccugagcaaguacgggcgcgucaagcggggcuccaaggugagccccaucaugacggugacccacuuccucccccgcaucuga

SEQ ID NO: 30142 - RNA, 585 nt, Artificial Sequence
  derived and/or modified sequence opt1 from FGF7__Homo_sapiens__NP_002000
augcacaaguggauccugaccuggauccuccccacccugcuguaccgcagcugcuuccacaucaucugccucgugggcacgaucucccuggccugcaacgacaugaccccggagcagauggccaccaacgucaacugcagcucccccgagcggcacacccgcagcuacgacuacauggagggcggggacauccgggugcgccggcuguucugccgcacgcagugguaccuccggaucgacaagcgcgggaaggugaagggcacccaggagaugaagaacaacuacaacaucauggagauccggaccgucgcgguggggaucguggccaucaagggcgucgaguccgaguucuaccuggccaugaacaaggagggcaagcuguacgccaagaaggagugcaacgaggacugcaacuucaaggagcucauccuggagaaccacuacaacaccuacgccagcgcgaaguggacgcacaacgggggcgagauguucguggcccugaaccagaaggggauccccgugcgcggcaagaagaccaagaaggagcagaagaccgcccacuuccuccccauggccaucaccuga

SEQ ID NO: 30143 - RNA, 648 nt, Artificial Sequence
  derived and/or modified sequence opt1 from FGF8__Homo_sapiens__NP_006110
augggcagcccccgcuccgcccugagcugccuccugcugcaccuccuggugcugugccuccaggcccaggucaccgugcaguccagcccgaacuucacccagcacgugcgggagcagucccuggucacggaccagcugagccgccggcucauccgcaccuaccagcuguacucccggaccagcgggaagcacguccaggugcuggcgaacaagcgcaucaacgccauggccgaggacggcgaccccuucgccaagcucaucguggagaccgacacguucgggucccgggugcgcgugcggggcgccgagaccgggcuguacaucugcaugaacaagaagggcaagcugaucgccaagagcaacggcaaggggaaggacugcgucuucaccgagaucgugcucgagaacaacuacaccgcgcugcagaacgccaaguacgagggcugguacauggccuucacgcgcaaggggcggccccgcaagggcuccaagacccggcagcaccagcgcgaggugcacuucaugaagcggcugccccgcgggcaccacaccaccgagcagagccuccgguucgaguuccugaacuacccgcccuucacgcgcucccugcggggcagccagcgcaccugggcgcccgagccccgguga

SEQ ID NO: 30144 - RNA, 627 nt, Artificial Sequence
  derived and/or modified sequence opt1 from FGF9__Homo_sapiens__NP_002001
auggcgccccugggcgagguggggaacuacuucggcguccaggacgccgugccguucgggaacgugcccguccuccccguggacagccccgugcugcuguccgaccaccucggccagagcgaggccgggggccugccgcgcggccccgccgucaccgaccuggaccaccucaaggggauccugcggcgccggcagcuguacugccgcaccggcuuccaccucgagaucuuccccaacgggacgauccagggcacccggaaggaccacucccgcuucgggauccuggaguucaucagcaucgccgugggccugguguccauccggggcgucgacagcgggcucuaccugggcaugaacgagaagggggagcuguacggcuccgagaagcucacccaggagugcguguuccgcgagcaguucgaggagaacugguacaacaccuacagcuccaaccuguacaagcacguggacacgggccggcgcuacuacgucgcccugaacaaggacgggacgccccgggagggcacccgcaccaagcggcaccagaaguucacccacuuccucccgcgccccguggaccccgacaaggugcccgagcuguacaaggacauccugagccaguccuga

SEQ ID NO: 30145 - RNA, 705 nt, Artificial Sequence
  derived and/or modified sequence opt1 from FGFBP1__Homo_sapiens__NP_005121
augaagaucugcagccugacccuccuguccuuccugcuccuggccgcccaggugcugcucgucgagggcaagaagaaggugaagaacgggcugcacagcaagguggucuccgagcagaaggacacccugggcaacacgcagaucaagcagaagucccgccccgggaacaagggcaaguucgugaccaaggaccaggcgaacugccggugggccgccaccgagcaggaggaggggaucagccucaagguggagugcacccagcuggaccacgaguucagcugcgucuucgccggcaacccgacguccugccugaagcucaaggacgagcgcguguacuggaagcaggucgcccggaaccugcgcagccagaaggacaucugccgguacuccaagaccgcggugaagacccgcgugugccggaaggacuuccccgagagcucccugaagcucgugagcuccacccuguucggcaacacgaagccccgcaaggagaagaccgagaugagcccccgggagcacaucaaggggaaggagaccaccccguccagccuggccgucacgcagaccauggccaccaaggcccccgagugcguggaggaccccgacauggcgaaccagcgcaagaccgcccucgaguucugcggcgagacgugguccagccugugcaccuucuuccuguccaucgugcaggacaccagcugcuga

SEQ ID NO: 30146 - RNA, 672 nt, Artificial Sequence
  derived and/or modified sequence opt1 from FGFBP2__Homo_sapiens__NP_114156
augaaguucgugcccugccugcuccuggucacccugagcugccucggcacccuggggcaggccccgcgccagaagcagggcuccacgggggaggaguuccacuuccagaccggcgggcgggacagcugcaccaugcgccccuccagccugggccagggcgccggggagguguggcuccggguggacugccgcaacaccgaccagacguacuggugcgaguaccggggccagcccuccaugugccaggcguucgccgccgaccccaagccguacuggaaccaggcccugcaggagcugcgccggcuccaccacgccugccagggggcgcccguccugcgccccagcgugugccgggaggccggcccccaggcccacaugcagcaggucaccuccagccugaagggguccccggagcccaaccagcagcccgaggccggcacccccagccuccgcccgaaggcgaccgugaagcugacggaggccacccagcugggcaaggacuccauggaggagcucgggaaggccaagcccaccacccggcccacggccaagcccacccagccgggcccccgccccgggggcaacgaggaggccaagaagaaggcgugggagcacugcuggaagcccuuccaggcccugugcgccuuccugaucagcuucuuccggggcuga

SEQ ID NO: 30147 - RNA, 777 nt, Artificial Sequence
  derived and/or modified sequence opt1 from FGFBP3__Homo_sapiens__NP_689642
augacgcccccgaagcugcgcgccagccucucccccagccugcugcuccugcuguccggcugccuccuggccgcggcccggcgcgagaagggggccgccagcaacguggccgagcccguccccggcccgaccgggggcuccagcgggcgguuccugucccccgagcagcacgcgugcagcuggcagcuccugcugcccgcccccgaggccgccgcgggcuccgagcucgcccugcgcugccagagcccggacggcgcccggcaccagugcgccuaccgcgggcaccccgagcggugcgccgcguacgccgcccgccgggcccacuucuggaagcagguccugggcgggcuccgcaagaagcggcgccccugccacgaccccgccccgcugcaggcgcggcugugcgccggcaagaaggggcacggcgccgagcuccgccuggugccccgggccuccccgcccgcccgccccaccguggcgggcuucgccggggagagcaagccccgggcccgcaaccggggccgcacccgggagcgcgccuccgggcccgccgcgggcacgcccccgccccagagcgccccgcccaaggagaaccccuccgagcgcaagaccaacgagggcaagcggaaggccgcccuggugcccaacgaggagcgccccauggggaccggccccgacccggacgggcucgacggcaacgcggagcugaccgagaccuacugcgccgagaaguggcacagccugugcaacuucuucgugaacuucuggaacggguga

SEQ ID NO: 30148 - RNA, 2439 nt, Artificial Sequence
  derived and/or modified sequence opt1 from FGFR1__Homo_sapiens__NP_001167535
auggccgccgugacccgcgacuucggcgagaugcugcuccacagcgggcggguccugcccgcggaggcccagccguggggcgcccccguggagguggaguccuuccugguccaccccggggaccuccugcagcugcgcugccggcuccgcgacgacgugcagagcaucaacuggcugcgggacggcgugcagcuggccgaguccaaccgcacccggaucaccggggaggaggucgaggugcaggacagcgugcccgccgacuccggccucuacgcgugcgucaccagcuccccgagcggcuccgacaccaccuacuucagcgugaacguguccgacgcccugcccagcuccgaggacgacgacgacgacgacgacagcuccagcgaggagaaggagacggacaacaccaagcccaaccgcaugcccgucgccccguacuggaccucccccgagaagauggagaagaagcugcacgccgugcccgcggccaagaccgugaaguucaagugccccagcuccgggacgccgaaccccacccuccgguggcugaagaacggcaaggaguucaagcccgaccaccgcaucgggggcuacaagguccgguacgccaccuggagcaucaucauggacagcguggugcccuccgacaaggggaacuacacgugcaucgucgagaacgaguacggcagcaucaaccacaccuaccagcuggacgugguggagcgcuccccgcaccggcccauccuccaggccggccugcccgccaacaagaccgucgcgcuggggagcaacguggaguucaugugcaagguguacuccgacccccagccgcacauccaguggcucaagcacaucgaggucaacggcagcaagaucgggcccgacaaccugcccuacgugcagauccugaagaccgccggcgucaacaccacggacaaggagauggaggugcuccaccuccgcaacguguccuucgaggacgccggcgaguacacgugccuggccgggaacagcaucggccucucccaccacagcgccuggcugaccguccuggaggcgcucgaggagcggcccgccgugaugaccuccccgcuguaccuggagaucaucaucuacugcaccggggccuuccucaucagcugcauggugggcuccgucaucguguacaagaugaaguccgggaccaagaaguccgacuuccacagccagauggccgugcacaagcuggccaaguccaucccccugcgccggcaggucagcgcggacuccagcgccagcaugaacuccggcgugcuccuggugcgccccagccggcuguccagcuccggcacccccaugcucgccggggucagcgaguacgagcugccggaggacccccgcugggagcugccccgggaccgccucgugcugggcaagccgcugggggagggcugcuucggccaggugguccucgccgaggccaucgggcuggacaaggacaagcccaaccgcgugaccaagguggcggucaagaugcugaaguccgacgccacggagaaggaccucagcgaccugaucuccgagauggagaugaugaagaugaucggcaagcacaagaacaucaucaaccugcucggggccugcacccaggacggcccccuguacgugaucguggaguacgccagcaaggggaaccugcgggaguaccugcaggcgcgccggcccccgggccucgaguacugcuacaaccccucccacaaccccgaggagcagcugagcuccaaggaccuggucagcugcgccuaccagguggcccgcgggauggaguaccucgccuccaagaagugcauccaccgggaccuggccgcgcgcaacgugcuggucaccgaggacaacgugaugaagaucgccgacuucggccucgcccgggacauccaccacaucgacuacuacaagaagaccacgaacggccgccugcccgugaaguggauggccccggaggcccuguucgaccggaucuacacccaccagagcgacgucugguccuucggggugcuccugugggagaucuucacccugggcgggagccccuaccccggcgugcccgucgaggagcuguucaagcugcugaaggagggccaccgcauggacaagccgagcaacugcaccaacgagcucuacaugaugaugcgggacugcuggcacgcggugcccucccagcgccccacguucaagcagcugguggaggaccuggaccggaucgucgcccucaccagcaaccaggaguaccuggaccuguccaugccccucgaccaguacagcccguccuuccccgacacccgcagcagcacgugcagcuccggggaggacagcguguucucccacgagccccugcccgaggagccgugccugccccggcaccccgcccagcucgccaacggcgggcugaagcgccgguga

SEQ ID NO: 30149 - RNA, 648 nt, Artificial Sequence
  derived and/or modified sequence opt1 from FGFR1OP2__Homo_sapiens__NP_001165358
augagcugcaccaucgagaaggcccuggccgacgcgaaggcccucguggagcgccugcgggaccacgacgacgccgccgagucccugaucgagcagaccacggcccucaacaagcgcgucgaggcgaugaagcaguaccaggaggagauccaggagcugaacgagguggcccggcaccgcccccggagcacccuggugaugggcauccagcaggagaaccgccagauccgggagcuccagcaggagaacaaggagcugcgcaccucccuggaggagcaccagagcgcccucgagcugaucauguccaaguaccgggagcagauguuccgccugcucauggccagcaagaaggacgacccggggaucaucaugaagcugaaggagcagcacuccaaggagcugcaggcgcacgucgaccagaucaccgagauggccgccgugaugcggaaggccaucgagaucgacgagcagcagggcugcaaggagcaggagcgcaucuuccagcucgagcaggagaacaaggggcugcgggagauccugcagaucacgcgcgagagcuuccucaaccugcggaaggacgacgccuccgagagcaccucccugagcgcgcucgugaccaacuccgaccugagccugcgcaaguccuga

SEQ ID NO: 30150 - RNA, 1056 nt, Artificial Sequence
  derived and/or modified sequence opt1 from FGFR1OP__Homo_sapiens__NP_001265619
auggccgccaccgcggccgccguggucgccgaggaggacaccgagcugcgcgaccuccuggugcagacgcuggagaacagcggcgugcucaaccggaucaaggccgagcugcgcgcggccgucuuccuggcccucgaggagcaggagaagguggagaacaagacgccccuggugaacgagucccugaagaaguuccucaacaccaaggacgggcggcuggucgccagccugguggcggaguuccuccaguucuucaaccuggacuucacccuggccguguuccagcccgagaccuccacccuccagggccuggaggggcgcgagaaccuggcccgggaccucggcaucaucgaggccgaggggaccgucggcggcccccugcugcucgaggugauccgccggugccagcagaaggagaaggggcccaccacgggcgagaaggccaacgacgaggcgaaccagagcgacaccuccgugagccuguccgagcccaagagcaaguccagccugcaccuccugucccacgagaccaagaucgggagcuuccuguccaaccgcacccucgacggcaaggacaaggccgggcugugcccggacgaggacgacauggagggcgacagcuucuucgacgaccccauccccaagcccgagaagacguacggccugcggaaggagccgcgcaagcaggccgggucccucgccagccuguccgacgccccgccccucaagagcggccuguccagccuggcgggggcccccagccugaaggacuccgagagcaagcggggcaacaccguccucaaggaccugaagcugaucuccgacaagaucggcagccucgggcugggcaccggggaggacgacgacuacguggacgacuucaacuccaccagccaccgcuccgagaaguccgagaucagcaucggcgaggagaucgaggaggaccugagcguggagaucgacgacaucaacacguccgacaagaccaucacccagcucgagugccugcugagcaucggggcccuccacuucaagaacaccgccgacaucuucuga

SEQ ID NO: 30151 - RNA, 2466 nt, Artificial Sequence
  derived and/or modified sequence opt1 from FGFR2__Homo_sapiens__NP_000132
auggugagcuggggccgcuucaucugccuggucguggugaccauggccacccucucccuggcccggcccagcuucucccuggucgaggacacgacccucgagccggaggagccgcccaccaaguaccagaucagccagcccgagguguacguggcggcccccggggagucccuggagguccgcugccugcucaaggacgccgccgugaucagcuggaccaaggacggcgugcaccuggggcccaacaaccggacgguccugaucggcgaguaccuccagaucaagggggccacgccccgcgacuccggccuguacgcgugcaccgccagccggaccguggacuccgagaccugguacuucauggugaacgucaccgacgccaucagcuccggcgacgacgaggacgacaccgacggggccgaggacuucgugagcgagaacuccaacaacaagcgcgcgcccuacuggaccaacacggagaagauggagaagcggcugcacgccgugccggccgccaacaccgucaaguuccgcugccccgccggcgggaaccccaugcccaccaugcgguggcucaagaacggcaaggaguucaagcaggagcaccgcaucgggggcuacaaggugcggaaccagcacuggagccugaucauggaguccguggucccgagcgacaagggcaacuacacgugcgugguggagaacgaguacggguccaucaaccacaccuaccaccuggacgucguggagcgcagcccccaccggcccauccuccaggcgggccugcccgccaacgccuccaccguggucgggggcgacguggaguucgucugcaagguguacagcgacgcccagccgcacauccaguggaucaagcacguggagaagaacggcagcaaguacgggcccgacggccugcccuaccucaagguccugaaggccgcgggggugaacaccaccgacaaggagaucgaggugcuguacauccgcaacgucacguucgaggacgccggcgaguacacgugccucgccgggaacuccaucggcaucagcuuccacuccgccuggcugaccgugcugcccgccccgggccgggagaaggagaucaccgcgagccccgacuaccucgagaucgccaucuacugcaucgggguguuccugaucgccugcauggucgugaccgugauccugugccgcaugaagaacaccaccaagaagcccgacuucuccagccagcccgccguccacaagcucaccaagcggaucccgcugcgccgccaggugacgguguccgccgagagcuccagcuccaugaacagcaacacgccccugguccggaucaccacccggcucuccagcaccgcggacacccccaugcuggccggcguguccgaguacgagcugcccgaggacccgaagugggaguucccccgcgacaagcucacccuggggaagccccugggcgaggggugcuucggccagguggucauggccgaggccgugggcaucgacaaggacaagccgaaggaggcggugaccgucgccgugaagaugcucaaggacgacgccacggagaaggaccugagcgaccugguguccgagauggagaugaugaagaugaucgggaagcacaagaacaucaucaaccuccugggcgccugcacccaggacgggccccuguacgucaucguggaguacgccagcaagggcaaccuccgcgaguaccugcgggcgcgccggccgcccgggauggaguacuccuacgacaucaaccgcgugcccgaggagcagaugaccuucaaggaccuggucagcugcaccuaccagcucgcccggggcauggaguaccuggccagccagaagugcauccaccgcgaccuggccgcccggaacgugcucgugaccgagaacaacgucaugaagaucgcggacuucggccuggcccgcgacaucaacaacaucgacuacuacaagaagacgaccaacgggcggcugcccgugaaguggauggcccccgaggcccuguucgaccgcguguacacccaccaguccgacgucuggagcuucggcgugcucaugugggagaucuucacccucgggggcucccccuacccgggcauccccguggaggagcuguucaagcugcugaaggaggggcaccggauggacaagcccgccaacugcacgaacgagcuguacaugaugaugcgcgacugcuggcacgcgguccccagccagcggccgaccuucaagcagcucguggaggaccuggaccgcauccugacccucaccacgaacgaggaguaccuggaccugucccagccccucgagcaguacagccccuccuaccccgacacccggagcuccugcagcuccggcgacgacagcguguucuccccggaccccaugcccuacgagcccugccugccgcaguacccccacaucaacgggagcgucaagaccuga

SEQ ID NO: 30152 - RNA, 2421 nt, Artificial Sequence
  derived and/or modified sequence opt1 from FGFR3__Homo_sapiens__NP_000133
augggcgcccccgccugcgcgcuggcccucugcguggccgucgccaucguggccggggcgagcuccgagagccugggcaccgagcagcgcguggucgggcgggccgccgaggugcccggccccgagcccgggcagcaggagcagcugguguucggcuccggcgacgccgucgagcucagcugcccgccgcccgggggcgggcccaugggccccaccgugugggugaaggacgggacgggccugguccccuccgagcgcgugcuggugggcccccagcggcuccagguccugaacgcgagccacgaggacuccggggccuacagcugccgccagcggcugacccagcgcgugcucugccacuucuccgugcgggucaccgacgcccccagcuccggcgacgacgaggacggggaggacgaggccgaggacaccggcguggacacgggcgcccccuacuggacccgcccggagcggauggacaagaagcugcuggcggugcccgccgccaacaccguccgcuuccggugccccgccgccgggaaccccaccccgagcaucuccuggcucaagaacggccgcgaguuccgcggggagcaccggaucggcgggaucaagcugcggcaccagcaguggagccuggugauggaguccgugguccccagcgaccgcggcaacuacacgugcgugguggagaacaaguucggcuccauccggcagaccuacacccucgacguccuggagcgcagcccccaccggcccauccugcaggcggggcucccggccaaccagaccgccgugcugggcuccgacgucgaguuccacugcaagguguacagcgacgcccagccccacauccaguggcugaagcacguggaggucaacgggagcaaggugggccccgacgggacgcccuacgugaccguccucaagaccgccggcgcgaacaccacggacaaggagcuggaggugcugucccuccacaacgugaccuucgaggacgccggcgaguacacgugccuggccgggaacagcaucggcuucucccaccacagcgccuggcuggucgugcucccggccgaggaggagcugguggaggcggacgaggccggguccgucuacgccggcauccugagcuacggggugggcuucuuccucuucauccugguggucgccgcggugacccugugccgccuccgguccccgcccaagaagggccuggggagccccaccgugcacaagaucucccgcuucccccugaagcgccaggucagccucgaguccaacgccagcauguccagcaacacgccccuggugcggaucgcccgccuguccagcggcgaggggcccacccucgccaacguguccgagcuggagcugccggccgaccccaagugggagcucagccgggcgcgccugacccugggcaagccccucggcgaggggugcuucggccaggucgugauggccgaggccaucgggaucgacaaggaccgggccgccaagcccgugaccgucgcggugaagaugcugaaggacgacgccaccgacaaggaccuguccgaccucgugagcgagauggagaugaugaagaugaucggcaagcacaagaacaucaucaaccugcugggggccugcacccagggcggcccgcuguacguccucguggaguacgccgccaaggggaaccugcgcgaguuccugcgggcgcgccggccgcccggccucgacuacagcuucgacacgugcaagccgcccgaggagcagcugaccuucaaggaccugguguccugcgccuaccaggucgcccgcgggauggaguaccucgccagccagaagugcauccaccgggaccuggcggcccgcaacgugcuggugaccgaggacaacgucaugaagaucgccgacuucggccucgcccgggacgugcacaaccuggacuacuacaagaagaccaccaacgggcgccugcccgugaaguggauggcccccgaggcccucuucgaccgggucuacacgcaccaguccgacguguggagcuucggcgugcugcugugggagaucuucacccucggcgggucccccuaccccggcauccccgucgaggagcuguucaagcugcucaaggaggggcaccgcauggacaagcccgcgaacugcacccacgaccuguacaugaucaugcgggagugcuggcacgccgcccccagccagcgcccgaccuucaagcagcugguggaggaccucgaccgggugcugacggucaccuccaccgacgaguaccuggaccucagcgcccccuucgagcaguacucccccggcgggcaggacacccccagcuccagcuccagcggcgacgacuccguguucgcgcacgaccugcugccgcccgccccgcccagcuccggcgggagccgcaccuga

SEQ ID NO: 30153 - RNA, 2205 nt, Artificial Sequence
  derived and/or modified sequence opt1 from FGFR4__Homo_sapiens__NP_001278909
augcgccugcuccuggcccugcucggcgugcugcugagcguccccgggccgcccgugcucucccuggaggccagcgaggagguggagcuggagcccugccucgcgcccucccuggagcagcaggagcaggagcugaccgucgcccucggccagccggugcggcugugcugcgggcgcgccgagcggggcgggcacugguacaaggagggcagccgccuggcccccgccggccgggugcgcggguggcggggccgccucgagaucgcguccuuccugcccgaggacgccgggcgguaccugugccucgcccgcggcagcaugaucguccugcagaaccugacccucaucacgggggacucccugaccagcuccaacgacgacgaggaccccaagagccaccgggacccguccaaccgccacagcuacccccagcaggcccccuacuggacccacccccagcggauggagaagaagcugcacgcggugccggccggcaacaccgugaaguuccgcugccccgccgccggcaaccccacgcccaccauccgguggcucaaggacgggcaggccuuccacggcgagaaccgcaucgggggcauccggcugcgccaccagcacuggucccuggucauggagagcguggugccguccgaccggggcaccuacacgugccucgucgagaacgcgguggggagcauccgcuacaacuaccugcuggacgugcucgagcggagcccccaccgccccauccugcaggccggccugcccgccaacaccaccgccgucgugggguccgacguggagcuccugugcaaggucuacuccgacgcccagccgcacauccaguggcugaagcacaucgugaucaacggcagcagcuucggggcggacggcuuccccuacgugcagguccucaagaccgccgacaucaacuccagcgagguggaggugcuguaccugcgcaacgucuccgccgaggacgccggcgaguacacgugccucgccgggaacagcaucggccuguccuaccagagcgcguggcugaccgugcuccccgaggaggaccccaccuggaccgccgccgccccggaggccuccagccccuggucccaggcgcugcccgccagccaggcccaccccugguacgaggccugcgucuccccgcccgcggcgcccccgugcagccccgccucccuggugcucgggaagccccugggcgaggggugcuucggccaggugguccgggccgaggccuucggcauggaccccgcccgcccggaccaggccagcaccguggccgugaagaugcugaaggacaacgccuccgacaaggaccucgccgaccuggucagcgagauggaggugaugaagcugaucgggcggcacaagaacaucaucaaccugcucggcgugugcacgcaggaggggccccuguacgucaucguggagugcgcggccaagggcaaccugcgcgaguuccuccgggcccgccggccgcccgggcccgaccugucccccgacggcccccgcagcuccgagggcccccugagcuucccggugcucgucagcugcgccuaccagguggcccgggggaugcaguaccuggagucccgcaagugcauccaccgggaccuggcggcccgcaacgugcucgucaccgaggacaacgugaugaagaucgccgacuucggccuggcccgcggggugcaccacaucgacuacuacaagaagaccagcaacggccggcugcccgucaaguggauggcgcccgaggcccucuucgaccggguguacacccaccaguccgacguguggagcuucggcauccugcugugggagaucuucacgcucgggggcucccccuacccggggauccccgucgaggagcuguucagccugcuccgcgagggccaccggauggaccgcccgccccacugcccgcccgagcuguacgggcugaugcgggagugcuggcacgccgcccccucccagcgccccaccuucaagcagcucguggaggcccuggacaaggugcugcucgcggucagcgaggaguaccuggaccugcgccucaccuucggccccuacucccccagcggcggggacgccuccagcacgugcuccagcuccgacagcguguucucccacgacccccugccgcugggcagcagcuccuuccccuucgggagcggcgugcagaccuga

SEQ ID NO: 30154 - RNA, 1515 nt, Artificial Sequence
  derived and/or modified sequence opt1 from FGFRL1__Homo_sapiens__NP_001004358
augacccccagcccgcugcuccugcugcuccugccgccccugcuccugggcgccuucccgcccgccgccgccgcccgcgggccgcccaagauggccgacaagguggucccccgccagguggcccgccugggccggaccgugcgccuccagugccccgucgagggggacccgccgccccugacgauguggaccaaggacggccggaccauccacuccggguggagccgcuuccgggugcugccccagggccucaaggugaagcaggucgagcgcgaggacgcgggcguguacgugugcaaggccaccaacggguucggcucccugagcgucaacuacacgcugguggugcucgacgacaucucccccgggaaggagagccugggccccgacuccagcuccgggggccaggaggaccccgccagccagcagugggcccggccccgcuucacccagcccuccaagaugcggcgccgggucaucgcgcgccccgugggcagcuccgugcggcugaagugcgucgccagcgggcacccccggcccgacaucaccuggaugaaggacgaccaggcccucacccggcccgaggccgccgagccccgcaagaagaaguggacgcugucccugaagaaccuccggcccgaggacagcggcaaguacacgugccgcguguccaaccgggcgggggccaucaacgccaccuacaagguggacgucauccagcgcacccgcagcaagccggugcugaccggcacccaccccgugaacaccaccgucgacuucggcgggacgaccuccuuccagugcaaggugcggagcgacgugaagcccgucauccaguggcugaagcgcguggaguacggcgccgaggggcggcacaacagcaccaucgacgucggcgggcagaaguucguggugcuccccaccggcgacgucuggucccgcccggacggcagcuaccugaacaagcugcucaucacgcgggcccgccaggacgacgcggggauguacaucugccugggcgccaacaccaugggguacuccuuccggagcgccuuccugaccgugcuccccgaccccaagccgcccggcccgcccguggccuccagcuccagcgccaccucccugcccuggcccgucgugaucgggauccccgcgggcgccguguucauccugggcacgcuccugcuguggcucugccaggcccagaagaagcccugcaccccggcccccgccccgccccugcccgggcaccgcccgcccggcaccgcgcgggaccgcagcggggacaaggaccugcccucccucgccgcccugagcgccggccccggggucggccugugcgaggagcacggcucccccgcggcgccccagcaccuccuggggcccggcccgguggccgggcccaagcuguaccccaagcucuacaccgacauccacacgcacacccacacccacagccacacccacucccacguggagggcaagguccaccagcacauccacuaccagugcuga

SEQ ID NO: 30155 - RNA, 1314 nt, Artificial Sequence
  derived and/or modified sequence opt1 from FGG__Homo_sapiens__NP_000500
augagcuggucccugcacccccgcaaccucauccuguacuucuacgcccugcucuuccugagcuccaccugcguggccuacgucgcgacccgggacaacugcugcauccuggacgagcgcuucggcagcuacugcccgacgaccugcgggaucgccgacuuccucuccaccuaccagaccaagguggacaaggaccugcagagccuggaggacauccuccaccagguggagaacaagacguccgaggucaagcagcugaucaaggccauccagcugaccuacaaccccgacgagagcuccaagcccaacaugaucgacgccgccacccucaagagccggaagaugcuggaggagaucaugaaguacgaggcguccauccugacccacgacagcuccauccgcuaccuccaggagaucuacaacagcaacaaccagaagaucgugaaccugaaggagaagguggcccagcuggaggcccagugccaggagcccugcaaggacacgguccagauccacgacaucaccggcaaggacugccaggacaucgccaacaagggggcgaagcaguccggccucuacuucaucaagccgcugaaggccaaccagcaguuccugguguacugcgagaucgacgggagcggcaacggcuggaccguguuccagaagcggcucgacggguccgucgacuucaagaagaacuggauccaguacaaggagggcuucgggcaccugagccccaccggcacgaccgaguucuggcuggggaacgagaagauccaccucaucuccacccagagcgccauccccuacgcccugcgcguggagcuggaggacuggaacggccggaccagcacggccgacuacgcgauguucaaggugggccccgaggccgacaaguaccgccucaccuacgccuacuucgccgggggcgacgccggggacgcguucgacggcuucgacuucggcgacgacccguccgacaaguucuucaccagccacaacgggaugcaguucuccaccugggacaacgacaacgacaaguucgagggcaacugcgccgagcaggacgggagcggcugguggaugaacaagugccacgccgggcaccugaacggcgucuacuaccagggcgggacguacuccaaggccagcacccccaacggcuacgacaacgggaucaucugggccaccuggaagacccggugguacuccaugaagaagacgaccaugaagaucauccccuucaaccgccugaccaucggcgaggggcagcagcaccaccucggcggcgcgaagcaggccggggacguguga

SEQ ID NO: 30156 - RNA, 1086 nt, Artificial Sequence
  derived and/or modified sequence opt1 from FGGY__Homo_sapiens__XP_011540039
augagcggcggggagcagaagcccgagcgcuacuacgugggcgucgacguggggaccggcuccgugcgggccgcccuggucgaccagagcggggugcuccuggcguucgccgaccagccgaucaagaacugggagccccaguucaaccaccacgagcaguccagcgaggacaucugggccgccugcugcguggucaccaagaagguggugcagggcaucgaccugaaccagauccgcggccucggguucgacgccacgugcucccuggucgugcuggacaagcaguuccacccccuccccgugaaccaggagggcgacagccaccggaacgucaucauguggcuggaccaccgcgcggugucccaggugaaccggaucaacgagaccaagcacagcguccugcaguacgucgggggcgugauguccguggagaugcaggccccgaagcuccuguggcugaaggagaaccuccgcgagaucugcugggacaaggccgggcacuucuucgaccugcccgacuuccugagcuggaaggccaccggcgugaccgcgcggucccucugcagccuggugugcaaguggacguacuccgccgagaagggcugggacgacagcuucuggaagaugaucgggcuggaggacuucgucgccgacaacuacuccaagaucggcaaccaggugcucccgcccggggccagccugggcaacggccugacccccgaggccgcgcgcgaccucgggcugcugcccggcaucgccguggccgccucccucaucgacgcccacgccgggggccugggggucaucggcgcggacgugcggggccacgggcugaucugcgagggccagcccgucaccagccgccucgccgugaucugcgggaccuccagcugccacaugggcaucagcaaggaccccaucuucgugccgggggucuggggccccuacuucuccgccauggugcccggcuucuggcugaacgagggcgggcagagcgugacggggaagcugaucgaccacaugguccagggccacgccgcguuccccgagcuccaggugaaggccaccgcccgguccccggacuga

SEQ ID NO: 30157 - RNA, 939 nt, Artificial Sequence
  derived and/or modified sequence opt1 from FGL1__Homo_sapiens__NP_004458
auggccaagguguucagcuucauccuggucaccaccgcccucacgaugggccgcgagaucuccgcgcuggaggacugcgcccaggagcagaugcggcugcgcgcccaggugcggcuccuggagacccgcgugaagcagcagcaggucaagaucaagcagcugcuccaggagaacgaggugcaguuccuggacaagggggacgagaacaccgugaucgaccugggcagcaagcggcaguacgccgacugcuccgagaucuucaacgacggguacaagcucagcggcuucuacaagaucaagccccugcaguccccggccgaguucagcgucuacugcgacauguccgacgggggcggcuggaccgugauccagcgccggagcgacggguccgagaacuucaaccgcggcuggaaggacuacgagaacggguucggcaacuucgugcagaagcacggggaguacuggcugggcaacaagaaccuccacuuccugacgacccaggaggacuacacccugaagaucgaccucgcggacuucgagaagaacagccgguacgcccaguacaagaacuucaaggucggcgacgagaagaacuucuacgagcugaacaucggggaguacuccggcaccgccggggacagccuggccggcaacuuccaccccgaggugcaguggugggcgucccaccagcgcaugaaguucagcacgugggaccgggaccacgacaacuacgagggcaacugcgccgaggaggaccaguccggguggugguucaaccgcugccacagcgccaaccucaacggcguguacuacuccgggcccuacaccgccaagaccgacaacggcaucgucugguacaccuggcacggguggugguacagccugaaguccguggugaugaagauccggcccaacgacuucaucccgaacgucaucuga

SEQ ID NO: 30158 - RNA, 1320 nt, Artificial Sequence
  derived and/or modified sequence opt1 from FGL2__Homo_sapiens__NP_006673
augaagcuggccaacugguacuggcucagcuccgccgugcuggcgaccuacggcuuccuggucguggccaacaacgagaccgaggagaucaaggacgagcgcgccaaggacgugugccccguccggcucgagagccgcgggaagugcgaggaggccggcgagugcccguaccaggugucccugccgccccugacgauccagcuccccaagcaguucagccggaucgaggagguguucaaggagguccagaaccugaaggagaucgugaacucccugaagaaguccugccaggacugcaagcuccaggccgacgacaacggggaccccggccgcaacgggcugcugcuccccagcaccggcgcgcccggcgaggugggggacaaccggguccgcgagcuggagagcgaggugaacaagcuguccagcgagcucaagaacgccaaggaggagaucaacgugcugcacggccggcuggagaagcucaaccuggucaacaugaacaacaucgagaacuacguggacuccaagguggccaaccugaccuucgucgugaacagccucgacgggaagugcuccaagugccccagccaggagcagauccagucccgcccggugcagcaccugaucuacaaggacugcagcgacuacuacgccaucggcaagcgguccagcgagaccuaccgcgucacgcccgaccccaagaacuccagcuucgagguguacugcgacauggagaccaugggcgggggcuggaccgugcugcaggcgcggcucgacgggagcaccaacuucacgcgcaccuggcaggacuacaaggccggcuucgggaaccugcggcgcgaguucuggcugggcaacgacaagauccaccuccugaccaaguccaaggagaugauccugcggaucgaccucgaggacuucaacggcgucgagcuguacgcccuguacgaccaguucuacguggccaacgaguuccucaaguaccgccugcacguggggaacuacaacggcaccgccggggacgcgcugcgguucaacaagcacuacaaccacgaccucaaguucuucacgacccccgacaaggacaacgaccgcuacccgagcggcaacugcgggcuguacuacuccagcggcuggugguucgacgccugccuguccgccaaccucaacggcaaguacuaccaccagaaguaccgcgggguccggaacggcaucuucugggggaccuggcccggcgugagcgaggcccaccccgggggcuacaaguccagcuucaaggaggccaagaugaugauccggcccaagcacuucaagccguga

SEQ ID NO: 30159 - RNA, 1383 nt, Artificial Sequence
  derived and/or modified sequence opt1 from FGR__Homo_sapiens__XP_011539313
augggcugcguguucugcaagaagcuggagcccguggccaccgccaaggaggacgcggggcucgagggcgacuuccgcagcuacggggccgccgaccacuacggcccggaccccaccaaggcccggcccgccuccagcuucgcgcacauccccaacuacuccaacuucagcucccaggccaucaacccgggguuccuggacagcggcacgauccgcggcguguccgugaaggucaccgggggccggcuggggcucagcgcccccgagaagcuggccgcguuccccgccaccaccuggccccugcucacgcaguccaagcucaagagcgccuacucccugagcauccgcgacugggaccagacccggggcgaccacgugaagcacuacaagauccgcaagcuggacaugggcggguacuacaucaccacccgggugcaguucaacuccguccaggagcuggugcagcacuacauggaggugaacgacggccugugcaaccuccugaucgccccgugcacgaucaugaagccccagacccuggggcucgccaaggacgcgugggagaucagccgcuccagcaucacccuggagcggcgccugggcaccgggugcuucggcgacgucuggcucggcacguggaacggguccaccaagguggccgugaagacccugaagcccggcaccaugagccccaaggccuuccuggaggaggcccaggucaugaagcuccugcggcacgacaagcuggugcagcucuacgccguggucuccgaggagccgaucuacaucgugacggaguucaugugccacgggagccugcuggacuuccucaagaaccccgagggccaggaccugcgccugccccagcucguggacauggcggcccaggucgccgaggggauggccuacauggagcggaugaacuacauccaccgcgaccugcgggccgcgaacauccuggugggcgagcgccucgccugcaagaucgccgacuucggccuggcccggcugaucaaggacgacgaguacaaccccugccaggggagcaaguucccgaucaaguggaccgcccccgaggcggcccucuucggccgcuucaccaucaaguccgacguguggagcuucgggauccugcugaccgagcucaucacgaagggccggauccccuaccccgggaugaacaagcgcgagguccuggagcaggucgagcagggcuaccacaugccgugcccgcccggcugccccgccucccuguacgaggccauggagcagaccuggcggcucgaccccgaggagcgccccaccuucgaguaccugcagagcuuccuggaggacuacuucaccuccgcggagccccaguaccagcccggggaccagacguga

SEQ ID NO: 30160 - RNA, 3432 nt, Artificial Sequence
  derived and/or modified sequence opt1 from FHDC1__Homo_sapiens__NP_203751
augcacgugaugaacugcgucagccugguguccgacaaggagaacggcaacaucgccaccgcccccggguucaugaucggccagaccccgccccccgcgcccccgcccccccccccgcccccccccccgagcccccccugcuccugcagccgcgaggagugccccuccagcccgcccccccccccgccccccccccucccgggggagccccccauccccccgccccccccgggccugccccccacgacccacaugaacggguacucccaccugggcaagaagaagcggaugcgcagcuucuucuggaagaccauccccgaggagcaggugcggggcaagaccaacaucuggacgcucgccgcccgccaggagcaccacuaccagaucgacaccaagaccaucgaggagcuguucgggcagcaggaggacaccacgaaguccagccugccgcggcgcggccggacccucaacuccagcuuccgcgaggcccgggaggagaucaccauccuggacgccaagcgcuccaugaacaucgggaucuuccugaagcaguucaagaagagcccccgguccaucgucgaggacauccaccagggcaagagcgagcacuacggguccgagacccuccgcgaguuccugaaguuccugcccgagagcgaggaggugaagaagcucaaggcguucuccggcgacgugagcaagcugagccuggccgacuccuuccucuacggccugauccagguccccaacuacagccugcggaucgaggccauggugcucaagaaggaguuccugccguccugcagcucccuguacacggacaucaccgugcuccgcaccgccaucaaggagcugaugagcugcgaggagcugcacuccauccuccaccugguccugcaggcggggaacaucaugaacgccggcggguacgccggcaacgccgugggcuucaagcucagcucccugcugaagcucgccgacaccaaggcgaacaagcccgggaugaaccugcugcacuucguggcccaggaggcccagaagaaggacacgauccuccugaacuucagcgagaagcugcaccacguccagaagaccgcccggcucucccuggagaacaccgaggccgagcugcaccuccuguucgugcgcaccaagagccugaaggagaacauccagcgggacggcgagcucugccagcagauggaggacuuccugcaguucgcgaucgagaagcugcgcgagcucgagugcuggaagcaggagcugcaggacgaggccuacacgcugaucgacuucuucugcgaggacaagaagaccaugaagcucgacgagugcuuccagaucuuccgggacuucugcaccaaguucaacaaggccgugaaggacaaccacgaccgcgaggcccaggagcugcggcagcugcagcgccugaaggagcaggagcagaagcagcgcuccugggccaccggggagcucggcgcguucgggcggagcuccagcgagaacgacgucgagcugcugacgaagaagggcgccgagggccuccugcccuuccugcacccccgcccgaucucccccagcucccccagcuaccggcccccgaacacccgccggagccgccucucccuggggcccagcgccgaccgggagcugcucaccuuccuggaguccagcaccggcucccccgaggagcccaacaaguuccacagccugccgcgcuccagcccccggcaggcccgccccacgaucgccugccucgagcccgcggaggugcggcaccaggacuccagcuucgcccacaagccgcaggccuccgggggccaggaggaggcccccaaccccccgagcgcgcaggcccaccagcuggccgccgcccagcccgagaaccacgcguccgccuucccccgcgcccggcgccagggggugagcguccugcggaagcgcuacuccgagcccgugagccucggcuccgcccagagcccgccccugagcccccuggcccucggcaucaaggagcacgagcuggugaccgggcuggcgcaguucaaccuccagggcucccaggggauggaggagaccagccagcugacccuguccgacuucagccccauggagcucgaguccgucggccaccgggggccgcagagccuguccgccagcuccagcucccugacgcccaugggccgcgacgcccucggcagccugucccccgcccuggaggacgggaaggccgcgcccgacgagccgggcagcgccgcccucggguccgugggcagcuccgaccccgagaacaaggacccccggccccuguucugcaucagcgacaccaccgacugcucccugacccucgacugcagcgagggcacggacagccgcccgcgcgggggcgaccccgaggaggggggcgagggggacggcuccaugagcuccggcgugggggagaugggcgacagccaggucuccagcaaccccaccuccagccccccgggggaggcccccgcgcccguguccgucgacagcgagcccuccugcaagggcgggcugccgcgggacaagcccaccaagcgcaaggacgugguggcccccaagcggggcagccugaaggaggccucccccggcgccagcaagccgggguccgcccgccggagccagggcgcggucgccaaguccgugcgcacccucaccgccagcgagaacgaguccaugcggaaggugaugcccaucacgaagagcagccgcggggccggcuggcggcgccccgagcuguccagccgggggccgucccagaacccccccagcuccaccgacaccgucuggagccgccagaacuccgugcggcgcgccagcaccggcgcggaggagcagcggcugccccgcggcuccagcggguccagcuccacgcggccgggccgcgacgugccccuccagccccgggggagcuucaagaagcccuccgccaagccgcugcgcaaccugccccggcagaagcccgaggagaacaagaccugccgcgcccacagcgagggccccgaguccccgaaggaggagcccaagacccccagcguccccuccgugccgcacgagcucccccgcgugcccagcuucgcccggaacaccgucgccagcuccagccgcuccaugcggacggaccugcccccgguggcgaaggcccccgggaucacccgcaccgugagccagcggcagcugcgcgucaagggcgaccccgaggacgccgcccccaaggacuccagcacccuccggcgcgcguccagcgcccgggccccgaagaagcgccccgaguccgccgagggccccagcgccaacacggaggcgccccugaaggcccggggggccggcgagcgcgccucccugcggcgcaaggacagcucccggaccacccucgggcgcauccugaacccgcugcggaaguga

SEQ ID NO: 30161 - RNA, 1533 nt, Artificial Sequence
  derived and/or modified sequence opt1 from FH__Homo_sapiens__NP_000134
auguaccgcgcccugcggcuccuggcccgcagccggccccuggugcgcgcgccggccgccgcccucgccuccgcgcccggccucgggggcgccgccguccccagcuucuggcccccgaacgccgcgcggauggccucccagaacagcuuccgcaucgaguacgacaccuucggggagcugaaggugcccaacgacaaguacuacggcgcccagaccgugcgguccacgaugaacuucaagaucgggggcgucaccgagcgcaugcccacccccgugaucaaggccuucggcauccugaagcgggccgcggccgaggugaaccaggacuacgggcuggacccgaagaucgccaacgccaucaugaaggccgcggacgaggucgccgagggcaagcugaacgaccacuucccccucgugguguggcagaccgggagcggcacgcagaccaacaugaacgucaacgaggugaucuccaaccgcgccaucgagaugcucgggggcgagcugggcagcaagauccccgugcaccccaacgaccacgucaacaagucccagagcuccaacgacaccuucccgaccgccaugcacaucgccgcggccaucgaggugcacgaggugcugcugcccgggcugcagaagcuccacgacgcccuggacgccaagagcaaggaguucgcccagaucaucaagaucggccggacgcacacccaggacgcggucccccugacccucgggcaggaguucuccggcuacgugcagcaggucaaguacgccaugacccgcaucaaggccgccaugccccggaucuacgagcuggcggccggcgggacggccgugggcaccgggcugaacacccgcaucggcuucgccgagaagguggccgcgaagguggccgcccucaccgggcugccguucgucacggcccccaacaaguucgaggcccuggcggcccacgacgcccucguggagcugagcggcgccaugaacaccaccgccugcucccugaugaagaucgcgaacgacauccgguuccucggcagcgggccccgcuccggccugggggagcugauccuccccgagaacgagccgggcagcuccaucaugcccgggaaggugaaccccacccagugcgaggccaugacgauggucgccgcccaggugaugggcaaccacgucgcggugaccgugggcgggagcaacggccacuucgagcugaacgucuucaagcccaugaugaucaagaacgugcugcacagcgcccggcuccugggggacgccuccgugagcuucaccgagaacugcgucgugggcauccaggccaacaccgagcgcaucaacaagcugaugaacgagucccucaugcuggugacggcccugaacccgcacaucggguacgacaaggcggccaagaucgccaagaccgcccacaagaacggcagcacccucaaggagaccgccaucgagcugggcuaccugacggcggagcaguucgacgagugggucaagcccaaggacaugcucgggcccaaguga

SEQ ID NO: 30162 - RNA, 444 nt, Artificial Sequence
  derived and/or modified sequence opt1 from FHIT__Homo_sapiens__NP_002003
augagcuuccgcuucggccagcaccugaucaagcccuccguggucuuccucaagaccgagcugagcuucgcccuggugaaccggaagccggugguccccgggcacgugcucgugugcccccugcgccccgucgagcgguuccacgaccugcgcccggacgagguggccgaccucuuccagaccacgcagcgggugggcaccgucguggagaagcacuuccacgggaccucccugaccuucagcaugcaggacggccccgaggcggggcagacggugaagcacguccacgugcacgugcugccccgcaaggccggcgacuuccaccggaacgacuccaucuacgaggagcuccagaagcacgacaaggaggacuuccccgccagcuggcgcuccgaggaggagauggccgccgaggcggccgcccugcgggucuacuuccaguga

SEQ ID NO: 30163 - RNA, 891 nt, Artificial Sequence
  derived and/or modified sequence opt1 from FHL1__Homo_sapiens__NP_001153171
auggccagccaccgccacuccggccccagcuccuacaagguggggaccauggccgagaaguucgacugccacuacugccgggacccgcugcagggcaagaaguacgugcagaaggacgggcaccacugcugccucaagugcuucgacaaguucugcgcgaacacgugcguggagugccgcaagcccaucggcgccgacagcaaggaggugcacuacaagaaccgguucuggcacgacacgugcuuccgcugcgccaagugccugcacccccuggccaacgagaccuucgucgccaaggacaacaagauccucugcaacaagugcaccacccgggaggacucccccaagugcaaggggugcuucaaggcgaucguggccggcgaccagaacguggaguacaagggcaccgucuggcacaaggacugcuucacgugcagcaacugcaagcaggucaucgggaccggcuccuucuucccgaagggggaggacuucuacugcgugaccugccacgagaccaaguucgccaagcacugcgugaagugcaacaaggccaucaccagcggcgggaucaccuaccaggaccagcccuggcacgcggacugcuucgugugcgugaccugcuccaagaagcuggccggccagcgcuucacggccgucgaggaccaguacuacugcguggacugcuacaagaacuucguggccaagaagugcgccggcugcaagaaccccaucaccggguucggcaaggggagcuccgucguggcguacgagggccagagcuggcacgacuacugcuuccacugcaagaagugcuccgugaaccuggccaacaagcgguucgucuuccaccaggagcaggucuacugccccgacugcgccaagaagcucuga

SEQ ID NO: 30164 - RNA, 1170 nt, Artificial Sequence
  derived and/or modified sequence opt1 from FHL2__Homo_sapiens__XP_005263959
augacccgccggggcuucagccgcgccggggccgcgcagcgguccacccgccccgccgccgagccgcagccgcccgccgcccgggcgcugcagccccgccccggcgugcccgggccccuccggugccgcgaguaccugcagcccccggcgccccggcgcgaggccgagggccugagccaccagggguccgaggucggcgccgagagcggcgcccggcccaaggagcgcggggccgagcccgagcucggccggcuguggcugcgcacgguguccagcuggcggcucggguggcacuucgacuucggcguggccgagaagccgggggucaagaugaccgagcgcuucgacugccaccacugcaacgagucccuguucggcaagaaguacauccugcgggaggagagccccuacugcguggugugcuucgagacccucuucgccaacacgugcgaggagugcggcaagcccaucgggugcgacugcaaggaccuguccuacaaggaccgccacuggcacgaggccugcuuccacugcagccagugccggaacucccuggucgacaagcccuucgcggccaaggaggaccagcuccugugcaccgacugcuacagcaacgaguacuccagcaagugccaggagugcaagaagaccaucaugccgggcacccgcaagauggaguacaagggguccagcuggcacgagaccugcuucaucugccaccggugccagcagcccaucggcacgaaguccuucauccccaaggacaaccagaacuucugcgugcccugcuacgagaagcagcacgccaugcagugcgugcagugcaagaagccgaucaccaccggcggggucaccuaccgcgagcagcccuggcacaaggagugcuucgugugcacggccugccgcaagcagcugagcggccagcgguucaccgcccgcgacgacuucgcguacugccucaacugcuucugcgaccuguacgccaagaagugcgccgggugcaccaaccccaucuccggccucgggggcaccaaguacaucagcuucgaggagcggcaguggcacaacgacugcuucaacugcaagaagugcagccugucccuggugggccgcggguuccugacggagcgggacgacauccucugccccgacugcggcaaggacaucuga

SEQ ID NO: 30165 - RNA, 855 nt, Artificial Sequence
  derived and/or modified sequence opt1 from FHL5__Homo_sapiens__XP_006715676
augaccaccgcccacuucuacugccaguacugcacggccagccugcucggcaagaaguacgugcugaaggacgacucccccuacugcgugaccugcuacgaccgcgucuucagcaacuacugcgaggagugcaagaagccgaucgaguccgacagcaaggaccugugcuacaaggaccggcacuggcacgaggggugcuucaagugcaccaagugcaaccacucccucguggagaagcccuucgcggccaaggacgagcgccugcugugcaccgagugcuacagcaacgagugcuccagcaagugcuuccacugcaagcggacgaucaugcccggcucccgcaagauggaguucaaggggaacuacuggcacgagaccugcuucgucugcgagaacugccggcagcccaucggcaccaagccgcucaucagcaaggaguccgggaacuacugcgugcccugcuucgagaaggaguucgcccacuacugcaacuucugcaagaaggugaucaccagcggcggcaucacguucugcgaccagcuguggcacaaggagugcuuccugugcuccgggugccgcaaggaccucugcgaggagcaguucaugagccgggacgacuaccccuucugcgucgacugcuacaaccaccuguacgccaacaagugcguggccugcuccaagcccaucagcggccugaccggggcgaaguucaucugcuuccaggacucccaguggcacagcgagugcuucaacugcggcaagugcuccgugagccucgucgggaagggcuuccugacccagaacaaggagaucuucugccagaagugcggcagcgggauggacaccgacaucuga

SEQ ID NO: 30166 - RNA, 3495 nt, Artificial Sequence
  derived and/or modified sequence opt1 from FHOD1__Homo_sapiens__NP_037373
auggccggcggggaggaccgcggcgacggggagcccgugagcgucgugaccgugcggguccaguaccuggaggacaccgacccguucgccugcgcgaacuuccccgagccccgccgggcccccacgugcucccucgacggcgcccugccgcugggggcccagauccccgccgugcaccgccuccugggcgcgccccugaagcucgaggacugcgcccuccaggugagccccuccggcuacuaccuggacaccgagcucagccuggaggagcagcgggagaugcuggagggguucuacgaggagaucuccaagggccgcaagccgacccucauccugcggacccagcugagcguccgcgugaacgccauccucgagaagcuguacuccagcuccgggcccgagcugcggcgcagccucuucucccugaagcagaucuuccaggaggacaaggaccuggugcccgaguucguccacagcgagggccucuccugccugauccgggugggggccgcggccgaccacaacuaccagagcuacauccugcgcgcccucggccagcugaugcuguucguggacggcaugcucggggucguggcccacuccgacacgauccaguggcuguacacccugugcgccagccucucccggcugguggucaagaccgcgcugaagcuccugcugguguucguggaguacagcgagaacaacgcgccccucuucauccgcgccgucaacuccguggccagcaccacgggcgccccgcccugggccaaccuggugagcauccuggaggagaagaacggggccgaccccgagcuccuggucuacaccgugacccugaucaacaagacccucgccgcccugcccgaccaggacuccuucuacgacgugacggacgcccuggagcagcagggcauggaggcgcucguccagcggcaccugggcaccgccgggaccgacguggaccugcgcacccagcucguccuguacgagaacgcccugaagcuggaggacggcgacaucgaggaggccccgggggccggcgggcggcgcgagcggcgcaagcccagcuccgaggagggcaagcggagccgccgcucccucgagggcgggggcugccccgcgcgggcccccgagccggggcccacgggccccgccagccccguggggccgaccuccagcaccggccccgcccugcugaccggccccgcguccagccccguggggccgcccuccggccugcaggccagcgucaaccuguuccccacgaucuccguggccccgagcgccgacaccuccagcgagcgcuccaucuacaaggcccgguuccuggagaacguggcggccgccgagaccgagaagcaggucgcccucgcccaggggcgcgcggagacccuggccggcgccaugcccaacgaggccgggggccaccccgacgcccggcagcugugggacagccccgagacggcgccggccgcccgcacgccccagucccccgcccccugcgugcuccugcgggcgcagcgcagccuggccccggagcccaaggagccccucauccccgccagcccgaaggccgagcccaucugggagcugcccacccgggcgccccgccuguccaucggcgaccucgacuucagcgaccugggggaggacgaggaccaggacaugcugaacguggaguccgucgaggccggcaaggacaucccggcccccagcccgccccucccccugcuguccggggugcccccgccgccgccccugcccccgcccccgcccaucaagggccccuucccgcccccgccgccccucccccuggccgcgccccucccccacagcgugcccgacuccagcgcccugcccaccaagcggaagaccgucaagcuguucuggcgcgagcucaagcuggccggcgggcacggcguguccgccagccgguucgggcccugcgccacccugugggccucccucgaccccgugagcgucgacaccgcccgccuggagcaccuguucgagucccgggcgaaggaggugcuccccagcaagaaggccggcgaggggcgccggaccaugacgaccgugcuggaccccaagcgcuccaacgccaucaacaucggccugaccacccugccgcccguccacgugaucaaggccgcgcuccugaacuucgacgaguucgccgugagcaaggacggcaucgagaagcuccugacgaugaugcccaccgaggaggagcggcagaagaucgaggaggcccagcuggccaaccccgacaucccccucgggcccgccgagaacuuccugaugacccuggcguccaucggcgggcucgccgcccgccugcagcugugggccuucaagcucgacuacgacagcauggagcgcgagaucgccgagccccuguucgaccugaaggucggcauggagcagcucgugcagaacgcgaccuuccggugcauccuggccacccugcucgccguggggaacuuccugaacggcagccaguccagcggcuucgagcuguccuaccucgagaaggucagcgaggugaaggacacggugcgccggcagucccugcugcaccaccucugcagccugguccugcagacccgccccgaguccagcgaccucuacuccgagauccccgcccugacccggugcgccaagguggacuucgagcagcugaccgagaaccucgggcagcuggagcgccggagccgcgcggccgaggagucccugcggagccucgccaagcacgagcuggcccccgcccugcgcgcgcggcucacgcacuuccuggaccagugcgcccgccggguggccaugcugcgcaucguccaccggcgcgugugcaaccgguuccacgccuuccuccuguaccugggcuacacgccccaggcggcccgcgaggugcggaucaugcaguucugccacacccuccgcgaguucgcccuggaguaccggaccugccgcgagcgcguccugcagcagcagcagaagcaggccaccuaccgggagcgcaacaagacccgggggcgcaugaucaccgagaccgagaaguucuccggcguggccggggaggcgcccagcaacccguccgugcccgucgccgugagcuccggccccggccgcggggacgccgacagccacgccuccaugaagucccuccugacgagccggcccgaggacaccacccacaaccggcgcagccggggcauggugcagagcuccagcccgaucaugcccaccgucgggcccuccacggccagccccgaggagccgcccggcuccagccugcccuccgacaccagcgacgagaucauggaccuccuggugcaguccgugaccaagagcagcccccgcgcgcuggccgcccgggagcgcaagcggucccgcgggaaccggaagucccuccgccggacccucaagagcggccugggcgacgaccugguccaggcccuggggcuguccaagggcccggggcucgagguguga

SEQ ID NO: 30167 - RNA, 4269 nt, Artificial Sequence
  derived and/or modified sequence opt1 from FHOD3__Homo_sapiens__NP_001268668
auggccacccuggccugccgcgugcaguuccucgacgacaccgaccccuucaacagcaccaacuuccccgagcccagccggccgccccuguucaccuuccgcgaggaccuggcccucggcacccagcuggccgggguccaccggcugcuccaggcgccccacaagcuggacgacugcacccugcagcucagccacaacggcgccuaccuggaccuggaggccacgcucgccgagcagcgcgacgagcuggagggguuccaggacgacgccggccgggggaagaagcacuccaucauccugcgcacccagcucagcgugcgggugcacgccugcaucgagaagcuguacaacuccagcggccgcgaccugcggcgcgcccucuucucccugaagcagaucuuccaggacgacaaggaccugguccacgaguucgugguggcggagggccugaccugccugaucaaggucggggccgaggccgaccagaacuaccagaacuacauccugcgggcccucggccagaucaugcuguacguggacgggaugaacggcgugaucaaccgcaacgagaccauccaguggcuguacacgcucaucgggagcaaguuccggcuggucgugaagaccgcccugaagcuccugcugguguucgucgaguacuccgagagcaacgcgccccuccugauccaggccgugaccgccguggacaccaagcgcggcgucaagcccugguccaacaucauggagauccuggaggagaaggacggcguggacacggagcuccugguguacgccaugacccuggucaacaagacccucagcgggcugcccgaccaggacaccuucuacgacgugguggacugccuggaggagcucggcaucgccgccgucucccagcggcaccugaacaagaaggggacggaccuggaccucguggagcagcugaacaucuacgagguggcccugcgccacgaggacggcgacgagaccaccgagcccccgcccagcggcugccgggaccgccggcgcgccuccgucugcagcuccgggggcggggagcaccggggccucgaccgccgccggagccgccggcacuccgugcagagcaucaagagcacccuguccgcccccacgagccccugcucccagagcgcccccuccuucaagcccaaccagguccgcgaccugcgggagaaguacagcaacuucgggaacaacuccuaccacagcucccgccccagcuccggcagcuccgugcccaccacccccaccagcuccguguccccgccccaggaggcgcggcuggagcgcuccagccccuccggccuccugacgagcagcuuccggcagcaccaggagucccuggccgccgagcgcgagcggcgccggcaggagcgcgaggagcggcuccagcgcaucgagcgggaggagcgcaacaaguuccgguacaaguaccuggagcagcuggccgccgaggagcacgagaaggagcuccgcagccgcuccgucagccgggggcgcgcggaccugucccuggaccucaccagccccgccgcccccgccugccuggcgccccugucccacagccccuccagcuccgacagccaggaggcccucaccguguccgccagcucccccggcacgccccaccacccccaggccagcgccggggaccccgagcccgaguccgaggcggagcccgaggccgaggccggcgccgggcaggucgccgacgaggcgggccaggacaucgccagcgcccacgagggcgccgagacggaggucgagcaggcccuggagcaggagcccgaggagcgggcgagccuguccgagaaggagcgccagaacgagggggugaacgagcgggacaacugcagcgccuccagcguguccagcuccagcuccacccucgagcgcgaggagaaggaggacaagcugagccgggaccgcaccaccggccuguggcccgccgggguccaggacgccggcgugaacgggcagugcggcgacauccucacgaacaagcgguucaugcuggacaugcuguacgcgcacaaccgcaagucccccgacgacgaggagaagggcgacggggaggccggccggacccagcaggaggccgaggccguggccagccucgcgacccgcaucuccacccugcaggccaacagccagacgcaggacgaguccguccggcgcguggacguggggugccuggacaaccggggcagcgucaaggccuucgccgagaaguucaacuccggcgaccucgggcgcggcagcaucucccccgacgccgagcccaacgacaaggugcccgagaccgcgcccgugcagcccaagaccgagagcgacuacaucugggaccagcugauggccaacccgcgggagcugcgcauccaggacauggacuucaccgaccucggggaggaggacgacaucgacguccuggacguggaccugggccaccgggaggcccccgggccgcccccgcccccgccgcccaccuuccucggccugcccccgcccccgcccccgccccugcucgacagcaucccgccgccgcccgugcccggcaaccugcuggugcccccgccgcccguguucaacgcgccccaggggcucggcuggucccaggugccccgcgggcagcccacguucaccaagaagaagaagaccauccggcuguucuggaacgagguccgccccuucgacuggcccugcaagaacaaccgccggugccgcgaguuccuguggagcaagcucgagcccaucaagguggacaccucccggcuggagcaccuguucgagagcaaguccaaggagcucagcguguccaagaagacggccgcggacggcaagcgccaggagaucaucguccuggacagcaagcgguccaacgccaucaacaucgggcugaccgugcugcccccgccccgcaccaucaagaucgccauccucaacuucgacgaguacgcccugaacaaggagggcaucgagaagauccucaccaugauccccacggacgaggagaagcagaagauccaggaggcgcagcuggccaacccggagaucccccugggcagcgccgagcaguuccuccugacccuguccagcaucuccgagcucagcgcccggcugcaccugugggccuucaagauggacuacgagaccaccgagaaggagguggcggagccccuccuggaccugaaggaggggaucgaccagcucgagaacaacaagacgcugggcuucauccuguccacccuccuggccaucgggaacuuccugaacggcaccaacgccaaggccuucgagcucagcuaccuggagaagguccccgaggugaaggacaccgugcacaagcagucccugcuccaccacgucugcacgauggugguggagaacuucccggacagcuccgaccuguacagcgagaucggggccaucacccgcagcgcgaaggucgacuucgaccagcugcaggacaaccucugccagauggagcggcgcugcaaggccuccugggaccaccugaaggccaucgccaagcacgagaugaagcccgugcugaagcagcggaugagcgaguuccucaaggacugcgccgagcgcaucaucauccugaagaucgugcaccggcgcaucaucaaccgguuccacuccuuccuccucuucaugggccacccgcccuacgcgauccgcgaggucaacaucaacaaguucugccggaucaucagcgaguucgcccuggaguaccgcaccacccgggagcgcgugcugcagcagaagcagaagcgcgccaaccaccgggagcgcaacaagacgcggggcaagaugaucaccgacuccgggaaguucagcggcuccagcccggcgccgcccucccagccccaggggcucagcuacgccgaggacgcggccgagcacgagaacaugaaggccgugcugaagaccuccagcccguccgucgaggacgccacccccgcgcugggcgugcgcacgcggagccgcgccucccgggggagcaccuccagcuggaccaugggcaccgacgacucccccaacgugacggacgacgccgccgacgagaucauggaccgcaucgucaagagcgccacccaggugccgagccagcggguggucccccgcgagcggaagcgcucccgggcgaaccgcaagagccuccggcgcacccugaaguccggccugacccccgaggaggcccgggcccucgggcuggugggcacgagcgagcugcagcucuga

SEQ ID NO: 30168 - RNA, 1074 nt, Artificial Sequence
  derived and/or modified sequence opt1 from FIBP__Homo_sapiens__NP_004205
augaccagcgagcuggacaucuucgugggcaacaccacgcucaucgacgaggacgucuaccgccuguggcuggacggguacuccgugaccgacgccguggcccuccggguccgcagcggcauccuggagcagaccggggcgaccgccgccgugcugcaguccgacacgauggaccacuaccggaccuuccacaugcucgagcgccugcugcacgcgcccccgaagcuccugcaccagcugaucuuccagaucccgcccagccggcaggcccuccugaucgagcgcuacuacgccuucgacgaggccuucgugcgggagguccugggcaagaagcucuccaaggggaccaagaaggaccuggacgacaucagcaccaagacgggcaucacccugaaguccugccgccggcaguucgacaacuucaagcgcguguucaagguggucgaggagaugcggggcagccucguggacaacauccagcagcacuuccugcuguccgaccgccucgcccgggacuacgccgcgaucguguucuucgccaacaaccgcuucgagaccgggaagaagaagcugcaguaccugagcuucggcgacuucgccuucugcgccgagcucaugauccagaacuggacccugggggccgucgacucccagauggacgacauggacauggaccuggacaaggaguuccuccaggaccugaaggagcugaaggugcucguggcggacaaggaccugcuggaccuccacaagagccuggucugcacggcccugcggggcaagcucgggguguucuccgagauggaggccaacuucaagaaccugagccgcggccuggugaacgucgccgccaagcucacccacaacaaggacgugcgggaccuguucguggaccuggucgagaaguucguggagcccugccgcuccgaccacuggccccucagcgacgugcgguucuuccugaaccaguacuccgcgagcguccacucccuggacggcuuccgccaccaggcccucugggaccgguacauggggacccugcgcggcugccugcuccgccuguaccacgacuga

SEQ ID NO: 30169 - RNA, 2724 nt, Artificial Sequence
  derived and/or modified sequence opt1 from FIG4__Homo_sapiens__NP_055660
augcccaccgccgccgcgcccaucaucagcuccgugcagaagcugguccucuacgagacccgcgcccgguacuuccuggugggcagcaacaacgccgagacgaaguaccgcgugcugaagaucgaccggaccgagcccaaggaccucgucaucaucgacgaccgccacguguacacccagcaggaggugcgggagcugcuggggcgccucgaccugggcaaccggaccaagauggggcagaagggcuccagcgggcuguuccgcgccgucuccgccuucggcguggugggcuucguccgguuccucgagggguacuacaucgugcugaucacgaagcgccggaagauggcggacaucggcgggcacgccaucuacaagguggaggacaccaacaugaucuacauccccaacgacagcguccgcgugacccaccccgacgaggcccgguaccugcgcaucuuccagaacguggaccucuccagcaacuucuacuucuccuacagcuacgaccugucccacagccugcaguacaaccucaccguccugcggaugccgcuggagaugcucaaguccgagaugacgcagaaccgccaggagagcuucgacaucuucgaggacgagggccugaucacccagggcggguccggcguguucgggaucugcagcgagcccuacaugaaguacguguggaacggcgagcugcucgacaucaucaaguccaccguccaccgggacuggcugcuguacaucauccacggguucugcggccagagcaagcuccugaucuacggccgccccguguacgugacccugaucgcccggcgcuccagcaaguucgcggggacgcgguuccucaagcgcggcgccaacugcgagggggacgucgccaacgagguggagaccgagcagauccugugcgacgccagcgugauguccuucaccgccggcagcuacuccagcuacguccaggugcgcggguccgucccccuguacuggagccaggacaucuccaccaugaugccgaagccgcccaucacgcucgaccaggcggaccccuucgcccacguggccgcccugcacuucgaccagauguuccagcgguucggcagccccaucaucauccugaaccucgugaaggagcgcgagaagcggaagcacgagcgcauccuguccgaggagcuggucgccgcggugaccuaccucaaccaguuccugccgcccgagcacaccaucguguacauccccugggacauggccaaguacaccaagagcaagcugugcaacguccucgaccggcugaacgugaucgccgaguccguggucaagaagacgggcuucuucgugaaccgccccgacagcuacugcuccauccugcggcccgacgagaaguggaacgagcucgggggcugcgugauccccaccgggcgccugcagaccggcauccugcggaccaacugcgucgacugccucgaccgcacgaacaccgcccaguucaugguggggaagugcgcccuggcguaccagcuguacagccucggccugaucgacaagcccaaccugcaguucgacaccgacgccgugcggcuguucgaggagcucuacgaggaccacggcgacacccugucccugcaguacgggggcagccagcucguccaccgcgugaagacguaccggaagaucgccccguggacccagcacuccaaggacaucaugcagacccugagccgcuacuacuccaacgccuucagcgacgccgaccggcaggacagcaucaaccuguuccucgggguguuccaccccaccgagggcaagccccaccugugggagcugcccacggacuucuaccuccaccacaagaacaccaugcgccugcugccgacccggcgcuccuacaccuacugguggacgcccgaggucaucaagcaccucccccugcccuacgacgaggugaucugcgcggugaaccugaagaagcucaucgucaagaaguuccacaaguacgaggaggagaucgacauccacaacgaguucuuccggccguacgagcugagcuccuucgacgacaccuucugccuggccaugaccagcuccgcccgcgacuucaugcccaagaccguggggaucgaccccagcccguucaccgugcgcaagcccgacgagacgggcaaguccguccucggcaacaagagcaaccgggaggaggccgugcugcagcgcaagaccgcggccuccgccccgccgccgcccagcgaggaggccguguccagcuccagcgaggacgacuccgggaccgaccgggaggaggagggcagcgucucccagcgcagcacccccgugaagaugacggacgccggggacagcgcgaaggugaccgagaacgucgugcagcccaugaaggagcuguacggcaucaaccucuccgacggccugagcgaggaggacuucuccaucuacagccgguucgugcagcuggggcagucccagcacaagcaggacaagaacagccagcagcccugcucccgcugcagcgacggcgucaucaagcucacccccaucuccgccuucagccaggacaacaucuacgaggugcagccgccccggguggaccgcaaguccaccgagaucuuccaggcccacauccaggccagccaggggaucaugcagccccugggcaaggaggacuccagcauguaccgggaguacauccgcaaccgguaccuguga

SEQ ID NO: 30170 - RNA, 1065 nt, Artificial Sequence
  derived and/or modified sequence opt1 from FIGF__Homo_sapiens__NP_004460
auguaccgcgaguggguggucgugaacguguucaugaugcuguacguccagcucgugcagggcagcuccaacgagcacgggcccgugaagcggagcucccagagcacccuggagcgcuccgagcagcagauccgggccgccagcucccuggaggagcuccugcgcaucacccacagcgaggacuggaagcuguggcggugccgccuccggcugaaguccuucacgagcauggacucccgcagcgcgucccaccggagcacccgcuucgccgccaccuucuacgacaucgagacccugaaggucaucgacgaggaguggcagcggacgcagugcuccccgcgcgagaccugcguggagguggccagcgagcucggcaaguccaccaacaccuucuucaagccgcccugcgucaacguguuccggugcgggggcugcugcaacgaggagagccugaucugcaugaacacguccaccagcuacaucagcaagcagcuguucgagaucuccgugccccucaccagcguccccgagcuggugcccgugaaggucgccaaccacaccgggugcaagugccugcccacggcgccccgccacccguacuccaucauccggcgcagcauccagauccccgaggaggaccggugcucccacagcaagaagcucugccccaucgacaugcugugggacuccaacaagugcaagugcgugcugcaggaggagaacccccucgccggcaccgaggaccacagccaccuccaggagccggcccugugcggcccccacaugauguucgacgaggaccgcugcgagugcgugugcaagacccccugccccaaggaccugauccagcacccgaagaacugcuccugcuucgagugcaaggagagccuggagaccugcugccagaagcacaagcuguuccaccccgacacgugcuccugcgaggaccggugccccuuccacacccgccccugcgccagcgggaagaccgcgugcgccaagcacugccgguucccgaaggagaagcgcgccgcccagggcccccacucccgcaagaaccccuga

SEQ ID NO: 30171 - RNA, 660 nt, Artificial Sequence
  derived and/or modified sequence opt1 from FIGLA__Homo_sapiens__NP_001004311
auggaccccgccccgggcgugcuggacccccgcgccgcgccgcccgcccuccuggggaccccgcaggccgagguccuggaggacgugcuccgggagcaguucggcccccugccccagcuggccgccgugugccgccucaagcggcugcccagcgggggcuacuccagcaccgagaaccugcagcucguccuggagcgccggcgcguggcgaacgccaaggagcgggagcgcaucaagaaccugaaccggggguucgcccgccucaaggcccuggugccguuccugccccagucccggaagcccagcaaggucgacauccucaagggcgcgacggaguacauccaggugcuguccgaccugcucgagggcgccaaggacagcaagaagcaggaccccgacgagcaguccuacagcaacaacuccagcgagucccacaccagcuccgcccgccagcugagccggaacaucacccagcacaucuccugcgccuucgggcugaagaacgaggaggagggcccgugggccgacgggggcagcggggagcccgcgcacgccugccgccacuccgugaugagcaccacggagaucaucucccccacccggagccucgaccgcuuccccgaggucgagcugcugagccaccggcucccccagguguga

SEQ ID NO: 30172 - RNA, 2280 nt, Artificial Sequence
  derived and/or modified sequence opt1 from FIGN__Homo_sapiens__NP_060556
augaucagcuccaccagcguguacggccugaagaugcaguggacccccgagcacgcccaguggccggagcagcacuucgacaucacguccaccacccgcagccccgcccacaaggucgaggcguaccgggggcaccuccagcgcaccuaccaguacgccugggccaacgacgacaucuccgcccugacggccagcaaccugcucaagaaguacgcggagaaguacuccggcauccuggaggggcccguggaccggcccgugcugagcaacuacuccgacaccccgagcggccucgucaacgggcgcaagaacgaguccgagcccuggcagcccagccugaacuccgaggccguguaccccaugaacugcgugccggacgucaucaccgccagcaaggccggcguguccagcgcgcugccgcccgccgacguguccgccagcaucggcuccagccccggggucgccagcaaccucaccgagcccuccuacagcuccagcacgugcggcucccacaccgugcccagccugcacgccgggcugcccucccaggaguacgcgcccggcuacaacgggagcuaccuccacuccaccuacagcucccagccggcccccgcccugcccagcccccacccgagcccccugcacuccuccggccuccugcagcccccgcccccgcccccgcccccgcccgcccuggugcccggcuacaacgggaccagcaaccucuccagcuacuccuaccccagcgccagcuacccgccccagacggcggucggcuccggguacagccccggcggcgccccgccgccgcccuccgccuaccugcccagcgggauccccgcccccacgccccugccgcccaccaccgugcccggcuacaccuaccaggggcacggccucacccccaucgcccccuccgcgcugaccaacagcuccgccagcucccugaagcggaaggccuucuacauggccgggcagggcgacauggacagcuccuacggcaacuacagcuacgggcagcagcgcuccacccagagccccauguaccggaugcccgacaacuccaucagcaacacgaaccgcggcaacggguucgaccgguccgccgagaccagcagccucgcguucaagcccaccaagcagcugauguccagcgagcagcagcgcaaguucuccagccaguccagccgggcccugaccccgcccuccuacagcacggccaagaacucccucggcagccgcuccagcgaguccuucgggaaguacaccagccccgugauguccgagcacggcgacgagcaccggcagcugcugagccaccccaugcagggccccgggcuccgcgccgcgaccuccagcaaccacuccgucgacgagcagcugaagaacaccgacacgcaccugaucgaccucgugaccaacgagaucaucacccaggggccgcccguggacuggaacgacaucgccggccuggaccuggucaaggccgugaucaaggaggaggugcucuggcccguccugcggagcgacgccuucagcggccugaccgcccucccccgcuccauccugcuguucgggccccggggcacgggcaagacccuccuggggcgcugcaucgcgagccagcugggcgccaccuucuucaagaucgccggguccggccucguggccaaguggcugggcgaggccgagaagaucauccacgcgagcuuccugguggcccggugccgccagcccuccgucaucuucgugagcgacaucgacaugcuccuguccagccaggucaacgaggagcacucccccgugagccggaugcgcaccgaguuccugaugcagcuggacacggugcucaccuccgccgaggaccagaucgucgugaucugcgccaccagcaagcccgaggagaucgacgagucccugcgccgguacuucaugaagcgccugcucaucccccugccggacagcaccgcccggcaccagaucaucgugcagcugcucucccagcacaacuacugccugaacgacaaggaguucgcgcugcucguccagcgcaccgagggguucagcggccuggacguggcccaccugugccaggaggccguggucgggccccuccacgccaugcccgcgacggaccuguccgccaucaugcccagccagcugcggccggugaccuaccaggacuucgagaacgccuucugcaagauccagcccuccaucagccagaaggagcucgacauguacguggaguggaacaagauguucggcugcagccaguga

SEQ ID NO: 30173 - RNA, 3651 nt, Artificial Sequence
  derived and/or modified sequence opt1 from FILIP1__Homo_sapiens__NP_001276916
auggugggcaugcgcagccggaaccagggcggggaguccgccagcgacgggcacaucuccugccccaagccgagcaucaucggcaacgccggggagaagucccugagcgaggacgcgaagaagaagaagaaguccaaccgcaaggaggacgacgucauggccagcggcaccgugaagcggcaccucaagaccuccggcgagugcgagcgcaagacgaagaagucccuggagcugagcaaggaggaccucauccagcugcugagcaucauggagggggagcuccaggcccgggaggacgugauccacaugcugaagaccgagaagaccaagcccgagguccuggaggcccacuacggcuccgccgagcccgagaaggugcuccgcgugcugcaccgggacgcgauccuggcccaggagaaguccaucggggaggacgucuacgagaagcccaucagcgagcucgaccgccuggaggagaagcagaaggagaccuaccggcgcaugcuggagcagcuccugcuggccgagaagugccaccggcgcacgguguacgagcucgagaacgagaagcacaagcacaccgacuacaugaacaagagcgacgacuucaccaaccugcuggagcaggagcgggagcgccucaagaagcugcuggagcaggagaaggccuaccaggcgcggaaggagaaggagaacgccaagcgccucaacaagcugcgggacgagcuggugaagcucaaguccuucgcccugaugcuggucgacgagcgccagaugcacaucgagcagcucggccugcagagccagaaggugcaggaccugacccagaagcuccgggaggaggaggagaagcugaaggccaucacguccaagagcaaggaggaccgccagaagcugcucaagcuggagguggacuucgagcacaaggccagccgguucucccaggagcacgaggagaugaacgcgaagcuggccaaccaggagagccacaaccgccagcuccgccugaagcuggucgggcucacccagcggaucgaggagcuggaggagaccaacaagaaccugcagaaggccgaggaggagcuccaggagcugcgcgacaagaucgccaagggcgagugcggcaacuccagccugauggccgagguggagaaccuccggaagcgcgugcuggagauggaggggaaggacgaggagaucaccaagacggagucccagugccgggagcugcgcaagaagcugcaggaggaggagcaccacagcaaggagcuccggcuggaggucgagaagcugcagaagcgcauguccgagcucgagaagcuggaggaggcguucagcaaguccaagagcgagugcacccagcugcaccucaaccuggagaaggagaagaaccugaccaaggaccuccugaacgagcuggagguggugaagucccgggucaaggagcucgagugcagcgagucccgccuggagaaggccgagcugagccucaaggacgaccugaccaagcugaaguccuucacggugaugcucguggacgagcggaagaacaugauggagaagaucaagcaggaggagcgcaaggucgacggccugaacaagaacuucaagguggagcaggggaaggugauggacgucaccgagaagcugaucgaggagagcaagaagcuccugaagcugaaguccgagauggaggagaagguguacaaccucacccgggagcgcgacgagcugaucggcaagcucaagagcgaggaggagaaguccagcgagcugagcugcuccgucgaccugcugaagaagcggcucgacggcaucgaggagguggagcgcgagaucacccgggggcgcagccggaagggcuccgagcugacgugcccggaggacaacaagaucaaggagcugacccucgagaucgagcgccugaagaagcgccugcagcagcucgagguggucgagggggaccugaugaagaccgaggacgaguacgaccagcuggagcagaaguuccggaccgagcaggacaaggccaacuuccucagccagcagcuggaggagaucaagcaccagaucgccaagaacaaggccaucgagaagggcgagguggugucccaggaggcggagcugcgccaccgguuccgccucgaggaggccaagagccgggaccugaaggccgagguccaggcccugaaggagaagauccacgagcucaugaacaaggaggaccagcugucccagcuccagguggacuacagcgugcugcagcagcgcuucauggaggaggagaacaagaacaagaacauggggcaggagguccugaaccugacgaaggagcucgagcuguccaagcgguacagccgcgcccugcggcccuccgugaacggccgccggaugguggacguccccgugaccagcaccggcgugcagaccgacgcggucuccggggaggccgccgaggaggagacgcccgccguguucauccgcaagagcuuccaggaggagaaccacaucauguccaaccuccgccaggugggccugaagaagccggucgagcggagcuccgugcuggaccgguacccgcccgcggccaacgagcucaccaugcgcaagagcuggauccccuggaugcggaagcgcgagaacgggcccagcaucacccaggagaagggcccccggaccaacuccagccccgggcaccccggcgaggugguccuguccccgaagcagggccagccccugcacauccgcgugacgcccgaccacgagaacagcaccgccacccucgagaucaccucccccacgagcgaggaguucuucuccagcaccaccgugaucccgacccuggggaaccagaagccccggaucaccaucauccccucccccaacgucaugccgcagaagcagaaguccggcgacacgacccuggggcccgagcgcgccaugagccccgugaccaucaccacguucagccgcgagaagacccccgaguccggccgcggggccuucgcggaccggccgaccagccccauccagaucaugaccguguccacgagcgccgcccccgccgagaucgccgucuccccggagagccaggagaugcccaugggccggaccauccucaaggugacccccgagaagcagaccgugcccacgccgguccgcaaguacaacuccaacgcgaacaucaucaccaccgaggacaacaagauccacauccaccugggcagccaguucaagcggagccccgggaccuccggcgagggggugagccccgugaucacgguccgccccgugaacgugaccgccgagaaggaggucuccaccggcaccgugcugcggagcccgcgcaaccaccucuccagccggcccggcgccuccaaggugacgagcaccaucaccaucacccccgucacgaccuccagcgcccgcgggacccaguccgugagcggccaggacggguccagccagcggcccaccccgacgcgcauccccauguccaagggcaugaaggccgggaagcccguggucgcggcccccggcgccggcaaccugaccaaguucgagccgcgggccgagacccagagcaugaagaucgagcugaagaaguccgcggccagcuccaccacgagccucgggggcgggaagggcuga

SEQ ID NO: 30174 - RNA, 3402 nt, Artificial Sequence
  derived and/or modified sequence opt1 from FILIP1L__Homo_sapiens__NP_001035924
augcgcagccggggcuccgacaccgaggggagcgcccagaagaaguucccccgccacaccaagggccacuccuuccaggggccgaagaacaugaagcaccggcagcaggacaaggacagccccuccgagagcgacgugauccugcccugccccaaggccgagaagccgcacuccggcaacgggcaccaggcggaggaccucagccgcgacgaccugcuguuccuccuguccauccuggagggcgagcuccaggcccgggacgaggucaucggcauccugaaggccgagaagauggaccuggcccuccuggaggcccaguacggguucgugacgcccaagaaggugcuggaggcgcuccagcgcgacgccuuccaggccaagagcacccccuggcaggaggacaucuacgagaagcccaugaacgagcuggacaaggucguggagaagcacaaggaguccuaccggcgcauccugggccagcuccugguggccgagaagucccggcgccagaccauccuggagcucgaggaggagaagcggaagcacaaggaguacauggagaaguccgacgaguucaucugccugcuggagcaggagugcgagcgccucaagaagcugaucgaccaggagaucaagagccaggaggagaaggagcaggagaaggagaagcgggucaccacgcugaaggaggagcucaccaagcucaagagcuucgcgcugauggugguggacgagcagcagcgccugaccgcccagcugacccugcagcggcagaagauccaggagcucacgaccaacgccaaggagacccacaccaagcuggcccuggccgaggcgcgcguccaggaggaggagcagaaggccacgcggcucgagaaggagcugcagacccagaccaccaaguuccaccaggaccaggacacgaucauggccaagcugaccaacgaggacagccagaaccgccagcuccagcagaagcuggccgcccugucccggcagaucgacgagcucgaggagaccaaccgcagccugcggaaggcggaggaggagcugcaggacaucaaggagaagaucuccaagggggaguacggcaacgccgggaucauggccgagguggaggagcuccgcaagcgcgugcuggacauggagggcaaggacgaggagcugaucaagauggaggagcagugccgggaccucaacaagcgccuggagcgggagacccugcagagcaaggacuucaagcucgaggucgagaagcugagcaagcgcaucauggcccuggagaagcuggaggacgccuucaacaaguccaagcaggagugcuacagccucaagugcaaccuggagaaggagcggaugacgaccaagcagcugucccaggagcucgagagccugaaggugcgcaucaaggagcuggaggcgaucgagucccggcucgagaagaccgaguucacccugaaggaggaccugacgaagcucaagacccugaccgugauguucgucgacgagcgcaagaccaugagcgagaagcugaagaagacggaggacaagcuccaggccgccuccagccagcuccagguggagcagaacaaggugaccaccgucaccgagaagcugaucgaggagacgaagcgggcccucaaguccaagaccgacguggaggagaagauguacagcgugaccaaggagcgcgacgaccugaagaacaagcugaaggccgaggaggagaagggcaacgaccuccugucccgggucaacaugcugaagaaccgccuccagagccuggaggcgaucgagaaggacuuccugaagaacaagcucaaccaggacuccggcaagagcaccacggcccugcaccaggagaacaacaagaucaaggagcugucccaggagguggagcggcucaagcugaagcugaaggacaugaaggccaucgaggacgaccucaugaagaccgaggacgaguacgagacccuggagcgccgguacgccaacgagcgcgacaaggcgcaguuccugagcaaggagcucgagcacgugaagauggagcuggccaaguacaagcuggccgagaagaccgagaccucccacgagcaguggcuguucaagcggcugcaggaggaggaggccaagagcgggcaccugucccgcgaggucgacgcccucaaggagaagauccacgaguacauggcgacggaggaccugaucugccaccuccagggggaccacagcgugcugcagaagaagcugaaccagcaggagaaccggaaccgcgaccugggccgcgagaucgagaaccucaccaaggagcuggagcgguaccgccacuucagcaagucccugcggccgagccucaacggccgccggaucuccgacccccaggucuucagcaaggaggugcagaccgaggccguggacaacgagccgcccgacuacaagucccugaucccccuggagcgcgccgucaucaacgggcagcucuacgaggagagcgagaaccaggacgaggaccccaacgacgagggcuccgugcugagcuucaagugcucccagagcacccccugccccgugaaccggaagcuguggaucccguggaugaaguccaaggaggggcaccuccagaacggcaagaugcagacgaagcccaacgccaacuucguccagcccggggaccuggugcugagccacacccccggccagccgcuccacaucaaggugacccccgaccacguccagaacaccgccacgcuggagaucaccucccccaccaccgagagcccccacuccuacacgagcaccgcggugaucccgaacugcggcacccccaagcagcgcaucaccauccugcagaacgccuccaucacgcccgucaagagcaagaccagcaccgaggaccucaugaaccuggagcaggggaugucccccaucaccauggccacguucgcccgggcccagaccccggagagcugcggcucccugacccccgagcgcaccaugagccccauccaggugcucgcggugacgggguccgccagcuccccggagcagggccggagccccgagcccaccgagaucuccgccaagcacgccaucuuccgcgugagccccgaccggcaguccagcuggcaguuccagcgcuccaacagcaacuccagcuccgucaucaccaccgaggacaacaagauccacauccaccuggggagcccguacaugcaggcgguggccucccccgugcggcccgccagccccagcgccccgcugcaggacaaccgcacgcagggccucaucaacggcgcccugaacaagaccaccaacaaggucaccuccagcaucacgaucacccccaccgcgacgccccugccccggcagucccagaucaccgugagcaacaucuacaacuga

SEQ ID NO: 30175 - RNA, 1767 nt, Artificial Sequence
  derived and/or modified sequence opt1 from FIP1L1__Homo_sapiens__NP_001128409
augagcgccggcgagguggagcgccuggucuccgagcucagcgggggcaccgggggcgacgaggaggaggaguggcuguacggggacgagaacgagguggagcggcccgaggaggagaacgccuccgcgaacccgcccagcggcaucgaggacgagaccgccgagaacggcgugcccaagcccaaggucacggagaccgaggacgacuccgacagcgacuccgacgacgacgaggacgacgugcacgugaccaucggggacaucaagaccggcgccccgcaguacgggagcuacggcacggcccccgucaaccugaacaucaagaccgggggccgcguguacggcaccaccgggacgaaggugaagggcgucgaccucgacgcccccggguccaucaacggcgugccccugcuggagguggaccucgacagcuucgaggacaagccguggcggaagcccggcgcggaccuguccgacuacuucaacuacggguucaacgaggacaccuggaaggccuacugcgagaagcagaagcgcauccggaugggccuggaggucauccccgugaccagcaccacgaacaagaucaccgccgaggacugcaccauggaggugacccccggggccgagauccaggacggccgcuucaaccucuucaagguccagcaggggcggacgggcaacuccgagaaggagaccgcgcugccgagcaccaaggccgaguucaccuccccccccagccuguucaagacgggccuccccccgucccgcaacagcaccuccagccagagccagaccuccaccgccagccggaaggccaacuccagcguggggaaguggcaggaccgcuacggccgggccgagucccccgaccugcgccggcugcccggggcgaucgacgugaucggccagacgaucaccaucagccgcgucgaggggcggcgccgggccaacgagaacuccaacauccaggugcucagcgagcgcuccgccaccgagguggacaacaacuucagcaagcccccgcccuucuucccccccggcgccccgcccacccaccugccccccccgcccuuccugcccccgccccccacggucuccaccgcccccccgcucauccccccccccggcaucccgaucaccgugcccccccccggguucccgcccccccccggcgcgccgccccccagccugauccccaccaucgaguccgggcacagcuccggcuacgacagccgguccgcccgcgccuucccguacgggaacguggccuucccccaccugcccggcagcgcccccuccuggccgagccucgucgacacgagcaagcagugggacuacuacgcgcggcgcgagaaggaccgcgaccgggagcgcgaccgggaccgcgagcgggaccgcgaccgggaccgcgagcgggagcgcacccgggagcgcgagcgggagcgcgaccacucccccacccccagcguguucaacuccgacgaggagcgguaccgcuaccgggaguacgccgagcgcggcuacgagcggcaccgcgccagccgcgagaaggaggagcggcaccgcgagcggcgccaccgggagaaggaggagacccgccacaaguccagccgguccaacagccgccggcgccacgaguccgaggagggggacagccaccggcgccacaagcacaagaaguccaagcggagcaaggagggcaaggaggccggguccgagccggcccccgagcaggagagcacggaggcgacccccgccgaguga

SEQ ID NO: 30176 - RNA, 459 nt, Artificial Sequence
  derived and/or modified sequence opt1 from FIS1__Homo_sapiens__NP_057152
auggaggccgugcugaacgagcucgucagcguggaggaccugcugaaguucgagaagaaguuccaguccgagaaggccgcgggcagcguguccaagagcacccaguucgaguacgccuggugccucguccgcuccaaguacaacgacgacauccggaaggggaucgugcugcuggaggagcuccugcccaagggcagcaaggaggagcagcgcgacuacguguucuaccuggccgucgggaacuaccggcucaaggaguacgagaaggcccugaaguacgugcgcggccugcuccagaccgagccgcagaacaaccaggccaaggagcuggagcggcugaucgacaaggcgaugaagaaggacgggcucgugggcauggccaucgucggcgggauggcccugggcguggccgggcuggcgggccucaucgggcuggccguguccaagagcaaguccuga

SEQ ID NO: 30177 - RNA, 879 nt, Artificial Sequence
  derived and/or modified sequence opt1 from FITM1__Homo_sapiens__NP_981947
auggagcgcggccccguggucggggccggccugggggccggcgcgcggauccaggcccuccuggggugccugcucaaggugcugcuguggguggccagcgcccuccuguacuucggcuccgagcaggccgcgcgccugcucggcagcccgugccugcggcgccuguaccacgccuggcucgccgccgucgugaucuucgggccccugcugcaguuccacgugaacccccggaccaucuucgcgucccacggcaacuucuucaacaucaaguucgucaacagcgccuggggguggaccugcacguuccucggcggguucgugcugcugguggucuuccucgccacccgccggguggccgugaccgcccgccaccugucccggcuggucgugggcgcggccguguggcgcggcgccgggcgggccuuccuccugaucgaggaccugaccggcagcugcuucgagccccucccgcaggggcugcugcuccacgagcugcccgaccgccgguccugccuggccgcgggccaccaguggcgcggcuacacggucagcucccacaccuuccuccugaccuucugcugccugcucauggccgaggaggccgccguguucgccaaguaccuggcgcacgggcugcccgccggcgcgccccuccggcugguguuccugcucaacguccugcugcucgggcuguggaacuuccugcuccugugcaccgugaucuacuuccaccaguacacgcacaagguggucggcgccgccguggggaccuucgccugguaccugaccuacggcagcugguaccaccagccguggucccccggcagccccgggcacggccucuucccccgcccgcacuccagccggaagcacaacuga

SEQ ID NO: 30178 - RNA, 789 nt, Artificial Sequence
  derived and/or modified sequence opt1 from FITM2__Homo_sapiens__NP_001073941
auggagcaccuggagcgcugcgaguggcuccugcggggcacccuggugcgcgccgccguccggcgcuaccuccccugggcgcugguggccagcaugcuggccgggucccuccugaaggagcugagcccccuccccgaguccuaccugagcaacaagcggaacgugcugaacgucuacuucgugaagguggccugggccuggaccuucugccuccugcugcccuucaucgcgcucacgaacuaccaccugaccggcaaggccgggcugguccuccgccggcuguccacccugcucgugggcaccgccaucugguacaucugcacgagcaucuucuccaacaucgagcacuacaccgggagcugcuaccagucccccgcccuggagggcgugcgcaaggagcaccagagcaagcagcagugccaccaggagggcggguucuggcacggcuucgacaucuccgggcacagcuuccugcucaccuucugcgcgcugaugaucgucgaggagauguccgugcugcacgaggugaagaccgaccggagccacugccuccacacggccaucaccacccuggucguggcccugggcauccucaccuucaucugggugcugauguuccugugcacggccgucuacuuccacaaccucucccagaagguguucgggacccuguucggccugcucagcugguacggcaccuacggguucugguacccgaaggccuucucccccggccugccgccccagagcugcucccugaaccucaagcaggacagcuacaagaaguga

SEQ ID NO: 30179 - RNA, 1314 nt, Artificial Sequence
  derived and/or modified sequence opt1 from FJX1__Homo_sapiens__NP_055159
augggccgccggaugcgcggggccgccgcgaccgccggccuguggcuccuggcccuggggagccuccuggcccuguggggcgggcuccugcccccgcggaccgagcugcccgccucccgcccgcccgaggaccggcucccccgccggcccgcgcgcagcggcggccccgcccccgccccgcgguucccccugcccccgccccuggccugggacgcgcgcgggggcucccucaagacguuccgggcccugcugacccucgccgccggggccgacggcccgccccgccagagccgguccgagccccgcuggcacgugagcgcgcggcagccccgccccgaggaguccgccgccguccacgggggcguguucuggagccggggccuggaggagcaggucccgcccggguucuccgaggcccaggccgcggccuggcuggaggccgcccgcggcgcccggaugguggcgcucgagcgcgggggcugcggccggagcuccaaccgccuggcccgcuucgccgacgggacccgggccugcgugcgcuacggcaucaaccccgagcagauccagggggaggcccugagcuacuaccucgcgcggcugcugggccuccagcgccacgugccgccccuggcccuggcccgggucgaggcccgcggggcgcagugggcccaggugcaggaggagcuccgggccgcccacuggaccgagggcuccguggucagccugacgcgcuggcugcccaaccucaccgacguggugguccccgcccccuggcgguccgaggacggccgccugcggccccugcgcgacgccgggggcgagcucgcgaaccugagccaggccgagcugguggaccucgugcaguggaccgaccugauccuguucgacuaccucaccgccaacuucgaccggcuggucuccaaccuguucagccuccagugggacccccgcgugaugcagcgggccacguccaaccugcaccgcgggccgggcggggcgcugguguuccucgacaacgaggccggccugguccacggcuaccggguggccgggaugugggacaaguacaacgagccccugcuccagagcgugugcgucuuccgcgagcggaccgcccgccgcgugcuggagcugcaccggggccaggacgccgcggcccgccugcuccggcuguaccgccggcacgagccccgcuucccggagcuggccgcccucgcggacccccacgcccagcugcugcagcggcgccucgacuuccuggccaagcacauccugcacugcaaggccaaguacgggcggcgcagcggcaccuga

SEQ ID NO: 30180 - RNA, 1749 nt, Artificial Sequence
  derived and/or modified sequence opt1 from FKBP10__Homo_sapiens__NP_068758
auguuccccgccggcccgcccagccacucccugcuccgccugccccugcuccagcugcugcuccuggugguccaggccguggggcggggccuggggcgcgcgagccccgccggcgggccgcucgaggacguggucaucgagcgguaccacaucccccgcgccugcccccgggaggugcagaugggcgacuucgugcgcuaccacuacaacggcaccuucgaggacgggaagaaguucgacuccagcuacgaccggaacacccuggucgccaucguggugggcgucgggcgccugaucacgggcauggaccgggggcucaugggcaugugcgugaacgagcgccggcgccugaucgugcccccgcaccugggcuacggguccaucggccucgccgggcugaucccccccgacgcgacccuguacuucgacgucgugcuccuggacguguggaacaaggaggacaccguccaggugagcacccugcuccggcccccgcacugcccccgcauggugcaggacggcgacuucguccgguaccacuacaacggcacgcugcuggacgggaccuccuucgacaccagcuacuccaagggcgggaccuacgacacguacgugggcagcggguggcucaucaagggcauggaccagggccugcuggggaugugccccggcgagcgccggaagaucaucauccccccguuccucgccuacggggagaagggcuacgggaccgugauccccccccaggccucccuggucuuccacgugcugcucaucgacgugcacaaccccaaggacgccguccagcuggagacccuggagcucccgcccggcugcgugcgccgggcgggcgccggggacuucaugcgcuaccacuacaacggcagccugauggacgggacccuguucgacuccagcuacucccggaaccacacguacaacaccuacaucggccagggguacaucauccccggcauggaccagggccuccagggggccugcaugggcgagcgccgccggaucaccauccccccgcaccuggccuacggggagaacggcaccggcgacaagauccccgggagcgccguccugaucuucaacgugcacgugaucgacuuccacaaccccgcggacgucguggagauccgcacgcucucccggcccagcgagaccugcaacgagaccaccaagcugggcgacuucgugcgcuaccacuacaacugcucccugcucgacgggacgcagcuguucaccagccacgacuacggcgccccgcaggaggccacccugggggccaacaaggucaucgagggccucgacaccggccugcaggggaugugcgugggcgagcggcgccagcugaucgugcccccccaccucgcccacggggagagcggcgcgcggggggucccgggcuccgccgugcugcuguucgagguggagcuggucagccgcgaggacggccuccccacgggguaccuguucguguggcacaaggacccccccgccaaccuguucgaggacauggaccucaacaaggacggcgaggugccgcccgaggaguucuccaccuucaucaaggcccaggucagcgaggggaagggccggcugaugcccgggcaggaccccgagaagaccaucggcgacauguuccagaaccaggaccgcaaccaggacggcaagaucaccguggacgagcugaagcucaaguccgacgaggacgaggagcgggugcacgaggagcuguga

SEQ ID NO: 30181 - RNA, 300 nt, Artificial Sequence
  derived and/or modified sequence opt1 from FKBP11__Homo_sapiens__NP_001137253
augugcgugggcgagaagcgccgggccaucauccccagccaccuggccuacgggaagcgcggcuucccgcccuccguccccgcggacgccguggugcaguacgacgucgagcucaucgcccugauccgggccaacuacuggcugaagcucgugaaggggauccugccccuggugggcauggccauggucccggcgcuccuggggcugaucggcuaccaccucuaccgcaaggccaaccggcccaaggugagcaagaagaagcugaaggaggagaagcgcaacaaguccaagaagaaguga

SEQ ID NO: 30182 - RNA, 636 nt, Artificial Sequence
  derived and/or modified sequence opt1 from FKBP14__Homo_sapiens__NP_060416
augcgccuguuccucuggaacgccgugcugacccuguucgucaccagccucaucggcgcccugauccccgagcccgaggugaagaucgaggugcugcagaagcccuucaucugccaccggaagacgaagggcggggaccucaugcugguccacuacgagggguaccuggagaaggacggcucccucuuccacagcacccacaagcacaacaacgggcagcccaucugguucacccugggcauccuggaggcgcucaagggcugggaccaggggcugaagggcaugugcgugggggagaagcgcaagcugaucaucccgcccgcccucggcuacgggaaggagggcaagggcaagaucccgcccgaguccacccugaucuucaacaucgaccugcucgagauccggaacgggccccgcagccacgaguccuuccaggagauggaccugaacgacgacuggaagcugagcaaggacgaggugaaggccuaccucaagaaggaguucgagaagcacggcgccgucgugaacgagucccaccacgacgcccugguggaggacaucuucgacaaggaggacgaggacaaggacggguucaucagcgcgcgggaguucacguacaagcacgacgagcuguga

SEQ ID NO: 30183 - RNA, 3660 nt, Artificial Sequence
  derived and/or modified sequence opt1 from FKBP15__Homo_sapiens__NP_056073
auguucggcgccggggacgaggacgacaccgacuuccugagccccuccggcggggcccgccucgcgagccuguucggccuggaccaggccgccgccgggcacggcaacgaguucuuccaguacaccgccccgaagcagcccaagaagggccaggggacggcggccaccggcaaccaggccacccccaagaccgcccccgcgacgauguccaccccgaccauccucguggccaccgccguccacgccuaccgguacacgaacgggcaguacgugaagcagggcaaguucggggccgcggugcugggcaaccacaccgcccgcgaguaccggauccugcucuacaucagccagcagcagcccgucaccguggcccgcauccacgugaacuucgagcugaugguccggcccaacaacuacuccaccuucuacgacgaccagcgccagaacuggagcaucauguucgaguccgagaaggccgccguggaguucaacaagcaggugugcaucgcgaagugcaacagcacguccagccuggacgccguccucucccaggaccugaucguggccgacggccccgccguggaggucggggacagccuggagguggccuacaccggcuggcucuuccagaaccacgugcuggggcaggucuucgacuccaccgcgaacaaggacaagcugcuccggcugaagcugggcagcggcaaggugaucaaggggugggaggacggcaugcucgggaugaagaagggcgggaagcgccugcugaucgugccgcccgccugcgccgucggcuccgagggcgugaucggguggacccaggccacggacagcauccucguguucgaggucgaggugcggcgcgugaaguucgcccgggacuccggcagcgacgggcacuccgucagcagccgcgacuccgcggcccccagccccaucccgggcgccgacaaccuguccgccgaccccguggucagcccccccaccuccaucccguucaagagcggggagcccgcgcugcggaccaaguccaacagccucuccgagcagcuggccaucaacaccagccccgacgccgugaaggccaagcugaucucccgcauggccaagaugggccagcccaugcucccgauccugcccccccagcuggacagcaacgacuccgagaucgaggacgugaacacgcuccagggcgggggccagcccgucgugaccccgagcgugcagcccucccugcaccccgcgcaccccgcccugccgcagaugaccagccaggccccccagcccuccgucaccgggcuccaggccccgagcgccgcgcugaugcagguguccagccuggacagccacuccgccgugagcggcaacgcccaguccuuccagcccuacgccgggaugcaggccuacgcguacccccaggccagcgccgucacgucccagcuccagcccgugcggccgcuguaccccgccccccugagccagcccccgcacuuccagggcuccggcgacauggcgagcuuccucaugaccgaggcccgccagcacaacaccgagauccggauggccguguccaaggucgccgacaagauggaccaccugaugaccaagguggaggagcugcagaagcacagcgccgggaacuccaugcucauccccagcauguccgugacgauggagaccagcaugaucauguccaacauccagcgcaucauccaggagaacgagcggcugaagcaggagauccuggagaagagcaaccgcaucgaggagcagaacgacaagaucuccgagcucaucgagcggaaccagcgcuacgucgagcagagcaaccugaugauggagaagcgcaacaacagccugcagaccgcgaccgagaacacgcaggcccgggugcuccacgccgagcaggagaaggccaaggugaccgaggagcuggccgcggccaccgcccaggucucccaccugcagcugaagaugaccgcccaccagaagaaggagacggagcuccagaugcagcugaccgagagccugaaggagaccgaccuccugcgcggccagcugaccaaggugcaggccaagcucuccgagcugcaggagaccagcgagcaggcgcaguccaaguucaagagcgagaagcagaaccggaagcagcuggagcucaaggugacgucccuggaggaggagcugaccgaccuccgcgucgagaaggagagccuggagaagaaccuguccgagcggaagaagaagagcgcccaggagcgcucccaggccgaggaggagaucgacgagauccggaagagcuaccaggaggagcucgacaagcugcgccagcugcucaagaagacccggguguccaccgaccaggccgcggccgagcagcugagccuggugcaggccgagcuccagacgcagugggaggccaagugcgagcaccugcuggccuccgcgaaggacgagcaccuccagcaguaccaggaggucugcgcccagcgcgacgccuaccagcagaagcuggugcagcugcaggagaagugccucgcccugcaggcccagaucaccgcgcugaccaagcagaacgagcagcacaucaaggagcucgagaagaacaagagccagauguccgggguggaggccgccgccagcgaccccuccgagaaggucaagaagaucaugaaccagguguuccagagccugcggcgcgaguucgagcuggaggagagcuacaacggccggaccauccucggcacgaucaugaacaccaucaagauggugacccugcagcugcucaaccagcaggagcaggagaaggaggaguccagcuccgaggaggaggaggagaaggccgaggagcgcccccggcgcccgagccaggagcaguccgcgagcgccuccagcgggcagccccaggccccccugaaccgggagcgccccgaguccccgaugguccccagcgagcaggugguggaggaggccgucccccugcccccgcaggcccucaccacgucccaggacggccaccggcgcaagggggacagcgaggcggaggcccuguccgagaucaaggacggcagccugccccccgagcucuccugcauccccagccaccgcgugcuggggccgcccaccuccauccccccggagccccugggccccgugagcauggacuccgagugcgaggagagccucgccgccagccccauggcggccaagccggacaaccccuccggcaaggucugcgugcgggagguggcccccgacgggccccugcaggagagcuccacccgccugagccucaccuccgacccggaggagggcgacccccuggcccuggggcccgagagccccggcgagccgcagcccccccagcucaagaaggacgacgucacguccagcaccgggccccacaaggagcuguccagcaccgaggccggcuccaccguggcgggcgccgcccugcggccgagccaccacucccagcgcagcucccucagcggggacgaggaggacgagcuguucaagggcgccacgcugaaggcccuccggcccaaggcgcagcccgaggaggaggacgaggacgagguguccaugaaggggcgccccccgcccaccccccuguucggcgacgacgacgacgacgacgacaucgacuggcugggguga

SEQ ID NO: 30184 - RNA, 327 nt, Artificial Sequence
  derived and/or modified sequence opt1 from FKBP1A__Homo_sapiens__NP_000792
augggcgugcaggucgagaccaucagccccggggacggccgcaccuucccgaagcgggggcagacgugcguggugcacuacaccggcaugcuggaggacgggaagaaguucgacuccagccgcgaccggaacaagcccuucaaguucaugcucggcaagcaggaggucauccgcggcugggaggaggggguggcccagauguccgugggccagcgggccaagcugaccaucagccccgacuacgcguacggggccaccggccaccccgggaucaucccgccccacgccacgcuggucuucgacguggagcuccugaagcuggaguga

SEQ ID NO: 30185 - RNA, 327 nt, Artificial Sequence
  derived and/or modified sequence opt1 from FKBP1B__Homo_sapiens__NP_004107
augggcguggagaucgagaccaucagccccggggacggccgcaccuucccgaagaaggggcagacgugcgucgugcacuacaccggcaugcugcagaacgggaagaaguucgacuccagccgggaccgcaacaagcccuucaaguuccggaucggcaagcaggaggugaucaagggcuucgaggagggggccgcccagaugucccucggccagcgcgcgaagcugaccugcacccccgacgucgccuacggggccacgggccaccccggggugaucccgcccaacgccacccugaucuucgacguggagcuccugaaccuggaguga

SEQ ID NO: 30186 - RNA, 429 nt, Artificial Sequence
  derived and/or modified sequence opt1 from FKBP2__Homo_sapiens__NP_004461
augcgccugagcugguuccgggugcucaccguccuguccaucugccugagcgccguggccaccgccacgggcgccgaggggaagcgcaagcuccagaucggcgugaagaagcgggucgaccacugccccaucaagucccgcaagggggacgugcugcacaugcacuacaccggcaagcuggaggacgggaccgaguucgacagcucccucccgcagaaccagcccuucguguucagccugggcaccggccaggucaucaaggggugggaccagggccugcucgggaugugcgagggcgagaagcggaagcuggugauccccuccgagcugggguacggcgagcgcggcgcgcccccgaagauccccgggggcgccacgcucguguucgaggucgagcugcugaagaucgagcggcgcaccgagcucuga

SEQ ID NO: 30187 - RNA, 675 nt, Artificial Sequence
  derived and/or modified sequence opt1 from FKBP3__Homo_sapiens__NP_002004
auggccgccgcggugccccagcgcgccuggaccgucgagcagcugcggagcgagcagcucccgaagaaggacaucaucaaguuccugcaggagcacggcuccgacagcuuccuggccgagcacaagcuccuggggaacaucaagaacguggccaagaccgccaacaaggaccaccuggugacggcguacaaccaccucuucgagaccaagcgcuucaagggcaccgaguccaucagcaaggucuccgagcaggucaagaacgugaagcugaacgaggacaagcccaaggagaccaagagcgaggagacgcuggacgaggggccgcccaaguacaccaaguccgugcucaagaagggcgacaagaccaacuuccccaagaagggggacguggugcacugcugguacaccggcacgcugcaggacggcaccgucuucgacaccaacauccagaccagcgccaagaagaagaagaacgccaagccccuguccuucaaggugggggugggcaaggucauccgggggugggacgaggcccuccugacgaugagcaagggcgagaaggcgcgccuggagaucgagcccgagugggccuacgggaagaagggccagcccgacgccaagaucccgcccaacgccaagcucaccuucgagguggagcugguggacaucgacuga

SEQ ID NO: 30188 - RNA, 1380 nt, Artificial Sequence
  derived and/or modified sequence opt1 from FKBP4__Homo_sapiens__NP_002005
augaccgccgaggagaugaaggccaccgagagcggcgcgcaguccgcgccccugccgauggaggggguggacaucagccccaagcaggacgagggcguccucaaggugaucaagcgcgaggggacgggcaccgagaugcccaugaucggggaccggguguucguccacuacaccggcuggcugcuggacggcaccaaguucgacuccagccucgaccgcaaggacaaguucuccuucgaccuggggaagggcgaggugaucaaggccugggacaucgccaucgccacgaugaaggugggggaggucugccacaucacgugcaagcccgaguacgccuacggcagcgccggguccccgcccaagaucccgcccaacgccacccugguguucgagguggagcuguucgaguucaagggcgaggaccucaccgaggaggaggacggcgggaucauccggcgcauccagacccggggcgagggguacgccaagcccaacgagggcgcgaucgucgagguggcccuggagggcuacuacaaggacaagcuguucgaccagcgcgagcuccgguucgagaucggggagggcgagaaccuggaccuccccuacgggcuggagcgcgccauccagcggauggagaagggcgagcacagcaucguguaccugaagcccuccuacgccuucgggagcgucggcaaggagaaguuccagaucccgcccaacgccgagcucaaguacgagcugcaccugaaguccuucgagaaggcgaaggagagcugggagaugaacuccgaggagaagcucgagcagagcaccaucgugaaggagcgcggcaccguguacuucaaggaggggaaguacaagcaggcccugcugcaguacaagaagaucgucuccuggcucgaguacgagagcuccuucagcaacgaggaggcccagaaggcccaggcccugcggcuggcgucccaccucaaccuggccaugugccaccugaagcuccaggccuucagcgccgccaucgagagcugcaacaaggcgcuggagcuggacuccaacaacgagaagggccucuuccgccgcggggaggcccaccuggccgugaacgacuucgagcuggcccgggccgacuuccagaaggugcuccagcuguaccccaacaacaaggcggccaagacccagcuggccgucugccagcagcggauccgccggcagcucgcccgcgagaagaagcuguacgcgaacauguucgagcggcuggccgaggaggagaacaaggccaaggccgaggccagcuccggcgaccaccccacggacaccgagaugaaggaggagcagaaguccaacaccgcggggagccagagccagguggagaccgaggccuga

SEQ ID NO: 30189 - RNA, 1374 nt, Artificial Sequence
  derived and/or modified sequence opt1 from FKBP5__Homo_sapiens__NP_001139247
augaccaccgacgagggcgccaagaacaacgaggagagccccacggccaccguggcggagcagggggaggacaucaccuccaagaaggaccgcggcguccugaagaucgugaagcggguggggaacggcgaggagaccccgaugaucggggacaaggucuacgugcacuacaagggcaagcucagcaacggcaagaaguucgacuccagccacgaccgcaacgagcccuucguguucucccuggggaagggccaggucaucaaggccugggacaucgggguggccacgaugaagaagggcgagaucugccaccuccugugcaagcccgaguacgccuacgggagcgccggcucccugcccaagaucccgagcaacgcgacccuguucuucgagaucgagcuccuggacuucaagggcgaggaccuguucgaggacgggggcaucauccggcgcaccaagcggaagggggagggcuacuccaaccccaacgagggcgccaccguggagauccaccucgaggggcgcugcggcgggcggauguucgacugccgcgacgucgccuucacggugggcgagggggaggaccacgacauccccaucggcaucgacaaggcccuggagaagaugcagcgggaggagcagugcauccuguaccucggcccccgcuacggguucggcgaggcggggaagccgaaguucggcaucgagcccaacgccgagcugaucuacgaggugacccucaagagcuucgagaaggccaaggaguccugggagauggacaccaaggagaagcuggagcaggccgccaucgucaaggagaaggggaccguguacuucaagggcggcaaguacaugcaggcggugauccaguacgggaagaucgucagcuggcuggagauggaguacggccuguccgagaaggagagcaaggccuccgagagcuuccuccuggccgccuuccugaaccucgccaugugcuaccugaagcugcgggaguacacgaaggcgguggagugcugcgacaaggcccucgggcuggacuccgccaacgagaagggccuguaccgccgcggggaggcccagcuccugaugaacgaguucgagagcgccaagggcgacuucgagaaggugcuggaggucaacccccagaacaaggcggcccggcuccagaucuccaugugccagaagaaggccaaggagcacaacgagcgggaccgccggaucuacgccaacauguucaagaaguucgccgagcaggacgcgaaggaggaggccaacaaggccaugggcaagaagaccagcgagggggugaccaacgagaagggcaccgacagccaggccauggaggaggagaagcccgaggggcacguguga

SEQ ID NO: 30190 - RNA, 969 nt, Artificial Sequence
  derived and/or modified sequence opt1 from FKBP6__Homo_sapiens__NP_001128683
augagcgccuccagcuggccccagaacggcaugccgcccuccagccuguacgagcgccucucccagcggaugcuggacaucagcggggaccgcggcgugcugaaggacgucauccgggagggggccggcgaccucguggcgcccgacgccuccgugcuggucaaguacagcggguaccuggagcacauggaccgccccuucgacuccaacuacuuccggaagaccccgcgccucaugaagcugggcgaggacaucacccuguggggcauggagcucgggcugcugagcaugcggcgcggcgagcucgcccgguuccuguucaagcccaacuacgccuacgggacgcugggcugcccgccccucaucccgcccaacaccaccgugcuguucgagaucgagcugcucgacuuccuggacugcgccgaguccgacaaguucugcgcgcugagcgccgagcagcaggaccaguucccccuccagaaggugcugaaggucgccgccaccgagcgcgaguucgggaacuaccuguuccggcagaaccgcuucuacgacgcgaaggugcgguacaagcgcgcccuccugcugcuccggcgccgguccgccccgcccgaggagcagcaccugguggaggccgccaagcugcccguccuccugaaccugagcuucacguaccucaagcuggaccgccccaccaucgcgcugugcuacggcgagcaggcccucaucaucgaccagaagaacgccaaggcccuguuccggugcggccaggccugccugcuccugaccgaguaccagaaggcgcgcgacuuccuggugcgggcccagaaggagcagcccuucaaccacgacaucaacaacgagcucaagaagcuggccuccugcuaccgcgacuacguggacaaggagaaggagauguggcaccgcauguucgcccccugcggggacggcagcaccgccggggaguccuga

SEQ ID NO: 30191 - RNA, 666 nt, Artificial Sequence
  derived and/or modified sequence opt1 from FKBP7__Homo_sapiens__NP_001128684
augcccaagaccaugcacuuccuguuccgcuucaucguguucuucuaccucuggggccuguucaccgcccagcggcagaagaaggaggagagcacggaggaggucaagaucgaggugcugcaccgcccggagaacugcuccaagaccagcaagaagggggaccuccugaacgcccacuacgacggcuaccuggcgaaggacggguccaaguucuacugcagccggacccagaacgagggccaccccaagugguucgugcucggggucggccaggugaucaagggccuggacaucgccaugaccgacaugugccccggggagaagcgcaagguggucaucccgcccuccuucgccuacggcaaggagggguacgagggcaagaucccgcccgacgccacgcugaucuucgagaucgagcucuacgccgugaccaaggggccccggagcaucgagaccuucaagcagaucgacauggacaacgaccgccagcuguccaaggcggagaucaaccuguaccuccagcgggaguucgagaaggacgagaagccccgcgacaagagcuaccaggacgccgugcuggaggacaucuucaagaagaacgaccacgacggcgacggcuucaucucccccaaggaguacaacgucuaccagcacgacgagcuguga

SEQ ID NO: 30192 - RNA, 1242 nt, Artificial Sequence
  derived and/or modified sequence opt1 from FKBP8__Homo_sapiens__NP_036313
auggccagcugcgccgagcccuccgagccgagcgcgccccugcccgccggcgugcccccgcucgaggacuucgagguccuggacgggguggaggacgccgagggcgaggaggaggaggaggaggaggaggaggaggaggacgaccuguccgagcucccgccccuggaggacauggggcagccgcccgccgaggaggccgagcagcccggcgcgcuggcccgcgaguuccucgccgccauggagcccgagcccgcgcccgcccccgcccccgaggaguggcuggacauccuggggaacggccuccugcggaagaagacccuggugcccggcccgcccgggagcucccgccccgucaagggccagguggugaccguccaccuccagacgagccuggagaacgggacccgggugcaggaggagcccgagcugguguucacccucggcgacugcgacgucauccaggcccuggaccuguccgugccgcucauggacgugggggagaccgccauggucacggcggacagcaaguacugcuacggcccccagggcucccgcagccccuacaucccgccccacgccgcccugugccuggaggugacccucaagaccgccguggacgggcccgaccuggagaugcugaccggccaggagcgggucgcccucgcgaaccgcaagcgggagugcgggaacgcccacuaccagcgcgccgacuucgugcuggccgccaacuccuacgaccuggcgaucaaggccaucacgagcuccgccaagguggacaugaccuucgaggaggaggcccagcuccugcagcugaaggucaagugccucaacaaccuggccgcgagccagcugaagcucgaccacuaccgggccgcccugcgcuccugcagccuggugcucgagcaccagcccgacaacaucaaggcccuguuccggaagggcaaggugcuggcgcagcagggcgaguacuccgaggccauccccauccuccgcgccgcccugaagcuggagccgagcaacaagaccauccacgccgagcucuccaagcuggucaagaagcacgcggcccagcggagcaccgagacggcccuguaccgcaagaugcucgggaaccccagccggcugcccgccaagugcccgggcaagggggccugguccauccccuggaaguggcuguucggcgcgaccgccguggcccucgggggcguggcccugagcgucgugaucgccgcgcgcaacuga

SEQ ID NO: 30193 - RNA, 1872 nt, Artificial Sequence
  derived and/or modified sequence opt1 from FKBP9__Homo_sapiens__NP_001271270
auggccuuccgcggcuggcggcccccgcccccgccccugcuccugcugcuccugugggugaccgggcaggccgcgcccgucgccggccuggggagcgacgccgagcuccagaucgagcgccgguucgugcccgacgagugcccccgcaccgugcgguccggcgacuucguccgcuaccacuacguggggacguuccccgacggccagaaguucgacagccgguacugggacaccgccgaggacaaggccgacaaguccccgugcccccaggugcgcgucggcgugaacaccagccccuccugccggcugaagcagaagggggugggcaucuacuggaaggaccugcaguuccucguccgcgugcagaaccacgggcugagcuacgaccgggacuccaccuucaacguguucgucggcaaggggcagcugaucacgggcauggaccaggcgcucgugggcaugugcgugaacgagcgccgguucgucaagaucccgcccaagcuggccuacgggaacgagggcgugagcggggugaucccgcccaacuccguccugcacuucgacgugcuccugauggacaucuggaacagcgaggaccaggugcagauccacaccuacuucaagccgcccuccugcccccgcaccauccaggucagcgacuucgugcgguaccacuacaacggcaccuuccuggacggcacccucuucgacuccagccacaaccgcaugaagacguacgacaccuacguggggaucggcuggcugauccccgggauggacaagggccugcucgggaugugcgucggcgagaagcggaucaucaccaucccgcccuuccuggccuacggcgaggacggggacggcaaggacauccccgggcaggccucccugguguucgacgucgcgcuccuggaccugcacaaccccaaggacagcaucuccaucgagaacaagguggugcccgagaacugcgagcgcaucagccaguccggcgacuuccuccgguaccacuacaacgggacgcugcuggacggcacccucuucgacagcagcuacucccgcaaccggaccuucgacaccuacaucggccagggguacgucauccccggcauggacgaggggcugcugggcgugugcaucggggagaagcgccgcaucguggucccgccccaccucggcuacggcgaggaggggcggggcaacauccccgggagcgccgugcugguguucgacauccacgucaucgacuuccacaaccccuccgacagcaucuccaucacgagccacuacaagccgcccgacugcuccgugcugagcaagaagggcgacuaccucaaguaccacuacaacgccucccugcuggacggcacccuccuggacagcaccuggaaccuggggaagaccuacaacaucgugcucggcuccgggcaggucgugcugggcauggacauggggcugcgcgagaugugcgugggcgagaagcggacggucaucaucccgccccaccucggcuacggggaggccggcguggacggggaggugcccggcagcgccguccugguguucgacaucgagcugcucgagcugguggcggggcugcccgagggcuacauguucaucuggaacggcgaggucucccccaaccuguucgaggagaucgacaaggacgggaacggcgaggugcuccuggaggaguucagcgaguacauccacgcccagguggccuccgggaagggcaagcuggcccccggguucgacgccgagcucaucgucaagaacauguucaccaaccaggaccgcaacggcgacggcaaggugaccgcggaggaguucaagcugaaggaccaggaggccaagcacgacgagcuguga

SEQ ID NO: 30194 - RNA, 1050 nt, Artificial Sequence
  derived and/or modified sequence opt1 from FKBPL__Homo_sapiens__NP_071393
auggagacgcccccggugaacaccaucggcgagaaggacaccagccagccccagcaggagugggagaagaaccugcgcgagaaccucgacuccgucauccagauccggcagcagccccgcgacccgcccaccgagacccuggagcuggaggugagccccgaccccgccucccagauccucgagcacacccagggggccgagaagcugguggcggagcuggagggcgacagccacaagucccacgggagcacgucccagaugcccgaggcccuccaggccagcgaccugugguacugcccggacggcuccuucgucaagaagaucgugauccgggggcacggccuggacaagcccaagcucggcagcugcugccgcgugcuggcccugggguuccccuucggcuccgggcccccggagggcuggaccgagcucaccaugggggucggccccuggcgggaggagaccuggggcgagcugaucgagaagugccuggagagcaugugccagggggaggaggccgagcuccagcugcccggccacuccgggcccccggugcgccugacgcucgcgagcuucacccagggccgggacuccugggagcuggagaccagcgagaaggaggcccuggcccgcgaggagcgggcccgcggcaccgagcuguuccgggcggggaaccccgagggcgccgcccgcugcuacgggcgggcccuccgccugcuccugacgcugcccccgcccggcccgcccgagcggaccgugcuccacgccaaccuggcggccugccagcugcuccuggggcagccccagcuggccgcccaguccugcgaccgcguccucgagcgggagcccggccaccugaaggcccuguaccgccggggcguggcgcaggccgcccucgggaaccuggagaaggccaccgccgaccugaagaaggugcucgcgaucgaccccaagaaccgcgccgcccaggaggagcugggcaaggucgugauccaggggaagaaccaggacgccggccuggcccaggggcuccggaagauguucggcuga

SEQ ID NO: 30195 - RNA, 1488 nt, Artificial Sequence
  derived and/or modified sequence opt1 from FKRP__Homo_sapiens__XP_011525609
augcgccugacccggugccaggccgcccucgcggccgccaucacccugaaccugcucgugcuguucuacgucagcuggcugcagcaccagccccgcaacucccgggcccgcggcccgcggcgcgccagcgcggccgggccccgggugacggugcucguccgcgaguucgaggccuucgacaacgccgugcccgagcugguggacuccuuccugcagcaggaccccgcgcagccggucgugguggccgccgacacccuccccuacccgccccuggcccugccccggauccccaacguccgccucgcccugcugcagcccgcgcucgaccggcccgccgccgccagccgcccggagaccuacguggccaccgaguucguggcgcugguccccgacggcgcccgggccgaggcccccgggcugcucgagcgcaugguggaggcccugcgggcgggcuccgcccgccugguggccgcccccgucgccacggcgaacccggcccggugccucgcccugaacgugagccugcgcgaguggaccgcccgguacggggcggcccccgccgcgccccgcugcgacgcccucgacggcgacgccgugguccugcugcgggcccgcgaccucuucaaccuguccgcgccccuggcccgcccggugggcaccagccucuuccugcagaccgcccugcgggggugggccgugcagcuccuggaccugacguucgccgccgcccgccagccgccccucgccaccgcgcacgcccgguggaaggccgagcgcgagggccgggcccgccgggcggcccugcugcgcgcccucgggauccggcuggucuccugggagggcgggcgccuggagugguucggcugcaacaaggagaccacccggugcuucggcacgguggugggggacacccccgccuaccucuacgaggagcgcuggaccccgcccugcugccugcgggcccugcgcgagaccgcgcgguacgucgugggcguccucgaggccgccggggugcgcuacuggcuggagggcggcagccugcucggggccgcccggcacggcgacaucauccccugggacuacgacguggaccuggggaucuaccuggaggacgucggcaacugcgagcagcugcgcggggcggaggccggcuccgugguggacgagcggggcuucgucugggagaaggccguggagggggacuucuuccgcgugcaguacagcgaguccaaccaccuccacgucgaccuguggcccuucuacccccgcaacggcgugaugacgaaggacaccuggcuggaccaccggcaggacguggaguuccccgagcacuuccuccagccccuggucccgcugcccuucgccggguucguggcccaggcgcccaacaacuaccgccgguuccucgagcugaaguucggccccggggugaucgagaacccgcaguaccccaaccccgcccugcucagccugaccggcuccggcuga

SEQ ID NO: 30196 - RNA, 1386 nt, Artificial Sequence
  derived and/or modified sequence opt1 from FKTN__Homo_sapiens__NP_001073270
augagccgcaucaacaagaacgugguccuggcccuccugacccugaccuccagcgccuuccuccuguuccagcuguacuacuacaagcacuaccucuccacgaagaacggcgcggggcugagcaaguccaagggcagccggaucggguucgacuccacccaguggcgcgccgugaagaaguucaucaugcugaccagcaaccagaacgugcccgucuuccucaucgacccgcugauccuggagcucaucaacaagaacuucgagcaggucaagaacaccucccacggcagcacgucccagugcaaguucuucugcgugccccgggacuucaccgccuucgcccugcaguaccaccuguggaagaacgaggaggggugguuccgcaucgccgagaacaugggcuuccagugccucaagaucgagagcaaggacccccggcuggacggcaucgacucccugagcgggaccgagaucccccuccacuacaucugcaagcuggcgacccacgccauccaccuggugguguuccacgagcgcuccggcaacuaccucuggcacgggcaccuccggcugaaggagcacaucgaccgcaaguucgugccguuccggaagcugcaguucggccgcuaccccggggccuucgaccggcccgagcugcagcaggucacgguggacggccuggaggugcucauccccaaggacccgaugcacuucgucgaggaggugccccacagccgcuucaucgagugccgguacaaggaggcccgcgcguucuuccagcaguaccuggacgacaacaccguggaggccgucgccuuccggaaguccgccaaggagcugcuccagcuggccgcgaagacccugaacaagcucggcgugcccuucuggcugagcuccgggaccugccugggcugguaccgccagugcaacaucauccccuacagcaaggacguggaccucgggaucuucauccaggacuacaagagcgacaucauccuggccuuccaggacgccggccugccgcucaagcacaaguucggcaaggucgaggacucccuggagcugagcuuccaggggaaggacgacgugaagcucgacguguucuucuucuacgaggagacggaccacauguggaacggcgggacccaggccaagaccggcaagaaguucaaguaccuguuccccaaguucacccugugcuggacggaguucgucgacaugaaggugcacgugcccugcgagacccucgaguacaucgaggccaacuacgggaagaccuggaagauccccgucaagaccugggacuggaagcgguccccgcccaacgugcagcccaacggcaucuggcccaucagcgagugggacgaggucauccagcuguacuga

SEQ ID NO: 30197 - RNA, 1341 nt, Artificial Sequence
  derived and/or modified sequence opt1 from FLAD1__Homo_sapiens__NP_001171820
augaccagccgcgccuccgagcugagccccggccgguccgugaccgccgggaucaucaucgucggcgacgagauccucaaggggcacacgcaggacaccaacaccuucuuccugugccgcacccugcggagccucggcguccaggugugccgcguguccguggugccggacgaggucgcgacgaucgccgccgaggugaccagcuucuccaaccgguucacccacgugcugaccgccgggggcaucggccccacgcacgacgacgucaccuucgaggccguggcgcaggccuucggggacgagcugaagccccaccccaagcucgaggccgccaccaaggcgcugggcggggagggcugggagaagcugagccucgugccguccagcgcccgccugcacuacgggaccgaccccugcacgggccagcccuuccgguucccccuggucuccgugcgcaacguguaccucuucccgggcauccccgagcugcugcggcgcguccucgaggggaugaagggccuguuccagaaccccgccgugcaguuccacagcaaggagcuguacguggccgccgacgaggcguccaucgcccccauccucgccgaggcccaggcccacuucgggcggcgccugggccugggcagcuacccggacuggggguccaacuacuaccaggucaagcucacccuggacagcgaggaggagggcccccuggaggagugccucgcguaccugaccgcccggcugccccaggggucccucgugcccuacaugccgaacgccguggagcaggccagcgaggccgucuacaagcuggcggaguccggcagcagccuggggaagaagguggccggcgcccuccagaccaucgagacgucccuggcccaguacagccugacccagcucugcgugggcuucaacgggggcaaggacugcaccgcccugcugcaccucuuccacgcggccguccagcgcaagcugcccgacgugcccaacccccugcagauccucuacauccgguccaucagcccguuccccgagcuggagcaguuccugcaggacaccaucaagcgcuacaaccuccagaugcuggaggccgagggguccaugaagcaggcccugggcgagcuccaggcgcggcacccccagcuggaggccguccugauggggacgcgccggaccgaccccuacagcugcucccucugcccguucagccccaccgaccccggcuggcccgccuucaugcgcaucaacccgcugcuggacuggaccuaccgggacaucugggacuuccugcgccagcuguucgugcccuacugcauccucuacgaccgcggcuga

SEQ ID NO: 30198 - RNA, 1029 nt, Artificial Sequence
  derived and/or modified sequence opt1 from FLCN__Homo_sapiens__NP_653207
augaacgccaucguggcccugugccacuucugcgagcuccacggcccccgcacccuguucugcaccgagguccugcacgcgccgcucccccagggggacggcaacgaggacagccccgggcagggcgagcaggccgaggaggaggagggcgggauccagaugaacucccggaugcgcgcccacagccccgccgagggcgccuccguggagagcuccagcccggggcccaagaaguccgacaugugcgagggcugccggagccuggcggccgggcaccccggcuacaucucccacgacaaggagacgagcaucaaguacgugucccaccagcaccccagccacccgcagcuguucuccaucguccgccaggccugcgugcggagccucuccugcgaggugugccccgggcgcgagggccccaucuucuucggcgacgagcagcacggguucgucuucagccacaccuucuucaucaaggacucccuggcccggggcuuccagcgcugguacagcaucaucaccaucaugauggaccggaucuaccugaucaacuccuggcccuuccuccuggggaaggugcgcggcaucaucgacgagcugcagggcaaggcgcucaagguguucgaggccgagcaguucgggugcccgcagcgggcccagcgcaugaacaccgccuucacgcccuuccugcaccagcggaacggcaacgccgcgcgcagccugaccagccucaccuccgacgacaaccugugggccugccugcacaccagcuucgccuggcuccugaaggccugcgggucccggcugacggagaagcuccuggagggcgcccccaccgaggacacccugguccagauggagaagcucgcgggggaggccggcgugcugcugcccggcccguggcccggguggcccuggggcgggaccagcugccuccuguccuggcaggagagccugcgcgagggcaacgccgcccucaaccagccccggacgucccugcgcgaggcccacccgcccaucagcguguga

SEQ ID NO: 30199 - RNA, 7176 nt, Artificial Sequence
  derived and/or modified sequence opt1 from FLG2__Homo_sapiens__NP_001014364
augaccgaccugcuccgcagcguggucaccgugaucgacguguucuacaaguacacgaagcaggacggcgagugcgggacccuguccaagggcgagcugaaggagcuccuggagaaggagcugcaccccguccucaagaacccggacgaccccgacaccguggacgugaucaugcacaugcuggaccgggaccacgaccgccggcuggacuucaccgaguuccuccugaugaucuucaagcugacgauggccugcaacaagguccucagcaaggaguacugcaaggccuccgggagcaagaagcaccgccggggccaccgccaccaggaggaggaguccgagaccgaggaggacgaggaggacacccccgggcacaagagcggcuaccggcacuccagcugguccgagggcgaggagcacggguacagcuccggccacagccgcgggaccgugaagugccggcacggcuccaacagccgccggcuggggcgccagggcaaccuguccagcuccggcaaccaggaggggagccagaagcgguaccaccgcuccagcugcggccacagcugguccgggggcaaggaccggcacggcagcuccagcguggagcuccgcgagcggaucaacaagucccacaucagccccucccgcgagagcggggaggaguacgaguccggcagcggguccaacagcugggagcggaagggccacgggggccuguccugcggccuggagacgagcgggcacgaguccaacagcacccagucccgcauccgggagcagaagcucggcagcuccugcagcgggagcggcgacuccgggcgccgcagccacgcgugcggcuacuccaacagcuccggcugcgggcggccgcagaacgccagcuccagcugccagucccaccgcuucggcgggcagggcaaccaguucagcuacauccaguccgggugccagagcggcaucaagggcgggcagggccacgggugcgucuccggcggccagcccagcgggugcggccagcccgaguccaaccccugcagccaguccuacagccagcggggguacggcgcccgcgagaacgggcagccgcagaacugcggcggccaguggcggaccgggagcucccagagcuccugcugcggccaguacgggagcggcgggucccagagcugcuccaacggccagcacgaguacggcagcugcgggcgcuucuccaacagcuccagcuccaacgaguucagcaagugcgaccaguacggcuccgggagcucccagagcaccuccuucgagcagcacggcacggggcugagccagagcuccggcuucgagcagcacgugugcggcagcgggcagaccugcggccagcacgaguccaccagcucccagagccugggguacgaccagcacggcuccagcuccgggaagaccagcggcuucggccagcacggguccggcagcgggcaguccagcggcuucggccagugcggguccggcagcgggcaguccagcggcuucgggcagcacggcuccgugagcggccagagcuccggguucggccagcacgggagcgucuccggccagagcuccggguucggccagcacgagagccggucccgccagagcuccuacggccagcacgggagcggcuccagccaguccagcggguacggccaguacgggucccgggagacgagcggcuucggccagcacgggcucggcuccgggcagagcaccggcuucggccaguacggguccggcagcgggcagagcuccggcuucgggcagcacggcagcggcuccgggcagagcuccggcuucgggcagcacgagagccgcuccggccagagcuccuacgggcagcacagcuccggcagcucccagagcuccggcuacgggcagcacggcagccggcagaccuccggguucggccagcacgggagcggcuccagccagagcaccggcuucgggcaguacggcuccgggagcggccaguccagcggguucggccagcacguguccggcagcgggcaguccagcggcuucgggcagcacgagucccgcagcggccacuccagcuacggccagcacggguucggcuccagccaguccagcggguacggccagcacggguccagcuccggccagacgagcggcuucgggcagcacgagcugagcuccggccagagcuccagcuucgggcagcacggcuccgggagcggccaguccagcggcuucgggcagcacggcuccgggagcggccaguccagcggguucggccagcacgagucccggagcggccaguccagcuacgggcagcacuccagcggcagcucccagagcuccggguacggccagcacgggagccgccagaccuccggcuucggccagcacgggagcggcuccagccaguccaccggguucggccaguacggcagcggguccggccagagcgccggguucggccagcacggguccggcagcggccaguccagcggguucggccagcacgagucccggagccaccaguccagcuacgggcagcacggcagcggguccagccaguccagcggcuacggccagcacggguccagcuccggccagaccagcggguucggccagcaccgcuccagcuccgggcaguacagcggcuucggccagcacggguccggcagcgggcaguccagcggcuucggccagcacgggacgggcuccgggcaguacagcggcuucgggcagcacgagucccggagccaccagagcuccuacggccagcacggcagcggguccagccaguccagcggcuacgggcagcacggcuccagcuccgggcagaccuucggcuucggccagcaccgcagcggguccggccagagcuccggguucggccagcacgggagcggcuccggccagagcuccggguucggccagcacgagagcggguccggcaagagcagcggguucggccagcacgagucccggagcucccagagcaacuacggccagcacggguccggcagcucccagagcuccggguacggccagcacggcagcuccagcgggcagaccaccggcuucgggcagcaccgcuccagcuccggccaguacagcggguucggccagcacggcuccgggagcgaccaguccagcggcuucgggcagcacggcacggggagcggccaguccagcggcuucgggcaguacgagucccgcagccggcaguccagcuacggccagcacggguccggcagcucccagagcuccggguacggccagcacggcagcaacuccgggcagaccagcggcuucgggcagcaccgccccggcuccggccagagcuccggguucggccaguacgggagcggcuccgggcagagcagcggcuucggccagcacggguccggcaccgggaagagcuccggcuucgcccagcacgaguaccggagcgggcaguccagcuacggccagcacggcaccggguccagccaguccagcggcugcgggcagcacgaguccggcagcgggcccacgaccuccuucggccagcacgugagcggcuccgacaacuucagcuccagcgggcagcacaucagcgacuccggccagagcaccggguucggccaguacggguccggcagcggccaguccaccgggcugggccagggggagagccagcaggucgaguccggcagcacggugcacggccgccaggagaccacccacgggcagaccaucaacaccacgcggcacucccagagcggccaggggcaguccacccagaccggcagccgcgugacccggcgccggcgcuccagccaguccgagaacagcgacuccgagguccacagcaaggugucccaccggcacagcgagcacauccacacgcaggcggggagccacuaccccaaguccggcagcaccgugcgccggcgccagggcaccacccacgggcagcggggcgacacgacccgccacgggcacuccggccacgggcagagcacccagaccggcucccggacgagcggccgccagcgguucucccacagcgacgccaccgacuccgagguccacagcggggugucccaccgcccgcacagccaggagcagacccacucccaggccggcagccagcacggggaguccgagagcaccgugcacgagcggcacgagacgaccuacggccagaccggggaggccaccggccacggccacuccgggcacggccagagcacgcagcgcgggucccgcaccaccggccggcgcggcagcgggcacagcgaguccagcgacuccgagguccacagcggcgggucccaccggccccagagccaggagcagacccacggccaggcggggucccagcacggcgagagcggcuccacggugcacgggcgccacggcaccacccacgggcagaccggcgacacgacccggcacgcccacuaccaccacgggaagagcacccagcgcggcuccagcaccacgggccggcgcggguccggccacagcgaguccagcgacuccgagguccacagcgggggcucccacacccacagcgggcacacccacggccagagcggcucccagcacggggagagcgaguccaucauccacgaccggcaccgcaucacccacggccagacgggggacaccacccggcacagcuacuccggccacgagcagaccacccagacggggagccgcaccaccggccggcagcgcaccucccacagcgaguccacggacagcgaggugcacuccggcgggagccaccggccccacucccgcgagcacaccuacggccaggccgggagccagcacgaggagcccgaguucaccgugcacgagcggcacggcaccacgcacggccagaucggggacaccaccggccacucccacagcgggcacggccaguccacccagcgcgggagccggacgaccggccgccagcgcuccagccacagcgaguccagcgacuccgagguccacagcggcgugucccacacccacaccgggcacacgcacggccaggccgggagccagcacggccaguccgagagcaucgugccggagcggcacgggaccacccacggccagaccggcgacacgacccgccacgcccacuaccaccacgggcucaccacccagacgggcucccggaccaccgggcgccggggcagcgggcacuccgaguacagcgacuccgagggcuacagcggcgucucccacacccacagcgggcacacgcacggccaggcgcgcucccagcacggggagagcgaguccaucgugcacgagcggcacggcaccauccacgggcagaccggcgacaccacgcgccacgcccacagcggccacgggcagagcacccagaccggcucccggaccacggggcgccggagcuccggccacagcgaguacuccgacagcgagggccacuccggguucagccagcgcccccacucccggggccacacccacgggcaggccggcagccagcacggggaguccgagagcaucguggacgagcgccacggcaccacccacggccagaccggggacacguccggccacagccaguccgggcacggccagagcacccaguccgggagcagcaccaccggccggcgccgguccggccacagcgaguccagcgacuccgagguccacagcgggggcucccacacgcacagcgggcacacccacucccaggcccgcagccagcacggcgaguccgagagcaccgugcacaagcggcaccagaccacgcacgggcagaccggcgacaccaccgagcacggccaccccucccacgggcagacgauccagaccggcagccgcaccaccgggcggcgcggcuccggccacagcgaguacuccgacagcgaggggcccuccggcgugagccacacgcacagcgggcacacccacggccaggccgggucccacuacccggagagcggcuccagcguccacgagcgccacggcaccacccacgggcagacggcggacaccacccggcacggccacuccgggcacggccagagcacccagcgcgggucccggacgaccggccgccgggccagcggccacuccgaguacagcgacuccgaggggcacagcggcgugucccacacccacagcgggcacgcccacggccaggccgggucccagcacggcgagagcggcuccagcgugcacgagcgccacgggaccacgcacggccagaccggggacaccacccggcacgcccacuccggccacgggcagagcacgcagcgcggcagccggaccgcgggccgccggggguccggccacagcgaguccagcgacuccgagguccacagcggggugucccacacccacagcggccacaccuacggccaggcccgcucccagcacggggagagcggcuccgccauccacgggcggcagggcacgauccacgggcagaccggcgacaccacccgccacggccagagcgggcacggccaguccacgcagaccgggagccggaccaccggccgccagcgguccagccacuccgagagcuccgacagcgaggugcacagcgaggccucccccacccacagcgggcacacgcacucccaggccggcagccgccacggccaguccgggagcuccggccacgggcggcagggcaccacccacgggcagaccggcgacacgacccgccacgcgcacuacggcuacgggcagagcacccagcgcggcucccggaccacggggcgccggggcagcggccacuccgagagcuccgacagcgagguccacuccugggggagccacacccacuccggccacauccaggggcaggccggcagccagcagcgccagcccggguccaccgugcacggccggcuggagaccacgcacggccagaccggggacaccacccgccacggccacagcggguacggccagagcacgcagaccgggucccggagcucccgcgccagccacuuccagucccacagcuccgagcggcagcgccacggcagcucccagguguggaagcacggcagcuacgggcccgccgaguacgacuacggccacaccggguacggcccguccgggggcagccggaaguccaucagcaacucccaccugagcugguccaccgacagcacggcgaacaagcagcucucccgccacuga

SEQ ID NO: 30200 - RNA, 12186 nt, Artificial Sequence
  derived and/or modified sequence opt1 from FLG__Homo_sapiens__NP_002007
augagcacccugcucgagaacaucuucgccaucaucaaccuguucaagcaguacuccaagaaggacaagaacaccgacacgcugagcaagaaggagcucaaggagcugcuggagaaggaguuccgccagauccucaagaaccccgacgacccggacaugguggacgucuucauggaccaccuggacaucgaccacaacaagaagaucgacuucaccgaguuccugcucaugguguucaagcuggcccaggcguacuacgaguccacccggaaggagaaccugcccaucagcggccacaagcaccgcaagcacucccaccacgacaagcacgaggacaacaagcaggaggagaacaaggagaaccggaagcgccccagcucccucgagcggcgcaacaaccggaaggggaacaagggccgcagcaaguccccccgggagaccgggggcaagcgccacgagagcuccagcgagaagaaggagcggaagggguacuccccgacgcaccgcgaggaggaguacggcaagaaccaccacaacagcuccaagaaggagaagaacaagaccgagaacacccggcugggcgacaaccgcaagcggcugagcgagcgccucgaggagaaggaggacaacgaggaggggguguacgacuacgagaacaccggccggaugacgcagaaguggauccaguccgggcacaucgccaccuacuacaccauccaggacgaggccuacgacaccacggacagccugcuggaggagaacaagaucuacgagcgcucccggagcagcgacggcaaguccagcucccaggucaaccgcagccggcacgagaacaccucccaggugccccuccaggagagccgcacccgcaagcggcgcgggucccgggugagccaggaccgcgacuccgagggccacagcgaggacuccgagcggcacagcggcuccgccagccgcaaccaccacggguccgccugggagcagagccgggacggcucccgccacccccggagccacgacgaggaccgcgcgucccacgggcacagcgccgacagcucccggcagagcggcacccgccacgccgagacguccagccggggccagaccgccuccagccacgagcaggcgcgcuccagccccggggagcggcacggcuccgggcaccagcagagcgccgacuccagccgccacuccgccaccggccgggggcaggccagcuccgccgucagcgaccgcggccaccggggcuccagcgggagccaggcguccgacagcgagggccacuccgagaacagcgacacccaguccgugagcgggcacggcaaggccgggcugcgccagcagucccaccaggagagcacgcgcggccgguccggcgagcgcagcgggcgguccggcagcucccuguaccaggugagcacccacgagcagccggacuccgcccacgggcgcaccggcaccagcacggggggccggcagggcucccaccacgagcaggcccgcgacagcucccggcacagcgccagccaggaggggcaggacaccauccgcggccaccccggguccagccggggcggccgccaggggucccaccacgagcagagcgucaaccgguccggccacagcgggucccaccacagccacaccaccucccagggccgcagcgacgcgucccacgggcagagcggcucccggagcgccucccgccagacgcggaacgaggagcagagcggcgacgggacccgccacuccggcagccggcaccacgaggccuccagccaggccgacagcucccgccacagccagguggggcagggccaguccagcgggccccggaccucccgcaaccagggcagcuccgugagccaggacuccgacagccagggccacuccgaggacagcgagcggugguccgggagcgccucccgcaaccaccacggcagcgcgcaggagcagucccgcgacgggagccggcacccccgcucccaccacgaggaccgggccggccacgggcacagcgccgacagcucccgcaagagcggcacccggcacacgcagaacuccagcuccggccaggccgccagcucccacgagcaggcgcgcagcuccgccggggagcggcacggcagccgccaccagcuccaguccgccgacagcucccggcacagcgggaccggccacgggcaggccuccagcgcgguccgcgacuccggccaccggggcagcuccgggagccaggccaccgacagcgagggccacuccgaggacagcgacacccaguccgugagcgggcacggccaggccggccaccaccagcagucccaccaggagagcgcccgcgaccgguccggggagcgcagccggcgcuccggcagcuuccuguaccagguguccacgcacaagcagagcgaguccagccacggguggaccggcccguccaccgggguccggcagggcagccaccacgagcaggcccgcgacaacucccggcacagcgcgucccaggacggccaggacaccauccgcgggcaccccggcagcagccgccgggggcgccagggcucccaccacgagcagagcguggaccgguccgggcacagcggcucccaccacagccacaccacgucccagggccgcagcgacgccucccgggggcagagcggcucccgcagcgccucccggaccacccgcaacgaggagcagagccgggacgggucccgccacagcggcucccggcaccacgaggccagcagccacgccgacaucucccgccacagccaggcggggcagggccaguccgagggcagccggaccucccgccggcaggggagcuccgugagccaggacuccgacagcgagggccacuccgaggacagcgagcgcugguccgggagcgccucccggaaccaccgcggcagcgcccaggagcagucccggcacggcagccgccacccccggucccaccacgaggaccgcgccgggcacggccacagcgccgacagcucccgccagagcgggacgccccacgcggagaccuccagcggcgggcaggccgccuccagccacgagcaggcccgguccagcccgggcgagcgccacggcucccggcaccagcagagcgcggacuccagccgccacuccgggaucccccggcgccaggccagcuccgccguccgggacagcggccacuggggguccagcggcucccaggccagcgacagcgaggggcacuccgaggagagcgacacccaguccgugagcggccacggccaggacgggccccaccagcagucccaccaggagagcgcccgcgacugguccggcgggcggagcggccgcuccgggagcuucaucuaccagguguccacccacgagcagagcgaguccgcgcacggccggacgcgcaccagcaccggccggcgccaggggucccaccacgagcaggcccgggacagcucccgccacagcgccucccaggagggccaggacaccauccgggcccaccccgggagccgccggggcgggcgccagggcagccaccacgagcaguccgucgaccgcagcggccacuccgggagccaccacucccacacgaccagccagggccgguccgacgccagccacgggcaguccggcagccgcuccgcgagccggcagacccgcaaggacaagcaguccggcgacgggagccggcacuccggcagccgccaccacgaggccgccuccugggccgacagcucccggcacagccagguggggcaggagcagagcuccggcagccgcaccucccggcaccaggggagcuccgugagccaggacuccgacagcgagcgccacuccgacgacagcgagcggcuguccggcagcgccucccgcaaccaccacggcagcucccgggagcagagccgcgacgggucccggcacccgggcuuccaccaggaggaccgcgcgagccacgggcacuccgccgacagcagccggcaguccggcacgcaccacaccgagagcuccagccacgggcaggccgucuccagccacgagcaggcccgcuccagccccggcgagcggcacggcucccgccaccagcagagcgcggacuccagccggcacuccgggaucggccaccgccaggccagcuccgccgugcgcgacagcgggcaccggggcuccagcgggagccaggucaccaacuccgagggccacagcgaggacuccgacacccagagcguguccgcccacggccaggccgggccccaccagcagagccacaaggaguccgcgcgcggccagagcggggaguccagcggccggucccgcagcuuccucuaccagguguccagccacgagcaguccgagagcacgcacgggcagaccgcccccuccaccggcggccggcaggggagccgccacgagcaggcccggaacuccagccgccacagcgccucccaggacggccaggacaccauccgggggcacccgggcagcucccgcggcgggcggcagggcagcuaccacgagcaguccgucgaccgcagcgggcacuccggcuaccaccacagccacacgaccccccaggggcgguccgacgccagccacggccaguccggcccccgcagcgcgucccggcagacccgcaacgaggagcagagcggggacggcucccggcacagcgggucccgccaccacgagcccagcacccgggccggcuccagccgccacagccagguggggcagggcgaguccgccggcagcaagacgucccgccggcaggggagcuccgugagccaggaccgcgacuccgagggccacagcgaggacuccgagcggcgcagcgaguccgccagccggaaccacuacggguccgcccgcgagcagagccggcacggcucccgcaacccgcggagccaccaggaggaccgcgcgucccacgggcacagcgccgaguccagccggcagagcggcacccgccacgccgagaccuccagcggcgggcaggccgccuccagccaggagcaggcgcgguccagccccggcgagcgccacgggucccggcaccagcagagcgccgacuccagcaccgacuccggcacgggccgccggcaggacagcuccgucgugggggacagcggcaaccgcggguccagcggcucccaggccagcgacuccgaggggcacagcgaggagagcgacacccaguccgugagcgcccacggccaggcgggcccccaccagcagucccaccaggagagcacccgggggcaguccggcgagcgcagcgggcgguccggcagcuuccuguaccaggucuccacccacgagcagagcgaguccgcccacgggcgcacgggcccgagcaccggcgggcgccagcggucccgccacgagcaggcccgggacagcucccgccacagcgccucccaggagggccaggacaccauccgggggcaccccggcagcucccgcgggggccggcagggcagccacuacgagcagagcguggacuccagcgggcacuccggcagccaccacucccacaccaccagccaggagcgcuccgacgugagccgggggcaguccggcagccgcuccgucagccggcagacgcgcaacgagaagcaguccggggacggcagccggcacuccggcagccgccaccacgaggccuccagccgggcggacagcucccgccacagccagguggggcagggccaguccagcgggccccggaccucccgcaaccagggcagcuccgugagccaggacuccgacagccagggccacuccgaggacagcgagcggugguccgggagcgccucccgcaaccaccugggcagcgccugggagcagucccgcgacgggagccggcaccccggcucccaccacgaggaccgcgccgggcacggccacagcgccgacagcucccggcagagcggcacccgccacaccgaguccagcucccgggggcaggcggccagcucccacgagcaggcccgcagcuccgccggcgagcggcacgggagccaccaccagcuccaguccgccgacagcucccgccacagcggcaucgggcacggccaggcguccagcgccguccgggacuccggccaccgcggguacagcggcucccaggccagcgacagcgaggggcacuccgaggacagcgacacgcaguccgugagcgcccagggcaaggcggggccgcaccagcagucccacaaggagagcgcccggggccaguccggcgagagcuccgggcgcagcggcuccuuccuguaccaggugagcacccacgagcaguccgagagcacccacgggcaguccgcccccagcaccggcggccggcaggggucccacuacgaccaggcccaggacagcucccgccacagcgccagccaggagggccaggacacgauccgggggcaccccggccccucccgcgggggccggcagggcagccaccaggagcaguccgucgaccgcagcgggcacuccggcagccaccacucccacaccaccagccaggggcgguccgacgcgagccgcggccaguccgggagccgguccgccagccgcaagaccuacgacaaggagcaguccggcgacggcagccgccacuccgggagccaccaccacgaggccuccagcugggccgacagcucccggcacagccuggugggccaggggcaguccagcggcccgcgcacgucccggccccgcgggagcuccgugagccaggacuccgacagcgagggccacuccgaggacagcgagcggcgcuccggcagcgccucccggaaccaccacgggagcgcgcaggagcagucccgcgacggcagccggcacccccgcucccaccacgaggaccgggccgggcacggccacagcgccgagagcucccgccagagcgggacccaccacgccgagaacuccagcggcggccaggccgcguccagccacgagcaggcccgguccagcgccggggagcgccacggcucccaccaccagcagagcgccgacuccagccggcacuccgggaucggccacggccaggcgagcuccgccguccgcgacagcgggcaccggggcuccagcgggagccaggccuccgacagcgagggccacuccgaggacagcgacacccaguccgugagcgcccacgggcaggccggcccccaccagcagucccaccaggagagcacccgcggccgguccgcggggcgcagcggccgcuccgggagcuuccucuaccagguguccacgcacgagcagagcgaguccgcccacggccggaccgggaccagcaccggcggccgccaggggucccaccacaagcaggcccgggacagcucccgccacagcacgagccaggagggccaggacaccauccacgggcacccgggcuccagcuccgggggccggcagggcagccacuacgagcagcuggucgaccgcuccgggcacagcggcucccaccacagccacaccaccucccaggggcggagcgacgccucccacggccacagcggcucccgcagcgccucccggcagacgcgcaacgacgagcagagcggggacggcucccggcacagcgggucccgccaccacgaggcgagcagccgggccgacuccagcggccacucccagguggggcagggccagagcgagggcccccgcaccucccggaacugggggagcuccuucagccaggacuccgacagccagggccacuccgaggacagcgagcgcugguccgggagcgccucccggaaccaccacggcagcgcccaggagcagcugcgcgacgggucccggcacccccgcagccaccaggaggaccgggccggccacggccacuccgcggacagcagccgccaguccgggacccgccacacccagacgagcuccggcgggcaggccgccagcucccacgagcaggcccggagcuccgccggcgagcgccacgggagccaccaccagcaguccgcggacagcucccggcacagcggcaucggccacgggcaggccuccagcgccgugcgcgacuccggccaccggggguacagcggcucccaggccagcgacaacgaggggcacuccgaggacagcgacacccagagcgucuccgcgcacggccaggccggcagccaccagcagucccaccaggagagcgcccgcgggcgguccggcgagaccagcgggcacuccggcagcuuccucuaccagguguccacccacgagcagagcgaguccagccacggcuggacggggcccuccacccgcggccggcaggggagccgccacgagcaggcccaggacuccagccggcacuccgccagccaggacggccaggacaccauccgcgggcacccgggcuccagccggggcgggcgccagggcuaccaccacgagcacagcguggacuccagcgggcacuccggcagccaccacucccacaccacgagccaggggcgguccgacgcgagccgcggccaguccggcagccgguccgccagccgcaccacccggaacgaggagcaguccggggacggcagccgccacuccgggagccgccaccacgaggccuccacccacgccgacaucagccggcacagccaggccguccagggccaguccgaggggagccgccggucccgccggcagggcagcuccgugagccaggacuccgacagcgagggccacuccgaggacagcgagcgcugguccgggagcgcgucccggaaccaccacggcagcgcccaggagcagcugcgcgacgggucccggcacccccgcagccaccaggaggaccgggccggccacgggcacuccgccgacagcucccgccagagcggcacccggcacacgcagaccagcuccggcgggcaggccgcgagcucccacgagcaggcccgcagcuccgccggcgagcggcacgggagccaccaccagcaguccgccgacagcucccgccacagcggcaucggccacgggcaggcguccagcgccgugcgggacuccggccaccgcggguacagcggcucccaggccagcgacaacgaggggcacuccgaggacagcgacacccaguccgucagcgcccacggccaggccggcagccaccagcagucccaccaggagagcgcgcgggggcgcuccggcgagaccagcgggcacuccggcagcuuccuguaccagguguccacgcacgagcagagcgaguccagccacggguggaccggccccuccacccggggccgccaggggagccgccacgagcaggcccaggacuccagccggcacuccgccagccaguacggccaggacaccauccgcgggcaccccggcuccagccgggggggccgccagggcuaccaccacgagcacuccguggacagcagcgggcacuccggcagccaccacucccacacgaccagccaggggcgguccgacgccagccgcggccaguccggcagccgguccgccagccgcaccacccggaacgaggagcaguccggggacagcucccgccacagcgucucccggcaccacgaggcgagcacgcacgccgacaucucccgccacagccaggccgugcagggccaguccgaggggagccggcgcagccggcgccagggcuccagcgugucccaggacagcgacuccgaggggcacagcgaggacuccgagcgguggagcggcuccgccagccgcaaccaccggggcuccguccaggagcagagccgccacgggucccgccacccgcggagccaccacgaggaccgcgccggccacgggcacuccgcggaccggagccgccaguccggcacccggcacgccgagaccagcuccgggggccaggccgccagcagccacgagcaggcgcgcuccagccccggcgagcggcacgggucccgccaccagcagagcgccgacuccagccggcacuccggcaucccccgcgggcaggccagcuccgccgugcgggacagccgccacuggggcuccagcgggucccaggccagcgacuccgagggccacagcgaggaguccgacacccagagcgugagcggccacgggcaggcgggcccccaccagcagucccaccaggagagcgcccgggaccgcuccgggggccggagcgggcgcuccggcagcuuccucuaccaggucuccacgcacgagcagagcgaguccgcccacggccggacccgcaccagcaccgggcggcgccagggcucccaccacgagcaggcccgggacagcucccgccacagcgccucccaggaggggcaggacacgauccgcggccacccgggcagcucccggcgcgggcggcagggcagccacuacgagcaguccguggaccgcagcgggcacagcggcucccaccacagccacaccaccucccaggggcggagcgacgcgucccgcggccagagcggcucccggagcgccucccgccagacccggaacgacgagcagagcggggacggcucccgccacagcuggucccaccaccacgaggccagcacgcaggccgacuccagccggcacucccagagcgggcagggccaguccgccgggccccgcaccagccggaaccagggcagcuccgugagccaggacuccgacagccagggccacuccgaggacagcgagcgcugguccgggagcgcgucccggaaccaccgcggcagcgcccaggagcagucccgggacgggagccgccaccccaccucccaccacgaggaccgggccggccacgggcacagcgccgaguccagccgccaguccggcacccaccacgccgagaacagcuccggcgggcaggcggccagcagccacgagcaggcccgcuccagcgccggcgagcggcacgggucccaccaccagcagagcgcggacuccagccgccacuccggcaucggccacgggcaggccagcuccgccguccgggacagcggccaccgcggguccagcggcucccaggccagcgacuccgaggggcacagcgaggacuccgacacgcagagcguguccgcccacggccaggcgggcccgcaccagcagagccaccaggagagcacccgggggcgcuccgccggccggagcgggcgcuccggcagcuuccuguaccagguguccacccacgagcagagcgaguccgcccacgggcgggccggccccagcaccggcgggcgccagggcucccggcacgagcaggcccgcgacagcucccggcacagcgcgucccaggaggggcaggacacgauccgcggccaccccgggagccggcgcggcggccggcagggguccuaccacgagcagagcgucgaccgcuccggccacagcgggucccaccacagccacaccaccagccagggccgguccgacgccagccacgggcaguccggcagccgcuccgccagccgggagacccgcaacgaggagcaguccggcgacgggagccgccacuccggcagccggcaccacgaggccuccacgcaggccgacagcucccgccacagccaguccgggcagggcgagagcgcgggcucccggcgcagccggcgccaggggagcuccgugagccaggacuccgacagcgaggccuaccccgaggacuccgagcggcgcagcgaguccgccagccggaaccaccacggcuccagccgcgagcagucccgggacgggagccgccacccgggcuccagccaccgggacaccgccucccacgugcagagcucccccguccagagcgacuccagcaccgcgaaggagcacgggcacuucagcucccugagccaggacuccgccuaccacagcggcauccagucccgcggcagcccccacuccagcuccagcuaccacuaccaguccgaggggaccgagcggcagaagggccagagcgggcucguguggcgccacggcuccuacgggagcgccgacuacgacuacggcgaguccggcuuccggcacagccagcacggguccgucagcuacaacuccaaccccgugguguucaaggagcgcagcgacaucugcaaggccagcgccuucggcaaggaccacccgcgguacuacgcgacguacaucaacaaggaccccgggcugugcggccacuccagcgacaucuccaagcagcugggguucagccagucccagcgcuacuacuacuacgaguga

SEQ ID NO: 30201 - RNA, 1161 nt, Artificial Sequence
  derived and/or modified sequence opt1 from FLI1__Homo_sapiens__NP_001257939
auggagggcgggcuggccggcgagcgcgcccgggagagccccguggacugcuccgucagcaagugcuccaagcucgucgggggcggggagagcaacccgaugaacuacaacuccuacauggacgagaagaacgggcccccgccgcccaacaugaccaccaacgagcgccgggugaucgugcccgcggaccccacgcuguggacccaggagcacgugcgccaguggcuggagugggccaucaaggaguacagccucauggagaucgacaccuccuucuuccagaacauggacggcaaggagcugugcaagaugaacaaggaggacuuccugcgggccaccacgcucuacaacaccgaggugcugcugagccaccucuccuaccugcgcgagagcucccugcucgccuacaacaccaccagccacacggaccaguccagccggcuguccgucaaggaggaccccagcuacgacuccgugcgccgcggcgccuggggcaacaacaugaacagcgggcugaacaaguccccgccccucggcggggcgcagaccaucagcaagaacaccgagcagcggccccagcccgaccccuaccagauccugggccccaccagcucccggcuggccaaccccggcagcgggcagauccagcucuggcaguuccugcuggagcuccuguccgacagcgccaacgccuccugcaucacgugggagggcaccaacggggaguucaagaugaccgaccccgacgagguggcgcgccgguggggcgagcgcaagagcaagccgaacaugaacuacgacaagcugucccgggcccuccgcuacuacuacgacaagaacaucaugaccaagguccacggcaagcgguacgccuacaaguucgacuuccacgggaucgcccaggcccugcagccccaccccacggagagcuccauguacaaguaccccagcgacaucuccuacaugccgagcuaccacgcgcaccagcagaaggugaacuucgugccgccccaccccuccagcaugcccgucaccuccagcuccuucuucggcgccgccagccaguacuggaccucccccaccgggggcaucuaccccaaccccaacgugccgcgccaccccaacacgcacgugcccagccaccuggggagcuacuacuga

SEQ ID NO: 30202 - RNA, 3645 nt, Artificial Sequence
  derived and/or modified sequence opt1 from FLII__Homo_sapiens__NP_001243194
auggaggccaccggcgugcugcccuucguccgcgggguggaccucagcggcaacgacuucaagggcggguacuucccggagaacgugaaggccaugaccucccugcgguggcugaagcucaaccgcacggggcugugcuaccugcccgaggagcucgcggcccugcagaagcuggagcaccucagcgucucccacaacaaccugaccacccugcacggcgagcucagcucccugcccagccugcgggccaucguggcccgcgccaacucccucaagaacagcggcgugcccgacgacaucuucaagcuggacgaccuguccguccucgaccugagccacaaccagcugaccgagugcccgcgggagcucgagaacgcgaagaacaugcuggugcugaaccucucccacaaccgccagcugcccgccaugacggcccugcagacccuccaccuccggagcacccagcgcacccaguccaaccugcccacgagccuggaggggcuguccaaccuggccgacguggaccucagcugcaacgaccugacccggguccccgagugccuguacacccucccgucccugcgccggcugaaccucagcuccaaccagaucaccgagcugagccugugcaucgaccagugggugcacguggagacgcucaaccugagccgcaaccagcugaccucccuccccagcgcgaucugcaagcuguccaagcugaagaagcucuaccugaacagcaacaagcuggacuucgacggccugcccuccgggaucggcaagcucaccaaccuggaggaguucauggccgccaacaacaaccuggagcucguccccgagagccugugccggugcccgaagcugcgcaagcucgugcugaacaagaaccaccuggugacccuccccgaggccauccacuuccugacggagaucgagguccuggacgugcgggagaaccccaaccucgugaugcccccgaagcccgccgaccgcgcggccgagugguacaacaucgacuucucccugcagaaccagcugcggcucgccggggccagccccgccaccgucgcggccgccgccgccggcuccggccccaaggacccgauggcgcgcaagaugcggcugcgccggcgcaaggacagcgcccaggacgaccaggccaagcagguccugaaggggauguccgacguggcccaggagaagaacaagaagcaggaggagagcgccgacgcgcgcgcccccuccggcaaggugcggcgcugggaccaggggcucgagaagccccggcuggacuacagcgaguucuucaccgaggacgugggccagcugcccggccucaccaucuggcagaucgagaacuucgugccgguccugguggaggaggccuuccacgggaaguucuacgaggccgacugcuacaucguccugaagacguuccucgacgacuccggcagccugaacugggagaucuacuacuggaucgggggcgaggcgacccuggacaagaaggccugcuccgccauccacgccgugaaccuccgcaacuaccugggggccgagugccggaccgugcgcgaggagaugggcgacgagagcgaggaguuccugcaggucuucgacaacgacaucuccuacaucgagggcgggaccgcgagcggcuucuacacgguggaggacacccacuacgugacccggauguaccgcgucuacgggaagaagaacaucaagcucgagcccgugccccugaagggcaccagccuggacccccgguucguguuccuccuggaccgcgggcuggacaucuacgucuggcggggcgcccaggccacgcucuccagcaccaccaaggcccgccuguucgccgagaagaucaacaagaacgagcggaagggcaaggcggagaucacccugcucgugcaggggcaggagcugccggaguucugggaggcccugggcggggagcccuccgagaucaagaagcacgugcccgaggacuucuggccgccccagcccaagcucuacaaggucggccuggggcugggcuaccucgagcugccccagaucaacuacaagcugagcguggagcacaagcagcgcccgaagguggagcucaugccccggaugcgccugcugcagucccuccuggacacgcggugcgucuacauccuggacugcuggagcgacguguucaucuggcucggccgcaagagcccccggcuggugcgcgccgccgcccugaagcucgggcaggagcugugcggcaugcugcaccgcccccggcacgcgaccgucucccgcucccucgaggggaccgaggcccagguguucaaggccaaguucaagaacugggacgacgugcugaccgucgacuacacgcggaacgccgaggcggugcugcagagcccgggccucuccggcaaggugaagcgcgacgccgagaagaaggaccagaugaaggccgaccugaccgcccuguuccucccccggcagccgcccaugagccuggccgaggcggagcagcugauggaggaguggaacgaggaccucgacgggauggagggcuucguccuggaggggaagaaguucgcccgccugcccgaggaggaguucggccacuucuacacccaggacugcuacguguuccucugccgguacugggugcccgucgaguacgaggaggaggagaagaaggaggacaaggaggagaaggccgaggggaaggagggcgaggaggccaccgccgaggcggaggagaagcagcccgaggaggacuuccagugcaucguguacuucuggcagggccgcgaggccuccaacaugggguggcugaccuucacguucagccugcagaagaaguucgagucccucuuccccggcaagcuggaggugguccggaugacccagcagcaggagaacccgaaguuccugagccacuucaagcgcaaguucaucauccaccgggggaagcgcaaggccgugcagggcgcccagcagcccucccucuaccagauccggaccaacgggagcgcccugugcacccgcugcauccagaucaacacggacagcucccugcucaacagcgaguucugcuucauccugaaggugcccuucgaguccgaggacaaccagggcaucgucuacgcgugggugggccgggccagcgaccccgacgaggccaagcuggccgaggacauccucaacaccauguucgacaccuccuacagcaagcaggucaucaacgagggggaggagccggagaacuucuucugggugggcaucggggcgcagaagcccuacgacgacgacgccgaguacaugaagcacacccgccuguuccggugcuccaacgagaagggcuacuucgccgugacggagaagugcagcgacuucugccaggacgaccuggccgacgacgacaucaugcuccuggacaacgggcaggagguguacaugugggucggcacccagaccucccagguggagaucaagcugagccucaaggccugccagguguacauccagcacaugcgcuccaaggagcacgagcggccccgccggcugcgccugguccgcaagggcaacgagcagcacgcguucacccggugcuuccacgccuggagcgccuucugcaaggcccucgccuga

SEQ ID NO: 30203 - RNA, 7944 nt, Artificial Sequence
  derived and/or modified sequence opt1 from FLNA__Homo_sapiens__NP_001104026
augagcuccagccacucccgcgccggccagagcgccgcgggggccgcccccggcgggggcguggacacccgggacgccgagaugccggccaccgagaaggaccuggcggaggacgcccccuggaagaagauccagcagaacacguucacccgcuggugcaacgagcaccucaagugcgucuccaagcggaucgccaaccugcagaccgaccugagcgacgggcuccgccugaucgcccugcucgaggugcugucccagaagaagaugcaccggaagcacaaccagcgccccaccuuccggcagaugcagcuggagaacgugagcgucgcgcucgaguuccuggaccgcgaguccaucaagcuggugagcaucgacuccaaggccaucguggacggcaaccucaagcugauccugggccucaucuggacgcugauccugcacuacagcaucuccaugcccaugugggacgaggaggaggacgaggaggccaagaagcagaccccgaagcagcggcuccugggguggauccagaacaagcugccccagcuccccaucaccaacuucagccgcgacuggcaguccggccgggcccugggggcccuggucgacagcugcgcgcccggccucugcccggacugggacuccugggacgccagcaagcccgugaccaacgcccgcgaggccaugcagcaggccgacgacuggcuggggaucccccaggugaucacgcccgaggagaucgucgacccgaacguggacgagcacuccgugaugaccuaccugagccaguuccccaaggcgaagcucaagcccggcgccccccugcggccgaagcugaaccccaagaaggcccgcgccuacggccccgggaucgagcccaccggcaacauggucaagaagcgggccgaguucaccguggagacgcgcagcgcggggcagggcgaggugcucgucuacguggaggacccggccggccaccaggaggaggccaaggugaccgccaacaacgacaagaaccggaccuucuccgucugguacgugcccgaggugaccgggacgcacaaggucaccgugcuguucgccggccagcacaucgcgaagagccccuucgagguguacgucgacaagucccagggggacgccagcaaggugaccgcccagggccccgggcuggagccguccggcaacaucgccaacaagaccacguacuucgagaucuucaccgcgggcgccgggaccggcgaggucgagguggugauccaggaccccauggggcagaagggcaccgucgagccccagcucgaggcccgcggggacagcacguaccggugcuccuaccagcccaccauggagggcgugcacaccgugcacgucaccuucgccggcgugccgaucccccgcagccccuacacggugaccgucgggcaggccugcaacccguccgcgugccgggccgugggccgcgggcugcagcccaagggcgugcgcgucaaggagaccgccgacuucaagguguacaccaagggggccggcagcggcgagcugaaggugacggucaaggggcccaagggcgaggagcgggugaagcagaaggaccucggggacggcguguacggcuucgaguacuaccccauggucccggggaccuacaucgugaccaucaccuggggcgggcagaacaucggccgcucccccuucgaggugaaggucgggacggagugcggcaaccagaaggugcgggccuggggccccgggcuggagggcgggguggucggcaagagcgcggacuucgugguggaggccaucggggacgacgucggcacccugggcuucuccguggaggggcccagccaggccaagaucgagugcgacgacaagggcgacggguccugcgacgugcgcuacuggccgcaggaggccggcgaguacgccguccacgugcucugcaacagcgaggacauccggcugucccccuucauggcggacauccgcgacgccccccaggacuuccaccccgaccgggugaaggcccgcgggccgggccuggagaagaccggcgucgccgugaacaagcccgcggaguucaccguggacgccaagcacgggggcaaggccccccuccggguccaggugcaggacaacgaggggugccccguggaggcccuggucaaggacaacggcaacgggaccuacagcugcuccuacgugccgcgcaagcccgugaagcacacggccauggucagcuggggcggcgugagcauccccaacucccccuuccgggugaacgucggggcgggcagccacccgaacaaggugaagguguacgggcccggcgucgccaagaccggccugaaggcccacgagcccaccuacuucaccguggacugcgccgaggccgggcagggcgacguguccaucgggaucaagugcgcgcccggcgucguggggccggccgaggccgacaucgacuucgacaucauccgcaacgacaacgacacguucaccgucaaguacaccccccggggcgccggcagcuacaccaucauggugcucuucgccgaccaggcgacgcccaccuccccgauccgcgugaaggucgagcccagccacgacgccuccaaggugaaggccgaggggcccggccugagccggaccgggguggagcugggcaagcccacccacuucacggucaacgccaaggcggccgggaagggcaagcucgacgugcaguucuccggccugaccaagggggacgccgugcgcgacgucgacaucaucgaccaccacgacaacaccuacaccgugaaguacacgccggugcagcagggccccgucggggugaacgugaccuacggcggggaccccauccccaagagcccguucuccgucgccgugagccccucccuggaccugagcaagaucaagguguccggccucggcgagaaggucgacguggggaaggaccaggaguucaccgugaagagcaagggcgccgggggccagggcaaggucgcguccaagaucguggggcccagcggcgccgccgugcccugcaaggucgagccggggcugggcgccgacaacagcguggugcgguuccugccccgcgaggaggggcccuacgaggucgaggugaccuacgacggcgugcccgucccgggcucccccuucccccucgaggccguggcgcccacgaagccgagcaaggugaaggccuucgggcccggccugcaggggggcuccgccgggagccccgcccgguucaccaucgacaccaagggcgccggcaccgggggccuggggcucacggucgagggccccugcgaggcgcagcuggagugccuggacaacggggacggcaccugcuccgugagcuacgugccgaccgagcccggcgacuacaacaucaacauccucuucgccgacacccacauccccgggucccccuucaaggcccacgucgugccgugcuucgacgccagcaaggugaagugcuccggccccgggcuggagcgcgccacggcgggcgaggucgggcaguuccagguggacugcagcuccgccggcagcgccgagcugaccaucgagaucugcuccgaggccggccuccccgcggagguguacauccaggaccacggggacggcacccacaccaucacguacaucccgcugugccccggggccuacaccgucaccaucaaguacggcggccagcccgugcccaacuucccgagcaagcugcagguggagcccgccgucgacaccuccggggugcagugcuacggccccgggaucgagggccaggggguguuccgcgaggccacgaccgaguucagcgucgacgcccgggcgcucacccagaccggcggcccccacgugaaggcccgcguggccaacccguccgggaaccugaccgagacguacguccaggaccggggcgacgggauguacaagguggaguacacccccuacgaggagggccugcacagcgucgacgugaccuacgacgggucccccgugcccagcagcccguuccagguccccgugaccgagggcugcgaccccucccgcgugcggguccacggccccgggauccagagcggcacgaccaacaagccgaacaaguucaccguggagacccgcggggccggcacggggggccucggccuggccguggaggggcccuccgaggcgaagaugagcugcauggacaacaaggacggcuccugcagcgucgaguacauccccuacgaggccgggaccuacucccugaacgugaccuacggcgggcaccaggugcccggcagcccguucaagguccccgugcacgacgugaccgacgccuccaaggucaagugcagcggccccgggcucucccccggcauggugcgggccaaccugccgcagagcuuccagguggacacguccaaggccggggucgcgccccugcaggugaaggugcagggccccaagggccucgucgagcccguggacguggucgacaacgccgacgggacccagaccgugaacuacgugccgagccgcgagggccccuacuccaucagcguccuguacggggacgaggaggugccccgguccccguucaaggugaagguccugcccacccacgacgccagcaaggugaaggccuccggccccgggcucaacacgaccggcgugcccgcgagccugccggucgaguucaccaucgacgccaaggacgccggcgaggggcugcucgccgugcagaucaccgaccccgagggcaagcccaagaagacgcacauccaggacaaccacgacgggaccuacaccguggccuacguccccgacgugaccggccgcuacacgauccugaucaaguacgggggcgacgagaucccguucagccccuaccgggugcgcgcgguccccaccggcgacgccuccaagugcaccgugaccgugagcaucgggggccacgggcugggcgccgggaucggccccacgauccagaucggcgaggagaccgucaucaccguggacaccaaggccgccgggaagggcaaggugacgugcaccgucugcaccccggacggguccgagguggacguggacgucguggagaacgaggacggcaccuucgacaucuucuacacggcgccccagcccggcaaguacgugaucugcguccgguucgggggcgagcacgugcccaacagcccguuccaggucaccgcccucgccggggaccagcccuccgugcagcccccccugcgcagccagcagcuggccccgcaguacaccuacgcccagggcgggcagcagaccugggcgcccgagcggccccucgugggcgucaacggccuggacgugaccucccugcgccccuucgaccucgugaucccguucacgaucaagaagggggagaucaccggcgagguccggaugcccagcgggaagguggcccagcccaccaucaccgacaacaaggacggcacggugaccguccgcuacgccccguccgaggccgggcugcacgagauggacauccgguacgacaacaugcacauccccggcagcccccugcaguucuacguggacuacgugaacugcggccacgucaccgcguacgggcccggccucacccacgggguggugaacaagccggccacguucaccgucaacaccaaggacgccggcgaggggggccugucccuggccaucgagggccccagcaaggccgagaucuccugcaccgacaaccaggacgggacgugcagcguguccuaccuccccgugcugcccggcgacuacagcauccuggucaaguacaacgagcagcacgugccggggucccccuucaccgcgcgcgugaccggcgacgacagcaugcggaugucccaccucaaggucgggagcgccgccgacauccccaucaacaucagcgagaccgaccugucccugcucacggccaccguggugcccccgagcggccgcgaggagcccugccugcugaagcgccuccggaacggccacgucgggaucuccuucgugcccaaggagaccggcgagcaccuggugcacgucaagaagaacgggcagcacguggccagcucccccaucccgguggucaucagccaguccgagaucggcgacgcgagccgcgugcggguguccggccaggggcugcacgagggccacaccuucgagcccgccgaguucaucaucgacacgcgcgacgccggguacggcgggcucagccuguccaucgagggccccagcaaggucgacaucaacaccgaggaccuggaggacggcaccugccgggugaccuacugccccacggagccggggaacuacaucaucaacaucaaguucgccgaccagcacgugcccggcucccccuucagcgucaaggugaccggggagggccgcgugaaggaguccaucacccggcgccggcgcgcccccagcgucgcgaacguggggucccacugcgaccucagccugaagaucccggagaucuccauccaggacaugaccgcccaggugacgagccccagcggcaagacccacgaggccgagaucgucgagggcgagaaccacaccuacugcauccgguucgugcccgccgagauggggacccacacgguguccgucaaguacaagggccagcacgugcccgggagcccguuccaguucaccgugggcccccugggggagggcggcgcccacaagguccgcgcggggggccccgggcucgagcgggccgaggccggcgugccggccgaguucuccaucuggacccgcgaggcgggcgccgggggccuggccaucgccguggaggggcccagcaaggccgagaucuccuucgaggaccggaaggacggcagcugcggggucgcguacgugguccaggagcccggcgacuacgagguguccgugaaguucaacgaggagcacauccccgacagcccguucgucgugcccguggccucccccagcggcgacgcccgccggcugaccgucuccagccuccaggaguccgggcugaaggugaaccagcccgccagcuucgccgugucccugaacggcgcgaagggggccaucgacgccaagguccacagcccguccggcgcccucgaggagugcuacgugacggagaucgaccaggacaaguacgccgugcgcuucaucccccgggagaacggggucuaccugaucgacgugaaguucaacggcacccacauccccggcagccccuucaagauccgcgugggggagccgggccacgggggcgaccccgggcuggucuccgcguacggcgccggccucgaggggggcgugaccgggaaccccgccgaguucguggucaacaccagcaacgccggcgcgggggcccugagcgugacgaucgacggccccuccaaggugaagauggacugccaggagugcccggagggcuaccgcgucaccuacacccccauggcccccgggagcuaccugaucuccaucaaguacggcgggcccuaccacaucggcggcagcccguucaaggccaaggugaccgggccccggcucguguccaaccacagccugcacgagaccuccagcgucuucguggacucccugacgaaggccaccugcgcgccccagcacggcgcccccgggccgggccccgccgacgccagcaagguggucgccaaggggcucggccuguccaaggcguacgugggccagaagagcuccuucaccguggacugcagcaaggccgggaacaacaugcugcucgucggcgugcacgggccccgcacccccugcgaggagauccuggugaagcacgucggcucccggcuguacagcguguccuaccuccugaaggacaagggggaguacacgcugguggucaaguggggcgacgagcacaucccgggcagccccuaccgcguggugguccccuga

SEQ ID NO: 30204 - RNA, 7902 nt, Artificial Sequence
  derived and/or modified sequence opt1 from FLNB__Homo_sapiens__NP_001157789
augcccgugaccgagaaggaccuggccgaggacgccccguggaagaagauccagcagaacaccuucacgcgcuggugcaacgagcaccucaagugcgucaacaagcggaucggcaaccugcagaccgaccugagcgacgggcuccgccugaucgcgcugcucgaggugcugucccagaagcggauguaccgcaaguaccaccagcggcccaccuuccgccagaugcagcuggagaacgugagcgucgcccucgaguuccuggaccgggaguccaucaagcuggugagcaucgacuccaaggccaucguggacggcaaccucaagcugauccuggggcucgucuggacccugauccugcacuacagcaucuccaugcccgugugggaggacgagggcgacgacgacgccaagaagcagacgcccaagcagcgccuccugggguggauccagaacaagaucccguaccugcccaucaccaacuucaaccagaacuggcaggacggcaaggcccucggcgcgcugguggacagcugcgcccccgggcugugccccgacugggaguccugggacccgcagaagcccgucgacaacgcccgggaggccaugcagcaggcggacgacuggcucggcgugccccaggugaucacccccgaggagaucauccacccggacgucgacgagcacagcgugaugaccuaccugucccaguuccccaaggccaagcugaagcccggggccccccucaagccgaagcugaaccccaagaaggcccgcgccuacggccgggggaucgagcccacgggcaacauggugaagcagcccgcgaaguucaccgucgacaccaucagcgccggccagggggacgugaugguguucgucgaggacccggagggcaacaaggaggaggcccaggugacccccgacuccgacaagaacaagacguacagcguggaguaccugcccaaggucaccgggcuccacaaggugaccgugcuguucgccggccagcacaucuccaagagccccuucgaggucuccguggacaaggcccagggcgacgcgagcaaggucaccgccaaggggccgggccuggaggccguggggaacaucgccaacaagcccacguacuucgacaucuacaccgccggcgcgggggugggcgacaucggcgucgagguggaggacccccaggggaagaacaccguggagcuccuggucgaggacaagggcaaccagguguaccgcugcguguacaagcccaugcagccggggccccacgucgugaagaucuucuucgccggcgacaccauccccaaguccccguucgugguccaggugggggaggccugcaaccccaacgccugccgggccagcggccgcggccugcagcccaagggggugcggauccgcgagacgaccgacuucaaggucgacaccaaggcggccggcagcggggagcucggcgugaccaugaaggggcccaagggccuggaggagcuggugaagcagaaggacuuccucgacggcgucuacgccuucgaguacuacccguccacgcccgggcgguacagcaucgccaucaccuggggcgggcaccacauccccaagucccccuucgaggugcaggugggcccggaggcgggcaugcagaagguccgcgccugggggcccggccugcacgggggcaucguggggcggagcgccgacuucguggucgaguccaucggcagcgaggugggcucccugggguucgccaucgagggccccagccaggccaagaucgaguacaacgaccagaacgacggguccugcgacgugaaguacuggcccaaggagccgggcgaguacgcgguccacaucaugugcgacgacgaggacaucaaggacagccccuacauggccuucauccaccccgccaccgggggcuacaaccccgaccucgugcgcgccuacggcccggggcuggagaaguccggcugcaucgugaacaaccuggccgaguucaccgucgaccccaaggacgcggggaaggccccccucaagaucuucgcccaggacggcgaggggcagcggaucgacauccagaugaagaaccgcauggacggcacguacgccugcagcuacacccccgugaaggccaucaagcacaccaucgcgguggucuggggcggggugaacaucccgcacucccccuaccgcgugaacaucggccaggggagccacccccagaaggucaagguguucggccccgggguggagcgguccggccugaaggccaacgagccgacccacuucacggucgacugcaccgaggccggcgagggggacgugagcgugggcaucaagugcgacgcccgcguccuguccgaggacgaggaggacguggacuucgacaucauccacaacgcgaacgacaccuucaccgugaaguacgucccccccgccgccgggcgguacacgaucaaggugcucuucgccagccaggagaucccggccucccccuuccgcgugaaggucgaccccagccacgacgcgagcaaggugaaggccgagggccccggccuguccaaggccgggguggagaacggcaagccgacccacuucaccgucuacaccaagggggccggcaaggccccccugaacgugcaguucaacagcccccugcccggggacgcggucaaggaccucgacaucaucgacaacuacgacuacucccacaccgugaaguacacgccgacccagcagggcaacaugcaggugcuggucaccuacggcggggaccccauccccaagagccccuucaccgugggcguggccgccccgcuggaccucuccaagaucaagcugaacgggcuggagaaccgggucgaggugggcaaggaccaggaguucacgguggacacccgcggggccggcggccaggggaagcucgacgucaccauccugagccccucccggaagguggugcccugccuggucacccccgugacgggccgcgagaacagcaccgccaaguucaucccgcgggaggaggggcucuacgcgguggacgucaccuacgacggccaccccgugcccgggucccccuacaccguggaggccagccugccgcccgaccccuccaaggucaaggcccacggccccggccuggaggggggccucguggggaagccggccgaguucacgaucgacaccaagggcgcgggcaccgggggccuggggcugaccguggagggccccugcgaggccaagaucgagugcagcgacaacggggacggcacgugcuccgucagcuaccuccccaccaagcccggcgaguacuucgugaacauccuguucgaggaggugcacaucccggggucccccuucaaggccgacaucgagaugcccuucgacccgagcaaggucguggccuccggccccgggcuggagcacggcaaggugggggaggccggccuccugagcgucgacugcagcgaggcgggccccggggcccugggccucgaggccguguccgacagcgggaccaaggccgagguguccauccagaacaacaaggacggcaccuacgccgucacguacgugccccugaccgcggggauguacacccugaccaugaaguacggcggcgagcucgugccgcacuuccccgcccgcgucaagguggagcccgccguggacacgagccggaucaaggucuucgggcccggcaucgaggggaaggacguguuccgcgaggccaccaccgacuucaccguggacucccggccgcugacgcaggucggcggggaccacaucaaggcccacaucgcgaaccccagcggcgccuccaccgagugcuucgugaccgacaacgccgacggcaccuaccagguggaguacacgcccuucgagaaggggcugcacgucguggaggugaccuacgacgacguccccaucccgaacagccccuucaagguggccgugaccgagggcugccagcccucccgcguccaggcccaggggcccggccucaaggaggcguucaccaacaagccgaacguguucacgguggucacccggggcgccgggaucggcgggcugggcaucaccguggaggggcccagcgaguccaagaucaacugccgcgacaacaaggacggcagcugcuccgccgaguacauccccuucgcccccggcgacuacgacgucaacaucaccuacgggggcgcgcacaucccggggagccccuuccgggugcccgugaaggacgucguggaccccuccaaggugaagaucgccggcccggggcugggcagcggcguccgcgcccgggugcuccaguccuucaccguggacagcuccaaggccgggcuggccccccuggagguccgcgugcucggcccccgcgcggacgacacggacagccagagcuggcgguccccccugaaggcccugagcgaguucuucaagggggacccgaagggcgacuucaacaagaccgggcucguggagcccgucaacgugguggacaacggcgacggcacccacaccgucacguacacccccucccaggaggggccguacauggugagcgugaaguacgccgacgaggagaucccccgcucccccuucaaggucaaggugcugcccaccuacgacgccagcaaggugaccgccuccggcccggggcugagcuccuacggcguccccgcgagccuccccguggacuucgccaucgacgcccgggacgccggggagggccugcuggccgugcagaucacggaccaggagggcaagcccaagcgcgcgaucguccacgacaacaaggacgggaccuacgccgugaccuacaucccggacaagaccggccgguacaugaucggggugacguacggcggcgacgacaucccccucucccccuaccgcauccgggccacccagaccggggacgccagcaagugccuggcgaccggccccgggaucgccuccacggucaagaccggcgaggaggugggguucguggucgacgccaagaccgccggcaagggcaaggugaccugcacggugcugaccccggacgggaccgaggccgaggcggacgucaucgagaacgaggacggcaccuacgacaucuucuacacggccgccaagcccgggaccuacgugaucuacgugcgcuucggcggggucgacauccccaacagccccuucaccgugauggccaccgacggcgaggugacggccgucgaggaggcgccggugaacgccugcccccccggcuuccggcccugggugaccgaggaggccuacgucccgguguccgacaugaacgggcucggcuucaagcccuucgaccuggugauccccuucgccguccgcaagggggagaucaccggcgaggugcacaugcccagcgggaagaccgccacgccggagaucguggacaacaaggacggcaccgucaccgugcgguacgcgcccaccgaggugggccugcacgagaugcacaucaaguacauggggucccacauccccgagagcccgcuccaguucuacgucaacuaccccaacuccggcagcgugagcgccuacgggcccggccuggucuacggcguggccaacaagacggccaccuucaccaucgugaccgaggacgcgggggagggcgggcuggaccucgccaucgagggccccuccaaggccgagaucagcugcaucgacaacaaggacgggaccugcacggucaccuaccugccgacccugcccggcgacuacuccauccucgugaaguacaacgacaagcacauccccggcagccccuucaccgccaagaucacggacgacucccgccggugcagccaggugaagcugggguccgccgcggacuuccugcucgacaucagcgagaccgaccuguccagccugaccgccuccaucaaggccccgagcggccgcgacgagcccugccuccugaagcggcugcccaacaaccacaucgggaucuccuucaucccccgcgaggucggcgagcaccucgugagcaucaagaagaacgggaaccacguggccaacuccccggucagcaucaugguggugcaguccgagaucggcgacgcccggcgcgcgaaggucuacggccgggggcugagcgagggccgcaccuucgagauguccgacuucaucguggacacgcgggacgccggguacggcgggaucagccuggccguggagggccccagcaaggucgacauccagaccgaggaccucgaggacggcaccugcaagguguccuacuuccccaccgugcccggggucuacaucgugagcacgaaguucgccgacgagcacgugccgggcucccccuucaccgucaagaucagcggggagggccgcgugaaggaguccaucacccgcaccagccgggcccccuccguggcgacggucgggagcaucugcgaccugaaccugaagauccccgagaucaacuccagcgacauguccgcccacgugaccagcccguccggccgcgugaccgaggccgagaucguccccaugggcaagaacagccacugcgugcgguucgugccccaggagauggggguccacaccguguccgugaaguaccgcggccagcacgucacggggagccccuuccaguucaccgugggcccgcucggcgaggggggcgcccacaaggugcgggccgggggccccgggcuggagcgcggcgaggcgggcguccccgccgaguucuccaucuggacccgggaggccggggccggcgggcugagcaucgcgguggagggccccuccaaggccgagaucaccuucgacgaccacaagaacgggagcugcggcgugagcuacaucgcccaggagccgggcaacuacgaggucuccaucaaguucaacgacgagcacauccccgagagccccuaccucgugccggugaucgcccccuccgacgacgcccgccggcugacggucaugagccugcaggaguccgggcucaaggugaaccagcccgcgagcuucgccauccgccugaacggcgccaaggggaagaucgacgccaaggugcacucccccagcggcgccgucgaggagugccacguguccgagcuggagccggacaaguacgcggugcgguucaucccccacgagaacgggguccacaccaucgacgugaaguucaacggcagccacguggucggcucccccuucaaggugcgcgucggggagcccggccaggccgggaacccggcccucgugagcgccuacggcaccggccuggaggggggcaccacggggauccaguccgaguucuucaucaacaccacccgggccggccccgggacccugagcgugacgaucgagggccccuccaaggucaagauggacugccaggagacccccgagggcuacaaggugauguacaccccgauggcgcccgggaacuaccucaucagcgugaaguacggcgggcccaaccacaucgucggcucccccuucaaggccaaggugaccgggcagcgccuggugagcccgggcuccgccaacgagacgagcagcauccuggucgaguccgugacccggagcuccaccgagaccugcuacagcgccauccccaaggcguccagcgacgccuccaaggugacgagcaagggcgccgggcucuccaaggccuucgucggccagaagagcuccuuccugguggacugcagcaaggccggguccaacaugcugcucaucggcgugcacgggcccaccacccccugcgaggaggucagcaugaagcacgugggcaaccagcaguacaacgugaccuacgucgugaaggagcgcggcgacuacgugcuggcggucaaguggggggaggagcacaucccgggcucccccuuccacgugaccgugcccuga

SEQ ID NO: 30205 - RNA, 8079 nt, Artificial Sequence
  derived and/or modified sequence opt1 from FLNC__Homo_sapiens__NP_001120959
augaugaacaacagcggcuacuccgacgccgggcugggccucggggacgagaccgacgagaugcccagcaccgagaaggaccuggccgaggacgcccccuggaagaagauccagcagaacacguucacccgcuggugcaacgagcaccugaagugcgucggcaagcggcucaccgaccugcagcgggaccuguccgacgggcuccggcugaucgcccugcucgagguccugagccagaagcgcauguaccggaaguuccacccccgccccaacuuccggcagaugaagcuggagaacguguccguggcccucgaguuccuggagcgcgagcacaucaagcuggucagcaucgacuccaaggccaucguggacggcaaccucaagcugauccugggccucaucuggacccugauccugcacuacagcaucuccaugcccaugugggaggacgaggacgacgaggacgcccggaagcagacgccgaagcagcgccuccugggguggauccagaacaaggugccccagcugcccaucaccaacuucaaccgggacuggcaggacggcaaggcccucggggcccuggucgacaacugcgcccccggccugugccccgacugggaggccugggaccccaaccagcccguggagaacgcgcgcgaggccaugcagcaggccgacgacuggcucggggugccccaggucaucgccccggaggagaucguggaccccaacguggacgagcacagcgucaugaccuaccugucccaguuccccaaggccaagcugaagcccggcgcgccggugcggagcaagcagcucaaccccaagaaggccaucgccuacggccccgggaucgagccccagggcaacaccgugcugcagccggcccacuucacgguccagaccguggacgccggggugggcgagguccugguguacaucgaggaccccgagggccacaccgaggaggcgaaggugguccccaacaacgacaaggaccgcaccuacgccguguccuacgugcccaaggucgccgggcuccacaaggugacgguccuguucgccggccagaacaucgagcggagcccguucgaggugaacguggggauggcccugggcgacgcgaacaaggucuccgcccgcgggcccggccucgagcccgugggcaacguggccaacaagcccaccuacuucgacaucuacaccgccggggccggcaccggggacgucgcgguggugaucgucgacccgcagggccggcgcgacacgguggagguggcccuggaggacaagggggacagcaccuuccggugcaccuaccgccccgccauggagggcccccacaccguccacguggccuucgcgggcgccccgaucacgcggucccccuuccccgugcacgucagcgaggccugcaaccccaacgccugccgcgccuccgggcgcggccugcagccgaagggggugcgggugaaggaggucgcggacuucaagguguucaccaagggcgccgggagcggcgagcucaaggugaccgucaagggccccaaggggaccgaggagcccgugaaggugcgcgaggccggcgacggggucuucgagugcgaguacuaccccguggugccgggcaaguacgucgugacgaucaccuggggcggguacgccaucccccggagccccuucgaggugcaggucucccccgaggccggcgugcagaaggugcgcgcgugggggccgggccuggagaccgggcaggucggcaagagcgccgacuucgugguggaggccaucggcaccgaggucgggacgcugggcuucuccaucgaggggcccagccaggccaagaucgagugcgacgacaagggcgacggguccugcgacgugcgguacuggcccaccgagcccggcgaguacgccgugcacgucaucugcgacgacgaggacauccgcgacagcccguucaucgcgcacauccuccccgcgccgcccgacugcuucccggacaaggugaaggccuucggccccgggcuggagcccaccggcugcaucguggacaagcccgccgaguucaccaucgacgcgcgggccgccgggaagggcgaccugaagcucuacgcccaggacgccgacgggugcccgaucgacaucaaggucauccccaacggcgacggcacguuccgcugcuccuacgugcccaccaagccgaucaagcacaccaucaucaucagcuggggcggggugaacguccccaagucccccuuccgggugaacgugggggagggcagccaccccgagcgcgucaagguguacgggccgggcguggagaagaccggccugaaggcgaacgagcccacguacuucaccgucgacugcuccgaggccgggcagggcgacgugagcaucgggaucaagugcgcccccggcgucgugggccccgccgaggccgacaucgacuucgacaucaucaagaacgacaacgacaccuucaccgugaaguacaccccgcccggggcgggccgguacacgaucaugguccuguucgccaaccaggagauccccgccucccccuuccacaucaagguggacccgagccacgacgccuccaaggugaaggccgaggggcccggccucaaccgcaccggggucgaggugggcaagcccacccacuucaccgugcugacgaagggcgcggggaaggccaagcuggacguccaguucgccggcaccgccaagggggagguggugcgggacuucgagaucaucgacaaccacgacuacagcuacaccgucaaguacaccgcggugcagcagggcaacauggccgugacggucaccuacgggggcgaccccgugccgaagucccccuucguggucaacguggcgccgccccuggaccucagcaagaucaaggugcagggccugaacuccaaggucgccguggggcaggagcaggccuucagcgugaacacccgcggcgccggcgggcaggggcagcuggacguccggaugaccagcccgucccgccggcccauccccugcaagcucgagcccgggggcggggccgaggcccaggccgugcgcuacaugccgcccgaggagggccccuacaagguggacaucacguacgacgggcaccccgucccgggcagccccuucgccguggagggcgugcugcccccggaccccuccaaggucugcgcguacgggcccggccugaagggcggccucguggggacccccgccccguucagcaucgacaccaagggcgccggcaccgggggccuggggcugacgguggagggccccugcgaggccaagaucgagugccaggacaacggggacggcuccugcgccgucagcuaccuccccaccgagcccggcgaguacaccaucaacauccuguucgcggaggcccacaucccggggucccccuucaaggccaccauccggcccguguucgaccccagcaaggugcgcgccuccggcccggggcuggagcgcggcaaggucggggaggccgcgacguucaccguggacugcagcgaggccggcgaggccgagcucaccaucgagauccuguccgacgccggcgugaaggcggagguccugauccacaacaacgccgacgggaccuaccacaucacguacagccccgccuuccccggcaccuacaccaucaccaucaaguacgggggccaccccgugccgaaguuccccacgcgggugcacguccagcccgccguggacaccuccggggugaaggucagcggccccggcguggagccgcacggggugcuccgcgaggucaccaccgaguucacgguggacgcccggucccugaccgcgaccggcgggaaccacgugaccgcccgcguccugaaccccagcggcgccaagacggacaccuacgugaccgacaacggcgacgggaccuaccggguccaguacaccgccuacgaggagggcgugcaccucguggagguccuguacgacgagguggccgugcccaagucccccuuccgcgucggggugacggagggcugcgacccgacccgggugcgcgcguucgggcccggccuggagggcgggcucgucaacaaggccaaccgguucaccguggagacccgcggcgccgggacgggcgggcugggccuggccaucgagggccccagcgaggccaagaugagcugcaaggacaacaaggacggguccugcaccguggaguacauccccuucaccccgggcgacuacgacgucaacaucaccuucgggggccggcccauccccgggagcccguuccgcgugcccgugaaggacgucguggaccccggcaaggugaagugcuccggccccgggcucggcgcggggguccgggcccgcgugccgcagacguucaccguggacugcagccaggccggccgggcgccccugcaggucgcggugcuggggcccaccggcguggccgagcccgucgaggugcgcgacaacggcgacgggacccacacggugcacuacaccccggccaccgacggccccuacaccgucgccgugaaguacgccgaccaggaggugccccggucccccuucaagaucaagguccucccggcgcacgacgccagcaaggugcgcgccuccgggcccggccugaacgccagcggcauccccgccucccugcccguggaguucacgaucgacgcgcgggacgccggggagggccuccugaccguccagauccuggacccggaggggaagcccaagaaggccaacauccgcgacaacggcgacgggaccuacaccgugagcuaccuccccgacauguccggccgguacacgaucaccaucaaguacggcggggacgagauccccuacagcccguuccgcauccacgcccugcccaccggcgacgccuccaagugccuggugaccgucagcaucgggggccacgggcucggcgcgugccugggcccccgcauccagaucgggcaggagacggugaucaccguggacgccaaggccgccggcgaggggaaggugaccugcaccguguccacgcccgacggcgcggagcuggacguggacgucguggagaaccacgacgggaccuucgacaucuacuacaccgccccggagcccggcaaguacgugaucaccauccgguucggcggggagcacauccccaacagcccguuccacguccucgccacggaggagcccguggugcccgucgagcccauggaguccaugcugcgcccguucaaccuggugauccccuucgccgugcagaagggcgagcucaccggggagguccggaugcccagcggcaagaccgcccgccccaacaucaccgacaacaaggacggcacgaucaccgugcgguacgcgccgaccgagaaggggcugcaccagaugggcaucaaguacgacgggaaccacauccccggcagcccccugcaguucuacgucgacgccaucaacagccgccacgugagcgccuacgggcccggccucucccacggcauggugaacaagccggccaccuucaccaucgucacgaaggacgccggggagggcgggcugagccuggcgguggagggccccuccaaggccgagaucacgugcaaggacaacaaggacgggaccugcaccgugagcuaccuccccacggcccccggcgacuacuccaucaucguccgguucgacgacaagcacaucccgggcagccccuucaccgccaagaucaccggggacgacuccaugcgcaccagccagcugaacgugggcacguccaccgacgugagccugaagaucaccgaguccgaccucagccagcugaccgccuccauccgggcgcccagcgggaacgaggagcccugccugcucaagcgccugccgaaccggcacaucggcaucuccuucacgcccaaggaggucggggagcacguggugagcguccgcaaguccggcaagcacgugaccaacagccccuucaagauccuggugggccccuccgagaucggggacgccagcaagguccggguguggggcaaggggcucagcgagggccacaccuuccagguggccgaguucaucgucgacacccgcaacgccggguacggcggccuggggcuguccaucgagggcccgagcaagguggacaucaacugcgaggacauggaggacgggacgugcaaggugaccuacugccccaccgagcccggcaccuacaucaucaacaucaaguucgccgacaagcacguccccggcuccccguucacggugaaggugaccggggagggccggaugaaggagagcaucacccgccggcgccaggcgcccuccaucgccaccaucgggagcacgugcgaccucaaccugaagauccccggcaacugguuccagauggucuccgcccaggagcggcugacccgcaccuucacccgcagcucccacacguacacccggaccgagcgcaccgagaucagcaagacgcgcgggggcgagaccaagcgcgaggugcggguggaggaguccacccaggucggcggggacccguuccccgccguguucggcgacuuccucgggcgcgagcggcugggcagcuucggguccaucacccgccagcaggagggcgaggcgagcucccaggacaugacggcccaggugaccagccccuccggcaaggucgaggccgccgagaucguggagggggaggacagcgccuacuccgugcgguucgucccccaggagaugggcccgcacaccguggcggugaaguaccgcgggcagcacguccccggcagccccuuccaguucaccguggggccccugggcgagggcggggcccacaaggugcgggccggcgggacgggccucgagcgcggcgucgccggggugccggccgaguucagcaucuggacccgggaggcgggcgccgggggccuguccaucgccguggaggggcccagcaaggccgagaucgccuucgaggaccgcaaggacggcuccugcggcgucagcuacguggugcaggagcccggggacuacgaggucuccaucaaguucaacgacgagcacauccccgacagcccguucguggugcccgucgcgucccugagcgacgacgcccggcgccucaccgugaccucccugcaggagaccggccugaaggugaaccagcccgccagcuucgccguccagcucaacggggcgcggggcgugaucgacgcccgcguccacacgcccuccggggccguggaggagugcuacgugagcgagcuggacuccgacaagcacaccauccgguucaucccgcacgagaacggcguccacagcaucgacgugaaguucaacggcgcccacauccccgggucccccuucaagauccgcgugggcgagcagagccaggccggggaccccggccuggucuccgcguacgggccgggccucgagggcgggaccaccggcgugagcuccgaguucaucgugaacacgcugaacgccgggagcggcgcccugagcgucaccaucgacgggcccuccaaggugcagcucgacugccgggagugccccgagggccacguggucaccuacacccccauggccccgggcaacuaccugaucgccaucaaguacgggggcccccagcacaucguggggagccccuucaaggcgaaggugacgggcccccgccuguccggcgggcacagccuccacgagaccuccaccguccugguggagaccgugaccaaguccuccagcucccgcggcagcuccuacagcuccaucccgaaguucagcuccgacgccagcaaggucgugacccgggggcccggccugucccaggccuucguggggcagaagaacagcuucaccgucgacugcuccaaggccggcaccaacaugaugauggugggcgugcacgggcccaagacgccgugcgaggaggucuacgugaagcacaugggcaaccgcguguacaacgucaccuacaccgugaaggagaagggggacuacauccucaucgugaaguggggcgacgagagcguccccgggagccccuucaaggugaaggugcccuga

SEQ ID NO: 30206 - RNA, 1284 nt, Artificial Sequence
  derived and/or modified sequence opt1 from FLOT1__Homo_sapiens__NP_005794
auguucuucacgugcggccccaacgaggccaugguggucagcggguucugccgcuccccgcccgugaugguggccggcgggcgggucuucgugcugcccugcauccagcagauccagcgcaucagccucaacacccugacccugaacgugaaguccgagaaggucuacacccggcacggcgugcccaucagcgugaccgggaucgcgcaggucaagauccagggccagaacaaggagaugcucgccgccgccugccagauguuccugggcaagaccgaggccgagaucgcgcacaucgcccuggagacgcucgaggggcaccagcgcgccaucauggcccacaugaccguggaggagaucuacaaggaccggcagaaguucuccgagcaggucuucaagguggcgagcuccgaccuggugaacaugggcaucagcguggucuccuacacccugaaggacauccacgacgaccaggacuaccuccacagccuggggaaggcccgcaccgcccaggugcagaaggacgcccggaucggcgaggccgaggcgaagcgcgacgccgggauccgggaggccaaggccaagcaggagaagguguccgcccaguaccugagcgagaucgagauggcgaaggcccagcgcgacuacgagcucaagaaggccgccuacgacaucgaggucaacacgcggcgcgcccaggcggaccuggccuaccagcuccagguggccaagaccaagcagcagaucgaggagcagcgggugcagguccaggugguggagcgcgcccagcaggucgccgugcaggagcaggagaucgcgcggcgcgagaaggagcuggaggcccggguccgcaagccggccgaggccgagcgguacaagcuggagcgccuggcggaggccgagaagucccagcucaucaugcaggccgaggccgaggccgcgagcgugcggaugcgcggcgaggccgaggccuucgccaucggcgcccgcgcgcgggccgaggccgagcagauggccaagaaggccgaggcguuccagcuguaccaggaggccgcccagcuggacaugcuccuggagaagcugccccagguggccgaggagaucuccgggccccucaccagcgcgaacaagaucacccuggucuccagcggcuccgggacgaugggcgccgccaaggugaccggcgaggugcuggacauccucacccgccugcccgagagcgucgagcggcugaccggggugagcaucucccaggugaaccacaagccgcuccgcacggccuga

SEQ ID NO: 30207 - RNA, 1287 nt, Artificial Sequence
  derived and/or modified sequence opt1 from FLOT2__Homo_sapiens__NP_004466
augggcaacugccacaccguggggcccaacgaggcccuggucgugagcggcgggugcugcggcuccgacuacaagcaguacguguucgggggcugggccugggcgugguggugcaucagcgacacccagcgcaucucccucgagaucaugacgcugcagccgcggugcgaggacgucgagaccgccgagggcguggcccugaccgugaccggggucgcccaggugaagaucaugacggagaaggagcuccuggccguggcgugcgagcaguuccugggcaagaacguccaggacaucaagaacguggugcuccagacccuggaggggcaccuccgcagcauccugggcacccugaccgucgagcagaucuaccaggaccgggaccaguucgccaagcuggugcgcgagguggccgcccccgacgucgggcggaugggcaucgagauccucuccuucacgaucaaggacguguacgacaagguggacuaccugagcucccugggcaagacccagaccgcggucgugcagcgcgacgccgacaucgggguggccgaggccgagcgggacgccggcauccgcgaggcggagugcaagaaggagaugcucgacgucaaguucauggccgacaccaagaucgccgacagcaagcgggccuucgagcugcagaaguccgccuucagcgaggaggugaacaucaagacggcggaggcccagcuggccuacgagcuccagggggcccgcgagcagcagaagauccggcaggaggagaucgagaucgaggugguccagcgcaagaagcagaucgccguggaggcgcaggagauccugcggaccgacaaggagcugaucgccaccguccgccggcccgccgaggccgaggcccaccgcauccagcagaucgcggagggcgagaaggugaagcagguccuccuggcccaggccgaggccgagaagauccggaagaucggcgaggcggaggccgccgugaucgaggccauggggaaggccgaggcggagcgcaugaagcugaaggccgaggccuaccagaaguacggcgacgccgccaagauggcgcucgugcuggaggcccugccccagaucgccgccaagaucgccgcgccgcucaccaagguggacgagaucgucgugcuguccggggacaacagcaaggugacguccgaggucaaccggcugcucgccgagcugcccgccagcgugcacgcccugaccggcguggaccucuccaagaucccccugaucaagaaggcgaccgggguccagguguga

SEQ ID NO: 30208 - RNA, 1983 nt, Artificial Sequence
  derived and/or modified sequence opt1 from FLRT2__Homo_sapiens__NP_037363
augggccugcagaccaccaaguggcccagccacggggccuucuuccucaaguccuggcugaucaucagccugggccucuacucccaggugagcaagcugcuggccugcccguccgucugccgcugcgaccggaacuucguguacugcaacgagcgcagccucacguccgugccccuggggauccccgagggcgucaccgugcuguaccuccacaacaaccagaucaacaacgcgggguuccccgccgagcugcacaacgugcagagcguccacaccguguaccuguacggcaaccagcucgacgaguucccgaugaaccugcccaagaacgugcggguccugcaccuccaggagaacaacauccagaccaucucccgcgccgcccuggcccagcugcucaagcuggaggagcugcaccucgacgacaacagcaucuccacggugggcguggaggacggggcguuccgggaggccaucagccugaagcuccuguuccuguccaagaaccaccugagcuccguccccgugggccuccccguggaccugcaggagcugcgcgucgacgagaaccggaucgccgugaucagcgacauggccuuccagaaccucaccucccuggagcgccugaucguggacgggaaccuccugaccaacaagggcaucgcggaggggaccuucagccaccugacgaagcucaaggaguucuccaucguccggaacagccugagccacccgccgcccgaccugcccggcacccaccucauccgccuguaccugcaggacaaccagaucaaccacaucccccucaccgccuucuccaaccugcggaagcuggagcgccucgacaucagcaacaaccagcugcggaugcugacccagggcguguucgacaaccucuccaaccugaagcagcugacggcccgcaacaaccccugguucugcgacugcagcaucaagugggugaccgaguggcugaaguacauccccuccagccucaacguccggggguucaugugccagggccccgagcagguccgcgggauggccgugcgggagcugaacaugaaccugcucuccugcccgaccaccacgcccggccugccccuguucacccccgccccgagcaccgcgucccccaccacgcagccgcccacccucagcauccccaaccccucccgcagcuacaccccgcccacccccacgaccuccaagcugcccaccauccccgacugggacggccgggagcgcgugaccccgcccaucagcgagcggauccagcuguccauccacuucgugaacgacacgagcauccaggucuccuggcucagccuguucaccgugauggccuacaagcugaccugggugaagauggggcacucccucgucggcgggaucgugcaggagcgcaucgugagcggcgagaagcagcaccugagccuggucaaccucgagccccgcuccaccuaccggaucugccuggugccccuggacgccuucaacuaccgcgccguggaggacacgaucugcagcgaggccaccacccacgcguccuaccucaacaacgggagcaacaccgccuccagccacgagcagacgaccucccacagcaugggcuccccguuccugcuggccggccucaucgggggcgccgucaucuucgugcuggugguccugcucagcguguucugcuggcacaugcacaagaaggggcgguacaccucccagaaguggaaguacaaccgcggccggcgcaaggacgacuacugcgaggccgggaccaagaaggacaacagcauccuggagaugaccgagacguccuuccagaucgugagccugaacaacgaccagcuccugaagggcgacuuccggcugcagcccaucuacacccccaacggcgggaucaacuacaccgacugccacauccccaacaacaugcgcuacugcaacuccagcgucccggaccucgagcacugccacaccuga

SEQ ID NO: 30209 - RNA, 1950 nt, Artificial Sequence
  derived and/or modified sequence opt1 from FLRT3__Homo_sapiens__NP_938205
augaucagcgccgccugguccaucuuccugaucggcaccaagaucgggcuguuccuccagguggcgccccugagcgucauggccaaguccugcccgagcgugugccgcugcgacgccggcuucaucuacugcaacgaccgguuccucaccuccauccccacggggauccccgaggacgccaccacccuguaccugcagaacaaccagaucaacaacgccggcauccccagcgaccucaagaaccugcugaagguggagcgcaucuaccucuaccacaacucccuggacgaguucccgaccaaccugcccaaguacgucaaggagcuccaccuccaggagaacaacauccggacgaucaccuacgacagccuguccaagauccccuaccucgaggagcugcaccuggacgacaacagcguguccgcggugagcaucgaggagggggccuuccgcgacuccaacuaccuccggcugcuguuccucagccgcaaccaccuguccaccauccccuggggccugccgcggaccaucgaggagcuccgccuggacgacaaccggaucagcacgaucuccagccccucccugcagggccucaccagccugaagcgccugguccucgacgggaaccugcugaacaaccacggccucggggacaagguguucuucaaccuggugaaccugaccgagcucagccugguccggaacucccugaccgccgcccccgugaaccuccccggcacgaaccugcgcaagcuguaccuccaggacaaccacaucaaccgggugccgcccaacgcguucagcuaccugcgccagcuguaccggcucgacauguccaacaacaaccugagcaaccugccccaggggaucuucgacgaccucgacaacaucacccagcugauccugcgcaacaaccccugguacugcggcugcaagaugaaguggguccgggacuggcugcagucccucccggugaaggugaacguccgcggccugaugugccaggcccccgagaaggugcgggggauggccaucaaggaccugaacgccgagcuguucgacugcaaggacagcggcaucguguccaccauccagaucaccacggccauccccaacaccgucuaccccgcgcaggggcaguggccggcccccgugaccaagcagcccgacaucaagaaccccaagcugaccaaggaccaccagacgaccggcagcccgucccgcaagaccaucaccaucacggucaagagcgugaccuccgacaccauccacaucagcuggaagcuggcccuccccaugaccgcccugcggcuguccuggcucaagcugggccacagccccgccuucggguccaucacggagaccaucgugaccggcgagcgcagcgaguaccuggugaccgcgcucgagcccgacuccccguacaaggucugcauggugcccauggagacgagcaaccuguaccuguucgacgagacccccgucugcaucgagaccgagaccgccccgcuccgcauguacaaccccacgaccacccugaaccgggagcaggagaaggagcccuacaagaaccccaaccugccgcucgccgccaucaucgggggcgccguggcgcuggugaccaucgcccugcucgcccuggucugcugguacgugcaccgcaacgggucccuguucagccggaacugcgccuacagcaagggccgccggcgcaaggacgacuacgccgaggcgggcaccaagaaggacaacuccauccucgagauccgggagacgagcuuccagaugcugcccaucuccaacgagcccaucagcaaggaggaguucgugauccacaccaucuucccgcccaacgggaugaaccuguacaagaacaaccacuccgagagcuccagcaaccgcuccuaccgggacagcggcauccccgacuccgaccacagccacuccuga

SEQ ID NO: 30210 - RNA, 2064 nt, Artificial Sequence
  derived and/or modified sequence opt1 from FLT1__Homo_sapiens__NP_001153392
auggugagcuacugggacaccggcguccugcucugcgcccugcuguccugccuccugcugaccgggagcuccagcggcuccaagcucaaggaccccgagcugagccugaaggggacgcagcacaucaugcaggccggccagacccuccaccuccagugccgcggggaggcggcccacaaguggucccugccggagauggugagcaaggaguccgagcggcugagcaucaccaaguccgccugcggccgcaacggcaagcaguucugcagcacccugacgcugaacaccgcccaggccaaccacaccggguucuacuccugcaaguaccucgcggugcccaccagcaagaagaaggagacggaguccgccaucuacaucuucaucagcgacaccggccggcccuucgucgagauguacuccgagauccccgagaucauccacaugaccgaggggcgcgagcuggugaucccgugccgggugaccagccccaacaucacggucacccugaagaaguucccccucgacacccugauccccgacggcaagcgcaucaucugggacucccggaagggguucaucaucagcaacgccaccuacaaggagaucggccugcucacgugcgaggccaccgugaacggccaccuguacaagaccaacuaccugacccaccgccagacgaacaccaucaucgacgugcagaucagcaccccgcggcccgucaagcuccugcgcgggcacacccuggugcucaacugcacggcgaccacgccccugaacacccgggugcagaugaccugguccuaccccgacgagaagaacaagcgcgccagcguccggcgccggaucgaccaguccaacagccacgccaacaucuucuacuccgugcugaccaucgacaagaugcagaacaaggacaagggccucuacacgugccgcgugcggagcgggccguccuucaagagcgucaacaccuccgugcacaucuacgacaaggccuucaucaccgugaagcaccgcaagcagcagguccuggagaccguggccggcaagcggagcuaccgccuguccaugaaggugaaggcguuccccagccccgaggucguguggcucaaggacggccugcccgccaccgagaaguccgcccgguaccugacccgcggguacagccucaucaucaaggacgugacggaggaggacgccggcaacuacaccauccugcuguccaucaagcagagcaacgucuucaagaaccucaccgccacccugaucgugaacgucaagccgcagaucuacgagaaggcgguguccagcuuccccgaccccgcccuguacccccucgggucccgccagauccugaccugcacggccuacggcaucccgcagcccaccaucaagugguucuggcaccccugcaaccacaaccacagcgaggcccggugcgacuucugcagcaacaacgaggaguccuucauccuggacgccgacagcaacauggggaaccgcaucgaguccaucacccagcggauggcgaucaucgagggcaagaacaagauggccagcacccucguggucgccgacucccgcaucagcggcaucuacaucugcaucgccuccaacaagguggggacggugggccggaacaucagcuucuacaucaccgacguccccaacggguuccacgugaaccuggagaagaugccgaccgagggcgaggaccugaagcucuccugcaccgugaacaaguuccuguaccgcgacgucacguggauccugcugcggaccgugaacaaccgcaccaugcacuacagcaucuccaagcagaagauggccaucaccaaggagcacagcaucacgcucaaccugaccaucaugaacgugucccugcaggacagcgggaccuacgcgugccgggcccgcaacgucuacaccggcgaggagauccuccagaagaaggagaucacgauccggggcgagcacugcaacaagaaggccguguucucccgcaucagcaaguucaaguccacccggaacgacugcaccacccagagcaacgugaagcacuga

SEQ ID NO: 30211 - RNA, 2982 nt, Artificial Sequence
  derived and/or modified sequence opt1 from FLT3__Homo_sapiens__NP_004110
augcccgcccuggcccgcgacggcgggcagcucccgcugcugguggucuucagcgcgaugaucuucggcaccaucaccaaccaggaccuccccgugaucaagugcgugcugaucaaccacaagaacaacgacuccagcgucgggaaguccagcuccuaccccauggugagcgagucccccgaggaccugggcugcgcccuccggccgcagagcuccgggacgguguacgaggccgccgccgucgagguggacgugagcgcguccaucacccugcagguccugguggacgcccccggcaacaucagcugccucuggguguucaagcacuccagccugaacugccagccccacuucgaccugcagaaccgcggcgucguguccauggugauccucaagaugaccgagacccaggccggggaguaccugcuguucauccagagcgaggccacgaacuacaccauccucuucaccgucuccauccggaacacccugcuguacacgcuccgccggcccuacuuccgcaagauggagaaccaggacgcgcuggugugcaucagcgaguccgugccggagcccaucgucgagugggugcugugcgacagccagggcgagagcugcaaggaggagucccccgccguggucaagaaggaggagaaggugcuccacgagcuguucgggaccgacauccggugcugcgcccgcaacgagcugggccgggagugcacccgccucuucaccaucgaccugaaccagacgccccagaccacccugccgcagcuguuccugaaggugggggagccccuguggauccggugcaaggccguccacgugaaccacggcuucggccucaccugggagcuggagaacaaggcccuggaggaggggaacuacuucgagaugagcacguacuccaccaaccgcaccaugauccggauccucuucgcguucgucagcuccguggcccgcaacgacaccggcuacuacacgugcagcuccagcaagcaccccucccagagcgcccuggugaccaucgucgagaagggguucaucaacgccaccaacuccagcgaggacuacgagaucgaccaguacgaggaguucugcuucuccgugcgguucaaggccuacccccagauccgcugcaccuggacguucagccggaaguccuucccgugcgagcagaagggccuggacaacggcuacagcaucuccaaguucugcaaccacaagcaccagcccggggaguacaucuuccacgcggagaacgacgacgcccaguucaccaagauguucacccucaacauccgccggaagccccaggugcuggccgaggccagcgccucccaggcgagcugcuucagcgacggcuacccccugccguccuggaccuggaagaagugcagcgacaagucccccaacugcacggaggagaucaccgagggggucuggaaccgcaaggccaaccggaagguguucggccagugggugagcuccagcacccucaacauguccgaggccaucaagggguuccuggucaagugcugcgccuacaacagccugggcaccuccugcgagacgauccuccugaacagccccggccccuucccguucauccaggacaacaucuccuucuacgccaccaucggggugugccuccucuucaucgugguccugacccugcucaucugccacaaguacaagaagcaguuccgcuacgagagccagcugcagaugguccaggugaccggcuccagcgacaacgaguacuucuacguggacuuccgcgaguacgaguacgaccugaagugggaguucccccgggagaaccuggaguucgggaaggugcucggcuccggggcguucggcaaggugaugaacgccacggccuacggcaucagcaagaccggggucuccauccagguggccgugaagaugcugaaggagaaggcggacagcagcgagcgcgaggcccugauguccgagcucaagaugaugacccagcugggcagccacgagaacaucgucaaccugcucggggccugcacccuguccggccccaucuaccugaucuucgaguacugcugcuacggggaccuccugaacuaccugcggagcaagcgcgagaaguuccaccggaccuggacggagaucuucaaggagcacaacuucuccuucuaccccaccuuccagagccacccgaacuccagcaugcccggcucccgcgaggugcagauccaccccgacagcgaccagaucuccggccuccacgggaacagcuuccacuccgaggacgagaucgaguacgagaaccagaagcggcuggaggaggaggaggaccugaacgugcucaccuucgaggaccugcugugcuucgccuaccaggucgccaagggcauggaguuccucgaguucaagagcugcgugcaccgcgaccuggcggcccggaacgugcuggucacccacgggaagguggugaagaucugcgacuucggccucgcccgcgacaucauguccgacagcaacuacgucgugcggggcaacgcccgccugccggugaaguggauggcccccgagucccuguucgaggggaucuacacgaucaagagcgacgucugguccuacggcauccuccugugggagaucuucagccugggggugaaccccuaccccggcaucccgguggacgcgaacuucuacaagcucauccagaacggguucaagauggaccagcccuucuacgccaccgaggagaucuacaucaucaugcagagcugcugggccuucgacucccggaagcgccccagcuuccccaaccugaccuccuuccugggcugccagcucgccgacgccgaggaggcgauguaccagaacgucgacggccgggugagcgagugcccgcacaccuaccagaaccgccggcccuucucccgcgagauggaccuggggcugcucagcccccaggcccagguggaggacuccuga

SEQ ID NO: 30212 - RNA, 708 nt, Artificial Sequence
  derived and/or modified sequence opt1 from FLT3LG__Homo_sapiens__NP_001450
augaccgugcuggcccccgccugguccccgaccaccuaccuccugcugcuccugcugcucuccagcggccuguccgggacccaggacugcagcuuccagcacucccccaucagcuccgacuucgcggucaagauccgcgagcugagcgacuaccuccugcaggacuaccccgugaccguggccuccaaccugcaggacgaggagcucugcggcgggcuguggcggcugguccucgcccagcgcuggauggagcggcugaagaccguggccggcagcaagaugcaggggcugcucgagcgcgugaacacggagauccacuucgucaccaagugcgccuuccagcccccgcccuccugccugcgguucgugcagaccaacaucagccgccugcuccaggagaccuccgagcagcugguggcgcugaagcccuggaucacgcggcagaacuucagccgcugccucgagcugcagugccagcccgacuccagcacccugccgccgcccuggagcccccggccccucgaggccaccgcccccaccgcgccccagcccccgcugcugcuccugcugcuccugcccgucggccugcuccugcuggccgccgccuggugccuccacuggcagcgcacgcggcgccggacgccccgccccggcgagcaggucccgcccgugcccagcccccaggaccugcugcucguggagcacuga

SEQ ID NO: 30213 - RNA, 3897 nt, Artificial Sequence
  derived and/or modified sequence opt1 from FLT4__Homo_sapiens__NP_002011
augcagcgcggcgccgcccugugccuccggcuguggcugugccucgggcugcuggacggccucgugagcggguacuccaugacgcccccgacccugaacaucaccgaggagagccacgucaucgacaccggcgacucccugagcaucuccugccgcgggcagcacccccucgagugggcguggcccggcgcccaggaggcccccgccaccggcgacaaggacagcgaggacaccgggguggugcgggacugcgagggcacggacgcccgcccguacugcaagguccugcugcuccacgaggugcacgcgaacgacaccggguccuacgugugcuacuacaaguacaucaaggcccggaucgagggcaccaccgccgccagcuccuacgucuucgugcgcgacuucgagcagcccuucaucaacaagcccgacacgcugcuggugaaccggaaggacgcgauguggguccccugccucgugagcaucccggggcugaacgugacccugcgcucccagagcuccguccucuggcccgacggccaggagguggugugggacgaccggcgcggcaugcuggucagcacgccccugcuccacgacgcccuguaccugcagugcgagaccaccuggggcgaccaggacuuccucuccaaccccuuccuggugcacaucaccgggaacgagcuguacgacauccagcuccugccgcgcaagagccuggagcuccuggugggggagaagcugguccucaacugcaccgugugggccgaguucaacuccggcgugaccuucgacugggacuaccccggcaagcaggccgagcgcgggaaguggguccccgagcggcgcagccagcagacgcacaccgagcuguccagcauccugaccauccacaacgugagccagcacgaccucggcuccuacgugugcaaggccaacaacgggauccagcgguuccgcgagagcaccgaggucaucgugcacgagaaccccuucaucuccgucgaguggcugaagggcccgauccuggaggcgacggccggggacgagcucgugaagcugcccgugaagcuggccgccuacccgccgcccgaguuccagugguacaaggacggcaaggcccucagcggccggcacagcccccacgcgcugguccugaaggaggugaccgaggccuccaccgggaccuacacgcucgcccuguggaacuccgccgccggccugcgccggaacaucagccucgagcugguggucaacgugccgccccagauccacgagaaggaggcguccagccccuccaucuacagccggcacucccggcaggcccugaccugcaccgccuacggggugccccugccccucagcauccaguggcacuggcgccccuggacccccugcaagauguucgcccagcgcucccugcggcgccggcagcagcaggaccugaugccccagugccgcgacuggcgggccgucacgacccaggacgcggugaaccccaucgagagccucgacaccuggaccgaguucguggagggcaagaacaagacggucuccaagcuggugauccagaacgccaacgugagcgccauguacaagugcgucguguccaacaagguggggcaggacgagcgccugaucuacuucuacgucaccaccaucccggacggcuucaccaucgagagcaagcccagcgaggagcuccuggagggccagcccgugcugcucuccugccaggccgacagcuacaaguacgagcaccuccggugguaccgccugaaccuguccacgcugcacgacgcgcacgggaacccccugcuccuggacugcaagaacgugcaccuguucgccaccccgcucgccgccagccuggaggaggucgcccccggcgcgcggcacgccacccugucccucagcaucccccgcguggcccccgagcacgaggggcacuacgugugcgagguccaggaccggcgcucccacgacaagcacugccacaagaaguaccugagcgugcaggcccuggaggccccgcggcucacccagaaccugaccgaccugcucgugaacgucuccgacagccuggagaugcagugccugguggcgggcgcccacgcccccuccaucgugugguacaaggacgagcgccuccuggaggagaaguccggggucgaccuggccgacagcaaccagaagcucagcauccagcgggugcgcgaggaggacgccggccgguaccugugcuccgugugcaacgcgaagggcugcgucaacagcuccgccagcguggccguggaggggagcgaggacaagggcuccauggagaucgucauccugguggggacgggcgugaucgccgucuucuucugggugcuccugcugcucaucuucugcaacaugcgccggcccgcgcacgccgacaucaagaccggcuaccugagcaucaucauggaccccggggaggugccgcuggaggagcagugcgaguaccucuccuacgacgccagccagugggaguucccccgcgagcgccugcaccugggccggguccucggguacggcgccuucgggaaggugguggaggccuccgcguucggcauccacaagggcagcuccugcgacaccgucgccgugaagaugcugaaggagggggccaccgccagcgagcaccgcgcccugauguccgagcucaagauccugauccacaucggcaaccaccugaacguggucaaccuccugggggcgugcacgaagccccagggcccccugauggugaucguggaguucugcaaguacgggaaccucagcaacuuccugcgggccaagcgcgacgccuucuccccgugcgccgagaagucccccgagcagcggggccgcuuccgggccauggucgagcuggcgcgccucgaccggcgccggcccggcagcagcgaccgcgugcuguucgcccgguucuccaagaccgagggcggggcccgccgggccagccccgaccaggaggcggaggaccuguggcucuccccgcugaccauggaggaccuggucugcuacagcuuccagguggcccgcgggauggaguuccucgccucccggaagugcauccaccgcgaccuggccgcccggaacauccugcucagcgagagcgacguggucaagaucugcgacuucggccuggcgcgcgacaucuacaaggaccccgacuacgugcggaagggguccgcccgccugccccucaaguggauggcccccgagagcaucuucgacaagguguacaccacgcaguccgacgucuggagcuucggcgugcugcugugggagaucuucucccucggcgccagcccguaccccggggugcagaucaacgaggaguucugccagcgccugcgggacggcacccgcaugcgggcccccgagcuggcgaccccggccauccgccggaucaugcucaacugcugguccggggaccccaaggcccgccccgccuucagcgagcuggucgagauccugggcgaccuccugcaggggcggggccugcaggaggaggaggaggugugcauggcgccccgcuccagccaguccagcgaggagggcuccuucagccagguguccaccauggcccuccacaucgcccaggccgacgccgaggacagcccgcccucccugcagcggcacagccuggccgcgcgcuacuacaacugggucuccuuccccgggugccucgcccggggcgccgagacgcgcgggagcagccggaugaagaccuucgaggaguuccccaugaccccgaccacguacaagggcuccguggacaaccagaccgacagcggcauggugcuggccuccgaggaguucgagcagaucgagagccgccaccggcaggaguccggguuccgcuga

SEQ ID NO: 30214 - RNA, 1668 nt, Artificial Sequence
  derived and/or modified sequence opt1 from FLVCR1__Homo_sapiens__NP_054772
auggcccgccccgacgacgaggagggcgccgcgguggccccggggcacccccuggccaagggcuaccucccccugccccgcggggccccggucggcaaggagagcguggagcugcagaacgggcccaaggccggcaccuuccccgugaacggcgcgccccgggacucccucgccgccgccagcgggguccugggcgggccgcagacgccccuggcgcccgaggaggagacccaggcccggcuccugcccgccggcgccggggccgagaccccgggcgcggaguccagcccccugccccucaccgcccugagcccccgccgguucguggugcugcucaucuucucccuguacucccuggucaacgccuuccaguggauccaguacagcaucaucuccaacguguucgagggcuucuacggggugacccuccugcacaucgacuggcugagcauggucuacaugcucgccuacgugccgcugaucuuccccgccacguggcugcucgacacccgcggccugcggcugaccgcgcuccugggguccggccugaacugccucggcgccuggaucaagugcgggagcgugcagcagcaccuguucugggucaccaugcugggccagugccucugcuccguggcccagguguucauccuggggcugcccagccgcaucgccuccgucugguucggccccaaggaggugagcacggccugcgcgaccgccgugcucgggaaccagcugggcaccgccgucggcuuccugcucccgcccgugcuggugcccaacacccagaacgacacgaaccugcucgccugcaacaucuccaccauguucuacgggaccagcgccgucgcgacccugcuguucauccucacggccaucgccuucaaggagaagccccgguacccgcccucccaggcccaggcggcccugcaggacagcccgcccgaggaguacagcuacaagaaguccauccgcaaccuguucaagaacauccccuucgugcuccugcugaucaccuacggcaucaugaccggggccuucuacagcguguccacccuccugaaccagaugauccugacguacuacgagggcgaggaggucaacgccgggcggaucggccugacccucguggucgccggcaugguggggagcauccugugcggccuguggcucgacuacaccaagaccuacaagcagacgacccugaucguguacauccuguccuucaucgggauggucaucuucaccuucacccucgaccugcgcuacaucaucaucguguucgugacgggcgggguccugggcuucuucaugaccggcuaccucccccugggguucgaguucgcgguggagaucaccuaccccgagagcgagggcaccuccagcgggcugcucaacgccuccgcccagaucuucggcauccuguucacgcuggcccagggcaagcucaccagcgacuacgggccgaaggccggcaacaucuuccugugcguguggauguucaucgggaucauccugaccgcgcucaucaaguccgaccugcggcgccacaacaucaacaucggcaucaccaacgucgacgugaaggccauccccgccgacagccccacggaccaggagcccaagaccgugaugcuguccaagcagagcgaguccgccaucuga

SEQ ID NO: 30215 - RNA, 966 nt, Artificial Sequence
  derived and/or modified sequence opt1 from FLVCR2__Homo_sapiens__NP_001182212
augagcgccgacaacuccagcaccaucugcgugugccgcuccguccggcaggagcugggcaucgccaucggguuccucgugcccccggugcugguccccaacaucgaggaccgcgacgagcuggcguaccacaucagcaucauguucuacaucaucggcgggguggccacccuccugcugauccucgugaucaucgucuucaaggagaagcccaaguacccgcccucccgggcccagagccuguccuacgcccugacgagccccgacgccuccuaccucggcagcaucgcgcgccuguucaagaaccugaacuucgugcuccuggugaucaccuacgggcugaacgccggcgccuucuacgcccucuccacccugcugaaccggauggucaucuggcacuaccccggcgaggaggugaacgcggggcgcaucggccucaccaucgugaucgccgggaugcugggcgccgucaucagcgggaucuggcuggaccgguccaagacguacaaggagaccacccucgugguguacaucaugacccuggucggcauggugguguacacguucacccugaaccucggccaccugugggucguguucaucaccgccgggaccaugggcuucuucaugacgggguaccugccccucggcuucgaguucgccguggagcugaccuacccggagagcgagggcaucuccagcgggcugcucaacaucuccgcgcaggucuucggcaucaucuucaccaucagccaggggcagaucaucgacaacuacggcaccaagcccgggaacaucuuccugugcguguuccugacgcucggcgccgcccugaccgccuucaucaaggccgaccugcgccggcagaaggcgaacaaggagacccucgagaacaagcugcaggaggaggaggaggaguccaacaccagcaaggugcccacggccgucagcgaggaccaccuguga

SEQ ID NO: 30216 - RNA, 3591 nt, Artificial Sequence
  derived and/or modified sequence opt1 from FMN1__Homo_sapiens__NP_001096654
auggagaacguggacaacagccuggacggcagcgacgugagcgagcccgccaagcccgaggccgggcucgagguggcccagagcauccugagcaaguucuccaugaagucccuguucggcuucaccuccaagcucgagagcgugaaccccgaggaggaggacgccguccugaaggccuuccacucccuggacgugaaccccaccagccagcaggacgacuccagcaacgggcucgacccccaggaggccggcucccgcgugagccccgaccuggggaacgacgagaagaucgccuccgucgagacggagagcgagggcucccagcggaaggaggccggcaccagccugcucgcccaggagcugcugccccucuccacccugaaggggaccaaggacgacgugaucugcgugcgcggcacgcugguccacaccaccagcgacagcgacuccgacgacgggggccaggagcccgaggaggggagcuccaccaacggccccaagagccccuccggcgugcucagcgagcccucccaggagagcaaggagaaccccgggggcuuccgggagaacacggugaccggggagaugaacggcgccgagcugugcgccgaggacccccagcgcaucccgcccgagauguccagcaagcuggaggcgggcaacgggggccuccagaccgagcggcgccccucccaggaccaggucggggaggagggcagccaggaccugcccgccgugaccaaccagaacuccagcguggggaucacggaguccgccagcuccaagaaggaggucagcggcgagaaguccuuccagcugcccgccuucuucagcggccuccgggugcugaagaagggggccaccgccgagggcggggagaccaucaccgagaucaagcccaaggacggcgaccuggcccuccugaagcugacgcagcccgugcagaagucccucguccaggccgggcugcagaccgugaaguccgagaagaaggccaccgaccccaaggccacccccacgcugcucgagcagcugagccugcuccugaacaucgacaugcccaagaccgagcccaagggcgccgaccccgagagcccccgccgggaggagaugggcugcaacgccgaccaggagucccaguccgggcccggcgugccccagacccagggcggggaggucaagcccaagagccccgagaccgcccuggaggccuucaaggcccucuucauccggccgccccgcaaggggacgaccgcggacaccuccgagcuggaggcccugaagcgcaagaugcggcacgagaaggagagccuccgcgccguguucgagcgguccaacagcaagcccgccgacggccccuccgacagcaagucccccgaccacagccugaccgagcaggacgaccgcacgcccggccggcugcaggccguguggcccccgcccaagaccaaggacaccgaggagaaggucgggcucaaguacaccgaggcggaguaccaggccgccauccugcaccugaagcgcgagcacaaggaggagaucgagaaccuccaggcccaguucgagcugcgggcguuccacauccgcggcgagcacgccaugaucacggcccggcuggaggagaccaucgagaaccucaagcacgagcuggagcaccgcuggcgcgggggcugcgaggagcggaaggacgugugcaucuccaccgacgacgacugcccgcccaagaccuuccgcaacgucugcgugcagacggaccgggagaccuuccugaagcccugcgagagcgaguccaagaccacccgcagcaaccagcuggugcccaagaagcucaacaucagcucccugagccagcugagcccgcccaacgaccacaaggacauccacgccgcccuccagcccauggagggcauggcgagcaaccagcagaaggcccugcccccgccgcccgccuccaucccgcccccgccgccccuccccagcgggcucggcucccugagccccgcgccgcccaugccgcccgucuccgccgggccgccccugcccccgcccccgcccccgcccccgccccugcccccgcccagcuccgcgggcccgccgccgccgcccccgcccccgccccugcccaacagccccgcgccgcccaaccccggcgggcccccgcccgcgcccccgccgcccgggcuggcgcccccgccgccgcccggccucuucuucggccugggguccagcuccagccagugcccccggaagcccgccaucgagcccuccugccccaugaagccccuguacuggacccgcauccagaucagcgaccggucccagaacgcgacgcccacccucugggacagccuggaggagcccgacauccgcgaccccagcgaguucgaguaccuguucuccaaggacaccacccagcagaagaagaagccccucagcgagacguacgagaagaagaacaaggugaagaagaucaucaagcugcuggacggcaagcggucccagaccguggggauccucaucagcucccugcaccuggagaugaaggacauccagcaggccaucuucaacgucgacgacagcgugguggaccucgagacccuggccgcccuguacgagaaccgcgcgcaggaggacgagcucgucaagauccggaaguacuacgagaccuccaaggaggaggagcugaagcugcucgacaagcccgagcaguuccugcacgagcuggcccagauccccaacuucgccgagcgcgcccagugcaucaucuuccggagcguguucuccgagggcaucacgagccuccaccgcaagguggagaucaucacccgggccuccaaggaccugcugcacgucaagagcgugaaggacauccucgcgcugauccuggccuucggcaacuacaugaacgggggcaaccgcacccgggggcaggccgacggcuacucccucgagauccugcccaagcugaaggacgucaagagccgcgacaacgggaucaaccucgucgacuacguggugaaguacuaccugcgguacuacgaccaggaggccggcaccgagaaguccgucuucccccugcccgagccccaggacuucuuccucgccagccaggugaaguucgaggaccugaucaaggaccugcgcaagcucaagcgccagcuggaggcguccgagaagcagaugguggucgugugcaaggagagccccaaggaguaccugcagcccuucaaggacaagcucgaggaguucuuccagaaggccaagaaggagcacaagauggaggagucccaccuggagaacgcccagaaguccuucgagacgaccgugcgguacuucggcaugaagcccaagagcggggagaaggagaucacccccuccuacgucuucauggugugguacgaguucugcagcgacuucaagaccaucuggaagcgcgaguccaagaacaucagcaaggagcggcugaagauggcccaggaguccgugagcaagcucacguccgagaagaaggucgagaccaagaagaucaaccccaccgccagccugaaggagcgccugcggcagaaggaggcguccgugaccacgaacuga

SEQ ID NO: 30217 - RNA, 5169 nt, Artificial Sequence
  derived and/or modified sequence opt1 from FMN2__Homo_sapiens__NP_064450
augggcaaccaggacgggaagcugaagcgcagcgccggcgacgcccuccacgaggggggcgggggcgcggaggacgcccugggcccccgggacguggaggccaccaagaagggguccggcgggaagaaggcccugggcaagcacgggaagggcggcgggggcgggggcggcgggggcgagagcgggaagaagaaguccaagagcgacucccgcgccagcgucuucuccaaccuccggauccgcaagaaccugagcaagggcaagggggcgggcggcucccgggaggacgugcuggacagccaggcccuccagaccggggagcuggacuccgcccacagccugcucacgaagaccccggaccugucccugagcgccgacgaggcgggccucuccgacaccgagugcgccgaccccuucgaggugaccgggcccggcgggcccggcccggccgaggcccgcgucggcgggcggcccaucgccgaggacguggagacggcggccggcgcccaggacgggcagcgcaccagcuccggcagcgacaccgacaucuacuccuuccacagcgccaccgagcaggaggaccugcugagcgacauccagcaggccauccggcuccagcagcagcagcagcagcagcugcagcugcagcuccagcagcagcagcagcagcagcagcugcagggggcggaggagcccgccgcccccccgacggccguguccccccagcccggcgccuuccugggccucgaccgcuuccugcuggggcccagcggcggggcgggcgaggccccgggcucccccgacaccgagcaggcccucagcgcccuguccgaccugcccgagagccucgccgcggagccccgggagccgcagcagccccccucccccgggggccugccggucagcgaggcccccucccugcccgccgcccagcccgcggccaaggacagcccguccagcaccgccuuccccuuccccgaggccgggcccggcgaggaggccgcgggggccccggugcgcggcgccggcgacaccgacgaggagggggaggaggacgccuucgaggacgccccccggggcucccccggggaggagugggcgccggaggugggcgaggacgccccccagcgccucggggaggagcccgaggaggaggcccagggccccgacgccccggccgcggccagccugcccggcucccccgcccccagccagcggugcuucaagccguacccccugaucacgcccugcuacaucaagaccaccacccgccagcucuccagccccaaccacuccccgagccagagccccaaccaguccccccggaucaagcgccggcccgagccgagccugucccgcgggagccggacggcccuggcguccgucgccgcccccgccaagaagcaccgcgccgacggcgggcucgcggccggccugagccgcuccgccgacuggaccgaggagcugggggcccggaccccccgcgugggcggcagcgcccaccuccuggagcgggggguggcguccgacagcggcgggggcgucucccccgcccuggccgccaaggccagcggggcgccggccgccgccgacggcuuccagaacguguucaccggccgcacgcuccuggagaagcuguucucccagcaggagaacgggccccccgaggaggcggagaaguucugcagccggaucaucgccaugggccuccugcugcccuucuccgacugcuuccgcgagccgugcaaccagaacgcccagaccaacgccgccagcuucgaccaggaccagcucuacaccugggcggccgugucccagcccacccacagccuggacuacagcgaggggcaguucccccggcgcgucccguccaugggcccccccagcaagcccccggacgaggagcaccggcuggaggacgccgagacggagucccagagcgccguguccgagaccccccagaagcgcagcgacgccgugcagaaggaggucguggacaugaaguccgagggccaggcgaccgugauccagcagcuggagcagaccaucgaggaccuccggacgaagaucgccgagcuggagcgccaguaccccgcccuggacaccgaggucgccagcgggcaccagggccucgagaacggggugaccgccuccggcgacgugugccuggaggcgcugcggcucgaggagaaggagguccgccaccaccggauccuggaggccaagagcauccagaccucccccacggaggaggggggcgugcugacccucccgcccgucgacggccugcccgggcgccccccgugcccccccggcgccgagagcgggccccagaccaaguucugcuccgagaucagccugaucguguccccgcggcgcaucagcgugcagcucgacucccaccagcccacccagagcaucucccagccccccccgccccccagccugcuguggagcgccggccaggggcagcccggcucccagccgccccacagcaucuccacggaguuccagaccagccacgagcacuccgucagcuccgccuucaagaacagcugcaacauccccucccccccgccccuccccugcaccgagagcuccagcuccaugccgggccuggggauggugcccccccccccgcccccccugcccggcaugaccgugccgacccuccccagcacggcgaucccccagcccccgccccugcaggggaccgagaugcugccccccccgccccccccccucccgggcgccgggauccccccccccccgccccugcccggcgccggcauccugccccucccgccccugcccggggccggcaucccgcccccccccccgcugcccggggcggccaucccccccccgcccccccuccccggcgccggcaucccgcugccccccccccugccgggggccggcauccccccccccccgccccuccccggggccggcauccccccgccccccccgcugcccggggcgggcaucccccccccgcccccccugcccggcgccgggaucccgcccccccccccgcuccccggcgccgggaucccccccccgcccccccugcccggcgccgggaucccgcccccccccccgcugcccggcgccggcaucccccccccgcccccccucccgggggcgggcauccccccccccccgccccugcccggggccggcauccccccgccccccccccugccgggggccggcauccccccccccccgccccuccccggcgccgggauccccccgccccccccccugccgggcgccgggauccccccccccccgccccugcccggcgucgggaucccgcccccccccccgcuccccggcgcgggcaucccccccccgcccccccugcccggggccggcaucccgcccccccccccgcugcccggggccggcaucccccccccgcccccccucccccgggugggcaucccgcccccccccccgcugcccggggccggcauccccccgccccccccccugccgggggcgggcauccccccccccccgccccuccccggggugggcauccccccgccccccccccugccgggcgucgggauccccccccccccgccccugcccggcgccgggauccccccgccccccccgcuccccggcauggggaucccccccgccccggcccccccccugcccccgcccggcaccggcaucccccccccgccccugcuccccguguccgggcccccgcugcugccccaggugggcagcuccacccuccccacgccccaggucugcggguuccugccgcccccccugcccagcggccucuucgggcugggcaugaaccaggacaagggcucccgcaagcagccgaucgagcccugccgccccaugaagccccuguacuggacccggauccagcuccacagcaagcgcgacagcuccaccagccugaucugggagaagaucgaggagccguccaucgacugccacgaguucgaggagcuguucagcaagaccgccgugaaggagcggaagaagcccaucuccgacacgaucagcaagaccaaggcgaagcagguggucaagcuccuguccaacaagcgcagccaggccguggggauccugauguccagccuccaccuggacaugaaggacauccagcacgccguggucaaccuggacaacuccgugguggaccucgagacccugcaggcccuguacgagaaccgggcccagagcgacgagcucgagaagaucgagaagcacggccgcuccagcaaggacaaggagaacgcgaagucccuggacaagcccgagcaguuccuguacgagcucagccugaucccgaacuucuccgagcgggucuucugcauccuguuccagagcaccuucuccgagagcaucugcagcauccgccggaagcucgagcugcugcagaagcucugcgagacgcugaagaacgggcccggcgugaugcaggugcuggggcucguccuggccuucggcaacuacaugaacggcgggaacaagacccgcggccaggccgacggguucggccuggacauccuccccaagcugaaggacgugaaguccagcgacaacucccggagccugcucuccuacaucgugagcuacuaccugcgcaacuucgacgaggacgccggcaaggagcagugccuguucccccugccggagccccaggaccucuuccaggccucccagaugaaguucgaggacuuccagaaggaccugcggaagcugaagaaggaccucaaggcgugcgaggucgaggccgggaagguguaccaggugagcuccaaggagcacaugcagcccuucaaggagaacauggagcaguucaucauccaggccaagaucgaccaggaggccgaggagaacagccugaccgagacccacaagugcuuccuggagacgaccgcguacuucuucaugaagcccaagcucggcgagaaggaggucuccccgaacgccuucuucagcaucuggcacgaguucuccagcgacuucaaggacuucuggaagaaggagaacaagcugcugcuccaggagcgcgugaaggaggccgaggaggugugccggcagaagaaggggaagucccuguacaagaucaagccccgccacgacagcggcaucaaggccaagaucuccaugaagaccuga

SEQ ID NO: 30218 - RNA, 3303 nt, Artificial Sequence
  derived and/or modified sequence opt1 from FMNL1__Homo_sapiens__NP_005883
augggcaacgccgccgggagcgcggagcagcccgccggcccggccgcccccccccccaagcagccggccccccccaagcagcccaugccggcggccggggagcuggaggagcgcuucaaccgggcccucaacugcaugaaccugccccccgacaaggugcagcugcucucccaguacgacaacgagaagaagugggagcugaucugcgaccaggagcgcuuccaggucaagaaccccccggccgcguacauccagaagcugaagagcuacguggacaccggcggggugucccggaaggucgccgccgacuggaugagcaaccucggcuucaagcgccgggugcaggaguccacccaggugcugcgcgagcuggagacgagccuccggaccaaccacaucggcuggguccaggaguuccugaacgaggagaaccgcgggcuggacgugcuccuggaguaccuggccuucgcccagugcuccgugaccuacgacauggagagcaccgacaacggcgcguccaacagcgagaagaacaagccccucgagcaguccgucgaggaccugagcaaggggccccccuccagcgugccgaagucccggcaccugacgaucaagcucacccccgcccacagccgcaaggcccugcggaacucccgcaucgugagccagaaggacgacguccacgugugcaucaugugccugcgggccaucaugaacuaccaguccggcuucagccucgugaugaaccaccccgccugcgucaacgagaucgcgcugagccugaacaacaagaacccccgcaccaaggcccucgugcuggagcugcucgccgccgugugccugguccgggggggccacgacaucauccuggccgcguucgacaacuucaaggaggugugcggcgagcagcaccgcuucgagaagcucauggaguacuuccggaacgaggacuccaacaucgacuucaugguggccugcaugcaguucaucaacaucgucgugcacagcguggagaacaugaacuuccgcgucuuccugcaguacgaguucacccaccuggggcucgaccuguaccuggagcggcuccgccugacggaguccgacaagcugcaggugcagauccaggccuaccucgacaacaucuucgacgucggcgcccugcuggaggacaccgagaccaagaacgccgugcucgagcacauggaggagcugcaggagcagguggcgcugcucaccgagcggcugcgcgacgccgagaacgagagcauggccaagaucgccgagcuggagaagcagcucucccaggcgcgcaaggagcuggagacgcugcgggagcgcuucagcgaguccaccgccaugggggccagccggcgcccgcccgagcccgagaaggcccccccggccgcgcccacccggcccuccgcccuggagcucaaggucgaggagcuggaggagaagggccugauccgcauccuccggggccccggggacgccgugagcaucgagauccugccgguggccgucgccacccccuccggcggggacgcgcccacgccgggcgugcccaccgggagccccucccccgaccuggccccggccgccgagcccgcccccggcgcggcccccccgcccccccccccgcuccccggccugcccagcccccaggaggccccgcccuccgcccccccccaggcgccgccccugcccgggagccccgagccgccccccgccccgccccuccccggcgaccugcccccgcccccccccccgcccccccccccgcccgggaccgacggccccgugcccccgcccccccccccgcccccccccccgcccgggggcccccccgacgcccugggccgccgggacuccgagcucgggccgggcgucaaggccaagaagcccauccagaccaaguuccgcaugccccugcugaacuggguggcccucaagccgagccagaucacggggaccguguucaccgagcugaacgacgagaagguccugcaggagcucgacauguccgacuucgaggagcaguucaagaccaagagccagggccccagccuggaccuguccgcgcucaagagcaaggccgcccagaaggcccccuccaaggccacgcugaucgaggcgaaccgggccaagaaccuggccaucacccuccgcaaggggaaccugggcgccgagcggaucugccaggccaucgaggcguacgaccugcaggcccucggccuggacuuccuggagcuccugaugcgcuuccugcccaccgaguacgagcggagccucaucacccgcuucgagcgggagcagcgcccgauggaggagcuguccgaggaggaccgguucaugcugugcuucagccgcaucccccgccuccccgagcggaugacgacccugaccuuccuggggaacuuccccgacaccgcccagcuccugaugccgcagcugaacgccaucaucgcggccuccaugagcaucaaguccagcgacaagcuccgccagauccuggagaucgugcuggccuucggcaacuacaugaacuccagcaagcggggggccgccuacggcuuccgccuccagucccuggacgcgcugcucgagaugaagagcacggaccggaagcagacccugcugcacuaccucgugaaggucaucgccgagaaguacccccagcugaccggcuuccacuccgaccugcacuuccucgacaaggccgggagcgugucccuggacagcgugcuggccgacguccgcagccuccagcggggccuggagcugacccagcgcgaguucgugcggcaggacgacugcauggugcucaaggaguuccugcgcgccaacucccccacgauggacaagcugcucgcggacagcaagaccgcccaggaggccuucgaguccgucguggaguacuucggggagaaccccaagaccaccagcccgggccuguucuucucccuguucagccgguucaucaaggccuacaagaaggccgagcaggagguggagcaguggaagaaggaggcggccgcccaggaggccggggccgacacccccggcaagggcgagccccccgcgccgaaguccccccccaaggcccgccggccccagauggaccucaucagcgagcugaagcgccggcagcagaaggagccgcugaucuacgaguccgaccgcgacggggccaucgaggacaucaucacggucaucaagaccgugcccuucaccgcccggaccggcaagcgcacgagccggcuccugugcgaggcgucccugggggaggagaugccccucuga

SEQ ID NO: 30219 - RNA, 3279 nt, Artificial Sequence
  derived and/or modified sequence opt1 from FMNL2__Homo_sapiens__NP_443137
augggcaacgccgggagcauggacucccagcagaccgacuuccgcgcccacaacgugccccugaagcucccgaugcccgagcccggcgagcuggaggagcgguucgcgaucguccugaacgccaugaaccuccccccggacaaggcccgccugcugcggcaguacgacaacgagaagaagugggagcucaucugcgaccaggagcgcuuccaggugaagaaccccccccacaccuacauccagaagcugaagggguaccuggaccccgccgugacgcggaagaaguuccgccggcgcguccaggagagcacccaggugcuccgggagcuggagaucucccugcgcaccaaccacaucggcugggugcgggaguuccucaacgaggagaacaaggggcuggacguccugguggaguaccucagcuucgcccaguacgcggugaccuucgacuucgaguccgucgagagcacgguggaguccagcguggacaaguccaagccguggagccgcuccaucgaggaccugcaccggggcagcaaccugcccucccccgucggcaacagcgugucccgcagcgggcggcacuccgcccuccgcuacaacacccugcccagccggcgcacccugaagaacucccggcucgugagcaagaaggacgacguccacgugugcaucaugugccugcgcgccaucaugaacuaccaguacggcuucaacauggugaugagccacccgcacgccgucaacgagaucgcgcugucccucaacaacaagaacccccggaccaaggcccuggugcuggagcuccuggccgccgugugccugguccgcgggggccacgagaucauccucagcgccuucgacaacuucaaggaggugugcggggagaagcagcgcuucgagaagcugauggagcacuuccggaacgaggacaacaacaucgacuucaugguggcguccaugcaguucaucaacaucgucgugcacagcgucgaggacaugaacuuccgcgugcaccugcaguacgaguucacgaagcucggccuggacgaguaccuggacaagcucaagcacaccgaguccgacaagcugcaggugcagauccaggccuaccuggacaacgucuucgacgugggcgcccuccuggaggacgccgagaccaagaacgccgcgcuggagcggguggaggagcucgaggagaacaucagccaccuguccgagaagcugcaggacaccgagaacgaggccaugagcaagaucgucgagcucgagaagcagcugaugcagcgcaacaaggagcuggacguggugcgggagaucuacaaggacgccaacacgcagguccacacccuccgcaagauggugaaggagaaggaggaggccauccagcggcaguccacccuggagaagaagauccacgagcuggagaagcaggggaccaucaagauccagaagaagggcgacggggacaucgccauccugcccguggucgcgagcggcacgcucuccaugggcagcgaggugguggccgggaacuccgucggccccaccaugggggccgccagcuccggcccgcugcccccccccccgcccccccugcccccgagcuccgacacccccgagaccgugcagaacgggcccgugacgcccccgaugccccccccgcccccccccccgcccccccccccgcccccccccccgcccccccccccgcccccccuccccggcccggccgcggagaccguccccgcccccccccuggccccgccccugcccagcgccccgccccuccccggcaccuccagccccaccgugguguucaacagcgggcuggcggccgucaagaucaagaagccgaucaagacgaaguuccgcaugcccguguucaacuggguggcccugaagcccaaccagaucaacggcaccgucuucaacgagaucgacgacgagcggauccucgaggaccugaacguggacgaguucgaggagaucuucaagaccaaggcccaggggcccgccaucgaccuguccagcuccaagcagaagaucccgcagaagggcagcaacaaggugacccuccuggaggcgaaccgcgccaagaaccuggccaucacgcuccggaaggccgggaagaccgccgacgagaucugcaaggcgauccacgucuucgaccugaagacccugcccguggacuucguggagugccucaugcgcuuccugcccaccgagaacgaggucaaggugcugcggcucuacgagcgcgagcggaagccccuggagaaccuguccgacgaggaccgcuucaugaugcaguucagcaagaucgagcggcucaugcagaagaugacgaucauggccuucaucggcaacuucgccgaguccauccagaugcugaccccgcagcugcacgccaucaucgccgcgagcguguccaucaagagcucccagaagcucaagaagauccuggagaucauccuggcccucggcaacuacaugaacagcuccaagcgcggggccgucuacggcuucaagcugcagagccuggaccuccugcuggacaccaaguccaccgaccggaagcagacgcuccugcacuacaucagcaacguggugaaggagaaguaccaccaggucucccuguucuacaacgagcuccacuacguggagaaggccgcggccgugagccuggagaacguccugcucgacgugaaggagcugcagcgcgggauggaccugaccaagcgcgaguacaccaugcacgaccacaacacccuccugaaggaguucauccugaacaacgagggcaagcucaagaagcugcaggacgacgccaagaucgcccaggacgccuucgacgacguggucaaguacuucggggagaaccccaagaccacgccccccagcguguucuucccgguguucguccgguucgugaaggcguacaagcaggccgaggaggagaacgagcugcgcaagaagcaggagcaggcccucauggagaagcugcuggagcaggaggcccucauggagcagcaggaccccaagucccccagccacaaguccaagcggcagcagcaggagcugaucgccgagcugcgccggcgccaggugaaggacaaccggcacgucuacgagggcaaggacggcgcgaucgaggacaucaucaccgaccuccgcaaccagcccuaccggcgcgccgacgccgugcggcgcagcgugcggcgccgguucgacgaccagaaccugcgcuccgucaacggggccgagaucaccauguga

SEQ ID NO: 30220 - RNA, 3084 nt, Artificial Sequence
  derived and/or modified sequence opt1 from FMNL3__Homo_sapiens__NP_783863
augggcaaccuggagagcgccgagggggugcccggcgagccgcccuccgucccccuccugcugccgcccgggaagaugcccaugcccgagcccugcgagcucgaggagcgcuucgcccuggugcugagcuccaugaaccucccgcccgacaaggcgcggcugcugcgccaguacgacaacgagaagaagugggaccucaucugcgaccaggagcgguuccaggugaagaacccgccccacaccuacauccagaagcugcagagcuuccuggaccccuccgucacccgcaagaaguuccggcgccgggugcaggagagcacgaaggugcuccgcgagcuggagaucucccugcggaccaaccacaucggcuggguccgcgaguuccucaacgacgagaacaaggggcuggacgugcugguggacuaccucagcuucgcccagugcuccgucauguucgacuucgagggccuggagagcggcgacgacggggccuucgacaagcugcgguccuggagccgcuccaucgaggaccuccagccgcccagcgcccuguccgcccccuucaccaacagccuggcgcgguccgcccgccagagcgugcuccgguacuccacccugcccggccgccgggcccugaagaacagccgccucgugagccagaaggacgacguccacgugugcauccugugccugcgggccaucaugaacuaccaguacggguucaaccucgugaugucccacccccacgcggucaacgagaucgcccugagccugaacaacaagaacccccgcacgaaggcccucgugcuggagcugcucgccgccgugugccugguccggggcgggcacgagaucauccuggcggccuucgacaacuucaaggaggugugcaaggagcuccaccgcuucgagaagcugauggaguacuuccgcaacgaggacuccaacaucgacuucaugguggccugcaugcaguucaucaacaucgucgugcacagcguggaggacaugaacuuccggguccaccuccaguacgaguucaccaagcugggccuggaggaguuccugcagaagucccgccacaccgagagcgagaagcuccaggugcagauccaggccuaccuggacaacgucuucgacgugggcgggcugcucgaggacgccgagaccaagaacguggcgcuggagaaggucgaggagcuggaggagcacgugucccaccugacggagaagcuccuggaccuggagaacgagaacaugaugcggguggccgagcucgagaagcagcugcugcagcgcgagaaggagcucgagagcaucaaggagaccuacgagaacaccucccaccagguccacacccugcggcgccugaucaaggagaaggaggaggccuuccagcggcgcugccaccucgagcccaacgugcggggccuggagagcguggacuccgaggcccuggcccgcgucgggcccgcggagcucagcgagggcaugccgcccuccgaccuggaccugcucgcccccgcgcccccgcccgaggaggugcugccccugcccccgccgcccgccccgccccugcccccgcccccgccgccccuccccgacaagugcccgcccgccccgccccugcccggcgccgcccccagcgugguccucacgguggggcuguccgccauccggaucaagaagcccaucaagaccaaguuccgccugcccguguucaacuggaccgcccucaagcccaaccagaucagcggcaccgucuucuccgagcuggacgacgagaagauccuggaggaccucgaccuggacaaguucgaggagcuguucaagacgaaggcgcaggggcccgcccucgaccugaucugcagcaagaacaagaccgcccagaaggccgccuccaaggugacccugcucgaggcgaaccgggccaagaaccuggccaucacccugcgcaaggccggccggagcgccgaggagaucugccgcgcgauccacacguucgaccuccagacccugcccguggacuucgucgagugccugaugcgguuccuccccaccgaggccgaggugaagcugcugcgccaguacgagcgggagcgccagccccucgaggagcuggccgccgaggaccgcuucaugcuccuguucagcaagguggagcggcugacccagcgcauggccgggauggcguuccugggcaacuuccaggacaaccuccagaugcugacgccccagcugaacgccaucaucgccgccuccgcgagcgucaaguccagccagaagcucaagcagaugcuggagaucauccuggcccucggcaacuacaugaacuccagcaagcgcggggccguguacggcuucaagcugcagucccuggaccuccugcuggacaccaagagcaccgaccggaagaugacccuccugcacuucaucgcccugacggugaaggagaaguaccccgaccucgccaacuucuggcacgagcugcacuucgucgagaaggcggccgccgugucccuggagaacgugcuccuggacgucaaggagcuggggcggggcauggagcucauccgccgggagugcagcauccacgacaacuccgugcugcgcaacuuccugagcaccaacgaggggaagcucgacaagcugcagcgggacgccaagaccgccgaggaggcguacaacgccgugguccgcuacuucggcgagucccccaagaccacgccgcccagcguguucuuccccguguucguccgguucauccgcuccuacaaggaggccgagcaggagaacgaggcccggaagaagcaggaggaggugaugcgcgagaagcagcuggcccaggaggcgaagaagcucgacgccaagacccccagccagcggaacaaguggcagcagcaggagcugaucgccgagcugcgccggcgccaggccaaggagcaccggcccguguacgagggcaaggacgggaccaucgaggacaucaucaccggccuccacugccagcccauggucgugcgccaccaggcgcgguccgccgccccgcccagcgggccgccccgcgcccccggcccccacuga

SEQ ID NO: 30221 - RNA, 1611 nt, Artificial Sequence
  derived and/or modified sequence opt1 from FMO1__Homo_sapiens__NP_001269621
augcaggagaacauggccaagcgcguggccaucgucggcgcgggggugagcggccuggccuccaucaagugcugccucgaggaggggcuggagccgaccugcuucgagcggagcgacgaccugggcgggcucuggcgcuucaccgagcacguggaggagggccgggccucccuguacaagagcgucguguccaacagcugcaaggagauguccugcuacagcgacuuccccuuccccgaggacuaccccaacuacgugcccaacucccaguuccuggaguaccucaagauguacgccaaccacuucgaccugcugaagcacauccaguucaagacgaaggucugcagcgugaccaagugcuccgacagcgccguguccggccagugggaggucgugaccaugcacgaggagaagcaggagagcgcgaucuucgacgccgugauggucugcaccggguuccucacgaacccguaccugccccuggacuccuuccccggcaucaacgccuucaaggggcaguacuuccacagccgccaguacaagcaccccgacaucuucaaggacaagcgggugcucgugaucggcauggggaacuccggcaccgacaucgccgucgaggcgagccaccuggccgagaagguguuccuguccaccaccggcgggggcugggugaucagccgcaucuucgacagcggguacccgugggacauggucuucaugacgcgguuccagaacaugcuccgcaacucccugcccacccccaucgugaccuggcugauggagcggaagaucaacaacuggcucaaccacgccaacuacggccugauccccgaggaccgcacccagcugaaggaguucgugcucaacgacgagcugccgggccggaucaucacggggaaggucuucauccgccccagcaucaaggaggugaaggagaacuccgugaucuucaacaacaccagcaaggaggagcccaucgacaucaucgucuucgccaccggcuacaccuucgccuuccccuuccuggacgaguccguggucaagguggaggacgggcaggcgagccucuacaaguacaucuucccggcccaccuccagaagcccacgcuggccaucaucggccugaucaagccccugggguccaugauccccaccggcgagacccaggcccggugggccgugcgcguccugaagggcgugaacaagcucccgccgcccagcgugaugaucgaggagaucaacgcgcggaaggagaacaagcccuccugguucgggcugugcuacugcaaggcccugcagagcgacuacaucaccuacaucgacgagcuccugacguacaucaacgccaagcccaaccuguucuccaugcuccugaccgacccccaccuggcccucaccgucuucuucggccccugcagccccuaccaguuccgccugaccgggccgggcaagugggagggggcccggaacgcgaucaugacgcagugggaccgcaccuucaaggugaucaaggcccgggugguccaggagucccccagccccuucgaguccuuccugaagguguucagcuuccucgcccugcugguggccaucuuccucaucuuccuguga

SEQ ID NO: 30222 - RNA, 1608 nt, Artificial Sequence
  derived and/or modified sequence opt1 from FMO2__Homo_sapiens__NP_001451
auggccaagaagguggccgucaucggcgcgggggugagcggccugaucucccucaagugcugcguggacgaggggcuggagccgaccugcuucgagcgcaccgaggacaucggcggggucuggcgguucaaggagaacguggaggacggccgcgccagcaucuaccaguccguggucacgaacaccagcaaggagauguccugcuucagcgacuuccccaugcccgaggacuuccccaacuuccugcacaacuccaagcuccuggaguacuuccggaucuucgccaagaaguucgaccugcucaaguacauccaguuccagaccaccgugcugagcgugcgcaagugccccgacuucuccagcuccggccaguggaaggucgugacgcagagcaacgggaaggagcaguccgccguguucgacgccgucauggugugcagcggccaccacauccugccgcacaucccccucaaguccuuccccgggauggagcgguucaagggccaguacuuccacagccgccaguacaagcaccccgacggguucgagggcaagcggauccuggugaucggcauggggaacuccggcagcgacaucgcggucgagcuguccaagaacgccgcccagguguucaucagcacccgccacgggaccugggugaugagccggaucuccgaggacggcuacccgugggacagcgucuuccacacccgcuuccgguccaugcuccgcaacgugcugccccggacggccgugaaguggaugaucgagcagcagaugaaccgcugguucaaccacgagaacuacggccuggagccccagaacaaguacaucaugaaggagcccguccucaacgacgacgugccgagccggcugcugugcggggcgaucaaggugaaguccaccgucaaggagcucaccgagaccagcgccaucuucgaggacggcacgguggaggagaacaucgacgucaucaucuucgccaccggguacuccuucagcuuccccuuccuggaggacucccuggugaagguggagaacaacauggucagccucuacaaguacaucuuccccgcccaccuggacaaguccacccuggccugcaucggccucauccagccccuggggagcaucuucccgaccgcggagcugcaggcccgcugggugacgcggguguucaagggccucugcucccugcccagcgagcgcaccaugaugauggacaucaucaagcggaacgagaagcgcaucgaccuguucggcgagucccagagccagacccuccagaccaacuacgucgacuaccuggacgagcuggcccucgagaucggggccaagcccgacuucugcucccugcuguucaaggaccccaagcucgccgugcggcuguacuucggcccgugcaacagcuaccaguaccgccugguggggcccggccagugggagggggcgcgcaacgccaucuucacgcagaagcagcggauccucaagccccugaagacccgcgcccugaaggacuccagcaacuucagcgucuccuuccuccugaagauccugggccuccuggccgugguggucgccuucuucugccagcugcaguggagcuga

SEQ ID NO: 30223 - RNA, 1599 nt, Artificial Sequence
  derived and/or modified sequence opt1 from FMO3__Homo_sapiens__NP_008825
augggcaagaagguggccaucaucggggccggcgucagcgggcuggcguccauccgcagcugccucgaggagggccuggagccgaccugcuucgagaaguccaacgacaucgggggccuguggaaguucagcgaccacgccgaggagggccgggccuccaucuacaagagcguguucuccaacagcuccaaggagaugaugugcuuccccgacuuccccuuccccgacgacuuccccaacuucaugcacaacagcaagauccaggaguacaucaucgccuucgccaaggagaagaaccuccugaaguacauccaguucaagaccuucguguccagcgucaacaagcacccggacuucgcgacgaccgggcagugggacgugaccaccgagcgcgacggcaagaaggaguccgccguguucgacgccgucauggugugcagcgggcaccacguguaccccaaccugcccaaggaguccuuccccggccucaaccacuucaaggggaagugcuuccacagccgggacuacaaggagccgggcgucuucaacggcaagcgcgugcugguggucgggcugggcaacuccgggugcgacaucgccacggagcucagccggaccgcggagcaggucaugaucuccagccgcagcggcuccugggugaugagccgggugugggacaacggcuaccccugggacaugcugcuggugacccgcuucgggaccuuccucaagaacaaccugcccacggccaucuccgacuggcuguacgugaagcagaugaacgcccgguucaagcacgagaacuacggccucaugccccugaacgggguccugcgcaaggagccgguguucaacgacgagcuccccgccagcauccugugcggcaucguguccgucaagcccaacgugaaggaguucaccgagaccagcgccaucuucgaggacgggaccaucuucgagggcaucgacugcgugaucuucgcgacgggcuacuccuucgccuaccccuuccuggacgagagcaucaucaagucccggaacaacgagaucauccucuucaagggggucuucccgccccugcuggagaaguccaccaucgccgugaucggcuucguccagagccucggggccgccauccccaccguggaccugcagagccgcugggcggcccaggugaucaaggggaccugcacgcugcccuccauggaggacaugaugaacgacaucaacgagaagauggagaagaagcggaagugguucggcaagagcgagaccauccagaccgacuacaucgucuacauggacgagcucuccagcuucaucggcgccaagccgaacauccccuggcuguuccugaccgaccccaagcucgccauggagguguacuucggccccugcuccccguaccaguuccgccugguggggcccggccaguggcccggggcccggaacgcgauccugacgcagugggaccgcagccucaagcccaugcagacccgggucgugggccgccugcagaagccgugcuucuucuuccacuggcugaagcuguucgccauccccauccuccugaucgccguguuccucguccugaccuga

SEQ ID NO: 30224 - RNA, 1677 nt, Artificial Sequence
  derived and/or modified sequence opt1 from FMO4__Homo_sapiens__NP_002013
auggccaagaagguggccgucaucggcgcgggggugagcggccuguccagcaucaagugcugcguggacgaggaccucgagccgaccugcuucgagcgcuccgacgacaucgggggccuguggaaguucaccgagagcuccaaggacgggaugacgcgggucuacaagagccuggugaccaacgugugcaaggagauguccugcuacagcgacuuccccuuccacgaggacuaccccaacuucaugaaccacgagaaguucugggacuaccuccaggaguucgccgagcacuucgaccugcugaaguacauccaguucaagaccaccgucugcuccaucacgaagcgccccgacuucagcgagaccggccagugggacguggugaccgagaccgagggcaagcagaaccgggccgucuucgacgccgugauggugugcacggggcacuuccucaacccccaccucccgcuggaggccuuccccggcauccacaaguucaaggggcagauccuccacucccaggaguacaagauccccgagggcuuccaggggaagcgcguccuggugaucggccugggcaacaccgggggcgacaucgcgguggagcucagccggaccgccgcccagguccugcuguccacccgcacggggaccugggugcucggccggagcuccgacuggggcuaccccuacaacaugauggugacccgccggugcugcagcuucaucgcccagguccugccgucccgcuuccugaacuggauccaggagcggaagcucaacaagcgcuucaaccacgaggacuacgggcugagcaucaccaagggcaagaaggcgaaguucaucgugaacgacgagcugcccaacugcauccucugcggggccaucacgaugaagaccuccgugaucgaguucaccgagaccagcgccgucuucgaggacggcacgguggaggagaacaucgacguggucaucuucaccaccggguacaccuucagcuuccccuucuucgaggagccccugaagucccugugcacgaagaagaucuuccucuacaagcaggucuucccgcugaaccuggagcgggccacccucgccaucaucggccugaucggccugaaggggagcauccucuccggcaccgagcugcaggcgcgcugggugacccggguguucaaggggcugugcaagaucccgcccagccagaagcucaugauggaggccacggagaaggagcagcugaucaagcgcggcguguucaaggacaccuccaaggacaaguucgacuacaucgccuacauggacgacaucgccgccugcaucgggaccaagcccagcaucccccugcuguuccugaaggacccccggcuggcgugggaggucuucuucggccccugcacccccuaccaguaccgccucaugggcccggggaagugggacggcgcccggaacgccauccugacgcagugggaccgcacccugaagccccucaagacccggaucgugcccgacuccagcaagcccgccuccaugagccacuaccugaaggccuggggcgcgccggugcugcucgccucccugcugcucaucugcaagagcucccuguuccugaagcugguccgcgacaagcuccaggaccgcaugagccccuaccuggugucccuguggcggggguga

SEQ ID NO: 30225 - RNA, 1131 nt, Artificial Sequence
  derived and/or modified sequence opt1 from FMOD__Homo_sapiens__NP_002014
augcaguggaccagccugcuccugcuggccggccucuucucccugagccaggcccaguacgaggacgacccccacuggugguuccacuaccugcgcucccagcagagcaccuacuacgacccguacgaccccuaccccuacgagacguacgagcccuacccguacgggguggacgagggccccgccuacaccuacgggucccccagcccgcccgacccccgggacugcccccaggagugcgacugcccgcccaacuuccccaccgccauguacugcgacaaccgcaaccucaaguaccugcccuucguccccucccggaugaaguacguguacuuccagaacaaccagaucaccagcauccaggagggcguguucgacaacgccacggggcugcucuggaucgcccugcacggcaaccagaucaccuccgacaaggucggccgcaagguguucagcaagcugcggcaccucgagcgccuguaccuggaccacaacaaccucacccggaugccggggccccugccccgcucccugcgggagcuccaccuggaccacaaccagaucagccgcgugcccaacaacgcccuggagggccucgagaaccugaccgcgcuguaccuccagcacaacgagauccaggaggucggguccagcaugcggggccugcgcucccugauccuccuggaccugagcuacaaccaccuccggaaggugccggacgggcugcccuccgcccuggagcagcucuacauggagcacaacaacguguacacgguccccgacagcuacuuccgcggcgcccccaagcugcuguacgugcggcucucccacaacagccugaccaacaacggccuggccagcaacaccuucaacuccagcucccuccuggagcuggaccucagcuacaaccagcugcagaagaucccgcccgugaacaccaaccuggagaaccucuaccugcaggggaaccgcaucaacgaguucuccaucagcuccuucugcacggucguggacguggucaacuucagcaagcuccaggugcugcggcuggacggcaacgagaucaagcgcuccgcgaugcccgccgacgcgccccugugccugcggcucgccagccugaucgagaucuga

SEQ ID NO: 30226 - RNA, 1614 nt, Artificial Sequence
  derived and/or modified sequence opt1 from FMR1__Homo_sapiens__NP_001172004
auggaggagcugguggucgaggugcgcggcagcaacggggccuucuacaaggccuucgugaaggacguccacgaggacuccaucaccguggcguucgagaacaacuggcagcccgaccggcagauccccuuccacgacgugcgcuucccgccgcccgucggcuacaacaaggacaucaacgagagcgacgagguggagguguacucccgggccaacgagaaggagcccugcugcugguggcucgccaagguccgcaugaucaagggggaguucuacgugaucgaguacgccgccugcgacgcgaccuacaacgagaucgugacgaucgagcggcugcgcagcgucaaccccaacaagcccgccaccaaggacaccuuccacaagaucaagcuggacgugcccgaggaccuccggcagaugugcgccaaggaggccgcgcacaaggacuucaagaaggccgugggcgccuucuccgucaccuacgaccccgagaacuaccagcuggugauccugagcaucaacgaggugacguccaagcgcgcccacaugcucaucgacaugcacuuccggagccugcgcaccaagcugucccucaucaugcggaacgaggaggccagcaagcagcuggaguccagccgccagcuggcgucccgguuccacgagcaguucaucguccgcgaggaccucauggggcuggccaucggcacccacggcgccaacauccagcaggcccggaaggugcccggggugaccgccaucgaccuggacgaggacacgugcaccuuccacaucuacggcgaggaccaggacgcggucaagaaggcccgcagcuuccucgaguucgccgaggacgugauccaggugccccggaaccuggucgggaaggugaucggcaagaacgggaagcugauccaggagaucgucgacaaguccggcguggugcgcguccggaucgaggccgagaacgagaagaacgugccccaggaggaggagaucaugccgcccaacagccuccccuccaacaacagccgcgugggccccaacgccccggaggagaagaagcaccuggacaucaaggagaacuccacccacuucagccagcccaacagcaccaagguccagcgggugcugguggcguccagcgucguggccggggagucccagaagcccgagcucaaggccuggcagggcauggugcccuucgucuucguggggacgaaggacagcaucgccaacgccaccgugcugcuggacuaccaccucaacuaccugaagcugcagcagcgcaagcgcggccgggcguccugcgccgaggagaccgacggcggggucgagggcgaggaggaggacaaggaggaggaggacguggaggaggccagcaaggagaccacgaucaccccggagcagaucaucgugcacgucauccaggagcgccucaaggaggagcagcagauggaccccuuccgguccgagcugaccgccaucaugaagggggugagcacccugaagcacuaccgcaucccgcccgugaaggucgugggcugcgcgcgggugaagaucgucacgcgccggaagcgcucccagaccgccuggauggugagcaaccacuccuga

SEQ ID NO: 30227 - RNA, 7068 nt, Artificial Sequence
  derived and/or modified sequence opt1 from FN1__Homo_sapiens__NP_002017
augcugcgggggcccgggcccggccuccugcugcucgccgugcagugccuggggaccgccguccccagcaccggcgccuccaagagcaagcggcaggcccagcagauggugcagccccagucccccguggccgucagccaguccaagcccgggugcuacgacaacggcaagcacuaccagaucaaccagcagugggagcgcaccuaccugggcaacgcccucgugugcacgugcuacgggggcagccggggguucaacugcgaguccaagcccgaggccgaggagaccugcuucgacaaguacaccggcaacaccuaccgcgugggggacaccuacgagcggcccaaggacagcaugaucugggacugcacgugcaucggcgccggccgcgggcggaucuccugcaccaucgccaaccgcugccacgagggcgggcagagcuacaagaucggcgacaccuggcggcgcccccacgagaccggcggguacaugcuggagugcgucugccugggcaacgggaagggcgaguggaccugcaagccgaucgccgagaagugcuucgaccacgccgccgggaccuccuacguggugggcgagaccugggagaagcccuaccagggcuggaugauggucgacugcacgugccucggggagggcagcgggcggaucacgugcaccucccgcaaccggugcaacgaccaggacacccgcaccagcuaccggaucggcgacaccugguccaagaaggacaaccgcgggaaccugcugcagugcaucugcaccggcaacggccgcggggaguggaagugcgagcgccacaccagcgugcagaccaccuccagcggcuccgggcccuucaccgacgugcgggccgccgucuaccagccccagccccacccccagccgccgcccuacggccacugcgugaccgacagcgggguggucuacagcgugggcaugcaguggcucaagacccagggcaacaagcagaugcugugcacgugccuggggaacggcguguccugccaggagaccgccgucacccagaccuacgggggcaacagcaacggcgagcccugcgugcuccccuucaccuacaacgggcgcaccuucuacuccugcaccaccgagggccggcaggacgggcaccuguggugcagcaccaccuccaacuacgagcaggaccagaaguacagcuucugcacggaccacaccgugcugguccagacccgcggcgggaacuccaacggcgcccucugccacuuccccuuccuguacaacaaccacaacuacaccgacugcaccagcgagggccgccgggacaacaugaaguggugcgggacgacccagaacuacgacgcggaccagaaguucggcuucugccccauggccgcccacgaggagaucugcaccaccaacgagggggugauguaccgcaucggcgaccagugggacaagcagcacgacauggggcacaugaugcggugcacgugcgugggcaacggccgcggggaguggaccugcaucgccuacucccagcugcgggaccagugcaucgucgacgacaucaccuacaacgugaacgacaccuuccacaagcgccacgaggagggccacaugcucaacugcacgugcuucgggcagggccgggggcgcuggaagugcgaccccgucgaccagugccaggacagcgagaccggcaccuucuaccagaucggcgacuccugggagaaguacgugcacggggugcgguaccagugcuacugcuacggccgcgggaucggcgaguggcacugccagccccugcagaccuaccccagcuccagcgggccggucgagguguucaucacggagacccccucccagcccaacagccaccccauccaguggaacgccccgcagcccucccacaucagcaaguacauccugcgguggcgccccaagaacuccgugggccgguggaaggaggcgaccaucccgggccaccucaacagcuacaccaucaaggggcugaagcccggcgucguguacgaggggcagcugaucagcauccagcaguacggccaccaggaggugacgcgcuucgacuucaccaccaccuccacgagcacccccgucaccuccaacaccgugacgggcgagaccacccccuucagcccgcucguggccaccuccgagagcgucacggagaucaccgccuccagcuucgugguguccugggucagcgccuccgacaccgugagcggguuccggguggaguacgagcuguccgaggagggcgacgagccccaguaccuggaccuccccagcaccgccacguccgucaacauccccgaccugcugccggggcgcaaguacaucgugaacguguaccagaucagcgaggacggcgagcagucccucauccugagcaccagccagaccaccgcgcccgacgcgccgcccgacccgacggucgaccagguggacgacaccuccaucgugguccgguggagccgcccccaggcccccaucaccggguaccggaucguguacucccccagcguggagggcuccagcaccgagcugaaccucccggagaccgccaacuccgucacgcugagcgaccugcagcccggcgugcaguacaacaucaccaucuacgccguggaggagaaccaggaguccacccccgucgugauccagcaggagaccacggggacgccccgcagcgacaccgugccgagcccccgcgaccuccaguucgucgaggugaccgacgugaaggucaccaucauguggacgccgcccgaguccgcggugaccggcuaccggguggacgucaucccggugaaccugcccggggagcacggccagcgccugcccaucucccggaacaccuucgccgaggugacggggcucagcccgggcgucaccuacuacuucaagguguucgccgugucccacggccgcgagagcaagccccugaccgcccagcagaccacgaagcuggacgcgcccaccaaccuccaguucgucaacgagaccgacuccaccgugcuggugcgguggacgcccccgcgcgcccagaucaccggguaccggcugaccgucggccucacccgccgggggcagccccgccaguacaacgugggccccagcguguccaaguacccccugcggaaccugcagccggccagcgaguacacggucagccugguggccaucaaggggaaccaggagucccccaaggccaccggcgucuucaccacccuccagcccggcagcuccaucccgcccuacaacacggaggugaccgagaccaccaucgugaucacguggacccccgcgccccgcaucggguucaagcugggcguccggcccagccagggcggggaggcgccccgcgaggugaccuccgacagcggcuccaucguggucagcgggcugacccccggcguggaguacguguacacgauccagguccuccgggacgggcaggagcgcgacgcccccaucgugaacaagguggucacgccccucuccccgcccaccaaccugcaccucgaggccaaccccgacaccggcgugcugaccgugagcugggagcgguccacgacccccgacaucaccggguaccgcaucaccacgaccccgaccaacggccagcagggcaacagccuggaggaggucgugcacgccgaccaguccagcugcaccuucgacaaccucucccccgggcuggaguacaacgugagcgucuacacggugaaggacgacaaggaguccgugcccaucagcgacaccaucauccccgccgucccgccgcccaccgaccugcgguucaccaacaucggcccggacacgaugcgcgugaccugggcgccgccgcccuccaucgaccucaccaacuuccuggugcgguacagcccggucaagaacgaggaggacguggccgagcugagcaucucccccagcgacaacgccgugguccucaccaaccugcugcccgggacggaguacgugguguccgucagcuccguguacgagcagcacgagagcacgccccuccgcggccgccagaagaccgggcuggacuccccgaccggcaucgacuucagcgacaucacggccaacuccuucaccgugcacuggaucgcgccccgggccaccaucaccggcuaccgcauccggcaccaccccgagcacuucagcgggcgcccccgggaggaccgcgucccgcacucccggaacagcaucacgcugaccaaccucacccccggcaccgaguacgugguguccaucgucgcccugaacgggcgcgaggagagcccccugcucaucggccagcaguccacggugagcgacgugccccgggaccuggaggucguggccgcgaccccgaccucccugcucaucagcugggacgcccccgccgugaccguccgcuacuaccggaucacguacggggagaccggcggcaacucccccgugcaggaguucaccgugcccgggagcaagagcaccgccacgaucuccggccugaagccgggggucgacuacaccaucaccguguacgccgugaccggccgcggggacagccccgcguccagcaagcccaucuccaucaacuaccggacggagaucgacaagcccagccagaugcaggucaccgacgugcaggacaacuccaucagcgugaaguggcugccguccagcucccccgucaccggcuaccgcgugaccaccacgcccaagaacggccccgggccgaccaagaccaagaccgccggccccgaccagacggagaugaccaucgaggggcuccagcccaccgucgaguacguggugagcgucuacgcccagaacccguccggcgagagccagccccuggugcagaccgccgugacgaacaucgaccggcccaagggccuggccuucaccgacgucgacguggacuccaucaagaucgcgugggagagcccccagggccaggugucccgcuaccgggucaccuacagcuccccggaggacggcauccacgagcuguuccccgcccccgacggggaggaggacaccgccgagcugcagggccugcgccccgggagcgaguacacggugagcguggucgcccuccacgacgacauggagucccagccgcugaucggcacccagagcaccgccauccccgcgcccaccgaccugaaguucacccaggugacccccaccucccucagcgcccaguggaccccgcccaacgugcagcugacgggcuaccggguccgcgugacccccaaggagaagaccgggcccaugaaggagaucaaccuggccccggacuccagcuccguggucgugagcggccucaugguggccaccaaguacgaggucuccguguacgcgcugaaggacacgcugaccagccgccccgcccaggggguggucaccacccucgagaacgugagcccgccccggcgcgcccgggugacggacgccaccgagaccaccaucacgaucagcuggcgcaccaagaccgagaccaucacgggcuuccaggucgacgccgugccggcgaacgggcagacccccauccagcggaccaucaagcccgacgugcgcuccuacaccaucaccggccugcagcccggcacggacuacaagaucuaccuguacacccucaacgacaacgcccggagcuccccggucgugaucgacgccagcaccgccaucgacgcccccuccaaccugcgcuuccuggcgaccacgcccaacagccuccugguguccuggcagccgccccgggcccgcaucaccggguacaucaucaaguacgagaagcccggcagcccgccccgggaggucgugccccgcccccggcccggggugaccgaggccaccaucacgggccuggagcccgggaccgaguacaccaucuacgucaucgcccucaagaacaaccagaaguccgagccccugaucggccgcaagaagaccgacgagcugccccagcucgugacgcugccccacccgaaccugcacggccccgagauccucgacgugcccuccaccguccagaagacccccuucgugacccacccgggguacgacacgggcaacgggauccagcugcccggcaccagcgggcagcagcccuccgugggccagcagaugaucuucgaggagcacggcuuccggcgcaccacgccgcccacgaccgccacccccauccggcaccgcccccggcccuacccgcccaacgucgggcaggaggcgcugagccagaccacgaucuccugggcccccuuccaggacaccagcgaguacaucaucuccugccaccccgugggcaccgacgaggagccccuccaguuccgcgugcccgggaccagcacguccgccacccugaccggccugacccggggcgccacguacaacaucaucgucgaggcccucaaggaccagcagcgccacaaggugcgcgaggagguggucaccguggggaacagcgugaacgagggccugaaccagcccaccgacgacuccugcuucgacccguacaccgucagccacuacgcggugggggacgagugggagcggauguccgagagcggcuucaagcugcucugccagugccugggguucggcuccggccacuuccgcugcgacagcucccgguggugccacgacaacggggucaacuacaagaucggcgagaagugggaccgccagggggagaacggccagaugaugagcugcacgugccuggggaacggcaagggcgaguucaagugcgacccccacgaggcgaccugcuacgacgacgggaagaccuaccacgugggcgagcaguggcagaaggaguaccucggggccaucugcagcugcacgugcuucggcgggcagcggggcuggcgcugcgacaacugccggcgccccggcggggagcccuccccggagggcaccacggggcagagcuacaaccaguacucccagcgguaccaccagcgcaccaacaccaacgugaacugccccaucgagugcuucaugccccuggacguccaggccgaccgggaggacagccgcgaguga

SEQ ID NO: 30228 - RNA, 930 nt, Artificial Sequence
  derived and/or modified sequence opt1 from FN3K__Homo_sapiens__NP_071441
auggagcagcugcuccgcgccgagcugcggaccgccacccugcgcgcguucggcgggcccggcgccgggugcaucagcgagggccgggccuacgacacggacgccgggccgguguucgucaaggugaaccgccggacccaggcccgccagauguucgagggcgagguggcgucccucgaggcccugcggagcaccggccugguccgcgugccccggcccaugaaggugaucgaccuccccgggggcggggccgccuucgucauggagcaccugaagaugaagucccugagcucccaggcgagcaagcucggcgagcagauggccgaccugcaccuguacaaccagaagcuccgcgagaagcugaaggaggaggagaacaccguggggcggcgcggcgagggcgccgagccgcaguacguggacaaguucggguuccacacggugaccugcugcggcuucaucccccaggucaacgaguggcaggacgacuggcccaccuucuucgcccggcaccgccugcaggcccagcucgaccugaucgagaaggacuacgcggaccgggaggcccgcgagcuguggucccggcuccaggugaagauccccgaccuguucugcgggcuggagaucgucccggcccuccugcacggcgaccuguggagcggcaacguggccgaggacgacguggggcccaucaucuacgaccccgccuccuucuacggccacagcgaguucgagcucgcgaucgcccugauguucgggggcuucccccgcuccuucuucaccgccuaccaccggaagaucccgaaggcccccggguucgaccagcgccugcuccuguaccagcuguucaacuaccucaaccacuggaaccacuucggccgggaguaccgcagccccucccugggcacgaugcgccggcugcucaaguga

SEQ ID NO: 30229 - RNA, 930 nt, Artificial Sequence
  derived and/or modified sequence opt1 from FN3KRP__Homo_sapiens__NP_078895
auggaggagcugcuccgccgggagcugggcugcagcuccgugcgcgccaccgggcacagcggcgggggcugcaucucccaggggcggagcuacgacaccgaccagggccgcgucuucgugaaggugaaccccaaggccgaggcgcggcgcauguucgagggcgagauggccucccugacggccauccucaagaccaacaccgucaaggugccgaagcccaucaaggugcuggacgcccccgggggcgggagcguccuggugauggagcacauggacaugcggcaccucuccagccacgccgcgaagcugggcgcccagcuggccgaccuccaccuggacaacaagaagcugggggagaugcgccucaaggaggccggcaccgugggccgcgggggcgggcaggaggagcggcccuucgucgcgcgguucggcuucgacguggugacgugcugcggcuaccugccgcaggucaacgacuggcaggaggacugggugguguucuacgcccgccagcggauccagccccagauggacauggucgagaaggaguccggggaccgcgaggcccugcagcucuggagcgcccugcagcugaagauccccgaccucuuccgggaccuggagaucauccccgcccugcuccacggcgaccuguggggcgggaacguggcggaggacuccagcgggccggugaucuucgaccccgccuccuucuacggccacagcgaguacgagcuggccaucgccggcauguucgggggcuucuccagcuccuucuacagcgccuaccacgggaagauccccaaggcgcccggcuucgagaagcgccuccagcuguaccagcuguuccacuaccucaaccacuggaaccacuucggguccggcuaccggggcagcagccugaacaucaugcgcaaccuggucaaguga

SEQ ID NO: 30230 - RNA, 1854 nt, Artificial Sequence
  derived and/or modified sequence opt1 from FNBP1__Homo_sapiens__NP_055848
augagcuggggcaccgagcugugggaccaguucgacaaccucgagaagcacacccagugggggaucgacauccuggagaaguacaucaaguucgugaaggagcgcacggagaucgagcuguccuacgccaagcagcuccggaaccugagcaagaaguaccagcccaagaagaacuccaaggaggaggaggaguacaaguacaccagcugcaaggccuucaucuccaaccugaacgagaugaacgacuacgcgggccagcacgaggucaucagcgagaacauggccucccagaucaucguggaccucgcccgcuacgugcaggagcugaagcaggagcgcaagagcaacuuccacgacgggcggaaggcccagcagcacaucgagaccugcuggaagcagcuggaguccagcaagcggcgcuucgagcgggacugcaaggaggccgaccgcgcgcagcaguacuucgagaagauggacgccgacaucaacgucaccaaggccgacguggagaaggcccggcagcaggcgcagauccgccaccagauggccgaggacuccaaggccgacuacagcuccauccuccagaaguucaaccacgagcagcacgaguacuaccacacgcacaucccgaacaucuuccagaagauccaggagauggaggagcggcgcaucgugcggaugggcgagagcaugaagaccuacgccgaggucgaccgccaggugauccccaucaucgggaagugccuggacggcaucgugaaggccgcggaguccaucgaccagaagaacgacagccagcuggucaucgaggccuacaaguccggcuucgagccgcccggggacaucgaguucgaggacuacacccagcccaugaagcggaccgugagcgacaacucccucagcaacagccgcggcgaggggaagcccgaccugaaguucggcgggaaguccaagggcaagcuguggcccuucaucaagaagaacaagcucaugagccugcugacgagcccccaccagccgcccccgccgccgcccgccuccgccucccccagcgccgugcccaacggcccccagucccccaagcagcagaaggagccccucagccaccgguucaacgaguucaugaccuccaagcccaagauccacugcuuccgcagccugaagcgggggcugucccucaagcugggcgcgacccccgaggacuucagcaaccugccgcccgagcagcgccggaagaagcuccagcagaaggucgacgagcugaacaaggagauccagaaggagauggaccagcgcgacgccaucaccaagaugaaggacguguaccugaagaacccccagaugggggaccccgccucccucgaccacaagcuggccgaggugagccagaacaucgagaagcugcgcgucgagacgcagaaguucgaggccuggcucgcggagguggagggccggcugcccgcccgcuccgagcaggcccggcgccagagcggccuguacgacucccagaacccgcccaccgugaacaacugcgcccaggaccgggagagccccgacggguccuacaccgaggagcagagccaggagagcgagaugaagguccucgccaccgacuucgacgacgaguucgacgacgaggagccccugcccgcgaucggcacgugcaaggcccuguacaccuucgaggggcagaacgagggcaccaucuccgugguggagggggagacccucuacgucaucgaggaggacaagggcgacggcuggacgcgcauccggcgcaacgaggacgaggagggguacgugccgaccagcuacguggaggucugccuggacaagaacgccaaggacuccuga

SEQ ID NO: 30231 - RNA, 5685 nt, Artificial Sequence
  derived and/or modified sequence opt1 from FNDC1__Homo_sapiens__NP_115921
auggcccccgaggccggcgccacccugcgcgcgccccggcgccuguccugggccgcccugcugcugcuggccgcccugcuccccguggccuccuccgccgccgccuccguggaccacccccugaagccccggcacgugaagcugcucagcaccaagauggggcugaaggugaccugggacccgcccaaggacgccaccucccgccccgucgagcacuacaacaucgccuacggcaagagccugaagucccucaaguacaucaaggugaacgccgagaccuacagcuuccugaucgaggacguggagcccggggucguguacuucgugcugcucaccgccgagaaccacuccggcgucagccggcccguguaccgcgccgagagcccgcccgggggcgaguggaucgagaucgacggcuuccccaucaaggggcccggccccuucaacgagaccgugaccgagaaggagguccccaacaagccccugcgggugcgcgugcggagcuccgacgaccgccugagcgucgccuggaaggcgccccggcucuccggggccaagagcccccgccggucccgcggcuuccugcugggguacggcgagagcggccggaagaugaacuacgugccccucacccgcgacgagcggacccacgagaucaagaagcuggccuccgagagcguguacgucgugagccugcaguccaugaacagccaggggcgcucccagcccguguaccgggccgcccucacgaagcgcaagaucagcgaggaggacgagcuggacguccccgacgacaucuccgugcgggugaugagcucccagagcguccugguguccugggucgaccccgugcucgagaagcagaagaagguggucgccagccgccaguacaccgugcgcuaccgggagaagggcgagcuggcccgcugggacuacaagcagaucgccaaccggcgcgugcugaucgagaaccucauccccgacaccgucuacgaguucgccgugcggaucucccagggggagcgcgacggcaaguggagcaccuccguguuccagcggacgcccgagagcgcccccaccaccgcccccgagaaccugaacgucuggcccgugaacggcaagcccaccguggucgccgccuccugggacgcgcugccggagacggaggggaaggugaaggaguacauccucagcuacgcccccgcccugaagcccuucggcgccaagucccugaccuacccgggggacaccaccagcgcgcucguggacggccugcagcccggggagcgcuaccuguucaagauccgggccacgaaccgccggggccucggcccccacuccaaggccuucaucgucgccaugcccaccaccagcaaggccgacguggagcagaacaccgaggacaacgggaagccggagaagcccgagcccagcucccccagcccgcgcgcgcccgccuccagccagcaccccuccgugcccgccagcccgcagggccggaacgccaaggaccugcugcucgaccugaagaacaagauccuggccaacgggggcgcgccccgcaagccccagcuccgggccaagaaggccgaggagcuggaccugcaguccacggagaucaccggggaggaggagcucggcagccgcgaggacucccccaugagcccguccgacacccaggaccagaagcggacccugcggccgcccagccggcacggccacuccgucguggcccccgggcgcacggccgugcgcgcgcggaugccggcccugccccgccgggagggcgucgacaagcccggguucagccuggccacccagccccgcccgggcgcgccgcccuccgcgagcgccuccccggcccaccacgccagcacccaggggaccagccaccggcccucccuccccgccagccugaacgacaacgaccugguggacuccgacgaggacgagcgcgcggugggcagccuccaccccaagggcgccuucgcccagccgcggcccgcccugucccccagccgccagucccccagcuccguccugcgggaccgcagcuccgugcacccgggggccaagcccgcgagccccgcccggcgcacgccccacuccggcgccgccgaggaggacagcuccgccagcgcgccgcccucccggcucuccccgccccacgggggcuccagccgccugcugccgacccagccccaccucagcagcccccugagcaagggcgggaaggacggcgaggacgcccccgccaccaacuccaacgccccgagccgguccaccaugagcuccagcguguccagccaccuguccagccgcacgcaggucuccgagggggcggaggccagcgacggcgagucccacggggacggcgaccgggaggacggcgggcgccaggccgaggccaccgcccagacccuccgggcgcgccccgccagcggccacuuccaccuccugcggcacaagcccuucgccgccaacgggcgcucccccagccgcuucuccaucggccgggggccgcgccuccagcccagcagcagcccccagagcaccgugcccucccgggcccacccgcgcgugcccagccacuccgacagccaccccaagcuguccagcggcauccacggcgacgaggaggacgagaagccgcugcccgcgaccgucgugaacgaccacgugcccuccagcucccggcagcccaucagccgcgggugggaggaccuccggcgcuccccgcagcggggcgccagccugcaccgcaaggagcccauccccgagaaccccaaguccacgggggccgacacccacccgcagggcaaguacagcucccuggccagcaaggcccaggacguccagcaguccaccgacgcggacaccgaggggcacagccccaaggcccagcccggcagcacggaccggcacgccucccccgcccgcccgcccgccgcgcggagccagcagcaccccuccgugccccgccggaugaccccgggccgcgcgccccagcagcagccgcccccgcccguggccaccagccagcaccaccccgggccccagucccgggacgccggccgcagccccucccagccccggcucagccugacccaggcggggcgcccccgccccacgucccagggccggagccacuccagcuccgacccguacaccgccagcucccgcgggaugcugcccaccgcccuccagaaccaggacgaggacgcccagggcagcuacgacgacgacuccaccgaggucgaggcccaggacgugcgggcgcccgcccacgccgcccgcgccaaggaggcggccgccagccugccgaagcaccagcaggucgagucccccacgggcgccggggccggcggggaccaccggagccagcgcggccacgcggccagccccgcccggcccucccgcccgggcgggccccagagccgggcccgcguccccucccgggcggcccccggcaagagcgagccgcccuccaagcgcccccugagcuccaagagccagcaguccgugagcgccgaggacgacgaggaggaggacgccggguucuucaagggcgggaaggaggaccuccuguccagcuccgugcccaaguggccgagcuccagcacgccccgcggcggcaaggacgccgacgggucccuggcgaaggaggagcgcgagcccgccaucgcccucgcgccccggggcgggagccuggccccggucaagcgcccccugccgcccccgcccggcuccagcccccgggcgagccacgugcccucccgccucccgccccggagcgccgccaccgugucccccgucgccgggacccaccccuggccccaguacaccacccgcgcgccgcccggccacuucagcaccaccccgaugcugucccugcggcagcgcaugaugcacgcgcgcuuccggaacccccucagccgccagcccgcccggcccuccuaccgccagggcuacaacgggcggccgaacguggagggcaaggugcugcccgggagcaacggcaagcccaacgggcagcgcaucaucaacggcccccagggcacgaagugggucguggaccuggaccgggggcucgugcugaacgccgagggccgcuaccugcaggacucccacgggaacccgcuccggaucaagcugggcggcgacgggcgcaccaucgucgaccuggagggcacccccguggucagccccgacgggcucccccuguucggccaggggcggcacggcaccccgcuggccaacgcgcaggacaagcccauccucucccugggcgggaagccccuggugggccucgaggugaucaagaagacgacccacccgcccaccaccacgaugcagcccaccaccaccacgacgccccugcccaccaccacgacgccccgccccaccaccgccaccacccggcgcaccaccaccacgcggcgcaccaccacccggcgccccacgaccaccguccggaccacgacccgcaccaccacgaccaccacccccacgccgaccacccccaucccgaccugcccgcccgggacgcuggagcgccacgacgacgacggcaaccucaucaugagcuccaacgggauccccgagugcuacgccgaggaggacgaguucagcggccuggagaccgacaccgccgugcccaccgaggaggccuacgugaucuacgacgaggacuacgaguucgagacgucccggccgcccaccaccaccgagcccagcacgaccgcgaccacgccccgcgucaucccggaggagggcgccaucuccagcuuccccgaggaggaguucgaccuggccgggcggaagcgcuucguggcccccuacgugacguaccucaacaaggaccccagcgccccgugcucccugaccgacgcgcuggaccacuuccaggucgacagccucgacgagaucauccccaacgaccugaagaaguccgaccugccgccccagcacgccccgcggaacaucaccgugguggccgucgagggcugccacagcuucgugaucguggacugggacaaggccacccccggggacgucgugaccggcuaccucguguacuccgccagcuacgaggacuucauccgcaacaagugguccacgcaggcgagcuccgucacccaccuccccaucgagaaccugaagcccaacacccgguacuacuucaaggugcaggcccagaacccgcacggguacggccccaucagccccuccgugagcuucgucaccgaguccgacaacccccuccugguggugcgcccgcccggcggggagcccaucuggauccccuucgccuucaagcacgacccgagcuacacggacugccacggccggcaguacgucaagcgcaccugguaccggaaguucgugggggugguccugugcaacucccuccgcuacaagaucuaccugagcgacaaccugaaggacaccuucuacuccaucggcgacagcugggggcggggcgaggaccacugccaguucguggacucccaccucgacggccgcaccgggccccagagcuacguggaggcccugcccacgauccagggcuacuaccggcaguaccgccaggagccgguccgguucgggaacaucggcuucggcacccccuacuacuacguggggugguacgagugcggcgugagcauccccgggaagugguga

SEQ ID NO: 30232 - RNA, 3597 nt, Artificial Sequence
  derived and/or modified sequence opt1 from FNDC3A__Homo_sapiens__NP_001073141
auggccgagcacccgccccugcucgacaccacccagauccugagcuccgacaucagccugcucuccgcccccaucgugagcgcggacggcacgcagcaggucauccugguccaggugaaccccggggaggccuucaccauccgccgggaggacggccaguuccagugcaucaccgggcccgcccagguccccaugaugucccccaacggcagcgugccgcccaucuacgugccgcccggguacgcgccccaggucaucgaggacaacggcgugcgccggguggucguggugccccaggcccccgaguuccaccccggcucccacaccguccugcaccgcagcccccacccgccccuccccggguucauccccgugcccacgaugaugccgcccccgccccggcacauguacucccccgugaccggcgccggggacaugaccacccaguacaugccccaguaccagagcucccaggucuacggcgacguggacgcccacagcacgcacgggcgcuccaacuuccgggacgagcgcagcuccaagaccuacgagcggcugcagaagaagcugaaggaccgccagggcacccagaaggacaagaugagcuccccgcccagcagcccccagaagugccccucccccaucaacgagcacaacggccucaucaaggggcagaucgccggcgggaucaacaccggcagcgccaagaucaaguccggcaaggggaagggcgggacccagguggacacggagaucgaggagaaggacgaggagaccaaggcguucgaggcccugcugagcaacaucgucaagccgguggccuccgacauccaggcccggaccgugguccucacguggagcccgcccuccagccugaucaacggcgagaccgacgaguccagcgugcccgagcuguacggguacgaggugcucaucuccagcaccggcaaggacggcaaguacaaguccgucuacgugggggaggagaccaacaucacgcugaacgaccugaagcccgccauggacuaccacgcgaagguccaggccgaguacaacagcaucaagggcacccccuccgaggccgagaucuucaccacccucagcugcgagcccgacauccccaacccgccccgcaucgccaaccggacgaagaacucccugacccugcaguggaaggcccccagcgacaacggguccaagauccagaacuucgugcucgagugggacgagggcaaggggaacggcgaguucugccagugcuacaugggcagccagaagcaguucaagaucaccaagcugucccccgcgauggggugcaaguuccgccugagcgcccggaacgacuacggcaccagcggguucuccgaggaggugcucuacuacacgagcggcugcgccccguccaugcccgccagccccguccugaccaaggccgggaucaccuggcugucccuccaguggagcaagcccuccggcaccccgagcgacgagggcaucuccuacauccuggagauggaggaggagacgagcggguacggcuucaagcccaaguacgacggggaggaccuggcguacaccgugaagaaccuccgccgguccaccaaguacaaguucaaggugaucgccuacaacagcgagggcaaguccaaccccagcgaggucguggaguucaccacgugccccgacaagccgggcauccccgugaagcccuccgucaaggggaagauccacagccacuccuucaagaucaccugggacccgcccaaggacaacggcggggccaccaucaacaaguacgugguggagauggccgagggcagcaacgggaacaagugggagaugaucuacagcggcgccacccgcgagcaccugugcgaccggcugaaccccggcugcuucuaccgccuccgggucuacugcaucuccgacgggggccagagcgcgguguccgagagccugcuggugcagacccccgccgucccgcccgggcccugccugcccccgcgccuccagggccgccccaaggccaaggagauccagcugcggugggggccgccccucguggacggcggcucccccaucagcugcuacuccguggagaugagccccaucgagaaggacgagccccgcgaggucuaccagggguccgagguggagugcacggugagcucccugcugcccggcaagaccuacagcuuccggcuccgcgccgcgaacaagaugggguucggcccguucuccgagaagugcgacaucaccaccgcccccgggccgcccgaccagugcaagccgccccaggucacgugccggagcgcgaccugcgcccaggugaacugggaggugccccuguccaacggcaccgacgucaccgaguaccgccuggaguggggcgggguggagggcagcaugcagaucugcuacugcgggcccggccucuccuacgagaucaaggggcugagccccgccacgaccuacuacugccgggugcaggcccuguccgucgugggcgccggccccuucagcgagguggucgccugcgugaccccgcccagcgugcccgggaucgugaccugccuccaggagaucuccgacgacgagaucgagaacccccacuacagccccuccacgugccuggccaucagcugggagaagcccugcgaccacggcuccgagauccuggccuacagcaucgacuucggggacaagcagucccugaccgugggcaaggugaccagcuacaucaucaacaaccuccagccggacaccacguaccgcauccggauccaggcgcugaacucccugggcgccgggcccuucagccacaugaucaagcucaagaccaagccccugccgcccgacccgccccgccuggagugcgucgccuucucccaccagaaccucaagcugaaguggggcgaggggacccccaagacccugagcacggacuccauccaguaccaccuccagauggaggacaagaacggccgguucgugagccuguaccgcgggcccugccacaccuacaaggugcagcggcugaacgaguccaccagcuacaaguucugcauccaggccugcaacgaggccggcgagggcccccucucccaggaguacaucuucaccacgcccaagagcgucccggcggcccugaaggcccccaagaucgagaaggugaacgaccacaucugcgagaucaccugggagugccugcagcccaugaagggggaccccgugaucuacucccuccaggucaugcugggcaaggacagcgaguucaagcagaucuacaaggggccggacagcuccuuccgcuacagcucccugcagcucaacugcgaguaccgguuccgcgugugcgccauccggcagugccaggacagccugggccaccaggaccugguggggcccuacuccaccaccguccucuucaucagccagcgcacggagccgcccgcguccaccaaccgggacaccguggagagcacccgcacgcgccgggcccuguccgacgagcagugcgccgccgugauccugguccucuucgccuucuucagcauccugaucgcguucaucauccaguacuucgugaucaaguga

SEQ ID NO: 30233 - RNA, 3615 nt, Artificial Sequence
  derived and/or modified sequence opt1 from FNDC3B__Homo_sapiens__NP_001128567
auguacgugaccaugaugaugaccgaccagaucccccuggagcucccgccccugcugaacggcgaggucgccaugaugccccaccucgugaacggggacgccgcgcagcaggucauccugguccaggugaaccccggcgagacguucaccauccgcgccgaggacgggacccugcagugcauccagggcccggccgaggugcccaugaugagccccaacggguccaucccgcccauccacgucccgcccggcuacaucagccaggugaucgaggacuccaccggcgugcggcgcgucguggugacgccccagagccccgagugcuacccgcccuccuaccccagcgccaugucccccacccaccaccucccgcccuaccugacccaccacccccacuucauccacaacagccacaccgccuacuacccgcccgucacggggcccggcgacaugccgccccaguucuucccccagcaccaccucccccacaccaucuacggggagcaggagaucauccccuucuacggcauguccaccuacaucacccgggaggaccaguacagcaagccgccccacaagaagcucaaggaccgccagaucgaccggcagaaccgccugaacagcccgcccuccuccaucuacaagagcuccugcacgaccguguacaacggguacggcaagggccacagcgggggcuccgggggcggcgggagcggcuccgggcccggcaucaagaagaccgagcggcgcgcgcggagcagccccaaguccaacgacagcgaccugcaggaguacgagcucgaggugaagcgcguccaggacauccuguccgggaucgagaagccccaggugagcaacauccaggcccgggccgugguccuguccugggccccgcccgugggccucagcugcggcccccacuccgggcugagcuuccccuacuccuacgagguggcgcugagcgacaagggccgcgacgggaaguacaagaucaucuacuccggcgaggagcucgagugcaaccugaaggaccugcggccggccaccgacuaccacguccgcguguacgccauguacaacagcgugaagggguccugcagcgagcccgucuccuucacgacccacagcugcgcccccgagugccccuucccgcccaagcucgcccaccgguccaagagcucccugacccugcaguggaaggcgcccaucgacaacggcagcaagaucaccaacuaccugcuggagugggacgagggcaagcgcaacagcggguuccggcagugcuucuucggcucccagaagcacugcaagcugacgaagcucugccccgccaugggguacaccuuccgccuggccgcccggaacgacaucggcaccagcggguacucccaggagguggugugcuacacccugggcaacaucccccagaugcccagcgcgccccgccucgugcgggccggcaucacgugggugacccugcagugguccaagcccgaggggugcagcccggaggaggucaucaccuacacccuggagauccaggaggacgagaacgacaaccucuuccaccccaaguacacgggcgaggaccugaccugcaccgugaagaaccugaagcgcuccacccaguacaaguuccgccucacggccagcaacaccgaggggaaguccugccccagcgaggugcuggucugcaccaccucccccgaccggccgggcccgcccacgcgcccccuggugaagggccccgugaccagccacggguucuccgucaagugggacccgcccaaggacaacggcgggagcgagauccucaaguaccugcuggagaucaccgacggcaacuccgaggccaaccagugggagguggccuacagcggguccgccaccgaguacaccuucacgcaccucaagcccggcacccuguacaagcugcgggcgugcugcaucagcaccggcgggcacagccagugcuccgagagccuccccgugcgcacccuguccaucgcccccggccagugccggcccccgcgcguccuggggcggcccaagcacaaggaggugcaccucgagugggacgugcccgccagcgaguccggcugcgaggucagcgaguacuccguggagaugacggagcccgaggacguggccagcgaggucuaccacgggccggagcuggagugcaccgugggcaaccugcugcccggcaccguguaccgcuuccggguccgcgcccucaacgacgggggcuacgggcccuacuccgacgugagcgagaucaccacggcggccgggcccccgggccagugcaaggcccccugcaucuccugcacccccgacggcugcgugcuggucggcugggagagccccgacuccagcggggccgacaucuccgaguaccggcuggaguggggcgaggacgaggagagccucgagcugaucuaccacgggaccgacacccgcuucgagauccgggaccugcucccggcggcccaguacugcugccgccugcaggccuucaaccaggccggcgccgggcccuacuccgagcuggugcucugccagacgcccgcgagcgcccccgacccgguguccacccugugcguccuggaggaggagccccucgacgccuaccccgacagccccagcgccugccuggugcugaacugggaggagccgugcaacaacggcuccgagauccucgccuacaccaucgaccugggcgacaccagcaucacgguggggaacaccaccaugcacgucaugaaggaccugcuccccgagaccacguaccggauccgcauccaggcgaucaacgagaucggcgccgggcccuucucccaguucaucaaggccaagacccggccgcugccgccccugccgccccgccucgagugcgccgccgcgggcccccagagccugaagcugaaguggggcgacuccaacagcaagacccacgccgccgaggacaucguguacacccuccagcuggaggaccggaacaagcgcuucaucuccaucuaccgcgggcccagccacacguacaaggugcagcggcugaccgaguucacgugcuacuccuuccgcauccaggccgcgagcgaggccggcgaggggcccuucuccgagaccuacaccuucagcaccaccaaguccgucccgcccaccaucaaggcgccccgggugacgcagcucgagggcaacagcugcgagauccugugggagaccgugcccuccaugaagggggaccccgucaacuacauccuccaggugcuggugggccgcgagagcgaguacaagcaggucuacaagggcgaggaggccaccuuccagaucuccgggcugcagaccaacacggacuaccgguuccgcgugugcgccugccggcgcugccuggacaccagccaggagcucuccggcgccuucagccccagcgccgccuucgugcugcagcgguccgaggucaugcugaccggggacaugggcagccucgacgaccccaagaugaaguccaugaugcccaccgacgagcaguucgccgccaucaucgugcugggguucgcgacccugagcauccucuucgccuucauccugcaguacuuccugaugaaguga

SEQ ID NO: 30234 - RNA, 705 nt, Artificial Sequence
  derived and/or modified sequence opt1 from FNDC4__Homo_sapiens__NP_073734
augcccagcggcugccacuccagcccgcccuccgggcugcgcggcgacauggccagccucgugccccugucccccuaccugagcccgaccguccuccugcugguguccugcgaccucggguucgugcgggccgaccgcccgcccagccccgucaacgugaccgugacgcaccuccgggcgaacuccgccaccgucagcugggacgugcccgagggcaacaucgugaucggguacuccaucagccagcagcgccagaacggccccggccagcgggucauccgcgaggugaacaccaccacgcgggccugcgcccugugggggcuggccgaggacuccgacuacaccgugcagguccgcagcaucggccugcgcggggaguccccgcccggcccccgggugcacuuccggacccugaaggggagcgaccgccuccccuccaacagcuccagccccggcgacaucaccguggagggccuggacggggagcggccccugcagacgggcgaggucgugaucaucguggucgugcuccugaugugggcggccgugaucgggcuguucugccgccaguacgacaucaucaaggacaacgacagcaacaacaacccgaaggagaagggcaagggccccgagcagagcccccaggggcggcccgucggcacccgccagaagaaguccccguccaucaacaccaucgacguguga

SEQ ID NO: 30235 - RNA, 1140 nt, Artificial Sequence
  derived and/or modified sequence opt1 from FNTA__Homo_sapiens__NP_002018
auggccgccaccgagggcgugggggaggcggcccagggcggggagcccggccagccggcccagcccccgccccagccccacccgcccccgccccagcagcagcacaaggaggagauggccgccgaggcgggggaggccgucgccagccccauggacgacggcuucgugucccuggacagccccuccuacgugcucuaccgcgaccgggccgagugggcggacaucgaccccgucccccagaacgacggccccaaccccguggugcagaucaucuacagcgacaaguuccgcgacgucuacgacuacuuccgggccgugcugcagcgcgacgagcgguccgagcgcgccuucaagcugacccgggacgccaucgagcucaacgccgcgaacuacacgguguggcacuuccgccggguccugcucaagagccugcagaaggaccugcacgaggagaugaacuacaucaccgccaucaucgaggagcagcccaagaacuaccagguguggcaccaccgccgggugcuggucgaguggcuccgcgacccgucccaggagcuggaguucaucgccgacauccugaaccaggacgccaagaacuaccacgccuggcagcaccggcagugggugauccaggaguucaagcucugggacaacgagcugcaguacguggaccagcugcucaaggaggacguccgcaacaacagcguguggaaccagcgguacuucgugaucuccaacaccaccggguacaacgaccgcgcgguccuggagcgggaggugcaguacacgcuggagaugaucaagcucgugccccacaacgagagcgccuggaacuaccugaagggcauccugcaggaccgcgggcucuccaaguaccccaaccugcugaaccagcuccuggaccugcagcccagccacuccagcccguaccucaucgccuuccuggucgacaucuacgaggacaugcuggagaaccagugcgacaacaaggaggacauccucaacaaggcccuggagcugugcgagauccucgccaaggagaaggacaccauccggaaggaguacuggcgcuacaucggccggucccugcagagcaagcacuccaccgagaacgacagccccaccaacgugcagcaguga

SEQ ID NO: 30236 - RNA, 1314 nt, Artificial Sequence
  derived and/or modified sequence opt1 from FNTB__Homo_sapiens__NP_002019
auggccagccccuccagcuucaccuacuacugcccgcccuccagcucccccguguggagcgagccccuguacucccuccgcccggagcacgcccgggagcgccugcaggacgacagcgucgagaccgugacguccaucgagcaggcgaagguggaggagaagauccaggaggucuucagcuccuacaaguucaaccaccuggugccccggcucgugcugcagcgcgagaagcacuuccacuaccugaagcggggccuccgccagcugaccgacgccuacgagugccuggacgccagccggcccuggcucugcuacuggauccugcacucccuggagcuccuggacgagcccaucccgcagaucgucgccaccgacgugugccaguuccuggagcucugccagagccccgagggcggguucgggggcgggcccggccaguacccccaccuggccccgaccuacgcggccgugaacgcccugugcaucaucggcacggaggaggccuacgacaucaucaaccgcgagaagcuccugcaguaccuguacucccucaagcagcccgacgggagcuuccugaugcacgucggcggggagguggacgugcgguccgcguacugcgccgccagcgucgccucccugaccaacaucaucacccccgaccucuucgagggcaccgccgaguggaucgcgcgcugccagaacugggagggcgggaucggcggggugcccggcauggaggcccacgggggcuacacguucugcggccuggccgcccuggugauccucaagcgggagcgcagccugaaccucaagagccugcugcagugggucaccucccggcagaugcgcuucgagggcggguuccaggggcggugcaacaagcugguggacggcugcuacagcuucuggcaggccgggcuccugccgcugcuccaccgcgcgcugcacgcccagggcgaccccgcccuguccaugagccacuggauguuccaccagcaggcccuccaggaguacauccugaugugcugccagugccccgccggcgggcugcucgacaagcccggcaagucccgggacuucuaccacacgugcuacugccugagcgggcuguccaucgcgcagcacuucggcagcggggccaugcuccacgacgugguccugggcgugccggagaacgcccugcagcccacccaccccguguacaacaucggccccgacaaggucauccaggccaccaccuacuuccuccagaagccggugcccggguucgaggagcugaaggacgagaccuccgccgagcccgcgaccgacuga

SEQ ID NO: 30237 - RNA, 5406 nt, Artificial Sequence
  derived and/or modified sequence opt1 from FOCAD__Homo_sapiens__NP_060264
augagcgacgacauccgcaagcgguucgaguuccccaacucccugauccagagccaggccgugggccaccucaucgccgcgguccugaaggagaacggguucuccgagaagauccaccagagcaccaaccagaccccggcccugaaccuccugugggagaagugcugcuccgacaacguggugguccgcacggccugcugcgagggccugguggcccucguggcccaggaccacgcggaguucagcuacguccugaacgggauccugaaccucauccccuccacccggaacacccacggccugaucaaggccaucaugcaccugcuccagaugcaggcccugaaggaggggcagggcggcgagaagaacauccagagcaucuacaccauccgcaaccacccccacccccugaucacggugcucgagcaccggccggacugcuggcccguguuccugcagcagcugaccgccuucuuccagcagugccccgagcgccucgaggucuccugcauccagaucauggcgcccuuccugugguaccuguacugcgagccgagccagcuccaggaguacgccaagcugcggcuggcccuccugaaggugcugcuccagccccaggugcugugcgacaaggaccagcccuccauccuggagcagcagauccuccagcugugcugcgacaucguccccugccugcaggugaaggaccucauccagaccaccgaggccaugauguucaucgaggaggugugccugagccugcuccgccacccggucuucuggaagauccagcugacgcagaugucccugcagcuccugugcgugagcgaggugucccugaagaucaccggggagugcagcuccagcauccaccuccuggagcacuccgucgagcugcucaaggaggacuuccccguggagcuggugaucaucggcaucgcccugcuccugcugcagacccccgcgagccagcagaagcccauccugaaccucgcccugaagcugcucagcgucaccgaggaccagaagaucccgaaguccagccugcugcucgugaugcccauccugcagauccuguccagcacggcccucgaggacugcaucuccguggacgaggaggggcccagccggcagcagcuggcccugaaccuccuggagaugauccagcaggagugcuaccgcgacgaccaccagaagcuguccuacaagcucgucugccccgugaccagcauguacggcaccaucuucaccgccuggcggauccuggaggucaugacggacuccagcgcggccuccgacuggcuggccagcguggagucccuccugccgaucaccgccgugauccccgcccccgcguuccugcuccuggcccaccugcucgucgaggacaaggggcagaaccugcaccagauccugaaggugaccaccgagcucgcccaggccgacagcucccaggugcccaaccugaucccgguccugauguucaagcucggccgcccccuggagcccauccuguacaacgacauccucuacacgcugcccaagcugggcgugcacaaggugugcaucgggcagauccuccggaucauccagcugcugggcaccaccccgcgccuccgggccgucacccugcgccugcucacgagccugugggagaagcaggaccggguguaccccgagcugcagcgcuucauggcgguguccgacguccccagccucuccguggggaaggaggugcagugggagaagcugaucgccaaggccgccagcauccgggacaucugcaagcagcgcccguaccagcacggcgcggacaugcuggccgccaucagccagguccucaacgagugcaccaagcccgaccaggccacccccgccgcgcuggugcugcagggccuccacgcccugugccaggccgagguggucugcauccgguccaccuggaacgcccugagccccaagcucuccugcgacacgcgcccgcugauccugaagacccucagcgagcuguucucccuggugcccagccucaccgugaacaccacggaguacgagaacuucaagguccaggugcuguccuuccuguggacccacacccagaacaaggaccccaucguggccaacgcggccuaccgcagccucgccaacuucuccgccggggagcacaccauccugcaccugcccgagaagauccggccggagauccccauccccgaggagcucgacgacgacgaggacgucgaggacguggaccugagcgugcccggcuccugcuaccugaagcuccugagccugacgccgccccucguccugcccgcccuggaggaguucuucaccucccucgugaagcaggagauggugaacaugccccgcgggaucuaccacagcgcgcugaagggcggggcccgguccgaccagggcaagaccgucgccggcaucccgaacuucauccugaagauguacgagaccaacaagcagcccgggcucaagcccggccuggccgggggcaugcuguucugcuacgacgugagcauguaccaguccaaggacgggaagccccucaaccgccugauggcgagccggggccgcagcuucaagcagaccucccuggcccucgugcacgagguccacauccagcugagcgaguggcaccgggccaucuuccugccgcaggccuggcucgccuacaugaaccgcgcguaccacgccauccugcagggccggcugggggagcucgagcugcagcugaagcacggcaaggaggagcccgaggaggugcaguacaagaaguccacggccuggcucugggugcgcgacaugcugaccgacgagaucaccaaggccgccgcgaaggagagccccgucgugaaggggaacgcccugcuggcccucuccagccuggccguggucgugucccggcacgaggccagccuguccagcgacuccgacggccuccuggaggugcagcccaacuuccugagcaugaaggagugggucuccauggugcucgacacccugcuggugaucgucgacagccacuaccagccgcgcgggcagcuccuguccugguucuacuacaagagcuacuccggcgagaacacggcgagcgccaucgcccgguccgccgcggccaccgcccugagccuccuggugcccguguucaucaucagcugcaaggagaaggucgaggagauccugaacaugcucaccgcccgccugcccggcaagccguccgccgacgagagccaggcggugcagauccacauggggcuggcccucggcauguuccugucccggcugugcgaggagaagcucagcgacaucuccgggcaggagaugaaccugcugcucaugaagagccuggacgcccuggagaacugcugcuucgacaccucccucgaguacaacacgggcugcauccugggcguggggcugguccucagccugaugucccacagcucccagaugcagagccgcgugcacgucgccgcccugcuccggaagcuguccgcgcacguggacgacagcggcucccagagccgcaccuuccaggaggugcuggccuacacccucuccugcgucugcaccagcgccuucuccgccgggaucaucgaggccacggaggcggaggacgugaugaacaagcugcggcugcucguggagaacagccagcagaccagcggcuucgcccuggcccuggggaacaucguccacggccucuccgugugcggccacgggaaggccgaggaccugggcagcaagcugcuccccgccuggauccgcaucgugcugaccgaggggacccccacgaugcugugccucgcggcccugcacggcauggucgcccuggugggguccgagggcgacgugaugcagcucaagagcgaggccauccagaccucccacuuccagggccgccugaacgaggucauccggacccugacccaggugaucagcguguccggggucaucggccuccagagcaacgcgguguggcugcuggggcaccuccaccuguccacgcugagcuccagccagucccgcgccagcgugcccaccgacuacuccuaccucccggagagcuccuucaucggcgccgccaucggguucuucaucaccggcggcaagaaggggcccgagagcgucccccccucccugcugaagguggugaugaagccgaucgccaccgucggcgagagcuaccaguacccccccgugaacugggcggcccuccugagcccccugaugcggcucaacuucggggaggagauccagcagcugugccuggagaucauggugacgcaggcccaguccagccagaacgccgccgcgcuccugggccugugggucaccccgccccucauccacucccugagccugaacaccaagcgcuaccuccugaucuccgccccccuguggaucaagcacaucagcgacgagcagauccucggguucguggagaaccugaugguggccgucuucaaggccgccuccccccugggcagcccggagcucugccccuccgcgcugcacggccugagccaggccaugaagcuccccucccccgcccaccaccuguggagccugcucuccgaggccaccgggaagaucuucgaccugcugccgaacaagauccggcgcaaggaccucgagcuguacaucagcaucgcgaagugccugcucgagaugacggacgacgacgccaaccggaucgcccaggugaccaaguccaacaucgagaaggccgccuucgugaagcuguaccuggucagccagggccgcuucccccucgugaaccugaccgacaugcuguccguggcgguccagcaccgggagaaggaggugcucgccuggaugauccugcacagccuguaccaggcccgcaucgugucccacgccaacaccgggguccugaagcggauggaguggcuccuggagcugaugggcuacauccgcaacguggccuaccagagcacgagcuuccacaacaccgcgcucgacaaggcccuggacuucuuccugcucaucuucgccaccgccguggucgccugggcggaccacaccgccccccugcugcucggccuguccgccagcuggcugcccuggcaccaggagaacgggccggccggccccgugcccuccuuccucgggcggagccccaugcaccgcgugacgcugcaggagguccugacccuccugccgaacuccauggcgcugcuccugcagaaggagcccuggaaggagcagacccagaaguucaucgacuggcuguucagcaucauggagucccccaaggaggcccucagcgcccagucccgggaccugcugaaggccacccuccugagccugcgcgugcucccggaguucaagaagaaggccguguggacccgggcguacggcugguga

SEQ ID NO: 30238 - RNA, 2160 nt, Artificial Sequence
  derived and/or modified sequence opt1 from FOLH1__Homo_sapiens__NP_001014986
auguggaaccugcuccacgagaccgacagcgccguggccaccgcgcgccggccccgcuggcugugcgccggcgcccugguccucgccgggggcuucuuccugcugggguuccucuucggcugguucaucaaguccagcaacgaggccacgaacaucaccccgaagcacaacaugaaggcguuccuggacgagcugaaggccgagaacaucaagaaguuccucuacaacuucacccagaucccccaccuggccgggaccgagcagaacuuccagcuggccaagcagauccagucccaguggaaggaguucggccucgacagcguggagcuggcgcacuacgacgugcugcucuccuaccccaacaagacgcaccccaacuacaucagcaucaucaacgaggacggcaacgagaucuucaacaccucccuguucgagccgcccccgcccggguacgagaacgucagcgacaucgugccgcccuucuccgccuucagcccccagggcaugcccgagggggaccugguguacgucaacuacgcccggaccgaggacuucuucaagcucgagcgcgacaugaagaucaacugcuccggcaagaucgugaucgcccgguacgggaagguguuccgcggcaacaaggucaagaacgcccagcuggcgggcgccaagggggugauccuguacagcgaccccgccgacuacuucgcccccggcgugaaguccuaccccgacggguggaaccuccccggcggcgggguccagcggggcaacauccugaaccugaacggggccggcgacccgcucacccccggguaccccgcgaacgaguacgccuaccgccggggcaucgccgaggccgugggccugcccagcaucccggugcaccccaucggguacuacgacgcccagaagcugcucgagaagaugggcggguccgcgccgcccgacagcuccuggcgcggcagccugaagguccccuacaacguggggcccggcuucacgggcaacuucuccacccagaaggugaagaugcacauccacagcaccaacgaggucacccggaucuacaacgugaucgggacgcugcgcggcgccguggagcccgaccgguacgucauccucgggggccaccgcgacagcuggguguucgggggcaucgacccccaguccggcgccgccgugguccacgagaucgugcggagcuucgggacccugaagaaggagggcuggcgcccgcggcgcaccauccuguucgccuccugggacgcggaggaguucgggcuccugggcagcaccgagugggccgaggagaacucccggcugcuccaggagcgcggcgucgccuacaucaacgccgacagcuccaucgaggggaacuacacgcugcggguggacugcacgccccugauguacagccucgugcacaaccugaccaaggagcugaagucccccgacgagggcuucgagggcaagagccucuacgaguccuggaccaagaaguccccgagccccgaguucagcgggaugccccgcaucuccaagcuggggagcggcaacgacuucgaggucuucuuccagcgccugggcaucgcguccgggcgggcccgcuacaccaagaacugggagaccaacaaguucagcggcuacccccucuaccacuccguguacgagaccuacgagcugguggagaaguucuacgacccgauguucaaguaccaccugaccgucgcccaggugcgcgggggcaugguguucgagcucgccaacagcaucguccugcccuucgacugccgggacuacgccguggugcugcggaaguacgcggacaagaucuacagcaucuccaugaagcacccccaggagaugaagacguacagcgucuccuucgacagccuguucuccgccgugaagaacuucaccgagaucgccagcaaguucuccgagcgccuccaggacuucgacaagagcaagcacgugaucuacgcccccuccagccacaacaaguacgccggggaguccuucccgggcaucuacgacgcgcuguucgacaucgagagcaaggucgaccccuccaaggccuggggcgaggugaagcggcagaucuacguggccgccuucaccguccaggccgcggccgagacccugagcgagguggccuga

SEQ ID NO: 30239 - RNA, 774 nt, Artificial Sequence
  derived and/or modified sequence opt1 from FOLR1__Homo_sapiens__NP_000793
auggcccagcgcaugaccacccagcugcuccugcugcucgugugggucgccguggugggcgaggcgcagacgcggaucgccugggcccgcaccgagcugcugaacgucugcaugaacgccaagcaccacaaggagaagcccgggccggaggacaagcuccacgagcagugccggcccuggcgcaagaacgccugcugcagcaccaacaccucccaggaggcgcacaaggacgugagcuaccuguaccgguucaacuggaaccacugcggcgagauggcccccgccugcaagcgccacuucauccaggacacgugccuguacgagugcucccccaaccucgggccguggauccagcaggucgaccagagcuggcggaaggagcgcgugcugaacgugccccugugcaaggaggacugcgagcaguggugggaggacugccggaccuccuacacgugcaagagcaacuggcacaagggcuggaacuggaccuccggguucaacaagugcgccgugggcgcggccugccagcccuuccacuucuacuuccccaccccgaccguccucugcaacgagaucuggacccacagcuacaagguguccaacuacagccgcggcuccgggcggugcauccagaugugguucgaccccgcccagggcaaccccaacgaggagguggcccgcuucuacgccgcggccaugagcggggccggccccugggccgccuggccguuccugcugucccucgcgcugaugcugcucuggcugcugagcuga

SEQ ID NO: 30240 - RNA, 768 nt, Artificial Sequence
  derived and/or modified sequence opt1 from FOLR2__Homo_sapiens__NP_001107008
augguguggaaguggaugccccugcuccugcugcucgucugcguggccaccaugugcagcgcccaggaccgcaccgaccugcugaacgugugcauggacgcgaagcaccacaagacgaagccgggccccgaggacaagcuccacgaccagugcucccccuggaagaagaacgccugcugcaccgccagcaccucccaggagcugcacaaggacaccagccggcuguacaacuucaacugggaccacugcgggaagauggagcccgccugcaagcgccacuucauccaggacacgugccucuacgagugcuccccgaaccugggccccuggauccagcaggucaaccagagcuggcggaaggagcgcuuccuggacgugccccucugcaaggaggacugccagcgguggugggaggacugccacaccucccacacgugcaagagcaacuggcaccgcgggugggacuggaccuccggcgugaacaagugccccgccggggcgcugugccggaccuucgagagcuacuucccgacccccgccgcccugugcgagggccucuggucccacagcuacaaggucuccaacuacagccgcggcuccgggcggugcauccagaugugguucgacagcgcccagggcaaccccaacgaggagguggcgcgcuucuacgccgccgccaugcacgugaacgccggggagaugcugcacggcaccgggggccugcuccugucccuggcgcucaugcugcagcuguggcuccugggcuga

SEQ ID NO: 30241 - RNA, 738 nt, Artificial Sequence
  derived and/or modified sequence opt1 from FOLR3__Homo_sapiens__NP_000795
auggacauggccuggcagaugaugcagcugcuccugcuggcccucgugaccgcggccggcagcgcccagccccgcuccgcccgggcccgcaccgaccugcugaacgucugcaugaacgcgaagcaccacaagacgcagccgagccccgaggacgagcucuacgggcagugcucccccuggaagaagaacgccugcugcaccgccagcaccucccaggagcugcacaaggacaccagccggcuguacaacuucaacugggaccacugcggcaagauggagcccacgugcaagcgccacuucauccaggacuccugccucuacgagugcagcccgaaccuggggcccuggauccgccaggugaaccaguccuggcggaaggagcggauccugaacgugccccucugcaaggaggacugcgagcgcuggugggaggacugccggaccagcuacacgugcaaguccaacuggcacaagggcuggaacuggaccagcgggaucaacgagugccccgccggcgcgcugugcuccaccuucgagagcuacuucccgacccccgccgcccugugcgagggccucuggucccacagcuucaaggucuccaacuacagccgcggguccggccggugcauccagaugugguucgacagcgcccaggggaaccccaacgaggagguggccaaguucuacgcggccgccaugaacgccggcgcccccagccgcgggaucaucgacuccuga

SEQ ID NO: 30242 - RNA, 525 nt, Artificial Sequence
  derived and/or modified sequence opt1 from FOPNL__Homo_sapiens__NP_653201
auggccaccguggccgagcugaaggcgguccucaaggacacccuggagaagaagggcgugcuggggcaccucaaggcccgcauccgggccgagguguucaacgcccuggacgacgaccgcgagccccggccgagccugucccacgagaaccuccugaucaacgagcugauccgcgaguaccucgaguucaacaaguacaaguacacggccagcguccugaucgcggaguccggccagcccguggugccccuggaccggcaguuccucauccacgagcugaacgccuucgaggagagcaaggacaacaccaucccccugcucuacgggauccuggcccacuuccugcgcggcaccaaggacgggauccagaacgccuuccucaagggcccgucccugcagcccagcgaccccucccugggccggcagcccagccgccggaagccgauggacgaccaccuccgcaaggaggagcagaaguccaccaacaucgaggaccugcacgucagccaggcggugaaccgguga

SEQ ID NO: 30243 - RNA, 909 nt, Artificial Sequence
  derived and/or modified sequence opt1 from FOSB__Homo_sapiens__NP_001107643
auguuccaggccuuccccggcgacuacgacagcgggucccgcugcagcuccagccccuccgccgagagccaguaccuguccagcguggacuccuucggcagcccgcccaccgcggccgccucccaggagugcgccgggcucggcgagaugcccgggagcuucguccccaccgugacggccaucaccaccucccaggaccugcaguggcuggugcagcccacccucaucagcuccauggcgcagagccagggccagccccuggccucccagcccccggucguggaccccuacgacaugcccggcacgagcuacuccacccccgggaugagcggcuacagcuccgggggcgccagcggguccggcggcccgagcaccuccgggaccacgagcggccccgggcccgcccggcccgcgcgcgcccggccgcgccggccccgcgaggagaccgagaccgaccagcuggaggaggagaaggccgagcucgaguccgagaucgccgagcugcagaaggagaaggagcggcuggaguucgugcucgucgcccacaagcccggcugcaagauccccuacgaggagggcccggggcccggcccccuggcggaggugcgcgaccugcccgggagcgccccggccaaggaggacggcuucuccuggcuccugcccccgccgcccccgccgccccugcccuuccagaccagccaggacgccccgcccaaccucacggccucccuguucacccacagcgaggugcagguccugggggaccccuuccccguggugaaccccuccuacaccagcuccuucguccugaccugccccgaggugagcgcguucgccggcgcccagcggacguccggcagcgaccagcccuccgacccccucaacagccccagccugcucgcccuguga

SEQ ID NO: 30244 - RNA, 1143 nt, Artificial Sequence
  derived and/or modified sequence opt1 from FOS__Homo_sapiens__NP_005243
augauguucagcggcuucaacgccgacuacgaggccuccagcucccgcugcagcuccgcgagccccgccggggacucccugagcuacuaccacuccccggccgacagcuucuccagcaugggcucccccgugaacgcccaggacuucugcaccgaccucgccgucagcuccgcgaacuucauccccaccgugacggccaucagcaccucccccgaccugcaguggcuggugcagccggcccucgucagcuccguggcccccagccagacccgggcgccccaccccuucggggugccggcccccagcgccggcgccuacucccgcgccggggucgugaagaccaugacgggcggccgggcgcagagcaucgggcgccggggcaagguggagcagcugucccccgaggaggaggagaagcgccggauccgccgggagcgcaacaagauggccgccgccaagugccggaaccgccggcgcgagcugaccgacacccuccaggccgagaccgaccagcuggaggacgagaaguccgcgcugcagacggagaucgccaaccuccugaaggagaaggagaagcuggaguucauccucgccgcccaccggcccgccugcaagaucccggacgaccugggguuccccgaggagaugagcgucgcgagccuggaccucaccggcgggcugcccgagguggccacccccgaguccgaggaggccuucacccugccgcuccugaacgaccccgagcccaagcccagcguggagccggucaaguccaucagcuccauggagcugaagacggagcccuucgacgacuuccucuuccccgccagcucccgccccagcggcuccgagaccgcccggagcgugccggacauggaccuguccggcagcuucuacgcggccgacugggagccccugcacuccgggagccucggcauggggcccauggccaccgagcuggagccccugugcaccccgguggucacgugcacccccagcugcaccgccuacaccuccagcuucguguucacguaccccgaggcggacuccuucccgagcugcgccgccgcccaccgcaagggcuccagcuccaacgagcccagcuccgacagccucuccagccccacccugcuggcccucuga

SEQ ID NO: 30245 - RNA, 408 nt, Artificial Sequence
  derived and/or modified sequence opt1 from FOSL1__Homo_sapiens__NP_001287784
auguuccgcgacuucggcgagcccgggccgagcuccggcaacgggggcggguacggcggccccgcccagccgcccgccgcggcccaggccgcccagcagaaguuccaccuggugcccagcaucaacaccauguccgggagccaggagcuccaguggaugguccagccccacuuccugggccccuccagcuacccccggccgcugaccuacccccaguacuccccgccccagccccgccccggggugauccgggcccucgggcccccgcccggggugcgccggcgccccugcgagcagcccggcggccggggcgcgcccccgagcaaggcccgcgccgagcaggccggcugcgggcagguccaggagcccgaggagggcacggaccggcugcccgcgggcggggacuga

SEQ ID NO: 30246 - RNA, 981 nt, Artificial Sequence
  derived and/or modified sequence opt1 from FOSL2__Homo_sapiens__NP_005244
auguaccaggacuaccccggcaacuucgacaccagcucccgcgggagcuccggcagcccggcccacgccgaguccuacagcuccgggggcgggggccagcagaaguuccggguggacaugcccggcagcggguccgcguucauccccaccaucaacgccaucacgaccagccaggaccugcaguggaugguccagcccaccgugaucaccuccaugagcaacccguacccccgcucccaccccuacagcccccucccgggccuggccuccgugcccgggcacauggcccugccccggcccggcgucaucaagacgaucgggaccaccgugggccgccggcgccgggacgagcagcucagcccggaggaggaggagaagcgccggauccgccgggagcgcaacaagcuggccgcggccaagugccggaaccgccggcgcgagcugaccgagaagcuccaggccgagacggaggagcuggaggaggagaaguccggccugcagaaggagaucgccgagcuccagaaggagaaggagaagcuggaguucaugcugguggcgcacgggcccgucugcaagaucagccccgaggagcggcgcuccccgcccgcccccggccuccagcccaugcggagcgggggcggcagcgugggggccguggucgugaagcaggagccccuggaggaggacuccccgagcuccagcuccgccggccuggacaaggcccagcgcagcgugaucaagcccaucuccaucgccgggggcuucuacggggaggagccccuccacacccccaucgucgugaccagcaccccggcggugacgcccggcaccuccaaccuggucuucaccuaccccagcgugcuggagcaggagucccccgccagcccguccgagagcugcuccaaggcccaccggcgcagcuccagcuccggcgaccagagcagcgacucccucaacagccccacccugcuggcccucuga

SEQ ID NO: 30247 - RNA, 1419 nt, Artificial Sequence
  derived and/or modified sequence opt1 from FOXA1__Homo_sapiens__NP_004487
augcugggcaccgugaagauggaggggcacgagaccagcgacuggaacuccuacuacgccgacacgcaggaggccuacagcuccguccccgugagcaacaugaacuccggccucgggagcaugaacuccaugaacaccuacaugaccaugaacaccaugacgaccagcggcaacaugaccccggcguccuucaacaugagcuacgccaaccccgggcugggcgccggccugucccccggggccguggccggcaugcccgggggcagcgcgggggccaugaacuccaugaccgccgccggcgucacggcgaugggcaccgcccucagcccguccgggaugggcgccaugggggcccagcaggccgcgagcaugaacggccugggccccuacgccgccgccaugaaccccugcaugucccccauggccuacgcgccgagcaaccuggggcgcucccgggccggcgggggcggggacgccaagaccuucaagcgcagcuacccccacgccaagccgcccuacagcuacaucucccucaucaccauggccauccagcaggcgcccagcaagaugcugacgcuguccgagaucuaccaguggaucauggaccucuuccccuacuaccggcagaaccagcagcgcuggcagaacagcauccggcacucccugagcuucaacgacugcuucgugaagguggcccgcucccccgacaagcccggcaagggcagcuacuggacccugcacccggacuccgggaacauguucgagaacggcugcuaccuccggcgccagaagcgguucaagugcgagaagcagcccggggccggcgggggcggcgggagcggcuccgggggcagcggggccaagggcggccccgagucccgcaaggaccccagcggggccuccaacccgagcgcggacuccccgcugcaccggggcguccacgggaagaccggccagcuggagggcgcccccgcccccgggcccgccgcgagcccccagacccucgaccacuccggcgccacggccaccgggggcgccagcgagcugaagacccccgccagcuccaccgcgcccccgaucagcuccgggcccggcgcccuggccagcgugcccgccucccacccggcccacggccucgcgccccacgagagccagcugcaccugaagggggacccccacuacuccuucaaccaccccuucagcaucaacaaccucauguccagcuccgagcagcagcacaagcuggacuucaaggccuacgagcaggcccugcaguacagcccguacggcuccacgcuccccgccagccugccccugggguccgccagcgugaccacccgcucccccaucgagccgagcgcgcucgagcccgccuacuaccagggcgucuacagccggcccgugcugaacaccuccuga

SEQ ID NO: 30248 - RNA, 1392 nt, Artificial Sequence
  derived and/or modified sequence opt1 from FOXA2__Homo_sapiens__NP_068556
augcacagcgccuccagcaugcugggcgccgugaagauggaggggcacgagcccuccgacuggagcuccuacuacgcggagccggagggcuacagcuccgucagcaacaugaacgccgggcucggcaugaacgggaugaacaccuacauguccaugagcgccgccgccaugggcuccggcagcgggaacauguccgcgggcagcaugaacauguccagcuacgugggggccggcaugucccccagccuggccgggaugucccccggcgccggcgcgauggccgggaugggcgggagcgccggcgccgccggcguggcggggaugggcccccaccugagcccgucccucagcccccugggcggccaggccgccggggccaugggcggccuggcccccuacgcgaacaugaacuccaugagccccauguacgggcaggccggccucucccgcgcccgggacccgaagaccuaccgccggagcuacacgcacgccaagccgcccuacuccuacaucagccugaucaccauggccauccagcagucccccaacaagaugcugacccucagcgagaucuaccaguggaucauggaccuguuccccuucuaccgccagaaccagcagcgguggcagaacuccauccgccacagccuguccuucaacgacugcuuccucaaggucccccggagccccgacaagcccgggaagggcuccuucuggacccugcacccggacagcgggaacauguucgagaacggcugcuaccugcgccggcagaagcgcuucaagugcgagaagcagcucgcgcugaaggaggccgccggcgccgccggguccggcaagaaggcggccgccggggcccaggcgagccaggcccagcugggcgaggccgccgggcccgccuccgagacgcccgcgggcaccgagagcccccacagcuccgccagcccgugccaggagcacaagcggggcgggcucggcgagcugaaggggacccccgccgccgcccuguccccgcccgagcccgcgcccagccccggccagcagcagcaggccgccgcccaccuccuggggcccccgcaccaccccgggcugcccccggaggcccaccucaagcccgagcaccacuacgcguucaaccaccccuucuccaucaacaaccugaugagcuccgagcagcagcaccaccacagccaccaccaccaccagccccacaagauggaccugaaggccuacgagcaggucaugcacuacccgggcuacgggucccccaugcccggcagccucgccauggggcccgugaccaacaagacgggccuggacgccuccccgcuggcggccgacaccagcuacuaccagggcguguacucccgccccaucaugaacagcuccuga

SEQ ID NO: 30249 - RNA, 1053 nt, Artificial Sequence
  derived and/or modified sequence opt1 from FOXA3__Homo_sapiens__NP_004488
augcugggcagcgugaagauggaggcccacgaccucgccgagugguccuacuaccccgaggcgggggaggucuacagcccggugacccccgugcccaccauggccccccugaacuccuacaugacgcugaacccgcucagcucccccuacccccccggcgggcugccggccagcccccugcccuccggcccccucgccccgcccgcccccgcggccccccuggggccgaccuuccccggccugggcgucagcgggggcuccagcuccagcggguacggcgcccccgggcccggccucgugcacggcaaggagaugccgaagggguaccgccggccccuggcccacgcgaagccccccuacuccuacaucagccugaucaccauggccauccagcaggccccgggcaagaugcucacccuguccgagaucuaccaguggaucauggaccuguuccccuacuaccgcgagaaccagcagcgguggcagaacagcauccgccacucccucagcuucaacgacugcuucgugaaggucgcccggucccccgacaagcccgggaagggcagcuacugggcccugcacccgagcuccggcaacauguucgagaacgggugcuaccugcgccggcagaagcgcuucaagcucgaggagaaggugaagaagggcgggagcggcgcggccacgaccacccggaacgggaccggcuccgccgccagcacgaccacccccgccgcgaccgugacgucccccccgcagcccccccccccggcccccgagcccgaggcccagggcggggaggacgucggcgcccuggacugcgggagccccgccuccagcaccccguacuucaccggccuggagcuccccggggagcugaagcuggacgcgcccuacaacuucaaccaccccuucuccaucaacaaccucaugagcgagcagaccccggccccccccaagcuggacgugggcuucggcggguacggcgccgaggggggcgagcccgggguguacuaccagggccuguacucccgcagccuccugaacgccuccuga

SEQ ID NO: 30250 - RNA, 978 nt, Artificial Sequence
  derived and/or modified sequence opt1 from FOXB1__Homo_sapiens__NP_036314
augccccgcccgggccggaacaccuacagcgaccagaagccgcccuacuccuacaucagccugaccgccauggccauccaguccagccccgagaagaugcucccccuguccgagaucuacaaguucaucauggaccgcuuccccuacuaccgggagaacacgcagcgcuggcagaacagccugcggcacaaccucuccuucaacgacugcuucaucaagaucccccgccggcccgaccagccggggaagggcagcuucugggcgcugcaccccuccugcggggacauguucgagaacggcagcuuccugcgccggcgcaagcgguucaaggugcucaaguccgaccaccuggcccccagcaagcccgccgacgccgcccaguaccugcagcagcaggcgaagcuccgccuguccgcccuggccgccagcgggacccaccucccgcagaugcccgcggccgccuacaaccugggcggcgucgcccagcccuccggguucaagcaccccuucgccaucgagaacaucaucgcgcgggaguacaagaugccgggcgggcuggccuucagcgccaugcagcccgugcccgccgccuacccccucccgaaccagcugaccaccaugggcuccagccuggggacgggcuggccccacguguacggcuccgcggggaugaucgacagcgccacccccaucagcauggccuccggcgacuacagcgccuacggggucccccucaagccgcugugccacgccgcgggccagacccugcccgccauccccgugcccaucaagccgacccccgccgccgugcccgcccucccggcgcugcccgcccccauccccacgcugcucuccaacagcccgcccucccugagccccaccuccagccagaccgccaccucccagagcucccccgccacgccgagcgagacccugaccucccccgcgagcgcccuccacuccgucgccgugcacuga

SEQ ID NO: 30251 - RNA, 1662 nt, Artificial Sequence
  derived and/or modified sequence opt1 from FOXC1__Homo_sapiens__NP_001444
augcaggcccgcuacagcguguccagccccaacucccugggcgucgugccguaccucgggggcgagcagagcuacuaccgggccgcggccgccgccgccgggggcggguacaccgcgaugcccgcccccauguccguguacagccaccccgcccacgccgagcaguacccgggcggcauggcgcgcgccuacgggcccuacacgccccagccccagccgaaggacauggucaagccgcccuacuccuacaucgcccugaucaccauggccauccagaacgcccccgacaagaagaucacccugaacggcaucuaccaguucaucauggaccgguuccccuucuaccgcgacaacaagcagggguggcagaacagcauccggcacaaccucucccugaacgagugcuucgugaaggugccccgcgacgacaagaagcccggcaaggggagcuacuggacccuggaccccgacuccuacaacauguucgagaacggcagcuuccuccggcgccggcgccgguucaagaagaaggacgcggucaaggacaaggaggagaaggaccgccugcaccugaaggagccgcccccgcccggccggcagcccccgcccgcgccgcccgagcaggccgacgggaacgcccccggcccccagcccccgcccgugcgcauccaggacaucaagaccgagaacgggacgugccccuccccgccccagccccucagccccgccgccgcccugggcuccggcagcgccgccgccgugcccaagaucgagucccccgacagcuccagcagcucccugagcuccgggagcuccccgcccggcagccuccccuccgcgcggccccugagccuggacggggccgacuccgccccgcccccgcccgcccccagcgcgcccccgccccaccacucccagggcuucagcgucgacaacaucaugaccucccuccgcgggagcccccaguccgccgccgccgagcugagcuccggccugcucgccagcgcggccgccuccagccgggccggcaucgcgccgccccuggcccugggggccuacagccccggccaguccagccucuacuccagccccugcucccagaccagcuccgccgggagcuccggcgggggcggcgggggcgccggggccgcgggcggggccggcggcgccgggaccuaccacugcaaccugcaggccaugagccuguacgccgcgggcgagcgcgggggccaccuccagggcgcccccgggggcgccgggggcuccgccguggacgacccccugcccgacuacagccugcccccggugacguccagcuccagcuccagccucagccacgggggcggcgggggcgggggcgggggcggccaggaggcggggcaccaccccgccgcccaccagggccggcugaccuccugguaccugaaccaggccgggggcgaccucgggcaccuggccagcgcggccgccgccgccgcggccgccggcuaccccggccagcagcagaacuuccacuccguccgcgagauguucgagagccagcggaucgggcugaacaacucccccgugaacggcaacagcuccugccagauggccuucccgagcucccagagccucuaccgcaccuccggggccuucguguacgacugcagcaaguucuga

SEQ ID NO: 30252 - RNA, 1506 nt, Artificial Sequence
  derived and/or modified sequence opt1 from FOXC2__Homo_sapiens__NP_005242
augcaggcccgcuacagcguguccgaccccaacgcccugggcgucgugcccuaccucagcgagcagaacuacuaccgggcggccggguccuacggcgggauggccagccccaugggcguguacuccgggcaccccgagcaguacagcgccggcaugggccgcuccuacgcccccuaccaccaccaccagccggcggcccccaaggaccuggucaagccgcccuacagcuacaucgcccugaucaccauggccauccagaacgcgcccgagaagaagaucacccucaacgggaucuaccaguucaucauggaccgguuccccuucuaccgcgagaacaagcagggcuggcagaacuccauccggcacaaccugagccugaacgagugcuucgugaaggugccccgcgacgacaagaagcccgggaagggcuccuacuggacccucgacccggacagcuacaacauguucgagaacggguccuuccugcggcgccggcgccgguucaagaagaaggacgucagcaaggagaaggaggagcgcgcccaccugaaggagcccccgcccgccgccuccaagggcgcccccgcgacgccccaccucgccgacgcccccaaggaggccgagaagaagguggugaucaagagcgaggccgcgucccccgcccugccggucaucaccaagguggagacccugagccccgaguccgcccuccagggcagcccccggagcgccgccuccacccccgcggggagcccggacggcucccugcccgagcaccacgccgccgcccccaacgggcugcccggcuucagcguggagaacaucaugacccuccgcaccuccccgcccggcggggagcugagccccggcgccgggcgggcgggccuggucgugccgccccucgcccugcccuacgccgccgcgcccccggccgccuacgggcagcccugcgcccagggccuggaggccggcgcggccgggggcuaccagugcuccaugcgcgccaugagccucuacaccggggccgagcggcccgcccacaugugcgugcccccggcgcuggacgaggcccuguccgaccaccccagcggccccacgagcccccucuccgcccugaaccuggccgccgggcaggagggcgcgcucgccgccaccggccaccaccaccagcaccacgggcaccaccacccgcaggccccgccgccgccgcccgcgccccagccccagcccacgccccagcccggcgccgccgccgcccaggcggccuccugguaccugaaccacagcggggaccugaaccaccuccccggccacaccuucgccgcccagcagcagaccuuccccaacguccgcgagauguucaacucccaccggcuggggaucgagaacagcacccugggcgagucccaggugagcggcaacgccuccugccagcuccccuaccgcagcacgccgccccuguaccggcacgcggcccccuacagcuacgacugcaccaaguacuga

SEQ ID NO: 30253 - RNA, 1398 nt, Artificial Sequence
  derived and/or modified sequence opt1 from FOXD1__Homo_sapiens__NP_004463
augacccugagcaccgagauguccgacgccagcggccucgccgaggagacggacaucgacguggucggggagggcgaggacgaggaggacgaggaggaggaggacgacgacgaggggggcgggggcggcccccgccuggcggugccggcccagcggcgccggcgccggcgcuccuacgccggggaggacgagcuggaggaccucgaggaggaggaggacgacgacgacauccugcuggccccccccgccggcgggagccccgcgccgcccggccccgcccccgccgccggggcgggcgccggcgggggcgggggcggcgggggcgccgggggcgggggcuccgccggcagcggggccaagaacccgcucgugaagccccccuacuccuacaucgcgcugaucaccauggccauccugcagagccccaagaagcggcucacccuguccgagaucugcgaguucaucagcggccgcuucccguacuaccgggagaaguuccccgccuggcagaacuccauccgccacaaccugagccucaacgacugcuucgucaagaucccccgggagcccgggaacccgggcaaggggaacuacuggacccuggaccccgaguccgccgacauguucgacaacggcagcuuccugcgccggcgcaagcgguucaagcgccagccccuccugcccccgaacgccgcggccgccgagucccugcuccugcggggcgccggggccgcgggcggggccggcgaccccgccgccgccgcggcccuguucccccccgccccgcccccccccccgcacgccuacggguacggccccuacggcugcggguacggccuccagcugcccccguacgcgccccccagcgcccuguucgccgccgccgcggccgccgccgccgcggccgccuuccacccccacuccccgcccccccccccgcccccccacggggccgccgcggagcucgcccgcacggccuucggcuaccggccccacccgcugggcgccgcgcugcccgggccccuccccgccagcgccgccaaggccggcgggccgggcgcguccgcccuggcccgcagccccuucagcaucgaguccaucaucgggggcagccugggccccgccgccgcggccgccgccgccgcgcaggccgccgccgcggcccaggccucccccagcccgucccccguggccgccccccccgcgccggggagcuccggcgggggcugcgccgcccaggccgccguggggcccgcggccgcccucacccggagccuggucgccgccgcggccgccgccgccuccagcguguccagcuccgcggcccugggcacccuccaccagggcaccgcccugagcuccguggagaacuucacggcccgcaucagcaacugcuga

SEQ ID NO: 30254 - RNA, 1122 nt, Artificial Sequence
  derived and/or modified sequence opt1 from FOXE1__Homo_sapiens__NP_004464
augaccgccgagagcgggcccccgccgccccagcccgaggugcuggccaccgucaaggaggagcgcggcgagacggcggccggcgccggggugcccggcgaggccaccgggcggggcgccggcgggcgccggcgcaagcggccccuccagcgcggcaagccgcccuacuccuacaucgcgcugaucgccauggccaucgcccacgcgcccgagcggcgccugacccucgggggcaucuacaaguucaucaccgagcgguuccccuucuaccgcgacaaccccaagaaguggcagaacagcauccggcacaaccugacgcugaacgacugcuuccucaagaucccccgcgaggccgggcggccgggcaagggcaacuacugggcccuggaccccaacgccgaggacauguucgaguccgggagcuuccugcgccggcgcaagcgguucaagcgcuccgaccucagcaccuaccccgccuacaugcacgacgcggccgccgccgccgcggccgccgccgccgcggccgccgccgccgcgaucuuccccggcgccgugccggccgcccggccgcccuaccccggggcggucuacgccggcuacgccccgcccucccuggccgcgcccccgcccguguacuaccccgccgccagccccggccccugccgcguguucgggcugguccccgagcggccccucucccccgagcugggcccggcccccagcgggcccggcggguccugcgccuucgccagcgcgggcgcccccgccaccaccacgggcuaccagccggccgggugcaccggcgcccgccccgcgaaccccuccgccuacgccgccgcguacgccgggcccgacggcgccuacccgcagggggccggcagcgccaucuucgcggccgccggccgccuggccgggcccgccuccccgcccgcgggcgggagcuccggcgggguggagaccaccguggacuucuacggccggacgagccccggccaguucggggcccucggcgccugcuacaaccccgggggccagcugggcggggccuccgccggcgcguaccacgcccgccacgccgccgcguaccccgggggcaucgaccgguucgucagcgccauguga

SEQ ID NO: 30255 - RNA, 1140 nt, Artificial Sequence
  derived and/or modified sequence opt1 from FOXF1__Homo_sapiens__NP_001442
augagcuccgcccccgagaagcagcagccgccccacggcgggggcgggggcgggggcggcgggggcggggccgcgauggaccccgccagcuccggccccagcaaggccaagaagaccaacgccgggauccgccggccggagaagccgcccuacuccuacaucgcccugaucgugauggcgauccagagcucccccaccaagcgccucacgcugagcgagaucuaccaguuccugcagucccgguuccccuucuuccgcggcagcuaccagggcuggaagaacuccgugcggcacaaccucagccugaacgagugcuucaucaagcugcccaaggggcucggccgccccgggaagggccacuacuggaccaucgaccccgccuccgaguucauguucgaggagggcagcuuccggcgccggccgcgcggguuccggcgcaagugccaggcccugaagcccauguacuccaugaugaacggccugggguucaaccaccuccccgacaccuacggcuuccaggggagcgccggcggccuguccugcccgcccaacagccuggcgcucgagggcgggcuggggaugaugaacggccaccuccccgggaacguggacggcauggcccugcccucccacagcgugccccaccucccgagcaacggcgggcacuccuacaugggcgggugcggcggggccgccgccggcgaguacccccaccacgacagcuccguccccgcgagcccccugcugccgaccggcgccgggggcgugauggagccccacgccguguacuccgggagcgccgccgcguggccgcccuccgccagcgccgcccugaacuccggcgccagcuacaucaagcagcagccccugucccccugcaaccccgcggccaacccgcucagcggcucccugagcacgcacucccuggagcagcccuaccuccaccagaacagccacaacgcccccgccgagcugcaggggaucccccgguaccacucccagagcccguccaugugcgaccgcaaggaguucgucuucagcuucaacgccauggcgagcuccagcaugcacuccgccggcgggggcagcuacuaccaccagcaggucaccuaccaggacaucaagcccugcgugauguga

SEQ ID NO: 30256 - RNA, 1335 nt, Artificial Sequence
  derived and/or modified sequence opt1 from FOXF2__Homo_sapiens__NP_001443
augaccaccgagggcgggcccccgcccgcgccccugcgccgggccugcagccccgugccgggcgcccuccaggccgcccugauguccccgccgcccgccgccgcggccgccgccgcggccgcccccgagacgaccagcuccagcuccagcuccagcuccgccagcugcgccuccagcuccagcuccagcaacuccgcgagcgcccccuccgccgccugcaagagcgccgggggcgggggcgcgggcgccgggagcggcggggccaagaaggccuccagcggccugcgccggcccgagaagccgcccuacuccuacaucgcccucaucgucauggcgauccagagcucccccagcaagcgccugacccuguccgagaucuaccaguuccuccaggcccgguuccccuucuuccgcggggccuaccagggcuggaagaacagcgugcggcacaaccugucccugaacgagugcuucaucaagcuccccaagggccuggggcgccccggcaaggggcacuacuggaccaucgaccccgccagcgaguucauguucgaggagggcuccuuccggcgccggccccgcggcuuccggcgcaagugccaggcccugaagcccauguaccaccggguggucagcgggcucggcuucggggcgucccugcugccgcagggcuucgacuuccaggccccgcccagcgcgccccucgggugccacucccagggcggcuacgggggccuggacaugaugcccgccggguacgacgccggcgccggggcccccagccacgcccacccccaccaccaccaccaccaccacgugccccacauguccccgaaccccggcagcacguacauggccuccugccccgugccggcgggccccgggggcgucggggccgccggcgggggcggcgggggcgacuacgggcccgacagcagcuccagccccgugccguccagccccgccauggccuccgcgaucgagugccacagccccuacaccucccccgccgcccacuggagcuccccgggcgccagccccuaccugaagcagccgcccgcccucacccccuccagcaaccccgcggccuccgccggccugcacagcuccaugagcuccuacagccuggagcagagcuaccuccaccagaacgcccgcgaggaccuguccguggggcugccccgguaccagcaccacagcacccccgucugcgaccgcaaggacuucgugcucaacuucaacggcaucuccagcuuccacccguccgcgagcggguccuacuaccaccaccaccaccagagcgugugccaggacaucaagcccugcgucauguga

SEQ ID NO: 30257 - RNA, 1470 nt, Artificial Sequence
  derived and/or modified sequence opt1 from FOXG1__Homo_sapiens__NP_005240
augcuggacaugggcgaccgcaaggaggugaagaugauccccaagagcuccuucagcaucaacucccucgucccggaggccgugcagaacgacaaccaccacgccagccacgggcaccacaacucccaccacccccagcaccaccaccaccaccaccaccaccaccaccacccccccccgcccgcgccccagcccccgccccccccccagcagcagcagccgcccccccccccgccccccgccccccagccgccccagacccggggcgcccccgccgccgacgacgacaaggggccccagcagcugcugcucccgcccccccccccgccccccccggcggccgcccuggacggcgccaaggcggacgggcugggcggcaagggggagcccggcgggggccccggggagcucgcccccgugggcccggacgagaaggagaagggcgccggggccggcggggaggagaagaagggcgccggcgaggggggcaaggacggggagggcgggaaggagggcgagaagaagaacggcaaguacgagaagccccccuucagcuacaacgcgcugaucaugauggccauccgccagucccccgagaagcggcugacccucaacgggaucuacgaguucaucaugaagaacuucccguacuaccgcgagaacaagcagggcuggcagaacagcauccggcacaaccugucccugaacaagugcuucgucaaggugccccgccacuacgacgaccccgggaagggcaacuacuggaugcucgaccccagcuccgacgacguguucaucgggggcacgaccggcaagcugcggcgccggagcaccaccucccgcgccaagcuggccuucaagcggggggcccgccucacgagcaccggccugaccuucauggaccgggcggggucccuguacuggccgaugagccccuuccucucccugcaccacccccgcgccagcuccacccugagcuacaacggcacgaccagcgccuaccccucccacccgaugcccuacagcuccguccucacccagaacagccuggggaacaaccacuccuucagcaccgccaacggccuguccguggaccggcucgugaacggcgagauccccuacgccacgcaccaccugaccgcggccgcccuggccgccagcguccccugcgggcucuccgugccgugcagcggcaccuacucccugaaccccugcagcgugaaccugcucgcggggcagaccuccuacuucuucccccacgucccccacccgagcaugacgucccagagcuccaccagcauguccgcccgcgccgccagcagcuccaccagcccccaggcgcccuccacccugccgugcgagagccugcggcccucccuccccagcuucacgaccggccuguccggcgggcugagcgacuacuucacccaccagaaccagggcuccagcuccaacccccucauccacuga

SEQ ID NO: 30258 - RNA, 1098 nt, Artificial Sequence
  derived and/or modified sequence opt1 from FOXH1__Homo_sapiens__NP_003914
augggccccugcagcgggucccgccugggcccgcccgaggccgagagccccucccagcccccgaagcggcgcaagaagcgguaccuccgccacgacaagccgcccuacaccuaccuggccaugaucgcgcuggugauccaggccgcccccagccggcgccucaagcuggcccagaucauccggcagguccaggccguguuccccuucuuccgcgaggacuacgagggguggaaggacuccauccggcacaaccugagcuccaaccgcugcuuccggaaggugcccaaggaccccgcgaagccccaggccaagggcaacuucugggccgucgacgugagccucaucccggccgaggcgcugcgccugcagaacaccgcccucugccggcgcuggcagaacgggggcgcccggggcgccuucgccaaggaccuggggcccuacgugcugcacggccgccccuaccggcccccguccccgcccccgccgcccagcgagggguucuccaucaagagccuccugggcggguccggcgagggcgcgcccuggcccgggcuggcgccccagagcucccccguccccgccggcacggggaacagcggcgaggaggccgugcccaccccgccccuccccuccagcgagcgcccccuguggccccugugcccccuccccggcccgacccggguggagggggagaccguccagggcggggccaucggccccuccacgcugagccccgagccccgcgccuggccgcugcaccuccugcaggggaccgccgugcccggcggccggagcuccgggggccaccgcgccagccugugggggcagcuccccaccuccuaccugcccaucuacaccccgaacguggucaugccccuggccccgccgcccacgagcugcccccagugccccuccaccagccccgccuacuggggcguggcgcccgagacccgcgggccgcccggccuccugugcgaccuggacgcccucuuccagggcgugccgcccaacaaguccaucuacgacgucugggugagccacccccgggaccuggccgcccccgggcccggcuggcugcucuccuggugcagccuguga

SEQ ID NO: 30259 - RNA, 1137 nt, Artificial Sequence
  derived and/or modified sequence opt1 from FOXI1__Homo_sapiens__NP_036320
augagcuccuucgaccugcccgccccgagcccgccccgcugcagcccccaguuccccuccaucggccaggagccgcccgagaugaaccucuacuacgagaacuucuuccacccccagggggugcccagcccccagcggcccuccuucgagggcgggggcgaguacggggccacccccaacccguaccugugguucaacggccccaccaugacgccgccgcccuaccugcccggccccaacgcgucccccuuccucccccaggccuacgggguccagcgcccccugcugcccagcguguccggccucgggggcagcgaccugggguggcugcccaucccgucccaggaggagcucaugaagcuggugcggccgcccuacagcuacuccgcccugaucgccauggccauccacggcgcgcccgacaagcgccucacccugagccagaucuaccaguacgucgccgacaacuuccccuucuacaacaaguccaaggccggcuggcagaacagcauccggcacaaccugucccucaacgacugcuucaagaaggugccccgcgacgaggacgaccccgggaagggcaacuacuggacccuggacccgaacugcgagaagauguucgacaacgggaacuuccggcgcaagcggaagcgcaagagcgacguguccagcagcaccgccucccuggcgcucgagaagacggagagcucccugcccgucgacagccccaagaccaccgagccccaggacauccuggacggcgccuccccgggcgggaccacgagcucccccgagaagcggcccagcccgccgcccuccggcgcccccugccucaacagcuuccuguccagcaugaccgccuacguguccgggggcagccccaccucccacccccuggugacccccgggcucagccccgagcccuccgacaagacgggccagaacagccugaccuucaacuccuucagcccgcugaccaaccucagcaaccacuccggcgggggcgacugggccaaccccaugcccaccaacaugcugagcuacgggggcuccguccugagccaguucagcccccacuucuacaacuccgugaacacguccggggugcucuacccgcgcgagggcaccgaggucuga

SEQ ID NO: 30260 - RNA, 1266 nt, Artificial Sequence
  derived and/or modified sequence opt1 from FOXJ1__Homo_sapiens__NP_001445
auggccgagagcuggcugcgccucuccggcgccgggcccgcggaggaggccggcccggagggcgggcuggaggagcccgacgcccuggacgacagccucaccucccugcaguggcugcaggaguucagcauccucaacgccaaggcccccgcgcugccgcccgggggcaccgacccccacggcuaccaccaggugcccggguccgccgcccccggcagcccccuggccgcggaccccgccugccucgggcagccccacacgcccggcaagccgaccuccagcugcaccucccggagcgccccgcccgggcugcaggcgcccccgcccgacgacgucgacuacgccaccaacccccacgugaagcccccguacuccuacgccacgcugaucugcauggccaugcaggccagcaaggccaccaagaucacccucuccgccaucuacaaguggaucaccgacaacuucugcuacuuccgccacgcggaccccacguggcagaacagcauccggcacaaccugucccugaacaagugcuucaucaaggugccccgcgagaaggacgagcccggcaagggcggguucuggcggaucgacccgcaguacgccgagcgccuccugagcggcgccuucaagaagcggcgccugccgcccguccacauccaccccgccuucgcccggcaggcggcccaggagcccuccgccgugccccgcgccgggccccucaccgugaacaccgaggcccagcagcugcugcgggaguucgaggaggcgaccggcgaggccggcuggggcgccggggaggggcgccucggccacaagcggaagcagccgcugcccaagcgcgucgccaaggugccccggcccccgagcacgcugcuccccacccccgaggagcagggggagcuggagccccugaagggcaacuucgacugggaggcgaucuucgacgccggcacccucgggggcgagcugggggcccuggaggcccucgagcuguccccgccccugagccccgccagccacguggacgucgaccucaccauccacggccgccacaucgacugccccgcgacgugggggccguccguggagcaggccgccgacagccuggacuucgacgagaccuuccuggccaccuccuuccuccagcaccccugggacgagagcggcuccggcugccugccgcccgagccccuguucgaggccggggacgcgacccucgccagcgaccugcaggacugggccuccgugggcgccuuccuguga

SEQ ID NO: 30261 - RNA, 1725 nt, Artificial Sequence
  derived and/or modified sequence opt1 from FOXJ2__Homo_sapiens__NP_060886
auggccagcgaccuggaguccagccucaccuccaucgacuggcugccccagcugacccuccgcgccacgaucgagaagcugggcagcgcgucccaggccgggccgcccggcagcucccggaagugcagccccgggucccccaccgaccccaacgccacccugagcaaggacgaggccgccgugcaccaggacggcaagccccgcuacuccuacgcgacccucaucacguacgccaucaacagcucccccgccaagaagaugacccugagcgagaucuaccgguggaucugcgacaacuuccccuacuacaagaacgccgggaucggcuggaagaacuccauccgccacaaccugagccucaacaagugcuuccggaaggucccccgcccccgggacgaccccggcaagggguccuacuggaccaucgacacgugccccgacaucagccgcaagcggcgccacccgcccgacgacgaccugucccaggacagccccgagcaggaggcgagcaagagcccccggggcgggguggccggcuccggggaggccucccugccgcccgagggcaacccccagaugagccuccagucccccaccagcaucgccuccuacagccagggcaccggguccguggacggcggggccgucgcggccggcgccagcggccgcgaguccgccgaggggccgccgccccuguacaacaccaaccacgacuucaaguucagcuacuccgagaucaacuuccaggaccugagcugguccuuccggaaccucuacaagagcaugcuggagaaguccagcuccagcagccagcacggcuucuccagccugcucggggacaucccgcccuccaacaacuacuacauguaccagcagcagcagcccccgccgccccagcagcagcagcagcagcagcagccgccccagcccccgccccagcagagccagccccagcagcagcaggcccccgcgcagggccccuccgccgucgggggcgccccgccccugcacacccccagcacggacggcugcaccccgcccgggggcaagcaggccggggccgagggcuacgggcccccgcccgugauggcgaugcacccgccgccccugcagcacggcggcuaccacccccaccagcaccacccccacucccaccccgcccagcagcccccgccgccccagccccaggcccaggggcaggcccccaucaacaacaccggcuucgccuuccccagcgacuggugcuccaacaucgacagccucaaggaguccuucaagauggugaaccgccugaacuggagcuccaucgagcagagccaguucuccgagcugauggagagccuccggcaggcggagcagaagaacuggacccuggaccagcaccacaucgccaaccugugcgacucccucaaccacuuccugacgcagaccgggcacgugccgccccagggcgggacccaccgcccgcccgcccccgcccggaucgcggacagcugcgcccugaccagcggcaagcaggaguccgccaugagccaggugaacuccuacggccacccccaggcgccccaccucuaccccgggcccagccccauguaccccauccccacgcaggacuccgccggcuacaaccgccccgcccaccacauggucccccggcccagcgugcccccgcccggggccaacgaggagauccccgacgacuucgacugggaccugaucaccuga

SEQ ID NO: 30262 - RNA, 2202 nt, Artificial Sequence
  derived and/or modified sequence opt1 from FOXK1__Homo_sapiens__NP_001032242
auggccgaggugggcgaggacagcggggcccgcgcgcugcucgcccugcgguccgcccccugcagcccgguccugugcgccgccgcggccgccgccgcguuccccgccgccgcgcccccgcccgcccccgcccagccccagcccccgcccggcccgccgcccccgccgccgccgccccucccgcccggggccaucgccggcgccggguccagcggcggcuccagcgggguguccggcgacagcgccguggcgggggccgcccccgcccuggucgccgcggccgccgccuccgugcgccagagccccggccccgcccuggcgcggcucgaggggcgcgaguucgaguuccugaugcggcagcccuccgugaccaucggccgcaacagcucccagggcagcgucgaccuguccauggggcucagcuccuucaucagccggcgccaccuccagcuguccuuccaggagccccacuucuaccuccggugccugggcaagaacgggguguucguggacggcgccuuccagcgccggggcgcccccgcccugcagcuccccaagcagugcaccuuccgcuuccccagcacggcgaucaagauccaguucaccagccuguaccacaaggaggaggcccccgccagcccccugcggccccucuacccccagaucagcccccugaagauccacauccccgagcccgaccugcgcuccauggucagcccggugcccucccccaccgggaccaucuccgugcccaacuccugccccgccagcccccggggcgccggguccagcuccuaccgcuucguccagaacgugacgagcgaccugcagcuggcggccgaguucgccgccaaggccgcguccgagcagcaggccgacaccagcggcggggacucccccaaggacgagagcaagcccccguucuccuacgcccagcugaucgugcaggccaucagcuccgcccaggaccggcagcucacccugagcggcaucuacgcgcacaucaccaagcacuaccccuacuaccgcacggccgacaagggcuggcagaacagcauccggcacaaccugucccucaaccgcuacuucaucaaggucccccggagccaggaggagcccgggaagggcuccuucuggcgcaucgacccggccagcgaggccaagcugguggagcaggcguuccgcaagcggcgccagcgcgggguguccugcuuccggacccccuucggcccccugagcucccggagcgcccccgccuccccgacccaccccgggcucaugagcccccgcuccggcggccugcagacccccgagugccugagccgggagggguccccgaucccccacgaccccgaguucggcagcaagcucgccuccgucccggaguaccgcuacagccaguccgcccccgggagccccgugagcgcgcagcccgugaucauggccgucccgccccggcccuccagccugguggccaagcccguggccuacaugccggccuccaucgucacgagccagcagcccgcgggccacgccauccacgugguccagcaggcccccaccgugaccauggugcgcgucgugaccacguccgccaacagcgccaacggguacauccugaccucccagggcgcggccggcgggagccacgacgccgccggcgcggccgugcucgaccugggguccgaggcccggggccuggaggagaagcccaccaucgccuucgccaccaucccggcggccggcggggucauccagacgguggccagccagauggcccccggcgugcccgggcacaccgucaccauccuccagcccgccaccccggugacgcugggccagcaccaccuccccgugcgcgcggucacccagaacgggaagcacgccgugcccaccaacucccuggccggcaacgccuacgcccugaccagcccccugcagcuccuggcgacgcaggccuccagcuccgccccgguggucgugacccgggugugcgaggucggccccaaggagcccgccgccgcgguggccgccaccgccaccacgacccccgcgaccgccaccacggccagcgccuccgccagcuccaccggggagccggaggugaagcgcagccgggucgaggagcccagcggcgcggugaccacccccgccggggugaucgccgccgccggcccccaggggccgggcaccggcgaguga

SEQ ID NO: 30263 - RNA, 1983 nt, Artificial Sequence
  derived and/or modified sequence opt1 from FOXK2__Homo_sapiens__NP_004505
auggccgccgcggccgccgcccugagcggcgccgggaccccgcccgcgggcgggggcgccgggggcggcggggccggcgggggcggguccccgcccggcggcugggccguggcgcgccucgaggggcgggaguucgaguaccugaugaagaagcgcagcgucaccaucggccggaacuccagccagggguccguggacgugagcaugggccacuccagcuucaucucccgccggcaccuggagaucuucacgccgcccggcgggggcgggcacggcggggccgcccccgagcucccgcccgcccagccccgccccgacgccggcggcgacuucuaccugcggugccuggggaagaacggcgucuucguggacgggguguuccagcgccggggcgcgccgccccuccagcugccccgcgucugcaccuuccgguuccccagcaccaacaucaagaucaccuucacggcccuguccagcgagaagcgcgagaagcaggaggccuccgagagccccgugaaggccgugcagccccacaucagcccccucaccaucaacauccccgacaccauggcccaccugaucagcccccugcccuccccgaccgggacgaucagcgcggccaacuccugccccagcagcccccggggcgccggcuccagcggguacaaggucggccgcgugaugcccuccgaccucaaccugauggccgacaacucccagcccgagaacgagaaggaggccuccgggggcgacagccccaaggacgacuccaagccgcccuacagcuacgcgcagcugaucgugcaggccaucaccauggcccccgacaagcagcucacccugaacgggaucuacacccacaucacgaagaacuaccccuacuaccggaccgccgacaagggcuggcagaacuccauccgccacaaccugagccucaaccgguacuucaucaaggucccccgcucccaggaggagccgggcaaggggagcuucuggcggaucgaccccgccuccgagagcaagcugaucgagcaggcguuccgcaagcggcgcccccgcggcgugcccugcuuccggaccccgcuggggccccucuccagccgcuccgcccccgccagccccaaccacgccggcgugcuguccgcgcacagcagcggcgcccagaccccggagucccugagccgggaggggucccccgcgccccucgagcccgagccgggcgccgcccagcccaagcuggccgucauccaggaggcccgcuucgcccagagcgcccccgggagcccccuguccucccagccggugcucaucacggugcagcggcagcugccccaggccaucaagcccgucaccuacaccguggcgacccccgugacgaccagcaccucccagccgcccgucgugcagaccgugcacgucgugcaccagauccccgccgucagcgugacguccguggccggccuggcccccgccaacaccuacaccgucagcgggcaggcgguggugaccccggccgccguccucgccccgcccaaggcggaggcccaggagaacggcgaccaccgcgaggugaaggugaaggucgagcccauccccgccaucggccacgccacgcuggggaccgccucccggaucauccagaccgcgcagaccacgcccgugcagaccgugaccaucguccagcaggcgccccugggccagcaccagcucccgaucaagaccgugacgcagaacgggacccacguggccagcguccccaccgccgugcacggccaggugaacaacgccgccgccagcccccugcacaugcuggccacccacgccuccgccuccgcgagccuccccaccaagcgccacaacggggaccagccggagcagcccgagcugaagcggaucaagacggaggacggcgagggcaucgucaucgcccugagcguggacaccccgcccgccgccgugcgcgagaaggggguccagaacuga

SEQ ID NO: 30264 - RNA, 1038 nt, Artificial Sequence
  derived and/or modified sequence opt1 from FOXL1__Homo_sapiens__NP_005241
augagccaccuguucgacccccgccucccggcccuggccgcgucccccaugcuguaccucuacggccccgagcgccccgggcugccgcuggccuucgcccccgccgccgcgcucgccgccagcggccgcgccgagacgccccagaagcccccguacuccuacaucgcgcugaucgccauggccauccaggacgcccccgagcagcgggugacccugaacgggaucuaccaguucaucauggaccgcuuccccuucuaccacgacaaccggcagggcuggcagaacagcauccgccacaaccucucccugaacgacugcuucgucaaggugccccgggagaaggggcgcccgggcaagggcagcuacuggacccuggacccccggugccucgacauguucgagaacgggaacuaccgccggcgcaagcggaagcccaagcccggcccgggggcccccgaggcgaagcgcccccgggccgagacccaccagcgcuccgccgaggcccagcccgaggccggcagcggggcgggcggcuccgggccggccaucagccggcugcaggccgcccccgccggccccagcccccugcucgacgggccguccccgcccgcgccccugcacuggcccggcaccgccucccccaacgaggacgccggcgacgccgcccagggggcggccgccguggccgucggccaggcggcccgcaccggggacggccccgggagcccgcugcggcccgccucccgcagcucccccaagagcuccgacaagagcaagagcuucuccaucgacagcauccucgccggcaagcagggccagaagcccccguccggggacgagcugcugggcggggccaagcccggccccgggggccggcucggcgcgagccugcuggccgccuccagcucccuccggcccccguucaacgccagccugaugcuggacccccacgugcagggcggguucuaccagcucgggauccccuuccuguccuacuucccccuccaggugccggacacgguccugcacuuccaguga

SEQ ID NO: 30265 - RNA, 1131 nt, Artificial Sequence
  derived and/or modified sequence opt1 from FOXL2__Homo_sapiens__NP_075555
augauggccagcuaccccgagcccgaggacgccgcgggcgcccugcucgcccccgagaccgggcgcaccgugaaggagcccgaggggcccccgcccucccccggcaagggcgggggcggcgggggcgggacggcccccgagaagcccgaccccgcccagaagccgcccuacagcuacgucgcgcugaucgccauggccauccgggaguccgccgagaagcgccugacccucagcggcaucuaccaguacaucaucgcgaaguuccccuucuacgagaagaacaagaagggguggcagaacuccauccggcacaaccugagccugaacgagugcuucaucaaggugccccgcgagggcggcggggagcggaagggcaacuacuggacccucgaccccgccugcgaggacauguucgagaaggggaacuaccgccggcgccggcgcaugaagcggcccuuccgcccgccgcccgcccacuuccagcccggcaagggccuguucggggccggcggggccgcgggcgggugcggcguggccggcgccggggccgacggcuacggguaccuggccccgcccaaguaccuccaguccggcuuccugaacaacagcuggccccugccccagccgcccucccccaugcccuacgcgagcugccagauggccgccgccgccgcggccgccgccgccgcggccgccgccgcggggccgggcucccccggcgccgccgccgucgugaaggggcucgccggccccgcggccagcuacgggccguacacccgggugcaguccauggcccugccgcccggcgucgugaacagcuacaacgggcugggcggcccgcccgccgcgcccccgcccccgccccacccccacccccacccccacgcccaccaccuccacgccgccgccgcgcccccgcccgccccgccccaccacggggccgccgcgcccccgcccggccagcugucccccgccagccccgccacggccgcgccgcccgcccccgcccccaccuccgcccccgggcugcaguucgccugcgcccgccagcccgagcucgccaugaugcacugcagcuacugggaccacgacuccaagaccggcgcgcugcacagccggcuggaccucuga

SEQ ID NO: 30266 - RNA, 2292 nt, Artificial Sequence
  derived and/or modified sequence opt1 from FOXM1__Homo_sapiens__NP_068772
augaagaccagcccccgccggccgcugauccucaagcgccggcgccugccccugcccgugcagaacgcccccuccgagaccagcgaggaggagccgaagcggucccccgcccagcaggagagcaaccaggcggaggccuccaaggaggucgccgagagcaacuccugcaaguuccccgccggcaucaagaucaucaaccaccccacgaugccgaacacccaggugguggccauccccaacaacgcgaacauccacagcaucaucaccgcccucaccgccaaggggaaggaguccggcagcuccgggcccaacaaguucauccugaucagcugcggcggggcccccacgcagccgcccggccugcgcccccagacccagaccuccuacgacgcgaagcggaccgaggucacgcucgagacccugggccccaagccggccgcccgcgacgugaaccugccccggccgcccggggcccucugcgagcagaagcgcgagaccugcgccgacggcgaggcggccgggugcaccaucaacaacagccuguccaacauccaguggcugcggaagaugagcuccgacggccucgggagccgcuccaucaagcaggagauggaggagaaggagaacugccaccuggagcagcgccaggugaaggucgaggagcccagccggcccagcgccuccuggcagaacagcguguccgagcggccgcccuacagcuacauggccaugauccaguucgccaucaacuccacggagcgcaagcggaugacccugaaggacaucuacaccuggaucgaggaccacuuccccuacuucaagcacaucgcgaagcccggcuggaagaacagcauccgccacaaccucucccugcacgacauguucgugcgggagaccagcgccaacggcaaggucuccuucuggacgauccaccccagcgccaaccgcuaccugacccucgaccagguguucaagccccuggacccggggagcccccagcugcccgagcaccucgagagccagcagaagcggccgaaccccgagcugcgccgcaacaugaccaucaagaccgagcugccccucggcgcccggcgcaagaugaagccccugcugccgcggguguccagcuaccucguccccauccaguuccccgugaaccagucccuggugcugcagcccagcgucaaggugccgcucccccuggccgcgucccugaugagcuccgagcucgcccgccacagcaagcgggugcgcaucgcccccaagguccugcuggccgaggaggggaucgcgccccucagcuccgccggcccgggcaaggaggagaagcugcuguucggggagggcuucagcccccuccugcccgugcagacgaucaaggaggaggagauccagcccggggaggagaugccgcaccuggcccggcccaucaagguggaguccccgccccucgaggaguggcccagccccgcccccuccuucaaggaggagagcucccacagcugggaggacuccagccagucccccaccccgcgccccaagaaguccuacuccggccugcggagccccacccgcugcgucuccgagaugcuggugauccagcaccgggagcgccgggagcgcagccggucccgccggaagcagcaccuccugccgcccugcguggacgagcccgagcuccuguucagcgaggggcccagcaccucccgcugggccgcggagcugccguuccccgccgacagcuccgaccccgccagccagcuguccuacagccaggaggucggcggccccuucaagacgccgaucaaggagacccugcccaucuccagcacccccuccaagagcgugcucccccggaccccggaguccuggcgccugacgccgcccgccaaggucgggggccuggacuucagccccgugcagaccucccagggggccagcgacccccuccccgacccccugggccugauggaccucuccaccacgccccugcagagcgcgccgccccuggagagcccccagcgccuccuguccuccgagccccuggaccucaucagcgugccguucgggaacagcucccccagcgacaucgacguccccaagcccggcuccccggagccccaggugagcggccuggccgccaaccggucccugaccgaggggcucgugcuggacaccaugaacgacagccuguccaagauccuccuggacaucagcuuccccggccuggacgaggacccgcucgggcccgacaacaucaacuggucccaguucauccccgagcugcaguga

SEQ ID NO: 30267 - RNA, 1947 nt, Artificial Sequence
  derived and/or modified sequence opt1 from FOXN1__Homo_sapiens__XP_005258103
auggugagccugcccccgccccaguccgacgucacccuccccggccccacccgccuggagggggagcggcagggcgaccugaugcaggccccggggcuccccggcagccccgcgccccaguccaagcacgccggguucagcugcuccagcuucguguccgacggcccgcccgagcgcacccccagccugcccccgcacagcccccggaucgccucccccggccccgagcagguccaggggcacugcccggccggccccgggcccggccccuuccgccuguccccgagcgacaaguaccccggguucggcuucgaggaggccgccgcguccagccccggccgguuccucaaggggucccacgcccccuuccacccguacaagcgccccuuccacgaggacgucuuccccgaggccgagaccacccuggcccugaagggccacagcuucaagacccccgggccgcucgaggcguucgaggagauccccguggacguggccgaggccgaggccuuccugcccggcuucuccgccgaggcguggugcaacggccugccguaccccagccaggagcacgggccccagguccucggcuccgaggugaaggugaagcccccgguccuggagagcggggccggcauguucugcuaccagccgccccugcagcacauguacugcagcucccagcccccguuccaccaguacagccccgggggcggcuccuaccccauccccuaccucgggagcucccacuaccaguaccagcggauggccccgcaggccagcacggacggccaccagccccuguuccccaagcccaucuacuccuacagcauccugaucuucauggcccucaagaacuccaagaccgggagccugccgguguccgagaucuacaacuucaugaccgagcacuuccccuacuucaagaccgcgcccgacggcuggaagaacagcgugcgccacaaccugucccucaacaagugcuucgagaagguggagaacaagagcggguccagcucccggaagggcugccugugggcccugaaccccgccaagaucgacaagaugcaggaggagcuccagaaguggaagcgcaaggacccgaucgccgugcgcaagagcauggccaagcccgaggagcuggacucccugaucggcgacaagcgggagaagcucgggagcccccugcugggcugcccgccgcccgggcucagcggcuccgggcccauccggccccuggcgccgcccgccggccugagcccgccccuccacucccugcaccccgcccccggccccauccccgggaagaacccccugcaggaccuccugaugggccacacgcccagcugcuacgggcagaccuaccugcaccucucccccggccuggccccgcccggcccgccccagccccuguucccccagcccgacgggcaccucgagcugcgcgcccagcccggcaccccgcaggacagcccccugcccgcgcacaccccgcccucccacagcgccaagcuccuggccgagcccucccccgcccggacgaugcacgacacccugcuccccgacggggaccugggcaccgaccuggacgcgaucaaccccagccugaccgacuucgacuuccaggggaaccucugggagcagcugaaggacgacucccuggcccucgacccccuggugcuggucacgagcucccccaccagcuccagcaugccgccgccccagcccccgccccacugcuucccgcccggccccugccucaccgagaccggcuccggggccggcgaccuggccgcccccgggagcggcgggagcggcgcgcugggcgaccuccaccugacgacccuguacuccgccuucauggagcucgagcccacgccgcccaccgcccccgccgggcccagcguguaccugucccccagcuccaagcccguggcccuggcguga

SEQ ID NO: 30268 - RNA, 1296 nt, Artificial Sequence
  derived and/or modified sequence opt1 from FOXN2__Homo_sapiens__NP_002149
augggccccgugaucgggaugaccccggacaagcgcgccgagacccccggcgccgagaagaucgcggggcugagccagaucuacaagaugggcucccuccccgaggccgucgacgccgcccggcccaaggccacgcugguggacagcgaguccgcggacgacgagcugaccaaccucaacuggcugcacgagagcaccaaccugcucaccaacuucucccuggggagcgagggccugccgaucgugagcccccucuacgacaucgagggcgacgacguccccuccuucgggcccgccugcuaccagaacccggagaagaaguccgccacgagcaagccgcccuacuccuucagccugcugaucuacauggccaucgagcacucccccaacaagugccuccccgugaaggagaucuacagcuggauccuggaccacuuccccuacuucgcgaccgcccccaccggcuggaagaacuccgugcgccacaaccugagccucaacaagugcuuccagaaggucgagcggucccacgggaaggugaacggcaaggggagccuguggugcguggaccccgaguacaagccgaaccugauccaggcccucaagaagcagcccuucuccagcgccagcucccagaacggcagccugagcccccacuaccuguccuccgucaucaagcagaaccaggugcgcaaccucaaggagagcgacaucgacgccgcggccgccaugaugcugcugaacaccuccaucgagcagggcauccucgagugcgagaagccccugccgcugaagacggcccuccagaagaagcggagcuacgggaacgccuuccaccaccccuccgcggugcgccugcaggagagcgacucccuggccaccagcaucgaccccaaggaggaccacaacuacuccgccagcuccauggccgcccagcggugcgcgagccgcuccagcgucuccagccucagcuccguggacgagguguacgaguucauccccaagaacagccacgucggcuccgacgggagcgagggcuuccacuccgaggaggacaccgacguggacuacgaggacgacccgcugggcgacagcggguacgccucccagcccugcgccaagaucagcgagaagggccaguccgggaagaagaugcggaagcagaccugccaggagaucgacgaggagcugaaggaggccgccggcagccuccugcaccuggcggggauccgcacgugccucggcucccugaucagcaccgccaagacccagaaccagaagcagcggaagaaguga

SEQ ID NO: 30269 - RNA, 1473 nt, Artificial Sequence
  derived and/or modified sequence opt1 from FOXN3__Homo_sapiens__NP_001078940
augggccccgugaugccgcccagcaagaagcccgaguccagcgggaucuccgucagcuccggccugagccagugcuacgggggcuccggguucagcaaggcccuccaggaggacgacgaccuggacuucucccugcccgacauccgccucgaggagggcgccauggaggacgaggagcugaccaaccugaacuggcuccacgagagcaagaaccugcugaaguccuucggcgagagcgugcuccgguccgugagcccgguccaggaccuggacgacgacaccccgcccucccccgcgcacagcgacaugcccuacgacgcccgccagaaccccaacugcaagccgcccuacuccuucagcugccugaucuucauggccaucgaggacucccccacgaagcggcuccccgugaaggacaucuacaacuggauccuggagcacuuccccuacuucgccaacgcccccaccggguggaagaacagcgugcgccacaaccugagccucaacaagugcuucaagaaggucgacaaggagcggucccagagcaucggcaaggggucccuguggugcaucgacccggaguaccgccagaaccugauccaggcgcucaagaagacccccuaccacccccacccccacguguucaacaccccgcccacgugcccccaggccuaccagagcaccuccgggcccccgaucuggcccgggagcaccuucuucaagcggaacggcgcccugcugcaggaccccgacaucgacgccgcguccgccaugaugcuccugaacacgcccccggagauccaggccggcuucccgcccggggugauccagaacggcgcccgcguccugagccggggccucuuccccggcgugcgcccccugcccaucacccccaucggcgugaccgccgcgaugcggaacgggaucaccuccugccgcaugcggaccgagagcgagccguccugcggcagccccgucguguccggggaccccaaggaggaccacaacuacagcuccgccaagagcuccaacgcccgcagcacgucccccaccagcgacagcaucuccagcuccagcuccagcgccgacgaccacuacgaguucgccaccaagggcucccaggaggggagcgagggcuccgagggcagcuuccggucccacgagagcccguccgacaccgaggaggacgaccgcaagcacagccagaaggagcccaaggacucccugggggacagcggcuacgcgucccagcacaagaagcggcagcacuucgccaaggcccgcaaggugcccagcgacacgcucccccugaagaagcggcgcaccgagaagccgcccgagagcgacgacgaggagaugaaggaggccgccgggucccugcuccaccuggcgggcauccggagcugccugaacaacaucaccaaccgcaccgccaaggggcagaaggagcagaaggagacgaccaagaacuga

SEQ ID NO: 30270 - RNA, 1968 nt, Artificial Sequence
  derived and/or modified sequence opt1 from FOXO1__Homo_sapiens__NP_002006
auggccgaggcgccccagguggucgagaucgacccggacuucgagccccugccccgcccccggagcugcaccuggccgcucccccgccccgaguucucccagagcaacuccgcgaccagcucccccgccccgagcggcuccgccgccgccaaccccgacgcggccgccgggcugcccagcgccuccgcggccgccgugagcgccgacuucauguccaaccugagccuccuggaggaguccgaggacuucccccaggccccgggcagcguggcggccgccgucgccgccgcggccgccgccgccgcgaccgggggccugugcggggacuuccagggccccgaggccggcugccuccaccccgcgcccccgcagcccccgccgcccgggccccugucccagcacccgcccgugccgcccgccgccgccggcccccuggccgggcagccccgcaagagcuccagcucccggcggaacgccuggggcaaccucagcuacgccgaccugaucacgaaggcgaucgagagcuccgccgagaagcgccugacccucagccagaucuacgaguggauggugaaguccguccccuacuucaaggacaagggggacagcaacuccagcgccggcuggaagaacuccauccggcacaaccugagccugcacuccaaguucauccgcgugcagaacgagggcaccggcaagagcuccugguggaugcucaaccccgagggcggcaagagcgggaaguccccgcggcgccgggccgccagcauggacaacaacuccaaguucgccaagagccgcucccgggccgccaagaagaaggccagccugcaguccgggcaggagggggccggcgacagccccgggagccaguucuccaaguggcccgcgagccccggcucccacagcaacgacgacuucgacaacugguccacguuccgcccccggaccagcuccaacgccagcaccaucuccgggcgccugagccccaucaugaccgagcaggacgaccucggcgagggcgacgugcacuccauggucuacccgcccagcgccgccaagauggccuccacgcugcccagccuguccgagaucagcaaccccgagaacauggagaaccuccuggacaaccugaaccuccuguccagccccaccagccugaccguguccacccagagcucccccgggacgaugaugcagcagacccccugcuacagcuucgcgccgcccaacaccucccucaacagccccucccccaacuaccagaaguacaccuacggccagagcuccaugagcccgcugccccagaugcccauccagacgcugcaggacaacaaguccagcuacgggggcaugucccaguacaacugcgcccccgggcuccugaaggagcugcucaccagcgacuccccgccccacaacgacaucaugacccccguggaccccggcgucgcccagccgaacagccgggugcugggccagaacgugaugauggggcccaacuccgucaugagcaccuacggcucccaggccagccacaacaagaugaugaaccccagcucccacacgcacccggggcacgcgcagcagaccagcgccgugaacggccgcccccugccccacaccguguccaccaugccccacacgagcgggaugaaccggcucacccaggucaagaccccgguccaggugccccugccccaccccaugcagauguccgcccugggcggcuacagcuccgugagcuccugcaacggguacggccgcauggggcuccugcaccaggagaagcugccgagcgaccucgacggcauguucaucgagcggcuggacugcgacauggaguccaucauccgcaacgaccugauggacggcgacacccucgacuucaacuucgacaacgugcugcccaaccagagcuucccccacuccgugaagacgaccacccacagcugggucuccggguga

SEQ ID NO: 30271 - RNA, 2022 nt, Artificial Sequence
  derived and/or modified sequence opt1 from FOXO3__Homo_sapiens__NP_963853
auggccgaggcccccgcgagcccggcgccccugagcccccucgagguggagcuggaccccgaguucgagccgcagucccgcccccgguccugcaccuggccccugcagcgccccgagcuccaggccagcccggccaagcccuccggcgagaccgccgccgacagcaugauccccgaggaggaggacgacgaggacgacgaggacgggggcgggcgggccggcuccgccauggccaucgggggcggcgggggcagcgggacgcugggcuccgggcugcuccuggaggacagcgcgcgcguccuggcccccggcggccaggacccgggguccggccccgccaccgccgccgggggccucagcggcgggacccaggcgcugcugcagccccagcagccccucccgccgccccagcccggcgccgccgggggcuccgggcagccccggaagugcagcucccgccggaacgccuggggcaaccugagcuacgccgaccugaucacccgcgcgaucgaguccagccccgacaagcggcucacgcugucccagaucuacgaguggauggugcgcugcgugcccuacuucaaggacaagggcgacagcaacagcuccgccggguggaagaacagcauccggcacaaccugucccuccacagccgcuucaugcggguccagaacgagggcaccgggaaguccagcugguggaucaucaaccccgacggcgggaaguccggcaaggccccgcgccggcgcgccgugagcauggacaacuccaacaaguacaccaagagccggggccgcgccgcgaagaagaaggccgcccugcagaccgcccccgaguccgccgacgacagccccucccagcugagcaaguggcccggguccccgacgagccgguccagcgacgagcucgacgcguggaccgacuuccgcucccggaccaacagcaacgccagcaccguguccggccgccugagccccaucauggccuccacggagcuggacgagguccaggacgacgacgcgccccucagcccgaugcuguacuccagcuccgccagccugucccccagcguguccaagcccugcaccguggagcucccccgccugaccgacauggccgggaccaugaaccugaacgacggccucacggagaaccugauggacgaccugcucgacaacaucacccugccgcccagccagcccucccccaccgggggccugaugcagcggagcuccagcuucccguacaccacgaagggcuccgggcucggcagccccaccagcuccuucaacagcaccgucuucgggcccuccagccugaacucccugcgccagagccccaugcagaccauccaggagaacaagccggccacguucuccagcaugucccacuacggcaaccagacccuccaggaccugcugaccagcgacucccucagccacuccgacgugaugaugacccagagcgacccccugaugucccaggccagcacggccguguccgcgcagaacagccggcgcaacgucaugcugcggaacgaccccaugauguccuucgccgcccagcccaaccagggcagccucgugaaccagaaccugcugcaccaccagcaccagacccagggggcccucggcgggagccgcgcccuguccaacagcguguccaacaugggccugagcgaguccagcucccuggggagcgcgaagcaccagcagcaguccccggucagccaguccaugcagacccucagcgacucccugagcggcuccagccuguacuccaccagcgccaaccuccccgugaugggccacgagaaguuccccuccgaccuggaccuggacauguucaacgggagccucgagugcgacauggagagcaucauccgguccgagcugauggacgccgacggccuggacuucaacuucgacagccucaucuccacgcagaacguggucgggcugaacgugggcaacuucaccggggccaagcaggccagcucccagagcugggugcccggcuga

SEQ ID NO: 30272 - RNA, 1353 nt, Artificial Sequence
  derived and/or modified sequence opt1 from FOXO4__Homo_sapiens__NP_001164402
auggaccccggcaacgagaacagcgccaccgaggccgcggccaucaucgaccuggacccggacuucgagccccagucccgcccccggagcugcaccuggccccucccgcgccccgagaucgccaaccagcccuccgagcccccggagguggagcccgaccugggggagaaggccaucgagagcgcccccgagaagcggcugacgcucgcgcagaucuacgaguggaugguccgcaccgugcccuacuucaaggacaagggcgacuccaacagcuccgccggguggaagaacagcauccggcacaaccugucccugcacagcaaguucaucaaggugcacaacgaggccaccggcaaguccagcugguggaugcucaacccggaggggggcaaguccggcaaggccccccgccggcgcgcggccagcauggacuccagcuccaagcugcugcgggggcgcagcaaggcccccaagaagaagcccuccguccucccggccccccccgagggcgccacccccacgagcccgguggggcacuucgcgaaguggagcggcucccccugcagccggaaccgcgaggaggccgacauguggaccaccuuccggccccgcuccagcuccaacgccagcuccgugagcacccggcuguccccccugcgcccggagagcgagguccucgccgaggagauccccgccuccgugagcuccuacgcggggggcgugccccccacgcugaacgagggccuggagcuccuggacgggcugaaccucaccagcucccacagccugcugucccggagcggccucuccggguucagccugcagcacccgggcgucaccggcccccugcacaccuacagcuccagccucuucucccccgccgaggggccgcugagcgccggcgaggggugcuucuccagcucccaggcccuggaggcccuccugacgagcgacacccccccccccccggcggacgugcugaugacccagguggaccccauccucucccaggcccccacccugcugcuccugggcgggcugcccagcuccagcaagcucgccacgggcgucggccugugcccgaagccccuggaggcccccgggcccuccagccucgugccgacccuguccaugaucgcccccccccccgugauggcgagcgccccgauccccaaggcccugggcacccccguccucacccccccgacggaggccgcgucccaggaccgcaugccccaggaccuggaccuggacauguacauggagaaccucgagugcgacauggacaacaucaucagcgaccugauggacgagggggagggccuggacuucaacuucgagcccgaccccuga

SEQ ID NO: 30273 - RNA, 1680 nt, Artificial Sequence
  derived and/or modified sequence opt1 from FOXO6__Homo_sapiens__NP_001278210
auggccgccaagcugcgcgcccaccagguggacgucgaccccgacuucgcgccccagagccggccccgcuccugcaccuggccccucccccagcccgaccuggccggcgacgaggacggggcccugggcgccgggguggccgagggcgccgaggacugcgggcccgagcggcgcgccaccgcccccgcgauggcccccgccccgccccucggcgccgaggugggcccccugcggaaggccaagagcucccgccggaacgcgugggggaaccugagcuacgccgaccucaucacgaaggccaucgaguccgcccccgacaagcgccugacccugagccagaucuacgacuggaugguccgguacgugccguacuucaaggacaagggcgacuccaacagcuccgccggguggaagaacagcauccgccacaaccucucccugcacacccgguucauccgcgugcagaacgagggcaccggcaagagcuccugguggaugcugaaccccgagggcgggaagacggggaagacgccccggcgccgggcggucagcauggacaacggcgccaaguuccuccgcaucaaggggaaggccuccaagaagaagcagcugcaggcccccgagcggagcccggacgacuccagccccuccgcccccgcgcccggcccggugcccgccgccgccaagugggccgcgagccccgccagccacgccuccgacgacuacgaggccugggcggacuuccgcggcgggggccggccccugcucggggaggccgccgagcuggaggacgacgaggcccuggaggcccucgcgccgagcagcccccugauguaccccucccccgccuccgcccugagcccggcccucggcucccgcugccccggggagcugccccggcuggccgagcucggcggcccgcuggggcugcacggcgggggcggggcgggccuccccgagggccugcuggacggggcccaggacgccuacggcccccgcgcccgcgccgggacccccgcguacuucggcgggugcaagggcggcgccuacgggggcgggggcggcuucgggccgcccgccaugggcgcccuccggcgccugcccaugcagaccauccaggagaacaagcaggcgagcuucgugcccgccgccgccccguuccggcccggggcccugcccgcgcuccugcccccgcccccgcccgccccgcgccccggccccguccugggggcccccggcgagcucgcccuggccggcgcggccgccgccuacccggggaagggcgccgcgcccuacgccccgcccgcccccucccggagcgcccuggcgcaccccaucucccucaugacccugcccggggaggccggcgccgccgggcuggccccgagcggccacgcggccgccuucggcgggccgcccggcgggcuccugcuggacgcccuccccggccccuacgccgcggccgccgccgggccccugggcgccgcgcccgaccgcuuccccgccgaccuggaccucgacauguucuccggcagccuggagugcgacguggaguccaucauccugaacgacuucauggacagcgacgagauggacuucaacuucgacuccgcccugccgcccccgccgcccgggcucgccggcgcgcccccgcccaaccagagcugggugcccggguga

SEQ ID NO: 30274 - RNA, 345 nt, Artificial Sequence
  derived and/or modified sequence opt1 from FOXP1__Homo_sapiens__NP_001012523
augaugcaggagagcggcaccgagaccaaguccaacgggagcgccauccagaacggcuccgggggcagcaaccaccuccuggagugcgggggccugcgcgagggccgguccaacggggagacgcccgccguggacaucggcgcggccgaccuggcccacgcccagcagcagcagcagcaguggcaccugaucaaccaccagccgagccgcucccccagcuccuggcugaagcggcugaucagcucccccugggagcucgagguccuccaggugccccuguggggcgccguggcggagaccaagaugagcgggccggucugccagcccaaccccucccccuucuga

SEQ ID NO: 30275 - RNA, 2145 nt, Artificial Sequence
  derived and/or modified sequence opt1 from FOXP2__Homo_sapiens__NP_001166237
augaugcaggagagcgccaccgagaccaucuccaacagcuccaugaaccagaacggcaugagcacgcuguccagccagcucgacgccgggucccgcgacggccggagcuccggggacaccagcuccgaggugagcaccgucgagcugcugcaccuccagcagcagcaggcgcugcaggccgcccgccagcugcuccugcagcagcagaccuccggccugaagucccccaaguccagcgacaagcagcggccgcuccaggugcccguguccgucgccaugaugacgccccaggugaucacgccccagcagaugcagcagauccugcagcagcagguccugagcccgcagcagcuccaggcccugcugcagcagcagcaggcggugaugcuccagcagcagcagcugcaggaguucuacaagaagcagcaggagcagcugcaccuccagcugcugcagcagcagcagcagcagcagcagcagcagcagcagcagcagcagcagcagcagcagcagcagcagcagcagcagcagcagcagcagcagcagcagcagcagcagcagcagcagcagcagcaccccgggaagcaggccaaggagcagcagcagcagcagcagcagcagcagcucgccgcccagcagcugguguuccagcagcagcugcuccagaugcagcagcugcagcagcagcagcaccuccugucccugcagcgccagggccugaucagcaucccgcccggccaggcggcccuccccgugcagagccugccccaggccgggcugucccccgccgagauccagcagcucuggaaggaggucaccggcgugcacagcauggaggacaacgggaucaagcacggcgggcuggaccugaccaccaacaacuccagcuccaccaccagcuccaacaccagcaaggccuccccgcccaucacgcaccacagcaucgugaacggccaguccagcguccucuccgcgcggcgcgacagcuccagccacgaggagaccggcgccucccacacccuguacgggcacggcgugugcaaguggcccgggugcgagagcaucugcgaggacuucggccaguuccugaagcaccucaacaacgagcacgcccuggacgaccgguccaccgcccagugccgcgugcagaugcaggucgugcagcagcuggagauccagcucagcaaggagcgggagcgccugcaggccaugaugacgcaccuccacaugcggcccagcgagcccaagccgucccccaagccccugaaccuggugagcuccgucaccaugagcaagaacaugcuggagaccagcccccagagccucccgcagacccccacgacccccaccgcgcccgugaccccgaucacgcagggccccuccgugaucacccccgccagcguccccaacgugggggccauccgccggcgccacuccgacaaguacaacaucccgaugagcuccgagaucgcccccaacuacgaguucuacaagaacgccgacgugcggcccccguucaccuacgcgacccugauccgccaggccaucauggagagcuccgaccggcagcugacgcugaacgagaucuacagcugguucacccgcaccuucgccuacuuccggcgcaacgccgccaccuggaagaacgcgguccggcacaaccucucccugcacaagugcuucgugcgcgucgagaacgugaagggcgccguguggacggucgacgagguggaguaccagaagcgccggagccagaagaucaccgggucccccacccuggugaagaacauccccaccagccucggcuacggggccgcccugaacgcgagccugcaggccgcccucgccgaguccagccugccccugcucuccaacccgggccugaucaacaacgccagcuccggccugcuccaggcgguccacgaggaccugaacgggagccuggaccacaucgacuccaacggcaacagcucccccgggugcagcccccagccccacauccacuccauccacgugaaggaggagccggugaucgccgaggacgaggacugccccaugagccucgucacgaccgccaaccacucccccgagcuggaggacgaccgcgagaucgaggaggagccccugagcgaggaccucgaguga

SEQ ID NO: 30276 - RNA, 1191 nt, Artificial Sequence
  derived and/or modified sequence opt1 from FOXP3__Homo_sapiens__NP_001107849
augcccaacccgcgccccggcaagcccagcgcccccucccuggcccucgggccgagccccggcgcgucccccagcuggcgggccgcccccaaggccuccgaccugcugggggcccgcggccccgggggcaccuuccagggccgggaccuccgcgggggcgcgcacgccagcuccagcucccugaaccccaugccgcccagccagcugcagcucuccaccguggacgcccacgcccggacgccgguccuccaggugcacccccuggagagccccgcgaugaucucccugacgcccccgaccaccgccaccgggguguucagccugaaggcccgccccggccugccgcccgggaucaacgucgccucccucgagugggugagccgggagcccgcccugcugugcaccuuccccaaccccuccgcgccccgcaaggacagcacccucuccgccgugccgcagagcagcuacccccugcuggccaacggcgucugcaaguggcccggcugcgagaagguguucgaggagcccgaggacuuccucaagcacugccaggccgaccaccuccuggacgagaaggggcgggcccagugccugcugcagcgcgagauggugcagucccuggagcagcagcucguccuggagaaggagaagcugagcgcgaugcaggcccaccucgccggcaagauggcccugaccaaggccuccagcguggcguccagcgacaagggguccugcugcaucguggccgccggcagccagggcccggucgugcccgccugguccgggccccgggaggccccggacagccuguucgcggugcgccggcaccucuggggcucccacgggaacagcacguuccccgaguuccugcacaacauggacuacuucaaguuccacaacaugcgcccgcccuucaccuacgccacccugauccggugggccauccucgaggcccccgagaagcagcgcacccugaacgagaucuaccacugguucacgcggauguucgcguucuuccgcaaccaccccgccaccuggaagaacgccauccggcacaaccugucccuccacaagugcuucguccgcguggagagcgagaagggcgccguguggaccgucgacgagcuggaguuccggaagaagcgcucccagcgccccagccggugcuccaaccccaccccggggcccuga

SEQ ID NO: 30277 - RNA, 2043 nt, Artificial Sequence
  derived and/or modified sequence opt1 from FOXP4__Homo_sapiens__NP_001012426
augaugguggagagcgccuccgagaccauccgcagcgcccccuccggccagaacggggucggcagccuguccgggcaggcggacggcagcuccgggggcgccaccggcacgaccgccagcgggaccggccgggaggugaccacgggggccgacuccaacggcgagaugagccccgccgagcuccugcacuuccagcagcagcaggcgcuccagguggcccgccaguuccuccugcagcaggccuccgggcugagcucccccggcaacaacgacagcaagcaguccgccagcgcgguccaggugcccguguccgucgccaugaugagcccccagaugcucaccccgcagcagaugcagcagauccuguccccgccccagcugcaggcccuccugcagcagcagcaggcccugaugcuccagcagcugcaggaguacuacaagaagcagcaggagcagcugcaccuccagcugcugacccagcagcaggccggcaagccccagcccaaggaggcgcucgggaacaagcagcuggccuuccagcagcagcugcuccagaugcagcagcugcagcagcagcaccuccugaaccugcagcggcagggccuggugagccuccagcccaaccaggccagcgggccccugcagacccugccccaggccgccgugugcccgacggaccucccccagcuguggaagggcgagggcgcgcccgggcagcccgccgaggacuccgugaagcaggagggccuggaccugaccgggaccgccgccaccgccacgagcuucgcggccccgcccaagguguccccgccccugagccaccacacccugcccaacggccagcccaccgugcucaccucccgccgggacagcuccagccacgaggagacgcccgggucccacccccuguacggccacggcgagugcaaguggccggggugcgagacccugugcgaggaccucggccaguucaucaagcaccugaacaccgagcacgcccuggacgaccgcagcaccgcccagugccggguccagaugcaggucgugcagcagcucgagauccagcuggccaaggaguccgagcgccugcaggcgaugauggcccaccuccacaugcggcccagcgagcccaagcccuucucccagccgcugaaccccgugcccgggagcuccagcuucuccaaggugacggugagcgccgccgacuccuucccggacggccugguccacccgcccaccagcgcggccgcccccgugacgccccuccgcccgcccgggcugggcagcgccucccugcacggcgggggccccgcccggcgccggagcuccgacaaguucugcagccccaucuccagcgagcuggcgcagaaccacgaguucuacaagaacgccgacgugcgcccgcccuucaccuacgccucccucauccggcaggccauccuggagacccccgaccgccagcugacccucaacgagaucuacaacugguucacccggauguucgccuacuuccgccggaacaccgcgacguggaagaacgccguccgccacaaccugagccugcacaagugcuucgugcggguggagaacgucaagggggccguguggaccgucgacgagcgcgaguaccagaagcgccggccgcccaagaugaccggcucccccacccucgugaagaacaugaucagcgggcuguccuacggcgcccugaacgccagcuaccaggcggcccucgccgaguccagcuucccccugcugaacucccccggcaugcucaaccccgggagcgccuccagccugcugccccucagccacgacgacgugggcgcgcccgucgagccgcugcccuccaacgggagcuccuccccgccccgccugagcccgccccaguacagccaccagguccaggugaaggaggagcccgccgaggccgaggaggaccggcagcccggcccgccccucggcgcccccaaccccuccgccagcgggccgcccgaggaccgcgaccuggaggaggagcugcccggcgaggagcucuccuga

SEQ ID NO: 30278 - RNA, 1212 nt, Artificial Sequence
  derived and/or modified sequence opt1 from FOXQ1__Homo_sapiens__NP_150285
augaagcuggagguguucgucccccgcgccgcccacggcgacaagcaggggagcgaccucgagggcgccgggggcuccgacgcgccgagcccccuguccgccgccggggacgacagccugggcuccgacggcgacugcgccgcgaacagccccgccgccgggggcggggcccgggacacccagggcgacggggagcaguccgcgggcggcgggcccggcgccgaggaggccaucccggccgccgcggccgccgccgugguggccgagggggcggaggccggcgccgccggccccggggccggcggggcgggcagcggggagggcgcccgcuccaagcccuacacccggcgccccaagccgcccuacagcuacaucgcccucaucgccauggccauccgggacuccgcgggcgggcgccugacgcuggccgagaucaacgaguaccucaugggcaaguuccccuucuuccgggggagcuacaccggcuggcgcaacuccguccggcacaaccugagccugaacgacugcuucgugaaggugcuccgcgaccccucccggccgugggggaaggacaacuacuggaugcugaaccccaacagcgaguacaccuucgccgacggcgucuuccgccggcgccggaagcgccugucccaccgggcccccgugcccgcgccgggccuccgccccgaggaggcccccgggcugcccgccgccccgccgcccgcccccgcggcccccgccagcccccggaugcgcucccccgcccggcaggaggagcgcgccagccccgcgggcaaguucagcuccagcuucgccaucgacuccauccugcgcaagccguuccggagccgccggcuccgcgacaccgcccccgggacgacccugcaguggggcgccgcccccugcccgccccugcccgcguuccccgcccuccugccggccgcccccugccgggcgcugcucccccugugcgccuacggggccggcgagcccgcccgccugggcgcccgggaggcggaggugccgcccaccgccccgccccuccugcuggcgccccuccccgccgccgcccccgccaagccccugcgcgggccggccgccggcggggcccaccuguacugcccccuccggcugcccgcggcccugcaggccgccuccguccgccggcccggcccgcaccuccccuaccccguggagacccugcuggcguga

SEQ ID NO: 30279 - RNA, 879 nt, Artificial Sequence
  derived and/or modified sequence opt1 from FOXR1__Homo_sapiens__NP_859072
augggcaacgagcuguuccucgccuucaccaccagccaccucccccuggccgagcagaagcuggcgcgcuacaagcugcggaucgugaagccgcccaagcugccccucgagaagaagcccaacccggacaaggacgggcccgacuacgagcccaaccuguggaugugggucaaccccaacaucguguacccgcccggcaagcuggagguguccgggcgccggaagcgcgaggaccucacgagcacccugcccuccagccagcccccgcagaaggaggaggacgccuccugcagcgaggccgccggcgucgagucccugagccaguccagcuccaagcggagcccgccccgcaagcgguucgccuucucccccagcaccugggagcucaccgaggaggaggaggcggaggaccaggaggacuccagcuccauggcccugcccagcccccacaagcgcgcgccccugcagucccggcgccuccggcaggccagcagccaggccgggcgccuguggucccggcccccgcugaacuacuuccaccucaucgcccuggcccugcgcaacagcucccccugcggccucaacgugcagcagaucuacagcuucacgcggaagcacuuccccuucuuccgcaccgcccccgagggcuggaagaacaccgugcggcacaaccugugcuuccgcgacuccuucgagaaggucccggugagcaugcagggcggggccuccacccggccccgcagcugccuguggaagcucacggaggaggggcaccggcgcuucgcggaggaggcccgcgcccuggccuccacccggcuggagagcauccagcagugcaugucccagcccgacgugaugcccuuccucuucgaccuguga

SEQ ID NO: 30280 - RNA, 936 nt, Artificial Sequence
  derived and/or modified sequence opt1 from FOXR2__Homo_sapiens__NP_940853
auggaccugaagcucaaggacugcgaguucugguacagccugcacggccaggugcccgggcugcucgacugggacaugcgcaacgagcuguuccugccgugcaccaccgaccagugcucccucgccgagcagauccuggccaaguaccgggucggcgugaugaagccgcccgagaugccccagaagcgccggcccagccccgacggggacggcccgcccugcgagcccaaccuguggauguggguggaccccaacauccucugcccccuggggucccaggaggcgcccaagccgagcggcaaggaggaccugacgaacaucucccccuucccccagcccccgcagaaggacgagggcagcaacugcuccgaggacaaggucguggagagccuccccuccagcuccagcgagcagagcccccugcagaagcaggggauccacucccccuccgacuucgagcugaccgaggaggaggccgaggagccggacgacaacagccuccagucccccgagaugaagugcuaccagagccagaagcuguggcagaucaacaaccaggagaaguccuggcagcgcccgccccugaacugcagccaccucaucgcccuggcccugcggaacaacccccacugcggccucagcgugcaggagaucuacaacuucacccgccagcacuuccccuucuucuggaccgcccccgacggguggaaguccacgauccacuacaaccugugcuuccuggacagcuucgagaagguccccgacucccucaaggacgaggacaacgcgcggccgcgcagcugccuguggaagcugaccaaggagggccaccggcgcuucugggaggagacccgggugcucgccuucgcccagcgcgagcggauccaggagugcaugucccagcccgagcugcugaccagccucuucgaccuguga

SEQ ID NO: 30281 - RNA, 1461 nt, Artificial Sequence
  derived and/or modified sequence opt1 from FOXRED1__Homo_sapiens__NP_060017
augauccgccgggugcugccccacggcauggggcgcggccuccugacccggcgcccggggacccggcgcggcggguucagccuggacugggacggcaaggucuccgagaucaagaagaagaucaagagcauccuccccggccgguccugcgaccugcugcaggacacgagccaccucccgcccgagcacuccgacguggugaucgucgggggcggggugcugggccugagcguggccuacuggcucaagaagcuggagucccgccgcggggccauccggguccuggugguggagcgggaccacaccuacagccaggcguccaccggccucagcgucggcgggaucugccagcaguucucccugcccgagaacauccagcugagccucuucuccgccagcuuccugcgcaacaucaacgaguaccuggccgugguggacgccccgccccucgaccugcgguucaaccccuccggcuaccugcuccuggccagcgagaaggacgcggccgccauggaguccaacgucaaggugcagcgccaggagggggccaaggugagccugaugucccccgaccagcuccggaacaaguuccccuggaucaacaccgagggcgucgcgcuggccagcuacggcauggaggacgaggggugguucgaccccuggugccugcuccagggccugcgccggaaggugcagagccuggggguccucuucugccagggcgaggugacgcgcuucguguccagcucccagcggaugcugaccaccgacgacaaggccgugguccugaagcgcauccacgaggugcacgugaagauggaccggagccucgaguaccagcccgucgagugcgccaucgugaucaacgccgcgggggccugguccgcccagaucgccgcccuggcgggcgucggcgaggggccgcccggcacccugcaggggacgaagcuccccguggagccccgcaagcgcuacguguacgucuggcacugcccgcagggccccgggcuggagacgccccugguggccgacaccagcggcgccuacuuccggcgcgagggccucggguccaacuaccugggcgggcggagccccaccgagcaggaggagccggaccccgccaaccuggagguggaccacgacuucuuccaggacaaggucuggccccaccucgcccugcgcgugcccgcguucgagacccugaaggugcaguccgccugggccggcuacuacgacuacaacaccuucgaccagaacggggucgugggcccgcacccccucguggucaacauguacuucgccaccggcuucagcgggcacggccugcagcaggcccccgggaucggccgggcgguggccgagauggugcugaagggccgcuuccagaccaucgaccucucccccuuccuguucacgcgguucuaccugggggagaagauccaggagaacaacaucaucuga

SEQ ID NO: 30282 - RNA, 1686 nt, Artificial Sequence
  derived and/or modified sequence opt1 from FPGS__Homo_sapiens__NP_001275732
augagccgcgcccggucccaccuccgcgccgcccucuuccuggccgccgccagcgcccggggcaucaccacccagguggcggcccgccgggggcuguccgccuggcccgucccgcaggagcccagcauggaguaccaggacgccgugcgcaugcucaacacccugcagaccaacgcgggcuaccuggagcaggucaagcggcagcgcggggacccccagacccagcucgaggccauggagcuguaccuggcccgguccggccuccagguggaggaccuggaccgccugaacaucauccacgugaccgggacgaagggcaagggcagcacgugcgccuucaccgagugcauccuccgguccuacgggcugaagaccggcuucuucagcagcccccaccuggugcagguccgcgagcggauccgcaucaacgggcagccgaucucccccgagcuguucaccaaguacuucuggcggcuguaccaccgccuggaggagaccaagguggaccucgccguggucgaggugggcaucgggggcgcguacgacugcaccaacaucauccggaagcccguggucugcggcguguccagccuggggaucgaccacaccucccugcucggcgacacgguggagaagaucgccuggcagaagggcgggaucuucaagcagggcguccccgccuucaccgugcugcagccggaggggccccuggccgugcuccgcgaccgggcccagcagaucagcugcccccuguaccugugccccaugcucgaggcgcuggaggagggcgggccgccccugacccucggccuggagggggagcaccagcgcuccaacgccgcccuggcccuccagcuggcccacugcuggcugcagcggcaggaccgccacggcgcgggcgagcccaaggccagccgccccgggcuccuguggcagcugccgcucgcccccgucuuccagcccaccucccacaugcggcugggccugcgcaacacggaguggcccgggcggacccaggugcuccgccggggcccgcugaccugguaccuggacggggcccacaccgccagcuccgcgcaggccugcgugcgcugguuccggcaggcccuccagggccgcgagcggcccagcggcgggcccgagguccgcgugcugcuguucaacgccacgggcgaccgggaccccgcggcccuccugaagcugcugcagccgugccaguucgacuacgccguguucugccccaaccucaccgaggucagcuccaccgggaacgccgaccagcagaacuucaccgugacgcuggaccagguccugcuccgcugccuggagcaccagcagcacuggaaccaccuggacgaggagcaggccagccccgaccucugguccgcgcccagcccggagcccggcggguccgccagccugcugcucgcgccccacccgccccacacgugcuccgccagcucccugguguucagcugcaucucccacgcccugcaguggaucagccagggccgggaccccaucuuccagcccccguccccgcccaagggccuccugacccaccccguggcgcacagcggggccuccauccugcgcgaggccgccgccauccacguccucgugaccggcagccugcaccuggucgggggcgugcucaagcugcuggagcccgcgcucucccaguga

SEQ ID NO: 30283 - RNA, 1053 nt, Artificial Sequence
  derived and/or modified sequence opt1 from FPR1__Homo_sapiens__NP_001180235
auggagaccaacagcucccugcccaccaacaucagcggcgggacgccggccguguccgccggcuaccucuuccuggacaucaucaccuaccuggucuucgcggugaccuucgugcucgggguccugggcaacgggcuggugaucuggguggccggcuuccgcaugacccacacggucaccaccaucagcuaccucaaccuggccguggccgacuucugcuucaccuccacgcugcccuucuucauggugcggaaggccaugggcgggcacuggcccuucggcugguuccucugcaaguucgucuucaccaucguggacaucaaccuguucgggagcguguuccugaucgcgcucaucgcccuggaccgcugcgucugcgugcugcaccccguguggacccagaaccaccggaccgucucccucgccaagaaggugaucaucggcccgugggugauggcccugcugcucacgcugcccgucaucauccgcgugaccaccgugcccgggaagaccggcacggucgcgugcaccuucaacuucagccccuggaccaacgacccgaaggagcggaucaacguggccguggccaugcugaccguccgcggcaucauccgguucaucaucggguucuccgcccccaugagcaucguggccgucuccuacggccucaucgcgacgaagauccacaagcaggggcugaucaagagcucccgcccccugcgggugcucagcuucguggccgccgccuucuuccugugcuggucccccuaccaggucguggcccugaucgcgaccgugcgcauccgggagcuccugcagggcauguacaaggagaucggcaucgccgucgacgugaccagcgcccuggccuucuucaacuccugccucaacccgaugcuguacguguucauggggcaggacuuccgcgagcggcugauccacgcccuccccgcgagccuggagcgcgcccugaccgaggacuccacgcagaccagcgacaccgccaccaacagcacgcuccccuccgccgaggucgagcugcaggccaaguga

SEQ ID NO: 30284 - RNA, 1056 nt, Artificial Sequence
  derived and/or modified sequence opt1 from FPR2__Homo_sapiens__XP_006723183
auggagaccaacuucagcacgccccugaacgaguacgaggagguguccuacgagagcgccggcuacaccguccuccgcauccugccgcugguggugcucggggucaccuucgugcugggcgugcuggggaacggccucgucaucuggguggccggguuccggaugacccgcaccgugacgaccaucugcuaccugaaccuggcgcucgccgacuucuccuucaccgccacccugcccuuccugaucgucagcauggccaugggcgagaaguggcccuucggcugguuccucugcaagcugauccacaucgugguggacaucaaccuguucggguccgucuuccucaucggcuucaucgcccuggaccggugcaucugcgugcugcaccccgugugggcgcagaaccaccgcacggucagccucgccaugaaggugaucguggggccguggauccuggcccugguccucacccugcccguguuccuguuccucaccaccgugacgauccccaacggcgacaccuacugcaccuucaacuucgccuccuggggcgggacccccgaggagcggcugaaggucgcgaucacgaugcugaccgcccgcggcaucauccgguucgugaucggguucagccucccgauguccaucguggccaucugcuacggccugaucgccgccaagauccacaagaaggggaugaucaagagcucccgcccccugcggguccucaccgcgguggucgccagcuucuucaucugcugguuccccuuccagcugguggcccugcucggcaccguguggcugaaggagaugcuguucuacggcaaguacaagaucaucgacauccucgucaaccccacguccagccuggccuucuucaacuccugccugaacccgaugcucuacguguucguggggcaggacuuccgcgagcggcugauccacagccugcccaccucccucgagcgcgcccugagcgaggacuccgcgcccaccaacgacaccgccgccaacagcgccagcccgcccgccgagacggagcugcaggcgauguga

SEQ ID NO: 30285 - RNA, 1062 nt, Artificial Sequence
  derived and/or modified sequence opt1 from FPR3__Homo_sapiens__NP_002021
auggagaccaacuucagcaucccccugaacgagaccgaggaggugcuccccgagcccgccggccacacgguccuguggaucuucucccugcucgugcacggggugaccuucgucuucggcgugcuggggaacggccuggugaucugggucgccggguuccgcaugacccggaccgugaacacgaucugcuaccucaaccuggcgcuggccgacuucagcuucuccgccauccuccccuuccgcauggugagcgucgccaugcgggagaaguggcccuucggcuccuuccugugcaagcuggugcacgugaugaucgacaucaaccucuucgucagcguguaccugaucaccaucaucgcccuggaccgcugcaucugcgugcuccacccggcgugggcccagaaccaccggaccaugucccuggccaagcgcgucaugaccggccuguggaucuucacgaucgugcucacccugcccaacuucaucuucuggaccaccaucagcacgaccaacggggacaccuacugcaucuucaacuucgccuucuggggcgacaccgcgguggagcggcugaacgucuucaucacgauggccaagguguuccucauccugcacuucaucaucggguucuccgugcccaugagcaucaucaccgucugcuacggcaucaucgccgccaagauccaccgcaaccacaugaucaaguccagccggccccugcgcguguucgccgcgguggucgccuccuucuucaucugcugguucccguacgagcucaucgggauccugauggccguguggcugaaggagaugcuccugaacggcaaguacaagaucauccugguccucaucaaccccaccagcucccuggccuucuucaacagcugccugaaccccauccucuacguguucaugggccggaacuuccaggagcgccugauccggucccugcccaccagccucgagcgcgcccugacggaggugccggacuccgcgcagaccagcaacaccgacaccacgagcgccuccccgcccgaggagaccgagcugcaggccauguga

SEQ ID NO: 30286 - RNA, 5931 nt, Artificial Sequence
  derived and/or modified sequence opt1 from FRAS1__Homo_sapiens__NP_001159605
augggcgugcugaaggucuggcucgggcuggcccuggcccucgcggaguucgccgugcugccccaccacagcgagggcgccugcguguaccaggacucccugcucgccgacgccaccaucuggaagccggacagcugccaguccugccgcugccacggggacaucgucaucugcaagcccgcggugugccggaacccccagugcgccuucgagaagggcgaggugcugcagaucgccgccaaccagugcugccccgagugcguccugcgcaccccggggagcugccaccacgagaagaagauccacgagcacggcacggagugggcguccagccccugcuccgugugcagcugcaaccacggcgaggugcggugcaccccccagcccugcccgccccucuccugcgggcaccaggagcuggccuucauccccgagggcagcugcugccccgucugcguggggcugggcaagccgugcuccuacgaggggcacguguuccaggacggcgaggacuggcgccucagccggugcgccaagugccugugccgcaacggcgucgcccagugcuucaccgcccagugccagccccuguucugcaaccaggacgagaccguggugcggguccccgggaagugcugcccccagugcuccgcgcgcagcugcuccgccgccggccagguguacgagcacggggagcaguggagcgagaacgccugcacgaccugcaucugcgaccggggcgaggugcgcugccacaagcaggccugccucccgcugcggugcggcaaggggcagucccgcgcgcggcgccacggccagugcugcgaggagugcgucagccccgccggguccugcagcuacgacggcguggugcgguaccaggacgagauguggaaggggagcgccugcgaguucugcaugugcgaccacggccaggucaccugccagaccggcgagugcgccaagguggagugcgcccgcgacgaggagcugauccaccucgacgggaagugcugccccgagugcaucucccggaacggcuacugcguguacgaggagacgggggaguucaugagcuccaacgcgagcgaggucaagcgcauccccgagggcgagaagugggaggacgggccgugcaaggugugcgagugccggggcgcccaggucaccugcuacgagcccuccugcccccccugcccggugggcacccuggcccuggaggugaaggggcagugcugccccgacugcaccagcguccacugccaccccgacugccucacgugcucccagagccccgaccacugcgaccugugccaggacccgaccaagcugcuccagaacggcuggugcgugcacuccugcgggcugggcuucuaccaggccgggagccugugccucgccugccagccccagugcuccaccugcaccagcggccuggagugcuccagcugccagcccccgcugcucaugcgccacggccagugcgugcccacgugcggggacggcuucuaccaggaccggcacuccugcgcggucugccacgagagcugcgccgggugcuggggccccaccgagaagcacugccuggccugccgcgacccccugcacgugcuccgcgacggcgggugcgaguccagcugcggcaagggguucuacaaccggcagggcaccugcuccgccugcgaccagagcugcgacagcugcgggccguccagcccccgcugccugaccugcacggagaagaccgugcugcacgacggcaagugcauguccgagugccccggcggguacuacgcggacgccaccggccggugcaaggucugccacaacagcugcgccuccugcagcgggcccaccccgucccacugcacggccugcagcccccccaaggcccuccgccagggccacugccugccccggugcggggagggcuucuacuccgaccacggcgugugcaaggcgugccacagcuccugccuggccugcauggggccggcccccagccacugcaccggcugcaagaagcccgaggaggggcuccagguggagcagcuguccgacgucggcauccccagcggggagugccuggcccagugccgcgcccacuucuaccucgaguccaccggcaucugcgaggcgugccaccagagcugcuuccggugcgccggcaaguccccgcacaacugcaccgacugcgggcccagccacgugcugcuggacggccagugccucagccagugccccgacggguacuuccaccaggagggcuccugcacggagugccaccccaccugccgccagugccacgggccgcuggagagcgacugcaucuccugcuacccccacaucagccugaccaacggcaacugccggaccuccugccgcgaggagcaguuccucaaccuggugggcuacugcgccgacugccaccaccugugccagcacugcgccgccgaccugcacaacacggggagcaucugccuccggugccagaacgcgcacuaccugcugcucggcgaccacugcguccccgacugccccuccggguacuacgccgagcgcggcgccugcaagaagugccacagcuccugccggaccugccagggccgcgggccguucagcugcuccagcugcgacaccaaccuggugcugucccacaccggcacgugcagcaccaccugcuuccccgggcacuaccucgacgacaaccacgugugccagcccugcaacacccacugcggcuccugcgacagccaggccuccugcaccagcugccgggacccgaacaagguccugcuguucggggagugccaguacgaguccugcgcgccccaguacuaccucgacuucagcacgaacaccugcaaggagugcgacuggagcugcuccgccugcagcggcccccugaagaccgacugccugcagugcauggacggcuacgugcuccaggacggggccugcguggagcagugccuguccagcuucuaccaggacuccggccugugcaagaacugcgacagcuacugccuccagugccaggggccccacgagugcacccgcugcaagggcccguuccugcugcucgaggcccagugcguccaggagugcgggaagggcuacuucgccgaccacgcgaagcacaagugcacggccugcccccagggcugccugcagugcucccaccgggaccgcugccaccugugcgaccacggguucuuccucaagagcggccugugcguguacaacugcgugcccggguucuccguccacaccagcaacgagaccugcuccggcaagauccacacccccagccugcacgugaacgggucccucauccugccgaucggcagcaucaagccccuggacuucucccuccugaacgugcaggaccaggagggccgggucgaggaccugcucuuccacguggugagcacgcccaccaacgggcagcugguccugucccgcaacggcaaggaggugcagcucgacaaggccgggcgcuucagcuggaaggacgugaacgagaagaagguccgguucgugcacuccaaggagaagcugcgcaagggcuaccuguuccucaagaucagcgaccagcaguucuucagcgagccccagcugaucaacauccaggccuucuccacccaggccccguacgugcugcggaacgagguccuccacaucagccgcggcgagcgggcgaccaucacgacccagaugcuggacauccgcgacgacgacaacccccaggacguggugaucgagaucaucgaccccccccugcacgggcagcuccugcagacccugcaguccccggccacccccaucuaccaguuccagcucgacgagcugagccggggccugcuccacuacgcccacgacggguccgacagcacguccgacgucgccgugcugcaggccaacgacggccacagcuuccacaacauccuguuccaggugaagaccgucccccagaacgaccgcgggcuccagcugguggcgaacuccaugguguggguccccgagggcggcaugcugcagaucaccaaccggauccuccaggccgaggccccgggggccagcgcggaggagaucaucuacaagaucacccaggacuacccccaguucggcgagguggugcugcuggucaacaugcccgccgacucccccgccgacgaggggcagcaccucccggacggccgcacggccacccccaccagcaccuucacgcagcaggacaucaacgaggggaucgugugguaccggcacuccggcgcccccgcgcagagcgacuccuuccgcuucgaggugagcuccgccagcaacgcccagacccggcuggagucccacauguucaacaucgccauccugccccagaccccggaggcccccaaggucagccucgaggcgagccugcacaugaccgcccgcgaggacggccugacggugauccagccccacucccucagcuucaucaacuccgagaagccgagcgggaagaucgucuacaacaucacccugccccugcaccccaaccagggcaucaucgagcaccgggaccacccccacuccccgauccgcuacuucacccaggaggacaucaaccaggggaaggugauguaccggcccccccccgccgccccgcaccuccaggagcugauggccuucagcuucgcgggccugcccgaguccgugaaguuccacuucaccgucagcgacggggagcacacgucccccgagauggugcucaccauccaccugcugcccagcgaccagcagcucccgguguuccaggucaccgccccccgccuggccgugucccccggcggcagcaccuccguggggcugcaggucguggugcgggacgccgagacggcccccaaggagcucuucuucgagcugcgccggccgccccagcacggcguccugcucaagcacaccgcggaguuccgccgccccauggccaccggggacaccuucaccuacgaggacguggagaagaacgcccugcaguacauccacgacggcagcuccacgcgggaggacagcauggagaucuccgugaccgacgggcugaccgucaccaugcucgaggugcgcguggaggucagccuguccgaggaccggggcccccgccuggccgcgggcagcagccucuccaucacgguggccagcaaguccaccgccaucaucacccggagccaccuggccuacguggacgacuccagcccggaccccgagaucuggauccagcugaacuaccuccccuccuacgggacccugcugcgcaucagcggcuccgaggucgaggagcucagcgagguguccaacuucacgauggaggacaucaacaacaagaagauccgguacagcgccguguucgagaccgacgggcaccuggucaccgacuccuucuacuucagcguguccgacauggaccacaaccaccuggacaaccagaucuucaccaucaugaucacgcccgcggagaacccgccccccgugaucgccuucgccgaccucaucaccgucgacgagggcggccgcgccccccugagcuuccaccacuucuucgccaccgacgacgacgacaaccugcagcgggacgcgaucaucaagcuguccgcccucccgaaguacgggugcaucgagaacaccggcacgggggaccgcuucggccccgagaccgccagcgaccuggaggccuccuuccccauccaggacgugcuggagaacuacaucuacuacuuccagagcgugcacgagagcaucgagccgacccacgacaucuucuccuucuacgucagcgacgggaccucccggagcgagauccacuccaucaacaucacgaucgaggugaagacccucgaggugggcaaggucgagccccugaccaccaucuuccacacgauccgcgagcugagccucuga

SEQ ID NO: 30287 - RNA, 840 nt, Artificial Sequence
  derived and/or modified sequence opt1 from FRAT1__Homo_sapiens__NP_005470
augcccugccgccgggaggaggaggaggaggccggcgaggaggccgagggggaggaggaggaggaggacagcuuccugcuccugcagcaguccguggcgcugggcagcuccggggaggucgaccgccucguggcccagaucggcgagacccugcagcuggacgccgcccagcacagcccggccucccccugcgggccgcccggcgcgccccuccgggcccccggcccccuggccgccgcggugcccgccgacaaggcccgcagcccggccgucccccugcuccugccgcccgcccuggcggagaccguggggcccgccccgcccggcgugcuccggugcgcccugggggaccgcggccggguccgcgggcgggccgcccccuacugcguggcggagcuggccacgggccccuccgcccucagcccccugccgccccaggccgaccuggacggcccgcccggggccggcaagcaggggaucccccagccccucuccggccccugccgccggggcuggcugcgcggggcggccgccagccggcgccugcagcagcggcgcggcucccagcccgagacccggaccggggacgacgacccccaccgccuccugcagcagcuggugcucagcggcaaccugaucaaggaggccguccggcgccugcacucccggcgccuccagcugcgcgccaagcugccccagcggccgcuccuggggccccugagcgcgcccgugcacgagccgcccuccccgcgcagcccccgggccgccugcuccgaccccggcgccagcggccgcgcgcagcuccggaccggggacggcgugcugguccccggguccuga

SEQ ID NO: 30288 - RNA, 702 nt, Artificial Sequence
  derived and/or modified sequence opt1 from FRAT2__Homo_sapiens__NP_036215
augcccugccgccgggaggaggaggaggaggccggcgaggaggccgagggggaggaggaggaggacgacagcuuccugcuccugcagcaguccgugacccugggcagcuccggggaggucgaccgccucguggcgcagaucggcgagacccugcagcuggacgccgcccaggacagcccggccucccccugcgccccgcccggggugccccuccgggcgcccggcccccuggccgccgccguccccgcggacaaggcccgcccgcccgccgugccccugcuccugcccccggccagcgccgagacggugggccccgcgcccuccggggcccugcggugcgcccucggcgaccgcgggcggguccgcggccgggccgcccccuacugcguggcggagguggccgccgggccgagcgcccugcccggccccugccgccggggcuggcugcgcgacgccgucaccucccggcgccuccagcagcggcgcuggacccaggcgggggcccgggccggcgacgacgacccccaccgccugcugcagcagcucgugcugagcgggaaccugaucaaggaggccgugcggcgccuccagcgggccgucgcggccguggccgccaccggcccggcguccgcccccggccccgggggcgggcgcagcggccccgaccgcaucgcccugcagccguccgggagccugcucuga

SEQ ID NO: 30289 - RNA, 2148 nt, Artificial Sequence
  derived and/or modified sequence opt1 from FREM1__Homo_sapiens__XP_006716792
auggugacccaggagagcaugcugaaggccgcccucccccuguucacccgcuucaucaucuccaacggccugcggacggagcacggggucuucgagaucacccucgagaccguggaccgcgcgcugccgguggucacccggaacaagggccugcgccucgcccagggggccgugggccugcugagccccgaccuccugcagcugacggaccccgacacccccgccgagaaccucaccuuccugcuggugcagcucccgcagcacgggcagcuguaccuguggggcaccggccuccugcagcacaacuucacgcagcaggacgucgacuccaagaacguggccuaccggcacagcgggggcgacucccagaccgacugcuucaccuucauggcgaccgacgggacgaaccagggcuucaucgugaacgggcgcgucugggaggagcccgugcuguucaccauccagguggaccagcucgacaagaccgcgccccggaucacccugcugcacagccccucccaggucggccuccugaagaacggcugcuacgggaucuacaucacgagccgcgugcugaaggccuccgacccggacaccgaggacgaccagaucaucuucaagauccuccagggccccaagcacgggcaccuggagaacaccaccacgggcgaguucauccacgagaaguucagccagaaggaccugaacuccaagaccauccucuacaucaucaaccccagccuggaggugaacuccgacaccgucgaguuccagaucauggaccccaccggcaacagcgccacgccgcagauccuggagcucaaguggucccacaucgaguggagccagaccgaguacgaggugugcgagaacguggggcugcugccccucgagaucauccggcgcggcuacuccauggacagcgccuucgucgggaucaaggugaaccagguguccgccgccgucggcaaggacuucaccgugauccccagcaagcugauccaguucgaccccgggaugagcaccaagauguggaacaucgccaucacguacgacggccuggaggaggacgacgagguguucgaggucauccucaacuccccggugaacgccguccugggcaccaagaccaaggcggccgugaagauccuggacagcaagggcgggcagugccaccccuccuacagcuccaaccagagcaagcacuccaccugggagaaggggaucuggcaccuccugccgcccggcagcuccagcuccacgaccagcggguccuuccaccuggagcggcgcccccuccccagcuccaugcagcuggccgugauccggggcgacacccugcgcggcuucgacagcaccgaccucucccagcggaagcugcgcacgcgggggaacggcaagaccguccgccccagcuccguguaccggaacgggaccgacaucaucuacaacuaccacggcaucgugagccugaagcuggaggacgacagcuuccccacccacaagcgcaaggccaaggucuccaucaucagccagccgcagaagaccaucaagguggccgagcucccccaggcggacaagguggaguccacgaccgacagccacuucccccggcaggaccagcugcccuccuucccgaagaacugcacccuggagcucaaggggcuguuccacuucgaggagggcauccagaagcuguaccagugcaacggcaucgccuggaaggccuggagcccccagaccaaggacgucgaggacaaguccugccccgccggguggcaccagcacagcggcuacugccacauccucaucacggagcagaaggggaccuggaacgccgcggcccaggccugccgcgagcaguaccugggcaaccuggugaccguguucucccgccagcacaugcgguggcucugggacaucggcgggcgcaagagcuucuggaucggccugaacgaccagguccacgccgggcacugggaguggaucggcggggagccgguggccuucaccaacggccggcgcggccccucccagcggagcaagcuggggaaguccugcgugcucguccagcgccagggcaaguggcagacgaaggacugccggcgcgcgaagccccacaacuacgugugcagccggaagcuguga

SEQ ID NO: 30290 - RNA, 9510 nt, Artificial Sequence
  derived and/or modified sequence opt1 from FREM2__Homo_sapiens__NP_997244
augcacuccgccggcacccccgggcuguccagccggcggaccggcaacuccaccagcuuccagcccgggccgccgcccccgccccgccuccugcugcuccugcugcuccugcugucccucgugagccgggugcccgcccagcccgcggccuucggccgcgcccugcugucccccgggcucgccggcgccgcgggcgugcccgccgaggaggccaucgugcuggccaaccgggggcugcgcguccccuucggccgggagguguggcucgacccccugcacgaccuggugcuccaggugcagcccggggaccgcugcgcggugagcgugcuggacaacgacgcccuggcccagcggcccggccgccucucccccaagcgguuccccugcgacuucgggcccggcgagguccgcuacagccaccugggcgcccggucccccagccgcgaccgggugcgccugcagcuccgguacgacgcccccgggggcgcggugguccugccccuggugcucgagguggaggucguguucacccagcuggagguggucacccgcaaccugccccucgugguggaggagcugcuggggaccuccaacgcccucgacgcccggagccuggaguucgccuuccagcccgagaccgaggagugccgcgucggcauccuguccggccucggggcccugccccgguacggcgagcugcuccacuacccccaggugcccggcggggcgcgcgagggcggggcccccgagacccugcugauggacugcaaggccuuccaggagcucggggugcgcuaccggcacaccgccgccagccgcucccccaaccgggacuggauccccauggucguggagcugcgcagccgcggggccccggucggcucccccgcccugaagcgggagcacuuccaggugcucgugcggauccgcgggggcgccgagaacaccgcccccaagccgagcuucgucgccaugaugaugauggagguggaccaguucgugcugacggcgcugacccccgacaugcucgccgccgaggacgccgagagccccuccgaccugcugaucuucaaccugaccagccccuuccagccggggcagggcuaccucgucuccaccgacgaccggagccugccccuguccagcuucacgcagcgcgaccuccggcugcugaagaucgcguaccagccgcccuccgaggacagcgaccaggagcgccucuucgagcuggagcuggaggugguggaccucgagggcgccgccuccgacccguucgccuucauggucguggugaagcccaugaacaccauggcccccgucgugacccggaacaccgggcugauccuguacgagggccagagccgcccccucacggggccggcgggcuccgggccccagaaccuggugaucagcgacgaggacgaccuggaggccguccggcucgaggugguggccggccugcgccacggccaccuggucauccucggggccuccagcggcuccagcgcccccaaguccuucaccguggcggagcuggccgccgggcaggucgucuaccagcacgacgaccgggacggcagccuguccgacaaccucgugcugcgcaugguggacggcgggggccggcaccagguccaguuccuguuccccaucacccucgugccgguggacgaccagccgcccguccugaacgccaacaccgggcugacgcucgccgagggcgagaccgugcccauccugccgcugagccucagcgcgaccgacauggacuccgacgacagccugcuccuguucgugcuggagucccccuuccugaccacggggcaccuccugcugcgccagacccacccgccccacgagaagcaggagcuccugcgcggccuguggcggaaggagggcgccuucuacgagcgcaccgucaccgaguggcagcagcaggacaucacggaggggcgccuguucuaccgccacagcggcccgcacucccccgggcccgugaccgaccaguucaccuuccgggugcaggacaaccacgacccgcccaaccagagcggccugcagcgcuucgucauccggauccaccccguggaccgccugcccccggagcucggguccggcugcccccugcggauggugguccaggagagccagcugacgccccuccgcaagaaguggcugcgguacaccgaccuggacaccgacgaccgcgagcuccgguacaccgugacccagcccccgacggacaccgacgagaaccaccuccccgcgccccugggcacccucgugcugaccgacaaccccuccgucguggugacccacuucacgcaggcccagaucaaccaccacaagaucgcguaccgcccgcccgggcaggagcugggcgucgccacccggguggcccaguuccaguuccagguggaggaccgcgccgggaacgucgcccccggcaccuucacccucuaccugcaccccguggacaaccagccgcccgagauccugaacacgggguucaccauccaggagaagggccaccacauccucagcgagaccgagcugcacgugaacgacgucgacaccgacguggcgcacaucuccuucacgcugacccaggcccccaagcacggccacaugcgggugagcgggcagauccuccacgucggcgggcuguuccaccuggaggacaucaagcagggccgcguguccuacgcccacaacggggacaagagccucaccgacuccugcagccuggaggucuccgaccggcaccacguggugcccaucacccugcgcgucaacgugcggccgguggacgacgagguccccauccucagccaccccacgggcacccuggagagcuaccuggacgugcucgagaacggcgccaccgagaucaccgccaacgugaucaaggggacgaacgaggagaccgacgaccugaugcugaccuuccuccuggaggacccgccccuguacggcgagauccucgucaacgggauccccgcggagcaguucacccagcgcgacauccuggagggcuccgugguguacacgcacaccagcggcgagaucgggcugcuccccaaggccgacuccuucaaccugagccuguccgacaugagccaggaguggcgcaucggcgggaacaccauccagggcgucaccaucugggugacgauccuccccguggacucccaggcccccgagaucuucgucggggagcagcugaucgugauggagggcgacaagagcgugaucaccuccguccacaucagcgccgaggacguggacucccugaacgacgacauccucugcaccaucgugauccagcccaccagcggcuacgucgagaacaucucccccgccccggggagcgagaagucccgggcgggcaucgccaucagcgccuucaaccugaaggaccugcgccaggggcacaucaacuacgugcaguccgugcacaagggcgucgagcccguggaggaccgguucguguuccgcugcagcgacgggaucaacuucuccgagcggcaguucuuccccaucgucaucauccccacgaacgacgagcagccggagauguucaugcgcgaguucauggugauggagggcaugagccucgugaucgacacccccauccugaacgccgcggacgccgacgucccccuggacgaccucaccuucaccaucacgcaguuccccacccacggccacaucaugaaccagcugaucaacgggaccgugcugguggagagcuucacccuggaccagaucaucgaguccagcuccaucaucuacgagcacgacgacagcgagacgcaggaggacuccuucgucaucaagcucaccgacggcaagcacagcguggagaagaccgugcugaucaucgucaucccgguggacgacgagacgccccggaugaccaucaacaacgggcuggagaucgagaucggcgacacgaagaucaucaacaacaagauccucauggccaccgaccuggacuccgaggacaagagccugguguacaucauccgcuacgggcccggccacggccuccugcagcggcgcaagcccaccggggccuucgagaacaucacccugggcaugaacuucacgcaggacgaggucgaccggaaccucauccaguacgugcaccuggggcaggagggcauccgcgaccugaucaaguucgacgugaccgacggcaucaacccgcucaucgaccgguacuucuacgucuccaucgggagcaucgacaucguguuccccgacgugaucuccaagggcgucagccugaaggagggcggcaaggugacccugaccacggaccuccuguccaccagcgaccugaacucccccgacgagaaccucguguucaccaucacccgcgcccccaugcgggggcaccuggagugcacggaccagccgggcgucagcaucaccuccuucacccagcugcagcucgcgggcaacaagaucuacuacauccacaccgccgacgacgaggugaagauggacagcuucgaguuccaggugacggacgggcgcaaccccgucuuccggaccuuccgcaucuccaucagcgacguggacaacaagaagcccgucgugaccauccacaagcugguggucagcgaguccgagaacaagcugaucacccccuucgagcucacgguggaggaccgggacaccccggacaagcugcugaaguucaccaucacccaggugcccauccacggccaccuccuguucaacaacacgcgccccgucaugguguucaccaagcaggaccugaacgagaaccucaucagcuacaagcacgacgggaccgaguccagcgaggacuccuucagcuucaccgugacggacggcacccacaccgacuucuacgucuuccccgacaccguguucgagacgcgccggccccaggugaugaagauccagguccuggccguggacaacuccgugccccagaucgccgucaacaagggggccagcacccugcgcacccucgcgaccggccaccugggcuucaugaucacguccaagauccugaagguggaggaccgggacagccuccacaucucccugcgcuucaucgugaccgaggcgccccagcacggguaccugcucaaccuggacaagggcaaccacagcaucacccaguucacccaggccgacaucgacgacaugaagaucugcuacguccugcgggagggggccaacgccaccuccgacauguucuacuucgcgguggaggacggcgggggcaacaagcucacguaccagaacuuccgccugaacugggccuggaucagcuucgagaaggaguacuaccuggugaacgaggacuccaaguuccucgacgucgugcugaagcggcgcggcuaccugggggagaccagcuucaucuccaucggcacccgggaccgcaccgccgagaaggacaaggacuucaaggggaaggcccagaagcagguccaguucaaccccggccagacgcgggccaccuggcgcguccggauccucagcgacggggagcacgagcaguccgagaccuuccagguggugcugagcgagccgguccuggcggcccucgaguuccccaccguggccacgguggagaucgucgaccccggcgacgagccgaccguguucaucccccagagcaaguacuccguggaggaggacgucggcgagcuguucauccccauccgccggagcggggacgugucccaggagcugaugguggucugcuacacccagcagggcaccgccacggggaccgugcccaccagcgugcucuccuacagcgacuacaucucccgcccggaggaccacaccagcgucgugcgguucgacaaggacgagcgcgagaagcugugccggaucgugaucaucgacgacucccuguacgaggaggaggagacguuccacguccuccugagcaugcccaugggcggccgcaucggguccgaguuccccggcgcccaggugaccaucgugcccgacaaggacgacgagccgaucuucuacuucggggacgucgaguacagcguggacgaguccgccggcuacguggagguccagguguggcggaccgggaccgaccugagcaaguccagcuccgugacgguccgcagccgcaagaccgacccgcccuccgccgacgccggcaccgacuacgugggcaucagccggaaccucgacuucgcccccggggucaacaugcagccggugcgcguggucauccuggacgaccugggccagcccgcgcucgaggggaucgagaaguucgagcuggugcugcggaugcccaugaacgccgcccucggcgagcccagcaaggccaccguguccaucaacgacagcgucuccgaccugccgaagaugcaguucaaggagcgcaucuacacggggagcgaguccgacggccagaucgugaccaugauccaccggaccggcgacgugcaguaccgcagcuccguccggugcuacacccgccaggggagcgcccaggugaugauggacuucgaggagcggcccaacacggacaccuccaucaucaccuuccugcccggcgagaccgagaagcccugcauccucgagcugauggacgacgugcuguacgaggaggucgaggagcuccgccuggugcuggggacgccgcagagcaacucccccuucggcgcggccgugggggagcagaacgagacccucauccggauccgcgacgacgccgacaagaccgucaucaaguucggcgagaccaaguucagcgugacggagcccaaggagcccggcgaguccguggucauccggaucccggugauccgccagggggacaccagcaagguguccaucguccgggugcacaccaaggacggcagcgccaccuccggggaggacuaccaccccgugagcgaggagaucgaguucaaggagggcgagacgcagcacgucguggagaucgaggugaccuucgacgggguccgcgagaugcgggaggccuucaccgugcaccugaagcccgacgagaacaugaucgcggagaugcagcugaccaaggccaucguguacaucgaggagauguccagcauggccgacgucaccuucccgagcgugccccagaucgugucccuccugauguacgacgacacgagcaaggccaaggaguccgcggagcccaugagcggcuaccccgucaucugcaucaccgccugcaacccgaaguacuccgacuacgacaagaccggcagcaucugcgccuccgagaacaucaacgacacccugacgcgcuaccgguggcucaucagcgcccccgccgggcccgacggcgugaccucccccaugcgcgagguggacuucgacaccuucuucaccagcuccaagauggucacgcuggacagcaucuacuuccagccggggucccgcgugcagugcgcggcccgggccgugaacaccaacggcgacgagggccuggagcucaugagccccaucgucaccaucucccgcgaggaggggcugugccagccccgggugcccggcguggucggggccgagccguucagcgccaagcugcgcuacaccggccccgaggacgcggacuacacgaaccucaucaagcugaccgugaccaugccccacaucgacgggaugcugcccgugaucuccacccgggagcucagcaacuucgagcugacgcugagcccggacggcacccgcgucggcaaccacaagugcuccaaccuccuggacuacaccgaggugaagacccacuacggguuccugacggacgccaccaagaaccccgagaucaucggcgagaccuaccccuaccaguacagccucuccauccgggggagcaccacgcugcgcuucuaccggaaccugaaccucgaggccugccugugggaguucguguccuacuacgacaugagcgagcugcuggccgacugcggcgggaccaucggcaccgacggccagguccucaaccuggugcaguccuacgugacccugcgcgucccccucuacgugagcuacgucuuccacuccccggugggggugggcggguggcagcacuucgaccucaagagcgagcugcggcugacguucgucuacgacaccgccauccuguggaacgacggcaucgggagcccgcccgaggcggagcugcagggcagccucuaccccaccuccaugcgcaucggcgacgaggggcggcuggccgugcacuucaagaccgaggcccaguuccacggccuguucgugcucagccacccggccuccuucacgagcuccgucaucaugagcgcggaccaccccgggcugaccuucucccugcgccucauccggagcgagcccaccuacaaccagcccgugcagcaguggagcuucguguccgacuucgccguccgcgacuacagcggcaccuacacggugaagcuggugccgugcaccgcccccucccaccaggaguaccggcugcccgugaccugcaacccgcgcgagcccgugaccuucgaccucgacauccgguuccagcaggucagcgaccccgucgccgccgaguucucccugaacacccagauguaccugcucagcaagaagucccuguggcugagcgacggcuccaugggguucggccaggagagcgacguggcguucgccgagggggacaucaucuacggccgcgugauggucgaccccgugcagaaccucggggacuccuucuacugcagcaucgagaagguguuccugugcacgggcgccgacggcuacgucccgaaguacucccccaugaacgccgaguacgggugccuggccgacagccccucccuccuguaccgguucaagaucguggacaaggcgcagcccgagacccaggccaccagcuucggcaacgugcuguucaacgccaagcucgccgucgacgacccggaggccauccugcuggugaaccagcccggguccgacggcuucaagguggacagcacgccccucuuccaggucgcgcuggggcgcgagugguacauccacacgaucuacaccgugcgcuccaaggacaacgccaaccggggcaucggcaagcgcagcguggaguaccacagccuggucucccaggggaagccccagagcaccaccaagucccggaagaagcgcgagauccggagcacgccgucccucgccugggagaucggcgccgagaacagccgcgggaccaacauccagcacaucgcccuggaccggaccaagcgccagaucccccacggccgggcgccgcccgacgggauccugccgugggagcucaacucccccagcuccgccgugagccuggugaccgucgugggcggcacgaccguggggcugcucaccaucugccugaccgucaucgccgugcugaugugccgcggcaaggaguccuuccgggggaaggacgcccccaagggcagcuccagcuccgagcccauggugccgccccagagccaccacaacgacuccagcgaggucuga

SEQ ID NO: 30291 - RNA, 6420 nt, Artificial Sequence
  derived and/or modified sequence opt1 from FREM3__Homo_sapiens__NP_001161707
auggccggcgccagccgccaccccaccgggacgccccggcagcugcucguggcccuggccugccugcuccugucccgccccgcccugcagggccgggccagcucccucgggaccgagcccgaccccgcccuguaccugccggcccgcggcgcccucgacgggacccggcccgacggccccagcgugcugaucgccaaccccggccugcgcgugccgcucgggcggucccuguggcuggacccccuccgcgaccuggugaucggcguccagcccggggaccggugcgaggugaccgugcuggacgcccucccccgccugaagggcgcgcugagcccgcggcgcuuccccugcaccuucgggccccggcagguccaguacacccacuucggcucccacagccccggccgcgcccgggugcuccugcagcugcgcuacgacgccccgacccacacccucgugcugcccuucacccuggccgucgaccucguguucucccagcuggagcuggugacgcggaaccgcccccucgucguggagaagcugcggagcuggucccgcgccaucgaccggcgcgugcuggacuucgcgagccucaaguccggggccaccgccacccgccggugccgccugacgccccugccgcacgaggacggcccccuccccaaguacgggcggcuggucgacgccgugggcgcgccccugccgcgcggcaaggggguggacugcgaggcguuccuccgggccggcguccgcuaccagcacacggccaccagcucccccaaccgggacuacgugcccaugaugguggagcugcuggggcccgagggccaggacgccgggagcgccggcguccucgugcgcgagcacuuccagcugcuggugcggauccgcggcggggcggagaacaccccgccccggcccuccuucauggccaccaugaugauggaggucgacccgcucgugcugacggcccugacccccgacgcccucgccgcggaggacgucgagagcgaccccggcgaccugguguucaacauccugaacgcccccacccacccgcccgggcaccccggccagcagggguacguggucuccaccgacgacccccugggccucccggugagcuucuucacgcagcaggagcugcgcgagcugaagaucgccuaccagccgcccgccgagaacagccacggcgagcgccuguuccagcuggagcuggagguggucgacggggacggcgcggccuccgaccccuucgccuucauggugaccgugaaguccaugaacacccucgucccgguggccucccacaaccgcgggcuggugcuguucgagggccagagccggccccucuccagcacccacuccauccccaucagcgacaaggacaaccuggaggaggucaagauggccgcggugcgcgggcugcggcacggccagcucguggucuucggcgcccccgccgggugcaaguacuucacgccggccgaccuggccgcgggccgcgugguguaccagcacgacggguccaacaccuacagcgacaacaucaucuuccggauggaggacggccaccaccaggucgacuuccuguucccccucaccauccugcccguggacgacgagcccccgauggugaacaccaacacgggccugucccucaccgaggggcaggucgugcagaucagccccuucgugcuguccgccaccgacaucgacagcgaggacuccaccauccacuucguccuggagaaccagccccucaagggcaacgaggaggagccccagugggagcuggccccggggagcucccacagcggccacuaccugggggaccuccugcugcagcaggccgagcucccccuguccacggaggacgaggacuggcacuacauggagaaggagggccuguacgagaagguggugaccgaguggcuccagcgcgacaucauggagggccgccuguucuaccggcaccuggggccccacagcccgcagagcgucauggugcagcucgccuuccacgugcaggacgaccacgacccgcccaaccuguccaagcagcacaucuucaccaucaagguccagcccguggacauccugagcccgcagcucuaccccggcaccacgcuggagaugaccgugcaggaguaccagcugacccacuuccagaagaacuuccuccgcuacaucgaccaggacuccgacgaccagaaccugugguacacccugcucacccugcccacggacaccgacgggaaccaccagguccgggcgggcgagaucgugcugaccgacagccccgacacccucaucaugcacuucacgcaggcccaggugaaccagcacaaggucgccuaccagccgccccagaagcuggggaucgcgccccggguggugcaguucaccuaccaggucgaggacgcggccggcaacuccgugcccggcaccuucacccuguuccuccagccgguggacaaccagccgcccgaggucacgaaccggggguucgccauccuggagggcgggagcuucaaccuguccagcaacgagcuccacgugaccgaccccgacaccgacaucgaccagaucguguucauccugguccgcggcccgcagcacgggcaccuccaguacuucaagcggugcauggugcccggcgaguccuucaugcaggccgacgugaucaacggcagcgucuccuaccagcacgggcgcgaccagaccacgaccagcgacaccuuccaccucgagguguccgacggcgugcaccacauccccaucaccauccccaucagcguccacccgaacguggccaaccggagcccccgcaucagccugcgguccagcagccugcucgacgucuccaucgacgugcuggagaacaaggcgacggagaucaccaugggggugauccacggcaagcgcaaggacgucggggaccugaugcucagcuucaucgugaaggacucccccaagcugggcaccauccuggugaacggccuccccaccgagcgguucacgcaggaggaccugaucaacgggcgcgucgccuacgcccacaccgccggcgaggugggguuccagaagcagcacgacgccuucagccugauccucuccaaggacagcuaccaguggguggucggcaacuccaucaucgagaagguccaggugcaggucaccgugcugccgguggacaacgucggccccaagguguucgugggggagagcuucaucgucuacgagggcgagaagaacucccugacccuccagcaccuccacguggaggacguggacacgcaccaggacgagcugcucugcaccgucaccagccagcccgcguccggguaccuggagaagaucgccagcgcccccggcuccaagaugagccaguccgggagcccgaucuccgccuucagccugcgggacauccaggugcgccacaucaacuacgugcaguccauccacaagggcgucgagccccaggaggaccaguucaccuucuacugcagcgacggcaucaacuucagccccaacguguucuucccgaucaucauccuccccacgaacgacgagcagcccaagcuguucgcccacgaguucaaggugcuggaggggaugucccucgucaucgacacccagcugcugaacggcgcggacgccgaccugccgcccaacgagcugcacuuccagcugaccgcccucccccggcacgggcgcaucauccagcagcuggccaccggcagccagcccauccacuccuucacgcugaaggagauccaggaggcgagcaccaucguguacgagcacgacgacuccgagaccaaggaggacagcuucgagguguggcucuccgacgggaagcacaccacgcaccggaagguccccaucguggugacccuggucgacgacgagacgccccaccugaccgugaacaacggccucaagguggagaagggccacagcgagaucaucaccaaccgcauccugaaggccaccgaccuggacuccgacgacaagagccucuccuucguccugcacagcgggccccagcagggccugcugcagcggcuccgcaagccccgcggggaggugcggaacaaccugacccugggcaugaacuucacccaggacgagaucaaccgcgggcucaucugcuacauccacaccggccaggagggcaucguggacaucaucaaguucgacgucacggacggggugaacacccugaccgaccacuacuucuacgugaccaucggcaaccuggacuccgucuuccccgaggugaucagcaagcggaucacgcucaucgagggggcccgcgugacccugaccaacaaccugcucaccaacuccgacaucaacagcuccgacgagcaccacuucagcaucacgcgggccccgucccugggccaccuggagagcagcgacuacgccggcgagcccaucgcguccuucacccagcuccagcuggccagcaacaagaucuccuacguccacaccagcaacgacgagaagaagauggacuccuucgaguuccaggugaucggggagcuguaccccguguuccgcaccuuccggaucuucaucacggacgucgacaacaagaagcccauccucaccauccaccgccugacccugcagaaggaggacagccagcucaucacccugcuggagcucacgguggaggacuccgacaccccggacgaccugauccuguucaccaucacccaggugcccaugcacggcaagauccucuacaacgggagccggcccgucacgaccuucaccaagcaggaccugaacaagaaccugaucuccuacaagcacgacggcagcgagaccacggaggacuccuucagccucaccgugaccgacgggacccacacggacuucuacguccugcccgacaccgcccuggccacccacaagccccaggugaugcgcgugcagauccggucccucgacaaccgccugccccagaucaccacgaaccggggcgcccccgcgcugaagcgccuccacaccggccacaugggguuccugaucaccagcaagucccugaaggccgaggaccaggacagcccccaccggcuccugaaguacaaggucacccgcggcccggagcacggguucaucaucaagaccggccuggggaaccaguccacgcggguguucacccaggccgacaucgacgagaugaagaucagcuacgugcucaacgagggcuccaacgccagcaaggacaucuucuacuucagcgucgaggacaacggcgggaacaagcugaccaaccagcccuuccaccugaacugggccuggaucugccucgagaaggaguacuacaucguggacgaggacuccaccuuccuggaggugacgcugacccgccggggcuaccucggggagaccagcuucaucuccaucggcaccaaggacgagacggcgaagaaggacaaggacuucaaguggaagaccaacaagcagauccaguucaaccccgggcagaccaccgccacguggcgcguccgcaucauccccgacaacgaguacgagaccagcgagaccuuccagaucauccuguccgagccgcugauggccgugcucgaguuccccgagauggccaccguggagaucgucgaccccggcgacgagagcacgguguacaucccggaggccgaguacaagaucgaggaggacaucggcgagcugcugauccccgugcggcgcuccggggacgcgagccaggagcucaucgucaucugcuccacccggcagggcagcgccaccgggaccaucuccagcacggugcuguucuccgacuacaucagccgccccgaggaccacaccuccauccugcacuucgacaagaacgagacccagaagaccugccaggugcucaucaucgacgacagccuguacgaggaggaggaguccuucagcgucucccugcggcuccccgugggcgggcagcugggcgcccgcuucccgacgaccaaggugaccauccuggccgaccgguacgacgagcccguccuccacuucggcgacgcggaguaccacgugaacgagagcgcccgcuacguggaggucugcguguggcggcgcgggaccgaccugagccagcccuccagcaucgccgugcggucccgcaagagcgagcaggaguccgccgaggccggcacggacuacgucgggaucagccggaaccuggacuucgcgcccggcgugcgcaugcagaccuuccaggugaccauccucgacgaccugggccagccgacccuggaggggcccgagaaguucgagcuccugcugcagaugcccaugggcgccguccucggggagcccaacaagacgaccaucuucaucgaggacaccaucaccgacugcaagcaguccgccugcagcuccuucgacuga

SEQ ID NO: 30292 - RNA, 777 nt, Artificial Sequence
  derived and/or modified sequence opt1 from FRG1__Homo_sapiens__NP_004468
auggccgaguacagcuacgugaaguccaccaagcugguccucaagggcaccaagaccaagagcaagaagaagaaguccaaggacaagaagcgcaagcgggaggaggacgaggagacgcagcuggacaucguggggaucugguggaccgugaccaacuucggcgagaucagcgggacgaucgccaucgagauggacaagggcaccuacauccacgcgcuggacaacggccucuucacccugggggcgccccacaaggaggucgacgagggcccguccccgcccgagcaguucaccgccgugaagcugagcgacucccgcaucgcccucaagagcggguacggcaaguaccuggggaucaacuccgacggccugguggucgggcggagcgacgccaucggcccccgcgagcagugggagcccguguuccagaacggcaagauggcccuccuggccuccaacagcugcuucauccggugcaacgaggccggggacaucgaggccaaguccaagacggcgggcgaggaggagaugaucaagauccgcagcugcgccgagcgggagaccaagaagaaggacgacauccccgaggaggacaaggggaacgugaagcagugcgagaucaacuacgucaagaaguuccaguccuuccaggaccacaagcugaagaucagcaaggaggacuccaagauccucaagaaggcccgcaaggacggcuuccugcacgagacccugcucgaccggcgcgccaagcugaaggccgaccgguacugcaaguga

SEQ ID NO: 30293 - RNA, 837 nt, Artificial Sequence
  derived and/or modified sequence opt1 from FRG2__Homo_sapiens__NP_001005217
augggcaaggggaacgaggacagcgaccugcacugcuccagcauccagugcuccaccgaccagcccccguuccagcagaucagcuucaccgagaagggcuccgacgagaagaagcccuucaaggagaaggggaagacggccuucagccacuccagcgagaagcacauccagcgccagggcuccgagcccaaccccaacaaggagaacagcgaggagaccaagcucaaggccgggaacuccaccgcgggcagcgagccggaguccagcuccuaccgggagaacugccgcaagcggaagaugagcuccaaggacagcugccaggacaccgccggcaacugccccgagaaggagugcucccugagccugaacaagaagucccgcuccagcacggccgugcacaacuccgagauccaggagaccugcgacgcccaccaccgggggcacagccgcgccugcaccggccacuccaagcggcaccgcagccgggcgcucgggguccagacccccuccauccgcaagagccuggugacguccgugcgggccaugagcgaggccgucuaccaggaccuggcccaggugugggcgcagcagauccacagcccccugaccugcgagcagcucacccugcucacccgccugcggggcccgcugugcgcccaggugcagacgcucuacagcauggccacccaggccgccuacgucuuccccgcggaguccuggcuggugcccgccacccugcccgggccgggcgagagcgcccucgaccgcgaggcccaccccuuccccggccaggagaucaccgagacgguguccgggagcgacgaggccaagcuguga

SEQ ID NO: 30294 - RNA, 1518 nt, Artificial Sequence
  derived and/or modified sequence opt1 from FRK__Homo_sapiens__XP_011533957
augagcaacaucugccagcgccugugggaguaccucgagcccuaccugccgugccuguccaccgaggccgacaagagcaccgugaucgagaaccccggcgcccucugcagcccccagucccagcggcacgggcacuacuucgucgcgcuguucgacuaccaggcccgcacggccgaggaccuguccuuccgggccggcgacaagcuccaggugcuggacacccugcacgagggguggugguucgcccgccaccucgagaagcggcgcgacggcagcucccagcagcugcagggguacauccccagcaacuacguggcggaggaccggucccugcaggccgagccgugguucuucggcgccaucggccgcagcgacgccgagaagcagcuccuguacuccgagaacaagaccgggagcuuccugauccgggaguccgagagccagaagggcgaguucucccucagcguccuggacggggcgguggugaagcacuaccgcaucaagcggcuggacgagggcggguucuuccucacccgccggcgcaucuucuccacgcugaacgaguucgucagccacuacaccaagaccuccgacggccugugcgugaagcucggcaagcccugccugaagauccaggugcccgcccccuucgaccugagcuacaagaccgucgaccagugggagaucgaccggaacagcauccagcuccugaagcgccugggguccggccaguucggggaggugugggagggccucuggaacaacacgaccccgguggccgucaagacccugaagcccggcagcauggaccccaacgacuuccugcgggaggcccagaucaugaagaaccuccgccaccccaagcugauccagcuguacgccgugugcacccucgaggacccgaucuacaucaucacggagcugaugcggcacgggucccugcaggaguaccuccagaacgacaccggcagcaagauccaccugacccagcaggucgacauggcggcccagguggccuccgggauggccuaccuggagagccgcaacuacauccaccgggaccucgccgcgcgcaacgugcuggugggcgagcacaacaucuacaaggucgccgacuucgggcuggcccgcguguucaagguggacaacgaggacaucuacgagucccggcacgagaucaagcuccccgucaaguggaccgcccccgaggccauccgcagcaacaaguucuccaucaagagcgacgugugguccuucggcauccugcuguacgagaucaucacguacggcaagaugcccuacagcgggaugaccggcgcccaggugauccagaugcucgcgcagaacuaccggcugccgcagcccuccaacugcccccagcaguucuacaacaucaugcuggagugcuggaacgccgagcccaaggagcgcccgaccuucgagacccuccgguggaagcuggaggacuacuucgagacggacagcuccuacagcgacgccaacaacuucauccgcuga

SEQ ID NO: 30295 - RNA, 1671 nt, Artificial Sequence
  derived and/or modified sequence opt1 from FRMD3__Homo_sapiens__NP_001231888
auguucgccagcugccacugcgugccccgcggccggcgcaccaugaagaugauccacuuccgguccagcuccgucaagagccugucccaggagaugcgcugcaccauccggcuccuggacgacagcgagaucuccugccacauccagcgcgagacgaaggggcaguuccugaucgaccacaucugcaacuacuacagccuccuggagaaggacuacuucggcauccgguacguggacccggagaagcagcgccacuggcuggagcccaacaaguccaucuucaagcagaugaagacccacccgcccuacaccaugugcuuccgggugaaguucuacccccacgagccccucaagaucaaggaggagcugacccgcuaccugcucuaccugcagaucaagcgggacaucuuccacgggcgccugcucugcagcuucuccgacgccgcguaccugggcgccugcaucguccaggccgagcugggggacuacgaccccgacgagcaccccgagaacuacaucagcgaguucgagaucuucccgaagcagucccagaagcucgagcggaagaucguggagauccacaagaacgagcugcgcggccagagcccgcccguggccgaguucaaccugcuccugaaggcccacacgcuggagaccuacggcgucgacccccaccccugcaaggacuccaccgggaccacgaccuuccucggcuucaccgcggccggguucgugguguuccagggcaacaagcggauccaccugaucaaguggcccgacgucugcaagcugaaguucgaggggaagaccuucuacgugaucggcacgcagaaggagaagaaggccaugcucgccuuccacaccagcacccccgcggccugcaagcaccuguggaagugcggcguggagaaccaggccuucuacaaguacgccaaguccagccagaucaagaccgucuccagcagcaagaucuucuucaaggggucccgcuuccgguacagcggcaagguggccaaggagguggucgaggcguccagcaagauccagcgcgagcccccggaggugcaccgggccaacaucacgcagucccgcagcucccacagccugaacaagcagcucaucaucaacauggagccccugcagccccugcuccccuccccgagcgagcaggaggaggagcugccccugggggagggcgugccccuccccaaggaggagaacaucuccgccccgcugaucagcuccagccccgucaaggccgcccgggaguacgaggacccgcccuccgaggaggaggacaagaucaaggaggagccccugaccaucagcgagcucguguacaaccccuccgcgagccugcugcccaccccgguggacgacgacgagaucgacaugcuguucgacugccccucccgccucgagcuggagcgcgaggacaccgacagcuucgaggaccucgaggccgacgagaacgccuuccugaucgccgaggaggaggagcugaaggaggcccggcgcgcgcucagcugguccuacgacauccugacgggccacauccgggucaacccccuggucaagagcuucucccgccuccuggugguggggcugggccugcuccuguucguguucccccugcuccugcugcuccuggagagcgucuccaugcaguga

SEQ ID NO: 30296 - RNA, 3120 nt, Artificial Sequence
  derived and/or modified sequence opt1 from FRMD4A__Homo_sapiens__NP_060497
auggccgugcagcugguccccgacagcgcccucggccugcugaugaugaccgaggggcgccggugccaggugcaccuccuggacgaccgcaagcuggagcuccuggugcagccgaagcugcucgcgaaggagcugcuggaccucgucgccucccacuucaaccugaaggagaaggaguacuucggcaucgccuucaccgacgagacggggcaccugaacuggcuccagcuggaccggcgcgugcuggagcacgacuuccccaagaaguccggccccgugguccucuacuucugcgugcgguucuacaucgaguccaucagcuaccugaaggacaacgccaccaucgagcuguucuuccucaacgccaaguccugcaucuacaaggagcugaucgacguggacagcgaggucguguucgagcuggcguccuacauccuccaggaggccaagggggacuucagcuccaacgaggugguccgcagcgaccugaagaagcugcccgcccucccgacccaggcccugaaggagcaccccucccuggcguacugcgaggaccgggugaucgagcacuacaagaagcucaacggccagacccgcggccaggccaucgugaacuacaugagcaucgucgagucccugcccacguacggggugcacuacuacgccgugaaggacaagcagggcauccccugguggcuggggcucagcuacaagggcaucuuccaguacgacuaccacgacaaggucaagccgcggaagaucuuccaguggcgccagcuggagaaccuguacuuccgggagaagaaguucuccguggaggugcacgacccccgccgggccagcgucacccgccggaccuucgggcacuccggcaucgccgugcacaccugguacgcgugccccgcccucaucaagagcaucugggccauggccaucucccagcaccaguucuaccuggaccgcaagcagagcaagagcaagauccacgccgcgcggucccugagcgagaucgccaucgaccucacggagaccggcacccugaagaccagcaagcuggccaacauggggagcaagggcaagaucaucuccgggagcuccggcagccuccuguccagcggcucccaggagagcgacuccagccaguccgccaagaaggacaugcuggccgcgcucaagagccgccaggaggcccuggaggagacgcugcggcagcgccucgaggagcugaagaagcugugccugcgggaggccgagcucaccgggaagcugcccguggaguacccgcuggaccccggcgaggagccgcccaucguccgccgccggaucgggaccgccuucaagcucgacgagcagaagauccugcccaagggcgaggaggccgagcuggagcgccucgagcgggaguucgcgauccagucccagaucaccgaggccgcccgccggcuggccagcgaccccaacguguccaagaagcugaagaagcagcgcaagacgagcuaccucaacgcgcugaagaagcugcaggagaucgagaacgccaucaacgagaaccggaucaagagcgggaagaagcccacccagcgcgccucccucaucaucgacgacggcaacaucgccagcgaggacuccagccuguccgacgcccugguccucgaggacgaggacagccaggugaccuccaccaucagcccccugcacuccccgcacaagggccugccgccccggccgcccagccacaaccggcccccgccgccccagucccucgaggggcugcgccagaugcacuaccaccgcaacgacuacgacaagagccccaucaagcccaagaugugguccgagagcucccuggacgagcccuacgagaaggugaagaagcggagcucccacagccacagcuccagccacaagcgcuuccccuccacgggcagcugcgcggaggccgggggcggguccaacagccuccagaacucccccauccggggccugccccacuggaacagccaguccagcaugcccuccacccccgaccugcgcguccggagcccccacuacgugcacuccacccgcagcguggacaucucccccacccggcuccacagccuggcccugcacuuccgccaccgcuccagcucccucgagagccagggcaagcugcuggggagcgagaacgacacgggcuccccggacuucuacacgccccggacccgcagcuccaacgggagcgaccccauggacgacugcuccagcugcaccucccacagcuccagcgagcacuacuaccccgcccagaugaacgccaacuacuccacccucgcggaggacagcccguccaaggcccggcagcgccagcggcagcgccagcgggccgccggcgcccuggggagcgcguccagcggcuccaugcccaaccuggccgcccgcggcggggccggcggggcgggcggcgccgggggcggggucuaccuccacagccagucccagcccagcagccaguaccggaucaaggaguacccccuguacaucgagggcggggccaccccgguggugguccgcucccuggagagcgaccaggagggccacuacuccgugaaggcccaguucaagaccagcaacuccuacaccgccggcggccucuucaaggagagcuggcggggcgggggcggggacgagggggacacgggccgccugacccccucccggagccagauccugcgcacccccucccucgggcgggagggcgcgcacgacaagggggccggccgcgccgccgugagcgacgagcugcggcagugguaccagcgcuccaccgccagccacaaggagcacucccggcugagccacacguccagcaccuccagcgacuccgggagccaguacagcaccuccagccaguccaccuucgucgcgcacagccgcgugacccggaugccccagaugugcaaggccacguccgccgcccucccgcagagccagcgcuccagcacccccuccagcgagaucggcgccaccccgcccuccagcccccaccacauccugaccuggcagacgggcgaggcgaccgagaacucccccauccuggacgggagcgagagcccgccccaccaguccaccgacgaguga

SEQ ID NO: 30297 - RNA, 3105 nt, Artificial Sequence
  derived and/or modified sequence opt1 from FRMD4B__Homo_sapiens__NP_055938
auggccagcguguucaugugcggcgucgaggaccuccucuucuccgggagccgcuucguguggaaccugaccguguccacccugcggcgcugguacacggagcggcuccgcgccugccaccagguccugcggaccuggugcggccugcaggacguguaccagaugaccgaggggcgccacugccaggugcaccuccuggacgaccggcgccuggagcuccugguccagcccaagcugcucgcgcgggagcugcuggaccucguggccagccacuucaaccugaaggagaaggaguacuucggcaucaccuucaucgacgacacggggcagcagaacuggcugcagcucgaccaccgcgugcuggaccacgaccugccgaagaagcccggccccaccauccuccacuucgccguccgguucuacaucgaguccaucagcuuccugaaggacaagaccaccguggagcuguucuuccucaacgccaaggccugcgugcacaagggccagaucgaggucgaguccgagacgaucuucaagcuggcggccuucauccugcaggaggccaagggggacuacaccagcgacgagaacgcccgcaaggaccucaagacccugcccgcguucccgaccaagacgcugcaggagcaccccucccucgccuacugcgaggaccgggugaucgagcacuaccugaagaucaagggccugacccgcgggcaggccgugguccaguacaugaagaucguggaggcccuccccaccuacggcgugcacuacuacgccgucaaggacaagcaggggcugcccugguggcugggcaucagcuacaagggcaucgggcaguacgacauccaggacaaggugaagccgcggaagcuguuccaguggaagcagcuggagaaccuguacuuccgcgagaagaaguucgcgguggagguccacgacccccggcgcaucuccgugagccggcgcaccuucggccaguccgggcuguucgugcagacgugguacgccaacagcucccugaucaagagcaucugggucauggccaucucccagcaccaguucuaccuggaccggaagcagagcaaggccaagauccccuccgcccgcagccucgacgagaucgcgauggaccugaccgagaccggcacccagcgcgccagcaagcuggugacgcucgaggccaagucccaguucaucauggccagcaacggcucccugaucagcuccgggagccaggacuccgaggucagcgaggagcagaagcgggagaagauccuggagcucaagaagaaggagaagcugcugcaggagaagcugcucaagaagguggaggagcugaagaagaucugccugcgcgaggccgagcucaccggcaagaugcccaaggaguacccgcugaacaucggggagaagccgccccaggugcggcgccgggucggcaccgcguucaagcuggacgacaaccuccugcccuccgaggaggaccccgcccugcaggagcucgagagcaacuuccugauccagcagaagcugguggaggccgccaagaagcucgccaacgagcccgaccugugcaagaccgugaagaagaagcgcaagcaggacuacacggacgcgaugaagaagcugcaggagaucgagaacgccaucaacgaguaccggauccgcugcgggaagaagcccucccagaaggccaccguccuccccgaggacaucaucccgagcgaguccagcucccugagcgacaccaccacguacgacgaccccuccgacgccuucaccuuccccggccagcggagcuccagcgugccccacagcccgcgcauccugccgcccaagucccucggcaucgagcggauccacuuccgcaagagcuccaucaacgagcaguucguggacacccggcagagccgcgagaugcuguccacccacagcucccccuacaagacgcuggagcggcgcccccagggcgggcggagcaugcccaccacccccguccucacccgcaacgcguacuccagcucccaccuggagccggagagcuccagccagcacugccggcagcgcuccgggagccuggagucccagagccaccuccugagcgagauggacuccgacaagcccuucuucagccuguccaagagccagcgcuccagcuccacggagauccucgacgacggcagcuccuacaccagccaguccagcaccgaguacuacugcgugacccccgugaccgggcccuacuacacgacccagacccuggacacccggacgcgcggccggcgccgguccaagaagcagaacgucagcaccuccaacagcggcuccaugccgaaccuggcccagaaggacagccuccgcaacgggguguacuccaagagccaggagccgcccagcuccagcuacuacaucgccggcuacacccccuacgccgagugcgacuucuacuacuccgggggcuacguguacgagaacgacaccgaggggcaguacagcgucaaccccuccuaccggagcuccgcccacuacggcuacgagcgccagcgggacuacagccgcuccuuccacgaggacgagguggaccgggugccccacaaccccuacgcgacgcugcgccugccccggaaggccgccgccaagagcgagcacaucaccaagaacauccacaaggcccucgucgcggagcaccuccgcggcugguaccagcgggccuccgggcagaaggaccagggccacagcccgcagaccuccuucgacagcgaccgcgggucccagcggugccugggcuucgccggccuccaggugcccugcagccccuccagccgcgccuccagcuacagcuccgugagcuccaccaacgccagcgggaacuggcggacgcagcugaccaucggccuguccgacuacgagacccccgcgcacagcuccuacaccagcugcuacgggaacgucuacaacccgcuccccucccccagccgccaguacacggagaucucccagcuggacggcaccgacgggaaccagcuggaggacaaccucgagagcuccgagcagcggcuguucuggcacgaggacagcaagcccggcacccugguguga

SEQ ID NO: 30298 - RNA, 1245 nt, Artificial Sequence
  derived and/or modified sequence opt1 from FRMD5__Homo_sapiens__NP_001273419
augugcuuccgcgugaaguucuaccccgccgacccggccgcgcugaaggaggagaucacccgguaccucgucuuccugcagaucaagcgcgaccuguaccacggccggcuccugugcaagaccagcgacgccgcccugcucgccgccuacauccugcaggcggagaucggggacuacgacuccggcaagcaccccgagggguacagcuccaaguuccaguucuuccccaagcacagcgagaagcuggagcgcaagaucgccgagauccacaagacggagcucuccggccagacccccgccaccagcgagcugaacuuccugcggaaggcccagacccucgagacguacgggguggacccgcaccccugcaaggacguguccggcaacgcggccuuccuggccuucacccccuucggcuucgucgugcugcaggggaacaagcgcgugcacuucaucaaguggaacgaggucaccaagcucaaguucgagggcaagaccuucuaccuguacgagaagaagaucauccugacguacuucgcccccaccccggaggccugcaagcaccucuggaagugcgggaucgagaaccaggcguucuacaagcuggagaaguccagccaggugcggaccgugagcuccagcaaccuguucuucaagggcucccgcuuccgguacagcgggcgcgucgccaaggaggugauggaguccagcgccaagaucaagcgggagccgcccgagauccaccgcgccggcauggugcccucccggagcugccccuccaucacccacggcccccgccucagcagcgucccccggacgcgccggcgcgccgugcacaucuccaucauggaggggcuggagagccugcgggacuccgcgcacagcacccccgugcgcuccaccagccacggcgacaccuuccucccgcacguccgguccagccgcacggacuccaacgagcgcguggccgugaucgccgacgaggccuacagccccgccgacuccguccugcccacccccguggcggagcacagccuggagcucaugcugcugucccggcagaucaacggggcgaccugcagcaucgaggaggagaaggaguccgaggccagcaccccgacggccaccgagguggaggcccucggcggcgagcugcgcgcccugugccaggggcacuccggccccgaggaggagcaggccauggucugccuccagaacccccugagcggggagcccgcccacuga

SEQ ID NO: 30299 - RNA, 795 nt, Artificial Sequence
  derived and/or modified sequence opt1 from FRMD6__Homo_sapiens__NP_001253976
auggaccagcuggagaagcgcagccgggccuccggcagcuccgccgggagcaugaagcacaagcgccucucccggcacagcaccgcgucccacagcuccagccacaccuccggcaucgaggccgacacgaagccccgcgacaccgggccggaggacagcuacuccagcuccgccauccaccggaagcugaagaccugcagcuccaugaccagccacggcuccagccacacgagcgggguggaguccggcggcaaggaccgccuggaggaggaccuccaggacgacgagaucgagaugcuggucgacgacccccgggaccuggagcagaugaacgaggagagccucgaggugucccccgacaugugcaucuacaucaccgaggacaugcugaugagccgcaagcugaacgggcacuccggccucaucgugaaggagaucgggagcuccaccagcuccagcuccgagaccgucgugaagcugcggggccagagcacggacucccugccccagaccaucugccgcaagccgaagaccagcaccgaccggcacucccucagccuggacgacauccgccuguaccagaaggacuuccuccggaucgccgggcugugccaggacacggcccaguccuacaccuucggcugcggccacgagcuggacgaggaggggcucuacugcaacagcugccuggcgcagcagugcaucaacauccaggacgccuuccccgugaagcgcaccuccaaguacuucagccuggaccucacccacgacgagguccccgaguucgugguguga

SEQ ID NO: 30300 - RNA, 2145 nt, Artificial Sequence
  derived and/or modified sequence opt1 from FRMD7__Homo_sapiens__NP_919253
augcugcaccucaaggugcaguuccuggacgacagccagaagaucuucgucguggaccagaaguccagcggcaaggcccuguucaaccucuccugcagccaccugaaccuggccgagaaggaguacuucgggcucgaguucugcucccacagcggcaacaacguguggcuggagcugcucaagcccaucaccaagcaggucaagaacccgaaggagaucguguucaaguucauggugaaguucuuccccgucgaccccgggcaccuccgcgaggagcugacccgguaccuguucacgcugcagaucaagaaggaccuggcgcucggccgccugcccugcuccgacaacugcaccgcccugauggugagccacauccuccaguccgagcugggggacuuccacgaggagaccgaccggaagcaccuggcccagacccgcuaccucccgaaccaggacugccuggagggcaagaucaugcacuuccaccagaagcacaucggccggagccccgccgaguccgacauccugcuccuggacaucgcccgcaagcuggacauguacgggauccggccccaccccgcgagcgacggcgaggggaugcagauccaccucgccguggcccacaugggcguccuggugcugcgcgggaacacgaagaucaacaccuucaacugggccaagauccggaagcucuccuucaagcgcaagcacuuccugaucaagcugcacgcgaacauccucgugcugugcaaggacacccuggaguucaccauggccagccgggacgccugcaaggccuucuggaagacgugcgucgaguaccacgccuucuuccgccucuccgaggagcccaagagcaagcccaagacccugcugugcuccaagggcagcuccuuccgguacagcggccgcacccagcggcagcuccuggaguacgggcgcaagggccggcucaagagccugcccuucgagcgcaagcacuaccccucccaguaccacgagcggcagugccgcagcuccccggaccugcugagcgacguguccaagcaggucgaggaccuccggcuggcguacgggggcggcuacuaccagaacgugaacggggugcacgccagcgagcccgugcuggagucccgccgccggaacagcgcccucgaggucaccuucgccacggagcuggagcacuccaagcccgaggccgaccccacccugcugcaccagagccaguccagcuccagcuucccguucaucuacauggaccccguguucaacaccgagcccaaccccaacccggacccccgcgacaucuucuccgagcggagcucccucagcuccuuccagaccagcugcaaguucagcggcaaccacauguccaucuacagcgggcugacguccaaggugcgccccgcgaagcagcugaccuacaccgacguccccuacaucccgugcaccggccagcaggucgggaucaugccgccccagguguucuucuacguggacaagcccccgcaggucccccgguggagccccauccgcgccgaggagcggacguccccgcacagcuacguggagcccaccgccaugaagcccgccgagcgcagcccccggaacauccgcaugaaguccuuccagcaggaccuccaggugcugcaggaggccaucgcgcggaccuccggccgcagcaacaucaacgugggccuggaggaggaggacccgaaccucgaggacgccuucgucugcaacauccaggagcagacccccaagcggucccagagccaguccgacaugaagacgauccgcuuccccuucgggagcgaguuccggccccugggcccgugccccgcccugucccacaaggccgaccucuucaccgacauguucgccgagcaggagcugcccgcggugcugauggaccagagcaccgccgagcgcuacguggccuccgagagcagcgacuccgagagcgagauccucaagcccgacuacuacgcccuguacgggaaggagauccgguccccgauggcgcgcauccggcugagcuccggcagccuccagcuggacgaggaggacgaggacgccuacuucaacacccccacggccgaggaccgcaccucccugaagcccugcaacuacuuccucgccuga

SEQ ID NO: 30301 - RNA, 4737 nt, Artificial Sequence
  derived and/or modified sequence opt1 from FRMPD1__Homo_sapiens__NP_055722
auggaggagcuggagaccagccucuuccagacccgcaaggcccaccggaucgagcagaugguggcccgcuggcugcggcgcucccgggacagcuccgcgcgcgccaaggucgccgccgccgacggccccgcgcggaacccgacgcagacccugauccccgugcgccacaccgugaagaucgacaaggacacccuccugcaggacuacggguuccacaucagcgagucccugccccucacggucguggccgugaccgccggcgggagcgcccacggcaagcuguuccccggggaccagauccugcagaugaacaacgagccggcggaggaccucuccugggagcgggccgucgacauccugcgcgaggccgaggacagccuguccaucaccguggugcggugcaccagcggcguccccaaguccagcuuccucacggaggagaagcgcgcccggcugaagaccaaccccgugaaggugcacuucgccgaggagguccugaucuccggccacagccaggggaacucccuccugugcaugcccaacgugcugaagcucuaccuggagaacggccagaccaaggcguucaaguucgaggccaacaccacggugaaggacaucauccugaccgucaaggagaagcucagcauccgcuccaucgaguacuucgcccuggcccuggaggagcaguacagcaucucccggcuccaccugcugcacgaggaggagcucauccagcaggugguggagcgcgaggagagccacgacuaccggugccuguuccgcgucugcuucgugccgaaggacccccuggaccuccugaaggaggaccccguggccuucgaguaccuguaccuccagagcugcuccgacguccugcaggagcgguucgcgguggagaugaagugcagcuccgcccugcgccucgccgcccugcacauccaggagcggaucuacgccugcgcgcagccccagaagaucagccugaaguacaucgagaaggacugggggaucgagaacuucaucuccccgacccuccugcgcaacaugaagggcaaggacaucaagaaggccaucagcuuccacaugaagcgcaaccagaaccugcucgagccccggcagaagcagcugaucuccgccgcccagcugcgccucaacuaccugcagauccugggggagcucaagaccuacggcggccggaucuucaacgccacgcugaugcugcaggaccgcgagagcuacaucgcgcugcucgugggggccaaguacggcaucucccaggucaucaacagcaagcugaacaucauguccacccuggccgaguucgccaacaucagccggguggagcucaccgaggaguccgagaaggucagcguggugaaggucuaccugcaggacgugaaggugcugacccuccugcuggaguccaacagcgcgaaggaccucgccugccugaucgccggguacuaccgccugcucgucgaccccgugacguccaucuuccuguggcccggcaacaagcagcaggcccaccgggugagcgccgaggagggcuacgagucccgcgcgugcagcgacagcgaggaguccagcgaggucgacugcgugcuggagccgcucuccgaccggcgccuggugaagcuggcccccugccggagccucaucaaggaggagcagccccccgggaacuccccgacccccgaggucgcccgccggggccccagcaccugcggggccuccagcaccacggacuccgccgagagcgaggcguccgacagcgccaacaccgagucccgcggcuaccggaccagcggguccagcgaguccauggacgcccuggaggaggacgaccuggacaccugcagcagcucccgcagcacguucuuccacuucggcucccccggccucgccgagagcaucgacuccgacagccaggaggagcgguccgggaucgagaccagcggcuuccugugccugcucgaccuggcccagcgcgcgaacccgcagugccagaagaccgaguucuccgagagcgccgcccuggagaccuucgggugggcccccgagcucuccacggugcggcuggacccccgccuguacgagggcagccacgcggacuacuacucccucugcagcuccgugagccccgccuccuaccugagcgacuccagcgagagcaccgccucccgccaggggggcgccccgcccgccuggggccagcagggguggaccgaggcgcagcccagcuccaugcuggagccgcucgcccugcaccccccccuggccuucgaggacggcagcuccgacgaggaguacuacgacgccgccgacaagcucacccccccggggccccccagcggcccccgggacgucuccacggcggagccgagcgccaccucccugcagaacaaggccagcaccuccagccccgagaacucccugcccugcgggcccgacggccgccagccgagccggcgcggcggggugaagaaguacgccaagacccuccggaagcgccgguccuuccugcagaccgacuacacgagccagguguccuucccccugguccccagcgccucccucgagagcguggacgacgugugcuacuacgaccgcgagcccuaccuggcgcugggcgccccgagccccaccgucuccagccuccaggacaugcagggggagcccggccugcuggagaccaaggcccucggccugcuggccccccuccgggagaccaaguccacgaacccggcgagccgcgugauggagauggagcccgagaccauggagaccaaguccgugaucgacagccgggucuccagcaucuccgccauccgcuuccggaucgaccccaacaacaaggagaacagcgggguggugcccgccgccuccagcuccgccagcaccccgcacugcuccaaccccggcagcuccgggcccgacacggcgcaggcccgcccgagccagauccugccccugucccaggaccucgacggcaucgcccccaaggagcccaccaucgagcacggggacagcagcuucucccugagcuccggcgacccgaaccccgaccgggccugccuggccagcaaccccggccucaacaacgucucccagggggacacccuggagcugcagcucgagccccacgugcagcuggagaugggccuggagagcuucugcaccaaccacauccaggagacggcgccgaaguacaccgagccccuccuguccccccgcgacgagccccggagcgacgagugcgggaucaacccgggcgagaagaucgccuccauccccaccaaggaggagccccaggggcagcugagccucgagcgcgaccgggaggugaccaacaagaacggcacgaacgucuuccaggaggagucccgcaaggacagcggcgacucccccggggacgugagcaacaacgugucccagacccuggacaucagcuccccggccggcaagaucgucaccagccugucccucgacgcccccgugaccgggacggagcagauccccccccacccgccccgggacccccagggccagagccgcgagcccccggggcagggcugccaggcccaggagcagaagcuguucguggagcuggaccucgaccccgacuucuuccugggcaagcagaccgucagccccgcggugcccccggaggggaucaaggccgaggcccccaaccacgugaccggccaggacaucgccccccgcgacuccccggagugggucugcuucaaccccgagcccagccugcccgagccgcuccccugcccccaggaggacccccaccuggagaccuccaaccacugccugcucagcgaggggaaguccgacagcuccagcaucugccuguccgccgagaagagcuuccugugcuucgcgccggagucccaccccgaggugagcgccucccuccggguggccacgagccugggcuucgccgggaugaacgagauggucgcgccccgcaucggcauggaccagugcuccugccaguucagcuacgccaccugcuuccggggcccccagccggagaccgaggaggaggaccgcgaccuggaggcccaccccauggccccccucaccucccccccgagcgccgggucccccguggugcugcccuggcggcccgcgcgcgcccacagcugcacgaccgccccgcugagccggaagucccacaucuggcccgaguacugcagccgcgcccuccggcagcugaaggccacccccgcguccacccccgagggcuucauccagcugauggagagccuccuggagcugcaggacauccucgagacguccuggggggucggcaacaagcacccgcccgagaagugcaccuggcacuucaccgagagccgcucccggcugugcaugggcagccagaagcugcuguccagcugccgccacgugauccggauggaccagucccccgaggagaugcagggggccgugcgcgacaccuuccagcaccucguccagcuggccggccugugcuuccaguucacggacugcagccggugcuccgcccgccaccgggaggccgcggggaaccuccgcgacgugguguacaccuaccaccaguucaucgaggccgccaagagcaccugcgagcggggcuaccacgaccuguccgucaagcugcucgcccgccagugcaccgcgcugaccgccgccguguucugccugacgcagaaguuccgcgccagcaccgcccucuga

SEQ ID NO: 30302 - RNA, 3930 nt, Artificial Sequence
  derived and/or modified sequence opt1 from FRMPD2__Homo_sapiens__NP_001018081
augcagccccugaccaaggacgccggcaugagccucuccagcgugacccuggccuccgcgcugcagguccgcggggaggcccucagcgaggaggagaucuggucccugcuguuccucgccgccgagcagcugcuggaggaccuccggaacgacagcuccgacuacguggugugcccguggagcgcccugcuguccgcggccggcagccucuccuuccaggggcgcgucagccacaucgaggccgcccccuucaaggcgcccgagcugcugcagggccaguccgaggacgagcagcccgacgccagccagaugcacguguacucccucgggaugacgcuguacuggagcgccggcuuccacgugccgccccaccagccccugcagcucugcgagccccugcacuccauccugcucaccaugugcgaggaccagccgcaccggcgcugcacccugcagagcguccuggaggccugccgggugcacgagaaggagguguccgucuaccccgcccccgcgggccuccacauccgccggcugguggggcuggugcucggcaccaucagcgaggucgagaagcgcgugguggaggagagcuccagcguccagcagaaccgguccuaccugcugcgcaagcggcuccgcgggacgagcuccgagagccccgccgcccaggccccggagugccugcaccccugccggguguccgagcgcagcaccgagacccaguccagccccgagccccacugguccacccugacgcacagccacugcucccuccuggugaaccgggcccugccgggcgcggacccccaggaccagcaggccgggcgccggcucagcuccggcagcguccacuccgccgccgacagcuccuggcccaccacccccagccagcgcggcuuccugcagcggcgcagcaaguucucccggccggaguucauccugcucgccggggaggcgcccaugacccugcaccuccccggcagcguggugacgaagaaggggaaguccuaccuggcccugcgcgaccugugcgucgugcuccugaacggccagcaccuggaggugaagugcgacgucgagagcaccgugggcgccgucuucaacgccgugaccuccuucgccaaccucgaggagcugaccuacuucgggcuggcguacaugaaguccaaggaguucuucuuccuggacagcgagacgcgccucugcaagaucgcccccgagggcuggcgggagcagccgcagaagaccagcaugaacaccuucacccuguuccugcgcaucaaguucuucgugucccacuacgggcuccugcagcacagccugacgcggcaccaguucuaccuccagcugcgcaaggacauccuggaggagcggcucuacugcaacgaggagauccugcugcagcucggcguccuggcccugcaggccgaguucgggaacuaccccaaggagcaggucgaguccaagcccuacuuccacguggaggacuacauccccgcgagccucaucgagcgcaugaccgcccugcggguccagguggagguguccgagaugcaccgccugagcuccgcccucuggggcgaggacgccgagcugaaguuccugcgggugacccagcagcucccggaguacggcgugcuggugcaccaggucuucagcgagaagcgccggcccgaggaggagauggcccuggggaucugcgcgaagggcgugaucguguacgaggucaagaacaacucccgcaucgccaugcuccgguuccaguggcgcgagaccgggaagaucagcacguaccagaagaaguucaccaucaccagcuccgugaccggcaagaagcacacguucgugaccgacagcgccaagaccuccaaguaccugcuggaccucugcagcgcccagcacggguucaacgcccagaugggcuccggccagcccagccacguccuguucgaccacgacaaguucgugcagauggcgaaccuguccccggcccaccaggcccggagcaagccccucaucuggauccagcgccuguccugcagcgagaacgagcuguucgugucccggcuccagggggccgccggcgggcugcugagcaccuccauggacaacuucaacgucgacggcagcaaggaggcgggggccgagggcaucggccgcucccccugcacggggcgggagcagcucaagagcgccugcgugauccagaagcccaugaccugggacucccugagcggcccgcccgugcaguccaugcacgccgggagcaagaacaaccgccgcaagagcuucaucgcggagcccggccgggagaucguccgcgugacccugaagcgggacccccaccgcggcuucggguucgugaucaacgagggcgaguacuccgggcaggccgacccgggcaucuucaucagcuccaucauccccgggggccccgccgagaaggccaagaccaucaagcccggcgggcagauccucgcccugaaccacaucagccuggagggcuucacguucaacauggcgguccggaugauccagaacuccccggacaacaucgagcucaucaucagccaguccaagggggugggcgggaacaaccccgacgaggagaagaacagcaccgccaacuccggcgugagcuccaccgacauccugagcuucggcuaccaggggucccugcucagccacacccaggaccaggaccgcaacaccgaggagcuggacauggccggcguccagucccuggugccccggcuccgccaccagcugagcuuccugccccucaagggggccggcuccagcugcccgcccuccccgcccgagaucagcgccggggagaucuacuucguggagcuggucaaggaggacggcacgcugggcuucagcgugaccgggggcaucaacaccuccgugcccuacgggggcaucuacgucaagagcaucgugcccgggggccccgcggccaaggagggccagauccuccagggggaccggcugcuccagguggacggcgucauccugugcgggcugacccacaagcaggccgugcagugccugaagggccccggccagguggcccgccucguccuggagcggcgcgugccgcgguccacgcagcagugccccagcgccaacgacuccaugggggacgagcgcaccgcggugagccuggucaccgcccuccccggccggccguccagcugcguguccgugaccgacgggcccaaguucgaggucaagcugaagaagaacgccaacggccugggguucagcuucgugcagauggagaaggaguccugcagccaccucaaguccgaccuggugcgcaucaagcggcuguuccccggccagcccgccgaggagaacggcgcgaucgccgccggggacaucauccucgccgucaacggccgcagcacggaggggcugaucuuccaggaggugcugcaccuccugcggggcgccccgcaggaggucacccugcuccugugccgcccgccgcccggggcgcugcccgagcucgagcaggaguggcagacccccgagcuguccgccgacaaggaguucacccgggccacgugcaccgacagcugcaccucccccauccuggaccaggaggacagcuggcgcgacuccgccagccccgacgccggcgagggccucgggcugcgccccgagagcucccagaaggcgauccgggaggcccaguggggccagaaccgcgagcggcccugggccagcucccugacccacagccccgagucccacccccaccucugcaagcugcaccaggagcgcgacgagagcacgcuggccaccucccucgagaaggacgugcggcagaacugcuacagcgugugcgacaucaugcgccuggggcgguacuccuucagcuccccgcugacccgccucagcaccgacaucuucuga

SEQ ID NO: 30303 - RNA, 3969 nt, Artificial Sequence
  derived and/or modified sequence opt1 from FRMPD4__Homo_sapiens__NP_055543
auggacguguucagcuucgucaagaucgccaagcuguccagccaccgcaccaaguccagcggcuggcccccgcccuccgggaccuggggccucagccaggugccccccuacgggugggagaugacggccaaccgggacggccgcgacuacuucaucaaccacaugacccaggcgaucccguucgacgacccccggcuggaguccugccagaucaucccccccgccccgcgcaagguggagaugcggcgcgaccccguccugggguucggcuucguggccggcagcgagaagcccguggucgugcgguccgugacccccgggggcccgagcgaggggaagcucauccccggcgaccagaucgucaugaucaacgacgagcccguguccgccgccccccgcgagcgggugaucgaccugguccgcagcugcaaggaguccauccugcucaccgugauccagccguaccccagccccaaguccgcguucaucagcgccgccaagaaggcccggcugaaguccaaccccgugaagguccgcuucagcgaggaggugaucaucaacgggcagguguccgagacggucaaggacaacagccugcucuucaugccgaacgugcugaagguguaccuggagaacggccagaccaagagcuuccgguucgacugcuccaccagcaucaaggacgucauccucacccugcaggagaagcuguccaucaagggcaucgagcacuucagccucaugcuggagcagcgcacggagggggcgggcaccaagcugcuccugcugcacgagcaggagacccucacccaggugacgcagcggcccuccagccacaagaugcgcugccuguuccggaucuccuucgugcccaaggaccccaucgaccugcuccgccgggacccggucgccuucgaguaccuguacgugcagagcugcaacgacgucgugcaggagcgcuucgggcccgagcugaaguacgacaucgcccuccggcuggccgcccugcagauguacaucgcgaccgugaccaccaagcagacgcagaagaucucccucaaguacaucgagaaggaguggggccuggagaccuuccugcccagcgccguccuccaguccaugaaggagaagaacaucaagaaggcccugagccaccuggugaaggccaaccagaaccucgugcccccgggcaagaagcuguccgcccugcaggcgaagguccacuaccucaaguuccugagcgaccugcgccucuacgggggccgcguguucaaggccacccuggugcaggccgagaagcgguccgaggucacccugcucguggggccccgcuacggcaucagccacgugaucaacacgaagaccaaccuggucgcccugcucgccgacuucucccacgugaaccggaucgagauguucagcgaggaggagucccuggugcgcgucgagcugcacgugcuggacgugaagcccaucacccuccugauggagagcagcgacgcgaugaaccuggccugccucaccgccggguacuaccggcugcuggucgacucccgccggagcaucuucaacauggccaacaagaagaacacggccacccaggagaccggcccggagaacaagggcaagcacaaccuccuggggcccgacuggaacugcaucccccagaugaccacguucaucggcgagggggagcaggaggcgcagaucaccuacaucgacuccaagcagaagaccguggagaucaccgacagcacgaugugccccaaggagcaccgccaccuguacaucgacaacgccuacuccagcgacggccucaaccagcagcugucccagccgggggaggcccccugcgaggccgacuaccggagccuggcgcagcgcucccuccugacccugagcggccccgagacccucaagaaggcccaggaguccccccggggcgccaaggugagcuucaucuucggggacuucgcccuggacgacggcaucuccccgcccacccugggguacgagacgcuccuggacgagggccccgagaugcuggagaagcagcgcaaccucuacaucgggagcgccaacgacaugaagggccuggaccugacccccgaggcggagggcauccaguucgucgagaacuccguguacgccaacaucggggacgugaagagcuuccaggccgccgagggcaucgaggagccgcuccugcacgacaucugcuacgccgagaacaccgacgacgcggaggacgaggacgaggucuccugcgaggaggaccugguggugggggagaugaaccagcccgccauccucaaccugagcggcagcuccgacgacaucaucgaccugaccagccucccccccccggagggcgacgacaacgaggacgacuuccugcugcggucccucaacauggccaucgccgcccccccccccggguuccgcgacagcuccgacgaggaggacagccagucccaggcggccagcuucccggaggacaaggagaagggcuccagccugcagaacgacgagauccccgucucccugaucgacgccgugcccaccagcgccgaggggaagugcgagaagggccucgacaacgcgguggucuccacgcugggggcccuggaggcccucagcguguccgaggagcagcagaccagcgacaacuccggcguggccauccugcgggccuacagccccgaguccagcagcgacuccggcaacgagaccaacagcuccgagaugaccgagagcuccgagcuggcgacggcccagaagcagagcgagaaccucucccgcauguuccuggccacccacgagggguaccacccgcuggccgaggagcagaccgaguuccccgccagcaagacccccgcgggcgggcucccgcccaaguccagccacgcccuggccgcccggcccgccacggaccugcccccgaaggucgugcccuccaagcagcuccugcacagcgaccacauggagauggagcccgagaccauggagaccaaguccgugaccgacuacuucagcaagcugcacaugggcuccgucgcguacagcugcacguccaagcgcaagagcaagcucgccgacggggagggcaaggcccccccgaacggcaacaccaccgggaagaagcagcagggcaccaagacggccgagauggaggaggaggcguccgggaaguucggcaccgugagcagccgggacucccagcaccugagcaccuucaaccuggagcgcaccgccuuccgcaaggacucccagcggugguacguggccacggaggggggcauggccgagaagagcggccucgaggccgcgaccgggaagaccuucccccgcgccuccggccugggggcccgggaggccgagggcaaggaggagggggcccccgacggcgagaccagcgacggcuccgggcugggccagggggaccgcuuccucacggacgucaccugcgcgagcuccgccaaggaccuggacaaccccgaggacgccgacagcuccaccugcgaccacccgagcaagcugcccgaggccgacgaguccguggcccggcucugcgacuaccaccuggcgaagcgcaugagcucccugcagagcgagggccacuucucccuccagagcucccagggcagcagcguggacgccgggugcggcaccggguccagcggcuccgccugcgccacgcccgucgagagcccccugugcccgucccuggggaagcaccucauccccgacgccagcggcaagggcgugaacuacauccccuccgaggagcgggcgcccgggcugccgaaccacggcgccaccuucaaggagcugcacccccagaccgaggggaugugcccccgcaugaccgugcccgcccuccacacggccaucaacaccgagccgcuguucggcacccugcgggacgggugccaccgccuccccaagaucaaggagaccacggucuga

SEQ ID NO: 30304 - RNA, 1035 nt, Artificial Sequence
  derived and/or modified sequence opt1 from FRRS1L__Homo_sapiens__NP_055149
augcgccggccccgccagggcgggggcggggccggcgggagcgccgcggcccgggcccgcgccggcggccucgggggcggguccgugccggcccgggcgcgcggcgcccccgccgccgcgcgggccgccuggcugcgcgaccugugcgcccggauggcccgcccgccccggcagcaccccggggucugggcgagccugcuccugcugcuccugaccggccccgccgccugcgccgccucccccgcggacgacggcgccgggcccggcgggcgcggcccgcggggccgcgcccgcggggacaccggcgccgacgaggccgugccccggcacgacagcuccuacgggacguucgcgggcgaguucuacgaccugcgguaccucagcgaggagggguaccccuuccccaccgccccgcccguggaccccuucgccaagaucaaggucgacgacugcggcaagaccaagggcugcuuccgcuacgggaagcccggcugcaacgccgagaccugcgacuacuuccuguccuaccggaugaucggggccgacguggaguucgagcugagcgcggacacggacggcuggguggccgucggguucuccagcgacaagaagaugggcggcgacgacgugauggccugcgugcacgacgacaacgggcgcguccggauccagcacuucuacaacgugggccagugggccaaggagauccagcgcaacccggcgcgcgacgaggaggggguguucgagaacaaccgggugaccugccgcuucaagcggcccgucaacgugccccgcgacgagaccaucgucgaccuccaccuguccugguacuaccuguucgccuggggccccgccauccaggggagcaucacccggcacgacaucgacuccccgcccgccagcgagcgcgugguguccaucuacaaguacgaggacaucuucaugcccagcgccgcguaccagacguucuccagccccuucugccuccugcugaucgucgcccucaccuucuaccugcugaugggcaccccguga

SEQ ID NO: 30305 - RNA, 1527 nt, Artificial Sequence
  derived and/or modified sequence opt1 from FRS2__Homo_sapiens__NP_001265286
augggcagcugcugcuccugccccgacaaggacaccgugccggacaaccaccgcaacaaguucaaggucaucaacguggacgacgacgggaacgagcugggcagcgggaucauggagcucaccgacacggagcugauccuguacacccggaagcgcgacuccgugaaguggcacuaccucugccugcggcgcuacggcuacgacagcaaccuguucuccuucgagagcgggcggcgcugccagaccggccagggcaucuucgccuucaagugcgcccgggcggaggagcuguucaacaugcuccaggagaucaugcagaacaacuccaucaacgucguggaggagcccguggucgagcgcaacaaccaccagaccgagcuggaggugccccggacgccccgcaccccgaccacccccggguucgccgcccagaaccuccccaacggcuacccccgguacccgagcuucggggacgccuccagccaccccuccagccgccaccccuccgugggcagcgcccggcugcccuccgucggggaggagagcacgcacccgcugcucguggcggaggagcagguccacaccuacgugaacaccaccggcgugcaggaggagcgcaagaaccggacguccgugcacgucccccuggaggcccgcgugagcaacgccgaguccagcacccccaaggaggagcccagcuccaucgaggaccgggacccgcagauccugcucgagcccgagggcgugaaguucguccuggggcccacccccgugcagaagcagcugauggagaaggagaagcucgagcagcugggccgcgaccaggugagcggguccggcgccaacaacaccgagugggacacgggcuacgacagcgacgagcggcgcgacgcgccguccgucaacaagcugguguacgagaacaucaacgggcucagcauccccuccgccagcggcgugcggcgcgggcgccugaccuccaccagcaccuccgacacgcagaacaucaacaacagcgcccagcggcgcaccgcccugcucaacuacgagaaccugcccucccugcccccggucugggaggcccggaagcucagccgcgacgaggacgacaaccugggccccaagacccccucccugaacggguaccacaacaaccucgaccccaugcacaacuacgugaacaccgagaacgucacggugccggcgagcgcccacaagaucgaguacucccggcgccgggacugcacccccaccguguucaacuucgacauccgccggcccagccuggagcaccgccagcugaacuacauccaggucgaccucgagggcggcuccgacagcgacaacccgcagacccccaagacgcccaccacgccccugccgcagacccccacccggcgcaccgagcuguacgccgugaucgacaucgagcggaccgccgccaugagcaaccuccagaaggcgcugccccgcgacgacgggaccucccggaagacgcgccacaacagcaccgaccugcccauguga

SEQ ID NO: 30306 - RNA, 1479 nt, Artificial Sequence
  derived and/or modified sequence opt1 from FRS3__Homo_sapiens__XP_011512557
augggcagcugcugcuccugccugaaccgcgacagcgugcccgacaaccacccgaccaaguucaaggucaccaacguggacgacgaggggguggagcucggcuccggggucauggagcugacgcagagcgagcuggugcuccaccuccaccggcgcgaggccgugcgguggcccuaccugugccugcgccgguacggcuacgacuccaaccuguucagcuucgaguccgggcgccggugccagaccggccagggcaucuucgccuucaagugcagccgcgcggaggagaucuucaaccugcuccaggaccugaugcagugcaacuccaucaacgucauggaggagcccgugaucaucacccggaacagccaccccgccgagcuggaccucccgcgcgcgccccagccgcccaacgcccugggguacaccguguccagcuucuccaacggcugccccggggagggcccccgguucagcgcgccccgccggcuguccacgagcucccuccgccaccccagccugggggaggaguccacccacgcccugaucgccccggacgagcagagccacaccuacgucaacacccccgccagcgaggacgaccaccggcgcggccggcacugccuccagccccugcccgagggccaggccccguuccugccccaggcccgcgggcccgaccagcgggacccccagguguuccuccagccgggccaggugaaguucguccuggggcccacgcccgcccgccggcacauggugaagugccagggccugugccccucccuccacgacccgccccaccacaacaacaacaacgaggcccccagcgagugccccgcccagccgaagugcaccuacgagaacgugaccggcgggcuguggcgcggcgccggguggcgccugucccccgaggagcccggcuggaacgggcucgcgcaccggcgcgccgcccugcugcacuacgagaaccucccgccccugccgcccgucugggagagccaggcccagcagcugggcggcgaggccggggacgacggcgacucccgggacgggcucacccccagcuccaacggcuuccccgacggggaggaggacgagacgccccugcagaagcccaccagcacccgcgcggccauccggucccacggcagcuucccggugccccugacccgccggcgcggcagcccccggguguucaacuucgacuuccgccggcccgggccggagccgccccgccagcucaacuacauccaggucgagcugaagggcuggggcggggaccggcccaaggggccccagaaccccuccagcccccaggcccccaugccgacgacccaccccgcccgcuccuccgacagcuacgccgugaucgaccugaagaagaccguggcgauguccaaccuccagcgggcccugccccgcgacgacggcaccgcccggaagacgcgccacaacagcaccgaccugccccucuga

SEQ ID NO: 30307 - RNA, 9042 nt, Artificial Sequence
  derived and/or modified sequence opt1 from FRY__Homo_sapiens__NP_075463
auggccagccagcaggacuccggguucuucgagaucagcaucaaguaccugcucaaguccuggagcaacaccucccccguggggaacggcuacaucaagccgcccgugccgcccgccagcgggacccaccgcgagaagggcccgcccaccaugcugcccaucaacguggaccccgacuccaagcccggggaguacgugcucaagagccucuucgucaacuucaccacccaggccgagcggaagauccgcaucaucauggccgagccccuggagaagccccugaccaagucccuccagcggggcgaggacccccaguucgaccaggugaucagcuccaugagcucccugagcgaguacugccugcccuccauccuccgcacgcuguucgacugguacaagcggcagaacggcaucgaggacgagagccacgaguaccgcccccggaccuccaacaagagcaaguccgacgagcagcagcgcgacuaccugauggagcggcgcgaccucgccaucgacuucaucuucagccuggugcugaucgagguccucaagcagaucccccugcaccccgugaucgacagccugauccacgacgugaucaaccucgccuucaagcacuucaaguacaaggagggguaccugggccccaacaccgggaacaugcacaucgucgccgaccuguacgcggaggugaucggcgugcucgcccaggccaaguuccccgccgucaagaagaaguucauggcggagcugaaggagcugcggcacaaggagcagaaccccuacguggugcaguccaucaucagccucaucauggggaugaaguucuuccgcaucaagauguaccccgucgaggacuucgaggccucccugcaguucaugcaggagugcgcccacuacuuccuggaggugaaggacaaggacaucaagcacgcccucgccggccuguucguggagauccuggucccgguggcggccgccgugaagaacgaggucaacgugcccugccuccggaacuucguggagagccuguacgacaccacgcuggagcucuccagccgcaagaagcacucccuggcccuguacccccucgugaccugccugcugugcgugagccagaagcagcuguuccugaaccgguggcacaucuuccugaacaacugccucuccaaccugaagaacaaggaccccaagauggcccgcgucgcgcuggagagccucuaccggcugcuguggguguacaugauccgcaucaagugcgaguccaacaccgccacccagagccggcucaucacgaucaucaccacccuguucccgaagggcucccgcgggguggucccccgggacaugccccugaacaucuucgugaagaucauccaguucaucgcccaggagcgccuggacuucgccaugaaggagaucaucuucgacuuccucugcgugggcaagcccgccaaggcguucagccugaacccggagcgcaugaacaucgggcugcgggccuuccucgucaucgccgacucccugcagcagaaggacggcgagccgcccaugccggugaccggcgccgugcugcccagcgggaacacgcuccgcgucaagaagaccuaccuguccaagacccugaccgaggaggaggccaagaugaucggcaugagccucuacuacucccaggugcggaaggcgguggacaacauccugcgccaccuggacaaggaggucgggcggugcaugaugcucacgaacgugcagaugcugaacaaggagcccgaggacaugaucaccggcgagcgcaagcccaagaucgaccuguuccggaccugcguggccgccaucccgcgccuccugcccgacgggaugagcaagcuggagcucaucgaccugcuggcccggcucagcauccacauggacgacgagcugcgccacaucgcgcagaacucccugcagggccuccuggucgacuucagcgacuggcgggaggacgugcuguucggcuucaccaacuuccuccugcgcgaggugaacgacaugcaccacacgcugcucgacuccagccugaagcugcuccugcagcugcucacccaguggaagcuggucauccagacccaggggaagguguacgagcaggccaacaagauccggaacuccgagcugaucgccaacggcagcucccaccgcauccagagcgagcgggggccccacugcuccgugcuccacgccgucgagggcuucgcccuggugcugcucugcagcuuccagguggcgacccgcaagcuguccguccugauccucaaggagauccgggcccuguucaucgcccuggggcagcccgaggacgacgaccgcccgaugaucgacgugauggaccagcucagcuccagcauccuggaguccuucauccacguggccgucagcgacuccgccacgcugccccucacccacaacguggaccugcaguggcugguggaguggaacgcgguccucgugaacagccacuacgacgucaagagccccucccacgucuggaucuucgcccagagcgugaaggaccccugggugcugugccuguucuccuuccuccggcaggagaaccugccgaagcacugccccaccgcccugagcuacgccuggcccuacgccuucacccgccuccaguccgucaugccccugguggacccgaacagccccaucaacgcgaagaagacguccaccgccggcagcggcgacaacuacgugacccuguggcgcaacuaccucauccugugcuucggggucgccaagcccuccaucaugagccccggccaccuccgggccuccaccccggagaucauggcgacgacccccgacgggaccgugagcuacgacaacaaggccaucggcacccccuccguggggguccuccugaagcagcuggugccccucaugcgccuggagagcaucgagaucaccgagucccuggugcucggcuucggccggacgaacagccuggucuuccgcgagcugguggaggagcuccacccccugaugaaggaggcccuggagcggcgccccgagaacaagaagcggcgcgagcggcgcgaccuccugcggcugcagcuccugcgcaucuucgagcugcucgccgacgccggggugaucuccgacagcaccaacggcgcgcuggagcgggacacccuggcccucggggcccuguuccuggaguacgucgaccucacccgcaugcugcuggaggccgagaacgacaaggagguggagauccucaaggacauccgggcccacuucuccgcgaugguggccaaccugauccagugcguccccgugcaccaccgccgguuccuguucccgcagcagagccugcgccaccaccucuucauccuguucagccagugggccggccccuucuccaucauguucacgccccuggaccgguacagcgaccgcaaccaccagaucacccgguaccaguacugcgcccucaaggccauguccgcgguccugugcugcggccccguguucgacaacguggggcugagcccggacggcuaccucuacaaguggcuggacaacauccuggccugccaggaccuccgcguccaccagcuggggugcgagguggugguccugcuccuggagcugaaccccgaccagaucaaccucuucaacugggccaucgaccgcugcuacaccggcuccuaccagcuggccagcgggugcuucaaggcgaucgccaccgugugcggcucccggaacuaccccuucgacaucgugacgcugcucaaccugguccuguucaaggccagcgacaccaaccgcgagaucuacgagaucuccaugcagcucaugcagauccuggaggccaagcuguucguguacagcaagaagguggccgagcagcggcccggcuccauccucuacgggacccacggcccgcugccgccccuguacagcgucucccucgcgcugcugagcugcgagcucgcccgcauguaccccgagcugacccugccccucuucuccgaggugagccagcgguuccccacgacccaccccaacgggcgccagaucaugcugaccuaccugcuccccuggcugcacaacaucgagcugguggacucccggcuccugcugccgggcagcucccccagcagccccgaggacgaggucaaggaccgcgagggggacgugaccgccucccacggccuccggggcaacggguggggcagccccgaggccacgucccuggugcugaacaaccucauguacaugaccgccaaguacggggacgaggucccgggccccgagauggagaacgcguggaacgcccuggccaacaacgagaaguggagcaacaaccugcgcaucacccuccaguuccugaucucccugugcggggugagcuccgacaccgugcuccugcccuacaucaagaaggucgccaucuaccugugccggaacaacacgauccagaccauggaggagcuccuguucgagcugcagcagaccgagcccgugaacccgaucgugcagcacugcgacaacccgcccuucuaccgcuucaccgccagcuccaaggcgagcgccgccgccuccggcacgaccagcuccagcaacaccgucguggccggccaggagaacuuccccgacgcggaggagaacaagauccucaaggaguccgacgagcgguucagcaacgugauccgcgcccacacccggcuggagucccgcuacagcaacuccagcgggggcagcuacgacgaggacaagaacgacccgaucucccccuacacgggguggcugcucaccaucaccgagaccaagcagccccagccgcugcccaugcccugcacgggcgggugcugggcgccccuggucgacuaccucccggagaccaucacgccccggggcccccugcaccgcugcaacaucgccgugaucuucaugaccgagaugguggucgaccacagcgugcgggaggacugggcgcugcaccucccccugcugcuccacgccguguuccugggccuggaccacuaccgcccggaggucuucgagcacuccaagaagcuccugcugcaccuccugaucgcccugagcugcaacuccaacuuccacagcaucgccuccgugcuccugcagacgcgcgagaugggggaggccaagacccugaccgugcagcccgcguaccagcccgaguaccucuacaccggcggguucgacuuccugcgggaggaccagagcucccccgucccggacagcggccuguccagcuccagcaccuccagcuccaucagccucggcggguccagcggcaaccugccccagaugacgcaggagguggaggacguggacaccgccgccgagaccgacgagaaggccaacaagcugaucgaguuccucaccacgcgcgccuucgggccccuguggugccacgaggacaucacccccaagaaccagaacagcaaguccgcggagcagcugaccaacuuccuccggcacgucgugagcguguucaaggacuccaagagcggcuuccaccuggagcaccagcuguccgaggucgcccuccagaccgcccuggccagcuccagccgccacuacgccgggcgguccuuccagaucuuccgcgcgcugaagcagccgcucagcgcccacgcccuguccgaccugcucagccggcugguggaggugaucggcgagcacggcgacgagauccagggguacgucauggaggcccugcugacgcucgaggcggccguggacaaccuguccgacugccugaagaacagcgaccuccugaccgugcugucccgcagcuccagccccgaccucuccagcagcuccaagcugaccgccagccggaaguccaccggccagcugaacaugaaccccgggacgaccagcggcaacaccgccaccgccgagcgcucccggcaccagcgcagcuucuccguccccaagaaguucggggugaucgaccggagcuccgacccgccccgcagcgcgacgcucgaccggauccaggccugcacccagcagggccuguccagcaagacccgcuccagcuccagccugaaggacucccucaccgaccccagccacaucaaccaccccacgaaccugcuggccaccaucuucugggugaccgucgcccucauggagagcgacuucgaguucgaguaccugauggcccugcggcuccugucccgccugcucgcgcacaugccgcuggacaaggccgagaaccgggagaagcuggagaagcuccaggcccagcugaagugggccgacuucagcggccugcagcagcuccugcugaagggguucaccucccucacgaccaccgaccugacccugcagcuguucagccugcugacgcccguguccaagaucagcauggucgacgccucccacgcgaucggcuucccccucaacgugcugugccugcucccccagcugauccagcacuucgagaacccgaaccaguucugcaaggacaucgccgagcgcaucgcccaggugugccuggaggagaagaaccccaagcucagcaaccuggcccacgucaugacccuguacaagacccacuccuacacccgggacugcgcgacgugggugaacguggucugccgcuaccuccacgaggccuacgccgacaucacccugaacauggugaccuaccuggccgagcuccuggagaaggggcugcccagcgugcagcagccgcuccugcaggucaucuacucccugcucagcuacauggaccuguccguggugcccgucaagcaguucaacguggaggugcugaagaccaucgagaaguacguccagagcgugcacuggcgcgaggcccucaacauccugaagcugguggucucccggagcgcgucccucgugcugcccagcuaccagcacuccgaccugagcaagaucgagauccaccgcguguggacgagcgccuccaaggagcuccccggcaagacccuggacuuccacuucgacaucagcgagaccccgaucaucgggcggcgcuacgacgagcugcagaacuccagcggccgggacggcaagccccgcgccauggccgucacccgguccaccagcuccacgagcuccgggagcaacuccaacgugcucgugcccgucagcuggaagcgcccccaguacucccagaagcggaccaaggagaagcuggugcacgugcugagccucugcggccaggaggucgggcuguccaagaacccgagcgugaucuucuccagcugcggcgaccuggaccuccuggagcaccagaccucccuggugagcagcgaggacggcgcccgcgagcaggagaacauggacgacaccaacuccgagcagcaguuccgggucuuccgcgacuucgacuuccucgacguggagcuggaggacggggagggcgagagcauggacaacuucaacuggggcguccggcgccggucccuggacagccucgacaagugcgacaugcagauccuggaggagcgccagcuguccggcagcacgcccucccucaacaagaugcaccacgaggacagcgacgaguccagcgaggaggaggaccugaccgcgucccagauccuggagcacagcgaccucaucaugacccugucccccagcgaggagaccaaccccauggagcugcucacgaccgccugcgacuccaccccggccgagccccacagcuucaacacccggauguccagcuucgacgccucccugcccgacaugaacaaccugcagaucagcgaggggagcaaggccgaggcgguccgcgaggaggaggacacgaccgugcacgaggacgaccucuccagcuccaucaacgagcugcccgccgccuucgagugcagcgacuccuucagccuggacaugaccgagggcgaggagaagggcaaccgggcccucgaccaguucacccuggccuccuucggggagggcgaccgcggggugagcccgccgcccucccccuucuucagcgcgauccuggccgccuuccagccggccgcgugcgacgacgccgaggaggccuggcgcucccacaucaaccagcucaugugcgacagcgacggcuccugcgccgucuacacguuccacguguucagcucccuguucaagaacauccagaagcgguucugcuuccugaccugcgacgccgcgagcuaccugggggacaaccuccgcggcaucggcuccaaguucgugagcuccagccagaugcugaccagcugcuccgagugccccacccuguucgucgacgccgagacgcuccugagcugcgggcugcucgacaagcugaaguucuccgugcuggagcuccaggaguaccuggacaccuacaacaaccggaaggaggccacccugagcuggcucgccaacugcaaggccaccuucgcgggcgggucccgcgacggcgugaucacgugccagcccggggacagcgaggagaagcagcuggagcugugccagcggcucuacaagcugcacuuccagcugcuccugcuguuccaguccuacugcaagcucaucggccagguccacgaggugagcuccaugcccgagcugcugaacaugagccgcgagcucuccgaccugaagaagcaccugaaggaggccagcgccgugaucgccgccgacccgcucuacuccgacggcgcguggagcgagcccaccuucaccuccaccgaggccgccauccagagcaugcuggagugccugaagaacaacgagcucgggaaggcccugcggcagauccgcgagugccggucccuguggcccaacgacaucuucggcagcuccagcgacgacgagguccagacgcuccugaacaucuacuuccgccaccagacccuggggcagaccggcaccuacgcgcucguggggagcaaccagucccugacggagaucugcaccaagcugauggagcucaacauggagauccgggacaugauccgccgggcccagagcuaccgcgugcugaccaccuuccugccggacuccagcgucuccggcacgagccucuga

SEQ ID NO: 30308 - RNA, 9042 nt, Artificial Sequence
  derived and/or modified sequence opt1 from FRYL__Homo_sapiens__NP_055845
augagcaacaucaccaucgaccccgacgugaagccgggcgaguacgugaucaagagccuguucgcggaguucgccgugcaggcggagaagaagaucgagguggucauggccgagccccuggagaagcugcugagccggucccugcagcgcggggaggaccugcaguucgaccagcugaucagcuccaugagcuccguggccgagcacugccuccccagccugcugcgcacccucuucgacugguaccggcgccagaacggcaccgaggacgaguccuacgaguaccggccccgcagcuccaccaagagcaagggggacgagcagcagcgggagcgcgacuaccugcuggagcggcgcgaccucgccguggacuucaucuucugccugguccugguggaggugcucaagcagauccccguccaccccgugcccgacccccuggugcacgagguccugaaccucgccuucaagcacuucaagcacaaggagggcuacuccgggaccaacaccggcaacgugcacaucaucgcggaccuguacgccgaggugaucggcguccuggcccagagcaaguuccaggccgugcggaagaaguucgugacggagcucaaggagcugcgccagaaggagcaguccccgcacgucgugcagagcgugaucucccugaucauggggaugaaguucuuccgggucaagauguaccccguggaggacuucgaggcgagcuuccaguucaugcaggagugcgcccaguacuuccucgaggugaaggacaaggacaucaagcacgcccuggccggccuguucgucgagauccucauccccguggccgcggccgucaagaacgaggugaacgugcccugccugaagaacuucgucgagaugcuguaccagaccaccuucgagcucuccagccgcaagaagcacagccuggcccuguacccgcucaucacgugccugcugugcgugucccagaagcaguucuuccucaacaacuggcacaucuuccugcagaacugccugagccaccucaagaacaaggaccccaagaugucccggguggcccuggagagccuguaccgccuccugugggucuacgugauccggaucaagugcgaguccaacacggugacccagagccgccugauguccaucgucagcgcccucuuccccaaggggucccggagcguggugccccgcgacaccccgcugaacaucuucgucaagaucauccaguucaucgcgcaggagcggcuggacuucgccaugaaggagaucaucuucgaccuccuguccgugggcaagagcaccaagacguucaccaucaaccccgagcgcaugaacaucgggcugcgcguguuccuggucaucgccgacucccuccagcagaaggacggcgagccgcccaugccgaccaccggcgugauccugcccagcgggaacacgcugcgggugaagaagaucuuccucaacaagacccugaccgacgaggaggccaaggucaucggcauguccguguacuacccccaggugcgcaaggcccuggacagcauccuccggcaccuggacaaggaggucgggcgccccaugugcaugaccuccgugcagaugagcaacaaggagccggaggacaugaucacgggcgagcggaagcccaagaucgaccuguuccggaccugcaucgcggccaucccccggcucauccccgacggcaugucccgcaccgaccugaucgagcugcucgcccggcugaccauccacauggacgaggagcugcgcgcccucgccuucaacacgcugcaggcgcugaugcucgacuucccggacuggcgggaggacgugcugagcggguucgucuacuucaucgugcgcgaggugaccgacguccaccccacccugcucgacaacgccgugaagaugcuggugcagcugaucaaccaguggaagcaggccgcccagaugcacaacaagaaccaggacacccagcacggcgucgcgaacggggccagccacccgccgccccucgagcggucccccuacagcaacguguuccacguggucgagggcuucgcccuggugauccugugcuccagccgccccgccacgcggcgccucgccguguccguccugcgggagauccgcgcgcuguucgcccuccuggagauccccaagggggacgacgagcuggccaucgacgugauggaccggcucagccccuccauccuggagagcuucauccaccugaccggcgccgaccagaccacccuccuguacugccccuccagcaucgaccugcagacgcucgccgaguggaacuccagccccaucucccaccaguucgacgugaucagccccucccacaucuggaucuucgcgcacgucacccagggccaggaccccuggaucaucagccuguccagcuuccugaagcaggagaaccuccccaagcacugcagcaccgccguguccuacgccuggauguucgccuacacccgccugcagcugcucagcccccagguggacaucaacuccccgaucaacgccaagaaggucaacacgaccaccagcuccgacagcuacaucgggcuguggcgcaacuaccugauccucugcugcuccgcggccaccagcuccagcuccaccagcgccggcuccgugcggugcuccccgcccgagacgcuggccuccacccccgacagcggguacuccaucgacagcaagaucaucggcaucccgucccccagcagccuguucaagcacaucgugcccaugaugcgcuccgagagcauggagaucaccgagucccucguccuggggcugggccggaccaaccccggcgcguuccgcgagcucaucgaggagcugcacccgaucaucaaggaggcccuggagcggcgccccgagaacaugaagcggcgccggcgccgggacauccuccgcgugcagcuggugcggaucuucgagcugcucgccgacgccggggucaucagccacuccgccagcggcgggcuggacaacgagacgcacuuccugaacaacacccuccuggaguacguggaccugacccgccagcuccuggaggcggagaacgagaaggacuccgacacccugaaggacauccggugccacuucagcgcccucguggccaacaucauccagaacguccccgugcaccagcgccgguccaucuucccccagcagagccugcgccacucccuguucaugcuguucagccacugggccggcccguucuccaucauguucacgccccuggaccgguacagcgaccgcaacaugcagaucaaccggcaccaguacugcgcccugaaggcgauguccgccguccucugcugcgggcccguggccgacaacgugggccugagcuccgacggcuaccuguacaaguggcucgacaacauccuggacagccuggacaagaagguccaccagcucgggugcgaggccgugacccugcugcucgagcugaacccggaccaguccaaccugauguacugggccguggaccgcugcuacaccggcagcgggcgcgucgcggccggcugcuucaaggccaucgccaacguguuccagaaccgggacuaccagugcgacaccgugaugcuccugaaccugauccucuucaaggcggccgacagcucccgcagcaucuacgaggucgccaugcagcugcugcagauccucgagcccaagauguuccgguacgcccacaagcuggaggugcagcgcacggacggcgugcugucccagcugagcccccucccccaccuguacuccgucagcuacuaccagcuguccgaggagcucgcccgggcguacccggagcugacccuggccaucuucagcgagaucucccagcgcauccagaccgcccaccccgccgggcgccaggugaugcuccacuaccugcugcccuggaugaacaacaucgagcucguggaccugaagccccugccgaccgcccgccggcacgacgaggacgaggacgacagccucaaggaccgcgagcugauggucacgucccggcgcuggcugcggggcgagggguggggcagcccccaggcgaccgccauggugcucaacaaccugauguacaugaccgccaaguacggggacgagcuggccugguccgagguggagaacgucuggaccacgcucgccgacggcuggcccaagaaccugaagaucauccugcacuuccucaucagcaucugcggcgugaacuccgagcccagccugcugccguacgugaagaaggucaucguguaccucgggcgcgacaagaccaugcagcugcuggaggagcucguguccgagcugcagcugaccgaccccgucagcuccggcgugacccacauggacaacccgcccuacuaccggaucacgagcagcuacaagaucccguccgugaccagcgggaccaccuccagcuccaacacgauggucgcgcccaccgacggcaaccccgacaacaagcccaucaaggagaacaucgaggagagcuacgugcaccucgacaucuacuccgggcugaacagccaccugaaccgccagcaccaccggcucgagucccgcuacagcuccagcuccggcggcagcuacgaggaggagaaguccgacagcaugccgcuguacuccaacuggcggcugaaggugauggagcacaaccagggggagccccuccccuucccgcccgccggcgggugcuggagcccccuggucgacuacgugcccgagaccuccagccccggccugccccuccaccgcugcaacaucgccgugauccugcugaccgaccucaucaucgaccacagcgucaagguggaguggggguccuaccugcaccuccugcugcacgccaucuucaucggcuucgaccacugccaccccgagguguacgagcacugcaagcgccugcuccugcaccuccugaucgucaugggccccaacagcaacauccggacgguggccuccgugcugcugcgcaacaaggaguucaacgagccgcggguccucaccgugaagcaggucgcgcaccuggacuacaacuucaccgccgggaucaacgacuucauccccgacuaccagcccagccccaugaccgacuccggccugagcuccagcuccacgagcuccagcaucucccucgggaacaacagcgccgccaucucccaccuccacaccaccauccugaacgaggucgacaucagcguggagcaggacggcaaggugaagacccucauggaguucaucaccucccgcaagcgggggccgcuguggaaccacgaggacgucagcgcgaagaaccccuccaucaagagcgccgagcagcugacgaccuuccucaagcacguggugagcgucuucaagcaguccagcuccgagggcauccaccuggagcaccaccugagcgagguggcccuccagaccgcccuguccugcagcucccgccacuacgccggccggagcuuccagaucuuccgcgcgcugaagcagccccucaccgccacgacccuguccgacgugcugagccggcucgucgagaccgugggggaccccggcgaggacgcccagggguucgucaucgagcugcugcucacccuggaguccgccaucgacacgcuggccgagaccaugaagcacuacgaccuccugagcgcgcugucccagaccagcuaccacgacccgaucaugggcaacaaguacgccgccaaccgcaaguccaccggccagcucaaccugagcacgucccccaucaacagcagcuccuaccugggguacaacagcaacgcccgguccaacagccuccgccugucccugaucggcgaccggcgcggggaccggcgccggagcaacacccucgacaucauggacggccgcaucaaccacuccagcucccuggcccggacccgcagccuguccagccuccgggagaaggggauguacgacgugcaguccaccacggagcccaccaaccugauggcgaccaucuucuggaucgccgccagccugcucgaguccgacuacgaguacgaguaccugcuggcccuccgccugcugaacaagcuccugauccaccucccccuggacaagagcgagucccgcgagaagaucgagaacgugcagagcaagcucaaguggaccaacuucccgggccugcagcagcuguuccucaagggcuucacguccgcgagcacccaggagaugaccguccaccuccugagcaagcucaucuccgugagcaagcacacccugguggaccccucccagcugagcggguucccccucaacauccugugccugcucccccaccugauccagcacuucgacuccccgacgcaguucugcaaggagaccgccagccggaucgccaaggucugcgccgaggagaagugccccacccuggugaaccucgcccacaugaugucccuguacagcacccacacguacucccgcgacugcagcaacuggaucaacguggucugccgguaccugcacgacuccuucagcgacaccaccuucaaccucgugaccuaccuggcggagcugcucgagaagggccuguccagcaugcagcagucccugcuccagaucaucuacagccugcugucccacaucgaccucagcgccgcccccgccaagcaguucaaccuggagaucaucaagaucaucgggaaguacgugcagucccccuacuggaaggaggcccugaacauccucaagcuggucgugagccgcagcgcgucccugguggucccgagcgacauccccaagacguacggcggggacaccggcucccccgagaucagcuucaccaagaucuucaacaacguguccaaggagcuccccggcaagacccuggacuuccacuucgacaucagcgagacgccgaucaucgggaacaaguacggcgaccagcacuccgccgccgggcggaacggcaagcccaaggugaucgccgucacccgcagcaccuccagcaccuccagcggguccaacagcaacgcccuggugcccguguccuggaagcggccccagcucagccagcgccggacccgcgagaagcugaugaacguccugucccucugcggcccggagagcggccugcccaagaaccccuccgugguguucagcagcaacgaggaccuggaggucggggaccagcagacgucccucaucagcaccaccgaggacaucaaccaggaggaggagguggcgguggaggacaacuccagcgagcagcaguucggcgucuucaaggacuucgacuuccuggacguggagcuggaggacgccgagggggaguccauggacaacuucaacuggggcgugcggcgccggagccucgacuccaucgacaagggcgacaccccgagccugcaggaguaccagugcuccagcuccacgcccagccugaaccucaccaaccaggaggacaccgacgaguccagcgaggaggaggccgcccugaccgcgucccagauccugagccgcacgcagaugcucaacuccgacagcgccaccgacgagaccauccccgaccaccccgaccugcugcuccaguccgaggacagcaccgggagcaucacgaccgaggagguccugcagauccgggacgagaccccgacccuggaggccucccucgacaacgccaacagccgccugcccgaggacacgaccuccgugcugaaggaggagcacgugaccaccuucgaggacgagggcagcuacaucauccaggagcagcaggagucccucgucugccaggggauccuggaccuggaggagacggagaugcccgagccccucgccccggagagcuaccccgaguccgugugcgaggaggacgugacccuggcgcugaaggagcucgacgagcggugcgaggaggaggaggccgacuucagcggccuguccagccaggacgaggaggagcaggacggguuccccgagguccagaccagcccccugccgucccccuuccucuccgccaucaucgccgccuuccagcccguggcguacgacgacgaggaggaggccuggcgcugccacgugaaccagaugcugagcgacaccgacggcuccagcgccgucuucacguuccacguguucucccggcuguuccagaccauccagcgcaaguucggcgagaucaccaacgaggccgugagcuuccucggggacucccugcagcgcaucggcaccaaguucaagagcagccuggaggucaugaugcucugcuccgagugccccacgguguucguggacgccgagacccugaugagcugcgggcugcucgagacccugaaguucggcguccuggagcuccaggagcaccuggacaccuacaacgugaagcgggaggcggccgagcaguggcuggacgacugcaagcgcacguucggggccaaggaggacauguaccggaucaacaccgacgcccagcagauggagauccucgccgagcuggagcugugccgccggcucuacaagcugcacuuccagcugcuccugcuguuccaggcguacugcaagcucaucaaccaggugaacaccaucaagaacgaggccgaggucaucaacauguccgaggagcuggcccagcuggagagcauccucaaggaggccgaguccgcgagcgagaacgaggagaucgacaucuccaaggccgcccagaccacgaucgagaccgccauccacagccugaucgagacccugaagaacaaggaguucaucuccgccguggcccaggugaaggccuuccgcagccuguggccguccgacaucuucggcagcugcgaggacgaccccguccagacccuccugcacaucuacuuccaccaccagacgcugggccagaccggguccuucgccgugaucggcagcaaccucgacauguccgaggccaacuacaagcugauggagcugaaccucgagauccgggagagccugcgcaugguccaguccuaccagcugcucgcccaggcgaagcccauggggaacauggugagcaccggcuucuga

SEQ ID NO: 30309 - RNA, 978 nt, Artificial Sequence
  derived and/or modified sequence opt1 from FRZB__Homo_sapiens__NP_001454
auggugugcggcagccccgggggcaugcugcuccugcgcgccgggcugcucgcccuggcggcccugugccuccugcgggucccgggcgcccgcgccgccgcgugcgagcccgugcggaucccccugugcaagucccuccccuggaacaugaccaagaugccgaaccaccuccaccacagcacccaggccaacgccauccuggccaucgagcaguucgaggggcuccugggcacgcacugcucccccgaccugcuguucuuccugugcgcgauguacgcccccaucugcaccaucgacuuccagcacgagcccaucaagccgugcaagagcgugugcgagcgcgcccggcagggcugcgagcccauccugaucaaguaccgccacuccuggcccgagaaccucgccugcgaggagcugcccgucuacgaccgcggggugugcaucagcccggaggccaucgugaccgcggacggcgccgacuuccccauggacuccagcaacgggaacugccggggcgccuccagcgagcggugcaagugcaagcccauccgcgccacccagaagacguacuuccggaacaacuacaacuacgucauccgcgccaaggugaaggagaucaagaccaagugccacgacgugaccgcggucguggaggugaaggagauccugaaguccagccucgucaacaucccccgggacaccgugaaccuguacacguccagcgggugccugugcccgccccucaacgugaacgaggaguacaucaucaugggcuacgaggacgaggagcgcucccggcugcugcucgucgagggcagcaucgccgagaaguggaaggaccgccuggggaagaaggugaagcggugggacaugaagcugcgccaccucggccuguccaagagcgacuccagcaacagcgacuccacccagagccagaaguccgggcggaacagcaacccccgccaggcccggaacuga

SEQ ID NO: 30310 - RNA, 900 nt, Artificial Sequence
  derived and/or modified sequence opt1 from FSBP__Homo_sapiens__NP_001243070
auggugggcaaggcccgcagcuccaacuucacccugagcgagaagcucgaccugcugaagcucgucaagcccuacgugaagauccuggaggagcacaccaacaagcacuccgugaucgucgagaagaaccggugcugggacaucaucgccgugaacuacaacgcgaucgggguggaccgcccgccccggacggcccagggccugcgcacccucuacaagcggcugaaggaguacgccaagcaggagcugcuccagcagaaggagacccagagcgacuucaaguccaacaucagcgagcccaccaagaaggucauggagaugaucccccagaucuccagcuucugccuggugcgcgaccggaaccacauccaguccgccaaccuggacgaggaggcccaggcggggacgagcucccuccaggugaugcuggaccaccacccggucgccaucaccguggaggugaagcaggaggaggacaucaagcccccgccgccccugguccucaacagccagcaguccgacacccuggagcagcgcgaggagcacgagcuggugcacgugauggagcggagccucucccccagccuguccagcgucgacaugcgcaugaccuccagccccagcuccaucccccggcgcgacgacuucuuccggcacgagagcggcgagcacuuccgcucccugcucggguacgacccccagauccugcagaugcugaaggaggagcaccagaucauccucgagaaccagaagaacuucggccuguacgugcaggagaagcgggacggccugaagcgccggcagcagcucgaggaggagcugcugcgcgccaagaucgagguggagaagcucaaggccauccggcugcgccacgaccugcccgaguacaacagccucuga

SEQ ID NO: 30311 - RNA, 2478 nt, Artificial Sequence
  derived and/or modified sequence opt1 from FSCB__Homo_sapiens__NP_115511
auggugggcaagagccagcagaccgacgucaucgagaagaagaagcacauggccauccccaaguccagcuccccgaaggccacccaccgcaucgggaacacgagcggcuccaaggggagcuacuccgcgaaggccuacgagagcauccggguguccagcgagcugcagcagaccuggaccaagcgcaagcacggccaggagaugaccuccaagagccuccagacggacaccaucguggaggagaagaaggaggucaagcugguggaggagaccgugguccccgaggagaaguccgccgacgugcgggaggccgccaucgagcugcccgagagcgugcaggacgucgagauccccccgaacauccccuccgugcagcucaagauggaccgcagccagcagaccucccggacgggguacuggaccaugaugaacaucccccccguggagaaggucgacaaggagcagcagaccuacuucagcgaguccgagaucguggugaucagccgcccggacagcuccagcaccaaguccaaggaggacgcgcugaagcacaagagcuccggcaagaucuucgccagcgagcaccccgaguuccagcccgccacgaacuccaacgaggagaucggccagaagaacaucagccggaccuccuucacccaggagaccaagaaggggcccccgguccugcucgaggacgagcugcgcgaggaggugacggugcccgucgugcaggagggcagcgccgugaagaaggucgcguccgccgagaucgagccccccagcaccgagaaguucccggccaagauccagcccccccugguggaggaggccaccgccaaggcggagccccggccggccgaggagacccacgugcagguccagcccuccacggaggagacccccgacgccgaggccgccaccgcgguggccgagaacagcgucaaggugcagcccccgcccgccgaggaggccccccucguggaguuccccgccgagauccagccgcccuccgcggaggagagccccuccgucgagcugcuggccgagauccucccgcccagcgccgaggagucccccagcgaggagcccccggccgagauccugcccccccccgccgagaagagcccguccguggagcugcucggggagauccgcagccccuccgcgcagaaggcccccaucgaggugcagccccugccggccgagggcgcccuggaggaggcgcccgccaaggucgagccccccaccguggaggagacgcucgccgacgugcagccgcugcugcccgaggaggccccccgggaggaggcccgcgagcuccagcugagcaccgcgauggagacccccgccgaggaggccccgaccgaguuccaguccccccugcccaaggagacgaccgccgaggaggccagcgcggagauccagcuccuggccgccaccgagcccccggccgacgagacccccgccgaggcgcgguccccccugagcgaggagacguccgccgaggaggcccacgccgagguccagagcccgcucgcggaggagaccaccgccgaggaggccuccgccgagauccagcugcuggccgcgaucgaggcccccgccgacgagacccccgccgaggcccagagcccccucuccgaggagacgagcgcggaggaggccccggccgaggugcagucccccagcgccaaggggguguccaucgaggaggccccccuggagcugcagcccccgagcggcgaggagaccaccgcggaggaggccagcgccgccauccagcuccuggcggccaccgaggccuccgccgaggaggcccccgcggagguccagccccccccggccgaggaggcccccgccgaggugcagccccccccggccgaggaggcgcccgccgaggugcagccccccccggccgaggaggcccccgccgagguccagccccccccggcggaggaggcccccgccgaggugcagccccccccggccgaggaggcccccgcggaggugcagcccccgcccgccgaggaggcccccgccgagguccagagccugcccgcggaggagaccccgaucgaggagacgcucgccgccgugcacuccccccccgccgacgacgugcccgccgaggaggcgagcgucgacaagcacuccccgcccgccgaccugcugcucaccgaggaguuccccaucggcgaggccagcgccgaggugucccccccgcccagcgagcagacccccgaggacgaggcccugguggagaacgucuccaccgaguuccagagcccccagguggcggggaucccggccgugaagcugggcuccgucgugcucgagggggaggccaaguucgaggaggugagcaagaucaacuccguccugaaggaccugagcaacacgaacgacggccaggcccccacccucgagaucgaguccguguuccacaucgagcugaagcagcgcccccccgagcuguga

SEQ ID NO: 30312 - RNA, 1482 nt, Artificial Sequence
  derived and/or modified sequence opt1 from FSCN1__Homo_sapiens__NP_003079
augaccgccaacggcaccgccgaggcggugcagauccaguucgggcugaucaacugcggcaacaaguaccucacggccgaggccuucggguucaaggucaacgccagcgccuccagccugaagaagaagcagaucuggacccuggagcagcccccggacgaggcgggcuccgccgccgugugccuccgcagccaccuggggcgguaccuggccgcggacaaggacggcaacgugaccugcgagcgcgagguccccggccccgacugccgguuccucaucguggcccacgacgacgggcgcuggucccugcagagcgaggcccaccggcgcuacuucggcgggaccgaggaccggcuguccugcuucgcccagacggugagccccgccgagaagugguccguccacaucgcgaugcacccccaggugaacaucuacagcgugacccgcaagcgguacgcccaccucuccgcccgcccggccgacgagaucgccgucgaccgggacgugcccuggggcguggacagccugaucacccuggcguuccaggaccagcgcuacuccguccagaccgccgaccaccgguuccuccgccacgacgggcggcugguggcccgccccgagccggccacgggcuacacccuggaguuccggagcggcaagguggccuuccgcgacugcgaggggcgguaccucgcgcccuccggccccagcgggacccugaaggccggcaaggccaccaaggucggcaaggacgagcuguucgcccucgagcaguccugcgcccagguggugcugcaggcggccaacgagcgcaacgucagcacgcggcaggggauggaccuguccgccaaccaggacgaggagaccgaccaggagaccuuccagcucgagaucgaccgcgacaccaagaagugcgccuuccgcacgcacaccggcaaguacuggacccugaccgcgaccgggggcgugcagagcacggccagcuccaagaacgccagcugcuacuucgacaucgaguggcgggaccgccggaucacccugcgcgccuccaacgggaaguucgugaccagcaagaagaacggccagcucgccgcguccgucgagacggccggcgacagcgagcuguuccugaugaagcucaucaaccggcccaucaucguguuccgcggggagcacggcuucaucgggugccggaaggugaccggcacccuggacgccaaccgcuccagcuacgacgucuuccagcuggaguucaacgacggggccuacaacaucaaggacuccaccggcaaguacuggacggugggcagcgacuccgccgucaccagcuccggggacaccccgguggacuucuucuucgaguucugcgacuacaacaagguggcgaucaaggucggcgggcgguaccucaagggcgaccacgccggggugcugaaggccagcgccgagaccguggaccccgccucccugugggaguacuga

SEQ ID NO: 30313 - RNA, 1551 nt, Artificial Sequence
  derived and/or modified sequence opt1 from FSCN2__Homo_sapiens__XP_011522894
augcccaccaacggccugcaccaggugcucaagauccaguucgggcuggucaacgacaccgaccgcuaccugacggccgagagcuucggcuucaaggugaacgccuccgcgccgagccucaagcggaagcagaccugggugcuggagcccgaccccgggcagggcaccgccguccugcuccgcuccagccaccuggggcgguaccuguccgccgaggaggacggccgcguggccugcgaggccgagcagcccggccgggacugccgcuuccucgugcugccgcagcccgacgggcgguggguccugcgcagcgagccccacggccgguucuucgggggcaccgaggaccagcucuccugcuucgcgacggccgugagccccgccgagcuguggaccgugcaccuggccauccacccgcaggcgcaccuccuguccgucagccgccggcgcuacgugcaccugugcccccgggaggacgagauggccgccgacggggacaagcccuggggcguggacgcccuccugacccugaucuuccgcucccggcgcuacugccucaagagcugcgacucccgguaccugcgcagcgacggccggcuggucugggagcccgagccgcgcgccugcuacacccucgaguucaaggcggggaagcuggccuucaaggacugcgacggccacuaccuggcccccguggggcccgccggcacgcucaaggccggccggaacacccgccccgggaaggacgagcuguucgaccuggaggagucccacccccaggugguccucguggcggccaaccaccgcuacgugagcguccggcagggcgugaacguguccgccaaccaggacgacgagcuggaccacgagaccuuccugaugcagaucgaccaggagaccaagaagugcacguucuacagcuccaccgggggcuacuggacccucgucacccacgggggcauccacgccacggccacccaggugagcgcgaacaccauguucgagauggaguggcgcggccggcgcguggcccugaaggccagcaacgggcgguacgucugcaugaagaagaacggccagcuggccgccaucuccgacuucguggggcccccgccccgcccggcguggaccggcaaggucgccgggggcgccgcccagcagacgcucagcccgcccggcaaggacgaggaguucacccugaagcugaucaaccggcccauccucgugcugcgcgggcuggacggcuucgugugccaccaccggggguccaaccagcucgacaccaaccgcagcgucuacgacguguuccaccuguccuucagcgacggcgcguaccggauccgcgggcgggacggcggcuucugguacaccgggucccacggcagcgugugcuccgacggggagcgcgccgaggacuucgucuucgaguuccgggagcgcggccggcuggccauccgcgcccggagcggcaaguaccuccgcgggggcgccuccgggcugcugcgcgcggacgccgacgcccccgccggcacggcccucugggaguacuga

SEQ ID NO: 30314 - RNA, 1491 nt, Artificial Sequence
  derived and/or modified sequence opt1 from FSD1__Homo_sapiens__NP_077309
auggaggagcagcgcgaggcccugcggaagaucaucaagacccucgccgugaagaacgaggagauccagagcuucaucuacucccugaagcagaugcugcucaacgucgaggcgaacagcgccaaggugcaggaggaccuggaggccgaguuccagucccuguucagccuccuggaggagcugaaggagggcaugcucaugaagaucaagcaggaccgcgccucccggaccuacgagcugcagaaccagcuggccgcgugcacgcgcgcccucgagagcuccgaggagcugcuggagaccgccaaccagacccuccaggccauggacagcgaggacuucccccaggcggccaagcagaucaaggacggggugaccauggccccggccuuccggcugucccugaaggccaaggucagcgacaacaugucccaccucaugguggacuucgcgcaggagcgccagaugcugcaggcccugaaguuccuccccgugcccagcgcccccgucaucgaccuggccgagucccugguggccgacaacugcgugacgcucgucuggcggaugccggacgaggacagcaagaucgaccacuacgugcuggaguaccgccggaccaacuucgagggcccgccccgccugaaggaggaccagcccuggauggugaucgaggggauccggcagaccgaguacacccucacgggccugaaguucgacaugaaguacaugaacuuccgcgucaaggcgugcaacaaggccguggccggggaguucuccgagcccgugacccuggagacccccgccuucauguuccggcucgacgccagcaccucccaccagaaccugcgcgucgacgaccugagcguggagugggacgcgaugggcggcaaggugcaggacaucaaggcccgggagaaggacgggaagggccgcacggccucccccaucaacagccccgcccgggggaccccgagccccaagcgcaugcccuccggccgcgggggccgggaccgguucaccgccgagagcuacaccguccucggcgacacgcugaucgacgggggcgagcacuacugggaggugcgcuacgagcccgacuccaaggcguucggggugggcgucgccuaccgcagccugggccgguucgagcagcucgggaagaccgccgccuccuggugccugcacgugaacaacuggcuccaggugagcuucaccgcgaagcacgccaacaaggucaaggugcuggacgccccgguccccgacugccugggcgugcacugcgacuuccaccaggggcugcucuccuucuacaacgcccgcaccaagcagguccugcacacguucaagacccgguucacccagccccugcuccccgccuucaccguguggugcggcagcuuccaggugacgaccgggcuccaggugccguccgcgguccgcugccugcagaagcggggcagcgccaccuccagcuccaacaccagccugacguga

SEQ ID NO: 30315 - RNA, 1593 nt, Artificial Sequence
  derived and/or modified sequence opt1 from FSD1L__Homo_sapiens__NP_001138785
auggacagccagaaguacugcuucaaggagaacgagaacgugaccgucgacaaggccugcuuccugaucuccaacaucaccaucggccccgagagcaucaaccuccagcaggaggcccugcagcgcaucaucuccacgcuggcgaacaagaacgacgagauccagaacuucaucgacacccuccaccacacccugaagggggugcaggagaacagcuccaacauccugagcgagcucgacgaggaguucgacucccuguacagcauccuggacgaggugaaggaguccaugaucaacugcaucaagcaggagcaggcccgcaagagccaggagcuccagucccagaucagccagugcaacaacgcccuggagaacuccgaggagcugcucgaguucgccacccggagccuggacaucaaggagccggaggaguucuccaaggccgcgcggcagaucaaggaccgcgucacgauggccagcgccuuccggcugucccucaagcccaaggugagcgacaacaugacccaccugaugguggacuucucccaggagcgccagaugcugcagacccucaaguuccugcccguccccaaggccccggagaucgaccccguggagugccugguggcggacaacagcgucaccguggccuggcggaugcccgaggaggacaacaagaucgaccacuucauccucgagcaccgcaagacgaacuucgacggccugccccgggugaaggacgagcgcugcugggagaucaucgacaacaucaaggggaccgaguacacccugagcggccucaaguucgacuccaaguacaugaacuuccggguccgcgccugcaacaaggccguggccggggaguacagcgacccggugacccuggagacgaaggcgcugaacuucaaccucgacaacuccagcucccaccugaaccugaaggucgaggacacgugcguggagugggaccccaccggcggcaaggggcaggagagcaagaucaagggcaaggagaacaaggggcgguccggcacccccagccccaagcgcaccuccguggggagccggccgcccgccguccgcggcucccgggaccgcuucaccggcgagagcuacaccgugcucggggacaccgccaucgaguccggccagcacuacugggaggugaaggcccagaaggacugcaagagcuacuccgucgggguggccuacaagacgcugggcaaguucgaccagcugggcaagaccaacaccagcuggugcauccacgugaacaacuggcuccagaacaccuucgcggccaagcacaacaacaaggucaaggcccuggacgugacgguccccgagaagaucgggguguucugcgacuucgacggcgggcagcuguccuucuacgacgccaacagcaagcagcuccuguacuccuucaagaccaaguucacccagcccgugcugccgggcuucauggucuggugcgggggccucagccugagcaccggcaugcagguccccuccgccgugcggacgcugcagaaguccgagaacgggaugaccggcagcgcgagcucccucaacaacguggugacccaguga

SEQ ID NO: 30316 - RNA, 2250 nt, Artificial Sequence
  derived and/or modified sequence opt1 from FSD2__Homo_sapiens__NP_001007123
auggaggaggagagcggcgaggagcuggggcucgaccgcuccacccccaaggacuuccacuucuaccacauggaccuguacgacagcgaggaccggcugcaccucuucccggaggagaacacccgcaugcggaaggugguccaggccgagauggccaacgagucccgcggcgcgggggacggcaaggcccagcgggaccugcaggaggagguggacgagcuggugcaccucuacgggcuggaggacgaccacgagcugggcgacgaguucgucgacgagaacaucccccgcacgggcgugagcgaguacccgcccuacaugaugaagcggcgcgaccccgcccgggagcagcgcgacuggcggcucuccggggaggccgccgaggcggaggaccugggcuucgggggcugggggagcgccggccagugccaggaccugcgcgaggccuaccgguacacccacggccgcgccuccgaggaguacgagugcuacgugauccccgaggaggaggacgaggaggaggcggccgacgucuucugcgugaccugcaagacccccauccgggccuuccagaagguguucgacgagcacaaggagcacgaggucaucccccucaacgaggcccuggagagcgccaaggacgagauccacaagaacauguacaagcuggagaagcagaucaucgagauggagaacuucgcgaaccaccucgaggagguguucaucacgguggaggagaacuucgggaagcaggagcagaacuucgagucccacuacaacgagauccuggagacccuggcccagaaguacgaggagaagauccaggcccucggcgagaagaagaaggagaagcuggaggcccuguacgggcagcucgucagcugcggcgagaaccuggacacgugcaaggagcugauggagaccaucgaggagaugugccacgaggagaagguggacuucaucaaggacgccguggcgauggccgaccgccucggcaaguuccugaagaccaagaccgacgucgagaucuccgcccagccggaguucgaggaccagacccuggacuucagcgacguggagcagcucaugggguccaucaacaccauccccgcccccagcgcccccgugaucaacccgcagguccccaacuccgcgacgggcagcuccgugcgggugugcuggagccuguacuccgacgacaccgucgagagcuaccagcugagcuaccgccccgugcaggacuccagccccgggaccgaccaggccgaguucaccgugacggucaaggagaccuacugcuccgugaccaaccucgucccgaacacccaguacgaguucugggugacggcccacaaccgggccggccccagccccuccagcgagcgcgccguguacaugaccgcgcccuccccgcccaucaucaagaccaaggagauccggagcugcgaggaggccguccugaucugcugggaguccgggaaccugaaccccguggacagcuacaccguggagcucacgcaggccgagucccccgaggccagcggcgucaccgaguccguggugggcaucccgaccugcgagagcgucgugcagcugcagcccgggcgcuccuacaucaucuacgugcgcgcgcugaacaugggcgggcccagcguccgguccgagcccgccaccgugcacacgaucggcagcuacuuccgccucaacaaggacacgugccacccguggcugaccaucuccgaggacgggcugaccgccgugcggagcgagcgccggacccccgcccgcgagcucagccccuccgacacccacuucacccggugcgucgccgugaugggcaaccugaucccggugcgcggccaccacuacugggaggucgagguggacgagcaccuggacuaccgggugggggucgcguucgccgacgugcgcaagcaggaggaccucggcgccaacugccugagcuggugcaugcggcacaccuucgccuccagccgccacaaguacgaguuccugcacaaccggacgacccccgacauccgcaucaccgugccgcccaagaagaucgggauccuccuggacuacgagcacuccaagcugagcuucuucaacgucgaccucucccagcaccuguacaccuucagcugccagcugcacgaguucgugcaccccugcuucucccuggagaagcccggcugccucaaggugcacaacgggaucagcaugcccaagcacgucaccuucuacuga

SEQ ID NO: 30317 - RNA, 390 nt, Artificial Sequence
  derived and/or modified sequence opt1 from FSHB__Homo_sapiens__NP_001018090
augaagacccugcaguucuucuuccucuucugcugcuggaaggccaucugcugcaacagcugcgagcugaccaacaucacgaucgccaucgagaaggaggagugccgcuucugcaucuccaucaacaccaccuggugcgcgggcuacugcuacacccgggaccugguguacaaggaccccgcccgcccgaagauccagaagacgugcaccuucaaggagcucgucuacgagaccgugcgggugcccgggugcgcccaccacgccgacagccuguacaccuaccccgucgccacgcagugccacugcggcaagugcgacuccgacagcaccgacugcaccgugcgcgggcugggccccuccuacugcagcuucggggagaugaaggaguga

SEQ ID NO: 30318 - RNA, 2088 nt, Artificial Sequence
  derived and/or modified sequence opt1 from FSHR__Homo_sapiens__NP_000136
auggcccugcuccuggugagccugcucgccuuccugucccugggcagcgggugccaccaccgcaucugccacugcuccaaccgggucuuccucugccaggagagcaaggugaccgagauccccuccgaccugccgcgcaacgcgaucgagcugcgguucgugcucaccaagcugcgcgucauccagaagggcgccuucagcggguucggcgaccuggagaagaucgagaucucccagaacgacgugcucgaggugaucgaggccgacgucuucagcaaccugcccaagcugcacgagauccggaucgagaaggccaacaaccuccuguacaucaaccccgaggccuuccagaaccugcccaaccuccaguaccugcugaucuccaacacggggaucaagcaccucccggacgugcacaagauccacagccugcagaaggugcugcucgacauccaggacaacaucaacauccacaccaucgagcgcaacuccuucgucggccugagcuucgaguccgugauccuguggcucaacaagaacggcauccaggagauccacaacugcgcguucaacgggacccagcuggacgagcugaaccucagcgacaacaacaaccuggaggagcugcccaacgacguguuccacggcgccuccgggcccgucauccucgacaucagccggacccgcauccacucccugcccagcuacggccuggagaaccucaagaagcugcgggcccgcuccacguacaaccugaagaagcucccgacccuggagaagcugguggcccucauggaggcgagccugaccuaccccagccacugcugcgccuucgccaacuggcggcgccagaucuccgagcugcaccccaucugcaacaagagcauccuccggcaggagguggacuacaugacccaggcccgcgggcagcgguccagccuggccgaggacaacgaguccagcuacucccgcggcuucgacaugacguacaccgaguucgacuacgaccugugcaacgaggucguggacgugaccugcagccccaagccggacgcguucaaccccugcgaggacaucaugggcuacaacauccuccggguccugaucugguucaucuccauccuggccaucaccgggaacaucaucgugcuggugauccucacgaccagccaguacaagcugaccgucccccgcuuccugaugugcaaccucgccuucgccgaccugugcaucggcaucuaccugcuccugaucgccuccguggacauccacaccaagagccaguaccacaacuacgcgaucgacuggcagacgggggccggcugcgacgccgccggcuucuucaccguguucgccuccgagcugagcgucuacacccucaccgcgaucacgcuggagcgguggcacaccaucacccacgccaugcagcuggacugcaaggugcagcuccgccacgccgccuccgucauggugaugggguggaucuucgccuucgcggccgcccuguuccccaucuucggcaucagcuccuacaugaaggugagcaucugccugccgauggacaucgacagcccccucucccagcuguacgucaugagccugcucgugcugaacgugcuggccuucgucgugaucugcgggugcuacauccacaucuaccucaccgugcggaaccccaacaucgucuccagcuccagcgacacgcgcaucgcgaagcgcauggccaugcugaucuucaccgacuuccugugcauggcccccaucuccuucuucgccaucagcgccucccucaaggugccgcugaucaccgugagcaaggcgaagauccugcucguccuguuccaccccaucaacuccugcgccaaccccuuccuguacgccaucuucaccaagaacuuccggcgcgacuucuucauccuccugagcaagugcggcugcuacgagaugcaggcccagaucuaccggacggagaccuccagcaccgugcacaacacccacccccgcaacgggcacugcuccagcgccccgcgggugacguccggcagcaccuacauccuggucccccucucccaccuggcgcagaacuga

SEQ ID NO: 30319 - RNA, 1746 nt, Artificial Sequence
  derived and/or modified sequence opt1 from FSIP1__Homo_sapiens__XP_011519608
auggacaucaucaagggcaaccuggacgggaucagcaagcccgccuccaacagccgcauccggccgggcucccgcagcuccaacgccagccucgaggugcuguccaccgagcccgggagcuucaaggucgacaccgcguccaaccugaacagcggcaaggaggaccacuccgagagcuccaacacggagaaccggcgcaccagcaacgacgacaagcaggaguccugcagcgagaagaucaagcucgccgaggagggguccgacgaggaccuggaccuggugcagcaccagaucaucagcgagugcuccgacgagcccaagcucaaggagcuggacagccagcugcaggacgccauccagaagaugaagaagcucgacaagauccuggccaagaagcagcggcgcgagaaggagaucaagaagcagggccuggagaugcggaucaagcucugggaggagaucaagagcgccaaguacuccgaggcguggcagagcaaggaggagauggagaacaccaagaaguuccugucccugaccgccgugagcgaggagacggucggccccucccacgaggaggaggacaccuucagcuccguguuccacacccagaucccgcccgaggaguacgagaugcagaugcagaagcucaacaaggacuucacgugcgacguggagcgcaacgagagccugaucaaguccgggaagaagcccuucagcaacaccgagaagaucgagcugcggggcaagcacaaccaggacuucaucaagcgcaacaucgagcucgccaaggagucccggaaccccgucgugaugguggaccgcgagaagaagcggcuggucgagcugcucaaggaccuggacgagaaggacagcgggcuguccagcuccgagggcgaccagagcggguggguggugccggucaagggcuacgagcucgccgugacccagcaccagcagcuggcggagaucgacaucaagcugcaggagcucuccgccgccagccccaccaucuccagcuucagcccccgccuggagaaccggaacaaccagaagcccgaccgcgacggcgagcggaacauggaggugaccccgggggagaagauccugcgcaacacgaaggagcagcgggaccuccacaaccgccugcgggagaucgacgagaagcugaagaugaugaaggagaacguccucgaguccaccagcugccuguccgaggagcagcugaagugccuccuggacgagugcauccugaagcagaaguccaucaucaagcucagcagcgagcgcaagaaggaggacaucgaggacgugacccccguguucccccagcugucccgcagcaucaucuccaagcugcucaacgagagcgagaccaagguccagaagacggagguggaggacgccgacaugcuggaguccgaggagugcgaggccagcaagggcuacuaccugaccaaggcgcucaccgggcacaacauguccgaggcccuggugaccgaggccgagaacaugaagugccugcaguucagcaaggacgucaucaucuccgacacgaaggacuacuucaugagcaagacccucggcaucggccggcugaagcgccccuccuuccuggacgacccgcuguacgggaucagcgugagccucuccagcgaggaccagcaccugaagcuguccagccccgagaacaccaucgccgacgagcaggagaccaaggacgccgcggaggagugcaaggagcccuga

SEQ ID NO: 30320 - RNA, 954 nt, Artificial Sequence
  derived and/or modified sequence opt1 from FST__Homo_sapiens__NP_006341
auggugcgcgcccggcaccagcccggcgggcugugccuccugcugcuccugcugugccaguucauggaggaccgcagcgcccaggcgggcaacugcuggcuccggcaggccaagaacgggcgcugccagguccuguacaagaccgagcuguccaaggaggagugcugcagcaccggccggcucuccacgagcuggaccgaggaggacgugaacgacaacacccuguucaaguggaugaucuucaacgggggcgccccgaacugcauccccugcaaggagaccugcgagaacguggacugcggccccgggaagaagugccgcaugaacaagaagaacaagccccggugcgucugcgccccggacugcuccaacaucacguggaagggccccgugugcgggcuggacggcaagaccuaccgcaacgagugcgcccuccugaaggcgcggugcaaggagcagcccgagcuggaggugcaguaccaggggcgcugcaagaagaccugccgggacgucuucugccccggcagcuccacgugcgugguggaccagaccaacaacgccuacugcgugaccugcaaccgcaucugcccggagcccgccagcuccgagcaguaccucugcggcaacgacggggucaccuacagcuccgccugccaccuccggaaggcgaccugccugcugggccgcagcaucgggcuggccuacgagggcaagugcaucaaggccaaguccugcgaggacauccagugcacgggcgggaagaagugccugugggacuucaaggugggccgggggcgcugcagccucugcgacgagcugugccccgacuccaagagcgacgagcccgucugcgccuccgacaacgccaccuacgcgagcgagugcgccaugaaggaggccgccugcuccagcggcgugcugcucgaggugaagcacagcggguccugcaacuga

SEQ ID NO: 30321 - RNA, 927 nt, Artificial Sequence
  derived and/or modified sequence opt1 from FSTL1__Homo_sapiens__NP_009016
auguggaagcgcuggcuggcccucgcccuggcgcugguggccgucgccugggugcgggccgaggaggagcuccgcagcaaguccaagaucugcgccaacguguucugcggcgcggggcgggagugcgccgucaccgagaagggcgagccgaccugccugugcaucgagcagugcaagccccacaagcgccccgugugcgggagcaacggcaagacguaccugaaccacugcgagcuccaccgggacgccugccugaccggguccaagauccagguggacuacgacggccacugcaaggagaagaaguccgucagccccagcgccucccccguggugugcuaccagagcaaccgcgacgagcugcggcgccggaucauccaguggcucgaggcggagaucaucccggacggcugguucuccaaggggagcaacuacuccgagauccuggacaaguacuucaagaacuucgacaacggcgacagccgccuggacuccagcgaguuccucaaguucgucgagcagaacgagaccgccaucaacaucaccacguaccccgaccaggagaacaacaagcugcugcgggggcucugcguggacgcccugaucgagcuguccgacgagaacgccgacuggaagcucagcuuccaggaguuccugaagugccugaaccccuccuucaacccgcccgagaagaagugcgcccucgaggacgagaccuacgcggacggcgccgagaccgagguggacugcaaccgcugcgucugcgccugcgggaacugggugugcaccgccaugacgugcgacggcaagaaccagaagggcgcccagacccagaccgaggaggagaugacccgguacgugcaggagcugcagaagcaccaggagacggcggagaagaccaagcgcgucagcaccaaggagaucuga

SEQ ID NO: 30322 - RNA, 792 nt, Artificial Sequence
  derived and/or modified sequence opt1 from FSTL3__Homo_sapiens__NP_005851
augcgccccggcgccccggggccccuguggccccuccccuggggcgcccuggcgugggccgugggguucgucagcuccaugggcagcgggaacccggcccccggcggcgugugcuggcugcagcaggggcaggaggcgaccugcucccucgugcugcagaccgacgucacgcgggccgagugcugcgccagcggcaacaucgacaccgccugguccaaccugacccaccccgggaacaagaucaaccuccugggcuuccuggggcucgugcacugccugcccugcaaggacagcugcgacggcguggagugcggcccggggaaggccugccgcaugcugggcgggcggccccgcugcgagugcgcccccgacugcuccggccuccccgcgcggcugcaggucugcggcagcgacggggccaccuaccgcgacgagugcgagcugcgggccgcccgcugccggggccacccggaccucuccgugauguaccgcgggcggugccgcaagagcugcgagcacguggucugcccccggccccaguccugcgugguggaccagacgggcagcgcccacugcgucgugugccgcgcggcccccugcccggugcccuccagccccgggcaggagcugugcggcaacaacaacgucaccuacaucuccagcugccacaugcggcaggcgaccugcuuccugggccgcuccaucggggugcggcacgccggcagcugcgccgggacccccgaggagccgcccggcggggaguccgccgaggaggaggagaacuucguguga

SEQ ID NO: 30323 - RNA, 2529 nt, Artificial Sequence
  derived and/or modified sequence opt1 from FSTL4__Homo_sapiens__NP_055897
augaagcccggcggguucuggcugcaccucacccugcugggcgccagccucccggccgcgcugggguggauggaccccggcaccucccgcgggcccgacgugggcgucggcgagagccaggccgaggagccccgguccuucgaggugacgcgccgggaggggcugagcucccacaacgagcuccuggccagcugcggcaagaaguucugcucccgcgggagccggugcgugcugucccgcaagaccggcgagccggagugccagugccucgaggccugccggcccagcuacguccccgugugcggguccgacggccgcuucuacgagaaccacugcaagcugcaccgggccgcgugccugcucggcaagcgcaucaccgugauccacagcaaggacugcuuccugaagggggacacgugcaccauggccggcuacgcccggcugaagaacguccuccuggcccugcagacccgccuccagccccugcaggagggggacucccggcaggacccggcgagccagaagcgccugcucguggagucccuguuccgggaccuggacgccgacggcaacggccaccucagcuccagcgagcuggcccagcacgugcugaagaagcaggaccucgacgaggaccugcuggggugcucccccggcgaccuccugcgcuucgacgacuacaacagcgacagcucccugacccuccgggaguucuacauggccuuccaggucgugcagcugagccuggcccccgaggaccgcguguccgucaccacggugaccguggggcucagcaccguccugaccugcgcggugcacggcgaccugcggcccccgaucaucuggaagcgcaacgggcucacgcugaacuuccuggaccucgaggacaucaacgacuucggcgaggacgacucccuguacaucaccaaggugaccaccauccacaugggcaacuacacgugccacgccagcgggcacgagcagcuguuccagacccacguccuccaggugaacgugccgcccgucauccggguguaccccgagucccaggcccaggagcccggcguggccgccagccugcgcugccacgcggaggggauccccaugccccgcaucaccuggcugaagaacggcgucgacguguccacccagaugagcaagcagcucucccugcuggccaacgggagcgagcugcacaucuccagcguccgguacgaggacacgggcgccuacacgugcaucgccaagaacgaggugggcguggacgaggacaucuccagccucuucaucgaggacuccgcccgcaagacccuggcgaacauccuguggcgggaggaggggcucagcgucggcaacauguucuacguguucuccgacgacgggaucaucgugauccaccccgucgacugcgagauccagcgccaccugaagccgaccgagaagaucuucaugagcuacgaggagaucugcccccagcgggagaagaacgccacccagcccugccagugggugagcgccgugaacguccgcaaccgguacaucuacguggcccagcccgcccugucccgcgugcucgucguggacauccaggcgcagaaggugcugcagagcaucggcgucgacccgcugcccgccaagcucuccuacgacaagagccacgaccaggugugggugcuguccuggggcgacguccacaagagccggcccucccuccaggugaucaccgaggccagcaccgggcagucccagcaccucauccgcacccccuucgccggcguggacgacuucuucaucccgcccacgaaccugaucaucaaccacauccgguucggguucaucuucaacaagagcgaccccgcgguccacaagguggaccuggagaccaugaugccgcucaagaccaucggccugcaccaccacgggugcgugccccaggccauggcccacacccaccugggcggcuacuucuucauccagugccgccaggacucccccgccagcgccgcgcggcagcuccuggucgacuccgugacggacagcgugcuggggcccaacggcgacgucaccgggaccccgcacaccucccccgacggccgcuucaucgugagcgccgccgccgacucccccuggcuccacgugcaggagaucacgguccgcggggagauccagacccuguacgaccugcagaucaacagcggcaucagcgaccucgccuuccagcgguccuucaccgagagcaaccaguacaacaucuacgcggcccugcacaccgagcccgaccugcuguuccuggagcuguccaccggcaagguggggaugcucaagaaccugaaggagccgcccgccggccccgcccagcccuggggcgggacgcaccggaucaugcgcgacagcgggcuguucggccaguaccuccugaccccggcccgggagucccuguuccucaucaacggccgccagaacacccugcgcugcgaggugagcgggaucaagggcgggaccacggucgugugggugggcgaggucuga

SEQ ID NO: 30324 - RNA, 2541 nt, Artificial Sequence
  derived and/or modified sequence opt1 from FSTL5__Homo_sapiens__NP_001121899
auguucaagugcuggagcgugguccuggugcucggcuucaucuuccuggaguccgaggggcgccccaccaaggagggcggguacggccucaagagcuaccagccgcucaugcggcugcgccacaaggagaagaaccaggaguccagccgggugaagggguucaugauccaggacggccccuucggcuccugcgagaacaaguacugcgggcugggccgccacugcgucaccagccgggagacggggcaggccgagugcgccugcauggaccucugcaagcgccacuacaagcccgugugcggcuccgacggggaguucuacgagaaccacugcgaggugcaccgggcggccugccugaagaagcagaagaucaccaucguccacaacgaggacugcuucuucaagggcgacaagugcaagaccaccgaguacagcaagaugaagaacaugcugcucgaccugcagaaccagaaguacaucaugcaggagaacgagaaccccaacggcgacgacaucucccgcaagaagcugcucguggaccagauguucaaguacuucgacgccgacagcaacgggcugguggacaucaacgagcugacgcaggucaucaagcaggaggagcucggcaaggaccuguucgacugcacccuguacgugcuccugaaguacgacgacuucaacgccgacaagcaccuggcccucgaggaguucuaccgggcguuccaggugauccagcugucccugccggaggaccagaagcucagcaucaccgccgccaccgucgggcaguccgccgugcugagcugcgcgauccagggcacgcugcgcccgcccaucaucuggaagcggaacaacaucauccucaacaaccuggaccuggaggacaucaacgacuucggcgacgacgggucccucuacaucaccaaggugaccaccacgcacgucggcaacuacacgugcuacgccgacggguacgagcaggucuaccagacccacaucuuccaggugaacgugccgcccgugauccgcguguaccccgagagccaggcccgggagcccggcgucaccgccucccugcgcugccacgccgaggggauccccaagccccagcugggcuggcucaagaacggcaucgacaucacccccaagcugagcaagcagcugacccuccaggcgaacggguccgaggugcacaucagcaacgugcgguacgaggacaccggcgccuacacgugcaucgccaagaacgaggccggggucgacgaggacaucagcucccuguucguggaggacagcgcccgcaagacccuggcgaacauccucuggcgggaggagggccuggggaucggcaacauguucuacgucuucuacgaggacggcaucaaggugauccagcccaucgagugcgaguuccagcgccacaucaagcccuccgagaagcugcucggguuccaggacgaggugugcccgaaggccgagggcgacgagguccagcggugcgugugggccagcgccgugaacgucaaggacaaguucaucuacguggcccagcccacccuggaccgcgugcugaucgucgacgugcagucccagaaggugguccaggcggugagcaccgaccccgugcccgucaagcuccacuacgacaagucccacgaccaggugugggugcugagcugggggacccuggagaagacguccccgacccuccaggucaucacccuggccagcggcaacgugccccaccacaccauccacacgcagcccguggggaagcaguucgaccgggucgacgacuucuucauccccaccaccacccugaucaucacgcacaugcgcuucggcuucauccugcacaaggacgaggccgcccuccagaagaucgaccuggagaccauguccuacaucaagaccaucaaccugaaggacuacaagugcgugccgcagagccucgccuacacccaccugggcggguacuacuucaucggcugcaagcccgacuccacgggggcggugagcccccaggucaugguggacggcgugaccgacuccgucaucggcuucaacagcgacgugaccgggacccccuacguguccccggacggccacuaccuggucagcaucaacgacgugaaggggcucgugcgcguccaguacaucaccauccggggcgagauccaggaggccuucgacaucuacacgaaccugcacaucuccgaccuggccuuccagcccagcuucaccgaggcccaccaguacaacaucuacgggagcuccagcacccagaccgacgugcuguucguggagcuguccagcggcaaggucaagaugaucaagucccugaaggagccccucaaggcggaggaguggccguggaaccgcaagaaccggcagauccaggacagcggccuguucgggcaguaccugaugacgcccuccaaggacagccucuucauccuggacggccgccugaacaagcucaacugcgagaucaccgagguggagaaggggaacaccgugaucugggucggcgacgccuga

SEQ ID NO: 30325 - RNA, 1626 nt, Artificial Sequence
  derived and/or modified sequence opt1 from FTCD__Homo_sapiens__NP_996848
augagccagcugguggagugcguccccaacuucuccgagggcaagaaccaggaggugaucgacgccaucagcggggccaucacccagaccccgggcugcgugcuccuggacgucgacgcggggcccuccacgaaccgcaccguguacaccuucgugggcccgcccgagugcgucguggagggggcccugaacgccgcccggguggccagccgccucaucgacaugucccggcaccagggcgagcacccgcgcaugggcgcgcuggacgucugccccuucauccccgugcgcggggugagcgucgacgagugcgugcugugcgcccaggccuucggccagcggcucgccgaggagcuggacgugcccgucuaccuguacggggaggcggcccggauggacucccgccggacccucccggccauccgcgccggcgaguacgaggcccugcccaagaagcugcagcaggcggacugggcccccgacuucgggcccagcuccuucgugccgagcuggggcgccacggccaccggcgcccggaaguuccucaucgcguucaacaucaaccugcuggggaccaaggagcaggcccaccgcaucgcccucaaccugcgggagcagggccgcgggaaggaccagcccggccggcugaagaaggugcagggcaucgggugguaccucgacgagaagaaccuggcccaggucuccaccaaccugcucgacuucgaggugacggcccugcacaccguguacgaggagaccugccgcgaggcgcaggagcugagccuccccgucgugggcucccagcugguggggcuggucccccucaaggcccugcuggacgccgccgccuucuacugcgagaaggagaaccucuucauccuggaggaggagcagcggauccgccugguggucagccggcucggccuggacucccugugcccguucagccccaaggagcgcaucaucgaguaccucgugcccgagcgggggcccgagcgcggccugggcuccaagagccugcgcgcguucgugggggaggucggcgcccgguccgccgcccccgggggcgggagcguggcggccgccgccgccgcgaugggcgccgcccucggcagcaugguggggcugaugaccuacggccgccggcaguuccagucccuggacacgaccaugcgccggcucaucccgcccuuccgcgaggccagcgccaagcugaccacccuggucgacgcggacgccgaggccuucacggccuaccucgaggccaugcggcugcccaagaacacccccgaggagaaggaccgccggaccgcggcccugcaggaggggcuccgccgggccguguccgugccccugacccuggccgagacggucgcgagccuguggcccgcccuccaggagcuggcccgcugcggcaaccuggccugccgguccgaccuccagguggccgcgaaggcccuggagauggggguguucggcgccuacuucaacguccugaucaaccuccgcgacaucaccgacgaggccuucaaggaccagauccaccaccgggugagcucccugcugcaggaggccaagacccaggcggcccucgugcuggacugccuggagacccgccaggaguga

SEQ ID NO: 30326 - RNA, 552 nt, Artificial Sequence
  derived and/or modified sequence opt1 from FTH1__Homo_sapiens__NP_002023
augaccaccgccagcacgucccaggugcgccagaacuaccaccaggacagcgaggccgcgaucaaccggcagaucaaccuggagcucuacgccuccuacgucuaccugagcauguccuacuacuucgaccgcgacgacguggcccugaagaacuucgccaaguacuuccuccaccagagccacgaggagcgggagcacgccgagaagcugaugaagcugcagaaccagcgcggcgggcggaucuuccuccaggacaucaagaagcccgacugcgacgacugggaguccggccugaacgcgauggagugcgcccugcaccucgagaagaacgugaaccagagccugcuggagcuccacaagcuggccaccgacaagaacgacccgcaccugugcgacuucaucgagacccacuaccucaacgagcaggucaaggccaucaaggagcugggggaccacgugaccaaccugcgcaagaugggcgcgcccgaguccgggcucgccgaguaccuguucgacaagcacacgcugggcgacagcgacaacgaguccuga

SEQ ID NO: 30327 - RNA, 528 nt, Artificial Sequence
  derived and/or modified sequence opt1 from FTL__Homo_sapiens__NP_000137
augagcucccagauccgccagaacuacagcaccgacguggaggccgccgucaacucccuggugaaccucuaccugcaggcgagcuacaccuaccugucccucggcuucuacuucgaccgggacgacguggcccuggagggggucagccacuucuuccgcgagcuggccgaggagaagcgggagggcuacgagcgccuccugaagaugcagaaccagcgcgggggccgggcccuguuccaggacaucaagaagcccgccgaggacgagugggggaagacgccggacgcgaugaaggccgccauggcccucgagaagaagcugaaccaggcgcugcucgaccugcacgcccugggcuccgcccggaccgacccccaccucugcgacuuccuggagacccacuuccuggacgaggaggugaagcucaucaagaagaugggcgaccaccugaccaaccugcaccgccucgggggccccgaggccgggcugggcgaguaccuguucgagcggcucacgcugaagcacgacuga

SEQ ID NO: 30328 - RNA, 729 nt, Artificial Sequence
  derived and/or modified sequence opt1 from FTMT__Homo_sapiens__NP_803431
augcugagcugcuuccgccuccugucccggcacaucagccccucccuggccagccuccgcccggugcggugcugcuucgcccugccccugcgcugggcgcccggccggccccucgacccgcgccagaucgcgccccggcgcccccuggccgccgccgccuccagccgggaccccaccgggccggccgccggccccucccgcguccggcagaacuuccaccccgacagcgaggccgcgaucaaccgccagaucaaccuggagcucuacgccuccuacguguaccugagcauggccuacuacuucucccgggacgacguggcccugaacaacuucagccgcuacuuccuccaccagucccgggaggagaccgagcacgccgagaagcugaugcgccugcagaaccagcgcgggggccggauccggcuccaggacaucaagaagcccgagcaggacgacugggagagcgggcugcacgcgauggagugcgcccugcuccuggagaagaacgucaaccagucccugcucgagcugcacgcccuggccagcgacaagggcgacccgcaccucugcgacuuccuggagacguacuaccugaacgagcaggucaaguccaucaaggagcucggcgaccacgugcacaaccuggugaagaugggggcccccgacgcgggccuggccgaguaccucuucgacacccacacccuggggaacgagaacaagcagaacuga

SEQ ID NO: 30329 - RNA, 1518 nt, Artificial Sequence
  derived and/or modified sequence opt1 from FTO__Homo_sapiens__NP_001073901
augaagcgcacccccaccgccgaggagcgggagcgcgaggccaagaagcugcggcuccuggaggagcuggaggacacguggcucccguaccugacccccaaggacgacgaguucuaccagcaguggcagcugaaguaccccaagcucauccugcgcgaggcgagcuccgugagcgaggagcugcacaaggagguccaggaggccuuccucacccugcacaagcacggcugccuguuccgggaccucgugcgcauccaggggaaggaccugcugacccccgugucccggauccucaucggcaacccggggugcacguacaaguaccugaacacccgccuguucaccguccccuggcccgugaagggcagcaacaucaagcacaccgaggccgagaucgccgccgcgugcgagacguuccucaagcugaacgacuaccugcagaucgagaccauccaggcccucgaggagcuggccgccaaggagaaggcgaacgaggacgccgugccccugugcauguccgccgacuucccgcgggucgggaugggcagcuccuacaacggccaggacgagguggacaucaagagccgcgccgccuacaacgugacccuccugaacuucauggacccccagaagaugcccuaccugaaggaggagcccuacuucgggaugggcaagauggcggucuccuggcaccacgacgagaaccucguggaccggagcgccguggccgucuacuccuacagcugcgaggggccggaggaggaguccgaggacgacagccaccuggagggccgcgaccccgacaucuggcacgugggguucaagaucuccugggacaucgagacccccggccuggccaucccccuccaccagggcgacugcuacuucaugcuggacgaccugaacgccacgcaccagcacugcgugcucgcggggagccagccgcgguucuccagcacccaccgcgucgccgagugcuccaccggcacccuggacuacauccugcagcggugccagcucgcccugcagaacgugugcgacgacguggacaacgacgacgucagccucaagagcuucgagcccgccgugcugaagcagggggaggagauccacaacgagguggaguucgaguggcugcgccaguucugguuccagggcaaccgguaccgcaagugcacggacugguggugccagcccauggcccagcuggaggcgcucuggaagaagauggagggcgucaccaacgccgugcugcacgaggugaagcgggaggggcugcccgucgagcagcgcaacgagauccucaccgccauccuggccucccugaccgcccggcagaaccuccgccgcgaguggcacgcgcggugccagagccgcaucgcccggacgcugccggccgaccagaagcccgagugccgccccuacugggagaaggacgacgccuccaugccccugccguucgaccugaccgacaucgugagcgagcuccggggccagcugcuggaggcgaagcccuga

SEQ ID NO: 30330 - RNA, 579 nt, Artificial Sequence
  derived and/or modified sequence opt1 from FTSJ1__Homo_sapiens__NP_001269086
auggcccugaacaucgccacccacgugcucaagcccggcgggugcuucgucgccaagaucuuccgcggccgggacgugacccugcuguacagccagcuccagguguucuucuccagcguccugugcgccaagccgcgcuccagccggaacuccagcaucgaggccuucgccgugugccagggguacgacccgcccgagggcuucauccccgaccuguccaagccccuccuggaccacagcuacgaccccgacuucaaccagcuggacgggcccacgcgcaucaucgugcccuucgugaccugcggcgaccucuccagcuacgacuccgaccggagcuacccgcuggaccuggagggcggguccgaguacaaguacaccccgcccacccagccgcccaucagcccgcccuaccaggaggccugcacgcucaagcgcaagggccagcuggcgaaggagauccggccccaggacugccccaucucccgcgucgacaccuucccccagccccuggccgcgccccagugccacacccuccuggcccccgagauggaggacaacgagaugagcugcucccccuga

SEQ ID NO: 30331 - RNA, 741 nt, Artificial Sequence
  derived and/or modified sequence opt1 from FTSJ2__Homo_sapiens__NP_037525
auggccggcuaccugaagcucgugugcgucagcuuccagcgccagggguuccacaccgugggcucccggugcaagaaccgcaccggggccgagcaccuguggcugacgcggcaccuccgcgaccccuucgugaaggcggccaaggucgagagcuaccggugccgcuccgccuucaagcugcuggaggugaacgagcggcaccagauccuccgcccgggccugcgggugcuggacugcggggccgcccccggcgcguggagccaggucgccgugcagaaggugaacgccgccggcaccgaccccuccagccccgucggguucgugcucggcguggaccugcugcacaucuucccgcucgagggggcgaccuuccugugccccgccgacgucaccgacccccgcacgucccagcggauccuggaggugcuccccggccgccgggccgacgugauccugagcgacauggccccgaacgccaccggguuccgcgaccuggaccacgaccggcucaucucccugugccugacccuccugagcgucacccccgacauccugcagcccggcggcacguuccucugcaagaccugggcggggucccagagccgccggcugcagcgccggcugaccgaggaguuccagaacgugcgcaucaucaagcccgaggccucccggaaggagagcuccgagguguacuuccucgccacccaguaccacggccgcaaggggacggucaagcaguga

SEQ ID NO: 30332 - RNA, 2544 nt, Artificial Sequence
  derived and/or modified sequence opt1 from FTSJ3__Homo_sapiens__NP_060117
augggcaagaaggggaaggugggcaagagccgccgggacaaguucuaccaccuggccaaggagaccggguaccgcucccggagcgccuucaagcucauccagcugaaccgccgguuccaguuccugcagaaggcgcgcgcccuccuggaccugugcgccgcccccggcggguggcuccaggucgccgcgaaguucaugccgguguccagccugaucgugggcgucgaccuggugcccaucaagccccuccccaacguggucacccugcagcaggacaucacgaccgagcggugccgccaggcccugcggaaggagcucaagaccuggaagguggacgugguccugaacgacggcgccccgaacgugggggccuccugggugcacgacgcguacagccaggcccaccugacccucauggcccugcgccuggccugcgacuuccucgcccggggcggguccuucaucacgaaggucuuccgcagccgggacuaccagccccugcuguggaucuuccagcagcuguuccgccgggugcaggcgaccaagccccaggccucccgccacgagagcgccgagaucuucguggucugccagggcuuccuggcccccgacaagguggacuccaaguucuucgacccgaaguucgccuucaaggagguggagguccaggcgaagaccgugaccgagcuggugacgaagaagaagcccaaggccgagggguacgccgagggcgaccucacccuguaccaccggaccagcgucaccgacuuccugcgcgccgccaaccccguggacuuccucuccaaggcgagcgagaucaugguggacgacgaggagcuggcccagcaccccgccacgaccgaggacauccgggucugcugccaggacauccgcgugcugggccggaaggagcuccgcucccugcugaacuggcgcaccaagcuccggcgcuacgucgccaagaagcugaaggagcaggccaaggcgcuggacaucagccucuccagcggggaggaggacgagggcgacgaggaggacuccaccgccgggacgaccaagcagccgagcaaggaggaggaggaggaggaggaggaggagcagcugaaccagacccuggccgagaugaaggcccaggagguggcggagcucaagcggaagaagaagaagcugcugcgcgagcagcggaagcagcgcgagcggguggagcucaagauggaccugcccggcgucagcaucgccgacgagggcgagaccgggauguucucccugagcacgauccgcggccaccagcuccuggaggaggugacccagggggacauguccgccgccgacaccuuccugagcgaccucccccgggacgacaucuacguguccgacgucgaggacgacggcgacgacaccagccuggacuccgaccuggaccccgaggagcuggccggggugcgcggccaccagggccuccgggaccagaagcgcaugcggcugacggaggugcaggacgacaaggaggaggaggaggaggagaacccgcugcucgucccccuggaggagaaggcggugcugcaggaggagcaggccaaccucugguucagcaagggguccuucgccggcaucgaggacgacgccgacgaggcccuggagaucagccaggcgcagcuccucuucgagaaccgccggaaggggcgccagcagcagcagaagcagcagcugccccagaccccgccguccugccugaagaccgagaucaugagcccccucuaccaggacgaggcccccaagggcaccgaggccuccagcgggacggaggccgccaccggccuggagggcgaggagaaggacgggaucuccgacagcgacuccagcaccuccagcgaggaggaggagagcugggagccccugcggggcaagaagcgcucccgggggcccaagagcgacgacgacggcuucgagaucgugcccaucgaggaccccgcgaagcaccgcauccucgaccccgaggggcuggcccugggcgccgucaucgccuccagcaagaaggcgaagcgcgaccucaucgacaacuccuucaaccgguacaccuucaacgaggacgagggcgagcugccggagugguucgugcaggaggagaagcagcaccgcauccggcagcugcccguggggaagaaggaggucgagcacuaccgcaagcgguggcgcgagaucaacgcccggcccaucaagaagguggccgaggccaaggcccgcaagaagcggcgcaugcucaagcggcuggagcagacgcgcaagaaggcggaggccguggucaacaccguggacaucagcgagcgggagaagguggcccagcugcgcucccucuacaagaaggccggccuggggaaggagaagcggcacgucaccuacgugguggccaagaagggcgucggccgcaaggugcggcgcccggcgggggugcggggccacuucaaggucguggacagccgcaugaagaaggaccagcgggcccagcagcgcaaggagcagaagaagaagcacaagcgcaaguga

SEQ ID NO: 30333 - RNA, 1998 nt, Artificial Sequence
  derived and/or modified sequence opt1 from FUBP1__Homo_sapiens__NP_001290362
auggccgacuacagcaccgugcccccgcccuccagcggcuccgccgggggcgggggcgggggcggcgggggcgggggcgucaacgacgcguucaaggacgcccugcagcgcgcccggcagaucgccgccaagaucgggggcgacgcgggcaccagccucaacuccaacgacuacggguacggcgggcagaagcgcccccuggaggacggcgacggcagcuggacgucccccagcuccaccacccacugggaggggaugccgagccccuucaaggaccagcccgacgccaagaagguggccccccagaacgacuccuucggcacccagcugccgcccaugcaccagcagcagagccgguccgugaugacggaggaguacaagguccccgacgggauggugggcuucaucaucgggcgcggcggcgagcagaucagccggauccagcaggaguccgggugcaagauccagaucgcccccgacagcggcgggcucccggagcgcuccugcaugcugaccggcacccccgagagcgugcaguccgcgaagcggcugcucgaccagaucgucgagaaggggcgccccgcccccggcuuccaccacggcgacgggccgggcaacgccgugcaggagaucaugauccccgccagcaaggccgggcuggugaucggcaaggggggcgagaccaucaagcagcugcaggagcgggcgggcgucaagauggugaugauccaggacgggccccagaacacgggcgccgacaagccccuccgcaucaccggggacccguacaaggugcagcaggccaaggagaugguccuggagcugauccgggaccagggcggcuuccgcgaggugcggaacgaguacgggagccgcaucggcgggaacgagggcaucgacgugcccaucccccgguucgccgucgggaucgugaucggccgcaacggcgagaugaucaagaagauccagaacgacgccggggugcggauccaguucaagcccgacgacggcaccaccccggagcgcaucgcgcagaucacggggccccccgaccggugccagcacgccgccgagaucaucaccgaccuccugcgcuccguccaggccggcaaccccgggggcccgggccccgggggccgggggcgcggccgcgggcagggcaacuggaacaugggccccccggggggccugcaggaguucaacuucaucgugcccaccgggaagaccggccucaucaucgggaagggcggcgagacgaucaagagcaucucccagcagagcggggcccggaucgagcugcagcgcaacccccccccgaacgcggaccccaacaugaagcuguucaccauccggggcaccccccagcagaucgacuacgcccgccagcucaucgaggagaagaucgggggccccgugaacccgcugggcccccccgucccccacgggccgcacggcgugcccgggccccacggccccccggggccccccggccccggcaccccgauggggcccuacaaccccgcccccuacaacccgggcccccccgggccggccccccacggcccccccgccccguacgcgccccagggguggggcaacgccuacccccacuggcagcagcaggcccccccggaccccgccaaggcgggcacggaccccaacuccgccgccugggccgccuacuacgcgcacuacuaccagcagcaggcccagcccccgcccgccgcccccgccggggcgcccaccaccacccagacgaacggccagggggaccagcagaacccggcccccgccggccagguggacuacaccaaggccugggaggaguacuacaagaagauggggcaggccguccccgcgcccaccggcgccccgcccggcgggcagcccgacuacagcgccgccugggcggaguacuaccggcagcaggccgccuacuacgcccagaccuccccccagggcaugccgcagcacccccccgccccccaggggcaguga

SEQ ID NO: 30334 - RNA, 1719 nt, Artificial Sequence
  derived and/or modified sequence opt1 from FUBP3__Homo_sapiens__NP_003925
auggccgagcuggugcagggccagagcgcccccguggggaugaaggcggagggcuucguggacgcccuccaccgcgugcggcagaucgccgccaagaucgacuccaucccgcaccugaacaacagcacgccccugguggaccccuccguguacggguacggcgugcagaagcgcccccucgacgacggggucggcaaccagcugggcgcccuggugcaccagcggaccgugaucaccgaggaguucaaggucccggacaagauggugggguucaucaucggccgcgggggcgagcagaucagccggauccaggcggaguccgggugcaagauccagaucgccagcgaguccagcggcauccccgagcgccccugcgugcucaccggcacccccgaguccaucgagcaggccaagcggcugcuggggcagaucgucgaccgcugccggaacggcccgggguuccacaacgacaucgacagcaacuccaccauccaggagauccucauccccgccagcaaggugggccuggugaucggccgcgggggcgagacgaucaagcagcugcaggagcggaccggggucaagauggugaugauccaggacggcccccuccccaccggggcggacaagccgcugcgcaucaccggcgacgccuucaaggugcagcaggcccgggagaugguccuggagaucauccgcgagaaggaccaggccgacuuccggggcgugcgcggggacuucaacucccggaugggcgggggcagcaucgagguguccgucccccgcuucgccguggggaucgugaucggccggaacggcgagaugaucaagaagauccagaacgacgcggggguccgcauccaguucaagcccgacgacggcaucagccccgagcgggccgcccaggugauggggccgcccgaccgcugccagcacgccgcccacaucaucuccgagcucauccugacggcgcaggagcgcgacggcuucgggggccuggccgccgcccggggccgcgggcggggccgcggggacuggagcgucggcgcccccggcggggugcaggagaucaccuacaccgugcccgcggacaagugcggccucgucaucgggaagggcggggagaacaucaaguccaucaaccagcagagcggcgcccacguggagcugcagcggaacccgccgcccaacagcgaccccaaccugcgccgguucaccauccgcggcgugccccagcagaucgaggucgcccggcagcucaucgacgagaaggucgggggcacgaaccugggggcccccggcgccuucgggcagucccccuucagccagcccccggcgccgccccaccagaacaccuucccgccccgcuccagcggcugcuuccccaacauggccgccaaggugaacggcaacccccacuccacccccgugagcgggccgcccgccuuccugacccagggcuggggguccacguaccaggcguggcagcagcccacccagcagguccccagccagcagucccagccccagagcucccagcccaacuacagcaaggccugggaggacuacuacaagaagcagucccacgccgccagcgccgcgccccaggccuccagcccgcccgacuacaccauggccugggccgaguacuaccggcagcaggucgccuucuacggccagacccucgggcaggcgcaggcccacucccaggagcaguga

SEQ ID NO: 30335 - RNA, 768 nt, Artificial Sequence
  derived and/or modified sequence opt1 from FUCA1__Homo_sapiens__XP_011539469
augcccgagcuguacgaccucgugaacagcuacaagccggaccugaucugguccgacggcgagugggagugccccgacaccuacuggaacagcaccaacuuccuguccuggcucuacaacgacagccccgucaaggacgaggugguggucaacgaccgcugggggcagaacugcuccugccaccacggcggguacuacaacugcgaggacaaguucaagccccagagccugccggaccacaagugggagaugugcacguccaucgacaaguucagcuggggcuaccggcgcgacauggcccuguccgacgugaccgaggagagcgagaucaucuccgagcucgugcagaccgucagccucgggggcaacuaccugcugaacaucggccccaccaaggacgggcugaucgugcccaucuuccaggagcggcugcucgccgugggcaaguggcuguccaucaacggggaggcgaucuacgccagcaagcccuggcgcguccagugggagaagaacacgaccuccgugugguacaccagcaagggcuccgccguguacgccaucuuccugcacuggccggagaacgggguccucaaccuggagagccccaucaccacguccaccaccaagaucaccaugcugggcauccagggcgaccucaaguggagcacggaccccgacaaggggcuguucaucagccugccccagcucccgcccuccgccgugcccgcggaguucgccuggaccaucaagcugaccggcgugaaguga

SEQ ID NO: 30336 - RNA, 1404 nt, Artificial Sequence
  derived and/or modified sequence opt1 from FUCA2__Homo_sapiens__NP_114409
augcgcccccaggagcugccgcggcucgccuucccccugcugcuccugcugcuccugcugcucccgccgccgcccugccccgcccacagcgcgacccgcuucgaccccaccugggagucccuggacgcccggcagcugcccgccugguucgaccaggccaaguucggcaucuucauccacuggggcguguucagcguccccuccuucgggagcgagugguucuggugguacuggcagaaggagaagauccccaaguacguggaguucaugaaggacaacuacccgcccuccuucaaguacgaggacuucgggccccucuucacggccaaguucuucaacgcgaaccagugggccgacaucuuccaggccagcggcgccaaguacaucgugcugaccuccaagcaccacgagggguucacccuguggggcagcgaguacuccuggaacuggaacgcgaucgacgagggccccaagcgcgacaucgucaaggagcucgagguggccauccggaaccgcaccgaccugcgguucgggcuguacuacagccucuucgagugguuccacccccuguuccuggaggacgaguccagcuccuuccacaagcgccaguuccccgugagcaagacgcuccccgagcuguacgagcuggucaacaacuaccagcccgaggugcucugguccgacggcgacgggggcgcccccgaccaguacuggaacagcaccggguuccuggccuggcuguacaacgaguccccggugcggggcaccgucgugaccaacgaccgcuggggcgccgggagcaucugcaagcacggcggguucuacacgugcuccgaccgguacaaccccggccaccuccugccccacaagugggagaacugcaugaccaucgacaagcugagcuggggcuaccgccgggaggcggggaucagcgacuaccucaccaucgaggagcuggugaagcagcuggucgagaccguguccugcggcgggaaccuccugaugaacaucggccccacgcuggacgggaccaucagcguggucuucgaggagcgccuccggcagaugggcuccuggcugaaggugaacggcgaggccaucuacgagacccacaccuggcgcagccagaacgacacggugaccccggacgucugguacaccuccaagcccaaggagaagcugguguacgccaucuuccucaaguggcccaccagcgggcagcuguuccugggccaccccaaggccauccucggggccacggaggugaagcugcugggccacgggcagccgcucaacuggaucucccuggagcagaacggcaucauggucgagcugccccagcucaccauccaccagaugcccugcaaguggggcugggcgcuggcccugaccaacgugaucuga

SEQ ID NO: 30337 - RNA, 468 nt, Artificial Sequence
  derived and/or modified sequence opt1 from FUNDC1__Homo_sapiens__NP_776155
auggccacccgcaaccccccgccccaggacuacgagagcgacgacgacuccuacgaggugcuggaccucaccgaguacgcccggcgccaccagugguggaaccgggucuucggccacagcuccgggcccaugguggagaaguacagcguggcgacgcagaucgucaugggcggggugaccggcuggugcgccggguuccuguuccagaaggugggcaagcuggccgccaccgccgucggcgggggcuuccuccugcugcagaucgcgucccacagcggguacgugcagaucgacuggaagcgcguggagaaggacgucaacaaggccaagcggcagaucaagaagcgcgccaacaaggccgcgcccgagaucaacaaccucaucgaggaggccaccgaguucaucaagcagaacaucgugaucuccagcggcuucguggggggcuuccugcugggccucgccuccuga

SEQ ID NO: 30338 - RNA, 570 nt, Artificial Sequence
  derived and/or modified sequence opt1 from FUNDC2__Homo_sapiens__NP_076423
auggagaccagcgcgccccgcgccggcucccagguggucgccaccacggcccggcacagcgccgccuaccgcgccgacccgcugcggguguccagccgcgacaagcucaccgagauggcggccuccagccaggggaacuucgagggcaacuucgagucccuggaccuggccgaguucgccaagaagcagcccugguggcggaagcuguucgggcaggagagcggccccuccgcggagaaguacagcguggccacccagcuguucaucgggggcgucaccggcuggugcacgggguucaucuuccagaaggugggcaagcucgccgccaccgccgucgggggcggguucuuccuccugcagcuggcgaaccacaccggcuacaucaagguggacuggcagcgcguggagaaggacaugaagaaggccaaggagcagcucaagauccggaaguccaaccagauccccaccgaggugcgcagcaaggccgaggaggucguguccuucgugaagaagaacguccuggugacgggcggguucuucggcggguuccugcucggcauggccagcuga

SEQ ID NO: 30339 - RNA, 2385 nt, Artificial Sequence
  derived and/or modified sequence opt1 from FURIN__Homo_sapiens__NP_001276752
auggagcugcgccccuggcuccuguggguggucgccgccaccggcacccuggugcuccuggcggccgacgcccaggggcagaagguguucacgaacaccugggccguccggauccccggcgggcccgccguggcgaacagcguggcccgcaagcacggcuuccugaaccucgggcagaucuucggcgacuacuaccacuucuggcaccggggcgucaccaagcgcucccugagcccccaccggccccgccacucccggcugcagcgcgagccccaggugcaguggcucgagcagcaggucgccaagcggcgcaccaagcgggacgucuaccaggagcccacggaccccaaguucccccagcagugguaccugagcggggugacccagcgcgaccugaacgugaaggccgcgugggcccagggcuacaccgggcacggcaucgucguguccauccucgacgacgggaucgagaagaaccaccccgaccuggccggcaacuacgaccccggcgccagcuucgacgugaacgaccaggaccccgacccccagccgcgguacacccagaugaacgacaaccgccacgggacgcggugcgccggcgaggucgcggccguggccaacaacggggugugcggcgucggcguggccuacaacgcccgcaucgggggcgugcggaugcuggacggggaggucaccgacgcgguggaggcccgcucccucggccugaaccccaaccacauccacaucuacagcgccuccugggggcccgaggacgacggcaagaccguggacggccccgcccggcuggccgaggaggcguucuuccgcggggugagccagggccgcgggggccucggguccaucuucgugugggccagcggcaacggcgggcgggagcacgacuccugcaacugcgacggcuacaccaacagcaucuacacgcuguccaucagcuccgccacccaguucgggaacgucccgugguacagcgaggccugcuccagcacccuggccaccacguacagcuccggcaaccagaacgagaagcagaucgugaccaccgaccuccgccagaagugcaccgagagccacacggggaccuccgcgagcgccccgcuggccgccggcaucaucgcgcugacccucgaggccaacaagaaccugaccuggcgggacaugcagcaccuggugguccagacguccaagcccgcccaccucaacgccaacgacugggccaccaacggcguggggcgcaaggugagccacuccuacggcuacgggcugcuggacgcgggcgccauggucgcccucgcccagaacuggaccaccguggcgccccagcggaagugcaucaucgacauccugacggagccgaaggacaucggcaagcgccuggaggugcggaagaccgucaccgccugccucggggagcccaaccacaucacccgccuggagcacgcccaggcccggcugacgcucagcuacaaccgccggggcgaccuggccauccaccuggugucccccauggggacccgcagcacccuccuggccgcgcggccccacgacuacuccgccgacggcuucaacgacugggccuucaugaccacgcacagcugggacgaggacccguccggggagugggugcuggagaucgagaacaccagcgaggccaacaacuacggcacccucaccaaguucacccugguccuguacggcacggcgcccgaggggcuccccgugcccccggaguccagcggcugcaagacccugaccuccagccaggccugcguggucugcgaggagggguucucccugcaccagaaguccugcgugcagcacugcccgcccggcuucgcgccccaggugcucgacacccacuacagcacggagaacgacgucgagaccauccgcgccagcgugugcgcccccugccacgccagcugcgcgaccugccaggggcccgcccugaccgacugccuguccugccccagccacgccucccuggacccgguggagcagacgugcagccggcagucccagagcucccgcgagagcccgccccagcagcagccgccccggcucccgcccgaggucgaggccggccagcgccugcgggccggccugcuccccucccaccuccccgaggugguggccgggcugagcugcgccuucaucguccugguguucgugaccgucuuccuggugcugcagcuccgcuccggcuucagcuuccgcggggugaaggucuacaccauggaccggggccugaucuccuacaaggggcugccgcccgaggccuggcaggaggagugccccagcgacuccgaggaggacgagggccgcggcgagcggaccgccuucaucaaggaccagagcgcgcucuga

SEQ ID NO: 30340 - RNA, 1569 nt, Artificial Sequence
  derived and/or modified sequence opt1 from FUS__Homo_sapiens__NP_001164408
auggccagcaacgacuacacccagcaggccacccaguccuacggcgcguaccccacgcagccggggcagggcuacagccagcaguccagccagcccuacgggcagcaguccuacagcggcuacucccagagcaccgacaccuccggguacggccagagcuccuacagcuccuacggccagagccagaacaccggguacggcacgcaguccacgccccagggguacggcagcaccgggggcuacggcuccagccaguccagccagagcuccuacgggcagcagagcuccuaccccggcuacgggcagcagccggcccccagcuccaccagcggcuccuacggcagcuccagccaguccagcuccuacgggcagccccagagcggcuccuacagccagcagcccuccuacgggggccagcagcagagcuacgggcagcagcaguccuacaacccgccccagggcuacggccagcagaaccaguacaacagcagcuccgggggcgggggcgggggcaacuacggccaggaccagagcuccaugagcuccgggggcgggagcggcgggggcuacggcaaccaggaccaguccgggggcgggggcagcggcggguacggccagcaggaccgcgggggccgggggcgcggcggcuccgggggcgggggcgggggcggcgggggcggguacaaccggagcuccggcggguacgagccccgcggccggggcgggggccgcgggggccgcgggggcaugggcgggagcgaccggggcggguucaacaaguucggcggcccccgggaccaggggucccgccacgacagcgagcaggacaacuccgacaacaacaccaucuucgugcagggccugggggagaacgucaccaucgagagcguggccgacuacuucaagcagaucggcaucaucaagaccaacaagaagaccgggcagccgaugaucaaccucuacacggaccgggagaccggcaagcugaagggcgaggccaccguguccuucgacgacccgcccagcgccaaggcggccaucgacugguucgacgggaaggaguucagcggcaaccccaucaaggucuccuucgccacccgccgggccgacuucaaccgcgggggcgggaacggccggggcgggcgcggccgcgggggccccauggggcggggcggcuacgggggcgggggcagcggcgggggcgggcggggcggguuccccuccggcggcgggggcgggggcgggcagcagcgcgcgggcgacuggaagugccccaaccccacgugcgagaacaugaacuucagcuggcggaacgagugcaaccagugcaaggccccgaagcccgacggccccgggggcgggcccggcgggucccacaugggcggcaacuacggggacgaccgccgcggcgggcggggcggguacgaccgcggcggcuaccgggggcgcggcggggaccggggcggcuuccgcgggggccgcgggggcggggaccggggcggcuucgggccgggcaagauggacagccgcggggagcaccggcaggaccggcgcgagcggcccuacuga

SEQ ID NO: 30341 - RNA, 1440 nt, Artificial Sequence
  derived and/or modified sequence opt1 from FUT10__Homo_sapiens__NP_116053
auggugcgcauccagcggcgcaagcugcucgccagcugccugugcgucaccgccaccguguuccugcucgugacccugcaggucaugguggagcugggcaaguucgagcggaaggaguucaaguccagcucccuccaggacgggcacaccaagauggaggaggcgcccacccaccugaacagcuuccugaagaaggagggccucaccuucaaccgcaagcggaagugggagcuggacuccuacccgaucaugcugugguggagcccccucacgggggagaccggccgccuggggcagugcggcgccgacgccugcuucuucaccaucaaccggaccuaccugcaccaccacaugacgaaggccuuccucuucuacggcaccgacuucaacaucgacucccugccccugccccgcaaggcccaccacgacugggcgguguuccacgaggagagcccgaagaacaacuacaagcuguuccacaagcccgucaucacccuguucaacuacaccgccacguucucccggcacagccaccucccccucaccacccaguaccuggaguccaucgaggugcucaagagccugcgcuaccuggugccccugcaguccaagaacaagcuccggaagcgccuggccccgcuggucuacgugcagagcgacugcgacccgcccuccgaccgggacagcuacgugcgcgagcucaugaccuacaucgaggucgacuccuacggggagugccugcggaacaaggaccugccccagcagcucaagaaccccgccagcauggacgcggacggcuucuaccgcaucaucgcccaguacaaguucauccuggccuucgagaacgccgugugcgacgacuacaucacggagaaguucuggcggccccugaagcucggggugguccccguguacuacggcucccccagcaucaccgacuggcugccgagcaacaaguccgccauccuggugagcgaguucucccacccccgcgagcucgcgagcuacauccggcgccuggacuccgacgaccggcuguacgaggccuacgucgaguggaagcucaagggggagaucagcaaccagcgccugcugaccgcccuccgcgagcggaaguggggcgugcaggacgugaaccaggacaacuacaucgacgccuucgagugcauggucugcaccaaggugugggccaacauccgccugcaggagaagggccugccgcccaagcggugggaggcggaggacacgcaccucuccugccccgagcccaccguguucgccuucagcccccugcgcacgcccccgcuguccagccugcgggagauguggaucuccagcuucgagcaguccaagaaggaggcccaggcccuccgcuggcuggucgaccggaaccagaacuucagcucccaggaguucugggggcugguguucaaggacuga

SEQ ID NO: 30342 - RNA, 1431 nt, Artificial Sequence
  derived and/or modified sequence opt1 from FUT11__Homo_sapiens__NP_001271123
auggccgccggccccauccgcgugguccuggugcuccugggggugcugagcgucugcgcggccuccggccacgggagcguggccgagcgggaggccggcggggaggccgagugggcggagccgugggacggcgccguguuccgcccgcccuccgcccucggcgccgucggggugacccggagcuccggcacgccccgccccgggcgggaggaggcgggcgaccugcccgugcugcucugguggagccccgggcuguucccccacuucccgggcgacuccgagcgcaucgagugcgcccggggcgccugcgucgccagccgcaaccggcgcgcccugcgggacucccgcacccgggcgcuccuguucuacgggaccgacuuccgcgccagcgccgcgccccugccccggcucgcccaccaguccugggcccugcugcacgaggagagcccccucaacaacuuccugcugucccacggcccggggauccgccucuucaaccugaccagcaccuucucccggcacagcgacuacccccugucccuccaguggcugcccggcacggccuaccugcgccggcccgugccgccgcccauggagcgcgccgaguggcggcgccgcggcuacgcgccccuccuguaccugcagagccacugcgacgugcccgccgaccgggaccgcuacguccgggagcucaugcgccacauccccguggacuccuacgggaagugccugcagaaccgggagcugcccaccgcccgccuccaggacaccgccaccgccacgaccgaggaccccgagcugcuggccuuccucagccgguacaaguuccaccuggcccuggagaacgcgaucugcaacgacuacaugaccgagaagcucuggcgcccgaugcaccugggcgccgugcccgucuaccgggggagccccuccgugcgcgacuggaugcccaacaaccacagcgugauccugaucgacgacuucgaguccccgcagaagcucgccgaguucaucgacuuccuggacaagaacgacgaggaguacaugaaguaccuggccuacaagcagcccggcgggaucaccaaccaguuccuccuggacagccugaagcaccgggaguggggcgucaacgacccccuccugccgaacuaccugaacggcuucgagugcuucgugugcgacuacgagcucgcgcgccuggacgccgagaaggcccacgccgccucccccggggacagccccguguucgagccccacaucgcgcagccgucccacauggacugccccguccccacgcccggcuucgggaacguggaggagaucccggagaacgacagcucccuggugcagguccgggaccacugcaucugccugcgcuuccucuggccccacagcgagaagggccggacccacaacuacgccgccgugcccuga

SEQ ID NO: 30343 - RNA, 1098 nt, Artificial Sequence
  derived and/or modified sequence opt1 from FUT1__Homo_sapiens__NP_000139
auguggcugcgcagccaccggcagcucugccuggccuuccugcucgugugcguccuguccgugaucuucuuccugcacauccaccaggacagcuucccccacggccucgggcuguccauccugugcccggaccgccggcucgugaccccgcccgucgccaucuucugccugcccggcaccgcgauggggcccaacgccagcuccagcugcccccagcaccccgccucccugagcggcacguggaccguguaccccaacgggcgcuucggcaaccagaugggccaguacgccacccuccuggcccuggcgcagcucaacgggcggcgcgccuucauccugccggccaugcacgccgcgcuggcccccguguuccggaucacccuccccguccuggcccccgagguggacucccgcacgccguggcgggagcugcagcuccacgacuggaugagcgaggaguacgccgaccugcgcgaccccuuccugaagcucuccggcuuccccugcagcuggaccuucuuccaccaccuccgggagcagauccgccgggaguucacccugcacgaccaccuccgcgaggaggcccaguccgugcuggggcagcugcggcugggccgcaccggggaccggccccgcacguucgucggcgugcacgugcggcgcggcgacuaccugcaggucaugccgcagcgguggaaggggguggugggcgacagcgcguaccugcgccaggccauggacugguuccgcgcccggcacgaggcccccgucuucguggugaccuccaacgggauggaguggugcaaggagaacaucgacaccagccagggcgacgucaccuucgccggcgacgggcaggaggcgacgcccuggaaggacuucgcccuccugacccagugcaaccacaccaucaugaccaucggcacguucggguucugggccgccuaccuggccggcggggacaccguguaccucgcgaacuucacccugcccgacuccgaguuccugaagaucuucaagccggaggccgccuuccuccccgagugggugggcaucaacgccgaccugagcccccuguggacccucgccaagcccuga

SEQ ID NO: 30344 - RNA, 1032 nt, Artificial Sequence
  derived and/or modified sequence opt1 from FUT2__Homo_sapiens__NP_001091107
augcuggugguccagaugcccuucagcuucccgauggcccacuucauccucuucguguucaccguguccaccaucuuccacguccagcagcgccuggccaagauccaggcgaugugggagcugcccgugcagauccccgugcucgccagcacguccaaggcccugggccccagccagcugcgggggauguggaccaucaacgccaucggccgccucgggaaccagaugggcgaguacgccacccuguacgcgcuggccaagaugaacgggcggccggccuucauccccgcccagaugcacuccacccucgcgcccaucuuccgcaucacgcugcccguccugcacagcgccaccgccucccggaucccguggcagaacuaccaccucaacgacuggauggaggaggaguaccgccacauccccggcgaguacgugcgguucaccggcuaccccugcagcuggaccuucuaccaccaccuccgccaggagauccugcaggaguucacgcugcacgaccacgugcgggaggaggcccagaaguuccugcgcgggcugcaggucaacggcucccggcccgggaccuucgugggcgugcacguccgccgcggggacuacgugcacgugaugccgaaggucuggaagggcgugguggccgaccggcgguaccuccagcaggcgcuggacugguuccgcgcccgguacagcucccugaucuucgucgugaccagcaacggcauggccuggugccgcgagaacaucgacaccucccacggggacguggucuucgccggcgacgggaucgagggcagccccgccaaggacuucgcgcuccugacgcagugcaaccacaccaucaugaccaucggcaccuucgggaucugggccgccuaccugacgggcggggacaccaucuaccucgccaacuacacccugcccgacucccccuuccugaagaucuucaagccggaggccgcguuccuccccgaguggaccggcaucgccgccgaccugagcccccugcucaagcacuga

SEQ ID NO: 30345 - RNA, 1086 nt, Artificial Sequence
  derived and/or modified sequence opt1 from FUT3__Homo_sapiens__XP_011526169
auggacccccugggcgccgccaagccgcaguggcccuggcgccggugccucgcggcccugcuguuccagcuccugguggccgucugcuucuucagcuaccugcgcgugucccgggacgacgccaccgggagcccccgcgcccccuccggcagcucccggcaggacaccacgccgacccgccccacccuccugauccugcuccggaccuggcccuuccacauccccguggcgcugagccgcugcuccgagauggucccggggacggccgacugccacaucaccgccgaccggaagguguacccccaggccgacauggugaucguccaccacugggacaucaugagcaaccccaagucccgccugcccccgagcccccggccccagggccagcgcuggaucugguucaaccucgagcccccgcccaacugccagcaccuggaggcgcuggaccgguacuucaaccucaccauguccuaccgcagcgacuccgacaucuucacccccuacggguggcuggagcccuggagcggccagccggcccacccgccccugaaccucuccgccaagacggagcugguggccugggccgugagcaacuggaagcccgacuccgcgcggguccgcuacuaccagagccugcaggcccaccucaagguggacguguacggccggucccacaagccccugcccaaggggaccaugauggagacccugagccgcuacaaguucuaccucgccuucgagaacagccugcaccccgacuacaucaccgagaagcuguggcggaacgcccucgaggccugggcgguccccguggugcugggcccgucccgcagcaacuacgagcgguuccugccgcccgacgccuucauccacgucgacgacuuccagucccccaaggaccucgcccgcuaccugcaggagcuggacaaggaccacgcccgcuaccucagcuacuuccgguggcgcgagacgcugcggccccgcuccuucagcugggcccuggacuucugcaaggcgugcuggaagcuccagcaggagucccgguaccagaccgugcgcagcaucgccgccugguucaccuga

SEQ ID NO: 30346 - RNA, 1593 nt, Artificial Sequence
  derived and/or modified sequence opt1 from FUT4__Homo_sapiens__NP_002024
augcgccggcuguggggcgccgcccgcaagcccagcggggcgggcugggagaaggagugggccgaggccccgcaggaggcccccggggccugguccggccggcucgggcccggccgcagcggccggaaggggcgcgcggugcccggcugggccuccuggccggcccaccuggcccuggcggcccggcccgcccgccaccucgggggcgccgggcagggcccccggccccugcacagcggcaccgccccguuccacucccgcgcgagcggggagcggcagcgccggcuggagccccagcuccagcacgagucccgcugccggagcuccacccccgccgacgccuggcgcgccgaggccgcgcugcccguccgggccaugggcgccccgugggggagccccacggccgccgcgggcggccgccggggguggcgccggggccgcgggcugcccuggaccgugugcgugcucgccgccgccggccugaccugcaccgcccugaucacguacgcgugcugggggcagcugcccccgcuccccugggccucccccacccccagccgcccggucggcgugcugcucuggugggagcccuucggcgggcgggacuccgcgccccggcccccgcccgacugccgccugcgcuucaacaucagcggcugccggcugcucaccgaccgcgccuccuacggggaggcccaggccgugcuguuccaccaccgggaccuggucaagggcccgcccgacuggcccccgcccugggggauccaggcccacaccgccgaggagguggaccuccgcgugcuggacuacgaggaggccgcggccgccgccgaggcccuggcgacgagcagcccccggccgcccggccagcgcugggucuggaugaacuucgagucccccucccacagccccggccuccggagccuggccuccaaccuguucaacuggacccucagcuaccgcgccgacuccgacguguucgugcccuacggguaccuguacccccggagccaccccggcgacccgcccuccgggcuggccccgccccucagccgcaagcagggccuggucgccuggguggugucccacugggacgagcggcaggcgcgcguccgguacuaccaccagcugagccagcacgugaccguggacgucuucgggcgcggcggccccgggcagcccgugcccgagaucggccuccugcacaccguggcccgguacaaguucuaccuggccuucgagaacucccagcaccucgacuacaucacggagaagcuguggcgcaacgcccugcucgcgggggccguccccguggugcugggcccggaccgcgccaacuacgagcgguucgucccccgcggcgccuucauccacguggacgacuuccccagcgccuccagccuggcguccuaccuccuguuccuggaccggaaccccgccgucuaccgccgguacuuccacuggcgccggagcuacgccgugcacaucaccuccuucugggacgagccguggugccgcgugugccaggccguccagcgggccggggaccgccccaagagcauccggaaccucgcguccugguucgagcgcuga

SEQ ID NO: 30347 - RNA, 1125 nt, Artificial Sequence
  derived and/or modified sequence opt1 from FUT5__Homo_sapiens__NP_002025
auggacccccugggcccggccaagccccaguggcucuggcgccggugccuggccgggcuccucuuccagcugcugguggcggucugcuucuucagcuaccuccgcgugucccgggacgacgccaccggcagcccccgccccgggcugauggccguggagccggucaccggcgcccccaacgggucccggugccaggacagcauggccacgcccgcgcaccccacccugcucauccugcuguggaccuggccguucaacacccccguggcccucccccgcugcuccgagauggugcccggcgccgccgacugcaacaucacggcggacagcuccgucuacccgcaggccgacgccgugaucgugcaccacugggacaucauguacaaccccagcgccaaccugcccccgcccacccggccccagggccagcgcuggaucugguucuccauggagagccccuccaacugccggcaccuggaggcccucgacggguacuucaaccugaccaugagcuaccgcuccgacagcgacaucuucacccccuacggcuggcuggagccgugguccgggcagcccgcgcacccgccccucaaccugagcgccaagacggagcuggucgccugggccguguccaacuggaagcccgacagcgcccgggugcgcuacuaccagucccuccaggcgcaccugaaggucgacguguacggccggagccacaagccccugcccaaggggaccaugauggagacccucagccgcuacaaguucuaccuggccuucgagaacucccugcaccccgacuacaucaccgagaagcucuggcggaacgcccuggaggccugggccgugccggucgugcugggccccagccgcuccaacuacgagcgguuccugcccccggacgcguucauccacguggacgacuuccagagccccaaggaccuggcccgcuaccugcaggagcucgacaaggaccacgcccgguaccuguccuacuuccacuggcgcgagacgcugcggccccgcagcuucuccugggcccucgccuucugcaaggcgugcuggaagcugcagcaggagagccgcuaccagaccguccgguccaucgccgccugguucaccuga

SEQ ID NO: 30348 - RNA, 1080 nt, Artificial Sequence
  derived and/or modified sequence opt1 from FUT6__Homo_sapiens__NP_001035791
auggacccccugggcccggccaagccccaguggagcuggcgcugcugccucaccacccugcuguuccagcuccugauggccgugugcuucuucuccuaccugcgggucagccaggacgaccccacgguguaccccaacgggucccgcuucccggacagcaccggcacccccgcgcacuccaucccccucauccugcuguggaccuggcccuucaacaagccgaucgcccucccccggugcagcgagauggugcccgggacggccgacugcaacaucaccgccgaccgcaaggucuacccccaggccgacgcggugaucgugcaccaccgggaggucauguacaacccguccgcccagcugccccgcagcccccggcgccagggccagcgguggaucugguucuccauggagagccccucccacugcuggcagcugaaggccauggacggguacuucaaccucaccaugagcuaccgcuccgacagcgacaucuucaccccguacggcuggcuggagcccugguccggccagcccgcccacccgccccugaaccucagcgcgaagacggagcugguggccugggccguguccaacugggggcccaacagcgcccggguccgcuacuaccagucccugcaggcccaccucaagguggacguguacggccggagccacaagccccugccccaggggaccaugauggagacccugagccgcuacaaguucuaccucgcguucgagaacucccugcacccggacuacaucaccgagaagcuguggcggaacgcccucgaggccugggccguccccguggugcugggccccagccgcuccaacuacgagcgguuccugcccccggacgccuucauccacgucgacgacuuccagagccccaaggaccucgcgcgcuaccugcaggagcuggacaaggaccacgcccgguaccucuccuacuuccgcuggcgggagacgcugcgcccccgcagcuucuccugggcccuggccuucugcaaggccugcuggaagcuccaggaggagagccgguaccagacccgcgggaucgcggccugguucaccuga

SEQ ID NO: 30349 - RNA, 1029 nt, Artificial Sequence
  derived and/or modified sequence opt1 from FUT7__Homo_sapiens__NP_004470
augaacaacgccggccacgggcccacccgccggcugcgcggccucggggugcuggccggcgucgcgcugcucgccgcccuguggcugcucuggcugcuggggagcgccccgcggggcacccccgcgccccagcccacgaucaccauccucguguggcacuggccguucaccgaccagccgcccgagcugcccuccgacacgugcacccgcuacggcaucgcccggugccaccugagcgccaaccgcucccuccuggccagcgccgacgcgguggucuuccaccaccgggagcugcagacccgccggucccaccucccccuggcccagcgcccccgggggcagcccugggugugggccagcauggagucccccagccacacccacggccugucccaccuccgcgggaucuucaacugggugcugagcuaccggcgcgacuccgacaucuucgucccguacggccggcuggagccccacugggggcccagcccgccccuccccgccaagucccgcguggccgcguggguggucagcaacuuccaggagcggcagcugcgcgcccggcuguaccgccagcucgcgccccaccuccggguggacguguucggccgcgccaacggccgcccccugugcgccuccugccuggucccgaccguggcccaguaccgguucuaccugagcuucgagaacucccagcaccgcgacuacaucacggagaaguucuggcggaacgcccugguggccgggaccguccccguggugcucggcccgccccgcgccaccuacgaggccuucguccccgcggacgccuucgugcacguggacgacuucgggagcgcccgggagcuggccgccuuccugaccggcaugaacgagucccgcuaccagcgguucuucgcguggcgcgaccggcuccgcguccggcuguucacggacuggcgcgagcgguucugcgccaucugcgaccgcuacccccaccucccccggagccagguguacgaggaccuggagggcugguuccaggccuga

SEQ ID NO: 30350 - RNA, 1239 nt, Artificial Sequence
  derived and/or modified sequence opt1 from FUT8__Homo_sapiens__NP_004471
augaccgaccuguacuaccucagccagaccgacggcgccggggacuggcgcgagaaggaggccaaggaccugacggagcuggugcagcggcgcaucaccuaccuccagaaccccaaggacugcuccaaggcgaagaagcuggucugcaacaucaacaagggcugcggguacggcugccagcugcaccacgugguguacugcuucaugaucgccuacgggacccagcggacccucauccuggagagccagaacuggcgcuacgccacgggcggcugggagaccgucuuccggccgguguccgagaccugcaccgaccgcagcgggaucuccacgggccacuggagcggggaggugaaggacaagaacguccaggugguggagcugcccaucgucgacucccuccacccccggcccccguaccugccccuggccgugcccgaggaccucgccgaccgccuggugcggguccacggcgaccccgcgguguggugggugagccaguucgucaaguaccugauccgcccgcagcccuggcucgagaaggagaucgaggaggccaccaagaagcugggguucaagcaccccgugaucggcgugcacguccggcgcaccgacaaggugggcaccgaggccgccuuccaccccaucgaggaguacauggugcacgucgaggagcacuuccagcugcucgcgcggcgcaugcaggucgacaagaagcggguguaccuggccacggacgacccgucccugcucaaggaggccaagaccaaguaccccaacuacgaguucaucagcgacaacuccaucagcugguccgccgggcugcacaaccgcuacaccgagaacagccugcggggcgugauccucgacauccacuuccugucccaggccgacuuccuggugugcaccuucagcucccaggucugccgcguggcguacgagaucaugcagacgcuccaccccgacgccagcgccaacuuccacucccuggacgacaucuacuacuucgggggccagaacgcccacaaccagaucgccaucuacgcgcaccagccccggaccgccgacgagaucccgauggagcccggcgacaucaucgggguggccggcaaccacugggacggguacagcaagggcgucaaccgcaagcuggggcggaccggccucuaccccagcuacaaggugcgcgagaagaucgagaccgugaaguaccccacguacccggaggccgagaaguga

SEQ ID NO: 30351 - RNA, 1080 nt, Artificial Sequence
  derived and/or modified sequence opt1 from FUT9__Homo_sapiens__XP_011533687
augaccagcaccuccaagggcauccugcgccccuuccucaucgugugcaucauccuggggugcuucauggccugccugcucaucuacaucaagccgacgaacagcuggaucuucucccccauggagagcgccuccagcguccugaagaugaagaacuucuucuccaccaagaccgacuacuucaacgagaccacgauccugguguggguguggcccuucggccagaccuucgaccucaccagcugccaggcgauguucaacauccaggggugccaccugaccacggaccggucccuguacaacaagagccacgccguccucauccaccaccgcgacaucuccugggaccugaccaaccugccccagcaggcccggccgcccuuccagaaguggaucuggaugaaccucgagagccccacccacacgccccagaaguccggcaucgagcaccuguucaaccugacccucaccuaccgccgggacagcgacauccaggugccguacggguuccugaccguguccaccaaccccuucgucuucgaggugcccagcaaggagaagcuggugugcugggucguguccaacuggaaccccgagcacgcccgcgugaaguacuacaacgagcucagcaaguccaucgagauccacacguacggccaggccuucggcgaguacgucaacgacaagaaccugaucccgaccaucagcacgugcaaguucuaccugagcuucgagaacuccauccacaaggacuacaucaccgagaagcucuacaacgcguuccuggccgggagcgugcccgugguccugggccccucccgggagaacuacgagaacuacauccccgccgacagcuucauccacguggaggacuacaacuccccgagcgagcucgccaaguaccugaaggagguggacaagaacaacaagcuguaccucuccuacuucaacuggcgcaaggacuucaccgucaaccugccccgguucugggagagccacgcgugccuggccugcgaccacgugaagcgccaccaggaguacaaguccguggggaaccucgagaagugguucuggaacuga

SEQ ID NO: 30352 - RNA, 1149 nt, Artificial Sequence
  derived and/or modified sequence opt1 from FUZ__Homo_sapiens__NP_001165408
augggcgaggaggggaccggcgggaccgugcaccuccugugccuggccgccagcuccggcgucccccuguucugccgcagcucccgcgggggcgcgccggcccggcagcagcuccccuucagcgugaucggcucccugaacggggugcacauguucggccagaaccuggagguccagcucagcuccgcccggacggagaacaccaccguggugcugcuggucgggcucgaggagcugaccaacauccgcaacguggagcggcugaagaaggaccuccgcgccagcuacugccugaucgacuccuuccugggcgacagcgagcucaucggggaccugacgcagugcguggacugcgucaucccgcccgagggcucccugcuccaggaggcccugagcggcuucgcggaggccgccgggaccaccuucgugucccugguggucagcggccgggugguggccgcgaccgaggggugguggcgccucggcacgcccgaggccguccugcugcccuggcucgugggcucccugccgccccagaccgcccgggacuaccccguguaccugccccacgggagccccaccgucccccaccgccuccugacccugacgcuccugccgucccuggagcucugccugcugugcggccccagcccgccccucucccagcuguacccccagcugcucgagcggugguggcagccccugcuggacccccuccgcgccugccugccccuggggccgcgggcccuccccagcggcuucccccugcacaccgacauccuggggcuccugcugcugcaccucgagcugaagcgcugccuguucaccguggagccccucggcgacaaggagccgagccccgagcagcggcgccggcugcugcgcaacuucuacacccucgugacguccacccacuucccgcccgagcccggcccgcccgagaagaccgaggacgaggucuaccaggcgcagcugccccgggccugcuaccuggugcucgggaccgaggagcccggcacgggggugcgccuggucgcccugcagcucggccugcggcgccugcuccugcugcucagcccccagucccccacccacgggcugcgcagccuggccacccacacccuccacgcccugacgccgcugcucuga

SEQ ID NO: 30353 - RNA, 633 nt, Artificial Sequence
  derived and/or modified sequence opt1 from FXN__Homo_sapiens__NP_000135
auguggacccugggccgccgggccguggccgggcuccuggcgagccccuccccggcccaggcccagacccugacgcgcgucccccggcccgccgagcucgcgccccugugcggccgccgggggcugcgcaccgacaucgacgcgaccugcaccccgcggcgcgccagcuccaaccagcggggccucaaccagaucuggaacgugaagaagcagagcguguaccugaugaaccugcgcaaguccgggacgcucggccaccccggcagccuggacgagaccaccuacgagcggcuggccgaggagacccucgacucccuggccgaguucuucgaggaccuggccgacaagcccuacacguucgaggacuacgacgucagcuucggguccggcgugcucaccgugaagcucgggggcgaccuggggaccuacgucaucaacaagcagacccccaacaagcagaucuggcugagcuccccgagcuccggccccaagcgcuacgacuggacgggcaagaacuggguguacagccacgacggggugucccugcacgagcugcucgccgccgagcugaccaaggcccugaagaccaagcucgaccugagcucccuggccuacagcggcaaggacgcguga

SEQ ID NO: 30354 - RNA, 1620 nt, Artificial Sequence
  derived and/or modified sequence opt1 from FXR1__Homo_sapiens__NP_001013456
auggccgagcugaccguggagguccgcggcagcaacggggccuucuacaagggcuucaucaaggacgugcacgaggacucccucaccguggucuucgagaacaacuggcagcccgagcgccaggugccguucaacgaggugcggcugcccccgccgcccgacaucaagaaggagaucagcgagggggacgaggucgagguguacucccgggcgaacgaccaggagcccugcggcugguggcuggccaaggugcgcaugaugaagggggaguucuacgucaucgaguacgccgccugcgacgccacguacaacgagaucgugaccuucgagcggcuccgccccgugaaccagaacaagaccgucaagaagaacaccuucuucaagugcacgguggacgugcccgaggaccugcgggaggcgugcgccaacgagaacgcccacaaggacuucaagaaggccgucggcgcgugccgcaucuucuaccaccccgagaccacccagcugaugauccucagcgccuccgaggccaccgugaagcgggugaacauccugagcgacaugcaccuccgcuccauccggacgaagcugaugcugaugagccgcaacgaggaggccaccaagcaccuggagugcaccaagcagcucgccgcggccuuccacgaggaguucgucgugcgggaggaccugaugggccuggccaucgggacccacggcuccaacauccagcaggcccgcaaggugcccggggucacggccaucgagcucgacgaggacaccggcaccuuccggaucuacggggagagcgcggacgccgugaagaaggcccgcggcuuccuggaguucguggaggacuucauccaggucccccggaaccuggugggcaaggucaucgggaagaacggcaaggugauccaggagaucguggacaaguccggggucgugcgcgugcggaucgagggcgacaacgagaacaagcucccccgcgaggacggcauggucccguucguguucguggggaccaaggagagcaucggcaacguccaggugcugcuggaguaccacaucgccuaccucaaggagguggagcagcugcggauggagcgccugcagaucgacgagcagcuccgccagaucgggucccggagcuacuccggccgcgggcggggccgccggggccccaacuacacgagcggguacggcaccaacuccgagcugagcaaccccuccgagaccgagagcgagcgcaaggacgagcugagcgacuggucccucgccggggaggacgaccgggacagccgccaccagcgggacucccgccggcgccccggcgggcggggccgcagcgucuccggcgggcggggccgcgggggcccgcgcgggggcaagagcuccaucagcuccgugcugaaggaccccgacagcaaccccuacucccugcucgacaacaccgagagcgaccagacggcggacaccgacgccuccgagagccaccacuccaccaaccggcggcgccgcagccggcgccggcgcaccgacgaggacgccgugcugauggacggcaugacggaguccgacaccgccagcgucaacgagaacgggcugggcaagcggugcgacuga

SEQ ID NO: 30355 - RNA, 2022 nt, Artificial Sequence
  derived and/or modified sequence opt1 from FXR2__Homo_sapiens__NP_004851
augggcgggcuggccagcggcggggacguggagcccggccucccggucgaggugcgcggguccaacggcgccuucuacaagggcuucgugaaggacguccacgaggacagcgugaccaucuucuucgagaacaacuggcaguccgagcgccagauccccuucggggacgugcgccugccgccgcccgcggacuacaacaaggagaucaccgagggcgacgaggucgagguguacagccgggccaacgagcaggagcccugcgggugguggcuggcccgcgugcggaugaugaagggcgacuucuacgucaucgaguacgccgccugcgacgcgacguacaacgagaucgugacccucgagcgccugcggcccgugaaccccaacccccuggccaccaagggguccuucuucaaggucaccauggccgugcccgaggaccuccgcgaggccugcagcaacgagaacgugcacaaggaguucaagaaggcgcugggcgccaacugcaucuuccugaacaucacgaacuccgagcuguucauccugagcaccaccgaggcccccgucaagcgggccucccugcucggcgacaugcacuuccgcagccugcggaccaagcugcuccugaugucccgcaacgaggaggccacgaagcaccuggagaccagcaagcagcucgcggccgccuuccaggaggaguucaccgugcgggaggaccucauggggcuggccaucggcacccacggggccaacauccagcaggcgcgcaaggugcccggcgucacggccaucgagcucggcgaggagaccugcaccuuccggaucuacggggagaccccggaggccugccgccaggcccgguccuaccuggaguucagcgaggacuccguccaggugccccgcaaccuggugggcaaggugaucgggaagaacggcaaggugauccaggagaucgucgacaagagcggggugguccgggugcgcguggagggcgacaacgacaagaagaacccccgggaggagggcaugguccccuucaucuucguggggacgcgcgagaacaucuccaacgcccaggcgcuccuggaguaccaccugagcuaccuccaggagguggagcagcugcgccuggagcggcuccagaucgacgagcagcugcgccagaucggccugggguuccggccgcccggcuccgggcgcggcagcggcgggagcgacaaggccggcuacuccaccgacgagagcuccagcuccagccuccacgccacccggaccuacgggggcuccuacgggggccgcggccgggggcgccggacgggcgggcccgccuacggccccagcuccgacgucagcaccgccuccgagaccgagagcgagaagcgcgaggagccgaaccgggcgggccccggggaccgcgacccgcccacccggggcgaggagucccgccggcgccccaccgggggccgggggcgcggcccgccgcccgcgccccggcccacgagccgcuacaacuccagcuccaucagcuccgugcugaaggaccccgacagcaaccccuacagccugcucgacaccuccgagcccgagccgcccguggacagcgagcccggcgagcccccgcccgccuccgcccgccggcgccggagccgccggcgccggaccgacgaggaccgcacggucauggacgggggccuggaguccgacgggcccaacaugaccgagaacggccuggaggacgagagccggccccagcgccggaaccgcucccggcgccggcgcaaccgggggaaccgcaccgacggcagcaucuccggcgaccggcagcccgugaccguggccgacuacaucagccgcgccgagucccagagccggcagcggcccccgcucgagcgcacgaagcccuccgaggacagccuguccgggcagaagggcgacagcgucuccaagcugcccaaggggcccagcgagaacggcgagcucagcgccccgcuggagcugggguccauggugaacggcgugagcuga

SEQ ID NO: 30356 - RNA, 279 nt, Artificial Sequence
  derived and/or modified sequence opt1 from FXYD1__Homo_sapiens__NP_001265647
auggccagccugggccacauccucguguucugcgucgggcugcugaccauggccaaggcggagucccccaaggagcacgacccguucaccuacgacuaccagagccuccagaucggcgggcuggugaucgccggcauccuguucauccucgggauccugaucgugcugucccgccggugccgcugcaaguucaaccagcagcagcggacgggcgagcccgacgaggaggagggcaccuuccgcagcuccauccggcgccucagcacccggcgccgguga

SEQ ID NO: 30357 - RNA, 201 nt, Artificial Sequence
  derived and/or modified sequence opt1 from FXYD2__Homo_sapiens__NP_001671
augaccggccugagcauggacgggggcgggucccccaagggcgacguggacccguucuacuacgacuacgagaccguccgcaacgggggccucaucuucgccggccuggccuucaucguggggcugcucauccugcugagccggcgcuuccggugcggcgggaacaagaagcgccggcagaucaacgaggacgagcccuga

SEQ ID NO: 30358 - RNA, 435 nt, Artificial Sequence
  derived and/or modified sequence opt1 from FXYD3__Homo_sapiens__NP_001129479
augggccgcggguacagcggcgcccugcaggcccgcgggggccucgaggagccccuggagcgggggcugcggggcccguccuucacccagagcccccuccacggcgcggccgccgccuaccuguccgcccagcgcgacgcgagccugcccgugcccgggcagcgguccgacaugcagaaggucacccucggccugcugguguuccucgccggguucccggugcuggacgccaacgaccuggaggacaagaacagccccuucuacuacgacuggcacucccuccaggucggcgggcugaucugcgccggcgugcugugcgcgaugggcaucaucaucgugaugagcgccaagugcaagugcaaguucgggcagaaguccggccaccaccccggggagacgcccccgcucaucacccccggcagcgcccaguccuga

SEQ ID NO: 30359 - RNA, 537 nt, Artificial Sequence
  derived and/or modified sequence opt1 from FXYD5__Homo_sapiens__NP_659003
augagccccuccggccgccugugccuccugaccaucguggggcugauccucccgacccggggccagacgcugaaggacaccaccagcuccagcuccgccgacagcaccaucauggacauccagguccccacgcgcgcccccgacgcgguguacaccgagcugcagcccaccuccccgacccccacguggcccgccgacgagacgccccagccgcagacccagacccagcagcucgaggggaccgacggcccccuggugaccgaccccgagacccacaagagcaccaaggccgcccaccccacggacgacaccaccacccuguccgagcggccgagccccuccacggacguccagaccgacccccagacccucaagcccagcggguuccacgaggacgacccguucuucuacgacgagcacacccugcgcaagcggggccugcucguggccgcggugcuguucaucacgggcaucaucauccugaccuccgggaagugccgccagcucagccggcugugccgcaaccggugccgcuga

SEQ ID NO: 30360 - RNA, 288 nt, Artificial Sequence
  derived and/or modified sequence opt1 from FXYD6__Homo_sapiens__NP_001158303
auggagcuggugcucgucuuccugugcagccugcucgcccccauggugcuggccuccgcggccgagaaggagaaggagauggacccguuccacuacgacuaccagacccugcgcaucggcgggcucguguucgccgucgugcuguucagcgugggcauccugcucauccugucccggcgcugcaagugcagcuucaaccagaagccccgggcccccggggacgaggaggcccaggucgagaaccugaucaccgcgaacgccacggagccccagaaggccgagaacuga

SEQ ID NO: 30361 - RNA, 2520 nt, Artificial Sequence
  derived and/or modified sequence opt1 from FYB__Homo_sapiens__NP_001230022
auggacggcaaggccgacgugaagagccugauggccaaguacaacaccgggggcaaccccaccgaggacgucuccgugaacagccgcccguuccgggugacggggcccaacuccagcuccggcauccaggcgcgcaagaaccucuucaacaaccaggggaacgccagcccccccgccggcccguccaacguccccaaguucggcagccccaagcccccgguggccgugaagcccuccagcgaggagaagcccgacaaggagcccaagccgcccuuccugaagcccaccggggccggccagcgguucgggacccccgcgucccugaccacgcgcgacccggaggccaaggucggcuuccucaagcccguggggcccaagcccaucaaccugccgaaggaggacagcaagcccaccuuccccuggcccccgggcaacaagcccucccugcacagcgugaaccaggaccacgaccucaagccccugggccccaaguccgggccgaccccccccaccagcgagaacgagcagaagcaggccuucccgaagcugacgggcgucaaggggaaguucauguccgccagccaggaccucgagcccaagccccuguuccccaagccggcguucggccagaagcccccccuguccaccgagaacagccacgaggacgagagccccaugaagaacguguccagcuccaagggcagcccggccccccucggggugcgguccaagagcggcccccugaagcccgcccgcgaggacuccgagaacaaggaccacgccggggagaucagcucccugccguuccccggcgucgugcucaagcccgccgcgagccgggggggccccggccuguccaagaacggggaggagaagaaggaggaccgcaagaucgacgccgccaagaacaccuuccagagcaagaucaaccaggaggagcuggccuccggcaccccgcccgcccgguuccccaaggcgcccagcaagcucacgguggggggcccgugggggcagucccaggagaaggagaagggcgacaagaacagcgccacccccaagcagaagccccugcccccgcuguucacccucggcccccccccgcccaagcccaaccgccccccgaacgucgaccugaccaaguuccacaagacguccagcgggaacuccaccagcaagggccagaccagcuacuccaccacgagccugcccccccccccgcccucccaccccgccagccagcccccgcuccccgccucccaccccagccagcccccggugcccucccugcccccccggaacaucaagccgcccuucgaccugaagagccccgugaacgaggacaaccaggacggggucacccacuccgacggcgccgggaaccucgacgaggagcaggacagcgagggcgagaccuacgaggacaucgaggcguccaaggagcgcgagaagaagcgggagaaggaggagaagaagcgccuggagcuggagaagaaggagcagaaggagaaggagaagaaggagcaggagaucaagaagaaguucaagcucaccggccccauccaggugauccaccuggccaaggccugcugcgacgugaaggggggcaagaacgagcugagcuucaagcagggggagcagaucgagaucauccggaucacggacaacccggagggcaaguggcucggccgcaccgcccggggguccuacggcuacaucaagaccaccgccgucgagaucgacuacgacagccugaagcugaagaaggacucccucggggcgcccagccgccccaucgaggacgaccaggagguguacgacgacguggccgagcaggacgacaucuccagccacagccaguccggcagcgggggcaucuuccccccgccccccgacgacgacaucuacgacggcaucgaggaggaggacgccgacgacggguccacgcugcagguccaggagaagagcaacaccugguccuggggcauccugaagaugcucaaggggaaggacgaccggaagaagagcauccgcgagaagccgaagguguccgacagcgacaacaacgagggcuccagcuuccccgccccccccaagcagcuggacaugggggacgaggucuacgacgacguggacaccuccgacuucccggugagcuccgcggagaugagccagggcaccaacgucggcaaggccaagacggaggagaaggaccugaagaagcucaagaagcaggagaaggaggagaaggacuuccggaagaaguucaaguacgacggggagauccgcgugcuguacuccaccaaggugaccaccagcaucacguccaagaaguggggcacccgcgaccugcaggucaagcccggggagagccucgaggugauccagaccaccgacgacaccaaggugcugugccggaacgaggagggcaaguacggguacguccugcgcuccuaccucgccgacaacgacggcgagaucuacgacgacaucgccgacggcugcaucuacgacaacgacuga

SEQ ID NO: 30362 - RNA, 4437 nt, Artificial Sequence
  derived and/or modified sequence opt1 from FYCO1__Homo_sapiens__NP_078789
auggccagcaccaacgccgagucccagcugcagcgcaucauccgggaccuccaggacgcggugaccgagcugagcaaggaguuccaggaggccggcgagcccaucacggacgacuccaccagccugcacaaguucuccuacaagcucgaguaccugcugcaguucgaccagaaggagaaggccacccuccuggggaacaagaaggacuacugggacuacuucugcgccugccuggccaaggucaagggcgcgaacgacgggauccgcuucgugaaguccaucuccgagcuccggaccagccugggcaaggggcgcgccuucauccgguacucccuggugcaccagcgccucgccgacacgcugcagcagugcuucaugaacaccaaggucaccagcgacugguacuacgcccgguccccguuccugcagcccaagcucagcuccgacaucgugggccagcuguacgagcugaccgaggugcaguucgaccucgcgagccgcggcuucgaccuggacgccgccuggcccacguucgcccggcgcacccugaccaccggguccagcgccuaccucuggaagcccccgucccggagcuccagcaugagcucccuggucagcuccuaccugcagacgcaggagauggugagcaacuucgaccucaacagcccccugaacaacgaggcgcuggagggcuucgacgagaugcgccucgagcuggaccagcuggaggugcgggagaagcagcuccgcgagcggaugcagcagcuggaccgcgagaaccaggagcugcgggccgccgucagccagcagggggagcagcuccagaccgagcgcgagcggggccgcaccgccgccgaggacaacgugcggcugaccugccugguggcggagcuccagaagcagugggaggucacgcaggccacccagaacaccgugaaggagcugcagaccugccugcaggggcucgagcugggcgccgccgagaaggaggaggacuaccacacggcccugcgccgccucgaguccaugcugcagccccuggcgcaggagcucgaggccacccgggacagccuggacaagaagaaccagcaccuggccuccuuccccggcuggcucgccauggcccagcagaaggcggacaccgccagcgacaccaaggggcgccaggagccgauccccuccgacgccgcccaggagaugcaggagcugggcgagaagcugcaggcgcuggagcgggagcgcacgaagguggaggaggucaaccggcagcagagcgcccagcucgagcagcuggugaaggagcugcagcucaaggaggacgcccgcgccucccuggagcggcuggugaaggagauggcgccccuccaggaggagcugagcgggaagggccaggaggcggaccagcuguggcgccggcuccaggagcugcuggcccacaccuccagcugggaggaggagcucgccgagcugcgccgggagaagaagcagcagcaggaggagaaggagcugcucgagcaggagguccgcucccugacccggcagcugcaguuccucgagacccagcuggcccaggugagccagcacguguccgaccuggaggagcagaagaagcagcucauccaggacaaggaccaccugagccagcaggucggcaugcuggagcgccucgccgggcccccgggccccgagcugcccguggcgggggagaagaacgaggcccuggugcccgucaacagcucccuccaggaggccuggggcaagccggaggaggagcagcgggggcugcaggaggcccagcuggacgacacgaaggugcaggagggcagccaggaggaggagcuccgccaggccaaccgggagcuggagaaggagcugcagaacgucgugggccgcaaccagcuccuggaggggaagcugcaggcgcuccaggccgacuaccaggcccugcagcagcgggaguccgccauccagggcagccuggcgucccucgaggccgagcaggccagcauccgccaccugggggaccagauggaggccucccugcucgccgugcgcaaggcgaaggaggccaugaaggcccagauggccgagaaggaggccauccugcagagcaaggagggcgagugccagcagcugcgggaggaggucgagcagugccagcagcucgcggaggcccgccaccgggagcugcgcgcccuggagucccagugccagcagcagacccagcucaucgaggugcugaccgccgagaaggggcagcagggcgugggcccgcccaccgacaacgaggcccgggagcuggcggcccagcucgcccugagccaggcccagcuggagguccaccagggggaggugcagcgccuccaggcccagguggucgaccugcaggccaagaugcgggccgcccuggacgaccaggacaaggugcagucccagcucagcauggccgaggcggugcugcgcgagcacaagacgcugguccagcagcucaaggagcagaacgaggcccugaaccgggcccacgugcaggagcugcuccagugcuccgagcgcgagggcgcccugcaggaggagcgggccgacgaggcgcagcagcgcgaggaggagcugcgggcccuccaggaggagcugagccaggccaagugcuccagcgaggaggcccagcuggagcacgccgagcuccaggagcagcugcaccgcgcgaacaccgacaccgccgagcuggggauccaggugugcgcccucaccgucgagaaggagcggguggaggaggcccuggccugcgcggugcaggagcugcaggacgccaaggaggccgccucccgcgagcgggagggccucgagcgccaggucgcggggcugcagcaggagaaggagagccugcaggagaagcucaaggccgccaaggccgccgcgggcagccugcccggccugcaggcccagcucgcccaggccgagcagcgggcccagucccugcaggaggcggcccaccaggagcugaacacgcucaaguuccagcugagcgccgagaucauggacuaccagucccgccugaagaacgccggggaggagugcaagagccuccggggccagcuggaggagcaggggcgccagcugcaggccgcggaggaggccguggagaagcucaaggccacccaggccgacaugggcgagaagcuguccugcaccagcaaccaccuggcggagugccaggccgccaugcuccgcaaggacaaggagggcgccgcccugcgggaggaccuggagcgcacccagaaggagcuggagaaggcgaccacgaagauccaggaguacuacaacaagcucugccaggaggugaccaaccgggagcgcaacgaccagaagaugcuggccgaccuggacgaccucaaccggaccaagaaguaccuggaggagcgccugaucgagcuccugcgggacaaggacgcccuguggcagaaguccgacgcccucgaguuccagcagaagcugagcgccgaggagcgcuggcugggggacaccgaggcgaaccacugccucgacugcaagcgggaguucuccuggaugguccgccggcaccacugccgcaucugcggccggaucuucugcuacuacugcugcaacaacuacgugcugagcaagcacgggggcaagaaggagcgcugcugccgggccugcuuccagaagcuguccgaggggcccggcagccccgacuccagcggcuccgggacgagccagggcgagcccucccccgcccucagcccggccucccccgggccccaggccaccggcgggcagggcgcgaacaccgacuaccggcccccggacgacgccguguucgacaucaucaccgacgaggagcugugccagauccaggagagcggcagcucccugcccgagacgcccaccgagaccgacagccucgacccgaacgccgccgagcaggacaccacguccaccagccugacccccgaggacaccgaggacaugcccgucgggcaggacuccgagaucugccugcucaagagcggcgagcugaugaucaaggugccccugacgguggacgagaucgcguccuucggggagggcagccgcgagcuguucguccgcuccagcaccuacucccucaucccgaucaccguggccgaggccgggcugaccaucagcuggguguucuccagcgaccccaaguccaucagcuucuccgucguguuccaggaggccgaggacacgccccucgaccagugcaaggugcugauccccaccacccggugcaacagccacaaggagaacauccagggccagcugaagguccgcaccccgggcaucuacaugcucaucuucgacaacacguucucccgcuucgugagcaagaagguguucuaccaccugaccgucgaccggcccgugaucuacgacgggagcgacuuccuguga

SEQ ID NO: 30363 - RNA, 1614 nt, Artificial Sequence
  derived and/or modified sequence opt1 from FYN__Homo_sapiens__NP_002028
augggcugcgugcagugcaaggacaaggaggccaccaagcugaccgaggagcgcgacgggagccucaaccaguccagcggcuaccgguacgggacggaccccaccccgcagcacuaccccuccuucggcgucaccagcauccccaacuacaacaacuuccacgccgccgggggccagggccugaccguguucgggggcgugaacuccagcucccacacggggacccugcgcacccggggcgggaccggcgucacccucuucguggcgcuguacgacuacgaggcccgcacggaggacgaccugagcuuccacaagggcgagaaguuccagauccucaacuccagcgagggggacuggugggaggcccggucccugaccaccggcgagacgggguacauccccagcaacuacguggccccggucgacuccauccaggcggaggagugguacuucggcaagcugggccgcaaggacgccgagcggcagcuccugagcuucgggaacccccgcggcaccuuccugauccgggaguccgagaccaccaagggggccuacagccucuccauccgcgacugggacgacaugaagggcgaccacgugaagcacuacaagauccggaagcuggacaacgggggcuacuacaucacgacccgcgcccaguucgagacccugcagcagcucgugcagcacuacagcgagcgggcggccggccugugcugccgccuggucgugcccugccacaaggggaugccccggcucaccgaccuguccgugaagacgaaggacgucugggagaucccgcgcgagagccugcagcucaucaagcggcugggcaacgggcaguucggcgagguguggauggggaccuggaacggcaacaccaagguggccaucaagacccugaagcccggcacgaugagccccgaguccuuccucgaggaggcccagaucaugaagaagcugaagcacgacaagcugguccagcucuacgccguggugagcgaggagcccaucuacaucgucaccgaguacaugaacaaggggucccugcuggacuuccucaaggacggcgaggggcgcgcgcugaagcugccgaaccucguggacauggccgcccagguggccgccggcauggcguacaucgagcggaugaacuacauccaccgcgaccugcggagcgccaacauccuggucgggaacggccucaucugcaagaucgccgacuucggccuggcccgccugaucgaggacaacgaguacaccgcccgccagggggcgaaguuccccaucaaguggaccgcccccgaggccgcccucuacggccgguucacgaucaaguccgacguguggagcuucgggauccugcugaccgagcucgugaccaagggccgcguccccuacccgggcaugaacaaccgggaggugcuggagcaggucgagcgcggguaccggaugcccugcccccaggacugccccaucucccugcacgagcucaugauccacugcuggaagaaggacccggaggagcgccccaccuucgaguaccugcagagcuuccuggaggacuacuucacggccaccgagccccaguaccagcccggcgagaaccucuga

SEQ ID NO: 30364 - RNA, 1746 nt, Artificial Sequence
  derived and/or modified sequence opt1 from FZD10__Homo_sapiens__NP_009128
augcagcgccccggcccgcggcuguggcucgugcugcaggucauggggagcugcgccgccaucuccagcauggacauggagcgccccggcgacgggaagugccagcccaucgagauccccaugugcaaggacaucggcuacaacaugacccggaugccgaaccugauggggcacgagaaccagcgcgaggcggccauccagcuccacgaguucgcgccccugguggaguacggcugccacggccaccuccgguucuuccucugcucccuguacgcccccaugugcaccgagcaggucagcacgcccaucccggccugccgcgugaugugcgagcaggcccggcugaagugcucccccaucauggagcaguucaacuucaaguggcccgacagccucgacugccgcaagcugcccaacaagaacgacccgaacuaccugugcauggaggcccccaacaacggguccgacgagcccacccggggcagcgggcuguucccgccccuguuccgcccccagcggccccacuccgcccaggagcacccccugaaggacggcgggccgggccgcggcgggugcgacaaccccggcaaguuccaccacguggagaaguccgccagcugcgcgccccucugcacccccgggguggacgucuacuggagccgggaggacaagcgcuucgccgugguguggcuggccaucugggccguccugugcuucuucuccagcgccuucaccgugcucacguuccugaucgacccggcgcgguuccgcuaccccgagcggcccaucaucuuccuguccaugugcuacugcguguacagcgucggcuaccucauccgccuguucgccggcgccgaguccaucgccugcgaccgggacagcgggcagcuguacgugauccaggagggccucgaguccaccgggugcacccugguguuccugguccucuacuacuucggcauggccagcagccugugguggguggugcugacccucacgugguuccuggcggccgggaagaaguggggccacgaggccaucgaggccaacuccagcuacuuccaccuggccgcgugggccauccccgccgucaagaccauccucauccuggugaugcgccggguggccggcgacgagcugaccggggucugcuacgugggcuccauggacgugaacgcccucaccggguucguccugaucccgcuggcgugcuaccucgugaucggcacgagcuucauccuguccggguucgucgcccuguuccacauccgccgcgugaugaagaccggcggcgagaacaccgacaagcucgagaagcugauggugcggaucgggcuguucagcguccucuacaccgugcccgccacgugcgugaucgccugcuacuucuacgagcgccugaacauggacuacuggaagauccuggcggcccagcacaagugcaagaugaacaaccagaccaagacccucgacugccugauggccgccuccauccccgccgucgagaucuucauggugaagaucuucaugcugcugguggucggcaucaccagcgggauguggaucuggacguccaagacccuccagagcuggcagcaggucugcucccggcgccugaagaagaagucccggcgcaagccggcgagcgugaucaccagcggcgggaucuacaagaaggcccagcacccccagaagacccaccacggcaaguacgagauccccgcccagucccccacgugcguguga

SEQ ID NO: 30365 - RNA, 1944 nt, Artificial Sequence
  derived and/or modified sequence opt1 from FZD1__Homo_sapiens__NP_003496
auggccgaggaggaggcccccaagaagucccgcgcggccggcgggggcgccagcugggagcugugcgccggggcccucagcgcgcggcuggccgaggagggcuccggggacgccggcggccgccggcgcccgcccguggacccccggcgccuggcccggcagcuccugcugcuccuguggcugcucgaggcgccccugcugcucgggguccgcgcccaggccgccggccaggggccgggccaggggcccggccccggccagcagcccccgcccccgccccagcagcagcagagcgggcagcaguacaacggcgagcgggggaucuccgugcccgaccacggcuacugccagcccaucagcaucccccugugcaccgacaucgccuacaaccagaccaucaugcccaaccugcucggccacacgaaccaggaggacgcggggcuggaggugcaccaguucuacccgcuggucaaggugcagugcuccgccgagcucaaguucuuccugugcagcauguacgcccccgugugcaccguccuggagcaggcccucccgcccugccgcucccugugcgagcgggcccgccagggcugcgaggcgcugaugaacaaguucggguuccaguggcccgacacccucaagugcgagaaguuccccgugcacggcgccggggagcugugcgugggccagaacaccagcgacaagggcacgcccacccccucccugcucccggaguucuggaccagcaacccccagcacgggggcgggggccaccgcgggggcuuccccggcggggccggcgccuccgagcgggggaaguucagcugcccccgggcccugaaggucccguccuaccugaacuaccacuuccucggcgagaaggacugcggggcgcccugcgagcccaccaagguguacggccugauguacuucggcccggaggagcugcgcuucagccggacguggaucgggaucugguccgugcucugcugcgccagcacccuguucaccguccugaccuaccucguggacaugcgccgguucuccuaccccgagcgccccaucaucuuccugagcggcugcuacacggccguggccgucgccuacaucgcgggguuccugcucgaggaccggguggugugcaacgacaaguucgccgaggacggcgcccgcaccgucgcccagggcaccaagaaggaggggugcaccauccuguucaugaugcuguacuucuucagcauggcguccagcaucuggugggugauccucucccugacgugguuccuggccgccggcaugaagugggggcacgaggccaucgaggccaacagccaguacuuccaccucgcggccugggccgugcccgccaucaagaccaucaccauccuggcccugggccaggucgacggggacgugcucuccggcgugugcuucgucggccugaacaacguggacgcgcugcgcggguucguccuggccccgcuguucguguaccuguucaucggcaccagcuuccugcucgccggguucgugucccuguuccggauccgcacgaucaugaagcacgacggcaccaagaccgagaagcuggagaagcucaugguccggaucgggguguucagcgugcuguacaccguccccgccacgaucgugaucgccugcuacuucuacgagcaggcguuccgcgaccagugggagcgguccuggguggcccagagcugcaaguccuacgccauccccugcccccaccuccaggccggcggcggggcgccgccccacccgcccaugagccccgacuucaccgucuucaugaucaaguaccucaugacccugaucgugggcaucaccuccggguucuggaucuggagcggcaagacgcugaacuccuggcgcaaguucuacacccggcucaccaacagcaagcagggggagaccacgguguga

SEQ ID NO: 30366 - RNA, 1698 nt, Artificial Sequence
  derived and/or modified sequence opt1 from FZD2__Homo_sapiens__NP_001457
augcgcccccggagcgcccugccgcgccuccugcugccccuccugcugcuccccgccgcgggccccgcccaguuccacggggagaagggcaucuccaucccggaccacggguucugccagcccaucagcaucccccugugcaccgacaucgccuacaaccagaccaucaugcccaaccugcucggccacacgaaccaggaggacgccgggcuggaggugcaccaguucuacccgcuggucaaggugcagugcucccccgagcuccgguucuuccugugcagcauguacgcccccgugugcaccguccuggagcaggcgaucccgccgugccgcuccaucugcgagcgggcccgccagggcugcgaggcccucaugaacaaguucggcuuccaguggcccgagcggcugcgcugcgagcacuucccccggcacggggccgagcagaucugcgugggccagaaccacagcgaggacggggcgcccgcccugcucaccaccgccccgccgcccggccugcagcccggggccggcggcacgcccgggggccccgggggcggcggggccccgccccgcuacgcgacccuggagcaccccuuccacugcccccgggugcucaagguccccuccuaccugagcuacaaguuccugggcgagcgcgacugcgccgcccccugcgagcccgcccggcccgacggguccauguucuucagccaggaggagacccgcuucgcccggcucuggauccugaccugguccgugcugugcugcgcgagcacguucuucaccgugaccaccuaccucgucgacaugcagcgcuuccgguaccccgagcgcccgaucaucuuccuguccggcugcuacacgauggugagcguggccuacaucgccggguucguccugcaggagcggguggugugcaacgagcgcuucuccgaggacggcuaccggaccgucgugcagggcaccaagaaggaggggugcaccauccucuucaugaugcuguacuucuucagcauggccuccagcaucuggugggugauccugucccucacgugguuccuggccgcgggcaugaagugggggcacgaggccaucgaggccaacagccaguacuuccaccuggccgccugggcgguccccgccgugaagaccaucaccauccucgccaugggccagaucgacggggaccugcugagcggcgugugcuucgucggccucaacucccuggacccccugcgcggguucgugcucgcgccccuguucguguaccuguucaucggcaccagcuuccuccuggccggguucgucucccuguuccgcauccggacgaucaugaagcacgacggcaccaagaccgagaagcucgagcgccugauggugcggaucggggucuucagcgugcuguacaccgugccggccacgaucgucaucgccugcuacuucuacgagcaggccuuccgcgagcacugggagcgguccugggugagccagcacugcaagucccuggccauccccugccccgcgcacuacacgccccgcaugagcccggacuucaccguguacaugaucaaguaccucaugacccugaucgucggcaucaccuccggcuucuggaucuggagcgggaagacccugcacuccuggcggaaguucuacacccgccucaccaacagccggcacggcgagacgaccguguga

SEQ ID NO: 30367 - RNA, 2001 nt, Artificial Sequence
  derived and/or modified sequence opt1 from FZD3__Homo_sapiens__NP_665873
auggccaugaccuggaucguguucagccuguggccccucaccgucuucaugggccacaucgggggccacucccuguucagcugcgagccgaucacgcugcgcaugugccaggaccuccccuacaacaccaccuucaugcccaaccugcugaaccacuacgaccagcagaccgccgcgcucgccauggagcccuuccacccgauggugaaccuggacugcucccgggacuuccgccccuuccugugcgcccucuacgcccccaucugcauggaguacgggcgggugacgcugcccugccgccggcugugccagcgcgccuacagcgagugcuccaagcucauggagauguucggcgucccguggcccgaggacauggagugcagccgguuccccgacugcgacgagcccuacccgcgccugguggaccugaaccucgcgggggagcccaccgagggcgcccccguggccguccagcgggacuacggcuucuggugcccccgcgagcugaagaucgacccggaccugggguacuccuuccuccacgugcgggacugcagcccgcccugccccaacauguacuuccgccgggaggagcuguccuucgcccgcuacuucaucggccugaucagcaucaucugccucuccgcgacccuguucaccuuccugacguuccucaucgacgugacccgguuccgcuaccccgagcggcccaucaucuucuacgccgucugcuacaugauggugagccugaucuucuucaucggguuccugcucgaggaccgcguggccugcaacgccuccauccccgcccaguacaaggcgagcaccgucacccagggcucccacaacaaggccugcacgaugcuguucaugauccuguacuucuucaccauggccgggagcguguggugggugauccucaccaucaccugguuccuggccgccguccccaaguggggcuccgaggcgaucgagaagaaggcccuccuguuccacgccagcgccuggggcaucccggggacgcugaccaucauccugcucgccaugaacaagaucgagggcgacaacaucuccggggugugcuucgugggccuguacgacgucgacgcgcugcgguacuucgugcucgcgccccugugccuguacguggucgugggcgugagccuccugcuggccgggaucaucagccucaaccgcguccggaucgagaucccccuggagaaggagaaccaggacaagcuggugaaguucaugauccgcaucggcgucuucuccauccucuaccuggugccccugcugguggucaucgggugcuacuucuacgagcaggccuaccgcggcaucugggagaccaccuggauccaggagcggugccgcgaguaccacaucccgugccccuaccaggugacgcagaugagccggcccgaccucauccuguuccugaugaaguaccucauggcccugaucguggggaucccguccgucuucugggugggcagcaagaagaccugcuucgagugggccuccuucuuccacggccgccggaagaaggagaucgugaacgagagccgccagguccugcaggagcccgacuucgcccagucccuccugcgggaccccaacacccccaucauccgcaagagccgggggaccuccacgcagggcaccagcacccacgccuccagcacccagcuggccaugguggacgaccagcgcuccaaggcggggagcauccacuccaaggugagcuccuaccacggcagccuccaccggucccgcgacgggcgguacacgccgugcagcuaccgcggcauggaggagcggcugccccacggcagcaugucccgccugaccgaccacagccggcacuccagcucccaccgccucaacgagcagagccggcacuccagcauccgcgaccuguccaacaaccccaugacccacaucacccacgggacgagcaugaaccgcgucaucgaggaggacggcaccuccgccuga

SEQ ID NO: 30368 - RNA, 1614 nt, Artificial Sequence
  derived and/or modified sequence opt1 from FZD4__Homo_sapiens__NP_036325
auggccuggcgcggcgccgggcccagcgugccgggcgcccccgggggcgucgggcugucccucggccugcugcuccagcugcugcuccugcugggccccgcccggggguucggcgacgaggaggagcgccggugcgaccccauccgcaucagcaugugccagaaccucggguacaacgugaccaagaugccgaaccuggugggccacgagcugcagaccgacgccgagcuccagcugacgaccuucacgccccugauccaguacgggugcuccagccagcuccaguucuuccugugcuccgucuacgugcccaugugcaccgagaagaucaacauccccaucggcccgugcggcgggaugugccugagcgugaagcggcgcugcgagcccguccucaaggaguucggcuucgccuggcccgagucccugaacugcagcaaguucccgccccagaacgaccacaaccacaugugcauggaggggcccggcgacgaggaggugccccugccccacaagaccccgauccagcccggcgaggagugccacuccguggggaccaacagcgaccaguacaucugggucaagcggucccucaacugcgugcugaagugcggcuacgacgccgggcuguacagccgcuccgcgaaggaguucaccgacaucuggauggccgugugggccagccucugcuucaucuccaccgccuucacgguccugaccuuccugaucgacagcucccgguucagcuaccccgagcgccccaucaucuuccucuccaugugcuacaacaucuacagcaucgcguacaucgugcggcugaccgugggccgcgagcggaucagcugcgacuucgaggaggccgccgagccgguccugauccaggaggggcucaagaacaccggcugcgccaucaucuuccugcugauguacuucuucggcauggccuccagcaucuggugggugauccucacgcugaccugguuccuggcggccgggcucaaguggggccacgaggccaucgagaugcacuccagcuacuuccacaucgccgccugggcgauccccgccgugaagaccaucgucauccugaucaugcgccugguggacgccgacgagcucaccgggcugugcuacgugggcaaccagaaccuggacgcccucacgggguucgucguggcgccccuguucaccuaccuggugaucggcacccucuucaucgcggccggccuggucgcccuguucaagauccgguccaaccuccagaaggacgggaccaagacggacaagcuggagcgccugauggugaagaucggcgucuucagcgugcuguacaccgugcccgcgaccugcgucaucgccugcuacuucuacgagaucuccaacugggcccucuuccgguacagcgccgacgacuccaacauggccguggagaugcugaagaucuucaugagccugcucguggggaucaccuccggcauguggaucuggagcgccaagacgcugcacaccuggcagaagugcuccaaccgccuggucaacagcgggaaggugaagcgggagaagcgcggcaacggcugggugaagccggggaagggcuccgagaccgucguguga

SEQ ID NO: 30369 - RNA, 1758 nt, Artificial Sequence
  derived and/or modified sequence opt1 from FZD5__Homo_sapiens__NP_003459
auggcccgccccgacccgagcgccccgcccucccugcuccugcugcuccuggcgcagcuggugggccgggccgccgccgccagcaaggcgcccgugugccaggagaucaccgugcccaugugccgcgggaucggcuacaaccucacccacaugcccaaccaguucaaccacgacacgcaggacgaggccgggcuggaggugcaccaguucuggccccuggucgagauccagugcucccccgaccuccgguucuuccugugcagcauguacaccccgaucugccugcccgacuaccacaagccccugcccccgugccgcuccgugugcgagcgggccaaggccggcugcagcccccucaugcgccaguacggguucgcguggcccgagcggauguccugcgaccgccugcccgugcucggccgggacgccgagguccugugcauggacuacaaccgcagcgaggccaccaccgccccgccccggcccuuccccgccaagccgacgcugcccggcccgcccggggcgcccgccuccggcggggagugccccgccggcgggcccuucgugugcaagugccgcgagcccuucgugccgauccucaaggagagccacccccuguacaacaagguccggaccggccaggugcccaacugcgccgugccgugcuaccagcccuccuucagcgccgacgagcgcaccuucgcgaccuucuggaucggccugugguccguccucugcuucaucagcacguccaccaccguggccaccuuccugaucgacauggagcgguuccgcuaccccgagcggcccaucaucuuccugagcgccugcuaccucugcgugucccugggguuccugguccgccucguggugggccacgccagcgucgccugcucccgggagcacaaccacauccacuacgagacgaccgggccggcgcugugcaccaucguguuccugcucguguacuucuucggcauggccagcagcaucuggugggucauccugucccugaccugguuccucgccgccggcaugaagugggggaacgaggccaucgcgggcuacgcccaguacuuccaccuggccgccuggcugauccccagcgugaaguccaucacggcgcucgcccugagcuccguggacggggaccccgucgccggcaucugcuacguggggaaccagaaccugaacagccuccgcggcuucguccugggcccccuggugcucuaccugcugguggggacccucuuccugcuggccggcuucgucucccucuuccggauccgcagcgugaucaagcagggcgggaccaagaccgacaagcuggagaagcugaugauccgcaucgggaucuucacgcugcucuacaccgugccggccuccaucgucguggcgugcuaccuguacgagcagcacuaccgggagagcugggaggccgcccugaccugcgccugccccggccacgacaccggccagccccgcgccaagcccgaguacugggugcucaugcugaaguacuucaugugccuggucguggggaucacguccggcguguggaucuggagcgggaagaccgucgaguccuggcggcgcuucaccagccggugcugcugccgcccgcggcgcggccacaaguccgggggcgcgauggccgccggcgacuaccccgaggccagcgccgcgcucaccgggcggacgggcccgcccgggcccgccgccaccuaccacaagcaggucucccugagccacguguga

SEQ ID NO: 30370 - RNA, 2025 nt, Artificial Sequence
  derived and/or modified sequence opt1 from FZD6__Homo_sapiens__NP_001158088
augaagauggccuacaacaugaccuucuuccccaaccugaugggccacuacgaccagagcaucgccgcgguggagauggagcacuuccucccgcuggccaaccuggagugcucccccaacaucgagaccuuccucugcaaggccuucguccccacgugcaucgagcagauccacguggugcccccgugccgcaagcugugcgagaaggucuacagcgacugcaagaagcugaucgacaccuucgggauccgguggcccgaggagcucgagugcgaccgccugcaguacugcgacgagaccgugcccgugaccuucgacccccacacggaguuccugggcccgcagaagaagaccgagcagguccagcgggacaucggguucuggugcccccgccaccucaagaccuccggcgggcagggcuacaaguuccugggcaucgaccagugcgccccgcccugccccaacauguacuucaagagcgacgagcuggaguucgccaaguccuucaucgggaccgugagcaucuucugccucugcgcgacgcuguucaccuuccugaccuuccucaucgacgugcggcgcuuccgguaccccgagcgccccaucaucuacuacuccgucugcuacagcaucgugucccugauguacuucaucggcuuccugcucggggacagcaccgccugcaacaaggccgacgagaagcuggagcugggcgacacggugguccucgggucccagaacaaggccugcaccgugcuguucaugcugcucuacuucuucaccauggcgggcaccguguggugggucauccugacgaucaccugguuccuggccgccggccggaaguggagcugcgaggccaucgagcagaaggccgugugguuccacgcgguggccugggggacccccggcuuccucaccgucaugcugcuggccaugaacaagguggagggggacaacaucuccggcgugugcuucgucggccucuacgaccuggacgccagccgcuacuucgugcugcucccgcugugccugugcguguucgucgggcucucccugcugcucgccggcaucaucagccugaaccacgugcggcaggucauccagcacgacgggcgcaaccaggagaagcugaagaaguucaugauccggaucggcguguucuccgggcucuaccuggugccccuggucacgcuccugggcugcuacguguacgagcaggucaaccgcaucaccugggagaucaccugggugagcgaccacugccggcaguaccacauccccugccccuaccaggcgaaggccaaggcccgcccggagcuggcccucuucaugaucaaguaccugaugacccugaucgugggcaucuccgccguguucugggucgggagcaagaagacgugcaccgagugggcgggcuucuucaagcggaaccgcaagcgggaccccaucagcgagucccgccgggugcugcaggagagcugcgaguucuuccucaagcacaacuccaaggugaagcacaagaagaagcacuacaagcccagcucccacaagcugaaggucaucagcaaguccauggggaccagcaccggcgccacggccaaccacgggaccuccgccguggccaucaccagccacgacuaccugggccaggagacccucacggagauccagaccucccccgagaccagcaugcgcgaggugaaggcggacggcgccuccaccccgcgccugcgggagcaggacugcggggagcccgccagccccgccgcguccaucagccgccuguccggcgagcaggucgacgggaagggccaggccgggagcguguccgagagcgcccggagcgagggccgcaucucccccaagagcgacaucacggacaccggccucgcccaguccaacaaccuccaggugccgagcuccagcgagcccuccagccugaagggguccaccagccugcugguccaccccguguccggcgugcggaaggagcagggcgggggcugccacagcgacaccuga

SEQ ID NO: 30371 - RNA, 1725 nt, Artificial Sequence
  derived and/or modified sequence opt1 from FZD7__Homo_sapiens__NP_003498
augcgcgaccccggcgccgccgcgccccugagcucccucgggcugugcgcccuggugcucgcccugcugggcgcccucagcgccggggcgggcgcccagcccuaccacggggagaagggcaucuccguccccgaccacggcuucugccagcccaucagcaucccgcugugcaccgacaucgccuacaaccagaccauccugcccaaccuccuggggcacacgaaccaggaggacgccggccuggaggugcaccaguucuacccccucgugaagguccagugcucccccgagcugcgguucuuccugugcagcauguacgcgccggugugcaccgugcucgaccaggccaucccgcccugccgcucccugugcgagcgggcccgccaggggugcgaggcccugaugaacaaguucggcuuccaguggcccgagcggcuccgcugcgagaacuuccccguccacggggccggcgagaucugcgugggccagaacaccagcgacggguccggcgggcccggcggcgggcccaccgcguaccccacggccccguaccugcccgaccugcccuucaccgcccugcccccgggcgccagcgacgggcggggccgccccgccuuccccuucuccugcccccggcagcucaaggugccgcccuaccugggguaccgcuuccucggcgagcgggacugcggcgcgcccugcgagcccgggcgcgccaacggccugauguacuucaaggaggaggagcggcgcuucgcccggcugugggucgggguguggagcgugcucugcugcgccuccacccuguucaccguccugacguaccucguggacaugcgccgguucagcuacccggagcgccccaucaucuuccuguccggcugcuacuucaugguggccgucgcgcacguggccggguuccugcucgaggaccgggccgugugcgucgagcgcuucagcgacgacggcuaccggaccguggcccagggcaccaagaaggaggggugcaccauccuguucauggugcuguacuucuucggcauggccuccagcaucuggugggucauccucucccugacgugguuccuggcggccgggaugaaguggggccacgaggccaucgaggccaacagccaguacuuccaccucgcggccugggccgugcccgccgugaagaccaucaccauccuggccauggggcaggucgacggcgaccugcucagcggcgugugcuacgucgggcuguccagcguggacgcgcugcgcggcuucgugcucgccccgcuguucgucuaccuguucaucgggaccuccuuccuccuggccggcuucgugagccuguuccgcauccggacgaucaugaagcacgacggcaccaagaccgagaagcuggagaagcucauggugcgcaucggggucuucuccgugcuguacaccgugcccgccacgaucguccuggccugcuacuucuacgagcaggcguuccgggagcacugggagcgcaccuggcuccugcagaccugcaagagcuacgccgugcccugcccgcccggccacuucccgcccaugucccccgacuucaccguguucaugaucaaguaccugaugacgaugaucgucgggaucaccaccggcuucuggaucuggagcgggaagacccuccaguccuggcggcgcuucuaccaccggcugagccacuccagcaagggcgagacggccguguga

SEQ ID NO: 30372 - RNA, 2085 nt, Artificial Sequence
  derived and/or modified sequence opt1 from FZD8__Homo_sapiens__NP_114072
auggaguggggcuaccugcucgaggugaccagccugcuggccgcccucgcgcugcugcagcgcuccagcggggccgccgccgccuccgcgaaggagcucgccugccaggagaucaccgucccccugugcaagggcaucggguacaacuacacguacaugccgaaccaguucaaccacgacacccaggacgaggccggccuggaggugcaccaguucuggccccucguggagauccagugcagccccgaccugaaguucuuccugugcuccauguacacccccaucugccucgaggacuacaagaagccgcugccgcccugccggagcgucugcgagcgcgccaaggcggggugcgcgccccugaugcggcaguacggcuucgccuggccggaccgcaugcggugcgaccgccuccccgagcagggcaaccccgacacccugugcauggacuacaaccggacggaccugaccaccgccgcccccuccccgccccgccggcucccgccgcccccgcccggggagcagccgcccagcggcuccgggcacggccgcccgcccggggcccggccgccccaccgcggcggcgggcggggcgggggcggcggggacgccgccgccccgcccgcccgcggcgggggcgggggcggcaaggcgcggccgcccgggggcggggccgcccccugcgagcccggcugccagugccgcgcccccauggugagcguguccagcgagcggcacccccuguacaaccgcgucaagaccgggcagaucgccaacugcgcgcugcccugccacaaccccuucuucucccaggacgagcgggccuucacgguguucuggaucggccucuggagcgugcugugcuucgucuccaccuucgccaccgugagcaccuuccugaucgacauggagcgcuucaaguaccccgagcggcccaucaucuuccucuccgccugcuaccuguucgugagcgucggcuaccuggugcgccucguggccgggcacgagaaggucgcgugcuccggcggggcccccggcgccgggggcgccggcggggcgggcggggccgccgccggcgccggcgcggccggggccggcgccgggggccccgggggccgcggcgaguacgaggagcugggggccguggagcagcacgugcgguacgagacgaccggccccgcgcugugcaccgucguguuccuccugguguacuucuucgggauggccagcagcaucuggugggucauccugucccucaccugguuccuggccgccggcaugaagugggggaacgaggccaucgcgggcuacagccaguacuuccaccuggccgccuggcucgugcccuccgucaagagcaucgccgugcuggcgcuguccagcguggacggcgaccccgucgccgggaucugcuacgugggcaaccagucccucgacaaccugcgcggguucgugcuggcgccccucgucaucuaccuguucaucggcacgauguuccugcucgccggguucgugagccuguuccggauccgcuccgugaucaagcagcaggacggccccaccaagacccacaagcuggagaagcucaugauccggcugggccuguucaccguccuguacacggugcccgccgccguggucguggccugccucuucuacgagcagcacaaccgcccccggugggaggccacccacaacugccccugccugcgcgaccugcagcccgaccaggcccggcgccccgacuacgccguguucaugcucaaguacuucaugugccuggucguggggaucaccagcggcgugugggucugguccgggaagacccuggagagcuggcggucccucugcacgcgcugcugcugggcgagcaagggcgccgccgucgggggcggcgccggggccaccgcggccggcgggggcggcgggcccggcgggggcgggggcggcgggcccggcgggggcgggggcccgggcgggggcgggggcucccuguacagcgacguguccaccgggcugaccuggcggagcggcacggccuccagcgugagcuaccccaagcagaugccccucucccagguguga

SEQ ID NO: 30373 - RNA, 1776 nt, Artificial Sequence
  derived and/or modified sequence opt1 from FZD9__Homo_sapiens__NP_003499
auggccguggcgccccugcgcggcgcccuccugcuguggcagcuccuggccgccgggggcgccgcccuggagaucgggcgguucgacccggagcgcggccgcggggcggcccccugccaggccgucgagauccccaugugccggggcaucggcuacaaccucacccggaugcccaaccugcuggggcacaccagccagggcgaggccgcggccgagcucgccgaguucgccccgcuggugcaguacgggugccacucccaccuccgcuucuuccugugcagccuguacgcccccaugugcacggaccagguguccacccccauccccgcgugccggccgaugugcgagcaggcccgccugcggugcgcccccaucauggagcaguucaacuucggcuggcccgacagccucgacugcgcccgccugcccacccggaacgacccgcacgcccugugcauggaggcgcccgagaacgccaccgccgggcccgccgagccccacaagggccucggcaugcugccggucgcgccccgccccgcccggcccccgggggaccugggccccggggccggcggcuccgggacgugcgagaaccccgagaaguuccaguacguggagaagucccgcagcugcgcgccccggugcggcccggggguggaggucuucuggagccgccgggacaaggacuucgcccucguguggauggccgugugguccgcccugugcuucuucagcaccgccuucaccguccugaccuuccuccuggagccccaccgcuuccaguaccccgagcggcccaucaucuuccuguccaugugcuacaacguguacagccucgccuuccugauccgcgccguggcgggcgcccaguccgucgccugcgaccaggaggccggggcccuguacgugauccaggagggccucgagaacacgggcugcacccugguguuccugcuccuguacuacuucgggauggcgagcucccuguggugggucgugcucacccugaccugguuccuggccgccggcaagaagugggggcacgaggccaucgaggcccacggcagcuacuuccacauggcggccugggggcucccggcccugaagacgaucgugauccugacccuccggaaggucgccggcgacgagcugaccggccugugcuacguggccuccaccgacgcggccgcccucacgggguucgugcuggucccccugagcggcuaccucgugcugggguccagcuuccugcugaccggcuucguggcccucuuccacauccgcaagaucaugaagaccgggggcaccaacacggagaagcuggagaagcugauggucaagaucggcguguucagcauccucuacaccguccccgcgaccugcgugaucgugugcuacgucuacgagcgccugaacauggacuucuggcggcugcgcgccaccgagcagccgugcgccgccgccgcggggcccggcgggcggcgcgacugcucccuccccggcggcagcgugcccacgguggccgucuucaugcugaagaucuucaugucccuggugguggggaucaccagcggcgucugggugugguccagcaagaccuuccagaccuggcagucccucugcuaccggaagaucgccgccgggcgcgcccgggcgaaggccugccgcgccccgggcagcuacgggcggggcacgcacugccacuacaaggcccccaccgugguccugcacaugaccaagaccgaccccucccuggagaaccccacgcaccucuga

SEQ ID NO: 30374 - RNA, 1215 nt, Artificial Sequence
  derived and/or modified sequence opt1 from FZR1__Homo_sapiens__NP_001129669
auggaccaggacuacgagcgccggcugcuccgccagaucgugauccagaacgagaacaccaugccccgggucaccgagaugcgccggacgcugaccccggccagcucccccgugagcucccccagcaagcacggcgaccgcuucauccccucccgggccggggcgaacuggagcgugaacuuccaccgcaucaacgagaacgagaaguccccgagccagaaccggaaggccaaggacgccaccuccgacaacggcaaggacgggcuggccuacagcgcccuccugaagaacgagcugcucggcgcggggaucgagaagguccaggacccccagaccgaggaccgccggcugcagcccuccacgcccgagaagaagggccuguucaccgugacccgccucugcgaccugagcguggagggcgacuccgucaccagcguggggugguccgagcggggcaaccugguggccgucgggacgcacaagggcuucgugcagaucugggacgccgccgcggggaagaagcucagcaugcuggagggccacaccgcccgcgugggcgcccuggccuggaacgccgagcagcucuccagcgggucccgggaccgcaugauccugcagcgggacauccgcaccccgccccugcagagcgagcggcgccuccagggccaccggcaggaggucugcgggcugaaguggagcaccgaccaccagcugcucgcguccggcggcaacgacaacaagcugcugguguggaaccacagcucccucagccccgugcagcaguacacggagcaccuggccgccgucaaggccaucgccuggagcccccaccagcacgggcugcucgcguccggcgggggcaccgccgaccgcugcauccgcuucuggaacacccugaccgggcagccgcugcagugcaucgacacgggcucccaggugugcaaccucgccuggagcaagcacgccaacgagcugguguccacccacggcuacagccagaaccagauccuggucuggaaguaccccucccucacccagguggccaagcugaccgggcacagcuaccgggugcuguaccucgcgaugucccccgacggcgaggccaucgucacgggggccggcgacgagacccugcgcuucuggaacguguucagcaagacccgguccaccaaggagagcguguccguccugaaccucuucacgcgcauccgguga

SEQ ID NO: 30375 - RNA, 312 nt, Artificial Sequence
  derived and/or modified sequence opt1 from G0S2__Homo_sapiens__NP_056529
auggagaccgugcaggagcugaucccccucgccaaggagaugauggcccagaagcgcaagggcaagauggucaagcuguacgugcuggggagcgugcucgcgcuguucggcgucgugcuggggcucauggagaccgugugcuccccguucacggccgcccggcgccugcgggaccaggaggccgccgucgcggagcugcaggccgcccucgagcgccaggcccugcagaagcaggcgcugcaggagaagggcaagcagcaggacaccgugcucgggggccgggcccugagcaaccgccagcacgccuccuga

SEQ ID NO: 30376 - RNA, 2121 nt, Artificial Sequence
  derived and/or modified sequence opt1 from G2E3__Homo_sapiens__NP_060239
augaacgagagcaagcccggcgacucccagaaccuggccugcguguucugccgcaagcacgacgacugcccgaacaaguacggggagaagaagaccaaggagaaguggaaccucaccguccacuacuacugccugcugaugagcuccggcaucuggcagcgggggaaggaggaggagggcguguacggguuccucaucgaggacauccgcaaggaggugaaccgggccagcaagcugaagugcugcgucugcaagaagaacggcgcguccaucggcugcguggcgccccgcugcaagcggagcuaccacuuccccugcgggcugcagcgcgagugcaucuuccaguucacgggcaacuucgccuccuucugcugggaccaccggcccgugcagaucaucaccagcaacaacuaccgcgagucccucccgugcaccaucugccuggaguucaucgagcccauccccagcuacaacauccugcggucccccugcugcaagaacgccugguuccaccgcgacugccuccagguccaggccaucaacgccgggguguucuucuuccggugcaccaucugcaacaacagcgacaucuuccagaaggagaugcugcgcaugggcauccacaucccggagaaggacgccuccugggagcuggaggagaacgccuaccaggagcuccugcagcacuacgagcggugcgacgugcgccggugccgcugcaaggaggggcgggacuacaacgcccccgacagcaagugggagaucaagcgcugccagugcugcggcuccagcggcacgcaccuggcgugcuccagccuccgguccugggagcagaacugggagugccuggagugccgcgggaucaucuacaacagcggcgaguuccagaaggccaagaagcacguccugcccaacagcaacaacguggggaucaccgacugccuccuggaggaguccagccccaagcugccgcggcagucccccggcagccaguccaaggaccuccugcgccagggcagcaaguuccgccggaacguguccacccugcucaucgagcugggguuccagaucaagaagaagaccaagcgccuguacaucaacaaggccaacaucuggaacagcgcccucgacgccuuccggaaccgcaacuucaaccccuccuacgcgaucgaggucgccuacgugaucgagaacgacaacuucggcagcgagcaccccggguccaagcaggaguuccugagccugcucaugcagcaccuggagaacuccagccuguucgagggcucccucagcaagaaccugucccugaacagccaggcccucaaggagaaccuguacuacgaggccgggaagaugcuggccaucucccucgugcacggcggcccgagccccggguucuucagcaagacgcuguucaacugccuggucuacggccccgagaacacccagcccauccucgacgacguguccgacuucgacguggcgcagaucaucauccggaucaacaccgccaccacggucgccgaccucaagagcaucaucaacgagugcuacaacuaccuggagcugaucgggugccugcgccugaucaccacccucuccgacaaguacaugcuggugaaggacauccugggcuaccacgugauccagcggguccacaccccguucgagagcuucaagcaggggcugaagacgcucggcgugcuggagaagauccaggccuaccccgaggccuucugcuccauccugugccacaagcccgagagccucuccgcgaagauccugagcgagcuguucaccgugcacacccuccccgacgucaaggcccugggcuucuggaacuccuaccugcaggccguggaggacggcaagagcaccacgaccauggaggacauccucaucuucgccaccgggugcuccagcaucccgcccgccggguucaagcccacccccuccaucgagugccugcacgucgacuucccggugggcaacaagugcaacaacugccuggcgauccccaucacgaacaccuacaaggaguuccaggagaacauggacuucaccauccgcaacacccuccggcuggagaaggaggagagcucccacuacaucgggcacuga

SEQ ID NO: 30377 - RNA, 1401 nt, Artificial Sequence
  derived and/or modified sequence opt1 from G3BP1__Homo_sapiens__XP_006714813
auggugauggagaagcccagcccgcugcuggucggccgcgaguucgugcggcaguacuacacccugcugaaccaggcccccgacaugcuccaccgcuucuacgggaagaacuccagcuacgugcacggcgggcuggacuccaacggcaagcccgccgacgcggucuacgggcagaaggagauccaccggaaggugaugagccagaacuucaccaacugccacacgaagauccgccacguggacgcccacgccacccugaacgacggcgucguggugcaggucaugggccuccuguccaacaacaaccaggcccugcggcgcuucaugcagaccuucgugcucgcccccgaggggagcguggcgaacaaguucuacguccacaacgacaucuuccgguaccaggacgagguguucggcggguucgugaccgagccgcaggaggaguccgaggaggaggucgaggagcccgaggagcgccagcagacgcccgagguggugcccgacgacagcggcaccuucuacgaccaggccgucguguccaacgacauggaggagcaccuggaggagccgguggccgagcccgagcccgaccccgagccggagcccgagcaggagcccgucagcgagauccaggaggagaagcccgagccggugcuggaggagaccgcccccgaggacgcgcagaaguccagcucccccgcccccgccgacaucgcccagaccgugcaggaggaccuccggacguucagcugggccuccgucaccagcaagaaccugccgcccuccggggcggugcccgucaccggcaucccgccccacguggugaagguccccgccagccagccccgccccgaguccaagccggagagccagaucccgccccagcggccccagcgcgaccagcgggugcgcgagcagcggaucaacaucccgccccagcgcggcccccggcccauccgcgaggccggggagcagggcgacaucgagccccggcgcauggugcggcaccccgacagccaccagcuguucaucgggaaccucccccacgaggucgacaaguccgagcugaaggacuucuuccagagcuacggcaacgugguggagcugcgcaucaacuccggcgggaagcucccgaacuucggcuucgucguguucgacgacagcgagcccgugcagaagguccuguccaaccgccccaucauguuccgcggggaggugcggcugaacguggaggagaagaagacccgggccgcccgcgagggcgaccggcgcgacaaccggcuccgcgggcccggcggcccgcgcgggggccucgggggcgggaugcggggcccgccccggggcgggaugguccagaagcccggcuucggggugggccgcgggcuggcgccccggcaguga

SEQ ID NO: 30378 - RNA, 465 nt, Artificial Sequence
  derived and/or modified sequence opt1 from G6PC2__Homo_sapiens__NP_001075155
auggacuuccugcaccgcaacggcgugcucaucauccagcaccuccagaaggacuaccgggccuacuacaccuuccugaacuucaugagcaacgucggggacccccgcaacaucuucuucaucuacuucccgcugugcuuccaguucaaccagaccgugggcacgaagaugaucuggguggccgucaucggggacuggcugaaccugaucuucaaguggauccucuucggccaccggcccuacuggugggugcaggagacccagaucuaccccaaccacuccagccccugccuggagcaguucccgacgaccugcgagaccgggcccggcucccccagcggccacgcgaugggggccuccugcgugugguacgucauggugaccgccgcccugagccacaccgugugcggcauggacaaguucuccaucacccuccaccgccacgccgggggccgggggcuguga

SEQ ID NO: 30379 - RNA, 1041 nt, Artificial Sequence
  derived and/or modified sequence opt1 from G6PC3__Homo_sapiens__NP_612396
auggagagcacccugggcgccgggaucgugaucgccgaggcccuccagaaccagcuggccuggcuggagaacgucuggcucuggaucaccuuccugggcgaccccaagauccuguuccucuucuacuucccggccgccuacuacgccucccgccggguggggaucgcggugcuguggaucagccugaucacggaguggcucaaccugaucuucaagugguuccuguucggcgaccgccccuucugguggguccacgaguccggguacuacagccaggcccccgcccaggugcaccaguuccccuccagcugcgagaccggcccgggcucccccagcgggcacugcaugaucaccggcgccgcgcucuggcccaucaugaccgcccuguccagccagguggccacgcgggcccgcucccgguggguccgcgugaugcccagccuggccuacugcaccuuccuccuggcgguggggcugucccggaucuucauccucgcccacuucccgcaccagguccuggccggccugaucaccggggccgugcucggcuggcugaugacgccccgcgugcccauggagcgggagcugagcuucuacggccucaccgcccuggcgcugaugcucgggaccucccugaucuacuggacccuguucacccucggccuggaccugagcugguccaucagccucgccuucaaguggugcgagcgccccgaguggauccacgucgacucccggccguucgccagccugagccgcgacuccggggccgcccugggccucggcaucgcgcugcacagccccugcuacgcccaggugcggcgcgcccagcuggggaacggccagaagaucgccugccucgugcuggccauggggcugcucggcccccuggacuggcuggggcacccgccccagaucucccucuucuacaucuucaacuuccugaaguacacgcuguggcccugccucguccuggcgcuggugcccugggccgugcacauguucagcgcccaggaggcgcccccgauccacuccagcuga

SEQ ID NO: 30380 - RNA, 1074 nt, Artificial Sequence
  derived and/or modified sequence opt1 from G6PC__Homo_sapiens__NP_000142
auggaggagggcaugaacgugcugcacgacuucgggauccagagcacccacuaccuccaggucaacuaccaggacagccaggacugguucauccuggugagcgugaucgccgaccugcgcaacgccuucuacguccucuuccccaucugguuccaccuccaggaggcggugggcaucaagcugcucuggguggccgucaucggggacuggcugaaccugguguucaaguggauccucuucggccagcggccguacuggugggugcuggacaccgacuacuacuccaacacgagcgucccccugaucaagcaguuccccgugaccugcgagaccgggcccggcuccccgagcggccacgccauggggaccgccggcguguacuacgucauggugacguccacccucagcaucuuccaggggaagaucaagcccaccuaccgcuuccggugccugaacgugauccuguggcucggcuucugggccguccagcugaacgugugccugucccgcaucuaccucgcggcccacuucccccaccagguggucgccggggugcugagcggcaucgccguggcggagaccuucucccacauccacagcaucuacaacgccucccugaagaaguacuuccucaucacguucuuccuguucagcuucgccaucggcuucuaccugcuccugaaggggcugggcgucgaccuccuguggacccuggagaaggcccagcgguggugcgagcagcccgagugggugcacaucgacaccaccccguucgccucccuccugaagaaccuggggacgcuguucggccugggccuggcgcucaacagcuccauguaccgcgagagcugcaaggggaagcuguccaaguggcugcccuuccggcucagcagcaucguggccucccugguccugcuccacguguucgacagccugaagccgcccucccaggucgagcugguguucuacgugcucagcuucugcaaguccgccgucgugccccuggccagcguguccgucauccccuacugccuggcccaggugcucggccagccccacaagaagucccuguga

SEQ ID NO: 30381 - RNA, 1638 nt, Artificial Sequence
  derived and/or modified sequence opt1 from G6PD__Homo_sapiens__NP_000393
augggccgccgggggagcgcccccggcaacgggcgcacccugcggggcugcgagcgcgggggccggcgccggcgcuccgccgacagcgugauggcggagcaggucgcccucucccggacccaggugugcggcauccugcgcgaggagcuguuccagggggacgccuuccaccagagcgacacgcacaucuucaucaucaugggcgccuccggggaccucgccaagaagaagaucuacccgaccaucugguggcuguuccgggacggccugcuccccgagaacaccuucaucgugggguacgcgcgcagccggcugaccgucgccgacauccgcaagcaguccgagcccuucuucaaggccacgcccgaggagaagcugaagcucgaggacuucuucgcccggaacagcuacguggcgggccaguacgacgacgccgccuccuaccagcgccugaacagccacaugaacgcccugcaccucggcucccaggccaaccggcuguucuaccuggcgcucccgcccaccguguacgaggccgucaccaagaacauccacgagagcugcaugucccagaucggguggaaccgcaucaucguggagaagcccuucggccgggaccugcagagcuccgaccgccugagcaaccacaucuccagccucuuccgggaggaccagaucuaccgcaucgaccacuaccuggggaaggagauggugcagaaccugaugguccuccgcuucgccaaccggaucuucggccccaucuggaaccgcgacaacaucgccugcgugauccugaccuucaaggagccguucggcacggaggggcggggcggguacuucgacgaguucggcaucauccgcgacgugaugcagaaccaccuccugcagaugcugugccuggucgccauggagaagcccgcguccaccaacagcgacgacgugcgggacgagaaggugaagguccucaagugcaucagcgaggugcaggccaacaacgugguccuggggcaguacgugggcaaccccgacggcgagggggaggccaccaagggcuaccuggacgaccccaccgugccgcgcggguccacgaccgccaccuucgccgcggucgugcucuacguggagaacgagcggugggacggcguccccuucauccugcgcugcgggaaggcccugaacgagcggaaggccgaggugcgccuccaguuccacgacgucgccggcgacaucuuccaccagcagugcaagcggaacgagcuggugauccgcgugcagcccaacgaggccgucuacaccaagaugaugacgaagaagcccggcauguucuucaacccggaggagagcgagcuggaccucaccuacgggaaccgguacaagaacgugaagcugcccgacgcguacgagcgccugauccucgacguguucugcggcucccagaugcacuucguccggagcgacgagcugcgcgaggccuggcggaucuucacgccccugcuccaccagaucgagcuggagaagcccaagccgauccccuacaucuacgggucccgcggccccaccgaggccgacgagcugaugaagcgggugggguuccaguacgagggcaccuacaagugggugaacccccacaagcucuga

SEQ ID NO: 30382 - RNA, 2859 nt, Artificial Sequence
  derived and/or modified sequence opt1 from GAA__Homo_sapiens__XP_005257251
augggcgugcgccaccccccgugcagccaccggcugcucgccgucugcgcccuggugucccuggcgaccgccgcccuccuggggcacauccugcuccacgacuuccugcuggugccccgcgagcucagcggcuccagccccguccuggaggagacccaccccgcccaccagcagggggccucccggccgggcccccgcgacgcgcaggcccaccccgggcggccccgcgccgugccgacgcagugcgacgugccccccaacagccgguucgacugcgcccccgacaaggcgaucacccaggagcagugcgaggcccgcggcugcugcuacaucccggccaagcagggccugcagggggcccagaugggccagcccuggugcuucuucccccccuccuacccgagcuacaagcucgagaaccuguccagcuccgagaugggguacaccgccacccugacgcggaccacccccaccuucuuccccaaggacauccucacgcugcgccuggacgucaugauggagaccgagaaccggcuccacuucaccaucaaggaccccgcgaaccgccgguacgaggugccgcuggagaccccccacgugcacagccgcgcccccuccccccuguacagcgucgaguucuccgaggagccguucggcgugaucgugcggcgccagcucgacgggcggguccugcugaacacgaccguggccccccucuucuucgccgaccaguuccugcagcugagcaccucccuccccagccaguacaucaccggccuggccgagcaccuguccccccucaugcugagcacgagcuggacccgcaucacccuguggaaccgggaccucgcgccgacccccggcgccaaccuguacgggucccaccccuucuaccuggcccucgaggacggcgggagcgcccacggcguguuccugcugaacuccaacgccauggacgucgugcuccagccgagccccgcgcuguccuggcgcagcacgggcgggauccuggacguguacaucuuccucggccccgagcccaaguccgucgugcagcaguaccuggacguggucggguacccguucaugccccccuacuggggccugggguuccaccucugccgguggggcuacagcuccaccgccaucacccgccaggugguggagaacaugacccgcgcccacuucccccuggacguccaguggaacgaccuggacuacauggacagccggcgcgacuucacguucaacaaggacggcuuccgggacuucccggccauggugcaggagcuccaccaggggggccgccgguacaugaugaucgucgaccccgccaucuccagcuccgggcccgcgggcagcuaccgccccuacgacgaggggcugcggcgcggcguguucaucaccaacgagaccggccagccgcugaucgggaagguguggcccggcuccaccgccuuccccgacuucacgaaccccaccgcccuggccuggugggaggacauggucgcggaguuccacgaccaggugccguucgacgggauguggaucgacaugaacgagcccagcaacuucauccggggcuccgaggacgggugccccaacaacgagcucgagaaccccccguacgugcccggcgucgugggcgggacccugcaggccgccaccaucugcgccagcucccaccaguuccugagcacgcacuacaaccuccacaaccuguacggccugaccgaggccaucgcgagccaccgcgcccucgugaaggcccgggggacccgccccuucgucaucucccggagcaccuucgccggccacggccgcuacgccgggcacuggacgggcgacgugugguccagcugggagcagcuggcguccagcgugcccgagauccugcaguucaaccuccugggggucccgcuggugggcgccgacgugugcggguuccucggcaacaccuccgaggagcugugcguccgguggacccagcugggcgccuucuaccccuucaugcgcaaccacaacagccuccugucccugccccaggagccguacagcuucuccgagcccgcccagcaggccaugcggaaggcgcucacccugcgcuacgcccugcucccccaccuguacacccuguuccaccaggcccacguggccggggagacgguggcgcggccccucuuccuggaguucccgaaggacagcuccaccuggaccgucgaccaccagcugcucuggggcgaggcccugcugaucacccccgugcuccaggccgggaaggccgaggugacgggcuacuucccccuggggaccugguacgaccugcagaccguccccguggaggcccucggcagccugccgcccccccccgcggccccgcgcgagcccgccauccacuccgagggccagugggugacccugcccgccccccucgacacgaucaacguccaccugcgcgccggguacaucaucccgcugcagggccccgggcucaccaccaccgagagccggcagcagcccauggcgcuggccguggcccugacgaagggcggggaggcccgcggcgagcucuucugggacgacggcgagucccuggaggugcuggagcggggggccuacacccaggucaucuuccucgcgcgcaacaacaccaucgugaacgagcuggugcgggucaccagcgagggcgccgggcugcagcuccagaaggugacggugcugggcgucgccaccgccccccagcaggugcugagcaacggggugccggucuccaacuucaccuacagccccgacaccaaggugcucgacaucugcgugucccugcugaugggcgagcaguuccucgucagcuggugcuga

SEQ ID NO: 30383 - RNA, 2085 nt, Artificial Sequence
  derived and/or modified sequence opt1 from GAB1__Homo_sapiens__NP_002030
augagcggcggggagguggucugcuccggcuggcugcgcaagagccccccggagaagaagcucaagcgguacgccuggaagcgccggugguucgugcugcgcuccgggcggcugaccggcgaccccgacgugcucgaguacuacaagaacgaccacgccaagaagcccauccgcaucaucgaccugaaccugugccagcaggucgacgcggggcucaccuucaacaagaaggaguucgagaacagcuacaucuucgacaucaacacgaucgaccggaucuucuaccugguggccgacuccgaggaggagaugaacaagugggugcgcugcaucugcgacaucugcggcuucaaccccaccgaggaggacccggucaagccccccggcagcucccugcaggcccccgccgaccucccgcuggccaucaacaccgcgccccccagcacccaggccgacuccagcuccgccacgcugcccccgcccuaccagcucaucaacgugcccccccaccuggagacccuggggauccaggaggacccgcaggacuaccuccugcugaucaacugccagagcaagaagcccgagcccacccggacccacgccgacuccgcgaagagcacguccagcgagaccgacugcaacgacaacgugcccucccacaagaacccggccagcucccagagcaagcacggcaugaacggguucuuccagcagcagaugaucuacgacagcccccccucccgcgcccccagcgccuccgucgacagcucccucuacaaccugccgcggagcuacucccacgacgugcugcccaaggugagccccuccagcaccgaggccgacggcgagcucuacgucuucaacacccccuccgggacgagcuccguggagacccagaugcgccacgugagcaucuccuacgacaucccgcccacccccggcaacaccuaccagaucccgcggacguuccccgagggcacccuggggcagaccagcaagcuggacaccauccccgacauccccccgccccgcccccccaagccgcaccccgcgcacgaccggucccccgucgagacgugcagcaucccccgcaccgccuccgacaccgacagcagcuacugcaucccgaccgccggcaugucccccagccgguccaacacgaucagcaccguggaccucaacaagcugcgcaaggacgccuccagccaggacugcuacgacaucccccgggccuuccccuccgaccgcagcuccagccuggagggguuccacaaccacuucaaggugaagaacguccucaccgugggcuccgugagcuccgaggagcuggacgagaacuacgucccgaugaaccccaacagccccccccggcagcacuccagcuccuucaccgagccgauccaggaggcgaacuacgugcccaugacgcccggcaccuucgacuucagcagcuucgggaugcaggugcccccgcccgcccacaugggcuuccgcuccagccccaagaccccgccccgccggcccguccccguggccgacugcgagccgccccccgucgaccgcaaccugaagcccgaccggaaggugaagccggccccccucgagaucaagccccugcccgagugggaggagcugcaggccccggugcgcucccccaucacccggagcuucgcgcgcgacuccagccgguuccccauguccccccgcccggacagcguccacuccacgaccagcuccagcgacucccacgacagcgaggagaacuacgugcccaugaaccccaaccucuccagcgaggaccccaaccuguucggguccaacagccuggacggcggguccagcccgaugaucaagcccaagggcgacaagcagguggaguaccucgaccuggaccuggacagcggcaaguccacccccccccggaagcagaagagcuccgggagcggcuccagcgucgccgacgagcgcguggacuacguggucguggaccagcagaagacccucgcccugaaguccacgcgggaggccuggaccgacgggcgccagagcaccgaguccgagaccccggccaagagcgugaaguga

SEQ ID NO: 30384 - RNA, 1917 nt, Artificial Sequence
  derived and/or modified sequence opt1 from GAB2__Homo_sapiens__NP_036428
augagcggcgaccccgacgugcuggaguacuacaagaacgaccacuccaagaagccgcuccgcaucaucaaccugaacuucugcgagcaggucgacgccgggcugaccuucaacaagaaggagcuccaggacagcuucguguucgacaucaagaccuccgagcggacguucuaccugguggccgagaccgaggaggacaugaacaaguggguccagagcaucugccagaucugcggcuucaaccaggcggaggaguccaccgacagccugcgcaacguguccagcgccgggcacggcccccgguccagccccgccgagcucuccagcuccagccagcaccuccugcgcgagcggaaguccagcgcccccucccacagcucccagccgacccucuucacguucgagccgcccgugagcaaccacaugcagcccacccugagcaccuccgcgccccaggaguaccuguaccuccaccagugcaucagccgccgggccgagaacgcccgcuccgccagcuucucccaggggacccgggccagcuuccugaugcgcuccgacacggcgguccagaagcuggcccagggcaacggccacugcgugaacgggaucagcggccaggugcacggguucuacucccuccccaagcccagccggcacaacaccgaguuccgcgacuccaccuacgaccugccccggagccuggccucccacggccacaccaaggggagccugacgggcuccgagaccgacaacgaggacgucuacaccuucaagaccccgagcaacacgcugugccgcgaguucggcgaccugcucguggacaacauggacgugcccgccacgccccuguccgccuaccagaucccccggaccuucacccuggacaagaaccacaacgcgaugaccgucgccaccccgggggacagcgccaucgccccgccgccccggccgcccaagcccucccaggccgagacgccccgguggggcagcccccagcagcgcccgcccaucagcgagaacucccggagcguggcggccaccaucccccgccggaacacccuccccgccauggacaacucccgccugcaccgcgccagcuccugcgagaccuacgaguacccccagcgcgggggcgagagcgccggccgcuccgcggagagcauguccgacggggugggcagcuuccugcccgggaagaugaucgucggccgguccgacagcaccaacuccgaggacaacuacgugcccaugaaccccgggagcuccacccuccuggccauggagcgcgccggcgacaacagccaguccguguacauccccaugagccccggcgcccaccacuucgacagccugggguacccguccacgacccuccccguccaccggggccccagccgcggguccgagauccagcccccgcccgugaaccggaaccugaagcccgaccgcaaggccaagcccaccccgcuggaccuccggaacaacaccgugaucgacgagcugcccuucaagagccccaucacgaaguccuggagccgcgcgaaccacaccuucaacuccagcuccagccaguacugccggcccaucuccacccagagcaucaccuccacggacagcggcgacuccgaggagaacuacgucccgaugcagaaccccgugagcgccucccccgugcccagcgggaccaacuccccggcccccaagaaguccaccggcagcgucgacuaccuggcccucgacuuccagcccagcagccccuccccgcaccgcaagcccagcaccuccagcgugaccuccgacgagaaggucgacuacguccagguggacaaggagaagacgcaggcgcugcagaacaccaugcaggaguggaccgacgugcggcagagcuccgagcccagcaagggcgccaagcuguga

SEQ ID NO: 30385 - RNA, 1764 nt, Artificial Sequence
  derived and/or modified sequence opt1 from GAB3__Homo_sapiens__NP_001075042
augagcgccggcgacgccgugugcaccggguggcuggucaaguccccgcccgagcgcaagcuccagcgguacgcguggcgcaagcggugguucgugcugcgccggggccgcaugagcgggaaccccgacgugcuggaguacuaccggaacaagcacuccagcaagcccauccgcgucaucgaccucuccgagugcgccguguggaagcacgugggccccagcuucguccggaaggaguuccagaacaacuucguguucaucgugaagaccacgucccgcaccuucuaccuggucgccaagaccgagcaggagaugcaggucugggugcacagcaucucccaggugugcaaccuggggcaccucgaggacggcgccgccgacagcauggagucccugagcuacaccccguccagccugcagcccuccagcgcguccagccuccugacggcccacgccgccuccagcagccugccccgggacgaccccaacaccaacgcgguggccaccgaggagacccgcuccgagagcgagcuccuguuccugccggacuaccucgugcuguccaacugcgagacgggccggcugcaccacaccagccuccccacccgcugcgacuccuggagcaacuccgaccggagccuggagcaggccuccuucgacgacgucuucguggacugccugcagccccuccccagcucccaccuggugcacccgagcugccacggguccggcgcccaggagguccccagcucccgcccccaggccgcgcugaucuggagccgggagaucaacgggcccccgcgcgaccaccucuccagcagcccccugcuggaguccagccucuccagcaccauccagguggacaagaaccagggcucccugcccugcggggccaaggagcuggacaucaugagcaacacgcccccgccccggccgcccaagcccucccaccucagcgagcgccggcaggaggagugguccacccacagcggcuccaagaagcccgagugcacccuggugccccgccgcaucagccuguccggccucgacaacaugcggaccuggaaggccgacgucgaggggcagagccugcgccaccgggacaagcgccugucccucaaccugcccugccgguucagcccgauguaccccacggccuccgccagcaucgaggacuccuacgugcccaugagcccgcaggcgggcgccagcgggcugggcccccacugcucccccgacgacuacauccccaugaacagcggcuccaucagcuccccgcuccccgagcugcccgccaaccuggagcccccgcccgugaaccgcgaccucaagccccagcgcaagagccggcccccgccccuggaccugcggaaccucuccaucauccgcgagcacgccagccugacccggacccgcaccguccccugcucccggacgagcuuccugucccccgagcgcaacgggaucaacagcgcccgguucuucgcgaacccggugucccgcgaggacgaggagagcuacaucgagauggaggagcaccggaccgccuccagccucuccagcggcgcccugaccuggaccaagaaguucucccuggacuaccuggcccucgacuucaacagcgccagccccgcgcccaugcagcagaagcugcugcucuccgaggagcagcgcgucgacuacguccagguggacgagcagaagacgcaggcccugcagagcaccaagcaggaguggaccgacgagcggcaguccaagguguga

SEQ ID NO: 30386 - RNA, 354 nt, Artificial Sequence
  derived and/or modified sequence opt1 from GABARAP__Homo_sapiens__NP_009209
augaaguucguguacaaggaggagcaccccuucgagaagcgccggagcgagggcgagaagauccgcaagaaguacccggaccggguccccgugaucguggagaaggcccccaaggcccgcaucggggaccuggacaagaagaaguaccucguccccuccgaccugaccgugggccaguucuacuuccugauccggaagcgcauccaccuccgggcggaggacgcccuguucuucuucgugaacaacgucaucccgcccaccagcgccacgauggggcagcuguaccaggagcaccacgaggaggacuucuuccucuacaucgccuacuccgacgagagcguguacggccuguga

SEQ ID NO: 30387 - RNA, 354 nt, Artificial Sequence
  derived and/or modified sequence opt1 from GABARAPL1__Homo_sapiens__NP_113600
augaaguuccaguacaaggaggaccaccccuucgaguaccgcaagaaggagggcgagaagauccggaagaaguaccccgaccgcgugcccgucaucguggagaaggcccccaaggcccgggugcccgaccuggacaagcgcaaguaccucgucccgagcgaccugaccguggggcaguucuacuuccugauccggaagcgcauccaccuccggcccgaggacgcgcuguucuucuucgugaacaacaccaucccgcccacguccgccaccaugggccagcuguacgaggacaaccacgaggaggacuacuuccucuacgucgccuacagcgacgaguccguguacgggaaguga

SEQ ID NO: 30388 - RNA, 354 nt, Artificial Sequence
  derived and/or modified sequence opt1 from GABARAPL2__Homo_sapiens__NP_009216
augaaguggauguucaaggaggaccacagccuggagcaccgcugcguggaguccgccaagauccgggccaaguaccccgaccgcgucccggugaucguggagaaggucagcggcucccagaucguggacaucgacaagcggaaguaccucgugcccagcgacaucaccgucgcgcaguucauguggaucauccgcaagcggauccagcugcccuccgagaaggccaucuuccuguucguggacaagaccgugccccagagcucccucacgauggggcagcuguacgagaaggagaaggacgaggacggcuuccuguacgucgccuacagcggggagaacaccuucggcuucuga

SEQ ID NO: 30389 - RNA, 2886 nt, Artificial Sequence
  derived and/or modified sequence opt1 from GABBR1__Homo_sapiens__NP_001461
augcugcuccugcugcuccuggcgccccuguuccuccgcccgcccggcgccgggggcgcccagacccccaacgccaccagcgaggggugccagaucauccacccgcccugggagggcgggauccgguaccgcggccugacgcgggaccaggugaaggccaucaacuuccugcccgucgacuacgagaucgaguacgugugccgcggcgagcgggagguggucgggcccaaggugcgcaagugccucgccaacggcuccuggaccgacauggacacccccagccggugcgugcgcaucugcuccaagagcuaccugacccuggagaacgggaaggucuuccucacgggcggggaccugcccgcccuggacggcgcgcggguggacuuccgcugcgaccccgacuuccaccucgugggcuccagccgguccaucugcagccaggggcagugguccacccccaagccccacugccaggucaaccgcaccccgcacagcgagcggcgcgccguguacaucggcgcccuguuccccauguccgggggcuggcccggcgggcaggccugccagcccgcgguggagauggcccuggaggacgucaacagccggcgcgacauccucccggacuacgagcugaagcugauccaccacgacuccaagugcgaccccggccaggccaccaaguaccucuacgagcugcuguacaacgaccccaucaagaucauccucaugcccgggugcagcuccgugagcacgcugguggccgaggccgcgcggauguggaaccugaucguccucuccuacggcagcuccagcccggcccugagcaaccgccagcgguuccccaccuucuuccgcacccaccccuccgccacccugcacaaccccacgcgggugaagcuguucgagaaguggggguggaagaagaucgccaccauccagcagaccaccgagguguucacgagcacccucgacgaccuggaggagcgcgucaaggaggccggcaucgagaucaccuuccgccaguccuucuucagcgacccggcggugcccgugaagaaccucaagcggcaggacgcccgcaucaucgucggccuguucuacgagaccgaggcccggaagguguucugcgagguguacaaggagcgccuguucgggaagaaguacgucugguuccucaucggcugguacgccgacaacugguucaagaucuacgaccccuccaucaacugcacgguggacgagaugaccgaggccgucgaggggcacaucaccaccgagaucgugaugcugaaccccgcgaacacgcggagcaucuccaacaugaccagccaggaguucguggagaagcugaccaagcgccucaagcggcacccggaggagaccggcggguuccaggaggcgccccuggccuacgacgccaucugggcccuggcccucgcccugaacaagacguccggcggcgggggccgcagcgggguccggcuggaggacuucaacuacaacaaccagaccaucaccgaccagaucuaccgcgccaugaacuccagcuccuucgagggcgugagcgggcacguggucuucgacgccuccggcagccggauggcguggacccucaucgagcagcugcagggcggguccuacaagaagaucggcuacuacgacagcacgaaggacgaccuguccuggagcaagaccgacaaguggaucgggggcagcccgcccgccgaccagacccucgugaucaagaccuuccgcuuccugucccagaagcuguucaucagcguguccguccugagcucccucggcaucgugcuggccguggucugccugagcuucaacaucuacaacucccacgugcgguacauccagaacagccagcccaaccucaacaaccugacggccguggggugcucccuggcccucgcggccgucuucccccugggccuggacggguaccacaucggccgcaaccaguuccccuucgugugccaggcccggcucuggcugcuggggcucggcuucagccugggcuacggguccauguucaccaagaucuggugggugcacaccgucuucaccaagaaggaggagaagaaggaguggcgcaagacccuggagcccuggaagcucuacgccacggugggccugcugguggggauggacguccucacccuggccaucuggcagaucguggacccccugcaccggaccaucgagaccuucgcgaaggaggagcccaaggaggacaucgacgugagcauccucccccagcuggagcacugcuccagccgcaagaugaacacguggcugggcaucuucuacggguacaagggccuccugcugcuccugggcaucuuccuggccuacgagaccaaguccgucagcaccgagaagaucaacgaccaccgggccguggggauggccaucuacaacguggccguccucugccugaucaccgcgccggugacgaugauccuguccagccagcaggacgccgccuucgccuucgcgagccucgccaucguguucuccagcuacaucacccuggucgugcuguucgugcccaagaugcgccgccucaucacccggggcgaguggcaguccgaggcccaggacaccaugaagacggggagcuccaccaacaacaacgaggaggagaagucccgccugcuggagaaggagaaccgggagcucgagaagaucaucgccgagaaggaggagcgcgucagcgagcugcggcaccagcugcagagccgccagcagcuccggucccgccggcacccgcccaccccgcccgagcccagcggcgggcugccccgcggcccgcccgagccgcccgaccggcuguccugcgacggcagccgcgugcaccuccuguacaaguga

SEQ ID NO: 30390 - RNA, 2826 nt, Artificial Sequence
  derived and/or modified sequence opt1 from GABBR2__Homo_sapiens__NP_005449
auggccagcccccgcuccagcggccagcccgggcccccgccgcccccgccgccgccgcccgcccggcugcuccugcugcuccugcugccccuccugcugccccucgcgcccggcgccugggggugggcccgcggcgcgccccggcccccgcccuccagcccgccccuguccaucauggggcugaugccccucaccaaggagguggccaagggcagcaucggccgcgggguccugcccgccguggagcuggccaucgagcagauccggaacgagucccuccugcgccccuacuuccuggaccuccggcuguacgacaccgagugcgacaacgccaagggccugaaggccuucuacgacgcgaucaaguacgggcccaaccaccucaugguguucggcggggucugccccagcgugacguccaucaucgccgagagccugcagggcuggaaccuggugcagcucuccuucgccgccaccacccccguccuggccgacaagaagaaguaccccuacuucuuccgcaccgugcccagcgacaacgcggugaaccccgccauccugaagcuccugaagcacuaccaguggaagcgggucggcacgcugacccaggacgugcagcgcuucuccgaggugcggaacgaccucaccgggguccuguacggcgaggacaucgagaucagcgacaccgaguccuucagcaacgaccccugcacguccgugaagaagcugaaggggaacgacgugcgcaucauccucggccaguucgaccagaacauggccgccaaggucuucugcugcgccuacgaggagaacauguacggcagcaaguaccaguggaucauccccgggugguacgagcccuccuggugggagcagguccacaccgaggcgaacagcagccggugccugcgcaagaaccugcucgccgccauggagggcuacaucgggguggacuucgagccccuguccagcaagcagaucaagaccaucuccggcaagacgccccagcaguacgagcgggaguacaacaacaagcgcagcggggugggccccuccaaguuccacggcuacgccuacgacgggaucugggugaucgccaagacccugcagcgggcgauggagacccuccacgccagcucccgccaccagcggauccaggacuucaacuacaccgaccacacccugggccgcaucauccugaacgccaugaacgagacgaacuucuucggggugaccggccaggucguguuccggaacggggagcgcaugggcaccaucaaguucacccaguuccaggacagccgcgaggugaaggucggcgaguacaacgccguggccgacacgcucgagaucaucaacgacaccauccgguuccagggguccgagcccccgaaggacaagaccaucauccuggagcagcugcgcaagaucagccucccccuguacuccauccugagcgcgcucaccauccugggcaugaucauggccuccgccuuccuguucuucaacaucaagaaccggaaccagaagcugaucaagaugagcucccccuacaugaacaaccucaucauccucgggggcaugcugagcuacgccuccaucuuccuguucgggcuggacggcagcuucgucuccgagaagacguucgagacccugugcaccgugcgcaccuggauccucacggugggcuacaccaccgcguucggggccauguucgccaagaccuggcggguccacgccaucuucaagaacgugaagaugaagaagaagaucaucaaggaccagaagcugcuggugaucgucggcgggaugcuccugaucgaccugugcauccucaucugcuggcaggccguggacccccugcgccggacgguggagaaguacagcauggagccggaccccgcgggccgcgacaucagcauccggccccugcucgagcacugcgagaacacccacaugaccaucuggcugggcaucgucuacgccuacaaggggcugcucaugcuguucggcugcuuccuggccugggagacccgcaacguguccauccccgcccucaacgacagcaaguacaucgggauguccguguacaacgucggcaucaugugcaucaucggggccgcggugagcuuccugacgcgggaccagccgaacgugcaguucugcaucgucgcccuggugaucaucuucugcuccaccaucacccucugccugguguucguccccaagcugaucacccuccgcaccaaccccgacgccgccacgcagaaccggcgcuuccaguucacccagaaccagaagaaggaggacagcaagaccuccaccagcgugacguccgugaaccaggccagcaccucccggcuggagggccugcagagcgagaaccaccgccuccggaugaagaucaccgagcuggacaaggaccuggaggaggucaccaugcagcuccaggacacgcccgagaagaccaccuacaucaagcagaaccacuaccaggagcugaacgacauccugaaccucggcaacuucaccgaguccacggacgggggcaaggcgauccugaagaaccaccuggaccagaacccgcagcuccaguggaacaccaccgagcccagccggaccugcaaggaccccaucgaggacaucaacucccccgagcacauccagcgccgccugagccugcagcucccgauccugcaccacgccuaccugcccuccaucgggggcguggacgccagcugcgugagccccugcgucucccccacggccagcccgcgccaccggcacgugccgcccuccuuccgcgugauggucagcgggcucuga

SEQ ID NO: 30391 - RNA, 1365 nt, Artificial Sequence
  derived and/or modified sequence opt1 from GABPA__Homo_sapiens__NP_002031
augaccaagcgcgaggccgaggagcugaucgagaucgagaucgacggcaccgagaaggccgagugcacggaggagagcaucguggagcagaccuacgcgcccgccgagugcgucucccaggccaucgacaucaacgagccgaucgggaaccucaagaagcugcuggagccccggcuccagugcagccuggacgcccacgagaucugccugcaggacauccagcucgaccccgagcgcucccuguucgaccagggcgugaagaccgacgggaccgugcagcugagcguccaggugaucuccuaccagggcaucgagcccaagcucaacauccuggagaucgugaagccggccgacacggucgagguggugaucgaccccgacgcgcaccacgccgagagcgaggcccaccuggucgaggaggcccaggugaucacccucgacgggaccaagcacaucaccacgaucuccgacgagaccagcgagcaggucacccggugggcggccgcccuggagggcuaccgcaaggagcaggagcggcugggcauccccuacgaccccauccagugguccaccgaccaggugcuccacuggguggugugggucaugaaggaguucagcaugacggacaucgaccugaccacccugaacaucuccgggcgcgagcucugcagccugaaccaggaggacuucuuccagcgggugccgcgcggcgagauccuguggucccaccucgagcugcugcggaaguacgugcucgccagccaggagcagcagaugaacgagaucgucaccaucgaccagcccgugcagaucauccccgccuccgugcagagcgcgacgcccaccaccaucaaggucaucaacuccagcgccaaggccgccaaggugcagcgcgccccgcggaucuccggggaggaccgcagcagccccggcaaccggaccgggaacaacggccagauccagcuguggcaguuccugcucgagcugcugacggacaaggacgcgcgcgacugcaucuccugggugggcgacgagggggaguucaagcucaaccagcccgagcuggucgcccagaaguggggccagcggaagaacaagcccaccaugaacuacgagaagcugagccgcgcccuccgguacuacuacgacggggacaugaucugcaaggugcagggcaagcgcuucgucuacaaguucgugugcgaccugaagacccugaucggcuacuccgccgccgagcucaaccggcuggugaccgagugcgagcagaagaagcuggcgaagaugcagcuccacgggaucgcccagccggucacggccguggcccuggccaccgcgagccugcagaccgagaaggacaacuga

SEQ ID NO: 30392 - RNA, 1083 nt, Artificial Sequence
  derived and/or modified sequence opt1 from GABPB1__Homo_sapiens__NP_002032
augagccugguggaccucggcaagaagcugcuggaggccgcccgcgcggggcaggacgacgagguccggauccucauggccaacggcgcccccuucaccaccgacuggcuggggacguccccgcugcaccucgccgcccaguacggccacuacagcaccaccgaggugcugcugcgcgcgggggugucccgggacgcccgcaccaaggucgaccggacgccccuccacauggccgccagcgagggccacgcguccaucguggaggugcugcugaagcacggcgccgacgucaacgccaaggacaugcucaagaugaccgcccugcacugggccaccgagcacaaccaccaggaggugguggagcugcucaucaaguacggggcggacguccacacccagagcaaguucugcaagacggccuucgacaucuccaucgacaacggcaacgaggaccuggccgagauccugcagaucgccaugcagaaccagaucaacaccaaccccgagagccccgacaccgugaccauccacgccgcgacgccgcaguucaucaucgggcccggcgggguggucaaccucaccggccugguguccagcgagaacuccagcaaggccaccgacgagaccggcguguccgccguccaguucgggaacagcuccacgagcgugcuggccacccucgccgcgcuggccgaggccuccgcgccccugagcaacuccagcgagacccccguggucgccaccgaggagguggugacggccgagagcgucgacggcgccauccagcaggucguguccagcgggggccagcaggucaucaccaucgugaccgacggcauccagcucgggaaccugcacuccaucccgaccagcggcaucgggcagcccaucaucgugacgaugcccgacggccagcagguccugaccgugcccgccaccgacaucgccgaggagaccgugaucuccgaggagccgcccgcgaagcgccagugcaucgagaucaucgagaaccggguggagagcgccgagaucgaggugcgcucccuccugcccgggguccugugccggagccaccccaaguga

SEQ ID NO: 30393 - RNA, 1371 nt, Artificial Sequence
  derived and/or modified sequence opt1 from GABRA1__Homo_sapiens__NP_001121120
augcgcaagagccccggccuguccgacugccucugggccuggauccugcugcucagcacccugaccgggcgguccuacggccagccgagccugcaggacgagcucaaggacaacacgaccguguucacccgcauccuggaccggcugcucgacggguacgacaaccgccugcggcccggccugggggagcgcgucaccgaggugaagacggacaucuucgugaccuccuucggccccgucagcgaccacgacauggaguacaccaucgacguguucuuccggcaguccuggaaggacgagcgccucaaguucaagggccccaugaccgugcugcggcugaacaaccucauggccagcaagaucuggacgccggacaccuucuuccacaacgggaagaaguccgucgcgcacaacaugaccaugcccaacaagcugcugcgcaucaccgaggacggcacgcuccuguacaccaugcggcugaccgugcgcgccgagugccccaugcaccucgaggacuuccccauggacgcccacgccugcccgcugaaguucgggagcuacgccuacacccgggcggagguggucuacgaguggacgcgcgagcccgcccgguccgugguggucgccgaggacggcagccgccugaaccaguacgaccuccuggggcagaccguggacuccggcaucgugcagagcuccaccggcgaguacgucgugaugaccacgcacuuccaccugaagcggaagaucggguacuucgugauccagaccuaccuccccugcaucaugaccgucauccugagccagguguccuucuggcugaaccgcgagagcgugcccgcccggaccgucuucggcgugacgaccgugcucaccaugaccacgcuguccaucagcgcgcgcaacagccugccgaaggucgccuacgccaccgccauggacugguucaucgccgugugcuacgcguucgucuucuccgcccucaucgaguucgccaccgugaacuacuucaccaagcggggguacgccugggacggcaagagcgugguccccgagaagcccaagaaggugaaggacccccugaucaagaagaacaacacguacgccccgaccgcgaccuccuacacccccaaccuggcccgcggcgaccccgggcucgccacgaucgccaagagcgccaccaucgagcccaaggaggugaagccggagaccaagccgcccgagcccaagaagaccuucaacuccgucagcaagaucgaccgccugucccggaucgcguucccccuccuguucggcaucuucaaccugguguacugggccaccuaccugaaccgcgagccccagcucaaggcccccacgccccaccaguga

SEQ ID NO: 30394 - RNA, 1356 nt, Artificial Sequence
  derived and/or modified sequence opt1 from GABRA2__Homo_sapiens__NP_000798
augaagaccaagcugaacaucuacaacaugcaguuccuccuguucguguuccuggucugggaccccgcccgccucgugcuggccaacauccaggaggacgaggcgaagaacaacaucaccaucuucacgcggauccuggaccgccuccuggacggcuacgacaaccggcugcgcccggggcucggcgacagcaucaccgagguguucaccaacaucuacgucaccuccuucgggcccgugagcgacacggacauggaguacaccaucgacguguucuuccggcagaaguggaaggacgagcgccugaaguucaagggccccaugaacauccugcggcucaacaaccugauggccuccaagaucuggacccccgacaccuucuuccacaacgggaagaaguccgucgcccacaacaugacgaugccgaacaagcugcuccgcauccaggacgacggcacccugcuguacaccaugcggcucaccgugcaggccgagugccccaugcaccuggaggacuuccccauggacgcccacagcugcccccugaaguucggcagcuacgcguacacgaccuccgaggugaccuacaucuggaccuacaacgccagcgacuccguccagguggccccggacgggagccgccucaaccaguacgaccugcugggccaguccaucgggaaggagacgaucaagagcuccaccggcgaguacaccgugaugaccgcccacuuccaccucaagcggaagaucggguacuucgucauccagacguaccugcccugcaucaugaccgugauccugagccagguguccuucuggcucaaccgcgagagcguccccgcgcggaccguguucggcgugaccacgguccugaccaugaccacccuguccaucagcgcccgcaacucccuccccaagguggccuacgccacggccauggacugguucaucgcggugugcuacgccuucgucuucagcgcccugaucgaguucgccaccgugaacuacuucaccaagcggggcugggccugggacggcaagagcguggucaacgacaagaagaaggagaaggcguccgugaugauccagaacaacgccuacgccgucgccguggccaacuacgcgccgaaccugagcaaggaccccgugcucuccaccaucagcaaguccgccacgacccccgagcccaacaagaagccggagaacaagcccgccgaggccaagaagaccuucaacagcgucuccaagaucgaccgcaugagccggaucguguuccccgugcuguucgggaccuucaaccuggucuacugggccacguaccucaaccgcgagcccgugcuggggguguccccguga

SEQ ID NO: 30395 - RNA, 1479 nt, Artificial Sequence
  derived and/or modified sequence opt1 from GABRA3__Homo_sapiens__NP_000799
augaucaucacccagaccagccacugcuacaugacgucccugggcauccucuuccugaucaacauccugcccgggaccaccggccagggggagagccgccggcaggagccgggcgacuucgugaagcaggacaucgggggccucucccccaagcacgcccccgacauccccgacgacagcaccgacaacaucacgaucuucacccgcauccuggaccggcugcucgacggcuacgacaaccgccugcggccggggcugggcgacgccgucaccgaggugaagaccgacaucuacgugacguccuucgggcccgucagcgacaccgacauggaguacaccaucgacguguucuuccgccagaccuggcacgacgagcggcucaaguucgacggccccaugaagauccugccccugaacaaccuccuggcguccaagaucuggacgccggacaccuucuuccacaacgggaagaaguccguggcccacaacaugaccacccccaacaagcugcuccgccuggucgacaacggcacgcugcucuacaccaugcggcugaccauccacgccgagugccccaugcaccuggaggacuuccccauggacgugcacgccugcccgcucaaguucggcagcuacgccuacaccacggcggagguggucuacagcuggacccuggggaagaacaaguccguggagguggcccaggacggcagccgccugaaccaguacgaccuccuggggcacgucgugggcaccgagaucauccgguccagcaccggcgaguacguggucaugacgacccacuuccaccugaagcgcaagaucggguacuucgugauccagaccuaccuccccugcaucaugaccgugauccugucccaggucagcuucuggcugaaccgggaguccgugcccgcccgcacgguguucggcgucaccaccgugcucaccaugacgacccugagcaucuccgcccggaacagccugcccaagguggcguacgccaccgccauggacugguucaucgccgucugcuacgccuucguguucagcgcgcucaucgaguucgccaccgucaacuacuucacgaagcgcuccugggccugggaggggaagaaggugccggaggcccuggagaugaagaagaagacccccgccgcgcccgccaagaagaccagcaccaccuucaacaucgugggcacgaccuaccccaucaaccuggccaaggacaccgaguucuccaccaucagcaagggggccgccccguccgcgagcuccacgcccaccaucaucgccagccccaaggccaccuacguccaggacucccccaccgagacgaagaccuacaacagcguguccaagguggacaagaucagccggaucaucuucccgguccucuucgccaucuucaaccugguguacugggccaccuacgugaaccgcgaguccgcgaucaagggcaugauccggaagcaguga

SEQ ID NO: 30396 - RNA, 1665 nt, Artificial Sequence
  derived and/or modified sequence opt1 from GABRA4__Homo_sapiens__NP_000800
auggugagcgccaagaagguccccgccaucgcccuguccgccggcgugagcuucgcccuccugcgcuuccugugccucgccgugugccugaacgagucccccgggcagaaccagaaggaggagaagcugugcaccgagaacuucacccggauccucgacagccugcuggacggcuacgacaaccgccuccggcccggguucggcgggcccgucacggaggugaagaccgacaucuacgugaccuccuucggccccgucagcgacguggagauggaguacaccauggacguguucuuccgccagacguggaucgacaagcggcugaaguacgacggcccgaucgagauccugcgccucaacaacaugauggucaccaagguguggacccccgacaccuucuuccggaacgggaagaaguccgugagccacaacaugacggcccccaacaagcuguuccgcaucaugcggaacggcaccauccuguacaccaugcgccucaccaucuccgcggagugccccaugcggcuggucgacuucccgauggacgggcacgccugcccccugaaguucggcagcuacgccuaccccaaguccgagaugaucuacacguggaccaaggggcccgagaaguccguggaggugccgaaggagagcagcucccucguccaguacgaccugaucggccagaccgugagcuccgagaccaucaagagcaucacgggcgaguacaucgugaugaccgucuacuuccaccuccgccggaagaugggguacuucaugauccagaccuacauccccugcaucaugaccgugauccugucccaggugagcuucuggaucaacaaggagagcguccccgcccgcacgguguucggcaucaccaccgugcugaccaugacgacccuguccaucagcgcgcggcacucccuccccaaggucagcuacgccaccgccauggacugguucaucgccgugugcuucgccuucgucuucuccgcgcugaucgaguucgccgccgugaacuacuucaccaacauccagauggagaaggccaagcgcaagacgagcaagccgccccaggaggugcccgccgcgcccguccagcgggagaagcacccggaggcgccccugcagaacaccaacgccaaccucaacaugcgcaagcggaccaacgcccuggugcacuccgagagcgacguggggaaccgcaccgaggucggcaaccacuccagcaaguccagcacgguggugcaggaguccagcaagggcacgccccgguccuaccuggccagcucccccaacccguucagccgcgccaacgccgccgagaccaucuccgccgcccgcgcgcuccccagcgccagccccaccuccauccggaccggguacaugccccgcaaggccagcgucggcuccgccagcacccggcacguguucgggucccgccugcagcggaucaagaccaccgugaacaccaucggcgcgacggggaagcugagcgccaccccgccgcccuccgcgcccccgcccagcggcuccggcaccagcaagaucgacaaguacgcccgcauccucuuccccgucaccuucggggccuucaacaugguguacuggguggucuaccuguccaaggacacgauggagaaguccgagagccugauguga

SEQ ID NO: 30397 - RNA, 1389 nt, Artificial Sequence
  derived and/or modified sequence opt1 from GABRA5__Homo_sapiens__XP_005268315
auggacaacggcauguucagcggguucaucaugaucaagaaccugcuccuguucugcaucuccaugaaccugagcucccacuucggcuucagccagaugcccaccuccagcgugaaggacgagaccaacgacaacaucacgaucuucacccgcauccucgacgggcugcuggacggcuacgacaaccggcuccgcccggggcugggcgagcggaucacccagguccgcaccgacaucuacgugacguccuucggccccgugagcgacaccgagauggaguacaccaucgacgucuucuuccggcaguccuggaaggacgagcgccugcgguucaaggggcccaugcagcgccucccccugaacaaccugcucgccagcaagaucuggaccccggacacguucuuccacaacggcaagaaguccaucgcccacaacaugaccacccccaacaagcugcugcggcucgaggacgacgggacccugcuguacacgaugcgccucaccaucagcgcggagugccccaugcagcuggaggacuuccccauggacgcccacgccugcccgcugaaguucggcuccuacgccuaccccaacagcgaggugguguacgucuggaccaacggguccaccaagagcgugguggucgccgaggacggcucccggcucaaccaguaccaccugaugggccagacgguggggaccgagaacaucagcaccuccaccggcgaguacacgaucaugaccgcgcacuuccaccugaagcgcaagaucggguacuucgugauccagaccuaccuccccugcaucaugaccgucauccugagccaggugagcuucuggcugaaccgggaguccgugcccgcccgcacggucuucggcgugaccaccgugcucaccaugacgacccugagcaucuccgcccggaacagccugccgaaggucgccuacgcgaccgccauggacugguucaucgccgugugcuacgccuucguguucuccgcccucaucgaguucgcgaccgucaacuacuucacgaagcgcggcugggccugggacgggaagaaggcccuggaggccgccaagaucaagaagaagcgggaggugauccugaacaagagcaccaacgcguucaccaccggcaagaugucccacccgcccaacauccccaaggagcagacgcccgccgggaccagcaacaccaccuccgugagcgucaagcccuccgaggagaagaccagcgaguccaagaagacguacaacagcaucuccaagaucgacaagaugagccgcaucguguuccccguccucuucggcaccuucaaccugguguacugggccaccuaccugaaccgggagcccgugaucaagggggccgccuccccgaaguga

SEQ ID NO: 30398 - RNA, 1362 nt, Artificial Sequence
  derived and/or modified sequence opt1 from GABRA6__Homo_sapiens__NP_000802
auggccagcucccugcccuggcucugcaucauccuguggcuggagaacgcccucggcaagcuggagguggaggggaacuucuacagcgagaacgucucccgcauccuggacaaccuccuggagggcuacgacaaccggcugcgccccggguucggcggggcggugaccgaggugaagaccgacaucuacgucacgagcuucggccccguguccgacguggagauggaguacaccauggacgucuucuuccggcagaccuggaccgacgagcgccucaaguucggcgggcccacggagauccugagccugaacaaccucaugguguccaagaucuggacccccgacaccuucuuccggaacggcaagaaguccaucgcccacaacaugaccacgccgaacaagcuguuccgcaucaugcagaacgggaccauccuguacaccaugcggcucaccaucaacgccgacugccccaugcgccuggugaacuuccccauggacggccacgccugcccccugaaguucgggagcuacgccuaccccaagagcgagaucaucuacacguggaagaagggcccccucuacuccgucgaggugcccgaggagagcuccagccugcugcaguacgaccucaucggccagaccguguccagcgagaccaucaaguccaacaccggggaguacgucaucaugacgguguacuuccaccuccagcggaagaugggcuacuucaugauccagaucuacacccccugcaucaugaccgugauccugagccaggucuccuucuggaucaacaaggagagcgugccggcgcgcaccguguucgggaucacgaccguccugaccaugaccacgcugagcaucuccgcccggcacagccugcccaagguguccuacgccaccgccauggacugguucaucgcggugugcuucgccuucgucuucagcgcccucaucgaguucgccgccgugaacuacuucaccaaccugcagacccagaaggcgaagcgcaaggcccaguucgccgccccgcccacggugaccaucuccaaggccaccgagccgcuggaggcggagaucguccuccaccccgacagcaaguaccaccugaagaagcggaucaccucccugagccuccccaucguguccagcuccgaggccaacaagguccugacgcgcgcccccauccugcagagcaccccggugaccccgccgccccucucccccgccuucggcggcaccagcaagaucgaccaguacucccggauccuguuccccguggccuucgcgggguucaaccuggucuacugggugguguaccucagcaaggacacgauggaggucuccagcuccguggaguga

SEQ ID NO: 30399 - RNA, 1425 nt, Artificial Sequence
  derived and/or modified sequence opt1 from GABRB1__Homo_sapiens__NP_000803
auguggaccgugcagaaccgcgagagccugggccuccuguccuuccccgucaugaucaccauggugugcugcgcccacagcacgaacgagccguccaacaugagcuacgugaaggagaccgucgaccggcugcucaagggguacgacauccgccugcggcccgacuucggcgggccgcccguggacgugggcaugcgcaucgacgucgccuccaucgacauggugagcgaggugaacauggacuacacccugaccauguacuuccagcaguccuggaaggacaagcggcucagcuacuccgggaucccccugaaccugacgcucgacaaccgcgucgcggaccagcugugggugcccgacaccuacuuccugaacgacaagaaguccuucgugcacggcgucaccgugaagaaccggaugauccgccuccaccccgacggcaccgugcuguacgggcugcggaucacgaccaccgccgccugcaugauggaccuccgccgguacccccuggacgagcagaacugcacccuggagaucgagagcuacggcuacacgaccgacgacaucgaguucuacuggaacgggggcgagggggccgucaccggcgugaacaagaucgagcucccgcaguucagcaucguggacuacaagauggucuccaagaagguggaguucaccacgggcgccuacccccgccugagccuguccuuccggcucaagcgcaacaucggguacuucauccugcagaccuacaugcccagcacccugaucaccauccucuccugggugagcuucuggaucaacuacgacgcguccgccgcccgggucgcccugggcaucacgaccgugcugaccaugaccacgaucagcacccaccuccgcgagacccugcccaagaucccguacgugaaggcgaucgacaucuaccugauggggugcuucgucuucguguuccucgcccugcuggaguacgccuucgucaacuacaucuucuucggcaagggcccccagaagaagggggccagcaagcaggaccaguccgccaacgagaagaacaagcucgagaugaacaagguccagguggacgcgcacggcaacauccugcugagcacccucgagauccggaacgagacguccgggagcgaggugcugaccuccgugagcgaccccaaggccaccauguacuccuacgacagcgccuccauccaguaccgcaagccccugagcucccgggaggccuacggccgcgcccucgaccggcacggggugccgagcaagggccgcauccgccggcgcgcgucccagcugaaggucaagauccccgaccugaccgacgugaacagcaucgacaaguggucccggauguucuuccccaucacguucagccucuucaacguggucuacuggcuguacuacgugcacuga

SEQ ID NO: 30400 - RNA, 1425 nt, Artificial Sequence
  derived and/or modified sequence opt1 from GABRB2__Homo_sapiens__NP_000804
auguggcgcgugcggaagcgcggcuacuucgggaucuggagcuucccccugaucaucgccgccgucugcgcgcaguccgugaacgacccgagcaacaugucccucgugaaggagaccgucgaccggcugcugaagggcuacgacauccgccuccggcccgacuucgggggcccgcccguggccguggggaugaacaucgacaucgccagcaucgacauggucuccgaggugaacauggacuacacccugacgauguacuuccagcaggccuggcgcgacaagcggcugagcuacaacgugaucccccucaaccugacccuggacaaccgcgucgccgaccagcucugggugcccgacaccuacuuccugaacgacaagaaguccuucgugcacggcgucaccgugaagaaccggaugauccgccugcaccccgacggcacggugcucuacgggcugcggaucaccaccaccgcggccugcaugauggaccugcgccgguacccccucgacgagcagaacugcacgcuggagaucgagagcuacggcuacaccaccgacgacaucgaguucuacuggcgcggggacgacaacgccgucaccggcgugacgaagaucgagcugccgcaguucuccaucguggacuacaagcucaucaccaagaaggucguguucagcaccggguccuacccccggcugagccuguccuucaagcucaagcgcaacaucggcuacuucauccugcagaccuacaugcccagcauccugaucacgauccucuccugggugagcuucuggaucaacuacgacgccuccgcggcccgggucgcccugggcaucaccaccgugcugaccaugacgaccaucaacacccaccuccgcgagacccugcccaagaucccguacgugaaggccaucgacauguaccugauggggugcuucgucuucguguucauggcccuccuggaguacgcgcuggucaacuacaucuucuucggccgggggccccagcgccagaagaaggccgccgagaaggccgccagcgcgaacaacgagaagaugcggcucgacgugaacaagauggacccccacgagaacauccugcuguccacgcucgagaucaagaacgagauggccaccagcgaggccgugaugggccugggcgacccccgcagcaccaugcuggccuacgacgccuccagcauccaguaccgcaaggcggggcucccgcggcacuccuucggccgcaacgcccuggagcggcacgucgcccagaagaagucccgccugcggcgccgggccagccagcucaagaucaccauccccgaccugacggacgugaacgccaucgaccgcuggagccggaucuucuuccccguggucuucuccuucuucaacaucguguacuggcuguacuacgugaacuga

SEQ ID NO: 30401 - RNA, 1422 nt, Artificial Sequence
  derived and/or modified sequence opt1 from GABRB3__Homo_sapiens__NP_000805
auguggggccuggccgggggccgccucuucgggaucuucagcgcccccgugcuggucgcgguggugugcugcgcccaguccgucaacgacccgggcaacaugagcuucgugaaggagaccguggacaagcugcucaagggguacgacauccggcugcgccccgacuucggcggcccgcccgucugcguggggaugaacaucgacaucgccuccaucgacauggugagcgaggucaacauggacuacacccugacgauguacuuccagcaguacuggcgggacaagcgccucgccuacuccggcaucccccugaaccugacccucgacaaccggguggccgaccagcugugggugcccgacaccuacuuccugaacgacaagaaguccuucguccacggggugaccgugaagaaccgcaugauccggcuccaccccgacggcacgguccuguacgggcugcgcaucaccaccaccgcggccugcaugauggaccuccggcgcuacccccuggacgagcagaacugcacgcuggagaucgagagcuacggcuacaccaccgacgacaucgaguucuacuggcggggcggggacaaggccgugaccggcguggagcgcaucgagcucccgcaguucagcaucgucgagcaccggcuggugucccgcaacguggucuucgccacgggggcguacccccggcugagccucuccuuccgccugaagcggaacaucggcuacuucauccugcagaccuacaugcccagcauccucaucaccauccuguccugggugagcuucuggaucaacuacgacgccuccgccgcccgcguggcccugggcaucaccacgguccucaccaugaccaccaucaacacgcaccuccgggagacccugcccaagaucccguacgugaaggcgaucgacauguaccugauggggugcuucgucuucguguuccuggcccugcucgaguacgccuucgugaacuacaucuucuucggccgcgggccccagcggcagaagaagcuggccgagaagaccgccaaggcgaagaacgaccgcagcaaguccgagagcaaccgcgucgacgcccacggcaacauccugcucaccucccuggaggugcacaacgagaugaacgaggugagcgggggcaucggcgacacgcggaacagcgccaucuccuucgacaacagcgggauccaguaccgcaagcaguccaugccccgggagggccacgggcgcuuccugggcgaccggagccucccccacaagaagacccaccuccgccggcgcuccagccagcugaagaucaagaucccggaccugaccgacgucaacgccaucgaccgguggucccgcaucguguuccccuucaccuucagccuguucaaccugguguacuggcucuacuacgucaacuga

SEQ ID NO: 30402 - RNA, 1521 nt, Artificial Sequence
  derived and/or modified sequence opt1 from GABRE__Homo_sapiens__NP_004952
augcugagcaaggugcuccccguccugcugggcauccuccugauccugcagucccgcguggaggggccgcagaccgagagcaagaacgaggccuccagccgggacguggucuacggcccccagccccagccccucgagaaccagcugcuguccgaggagaccaagagcacggagaccgagaccgggucccgcgugggcaagcucccggaggccagccggauccugaacaccauccuguccaacuacgaccacaagcuccgccccgggaucggcgagaagcccacgguggucaccguggagaucagcgugaacucccugggcccccugagcauccucgacauggaguacaccaucgacaucaucuucucccagaccugguacgacgagcggcugugcuacaacgacacguucgagagccugguccucaacgggaacguggugucccagcuguggaucccggacaccuucuuccgcaacagcaagcggacccacgagcacgagaucaccaugcccaaccagaugguccgcaucuacaaggacggcaaggugcuguacacgauccggaugaccaucgacgcggggugcucccuccacaugcugcgcuuccccauggacagccacuccugcccccugagcuucagcuccuucagcuacccggagaacgagaugaucuacaagugggagaacuucaagcucgagaucaacgagaagaacuccuggaagcuguuccaguucgacuucaccggcgugagcaacaagaccgagaucaucacgacccccgucggggacuucauggugaugaccaucuucuucaacgugucccggcgcuucggcuacgucgccuuccagaacuacgugcccagcuccgugaccacgaugcugagcugggucuccuucuggaucaagaccgagagcgcccccgcccggaccucccucggcaucaccagcgugcugacgaugaccacccuggggaccuucucccgcaagaacuucccgcgggugagcuacaucacggcccucgacuucuacaucgcgaucugcuucgucuucugcuucugcgcccugcuggaguucgccgugcucaacuuccugaucuacaaccagaccaaggcccacgcgucccccaagcugcgccacccccggaucaacagccgcgcccacgcccggacccgcgcccggucccgcgccugcgcgcgccagcaccaggaggccuucgucugccagaucgugaccacggagggcagcgacggggaggagcggcccuccugcagcgcccagcagccgcccagccccggcucccccgagggcccgcgcagccucugcuccaagcuggccugcugcgaguggugcaagcgguucaagaaguacuucugcauggugcccgacugcgaggggagcaccuggcagcagggccgccugugcauccacgucuaccggcucgacaacuacucccgcgugguguuccccgucaccuucuucuucuucaacgugcuguacuggcuggugugccucaaccuguga

SEQ ID NO: 30403 - RNA, 1398 nt, Artificial Sequence
  derived and/or modified sequence opt1 from GABRG1__Homo_sapiens__NP_775807
augggcccccugaaggccuuccucuucagcccguuccugcugcgcucccagagccgcggggugcggcucgucuuccugcugcucacccugcaccugggcaacugcguggacaaggccgacgacgaggacgacgaggaccucaccgugaacaagacguggguccuggcgcccaagauccacgagggggacaucacccagauccugaacucccuccugcagggcuacgacaacaagcugcggcccgacaucggggugcgccccaccgugaucgagaccgacgucuacgugaacagcaucggcccgguggaccccaucaacauggaguacacgaucgacaucaucuucgcccagaccugguucgacucccggcucaaguucaacagcaccaugaagguccugaugcugaacuccaacauggugggcaagaucuggauccccgacaccuucuuccgcaacagccggaaguccgacgcccacuggaucacgacccccaaccgccuccugcggaucuggaacgacgggcgcgugcuguacacccuccggcugaccaucaacgccgagugcuaccugcagcuccacaacuucccgauggacgagcacagcugcccccuggaguucuccagcuacggcuaccccaagaacgagaucgaguacaaguggaagaagcccuccgucgagguggccgacccgaaguacuggcgccuguaccaguucgcguucguggggcuccggaacagcacggagaucacccacaccaucuccggcgacuacgucaucaugaccaucuucuucgaccugagccgccggaugggguacuucacgauccagaccuacauccccugcauccugaccguggugcucuccugggucagcuucuggaucaacaaggacgccgugcccgcccgcaccucccugggcaucacgaccgugcugaccaugaccacgcucagcaccaucgcccgcaagagccugcccaaggucuccuacgugaccgcgauggaccuguucgugagcgucugcuucaucuucguguucgccgcccucauggaguacggcacccugcacuacuucacguccaaccagaaggggaagaccgccaccaaggaccggaagcugaagaacaaggccagcaugaccccgggccuccaccccggguccacgcugauccccaugaacaacaucagcgucccccaggaggacgacuacggcuaccagugccuggagggcaaggacugcgcguccuucuucugcugcuucgaggacugccggaccgggagcuggcgcgagggccggauccacauccgcaucgccaagaucgacuccuacagccgcaucuucuucccgaccgccuucgcccucuucaaccugguguacugggugggguaccuguaccucuga

SEQ ID NO: 30404 - RNA, 1404 nt, Artificial Sequence
  derived and/or modified sequence opt1 from GABRG2__Homo_sapiens__NP_000807
augagcucccccaacaucuggagcaccggcuccagcguguacuccaccccggucuucagccagaagaugacgguguggauccugcuccugcugucccucuaccccggguucaccagccagaaguccgacgacgacuacgaggacuacgccagcaacaagaccugggugcugacccccaagguccccgagggcgacgugacggugauccugaacaaccuccuggagggguacgacaacaagcugcgcccggacaucggcgucaagcccacccucauccacaccgacauguacgugaacuccaucgggcccgugaacgccaucaacauggaguacaccaucgacaucuucuucgcgcagacgugguacgaccggcgccugaaguucaacagcaccaucaagguccugcggcucaacuccaacauggugggcaagaucuggauccccgacaccuucuuccgcaacagcaagaaggccgacgcccacuggaucaccacgccgaaccggaugcugcgcaucuggaacgacggccgggugcuguacacccuccgccugaccaucgacgccgagugccagcugcagcuccacaacuuccccauggacgagcacuccugcccccuggaguucagcuccuacggguacccccgggaggagaucgucuaccaguggaagcgcagcuccguggaggugggcgacacccggagcuggcgccuguaccaguucagcuucgucgggcuccggaacacgaccgagguggugaagaccaccuccggcgacuacgucgugaugagcguguacuucgaccugucccgccggaugggguacuucacgauccagaccuacaucccgugcacccugaucgucgugcucagcuggguguccuucuggaucaacaaggacgccguccccgcgcgcaccagccugggcaucacgaccgugcugaccaugaccacgcucuccaccaucgcccgcaagagccugcccaaggucuccuacgugaccgccauggaccuguucgugagcgucugcuucaucuucguguucuccgcccucguggaguacggcacccugcacuacuucgucagcaaccggaagcccuccaaggacaaggacaagaagaagaagaacccggcgcccacgaucgacauccggccccgcagcgccaccauccagaugaacaacgccacccaccuccaggagcgggacgaggaguacggguacgagugccuggacggcaaggacugcgccuccuucuucugcugcuucgaggacugccgcaccggggccuggcgccacggccggauccacauccgcaucgcgaagauggacagcuacgcccggaucuucuuccccacggccuucugccuguucaaccugguguacuggguguccuaccucuaccuguga

SEQ ID NO: 30405 - RNA, 762 nt, Artificial Sequence
  derived and/or modified sequence opt1 from GABRG3__Homo_sapiens__NP_001257802
auggcccccaagcugcuccugcugcucugccuguucagcggccugcacgcccgcucccggaagguggaggaggacgaguacgaggacagcuccagcaaccagaaguggguccucgcgccgaagucccaggacaccgacgugacccugauccugaacaagcuccugcgcgaguacgacaagaagcugcggcccgacaucgggaucaagcccacggugaucgacgucgacaucuacgugaacagcaucggccccguguccagcaucaacauggaguaccagaucgacaucuucuucgcccagaccuggaccgacucccgccuccgguucaacagcaccaugaagauccugacgcugaacuccaacauggucgggcucaucuggaucccggacaccaucuuccgcaacagcaagaccgccgaggcccacuggaucaccacgcccaaccagcugcugcggaucuggaacgacggcaagauccucuacacccugcgccugaccaucaacgccgagugccagcuccagcugcacaacuuccccauggacgagcacuccugcccccugaucuucagcuccuacggguacccgaaggaggagaugaucuaccgguggcgcaagaacagcguggaggcggccgaccagaaguccuggcggcucuaccaguucgacuucaugggccugcgcaacaccacggagaucgugaccaccagcgccggccggaaccugcucaaggaggcccagcuguccaaggcgcgcgaggccuga

SEQ ID NO: 30406 - RNA, 1323 nt, Artificial Sequence
  derived and/or modified sequence opt1 from GABRP__Homo_sapiens__XP_011532807
augaacuacagccugcaccucgccuucgugugccugucccuguucaccgagcgcaugugcauccagggcagccaguucaacgucgagguggggcgguccgacaagcucagccugcccggcuucgagaaccugaccgccggguacaacaaguuccuccgcccgaacuucggcggggagcccgugcagaucgcgcugacgcuggacaucgccuccaucagcuccaucagcgaguccaacauggacuacaccgccaccaucuaccuccggcagcgcuggauggaccagcggcuggucuucgagggcaacaagagcuucacccuggacgcccgccucguggaguuccugugggugcccgacacguacaucgucgaguccaagaaguccuuccugcacgaggugaccgugggcaaccggcucauccgccuguucagcaacgggaccguccuguacgcccuccggaucaccacgaccguggcgugcaacauggaccugagcaaguaccccauggacacccagaccugcaagcugcagcucgaguccuggggcuacgacgggaacgacguggaguucacguggcugcgcggcaacgacagcguccgggggcuggagcaccuccgccuggcccaguacaccaucgagcgguacuucacccuggugacccgcucccagcaggagacgggcaacuacacccggcucgugcugcaguucgagcugcgccggaacguccucuacuucauccuggagaccuacgugccgagcaccuuccuggugguccucuccugggugagcuucuggaucagccuggacuccgugcccgcccgcacgugcaucggcgucaccaccgugcugagcaugaccacgcucaugaucgggucccggaccagccugcccaacaccaacugcuucaucaaggccaucgacguguaccugggcaucugcuucuccuucgucuucggggcgcuccuggaguacgccguggcccacuacagcucccugcagcagauggccgccaaggaccgcggcaccacgaaggaggucgaggaggugagcaucaccaacaucaucaacuccagcaucuccagcuucaagcggaagaucuccuucgcgagcaucgagaucuccagcgacaacguggacuacuccgaccucaccaugaagaccagcgacaaguucaaguucgucuuccgcgagaagaugggccgcaucguggacuacuucacgauccagaaccccuccaacguggaccacuacagcaagcugcuguucccgcucaucuucaugcuggccaacgucuucuacugggccuacuacauguacuucuga

SEQ ID NO: 30407 - RNA, 1899 nt, Artificial Sequence
  derived and/or modified sequence opt1 from GABRQ__Homo_sapiens__NP_061028
augggcauccgcgggaugcugcgggccgccgugauccuccugcugauccgcaccuggcucgcggagggcaacuaccccagcccgauccccaaguuccacuucgaguucuccagcgccguccccgagguggugcugaaccuguucaacugcaagaacugcgccaacgaggccgucgugcagaagauccucgaccgggugcugucccgcuacgacguccggcugcgccccaacuucgggggcgccccggugcccgugcggaucagcaucuacgucaccuccaucgagcagaucagcgagaugaacauggacuacacgaucaccauguucuuccaccagaccuggaaggacucccgccucgcguacuacgagaccacgcugaaccugacccucgacuaccggaugcacgagaagcugugggugcccgacugcuacuuccugaacagcaaggacgccuucgugcacgacgucaccguggagaaccgcguguuccagcuccaccccgacgggaccguccgguacggcauccgccugacgaccaccgccgccugcucccuggaccuccacaaguucccgauggacaagcaggcgugcaaccuggugguggagagcuacggcuacaccgucgaggacaucauccuguucugggacgacaacgggaacgccauccacaugacggaggagcuccacaucccccaguucaccuuccugggccggaccaucaccuccaaggagguguacuucuacacggggagcuacauccgccugauccucaaguuccaggugcagcgggaggucaacuccuaccugguccagguguacuggcccaccgugcugaccaccaucacgagcuggaucuccuucuggaugaacuacgacagcuccgccgcccgcgugaccaucggccucaccagcaugcugauccugaccacgaucgacucccaccuccgggacaagcugcccaacaucagcugcaucaaggccaucgacaucuacauccuggucugccucuucuucguguuccugagccugcucgaguacguguacaucaacuaccuguucuacucccgcgggccgcggcgccagccccggcgccaccgccggccccgccgggucaucgcgcgcuaccgguaccagcaggucguggugggcaacgugcaggacggccugaucaacguggaggacggggucagcucccuccccaucaccccggcccaggcgccccuggccagccccgagucccugggcagccucaccuccaccagcgagcaggcccagcuggccacguccgagagccugagcccccucaccucccuguccgggcaggccccgcuggccaccggcgagagccucuccgaccugcccagcaccuccgagcaggcccgccacagcuacggcgugcgguucaacggguuccaggccgacgacuccaucauccccacggagauccgcaaccggguggaggcgcacggccacggggucacccacgaccacgaggacagcaacgagagccuguccagcgacgagcgccacggccacgggcccuccggcaagccgaugcugcaccacggcgagaagggggugcaggaggccggcugggaccucgacgacaacaacgacaagagcgacugccuggccaucaaggagcaguucaagugcgacaccaacuccaccugggggcugaacgacgacgagcucauggcccacggccaggagaaggacagcuccagcgaguccgaggacagcugcccgcccucccccgggugcagcuucacggagggcuucuccuucgaccuguucaaccccgacuacgugcccaaggucgacaaguggagccgguuccuguucccccucgccuucggccuguucaacaucguguacuggguguaccacauguacuga

SEQ ID NO: 30408 - RNA, 1389 nt, Artificial Sequence
  derived and/or modified sequence opt1 from GABRR1__Homo_sapiens__NP_001243632
augcuggccgugcccaacaugcgcuucggcaucuuccuccugugguggggguggguccuggccaccgagagccggaugcacuggccgggccgcgaggugcacgagauguccaagaaggggagccccauccuccggcgcucccccgacaucaccaagagcccccugacgaaguccgagcagcugcuccggaucgacgaccacgacuucagcaugcgcccgggcuucgggggccccgcgauccccgugggcgucgacguccagguggagucccuggacagcaucuccgagguggacauggacuucaccaugacccuguaccuccggcacuacuggaaggacgagcgccugagcuuccccuccaccaacaaccugagcaugacguucgacgggcggcucgugaagaagaucugggugccggacauguucuucguccacuccaagcgcagcuucauccacgacaccaccaccgacaacgugaugcugcgggugcagcccgacggcaagguccuguacucccuccgcgugacggugaccgccaugugcaacauggacuucagccgguucccccuggacacccagaccugcucccuggagaucgagagcuacgccuacacggaggacgaccucaugcuguacuggaagaaggggaacgacucccugaagaccgacgagcgcaucagccucagccaguuccugauccaggaguuccacaccaccacgaagcuggccuucuacuccagcaccggcugguacaaccggcucuacaucaacuucacccugcgccggcacaucuucuucuuccugcuccagaccuacuuccccgccacgcugauggucaugcuguccugggugagcuucuggaucgaccgccgggcggugccggcccgcgucccccucgggaucaccaccgugcugaccauguccacgaucaucaccggcgugaacgccagcaugccccgggucuccuacaucaaggccguggacaucuaccugugggugagcuucgucuucguguuccucuccguccuggaguacgcggccgugaacuaccugaccaccgugcaggagcgcaaggagcagaagcuccgcgagaagcugcccugcacgagcggccugccgccgccccggaccgccaugcucgacgggaacuacuccgacggcgaggucaacgaccuggacaacuacaugcccgagaacggggagaagcccgaccgcaugauggugcagcugacccucgccagcgagcgguccagcccccagcgcaagucccagcggagcuccuacgugagcaugcgcaucgacacccacgccaucgacaaguacucccggaucaucuuccccgcggccuacauccuguucaaccugaucuacuggagcaucuucagcuga

SEQ ID NO: 30409 - RNA, 1398 nt, Artificial Sequence
  derived and/or modified sequence opt1 from GABRR2__Homo_sapiens__NP_002034
augcccuacuucacccgccugauccucuuccuguucugccugauggugcucgucgagagccggaagccgaagcgcaagcgguggaccggccagguggagaugcccaagcccucccaccuguacaagaagaaccuggacgugacgaagauccgcaaggggaagccccagcagcuccugcgggucgacgagcacgacuucagcaugcgcccggccuucggcgggcccgccauccccgugggcguggacguccagguggagucccuggacagcaucuccgagguggacauggacuucaccaugacccucuaccugcggcacuacuggaaggacgagcgccuggcguucagcuccgccagcaacaaguccaugaccuucgacgggcggcucgucaagaagaucugggugcccgacguguucuucguccacagcaagcgcuccuucacgcacgacaccaccaccgacaacaucaugcugcggguguucccggacggccacgugcuguacagcaugcgcaucacggucaccgccaugugcaacauggacuucucccacuucccccucgacagccagaccugcucccuggagcuggagagcuacgccuacaccgacgaggaccucaugcuguacuggaagaacggcgacgagucccugaagacggacgagaagaucagccucucccaguuccugauccagaaguuccacaccaccagccggcuggccuucuacagcuccaccgggugguacaaccgccucuacaucaacuucacgcugcggcgccacaucuucuucuuccugcuccagaccuacuuccccgcgacccugauggugaugcugagcuggguguccuucuggaucgaccggcgcgccguccccgcccgggugagccucggcaucaccacggugcugaccaugaccaccaucaucacgggggucaacgccuccaugccgcgcgugagcuacgugaaggcggucgacaucuaccuguggguguccuucgucuucguguuccucagcgugcuggaguacgccgccgucaacuaccugaccaccgugcaggagcggaaggagcgcaagcuccgcgagaaguuccccugcaugugcggcaugcugcacuccaagaccaugaugcuggacgggagcuacuccgagagcgaggccaacucccucgccggcuacccccggagccacauccugacggaggaggagcgccaggacaagaucgugguccaccugggccucuccggggaggcgaacgccgcccggaagaagggccugcugaaggggcagaccggcuuccgcaucuuccagaacacccacgccaucgacaaguacagccggcucaucuuccccgccuccuacaucuucuucaaccugaucuacuggagcguguucuccuga

SEQ ID NO: 30410 - RNA, 1785 nt, Artificial Sequence
  derived and/or modified sequence opt1 from GAD1__Homo_sapiens__NP_000808
auggccagcuccacccccagcuccagcgccaccuccagcaacgcgggcgccgacccgaacacgaccaaccugcgccccaccaccuacgacacguggugcgggguggcccacggcugcacccggaagcucgggcugaagaucugcggcuuccugcagcgcaccaacucccucgaggagaagucccggcuggucagcgccuucaaggagcgccagagcuccaagaaccugcucagcugcgagaacuccgaccgggacgcccgcuuccggcgcaccgagacggacuucagcaaccuguucgcgcgggaccugcuccccgccaagaacggggaggagcagaccgugcaguuccugcuggagguggucgacauccuccugaacuacgugcgcaagaccuucgaccgguccaccaaggugcuggacuuccaccacccccaccagcuccuggagggcauggagggcuucaaccuggagcucagcgaccacccggagucccuggagcagauccuggucgacugccgcgacacgcucaaguacggggugcggaccggccacccccgcuucuucaaccagcugagcaccgggcuggacaucaucggccucgccggggaguggcugaccuccacggccaacaccaacauguucaccuacgagaucgcgcccguguucguccugauggagcagaucacccucaagaagaugcgggagaucgugggcuggagcagcaaggacggcgacgggaucuucucccccggcggggccaucagcaacauguacuccaucauggccgcccgcuacaaguacuucccggaggugaagacgaagggcauggccgcgguccccaagcuggugcuguucaccagcgagcagucccacuacagcaucaagaaggccggcgccgcccucggguucggcaccgacaacgugauccugaucaagugcaacgagcgggggaagaucauccccgccgacuucgaggcgaagauccuggaggccaagcagaagggcuacguccccuucuacgugaacgccaccgccgggacgaccguguacggcgccuucgacccgauccaggagaucgcggacaucugcgagaaguacaaccucuggcugcacgucgacgccgccuggggcgggggccugcucaugucccgcaagcaccggcacaagcugaacgggaucgagcgcgccaacagcgugaccuggaacccccacaagaugaugggcgugcugcuccagugcuccgccauccuggucaaggagaaggggauccugcagggcugcaaccagaugugcgcgggcuaccucuuccagcccgacaagcaguacgacgugagcuacgacaccggggacaaggccauccagugcggccggcacguggacaucuucaaguucuggcugauguggaaggccaaggggacggucggcuucgagaaccagaucaacaagugccuggagcucgccgaguaccuguacgcgaagaucaagaaccgcgaggaguucgagaugguguucaacggggagcccgagcacaccaacgucugcuucugguacaucccgcagucccugcgcggcgugcccgacagcccccagcggcgcgagaagcuccacaagguggcccccaagaucaaggcccugaugauggaguccggcaccaccauggucggguaccagccgcagggcgacaaggccaacuucuuccggauggugaucagcaaccccgccgcgacgcaguccgacaucgacuuccugaucgaggagaucgagcgccuggggcaggaccucuga

SEQ ID NO: 30411 - RNA, 1758 nt, Artificial Sequence
  derived and/or modified sequence opt1 from GAD2__Homo_sapiens__NP_001127838
auggccagccccggcuccggguucuggagcuucggcuccgaggacgggagcggcgacuccgagaacccggggaccgcccgcgcguggugccagguggcccagaaguucaccggcggcaucgggaacaagcugugcgcccuccuguacggcgacgccgagaagcccgccgagagcgggggcucccagccgccccgggcggccgcccgcaaggccgcgugcgccugcgaccagaagcccugcagcugcuccaaggucgacgugaacuacgccuuccugcacgccacggaccuccugcccgccugcgacggggagcggcccacccuggcguuccuccaggacgugaugaacauccugcugcaguacgucgucaagagcuucgaccgcuccaccaaggugaucgacuuccacuaccccaacgagcuccugcaggaguacaacugggagcuggccgaccagccgcagaaccucgaggagauccugaugcacugccagaccacgcugaaguacgccaucaagaccggccacccccgguacuucaaccagcucagcaccggccuggacaugguggggcuggccgccgacuggcucaccuccacggcgaacaccaacauguucaccuacgagaucgcccccguguucgugcugcuggaguacgucacccucaagaagaugcgcgagaucaucggcuggcccgggggcagcggcgacgggaucuucuccccgggcggggccaucagcaacauguacgccaugaugaucgcccgguucaagauguuccccgaggugaaggagaagggcauggcggcccugccccgccugaucgccuucacguccgagcacagccacuucucccucaagaagggggccgccgcgcugggcaucggcaccgacagcgugauccugaucaagugcgacgagcgggggaagaugauccccagcgaccucgagcgccggauccuggaggccaagcagaagggcuucgucccguuccugguguccgccaccgccgggaccacgguguacggcgcguucgacccccuccuggccgucgccgacaucugcaagaaguacaagaucuggaugcacguggacgccgccuggggcgggggccugcucaugagccgcaagcacaaguggaagcuguccgggguggagcgggcgaacagcgucaccuggaacccccacaagaugaugggcgugccccugcagugcuccgcccuccuggugcgcgaggaggggcugaugcagaacugcaaccagaugcacgccagcuaccucuuccagcaggacaagcacuacgaccuguccuacgacaccggcgacaaggcccugcagugcgggcggcacgucgacguguucaagcucuggcugauguggcgcgccaagggcaccacgggcuucgaggcgcacguggacaagugccuggagcucgccgaguaccuguacaacaucaucaagaaccgggagggguacgagauggucuucgacggcaagccgcagcacaccaacgugugcuucugguacaucccgcccagccugcgcacccucgaggacaacgaggagcggaugucccgccugagcaaggucgcccccgugaucaaggcccggaugauggaguacgggaccacgaugguguccuaccagccccugggcgacaaggucaacuucuuccgcauggugaucagcaaccccgccgcgacccaccaggacaucgacuuccugaucgaggagaucgagcgccucggccaggaccuguga

SEQ ID NO: 30412 - RNA, 483 nt, Artificial Sequence
  derived and/or modified sequence opt1 from GADD45B__Homo_sapiens__NP_056490
augacccuggaggagcucguggccugcgacaacgccgcgcagaagaugcagaccgucacggccgccguggaggagcugcugguggccgcccagcgccaggaccggcucaccgucggcguguacgagagcgcgaagcugaugaacguggaccccgacuccgucgugcugugccuccuggccaucgacgaggaggaggaggacgacaucgcccugcagauccacuucacccucauccagagcuucugcugcgacaacgacaucaacaucgugcgcgucuccgggaugcagcggcuggcccagcugcucggcgagccggcggagacccaggggacgaccgaggcccgcgaccugcacugccugcucgugaccaacccccacaccgacgccuggaagucccacggccugguggaggucgccagcuacugcgaggagagccgggggaacaaccagugggugcccuacaucucccugcaggagcgcuga

SEQ ID NO: 30413 - RNA, 480 nt, Artificial Sequence
  derived and/or modified sequence opt1 from GADD45G__Homo_sapiens__NP_006696
augacccuggaggaggugcgcggccaggacaccguccccgagagcacggcccggaugcagggggccggcaaggcgcuccacgagcugcugcucuccgcccagcgccaggggugccugaccgccggcguguacgagagcgccaaggugcugaacgucgacccggacaacgugaccuucugcgugcucgccgcgggggaggaggacgagggcgacaucgcccugcagauccacuucacccugauccaggccuucugcugcgagaacgacaucgacaucguccgggugggcgacgugcagcgccucgccgcgaucgucggggccggcgaggaggccggggcccccggcgaccugcacugcauccugaucuccaaccccaacgaggacgccuggaaggaccccgcgcucgagaagcugagccuguucugcgaggagucccggagcgugaacgacugggugccguccaucacgcuccccgaguga

SEQ ID NO: 30414 - RNA, 669 nt, Artificial Sequence
  derived and/or modified sequence opt1 from GADD45GIP1__Homo_sapiens__NP_443082
auggccgccagcgugcgccaggcgcggucccugcucggcgucgccgccacccuggcccccgggagccgcggcuaccgggcccgcccgccgccccggcgccggcccgggccccgcuggcccgaccccgaggaccugcucacgccccgguggcagcugggcccgcgcuacgcggccaagcaguucgcccgguacggggccgcguccggcguggugcccggcagccuguggcccucccccgagcagcuccgcgagcuggaggccgaggagcgggagugguacccgagccuggccaccaugcaggagucccuccgcgucaagcagcuggccgaggagcagaagcggcgcgagcgggagcagcacaucgccgagugcauggcgaagaugccccagaugaucgugaacuggcagcagcagcagcgcgagaacugggagaaggcccaggccgacaaggagcggcgcgcccggcugcaggccgaggcgcaggagcuccugggguaccagguggacccccgcagcgcccgcuuccaggagcugcuccaggaccuggagaagaaggagcggaagcgccugaaggaggagaagcagaagcggaagaaggaggcccgcgccgccgcgcucgccgccgccgucgcccaggaccccgcggccuccggcgccccgagcuccuga

SEQ ID NO: 30415 - RNA, 1566 nt, Artificial Sequence
  derived and/or modified sequence opt1 from GADL1__Homo_sapiens__NP_997242
augagcuccgacagcgaccgccagugccccguggacggcgacaucgaccagcaggagaugaucccguccaagaagaacgccguccugguggacggggugguccucaacggccccaccaccgacgccaaggcgggggagaaguucguggaggaggccugccggcugaucauggaggaggugguccugaaggccacggacgugaacgagaaggugugcgaguggcgcccgcccgagcagcucaagcagcugcuggaccucgagaugcgggacagcggcgagccgccccacaagcugcuggagcucugccgcgacgucauccacuacuccgugaagaccaaccacccccgguucuucaaccagcuguacgccgggcuggacuacuacagccucguggcccgcuucaugaccgaggcgcugaaccccuccgucuacaccuacgaggugagccccguguuccugcucgucgaggaggccgugcugaagaagaugaucgaguucaucggcuggaaggagggcgacgggaucuucaaccccggcggguccgugagcaacauguacgccaugaaccuggcccgguacaaguacugccccgacaucaaggagaagggccucuccgggagcccccgccugauccuguucacguccgcggagugccacuacagcaugaagaaggccgccuccuuccucggcaucggcaccgagaacgucugcuucguggagaccgacgggcggggcaagaugaucccggaggagcuggagaagcaggucuggcaggcccgcaaggagggggccgcgcccuuccuggugugcgccaccagcggcacgaccgugcucggcgccuucgacccccuggacgagaucgccgacaucugcgagcggcacucccuguggcuccacguggacgccagcuggggcggguccgcgcugaugagccgcaagcaccggaagcugcuccacgggauccaccgcgccgacagcgucgccuggaacccccacaagaugcugauggccggcauccagugcugcgcccugcucgugaaggacaaguccgaccugcugaagaagugcuacagcgcgaaggccuccuaccucuuccagcaggacaaguucuacgacgucagcuacgacaccggggacaaguccauccagugcagccggcgcccggacgccuucaaguucuggaugaccuggaaggcccugggcacgcugggccucgaggagcgggugaaccgcgcccuggcgcugucccgguaccucguggacgagaucaagaagcgcgagggguucaagcugcugauggagcccgaguacgccaacaucugcuucugguacaucccgcccagccuccgggagauggaggagggccccgaguucugggccaagcugaaccuggucgcccccgcgaucaaggagcgcaugaugaagaaggggucccucaugcugggcuaccagccccaccgcgggaaggugaacuucuuccgccagguggucaucagcccccaggugucccgggaggacauggacuuccugcuggacgagaucgaccuccugggcaaggacauguga

SEQ ID NO: 30416 - RNA, 351 nt, Artificial Sequence
  derived and/or modified sequence opt1 from GAGE10__Homo_sapiens__NP_001091883
augagcuggcgcggccgguccaccuaccgcccccggccgcgccgguacguggagccgcccgagaugaucgggcccaugcugcccgagcaguucagcgacgagguggagcccgccacccccgaggagggcgagcccgccacgcagcgccaggacccggcggccgcccaggagggggaggacgagggcgccuccgccgggcagggccccaagcccgaggcggacagccaggagcagguccaccccaagaccggcugcgagugcggggacggcccggacgggcaggagaugggccuccccaaccccgaggaggugaagcggcccgaggagggggagaagcagucccagugcuga

SEQ ID NO: 30417 - RNA, 354 nt, Artificial Sequence
  derived and/or modified sequence opt1 from GAGE1__Homo_sapiens__NP_001035753
augagcuggcgcggccgguccaccuacuacuggccccgcccgcggcgcuacgugcagccgcccgagaugaucgggcccaugcggcccgagcaguucagcgacgaggucgagcccgccacccccgaggagggcgagcccgccacgcagcgccaggacccggcggccgcccaggagggggaggacgagggcgccuccgccgggcagggccccaagcccgaggcggacagccaggagcagggccacccccagaccgggugcgagugcgaggacggcccggacgggcaggagauggacccgcccaaccccgaggaggugaagacccccgaggagggcgaggggcagucccagugcuga

SEQ ID NO: 30418 - RNA, 3936 nt, Artificial Sequence
  derived and/or modified sequence opt1 from GAK__Homo_sapiens__NP_005246
augagccugcuccaguccgcccuggacuuccuggccggccccgggagccucggcggggcguccggccgcgaccagagcgacuucguggggcagaccgucgagcugggcgagcugcggcuccgcgugcggcgcgugcuggccgagggcggguucgccuucgucuacgaggcccaggacgugggcuccgggcgggaguacgcccugaagcgccuccugagcaacgaggaggagaagaaccgggcgaucauccaggaggugugcuucaugaagaagcuguccggccacccgaacaucguccaguucugcagcgccgccuccaucgggaaggaggagagcgacaccggccaggccgaguuccuccugcugacggagcucugcaagggccagcugguggaguuccugaagaagauggagucccgcgggccccucagcugcgacaccgugcugaagaucuucuaccagaccugccgggcgguccagcacaugcaccgccagaagccccccaucauccaccgggaccugaagguggagaaccuccugcuguccaaccagggcaccaucaagcucugcgacuucgggagcgccacgaccaucucccacuacccggacuacagcugguccgcccagcgccgggcccugguggaggaggagaucacccgcaacaccacgcccauguaccggacccccgagaucaucgaccuguacagcaacuuccccaucggcgagaagcaggacaucugggcccucggcugcauccuguaccugcucugcuuccgccagcacccguucgaggacggggcgaagcugcggaucgucaacggcaaguacuccauccccccccacgacacccaguacaccguguuccacagccugauccgcgccaugcuccaggugaaccccgaggagcggcugagcaucgccgaggucgugcaccagcugcaggagaucgccgccgcgcgcaacgugaacccgaagucccccaucacggagcuccuggagcagaacgggggcuacgggagcgccacccugucccggggcccccccccgcccgucggccccgccgggagcggcuacuccgggggccucgcccuggccgaguacgaccagcccuacgggggcuuccuggacauccuccgcggcgggaccgagcgccuguucaccaaccugaaggacacgagcuccaaggugauccagagcguggcgaacuacgccaagggcgaccucgacaucuccuacaucaccagccggaucgccgucauguccuucccggccgaggggguggagagcgcccugaagaacaacaucgaggacgugcgccuguuccucgacuccaagcaccccggccacuacgcggucuacaaccugagcccccggaccuaccgccccucccgguuccacaaccgcgugagcgagugcgggugggccgcccggcgcgccccgcaccugcacacccuguacaacaucugccggaacaugcacgcguggcuccgccaggaccacaagaacgucugcguggugcacugcauggacggccgggccgccuccgccgucgccgugugcagcuuccugugcuucugccgccuguucuccacggcggaggccgccguguacauguucagcaugaagcggugcccccccggcaucuggcccagccacaagcgcuacaucgaguacaugugcgacauggucgccgaggagccgaucaccccccacuccaagcccauccucgugcgggccguggucaugaccccggugccccuguucagcaagcagcgcuccgggugccggcccuucugcgagguguacgucggcgacgagcgcguggcgagcaccucccaggaguacgacaagaugcgggacuucaagaucgaggacgggaaggccgugaucccccugggcgucacggugcagggcgacgugcucaucgucaucuaccacgcccgcagcacccuggggggccgccugcaggccaagauggccuccaugaagauguuccagauccaguuccacaccggguucgugccgcggaacgcgaccacggugaaguucgccaaguacgaccucgacgccugcgacauccaggagaaguaccccgaccuguuccaggucaaccuggagguggagguggagccccgcgaccggcccagccgcgaggccccgcccugggagaacuccagcaugcggggccucaaccccaagauccuguucuccagccgcgaggagcagcaggacauccuguccaaguucgggaagcccgagcucccgcggcagcccggcagcaccgcgcaguacgacgccggcgccgggucccccgaggccgagcccaccgacagcgacuccccgcccagcagcuccgccgacgcgagccgcuuccugcacacccuggacuggcaggaggagaaggaggccgagacgggcgccgagaacgccuccagcaaggaguccgagagcgcccucauggaggaccgggacgaguccgaggucagcgacgaggggggcucccccaucagcuccgaggggcaggagccccgcgcggacccggagccccccggccuggccgccggccuggugcagcaggaccucguguucgaggucgagacccccgccgugcugccggagcccgugccccaggaggacggggucgaccugcucggccugcacagcgaggugggggccggcccggcggugcccccccaggccugcaaggcccccuccagcaacaccgaccugcucuccugccugcuggggccgcccgaggccgcgagccagggcccccccgaggaccuccuguccgaggacccgcugcuccuggccagccccgcccccccccuguccguccagagcaccccgcggggcgggccccccgccgccgcggaccccuucggcccgcuccugcccagcuccgggaacaacagccagcccugcuccaaccccgaccuguucggcgaguuccucaacagcgacuccgugacggugccgcccagcuuccccuccgcccacagcgcccccccgcccuccugcagcgccgacuuccugcaccugggggaccuccccggcgagcccuccaagaugaccgccagcuccagcaacccggaccugcugggcgggugggcggccuggaccgagaccgccgccuccgccgucgcgcccacccccgccacggagggcccgcucuucagccccgggggccagcccgcccccugcggcucccaggccagcuggaccaagucccagaacccggaccccuucgccgaccugggggaccugagcagcggccuccaggggucccccgcgggcuuccccccggggggcuucauccccaagaccgccaccacgcccaagggcagcuccagcuggcagaccucccgccccccggcccagggggccagcuggcccccccaggcgaagcccccgcccaaggccugcacccagccccggcccaacuacgccuccaacuucagcgugaucggcgcccgcgaggagcggggggugcgcgccccguccuucgcgcagaagcccaaggucagcgagaacgacuucgaggaccugcuguccaaccagggcuucagcucccggagcgacaagaaggggcccaagaccaucgccgagaugcgcaagcaggaccucgccaaggacacggacccccugaagcugaagcuccuggacuggaucgagggcaaggagcggaacauccgcgcccugcucuccacccugcacaccgugcugugggacggcgagagccgguggaccccgguggggauggccgaccucgucgcgcccgagcaggugaagaagcacuaccgccgcgccgugcuggccguccaccccgacaaggccgccggccagcccuacgagcagcacgcgaagaugaucuucauggagcugaacgacgccugguccgaguucgagaaccaggggagccggccgcucuucuga

SEQ ID NO: 30419 - RNA, 2058 nt, Artificial Sequence
  derived and/or modified sequence opt1 from GALC__Homo_sapiens__NP_000144
auggccgaguggcugcucagcgccuccuggcagcgccgggcgaaggccaugaccgccgccgccggcagcgcggggcgcgccgccgugccccugcugcucugcgcccugcuggcgccgggcggggccuacguccucgacgacuccgacggccuggggcgggaguucgacggcaucggcgccgugagcgggggcggggccaccucccgccugcucgugaacuaccccgagcccuaccggagccagauccuggacuaccuguucaagcccaacuucggcgccucccuccacauccugaaggucgagaucgggggcgacggccagacgaccgacgggaccgagccgagccacaugcacuacgcgcuggacgagaacuacuuccgcggcuacgagugguggcucaugaaggaggccaagaagcggaaccccaacaucacccugaucgggcugcccugguccuuccccggcuggcucggcaagggguucgacuggccguacgugaaccugcagcugacggccuacuacguggucaccuggaucgugggcgccaagcgcuaccacgaccucgacaucgacuacaucgggaucuggaacgagcggagcuacaacgccaacuacaucaagauccugcgcaagaugcugaacuaccagggccuccagcgggugaagaucaucgcguccgacaaccugugggagagcaucuccgccagcaugcugcucgacgccgagcuguucaaggucguggacgugaucggggcccacuaccccggcacccacuccgccaaggacgcgaagcugaccggcaagaagcucuggagcuccgaggacuucagcacgcugaacuccgacaugggggccggcugcugggggcgcauccugaaccagaacuacaucaacggcuacaugaccagcaccaucgccuggaaccucgucgccagcuacuacgagcagcugcccuacgggcggugcggccugaugaccgcccaggagcccugguccggccacuacgugguggagagcccggucuggguguccgcgcacacgacccaguucacccagcccgggugguacuaccucaagaccgugggccaccuggagaagggcgggagcuacgucgcccugacggacgggcucggcaaccugaccaucaucaucgagaccaugucccacaagcacagcaagugcauccgccccuuccugcccuacuucaacgugucccagcaguucgccaccuucgugcucaagggcagcuucuccgagaucccggagcugcaggucugguacacgaagcuggggaagaccagcgagcgguuccucuucaagcagcuggacucccuguggcuccuggacagcgacggcuccuucacccugagccugcacgaggacgagcuguucacccucacgacccugaccaccgggcgcaagggcuccuacccccucccgcccaagagccagcccuuccccuccacguacaaggacgacuucaacguggacuaccccuucuucagcgaggcccccaacuucgcggaccagaccggcguguucgaguacuucaccaacaucgaggacccgggggagcaccacuucacccugcggcagguccugaaccagcgccccaucacgugggccgccgacgccuccaacaccaucagcaucaucggcgacuacaacuggaccaaccucaccaucaagugcgacguguacaucgagacgcccgacaccgggggcgucuucaucgccgggcgggugaacaagggcggcauccugauccgcagcgcgcgggggaucuucuucuggaucuucgccaacggcuccuaccgcgugaccggggaccuggccggcuggaucaucuacgcccucgggcgcgucgaggugaccgccaagaagugguacacccugacgcugaccaucaagggccacuucaccagcggcaugcucaacgacaagucccuguggaccgacauccccgugaacuucccgaagaacgggugggcggccaucggcacgcacagcuucgaguucgcccaguucgacaacuuccuggucgaggccacccgguga

SEQ ID NO: 30420 - RNA, 372 nt, Artificial Sequence
  derived and/or modified sequence opt1 from GAL__Homo_sapiens__NP_057057
auggcccgcggcagcgcccugcuccuggcgucccugcuccuggccgccgcccugagcgccuccgcggggcucuggagccccgccaaggagaagcggggcuggacccugaacuccgccggguaccugcucggcccgcacgccguggggaaccaccgcagcuucuccgacaagaacggccugaccagcaagcgggagcugcgccccgaggacgacaugaagcccggcuccuucgaccggagcauccccgagaacaacaucaugcgcacgaucaucgaguuccucuccuuccugcaccugaaggaggcgggggcccucgaccggcugcuggaccucccggccgccgccagcuccgaggacaucgagcgcagcuga

SEQ ID NO: 30421 - RNA, 1179 nt, Artificial Sequence
  derived and/or modified sequence opt1 from GALK1__Homo_sapiens__NP_000145
auggccgcccugcgccagccccagguggcggagcuccuggccgaggcccggcgcgccuuccgggaggaguucggcgccgagccggagcuggcggucagcgcccccgggcgcgugaaccucaucggcgagcacaccgacuacaaccaggggcuggugcugcccauggcccucgagcugaugaccguccuggugggcagcccccggaaggacgggcucgugucccugcugacgaccuccgagggcgccgacgagccgcagcgccuccaguucccccugcccaccgcgcagcggagccuggagcccggcaccccgcgcugggccaacuacgucaagggggugauccaguacuaccccgccgcgccccuccccggcuucuccgccguggucgugagcuccgugccgcucgggggcgggcugagcuccagcgccucccuggaggucgccacguacaccuuccugcagcagcugugccccgacagcggcaccaucgccgcccgggcccaggugugccagcaggcggagcacuccuucgccggcaugcccugcgggaucauggaccaguucaucagccucaugggccagaaggggcacgcccugcugaucgacugccgcucccucgagaccagccuggugccccuguccgacccgaagcucgccguccugaucacgaacagcaacgugcggcacucccuggccagcagcgaguaccccgugcgccggcgccagugcgaggaggucgcgcgggcccucggcaaggagucccugcgcgaggugcagcuggaggagcucgaggccgcccgggaccuggugagcaaggagggcuuccgccgggcccgccacgucgugggggagauccggcgcaccgcgcaggccgccgccgcgcugcgccggggcgacuaccgcgccuucgggcggcucaugguggagucccaccgcagccugcgggacgacuacgaggucuccugccccgagcuggaccagcucguggaggccgcccuggccguccccggcguguacgggagccgcaugaccggcggcggguucggcgggugcaccgugacgcugcucgaggcguccgccgccccgcacgccaugcggcacauccaggagcacuacggcgggaccgccaccuucuaccugagccaggcggccgacggcgccaagguccugugccucuga

SEQ ID NO: 30422 - RNA, 1344 nt, Artificial Sequence
  derived and/or modified sequence opt1 from GALK2__Homo_sapiens__NP_001001556
augcccgugcuguacgaccgccuccugaagcugaaggagauguucaacagcaaguucggcuccaucccgaaguucuacguccgggcccccgggcgcgugaacaucaucggcgagcacaucgacuacugcggguacagcgugcuccccauggccgucgagcaggacgugcugaucgcgguggagcccgucaagaccuacgcccugcagcucgccaacaccaacccgcuguaccccgacuucuccacgagcgccaacaacauccagaucgacaagaccaagccccuguggcacaacuacuuccucugcggccugaaggggauccaggagcacuucggccuguccaaccucaccggcaugaacugccugguggacgggaacaucccgcccagcuccggccugagcuccagcuccgcccucgugugcugcgcggggcuggucacccugacggugcucggccggaaccugagcaagguggagcuggccgagaucugcgccaaguccgagcgcuacaucgggaccgagggcggcgggauggaccagagcaucuccuuccucgccgaggagggcaccgcgaagcugaucgaguucagcccccugcgggccaccgacgucaagcuccccuccggggccguguucgugaucgccaacagcugcgucgagaugaacaaggccgcgacgucccacuucaacauccgcgugauggagugccggcuggccgccaagcugcucgccaaguacaagagccugcagugggacaaggugcugcgccucgaggagguccaggccaagcugggcaucagccuggaggagaugcuccuggugaccgaggacgcgcugcaccccgagccguacaaccccgaggagaucugccggugccucggcaucucccuggaggagcugcgcacccagauccucagccccaacacccaggacgugcugaucuucaagcuguaccagcgggccaagcacgucuacuccgaggccgcccgcgugcuccaguucaagaagaucugcgaggaggcccccgagaacauggugcagcugcugggggagcucaugaaccagagccacauguccugccgggacauguacgagugcagcugcccggagcuggaccagcuggucgacaucugccgcaaguucggcgcgcaggggucccggcucacgggcgccggguggggcggcugcaccgugagcaugguccccgccgacaagcugcccuccuuccuggccaacgugcacaaggccuacuaccagcgcagcgacgggucccuggcgcccgagaagcagagccucuucgccaccaagccgggcgggggcgcccuggugcugcucgaggccuga

SEQ ID NO: 30423 - RNA, 1029 nt, Artificial Sequence
  derived and/or modified sequence opt1 from GALM__Homo_sapiens__NP_620156
auggccagcgugacccgcgccgucuucggcgagcugcccuccgggggcgggaccguggagaaguuccagcuccagagcgaccugcugcggguggacaucaucuccuggggcugcacgaucaccgcgcucgaggucaaggaccgccaggggcgggccagcgacguggugcugggcuucgccgagcuggagggcuaccuccagaagcagccguacuucggggccgucaucggccgcguggccaaccggaucgcgaaggggaccuucaagguggacggcaaggaguaccaccuggccaucaacaaggagcccaacucccugcacgggggcguccgcggcuucgacaaggugcucuggacgccccgggugcugagcaacgggguccaguucucccgcaucagccccgacggcgaggagggguacccgggcgagcugaaggugugggugaccuacacccucgacggcggggagcugaucgucaacuaccgggcccaggccucccaggcgacccccgugaaccugaccaaccacagcuacuucaaccucgccggccaggccucccccaacaucaacgaccacgaggugacgaucgaggccgacaccuaccugcccgucgacgagacccugaucccgaccggggagguggcccccgugcagggcacggcguucgaccuccgcaagcccgucgagcuggggaagcaccuccaggacuuccaccugaacggcuucgaccacaacuucugccugaagggcagcaaggagaagcacuucugcgcccgggugcaccacgccgccuccgggcgcgugcuggaggucuacaccacccagcccggcgugcaguucuacaccgggaacuuccucgacggcacgcugaaggggaagaacggcgccgucuacccgaagcacagcggcuucugccuggagacccagaacuggcccgacgcggugaaccagccccgguucccgcccgugcuccugcgccccggggaggaguacgaccacaccaccugguucaaguucuccgucgccuga

SEQ ID NO: 30424 - RNA, 1569 nt, Artificial Sequence
  derived and/or modified sequence opt1 from GALNS__Homo_sapiens__NP_000503
auggccgccguggucgcggccacccgcugguggcagcugcuccuggugcugagcgccgccggcaugggggccuccggcgcgccccagccgcccaacauccuccugcugcucauggacgacaugggguggggcgaccuggggguguacggcgagcccagccgggagacccccaaccuggaccgcauggccgccgagggccuccuguucccgaacuucuacuccgccaacccccugugcagccccucccgggcggcccuccugacggggcgccugcccauccggaacggcuucuacaccaccaacgcccacgcccgcaacgccuacaccccgcaggagaucgucgggggcauccccgacagcgagcagcuccugcccgagcugcucaagaaggcgggguacguguccaagaucgugggcaaguggcaccugggccaccggccccaguuccacccgcugaagcacggguucgacgagugguucggcagccccaacugccacuucgggcccuacgacaacaaggcccgccccaacaucccggucuaccgggacugggagauggugggccgcuacuacgaggaguuccccaucaaccucaagacgggcgaggccaaccugacccagaucuaccugcaggaggcccucgacuucaucaagcggcaggcccgccaccaccccuucuuccuguacugggcgguggacgccacccacgcccccgucuacgccuccaagccguuccuggggaccagccagcggggccgcuacggggacgccgugcgggagaucgacgacuccaucggcaagauccucgagcugcugcaggaccuccacguggcggacaacacguucgucuucuucaccagcgacaacggggccgcccugaucuccgcccccgagcagggcggcagcaacgggcccuuccugugcggcaagcagaccaccuucgagggcgggaugcgcgagcccgcccucgcgugguggccggggcacgugacggccggccaggugucccaccagcugggcagcaucauggaccuguucaccaccucccucgcccuggccgggcugaccccgcccagcgaccgggcgaucgacggccucaaccugcugcccacgcuccugcaggggcgccugauggaccggcccaucuucuacuaccgcggcgacacccucauggccgccacccuggggcagcacaaggcccacuucuggaccuggacgaacuccugggagaacuuccggcagggcaucgacuucugccccggccagaacgucagcggggugaccacccacaaccuggaggaccacaccaagcucccccugaucuuccaccugggccgcgacccgggggagcgcuucccccugagcuucgccuccgcggaguaccaggaggcccucagccggaucacguccgugguccagcagcaccaggaggcccuggugcccgcccagccccagcugaacgugugcaacugggccgucaugaacugggcgccgcccggcugcgagaagcucggcaagugccugaccccgcccgagagcauccccaagaagugccuguggucccacuga

SEQ ID NO: 30425 - RNA, 1746 nt, Artificial Sequence
  derived and/or modified sequence opt1 from GALNT12__Homo_sapiens__NP_078918
auguggggccgcaccgcccggcgccggugcccccgcgagcugcggcgcgggcgggaggcccuccuggugcugcucgcgcugcuggcccucgccggccuggggagcguccugcgcgcccagcggggcgccggggcgggcgccgccgagccgggcccgccccgcacgccccggcccgggcgccgggagcccgugaugccccggcccccggugcccgccaacgcgcucggcgcccgcggggaggccguccgccugcagcugcagggcgaggagcuccggcugcaggaggaguccgugcgccugcaccagaucaacaucuaccucagcgaccggaucucccugcaccgccggcugcccgagcgcuggaacccccucugcaaggagaagaaguacgacuacgacaaccugccgcgcaccagcgugaucaucgccuucuacaacgaggccugguccacccugcuccggaccgucuacagcgugcuggagaccucccccgacauccugcucgaggaggugauccuggucgacgacuacagcgaccgcgagcaccugaaggagcggcucgcgaacgagcuguccgggcugcccaaggugcgccucauccgggccaacaagcgcgagggccuggugcgggcccgccugcucggcgccagcgccgcgcgcggggacguccugacguuccuggacugccacugcgagugccacgagggcuggcucgagccccugcugcagcggauccacgaggaggaguccgccguggugugcccggucaucgacgugaucgacuggaacaccuucgaguaccucgggaacagcggcgagccccagaucggcggguucgacuggcggcugguguucaccuggcacaccguccccgagcgcgagcggauccgcaugcagucccccguggacgugauccggagcccgacgauggccggcgggcuguucgccgucuccaagaaguacuucgaguaccucggcagcuacgacaccgggauggagguguggggcggcgagaaccuggaguucuccuuccgcaucuggcagugcgggggcgugcuggagacccaccccugcagccacgucgggcacguguuccccaagcaggcccccuacucccggaacaaggcgcucgccaacagcguccgcgccgccgagguguggauggacgaguucaaggagcuguacuaccaccggaacccgcgcgcccgccuggagcccuucggcgacgugaccgagcggaagcagcuccgcgacaagcugcagugcaaggacuucaagugguuccuggagacggucuaccccgagcugcacgugcccgaggaccggccgggguucuucggcaugcuccagaacaagggccugaccgacuacugcuucgacuacaacccgcccgacgagaaccagaucguggggcaccaggucauccuguaccucugccacggcauggggcagaaccaguucuucgaguacaccagccagaaggagauccgcuacaacacccaccagcccgagggcugcaucgcgguggaggccgggauggacacgcugaucaugcaccugugcgaggagaccgcccccgagaaccagaaguucauccuccaggaggacggcucccuguuccacgagcagagcaagaagugcgugcaggccgcgcggaaggaguccagcgacuccuucgucccccugcuccgcgacugcaccaacagcgaccaccagaagugguucuucaaggagcggaugcuguga

SEQ ID NO: 30426 - RNA, 1686 nt, Artificial Sequence
  derived and/or modified sequence opt1 from GALNT13__Homo_sapiens__NP_001288556
augcgccgguucguguacugcaaggucgugcuggccaccagccucaugugggugcuggucgacguguuccugcuccuguacuucuccgagugcaacaagugcgacgacaagaaggagcgcagccugcuccccgcccugcgggcggugaucucccgcaaccaggagggcccgggggagaugggcaaggccguccugauccccaaggacgaccaggagaagaugaaggagcuguucaagaucaaccaguucaaccucauggccagcgaccugaucgcccucaaccggucccugcccgacgugcgccuggaggggugcaagaccaagguguaccccgacgagcucccgaacacgagcgucgugaucguguuccacaacgaggccugguccacccugcugcggaccgucuacagcgugaucaaccgcagcccccacuaccuccuguccgaggugauccuggucgacgacgcguccgagcgggacuuccucaagcugacccuggagaacuacgugaagaaccucgaggugcccgucaagaucauccgcauggaggagcggagcggccugauccgcgcccggcugcgcggggccgccgcguccaagggccaggugaucacguuccucgacgcccacugcgagugcacccugggcuggcuggagccccuccuggcccggaucaaggaggaccgcaagaccguggucugcccgaucaucgacgugaucagcgacgacaccuucgaguacauggccggguccgacaugacguacggcggguucaacuggaagcugaacuuccggugguaccccgugccccagcgcgagauggaccggcgcaagggcgaccggacccuccccguccgcaccccgaccauggccgggggccuguucagcaucgaccgcaacuacuucgaggagaucggcacguacgacgcggggauggacaucuggggcggggagaaccuggagauguccuuccggaucuggcagugcggcggcagccucgagaucgugaccugcucccacgucgggcacguguuccgcaaggccacccccuacaccuuccccggcgggacgggccacgugaucaacaagaacaaccggcgccuggccgaggucuggauggacgaguucaaggacuucuucuacaucaucagccccgggguggugaaggucgacuacggcgacgugagcgugcggaagacccugcgcgagaaccucaagugcaagccguucuccugguaccuggagaacaucuaccccgacagccagaucccccggcgcuacuacucccugggcgagauccggaacgucgagaccaaccagugccucgacaacauggggcgcaaggagaacgagaaggugggcaucuucaacugccacgggaugggcgggaaccagguguucagcuacaccgccgacaaggagauccggacggacgaccugugccuggacgucucccgccucaacggccccgugaucaugcugaagugccaccacaugcggggcaaccagcugugggaguacgacgccgagagcugccucuccgugaacaaggucgcggacgggagccagcacccgaccguggagaccugcaacgacuccacccugcagaaguggcugcugcgcaacuacacgcggauggagaucuuccgcaacaucuucggcaacagcaccgacuacauccucuga

SEQ ID NO: 30427 - RNA, 1674 nt, Artificial Sequence
  derived and/or modified sequence opt1 from GALNT14__Homo_sapiens__NP_001240755
augcgccggcugacccgccggcucgugcugcccgucuucggcgugcuguggaucaccgugcuccuguucuucugggucacgaagcgcaagcuggaggugccgaccgggcccgaggugcagacccccaaggucuggagccucuucuucaagguggccggcaugucccccugggccccgcagguccccgugagccccacgcccccguaccagcgggggcaccuccccaccggcgggcaccuggcggugugccacuuccccugccuccugcaggaggcccaguuccaccuccagacccagguguuccugcagguccgcugcacccugcugguguacugcaccgaccugcccccgacguccaucaucaucaccuuccacaacgaggcccggagcacccugcugcgcaccauccgguccgugcucaaccgcacgcccacccaccugauccgggagaucauccuggucgacgacuucagcaacgaccccgacgacugcaagcagcucaucaagcugcccaaggugaagugccugcgcaacaacgagcggcagggccucgugcgcucccggauccgcggcgccgacaucgcccaggggaccacccugacguuccuggacagccacugcgaggucaaccgggacuggcuccagccgcugcugcaccgcgugaaggaggacuacacccggguggucugccccgugaucgacaucaucaaccucgacaccuucaccuacaucgaguccgcgagcgagcugcgcggcggguucgacuggucccugcacuuccagugggagcagcucagccccgagcagaaggcccggcgccuggaccccacggagccgauccgcacccccaucaucgccggcgggcuguucgugaucgacaaggccugguucgacuaccucggcaaguacgacauggacauggacaucuggggcggggagaacuucgagaucuccuuccgggucuggaugugcggcgggagccuggagaucgugcccugcucccgcgucggccacguguuccggaagaagcaccccuacguguucccggacggcaacgcgaacaccuacaucaagaacaccaagcgcacggccgaggucuggauggacgaguacaagcaguacuacuacgccgcccggcccuucgcccuggagcgccccuucgggaacguggagagccggcucgaccugcgcaagaaccugcggugccaguccuucaagugguaccucgagaacaucuaccccgagcugagcaucccgaaggaguccagcauccagaagggcaacauccgccagcggcagaagugccuggagagccagcgccagaacaaccaggagacccccaaccucaagcugucccccugcgcgaaggugaagggggaggacgccaagagccaggucugggccuucaccuacacccagcagauccugcaggaggagcucugccuguccgugaucacgcuguucccgggcgcccccgugguccuggugcucugcaagaacggggacgaccggcagcaguggaccaagaccggcagccacaucgagcacaucgccucccaccugugccuggacaccgacauguucggcgacgggacggagaacggcaaggagaucguggucaaccccugcgagagcucccucaugagccagcacugggacaugguguccagcuga

SEQ ID NO: 30428 - RNA, 1920 nt, Artificial Sequence
  derived and/or modified sequence opt1 from GALNT15__Homo_sapiens__NP_473451
augcugcuccgcaagcgguaccgccaccggcccugccgccugcaguuccugcuccugcugcucaugcugggcugcgugcugaugauggucgccaugcuccacccgccccaccacacccugcaccagaccgugacggcccaggcgagcaagcacucccccgaggcccgguaccgccuggacuucggggagagccaggacugggugcucgaggccgaggacgagggcgaggaguacagcccccuggaggggcugccgcccuucaucucccuccgggaggaccagcugcuggucgccguggcccucccccaggcgcgccggaaccagucccagggccgccgcgggggcagcuaccggcugaucaagcagccccggcgccaggacaaggaggccccgaagcgggacuggggcgccgacgaggacggggagguguccgaggaggaggagcugacccccuucagccucgacccccgcggccugcaggaggcccuguccgcgcggaucccccuccagcgcgcccugccggagguccggcacccccugugccuccagcagcacccccaggacagccugcccaccgccuccgugauccugugcuuccacgacgaggccuggagcacccuccugcgcacggugcacuccauccuggacaccgucccgcgggccuuccucaaggagaucauccugguggacgaccugagccagcaggggcagcucaaguccgcgcugagcgaguacguggcccgccuggagggcgucaagcuccugcgcuccaacaagcggcugggggccauccgcgcccggaugcucggcgccacccgcgcgaccggcgacgugcugguguucauggacgcccacugcgagugccaccccggguggcuggagccccuccugagccggaucgccggcgaccgcucccgggucgugagccccgugaucgacgucaucgacuggaagacguuccaguacuacccgagcaaggaccugcagcgcggggugcucgacuggaagcuggacuuccacugggagccccugcccgagcacgugcggaaggcccugcagucccccaucagcccgauccgcucccccgucgugcccggcgagguggucgccauggaccggcacuacuuccagaacaccggcgcguacgacagccucaugucccugcgcgggggcgagaaccuggagcucagcuucaaggccuggcugugcgggggcuccguggagauccugcccugcagccgggucgggcacaucuaccagaaccaggacucccacagcccgcucgaccaggaggccacccugcgcaaccgggugcgcaucgccgagaccuggcugggcuccuucaaggagacguucuacaagcacagccccgaggccuucucccucagcaaggcggagaagcccgacugcauggagcggcugcagcugcagcgccggcucggcugccgcaccuuccacugguuccuggccaacguguacccggagcuguaccccuccgagccccgccccagcuucuccgggaagcuccacaacaccggccuggggcugugcgccgacugccaggccgagggcgacauccucgggugcccgaugguccuggcgcccugcagcgacucccggcagcagcaguaccugcagcacaccagccgcaaggagauccacuucggcagcccccagcaccucugcuucgccgugcggcaggagcaggucauccugcagaacugcacggaggagggccuggccauccaccagcagcacugggacuuccaggagaacgggaugaucgugcacauccucuccggcaagugcauggaggccguggugcaggagaacaacaaggaccuguaccugcgccccugcgacgggaaggcccggcagcaguggcgcuucgaccagaucaacgcggucgacgagcgguga

SEQ ID NO: 30429 - RNA, 1824 nt, Artificial Sequence
  derived and/or modified sequence opt1 from GALNT18__Homo_sapiens__NP_940918
auggugugcacccgcaagaccaagacgcuggucagcacgugcgugauccucuccggcaugaccaacaucaucugccugcuguacguggggugggucaccaacuacaucgccagcguguacgugcggggccaggagcccgccccggacaagaagcucgaggaggacaagggggacacccugaagaucaucgagcgccuggaccaccucgagaacgucaucaagcagcacauccaggaggcgcccgccaagcccgaggaggccgaggccgagcccuucaccgacuccagccuguucgcccacuggggccaggagcuguccccggaggggcggcgcguggcgcucaagcaguuccaguacuacggcuacaacgccuaccugagcgaccggcugccccucgaccgcccccugcccgaccugcggccguccggcugccgcaaccucagcuuccccgacucccugcccgaggugagcaucgucuucaucuucgugaacgaggcccuguccgugcuccugcggagcauccacuccgccauggagcgcacgcccccgcaccuccugaaggagaucauccuggucgacgacaacagcuccaacgaggagcugaaggagaagcucaccgaguacguggacaaggugaacagccagaagcccggguucaucaaggucgugcggcacuccaagcaggagggccugauccgcagccggguguccggguggcgcgcggccaccgcccccgucguggcccuguucgacgcccacguggaguucaacgucggcugggcggagcccgugcucacccggaucaaggagaaccgcaagcggaucaucagcccgagcuucgacaacaucaaguacgacaacuucgagaucgaggaguacccccuggccgcccagggguucgacugggagcuguggugccgcuaccucaacccgcccaaggccugguggaagcuggagaacuccaccgcccccauccggagccccgcgcugaucggcugcuucaucguggaccgccaguacuuccaggagaucggccuccuggacgaggggauggaggucuacggcggggagaacguggagcugggcauccgggucuggcagugcggcggguccguggaggugcuccccugcagccgcaucgcccacaucgagcgcgcccacaagcccuacaccgaggaccugacggcccacguccggcgcaacgcccugcggguggcggagguguggauggacgaguucaagucccacgucuacauggccuggaacaucccgcaggaggacagcggcaucgacaucggggacaucaccgcccgcaaggcccuccggaagcagcugcagugcaagaccuuccgcugguaccugguguccguguaccccgagaugcggauguacagcgacaucaucgccuacggcguccuccagaacucccugaagaccgaccugugccucgaccaggggcccgacacggagaacgugcccaucauguacaucugccacggcaugaccccgcagaacguguacuacaccagcucccagcagauccacgucggcauccugagccccaccguggacgacgacgacaaccgcugccugguggacgucaacucccggccccgccucaucgagugcagcuacgcgaaggccaagcggaugaagcugcacuggcaguucucccagggcgggccgauccagaaccgcaagagcaagcggugccuggagcugcaggagaacuccgaccucgaguucggguuccagcuggugcugcagaagugcagcggccagcacugguccaucacgaacgugcuccgcagccuggccagcuga

SEQ ID NO: 30430 - RNA, 1680 nt, Artificial Sequence
  derived and/or modified sequence opt1 from GALNT1__Homo_sapiens__XP_005258296
augcgcaaguucgccuacugcaaggugguccuggccaccagccucaucugggugcugcuggacauguuccuccugcuguacuucuccgagugcaacaagugcgacgagaagaaggagcggggccuccccgcgggggacgugcuggagccgguccagaagccccacgagggccccggggagaugggcaagcccguggugaucccgaaggaggaccaggagaagaugaaggagauguucaagaucaaccaguucaaccugauggccagcgagaugaucgcccucaaccgcucccugcccgacguccggcuggaggggugcaagaccaagguguaccccgacaaccuccccacgaccagcguggucaucguguuccacaacgaggccugguccacccugcugcgcaccgugcacagcgucaucaaccgguccccgcgccacaugaucgaggagaucgugcucguggacgacgccagcgagcgggacuuccugaagcgcccccuggaguccuacgucaagaagcucaaggugcccgugcacgucauccggauggagcagcgcagcggccugauccgggcgcgccugaagggcgccgccguguccaagggccaggugaucacguuccucgacgcccacugcgagugcaccgucggguggcuggagccccugcucgcgcggaucaagcacgaccgccggaccguggugugcccgaucaucgacgucaucagcgacgacaccuucgaguacauggccggguccgacaugacguacggcggguucaacuggaagcugaacuuccgcugguaccccgugccccagcgggagauggaccgccggaagggcgaccgcacccugcccguccggaccccgaccauggccggcggccucuucagcaucgaccgcgacuacuuccaggagaucgggacguacgacgccgggauggacaucuggggcggcgagaaccuggagaucuccuuccgcaucuggcagugcgggggcacccuggagaucgugaccugcagccacguggggcacgucuuccggaaggccacccccuacacguuccccggcgggaccggccagaucaucaacaagaacaaccgccggcucgcggagguguggauggacgaguucaagaacuucuucuacaucaucucccccggcgugaccaaggucgacuacggggacaucagcucccgcgugggccugcggcacaagcugcagugcaagccguucagcugguaccucgagaacaucuaccccgacagccagaucccccgccacuacuucucccugggggagauccggaacguggagaccaaccagugccuggacaacauggcccgcaaggagaacgagaaggucggcaucuucaacugccacgggaugggcggcaaccagguguucagcuacacggccaacaaggagauccggaccgacgaccucugccuggacguguccaagcugaacgggcccgucaccaugcucaagugccaccaccugaagggcaaccagcugugggaguacgacccggugaagcucacccugcagcacgugaacagcaaccagugccuggacaaggccacggaggaggacucccagguccccagcauccgcgacugcaacgggucccggagccagcaguggcuccugcgcaacgugacccugcccgagaucuucuga

SEQ ID NO: 30431 - RNA, 1602 nt, Artificial Sequence
  derived and/or modified sequence opt1 from GALNT2__Homo_sapiens__NP_001278795
auggccgaccgcgaggacuggaacgagaucgaccccaucaagaagaaggaccugcaccacagcaacggcgaggagaaggcccaguccauggagacccucccgcccgggaaggugcgguggcccgacuucaaccaggaggcguacgucggcgggaccauggugcgcagcggccaggaccccuacgcccggaacaaguucaaccagguggaguccgacaagcugcgcauggaccgggccaucccggacacgcgccacgaccagugccagcggaagcaguggcgcgucgaccugcccgccaccagcguggugaucaccuuccacaacgaggcccgguccgcgcuccugcgcaccgucgugagcgugcugaagaaguccccgccccaccucaucaaggagaucauccuggucgacgacuacagcaacgaccccgaggacggggcccugcucggcaagaucgagaaggugcgggugcugcgcaacgaccggcgcgagggccugaugcggucccgcguccgcggggccgacgccgcgcaggccaaggugcucacguuccuggacagccacugcgagugcaacgagcacuggcuggagccccuccuggagcggguggccgaggaccggacccgcgucgugucccccaucaucgacgugaucaacauggacaacuuccaguacgucggcgccagcgccgaccugaagggcggguucgacuggaaccucguguucaagugggacuacaugacccccgagcagcggcgcucccgccaggggaacccgguggcgcccaucaagacccccaugaucgccggcggccuguucgucauggacaaguucuacuucgaggagcuggggaaguacgacaugaugauggacguguggggcggggagaaccucgagaucagcuuccggguguggcagugcggcggcucccuggagaucauccccugcagccgcgucgggcacguguuccggaagcagcacccguacacguuccccggcggguccggcaccgucuucgcccgcaacacccggcgcgccgccgagguguggauggacgaguacaagaacuucuacuacgcggccgugcccagcgcccggaacguccccuacgggaacauccagucccgccuggagcuccggaagaagcugagcugcaagccguucaagugguaccuggagaacguguaccccgagcuccgcgugcccgaccaccaggacaucgccuucggcgcccugcagcagggcaccaacugccuggacacgcucgggcacuucgcggacggcgucguggggguguacgagugccacaacgccggcgggaaccaggagugggcccugaccaaggagaaguccgucaagcacauggaccugugccucaccgugguggaccgggcccccggcagccugaucaagcugcagggcugccgcgagaacgacagccggcagaagugggagcagaucgaggggaacuccaagcuccgccacgucggcagcaaccugugccuggacucccggaccgccaagagcgggggccucuccguggaggugugcgggccggcgcugagccagcaguggaaguucacgcugaaccuccagcaguga

SEQ ID NO: 30432 - RNA, 1902 nt, Artificial Sequence
  derived and/or modified sequence opt1 from GALNT3__Homo_sapiens__NP_004473
auggcccaccugaagcgccucgugaagcugcacaucaagcggcacuaccacaagaaguucuggaagcugggcgccgucaucuucuucuucaucaucgugcucgugcugaugcagcgcgaggucagcgugcaguacuccaaggaggagagccggauggagcgcaacaugaagaacaagaacaagaugcuggaccucaugcuggaggcggugaacaacaucaaggacgccaugcccaagaugcagaucggggccccgguccggcagaacaucgacgccggcgagcgccccugccugcagggguacuacaccgccgcggagcucaagcccgugcuggaccggcccccgcaggacuccaacgcccccggcgccagcgggaaggccuucaagaccacgaaccuguccguggaggagcagaaggagaaggagcgcggcgaggcgaagcacugcuucaacgccuucgccagcgaccggaucucccuccaccgcgaccugggccccgacacccggcccccggagugcaucgagcagaaguucaagcgcugcccgccccugcccaccaccagcgucaucaucguguuccacaacgaggccugguccacgcuccugcggaccgugcacagcguccuguacuccagccccgccauccuccugaaggagaucauccugguggacgacgcguccguggacgaguaccuccacgacaagcuggacgaguacgucaagcaguucagcaucgugaagaucgugcgccagcgggagcgcaaggggcugaucaccgcccggcuccugggcgccaccgucgccacggccgagacccugaccuuccucgacgcgcacugcgagugcuucuacggguggcuggagccccugcucgcccgcaucgccgagaacuacaccgccguggugucccccgacaucgccagcaucgaccugaacacguucgaguucaacaagcccuccccguacggcagcaaccacaaccgggggaacuucgacuggucccugagcuucggcugggagagccuccccgaccacgagaagcagcgccggaaggacgagaccuaccccaucaagacccccaccuucgcgggcgggcuguucuccaucagcaaggaguacuucgaguacaucggcuccuacgacgaggagauggagaucuggggcggggagaacaucgagaugagcuuccgcgucuggcagugcggcgggcagcuggagaucaugccgugcuccguggugggccacgucuuccgcagcaagagcccccacuccuuccccaaggggacccaggugaucgcccggaaccagguccgccucgccgagguguggauggacgaguacaaggagaucuucuaccggcgcaacaccgacgccgccaagaucgugaagcagaaggcguucggcgaccuguccaagcgguucgagaucaagcaccgccugcagugcaagaacuucaccugguaccucaacaacaucuaccccgaggucuacgugccggaccugaaccccgugaucagcggguacaucaaguccgucggccagccccugugccucgacgugggcgagaacaaccagggcgggaagccccugaucauguacacgugccacgggcugggcgggaaccaguacuucgaguacagcgcccagcacgagauccggcacaacauccagaaggagcucugccugcacgccgcccagggccuggugcagcucaaggcgugcacguacaagggccacaagaccgucgugaccggggagcagaucugggagauccagaaggaccagcugcuguacaacccguuccugaagaugugccucuccgccaacggcgagcaccccagccugguguccugcaaccccagcgacccgcugcagaaguggauccucucccagaacgacuga

SEQ ID NO: 30433 - RNA, 1737 nt, Artificial Sequence
  derived and/or modified sequence opt1 from GALNT4__Homo_sapiens__NP_003765
auggccgugcgcuggaccugggccggcaagagcugccugcuccuggcguuccugaccgucgccuacaucuucguggagcuccugguguccacguuccacgccagcgccggggccggccgcgcgcgcgagcuggggucccggcgccucagcgaccugcagaagaacaccgaggaccugucccggccccucuacaagaagccgcccgccgacagccgcgcccugggcgagugggggaaggccuccaagcugcagcucaacgaggacgagcugaagcagcaggaggagcugaucgagcgguacgcgaucaacaucuaccucagcgaccgcaucucccugcaccggcacaucgaggacaagcgcauguacgagugcaagagccagaaguucaacuaccggacccugcccaccacguccgucaucaucgccuucuacaacgaggccuggagcacccuccugcgcaccauccacuccgugcuggagaccagccccgccgugcuccugaaggagaucauccuggucgacgaccucuccgaccggguguaccugaagacgcagcuggagaccuacaucagcaaccucgaccgcgugcggcugauccgcaccaacaagcgggagggccugguccgcgcccggcucaucggcgcgaccuucgccacgggggacgugcugaccuuccuggacugccacugcgagugcaacuccggcuggcucgagccgcugcuggagcgcaucgggcgggacgagaccgccguggucugccccgugaucgacaccaucgacuggaacacguucgaguucuacaugcagaucggcgagcccaugaucgggggcuucgacuggcgccucaccuuccaguggcacagcgugcccaagcaggagcgcgaccggcgcaucucccggaucgacccgauccgcagccccaccauggccggcgggcuguucgccgucagcaagaaguacuuccaguaccugggcaccuacgacacggggauggagguguggggcggcgagaaccucgagcuguccuuccggguguggcagugcgggggcaagcuggagauccaccccugcagccacgucgggcacguguuccccaagcgcgcgccguacgcccggcccaacuuccuccagaacaccgcccgcgccgccgagguguggauggacgaguacaaggagcacuucuacaaccggaacccgcccgcgcgcaaggaggccuacggcgacaucuccgagcggaagcugcugcgcgagcggcuccgcugcaagagcuucgacugguaccugaagaacgucuuccccaaccugcacgugcccgaggaccggcccggguggcacggcgccauccgcucccggggcaucagcuccgagugccucgacuacaacagccccgacaacaacccgaccggggccaaccugucccuguucggcugccacgggcagggcgggaaccaguucuucgaguacaccagcaacaaggagauccgcuucaacuccgugacggagcugugcgccgagguccccgagcagaagaacuacgugggcaugcagaacugccccaaggacggcuuccccgucccggcgaacaucaucuggcacuucaaggaggacgggaccaucuuccacccccacagcggccucugccuguccgccuaccggacccccgaggggcgccccgacgugcagaugcggaccugcgacgcccuggacaagaaccagaucuggagcuucgagaaguga

SEQ ID NO: 30434 - RNA, 2823 nt, Artificial Sequence
  derived and/or modified sequence opt1 from GALNT5__Homo_sapiens__NP_055383
augaaccgcauccggaaguucuuccgcggcagcgggcgggugcuggccuucaucuucgucgccuccgugaucuggcuccuguucgacauggcggcccugcgccucagcuucuccgagaucaacacccgggugaucaaggaggacaucguccgccgggagcgcaucggcuuccgggugcagcccgaccaggggaagaucuucuacagcuccaucaaggagaugaagccgccccugcgcggccacgggaagggcgccuggggcaaggagaacgugcggaagaccgaggagagcguccugaagguggagguggaccucgaccagacgcagcgcgagcggaagaugcagaacgcccuggggcgcggcaaggucgugccccuguggcaccccgcccaccuccagacccugccggugacccccaacaagcagaagaccgacgggcggggcacgaagcccgaggcguccagccaccaggggacccccaagcagaccaccgcccagggcgccccgaagacguccuucaucgccgcgaagggcacccaggucgugaagaucagcgugcacauggggcgcgucucccugaagcaggagccccgcaagagccacucccccagcuccgacaccagcaagcucgccgccgagcgggaccugaacgugaccaucucccugagcacggaccggcccaagcagcgcucccaggccguggccaacgagcgggcgcacccggccagcaccgccguccccaagagcggcgaggccauggcccucaacaagaccaagacccaguccaaggaggugaacgcgaacaagcacaaggccaacacgagccugcccuuccccaaguucaccgugaacuccaaccgccugcgcaagcagagcaucaacgagaccccgcucgggucccugagcaaggacgacggcgcccggggcgcccacgggaagaagcugaacuucuccgagagccaccucgucaucaucaccaaggaggaggagcagaaggccgaccccaaggagguguccaacagcaagacgaagaccaucuuccccaaggugcugggcaagucccagagcaagcacaucucccgcaaccggagcgagauguccagcuccagccuggcgccccaccgcgucccgcucucccagaccaaccacgcccugaccgggggccuggagcccgccaagaucaacaucacggccaaggcccccagcaccgaguacaaccagagccacaucaaggcgcuccugcccgaggacuccgggacccaccaggugcugcggaucgacgucacccucagcccgcgcgaccccaaggcccccggccaguucggccggcccgugguggucccgcacgggaaggagaaggaggccgagcgccgguggaaggagggcaacuucaacguguaccuguccgaccugauccccguggaccgcgccaucgaggacacgcggcccgcggggugcgccgagcagcucguccacaacaaccugccgaccaccagcgugaucaugugcuucguggacgaggucugguccacccugcuccgcagcgugcacuccgugaucaaccggagcccgccccaccugaucaaggagauccugcucgucgacgacuucuccacgaaggacuaccugaaggacaaccuggacaaguacaugagccaguuccccaaggugcgcauccuccggcugaaggagcgccacggccugauccgggcccgccucgccggggcccagaacgcgaccggcgacgugcugaccuuccuggacucccacgucgagugcaacgugggcuggcucgagccccugcuggagcggguguaccugagccgcaagaaggucgccugccccgugaucgaggugaucaacgacaaggacauguccuacaugaccgucgacaacuuccagcgcgggaucuucguguggcccaugaacuucggcuggcggacgaucccgcccgacgugaucgccaagaaccgcaucaaggagaccgacaccauccggugccccgucauggccgggggccucuucagcaucgacaaguccuacuucuucgagcuggggaccuacgaccccggccuggacguguggggcggggagaacauggagcucagcuucaagguguggaugugcggcggggagaucgagaucauccccugcucccgcgucggccacaucuuccggaacgacaacccguacagcuuccccaaggaccgcaugaagaccguggagcggaaccuggugcgcgucgccgagguguggcuggacgaguacaaggagcuguucuacggccacggggaccaccucaucgaccagggccuggacguggggaaccucacgcagcagcgggagcugcgcaagaagcugaagugcaagagcuucaagugguaccucgagaacgucuuccccgaccugcgggcgcccaucgugcgcgccuccggcgugcugaucaacgucgcccucgggaagugcaucagcaucgagaacaccaccgugauccuggaggacugcgacggcuccaaggagcugcagcaguucaacuacaccuggcuccggcugaucaagugcggcgaguggugcaucgccccgauccccgacaagggggccgugcgccugcaccccugcgacaaccggaacaagggccucaaguggcugcacaagagcacguccgucuuccaccccgagcuggugaaccacaucguguucgagaacaaccagcagcuccugugccuggaggggaacuucagccagaagauccucaaggucgcggccugcgacccggugaagcccuaccagaaguggaaguucgagaaguacuacgaggccuga

SEQ ID NO: 30435 - RNA, 1869 nt, Artificial Sequence
  derived and/or modified sequence opt1 from GALNT6__Homo_sapiens__XP_006719277
augcgccugcuccggcgccggcacaugccccugcgccuggccauggugggcugcgccuucguccucuuccuguuccugcuccaccgggacgugagcucccgcgaggaggcgaccgagaagccguggcucaagagccuggugucccggaaggaccacguccuggaccugaugcuggaggccaugaacaaccuccgcgacagcaugcccaagcugcagauccgggcccccgaggcccagcagacccuguucuccaucaaccagagcugccuccccggguucuacacgccggccgagcugaagcccuucugggagcgcccgccccaggaccccaacgcgcccggcgccgacgggaaggccuuccagaaguccaaguggacgccccuggagacccaggagaaggaggagggcuacaagaagcacugcuucaacgccuucgcgagcgaccggaucucccuccagcgcagccuggggcccgacacccggccgcccgagugcguggaccagaaguuccgccggugcccgccccuggccaccaccuccgugaucaucgucuuccacaacgaggccuggagcacccuccugcgcaccguguacuccgugcugcacacgacccccgccauccuccugaaggagaucauccuggucgacgacgccagcaccgaggagcaccucaaggagaagcuggagcaguacgugaagcagcuccaggugguccggguggugcgccaggaggagcggaagggccugaucaccgcgcgccugcugggcgccuccgucgcccaggccgaggugcucacguuccuggacgcccacugcgagugcuuccacggguggcuggagccccuccuggcgcggaucgccgaggacaagaccguggucgugagccccgacaucgugaccaucgaccugaacaccuucgaguucgccaagcccguccagcgcggccgcgugcacucccgggggaacuucgacuggagccucacguucggcugggagacccugccgccccacgagaagcagcgccggaaggacgagaccuaccccaucaagucccccaccuucgccgggggccuguucagcaucagcaaguccuacuucgagcacaucggcacguacgacaaccagauggagaucuggggcggcgagaacguggagaugagcuuccgcgucuggcagugcgggggccagcucgagaucaucccgugcuccguggucggccacguguuccggaccaagagcccccacaccuuccccaaggggaccuccgugaucgcccgcaaccagguccggcuggcggagguguggauggacagcuacaagaagaucuucuaccgccggaaccugcaggccgccaagauggcccaggagaaguccuucggcgacaucagcgagcgccuccagcugcgggagcagcugcacugccacaacuucuccugguaccuccacaacguguaccccgagauguucgucccggaccugacgcccaccuucuacggggccaucaagaaccugggcaccaaccagugccuggacgugggggagaacaaccgcggcggcaagccccucaucauguacagcugccacgggcugggcgggaaccaguacuucgaguacaccacgcagcgggaccugcgccacaacaucgcgaagcagcucugccugcacguguccaagggcgcccuggggcucggcagcugccacuucaccggcaagaacucccaggucccgaaggacgaggagugggagcuggcccaggaccagcugauccggaacagcggguccgggaccugccucaccagccaggacaagaagcccgccauggcgcccugcaaccccuccgacccgcaccagcuguggcuguucguguga

SEQ ID NO: 30436 - RNA, 1974 nt, Artificial Sequence
  derived and/or modified sequence opt1 from GALNT7__Homo_sapiens__NP_059119
augcgccugaagaucggcuucauccuccggagccugcugguggucggguccuuccucggccugguggugcuguggagcucccucacgccccgcccggacgaccccagcccccugucccggaugcgcgaggaccgggacgucaacgaccccaugccgaaccgcgggggcaacgggcuggcccccggcgaggaccgguucaagcccguggugcccuggccgcacgucgagggcguggagguggaccucgagagcauccgccggaucaacaaggccaagaacgagcaggagcaccacgccgggggcgacucccagaaggacaucaugcagcgccaguaccugaccuucaagccccagaccuucaccuaccacgaccccguccugcggcccgggauccucggcaacuucgagccgaaggagcccgagccgcccgggguggugggcggccccggggagaaggcgaagccccugguccugggccccgaguucaagcaggccauccaggccagcaucaaggaguucggguucaacaugguggccuccgacaugaucagccucgaccgcuccgugaacgaccugcggcaggaggagugcaaguacuggcacuacgacgagaaccugcucaccagcuccgucgugaucguguuccacaacgagggcuggagcacccugaugcgcacgguccacuccgugaucaagcggacgccccgcaaguaccuggcggagaucgugcucaucgacgacuucagcaacaaggagcaccugaaggagaagcuggacgaguacaucaagcucuggaacggccuggucaagguguuccggaacgagcgccgggaggggcugauccaggcccgcuccaucggcgcccagaaggccaagcucggccaggugcugaucuaccuggacgcgcacugcgaggucgccgugaacugguacgccccgcucgucgcccccaucagcaaggaccggaccaucugcaccgugccccugaucgacgugaucaacgggaacaccuacgagaucaucccccagggcgggggcgacgaggacggguacgcccgcggcgcgugggacugguccaugcuguggaagcgcgucccgcucacgccccaggagaagcggcugcgcaagaccaagaccgagcccuaccggagccccgccauggccgggggccuguucgccaucgagcgcgaguucuucuucgagcucgggcuguacgacccgggccugcagaucuggggcggggagaacuucgagaucagcuacaagaucuggcagugcggcgggaagcuccuguucgugcccugcucccgggugggccacaucuaccgccuggagggguggcagggcaacccgccgcccaucuacgucggcagcucccccacccucaagaacuacgugcggguggucgagguguggugggacgaguacaaggacuacuucuacgccagccgccccgagucccaggcgcugcccuacggggacaucagcgagcugaagaaguuccgggaggaccacaacugcaaguccuucaagugguucauggaggagaucgccuacgacaucaccagccacuacccccucccgcccaagaacguggacuggggcgagauccgcggguucgagaccgccuacugcaucgacuccaugggcaagaccaacggcggguucgucgagcugggccccugccaccggaugggcgggaaccagcuguuccgcaucaacgaggccaaccagcucaugcaguacgaccagugccugacgaagggggccgacggcagcaaggugaugaucacccacugcaaccugaacgaguucaaggaguggcaguacuucaagaaccugcaccgguucacccacauccccuccggcaagugccucgaccgcagcgaggugcugcaccaggucuucaucuccaacugcgacagcuccaagaccacgcagaagugggagaugaacaacauccacagcguguga

SEQ ID NO: 30437 - RNA, 1914 nt, Artificial Sequence
  derived and/or modified sequence opt1 from GALNT8__Homo_sapiens__NP_059113
augauguucuggcgcaagcugcccaaggcccucuucaucggccugacccuggccaucgcggugaaccuccugcuggucuucagcuccaaggggacccuccagaaccuguucacgggcgggcugcaccgggagcucccgcugcaccugaacaagcgcuacggcgccgugaucaagcggcucagccaccuggagguggagcugcaggaccucaaggaguccaugaagcuggcccugcgccagcaggagaacgucaacagcacccucaagcgggccaaggacgaggugcgcccccugcugaaggccauggagaccaaggugaacgagaccaagaagcacaagacgcagaugaagcuguucccccacucccagcuguuccggcaguggggcgaggaccucagcgaggcgcagcagaaggccgcccaggaccucuuccgcaaguucggguacaacgccuaccuguccaaccagcugccccucaaccggaccaucccggacacccgcgacuaccggugccugcgcaagaccuaccccagccagcugcccucccucagcgucauccugaucuucgugaacgaggcgcuguccaucauccagcgggccaucacgagcaucaucaaccgcacccccucccggcuccugaaggagaucauccugguggacgacuucagcuccaacggcgagcucaagguccaccuggacgagaagaucaagcuguacaaccagaaguacccggggcuccugaagaucauccgccaccccgagcggaagggccuggcccaggcccgcaacaccgggugggaggccgcgaccgccgacgugguggccauccucgacgcccacaucgaggucaacgugggcugggccgagcccauccuggcgcggauccaggaggaccgcacggugaucgucagccccguguucgacaacauccgguucgacaccuucaagcuggacaaguacgagcucgccguggacggguucaacugggagcuguggugccgcuacgacgcccugccgcaggccuggaucgaccuccacgacgucaccgcccccgugaagucccccagcaucaugggcauccuggcggccaaccgccacuuccugggcgagaucgggucccuggacggcgggaugcucaucuacggcggcgagaacguggagcugagccugcgggucuggcagugcgggggcaagguggagauccuccccugcagccgcaucgcccaccuggagcggcaccacaagccguacgcccuggaccucaccgccgcgcugaagcgcaacgcccugcggguggccgagaucuggauggacgagcacaagcacauggucuaccucgccuggaacaucccccugcagaacuccgggaucgacuucggcgacgugagcucccgcauggcgcugcgggagaagcucaagugcaagacguucgacugguaccugaagaacgucuacccccugcucaagccccugcacaccaucgugggguacggccgcaugaagaaccugcucgacgagaacgugugccuggaccagggcccgguccccgggaacacccccaucauguacuacugccacgaguucagcucccagaacguguacuaccaccugaccggcgagcucuacguggggcagcugaucgccgaggccagcgccuccgaccggugccugacggaccccggcaaggccgagaagccgacccucgagcccugcagcaaggcggccaagaaccgccugcacaucuacugggacuucaagcccgggggcgccgucaucaaccgggacaccaagcgcugccuggagaugaagaaggaccuccugggcucccacgugcuggugcuccagaccugcagcacgcaggucugggagauccagcacaccgugcgggacugggggcagaccaacucccaguga

SEQ ID NO: 30438 - RNA, 1812 nt, Artificial Sequence
  derived and/or modified sequence opt1 from GALNT9__Homo_sapiens__NP_001116108
auggccguggcccgcaagauccggacccugcucaccgucaacauccugguguucgugggcaucguccuguucagcguguacugccgccuccaggggcggucccaggagcuggugcgcaucgucagcggcgaccggcgcgugcggucccgccacgcgaagguggggacgcugggcgaccgggaggccauccuccagcgccuggaccaccuggaggaggucguguacaaccagcucaacgggcuggccaagcccaucggccugguggagggccccgggggccucgggcagggcgggcuggccgccacccugcgggacgacggccaggaggcggagggcaaguacgaggaguacggguacaacgcccagcucagcgaccgcaucucccuggaccggagcauccccgacuaccgcccccggaagugccgccagauguccuacgcccaggaccugccccaggucagcgugguguucaucuucgucaacgaggcccucuccgugauccugcggagcgugcacuccgucgugaaccacaccccgagccagcugcucaaggaggugauccuggucgacgacaacuccgacaacguggagcugaaguucaaccucgaccaguacgugaacaagcgcuaccccggccuggucaagaucgugcggaacagccgccgggaggggcugauccgcgcgcgccuccagggcuggaaggccgccaccgcccccgucgugggcuucuucgacgcccacguggaguucaacacggggugggcggagcccgcccugucccggauccgcgaggaccggcgccggaucguccugccggccaucgacaacaucaaguacagcaccuucgaggugcagcaguacgccaacgccgcgcacggcuacaacugggggcucuggugcauguacaucaucccgccccaggacuggcuggaccgcggcgacgaguccgcccccauccggaccccggccaugaucgggugcagcuucguggucgaccgcgaguacuucggcgacaucggccugcucgaccccgggauggagguguacggcggggagaacguggagcugggcaugcgggucuggcagugcgggggcuccauggaggugcugcccugcagccgcguggcccacaucgagcggacccgcaagcccuacaacaacgacaucgacuacuacgccaagcggaacgcgcuccgcgccgccgaggucuggauggacgacuucaagagccacguguacauggccuggaacaucccgauguccaaccccggcguggacuucggggacgucagcgagcggcuggcccugcgccagcggcucaagugccgcuccuucaagugguaccuggagaacguguaccccgagaugcggguguacaacaacacgcugaccuacggcgagguccgcaacagcaaggcguccgccuacugccucgaccagggggccgaggacggcgaccgcgccauccuguaccccugccacgggaugagcucccagcuggugcgguacagcgcggacggccuccugcagcugggcccgcucggguccaccgccuuccugcccgacagcaagugccugguggacgacggcaccgggcgcaugcccacgcugaagaagugcgaggacgucgcccggcccacccagcgccucugggacuucacccaguccggcccgaucgugagccgggccaccggccgcugccuggagguggagauguccaaggacgccaacuucgggcugcggcucgucgugcagcgcugcagcggccagaaguggaugauccggaacuggaucaagcacgcgcgccacuga

SEQ ID NO: 30439 - RNA, 1806 nt, Artificial Sequence
  derived and/or modified sequence opt1 from GALNTL6__Homo_sapiens__NP_001030017
augaagcgcaagcagaagcgguuccugcagaugacccuccuguucaccguggcccugaucuuccuccccaacgucggccuguggagccuguacaaggacaagcaccucgugaaguccgccgagccgggggagcagcagacguucccccugggccugggggacggccaguucuacagcuggaccgacgggcuccgccggaaggacuggcacgacuacgaguccauccagaaggaggcgaugcgcagcggcaagggcgagcacgggaagcccuacccccugaccgaggaggaccacgacgacuccgccuaccgggagaacggcuucaacaucuucgugagcaacaacaucgcccuggagcgcucccucccggacauccggcacgccaacugcaagcacaagauguaccuggagcgccugcccaacaccagcaucaucauccccuuccacaacgagggguggacgucccuccugcggaccauccacagcaucaucaaccgcacccccggcucccugaucgccgagaucauccucgucgacgacuucagcgagcgggagcaccugaaggacaagcuggaggaguacauggcgcgcuucuccaaggugcggaucgugcgcaccaagaagcgggaggggcucauccgcacgcggcugcugggcgccagcauggcccgcggcgagguccucaccuuccuggacucccacugcgaggugaacgugaacuggcugccgccccuccugaaccagaucgcccugaaccacaagaccaucgucugccccaugaucgacgugaucgaccacaaccacuucggguacgaggcgcaggccggcgacgccaugcgcggggccuucgacugggagauguacuacaagcggauccccaucccgcccgagcuccagcgggccgaccccagcgaccccuucgaguccccggugauggcgggcggccuguucgccgucgaccgcaagugguucugggagcucgggggcuacgaccccgggcucgagaucuggggcggggagcaguacgagaucagcuucaagguguggaugugcggcggcgagauguucgacgugcccugcucccgcgucgggcacaucuaccggaaguacgugcccuacaaggugccgagcggcaccagccuggcccgcaaccugaagcgggucgccgagacguggauggacgaguucgccgaguacaucuaccagcgccggcccgaguaccgccaccucuccaccggggacaucagcgcgcagaaggagcugcggaagcagcugaagugcaaggacuucaagugguucauggccgccguggccugggacgugcccaaguacuacccgcccgucgagcccccgcccgccgcguggggcgagauccgcaacguggccgccaaccucugcguggacuccaagcacggggccaccggcaccgagcugcggcuggacaucugcgucaaggacggcagcgagcgcacguggucccacgagcagcuguucaccuucggguggcgggaggacauccgccccggcgagccccugcacacccggaaguucugcuucgacgccaucagccacaacucccccgugacccuguacgacugccacgggaugaagggcaaccagcucuggggguaccgcaaggaccggacgcuguuccacccggucagcaacuccugcauggacugcaaccccgcggagaagaagaucuucauggcccgcugcgacccccugagcgagacccagcaguggaucuucgagcacaucaacaugaccgugcucgagaaguucaaccaccacgccaacuccuga

SEQ ID NO: 30440 - RNA, 150 nt, Artificial Sequence
  derived and/or modified sequence opt1 from GALP__Homo_sapiens__NP_001139018
auggcgcccccgagcgugccccugguccuccugcuggugcuccugcugucccucgccgagacccccgccagcgcccccgcccaccgcuccagcaccuucccgaagugggugacgaagaccgagcggggccgccagccccugcgguccuga

SEQ ID NO: 30441 - RNA, 1050 nt, Artificial Sequence
  derived and/or modified sequence opt1 from GALR1__Homo_sapiens__NP_001471
auggagcuggccgugggcaaccucagcgaggggaacgccuccuggcccgagccgcccgcgcccgagcccggcccccuguucgggaucggcgucgagaacuucgugacccugguggucuucgggcucaucuucgcccugggcgugcugggcaacagccucgugaucaccguccuggcccgcuccaagcccgggaagccccggagcacgaccaaccuguucauccucaaccuguccaucgccgaccuggccuaccuccuguucugcauccccuuccaggcgaccguguacgcccugccgaccugggugcucggcgccuucaucugcaaguucauccacuacuucuucacggucagcaugcugguguccaucuucacccuggccgcgaugagcguggaccgcuacgucgccaucgugcacucccggcgcagcuccagccuccgggugucccgcaacgcccugcugggggucggcugcaucugggcccucagcaucgccauggcgucccccguggccuaccaccaggggcuguuccacccccgggccagcaaccagaccuucugcugggagcaguggcccgacccgcgccacaagaaggccuacguggucugcaccuucguguucggcuaccugcucccccugcugcucaucugcuucugcuacgccaaggugcugaaccaccuccacaagaagcugaagaacauguccaagaaguccgaggcgagcaagaagaagacggcccagaccguccuggugguggucguggucuucggcaucagcuggcugccccaccacaucauccaccucugggccgaguucgggguguucccccugaccccggccagcuuccuguuccggaucaccgcccacugccucgcguacuccaacagcuccgugaaccccaucaucuacgccuuccugagcgagaacuuccgcaaggccuacaagcaggucuucaagugccacauccggaaggacucccaccugagcgacacgaaggaguccaagagccgcaucgacaccccgcccuccaccaacugcacccacguguga

SEQ ID NO: 30442 - RNA, 1164 nt, Artificial Sequence
  derived and/or modified sequence opt1 from GALR2__Homo_sapiens__NP_003848
augaacgugagcggcugccccggggccggcaacgccucccaggccgggggcgggggcggcuggcacccggaggccgucaucgugccccuccuguucgcccugaucuuccugguggggaccgucggcaacacccucgugcuggccgugcugcuccgcgggggccaggccgucagcacgaccaaccuguucauccugaaccucgggguggcggaccugugcuucauccugugcugcgugcccuuccaggccaccaucuacacccucgacggcugggucuucggcucccugcugugcaaggccgugcacuuccucaucuuccugacgaugcacgccagcuccuucacccuggcggccgugagccucgaccgguaccuggccauccgcuacccccugcacucccgggagcuccgcaccccgcggaacgcccuggccgcgaucgggcugaucuggggccucagccugcuguucuccgggcccuaccucagcuacuaccgccagucccagcuggccaaccugaccgucugccaccccgccuggagcgcgccccggcgccgggccauggacaucugcacguucguguucuccuaccuccugccggugcugguccucggccugaccuacgcgcgcacccugcgguaccucuggcgcgccguggaccccguggccgccggcagcggggcccggcgcgcgaagcggaaggucacccgcaugauccugaucguggccgcccuguucugccucugcuggaugccccaccacgcccugauccugugcgugugguucggccaguucccccucacgcgggccaccuacgcgcugcgcauccugucccaccucgucagcuacgccaacuccugcgugaacccgaucguguacgcccuggucagcaagcacuuccggaagggguuccgcaccaucugcgccggccugcucgggcgggcgcccggccgcgccuccggccgcgugugcgccgccgcccgggggacccacagcggcagcguccuggagcgcgaguccagcgaccugcugcacauguccgaggcggccggggcccuccggcccugccccggcgccagccagccgugcauccuggagcccugccccgggcccuccuggcagggcccgaaggccggcgacagcauccugacgguggacguggcguga

SEQ ID NO: 30443 - RNA, 1107 nt, Artificial Sequence
  derived and/or modified sequence opt1 from GALR3__Homo_sapiens__XP_011528770
auggccgacgcccagaacaucagccuggacucccccggcagcgugggggcggucgccgugccgguggucuucgcccucaucuuccugcugggcaccguggggaacggccucgugcuggccguccugcuccagcccgggcccuccgccuggcaggagcccggcagcaccacggaccuguucauccugaaccucgcgguggccgaccugugcuucauccugugcugcgugccguuccaggccaccaucuacacccucgacgccuggcuguucggcgcgcuggucugcaaggccgugcaccuccugaucuaccugaccauguacgccuccagcuucacgcucgccgccguguccgucgaccgcuaccuggcggugcggcacccccugcgcagccgggcccuccgcacgccccggaacgcccgcgccgccguggggcuggucuggcugcucgcggcccuguucuccgcccccuaccugagcuacuacggcaccgugcgguacggggcccucgagcugugcgugccggccugggaggacgcgcgccggcgcgcccuggacgucgccaccuucgccgccggcuaccuccugcccguggcgguggucucccuggccuacgggcggacccuccgcuuccugugggccgccgugggccccgcgggcgccgccgccgccgaggcgcggcgccgggccaccgggcgcgccggccgggccaugcuggccguggcggcccucuacgcccugugcugggggccccaccacgcccugauccucugcuucugguacggccgcuucgccuucagcccggcgaccuacgccugccggcuggccucccacugccuggccuacgcgaacagcugccucaacccccuggucuacgcccuggccucccgccacuuccgggcccgcuuccgccggcucuggcccugcggccgccggcgccggcaccgcgcccggcgcgcgcugcggcgcgugcggcccgccagcuccgggccgcccggcugccccggggacgcccgccccagcggccggcugcucgccgggggcggccaggggccggagccccgcgagggccccguccacgggggcgaggccgcgcgggggcccgaguga

SEQ ID NO: 30444 - RNA, 1140 nt, Artificial Sequence
  derived and/or modified sequence opt1 from GALT__Homo_sapiens__NP_000146
augagccgcuccggcaccgacccccagcagcggcagcaggccagcgaggccgacgcggccgccgccaccuuccgcgccaacgaccaccagcacauccgguacaacccgcugcaggacgagugggugcucgucuccgcgcaccgcaugaagcggcccuggcagggccagguggagccccagcugcugaagacggugccccgccacgacccgcucaacccccugugccccggggccauccgggccaacggggaggucaacccccaguacgacagcaccuuccuguucgacaacgacuucccggcccuccagcccgacgcgcccucccccggcccgagcgaccacccccuguuccaggccaaguccgcccgcggggugugcaaggugaugugcuuccaccccuggagcgacgucacccugccccucauguccgugccggagauccgggccguggucgacgccugggcgagcgugaccgaggagcugggcgcccaguaccccugggugcagaucuucgagaacaagggcgccaugauggggugcuccaacccccacccccacugccaggucugggccagcuccuuccugccggacaucgcccagcgcgaggagcggagccagcaggcguacaagucccagcacggcgagccccuccugauggaguacagccgccaggagcugcuccggaaggagcgccuggugcugacguccgagcacuggcucgugcugguccccuucugggccaccuggcccuaccagacccugcuccugccgcggcgccacgugcggcgccugcccgagcucacccccgccgagcgggacgaccuggccagcaucaugaagaagcugcucacgaaguacgacaaccuguucgagaccuccuuccccuacagcaugggguggcacggcgccccgaccgggagcgaggcgggcgccaacuggaaccacuggcagcugcacgcccacuacuacccgccccuccugcgcuccgccaccgugcggaaguucauggucggcuacgagaugcuggcccaggcgcagcgcgaccucacgcccgagcaggccgccgagcgccugcgggcccugcccgaggugcacuaccaccucgggcagaaggaccgcgagaccgcgaccaucgccuga

SEQ ID NO: 30445 - RNA, 711 nt, Artificial Sequence
  derived and/or modified sequence opt1 from GAMT__Homo_sapiens__NP_000147
augagcgcccccuccgccaccccgaucuucgcgcccggcgagaacugcagccccgccuggggcgccgcccccgccgcguacgacgccgccgacacccaccuccgcauccuggggaagccggugauggagcggugggagacgcccuacaugcacgcccuggcggccgccgccuccagcaagggcgggcgcguccuggaggugggguucggcauggccaucgcggccuccaaggugcaggaggcccccaucgacgagcacuggaucaucgagugcaacgacggcgucuuccagcggcuccgcgacugggcgccccggcagacccacaaggugaucccgcugaaggggcugugggaggacguggcccccacccuccccgacggccacuucgacgggauccuguacgacaccuacccccugagcgaggagacguggcacacccaccaguucaacuucaucaagaaccacgccuuccgccuccugaagccgggcgggguccugaccuacugcaaccucaccuccuggggcgagcugaugaaguccaaguacagcgacaucacgaucauguucgaggagacccaggugcccgcccugcucgaggccggcuuccggcgcgagaacauccggaccgaggugauggcccuggucccgcccgccgacugccgcuacuacgcguucccccagaugaucacgccccuggugaccaagggguga

SEQ ID NO: 30446 - RNA, 2544 nt, Artificial Sequence
  derived and/or modified sequence opt1 from GANAB__Homo_sapiens__NP_001265123
augacccgcuuccggaucgacgagcuggagccccgccggccgcgcuaccgggugcccgacguccucguggccgacccgcccaucgcccgccugagcguguccggccgggacgagaacagcgucgagcugaccauggcggaggggcccuacaagaucauccucacggcccgccccuuccggcuggaccugcucgaggaccgcucccugcugcucagcgugaacgcccggggccugcuggaguucgagcaccagcgcgcgccccgggugucccaggggagcaaggaccccgccgagggcgacggggcccagccggaggagacgccccgcgacggcgacaagcccgaggagacccagggcaaggccgagaaggacgagcccggggccugggaggagaccuucaagacgcacuccgacagcaagccguacggccccauguccgucgggcucgacuucagccugcccggcauggagcacguguacgggauccccgagcacgccgacaaccugcggcucaaggugaccgagggcggcgagccguaccgccuguacaaccuggacgucuuccaguacgagcucuacaaccccauggcgcuguacggguccgugcccgugcugcucgcccacaacccccaccgggaccugggcaucuucuggcugaacgccgccgagaccugggucgacaucagcuccaacaccgccgggaagacccucuucggcaagaugauggacuaccugcagggcagcggggagaccccgcagaccgacgugcgcuggauguccgagaccggcaucaucgacguguuccugcuccuggggcccagcaucuccgacgucuuccggcaguacgcgagccugacgggcacccaggcccucccgccccuguucucccugggguaccaccagagccgcuggaacuaccgggacgaggccgacgugcucgagguggaccagggcuucgacgaccacaaccugcccugcgacgucaucuggcuggacaucgagcacgccgacggcaagcgcuacuucaccugggaccccagccgcuucccccagccccggaccaugcucgagcgccuggccuccaagcggcgcaagcugguggcgaucguggacccgcacaucaaggucgacagcggguaccgggugcacgaggagcuccgcaaccugggccuguacgugaagacgcgggacggguccgacuacgagggcuggugcuggcccgggagcgccggcuaccccgacuucaccaacccgaccaugcgcgccuggugggccaacauguucuccuacgacaacuacgagggcagcgcccccaaccucuucgucuggaacgacaugaacgagcccuccguguucaacgggcccgaggucaccaugcugaaggacgcgcagcacuacggcgggugggagcaccgggacgugcacaacaucuacggccuguacgugcacauggccacggccgacgggcuccgccagcggagcggcggcauggagcgcccguucguccuggcccgggccuucuucgcggggucccagcgcuucggcgccguguggaccggggacaacaccgccgagugggaccaccugaagaucagcauccccaugugccucucccugggccuggugggccugagcuucugcggggccgacgucggcggguucuucaagaaccccgagcccgagcuccuggugcggugguaccagaugggcgcguaccagccguucuuccgcgcccacgcccaccuggacaccgggcggcgcgagcccuggcuccugcccucccagcacaacgacaucauccgggacgcccugggccagcgcuacagccuccugcccuucugguacacgcugcucuaccaggcccaccgcgagggcaucccggugaugcggccccuguggguccaguacccccaggacgugaccaccuucaacaucgacgaccaguaccugcucggggacgcgcugcuggugcaccccgucuccgacagcggcgcccacgggguccagguguaccucccgggccagggggaggugugguacgacauccaguccuaccagaagcaccacggcccccagacccuguaccugcccgugacgcucagcuccauccccguguuccagcgcggcgggaccaucgucccgcgguggaugcgcgugcggcgcagcagcgagugcaugaaggacgaccccaucacccuguucguggcccugagcccccagggcaccgcccagggggagcuguuccucgacgacggccacacguucaacuaccagacccggcaggaguuccugcuccgccgguucuccuucuccgggaacacccuggucagcuccagcgccgaccccgagggccacuucgagaccccgaucuggaucgagcgcguggugaucaucggcgcggggaagcccgccgccgucgugcugcagacgaagggcucccccgagagccggcucuccuuccagcacgacccggagaccagcgugcugguccugcgcaagcccgggaucaacguggccuccgacuggagcauccaccuccgguga

SEQ ID NO: 30447 - RNA, 849 nt, Artificial Sequence
  derived and/or modified sequence opt1 from GANC__Homo_sapiens__NP_001288339
auggaggccgccgugaaggaggagaucagccuggaggacgaggcggucgacaagaacaucuuccgcgacugcaacaagaucgccuucuaccggcgccagaagcaguggcucuccaagaaguccaccuaccaggcccugcuggacagcgugaccacggacgaggacagcacccgguuccagaucaucaacgaggccuccaaggugcgcugccaggaccagagccccaccacccucgacgccuucaagggcaaggagacgaccguccaggaggagacccaggaccuguccacccggcagcaccuggcgcagaaggaggccgaggagccggacaagcaggggcagaucacgugggacaucagcaacguggcccccaagaccgagaacuucgaggaccuccuggagcagacccccugcuccgccugccugcagggcuucacccgcgacaacacgagcuccagcuucuccgaggacgcggggaucagccucuccaccagcgugaagcugccccuggccuccagcuccaagccgaacgagaacgaggcccuccccaaccagccgcccagccagcagauccggcacaacuaccgccugcuggccagcaccgucuccgccgagauggcgcggaaccgccagcucaucugggagcuggcccggcagagcgaggcccaccuggaccgccccguggugcucggcgagcaggccuccgcccagcgggaggucgcgagcauccugugccgcaaguccgugcuggccaucaaccagcucgccgccaccguggaggggacgaucagcguccugcagcaguucaacgagcugcucgaccacccccuggaccccggccgguccuga

SEQ ID NO: 30448 - RNA, 1794 nt, Artificial Sequence
  derived and/or modified sequence opt1 from GAN__Homo_sapiens__NP_071324
auggccgagggcagcgccguguccgacccccagcacgcggcccgccugcuccgggcccugagcuccuuccgcgaggagagccgguucugcgacgcccaccugguccucgacggggaggagaucccggugcagaagaacauccuggccgcggccucccccuacauccgcaccaagcugaacuacaacccgcccaaggacgacggcagcaccuacaagaucgagcucgaggggaucuccgugauggucaugcgggagauccuggacuacaucuucagcggccagauccgccugaacgaggacacgauccaggacguggugcaggccgccgaccuccugcugcucaccgaccugaagacccugugcugcgaguuccucgaggggugcaucgcggccgagaacugcaucggcauccgggacuucgcccugcacuacugccugcaccacguccacuaccucgccaccgaguaccuggagacgcacuuccgcgacguguccagcaccgaggaguuccuggagcucagcccccagaagcugaaggaggugaucucccuggagaagcucaacgucggcaacgagcgguacguguucgaggccgugauccgcuggaucgcgcacgacaccgagauccggaagguccacaugaaggacgugauguccgcccugugggugagcgggcuggacuccagcuaccuccgcgagcagaugcugaacgagccccugguccgggagaucgugaaggagugcuccaacaucccccucagccagccccagcagggcgaggccaugcuggccaacuucaagccgcgcggguacuccgagugcaucgugaccgucggcggggaggagcgggugagccgcaagcccacggccgcgaugcggugcaugugcccccuguacgaccccaaccgccagcucuggaucgagcuggccccgcugagcaugccccggaucaaccacggcgugcucuccgccgagggcuuccuguucgucuucgggggccaggacgagaacaagcagacccugagcuccggggagaaguacgaccccgacgccaacaccuggaccgcccugcccccgaugaacgaggcgcgccacaacuucggcaucguggagaucgacggcaugcuguacauccucgggggcgaggacggggagaaggagcucaucagcauggagugcuacgacaucuacuccaagacguggaccaagcagcccgaccugaccauggugcggaagaucggcugcuacgccgccaugaagaagaagaucuacgccaugggcgggggcagcuacgggaagcuguucgaguccgucgagugcuacgacccccgcacccagcaguggacggccaucugcccccucaaggagcgccgguucggcgcgguggccugcggggucgccauggagcuguacguguucggcggggugcgcagccgggaggacgcccagggcuccgagauggugaccugcaagagcgaguucuaccacgacgaguucaagcgcuggaucuaccugaacgaccagaaccucugcaucccggcguccagcuccuucgucuacggcgccgugcccaucggggccagcaucuacgucaucggcgaccuggacaccgggaccaacuacgacuacgugcgggaguucaagcgcuccacgggcaccuggcaccacaccaagccccugcugcccagcgaccuccggcgcaccgggugcgccgcccugcggaucgcgaacugcaagcuguuccgccuccagcugcagcagggccuguuccggauccgcgugcacuccccguga

SEQ ID NO: 30449 - RNA, 825 nt, Artificial Sequence
  derived and/or modified sequence opt1 from GAP43__Homo_sapiens__NP_001123536
augaccaagagcugcuccgagcugugccaccccgcccuccacuuccugccgugccugggcgggcuccgcaagaaccugcagcgggccgugcgccccagccccuacucccugggcuuccucaccuucuggaucagccgggucgagaagaacgacgacgaccagaagaucgagcaggacgggaucaagcccgaggacaaggcgcacaaggccgccacgaagauccaggccuccuuccgcggccacaucacccggaagaagcugaagggggagaagaaggacgacgugcaggccgcggaggccgaggccaacaagaaggacgaggccccgguggcggacggcgucgagaagaagggcgaggggaccaccacggccgaggccgcccccgccaccggcagcaagcccgacgagcccgggaaggcgggcgagaccccguccgaggagaagaagggggagggcgacgccgccaccgagcaggccgcgccccaggcccccgccagcuccgaggagaaggccggcagcgccgagacggaguccgccaccaaggcgagcaccgacaacucccccagcuccaaggccgaggacgccccggccaaggaggagcccaagcaggccgacgugcccgcggccgugaccgccgccgcggccacgacccccgccgccgaggacgccgcggccaaggccaccgcccagccgcccaccgagacgggggagagcucccaggccgaggagaacaucgaggcggucgacgagaccaagcccaaggagagcgcccgccaggacgagggcaaggaggaggagcccgaggccgaccaggagcacgccuga

SEQ ID NO: 30450 - RNA, 882 nt, Artificial Sequence
  derived and/or modified sequence opt1 from GAPDH__Homo_sapiens__NP_001243728
augguguacauguuccaguacgacagcacccacggcaaguuccacgggaccgucaaggccgagaacggcaagcuggugaucaacgggaaccccaucacgaucuuccaggagcgcgacccguccaagaucaaguggggcgacgccggggcggaguacguggucgagagcaccggcguguucaccaccauggagaaggccggcgcccaccuccagggcggggccaagcgggugaucaucuccgcccccagcgcggacgcccccauguucgucaugggggugaaccacgagaaguacgacaacucccugaagaucaucagcaacgccuccugcacgaccaacugccuggcgccccucgccaaggugauccacgacaacuucggcaucgucgaggggcugaugaccaccgugcacgccaucacggccacccagaagaccguggacggcccgagcggcaagcuguggcgcgacgggcggggcgcccuccagaacaucauccccgccuccaccggggcggccaaggccgucggcaaggugauccccgagcugaacggcaagcugacggggauggccuuccgcgugcccaccgccaacgucagcgugguggaccugaccugccggcucgagaagccggcgaaguacgacgacaucaagaaggucgugaagcaggccuccgagggcccccugaaggggauccucggcuacaccgagcaccagguggucagcuccgacuucaacagcgacacgcacuccagcaccuucgacgccggggccggcaucgcccugaacgaccacuucgugaagcugaucuccugguacgacaacgaguucggcuacagcaaccgcguggucgaccucauggcgcacauggccuccaaggaguga

SEQ ID NO: 30451 - RNA, 1227 nt, Artificial Sequence
  derived and/or modified sequence opt1 from GAPDHS__Homo_sapiens__NP_055179
augagcaagcgcgacaucgugcugaccaacgucaccguggugcagcuccugcggcagcccugcccggucacgcgcgcgcccccgccgcccgagcccaaggccgagguggagccccagccccagcccgagcccacccccgugcgggaggagaucaagcccccgcccccgccccugccgccccaccccgccacgcccccgcccaagauggucuccguggcccgcgagcucaccgugggcaucaacggguucggccggaucgggcgccugguccugcgggccugcauggagaagggcgugaagguggucgccgugaacgaccccuucaucgaccccgaguacaugguguacauguucaaguacgacagcacccacgggcgcuacaagggcuccgucgaguuccggaacggccagcucgugguggacaaccacgagaucagcgucuaccagugcaaggagcccaagcagauccccuggcgcgccguggggucccccuacguggucgagagcaccggcguguaccuguccauccaggcggccagcgaccacaucuccgccggggcccagcggguggucaucagcgcgcccuccccggacgcccccauguucgugaugggcgucaacgagaacgacuacaaccccgggagcaugaacaucguguccaacgccagcugcaccaccaacugccuggccccgcucgccaaggugauccacgagcgcuucggcaucgucgagggccugaugacgaccgugcacuccuacaccgcgacccagaagacgguggacgggcccagccggaaggccuggcgcgacggccgcggggcccaccagaacaucauccccgccuccaccggcgccgcgaaggccgucaccaaggugauccccgagcugaagggcaagcucaccgggauggccuuccgggugccgacgcccgacgucagcgugguggaccugaccugccggcuggcccagcccgcccccuacuccgcgaucaaggaggccgucaaggccgccgccaagggcccgauggcggggauccucgccuacaccgaggacgagguggugagcaccgacuuccugggcgacacgcacagcuccaucuucgacgccaaggccgggaucgcgcugaacgacaacuucgucaagcucaucagcugguacgacaacgaguacggcuacucccaccgcgugguggaccugcugcgguacauguucagccgcgacaaguga

SEQ ID NO: 30452 - RNA, 654 nt, Artificial Sequence
  derived and/or modified sequence opt1 from GAR1__Homo_sapiens__NP_061856
augagcuuccgcggcgggggccgcgggggcuucaaccgcgggggcggcgggggcggguucaaccggggcggguccagcaaccacuuccgcggcggcgggggcgggggcggcgggggcaacuuccgcgggggcgggcggggcggcuucgggcggggcgggggccgcgggggcuucaacaagggccaggaccaggggccgcccgagcgggugguccugcucggcgaguuccugcaccccugcgaggacgacaucgugugcaagugcaccaccgacgagaacaaggugcccuacuucaacgcccccgucuaccuggagaacaaggagcagaucgggaagguggacgagaucuucggccagcuccgcgacuucuacuucuccgugaagcugagcgagaacaugaaggccuccagcuucaagaagcugcagaaguucuacaucgaccccuacaagcuccugccccugcagcgguuccucccccggcccccgggggagaagggcccgccccggggcgggggccgcgggggccggggcgggggccgcgggggcgggggccggggcgggggccgcgggggcggguuccggggcggccgcgggggcgggggcgggggcuuccggggcgggcgcggcgggggcuuccgcgggcggggccacuga

SEQ ID NO: 30453 - RNA, 2631 nt, Artificial Sequence
  derived and/or modified sequence opt1 from GAREM__Homo_sapiens__NP_001229338
auggaccccgccccgagccugggcugcucccucaaggacgugaaguggagcuccgucgccgugccccuggaccugcucgugagcaccuaccgccugccccagaucgcccggcuggacaacggggagugcgucgagggccuccgcgagaacgacuaccugcugauccacuccugccggcaguggaccacgaucaccgcccacagccucgaggaggggcacuacgugaucggccccaagaucgagaucccggugcacuacgccgggcaguucaagcugcuggagcaggaccgcgacaucaaggagcccguccaguacuucaacuccguggaggagguggccaaggccuuccccgagcgggucuacgugauggaggacaucaccuucaacgugaaggucgcgagcggcgagugcaacgaggacaccgagguguacaacaucacgcucugcaccggcgacgagcugacccugauggggcaggccgagauccucuacgccaagaccuucaaggagaagucccgccugaacacgaucuucaagaagaucggcaagcugaacagcaucuccaagcucgggaagggcaagaugcccugccugaucugcaugaaccaccggaccaacgagagcaucucccugccguuccagugcaaggggcgcuucagcacccggagcccccucgagcugcagaugcaggagggcgagcacaccauccgcaacaucguggagaagacgcggcugcccgucaacgugaccgugcccuccccgccgccccgcaaccccuacgaccuccacuucauccgggagggccaccgcuacaaguucgucaacauccagaccaagaccgugguggucugcugcgugcugcggaacaacaagauccugcccaugcacuucccccuccaccugacggugcccaaguucucccugcccgagcaccucgucaagggggagagcuggccggagacccuggugcaccacuggcugggcaucugccaggagcaguucgacaucgacgaguacucccgcgccguccgggacgugaagaccgacuggaacgaggagugcaagagccccaagaaggggcgcugcagcggccacaaccacgugcccaacucccucagcuacgcgcgggacgagcugacccaguccuuccaccgccugagcgucugcguguacggcaacaaccuccacgggaacuccgaggugaaccugcacggcugccgggaccucgggggcgacugggcccccuucccgcacgacauccuccccuaccaggacagcggggacuccggcagcgacuaccuguuccccgaggccuccgaggagagcgccggcauccccgggaaguccgagcugccguacgaggagcucuggcuggaggagggcaagcccagccaccagccccugacgcgcucccucagcgagaagaaccgcugcgaccaguuccggggguccguccgcagcaagugcgccaccuccccgcugcccauccccggcacccugggggcggccgucaagagcuccgacaccgcccugcccccgccgcccgugccgcccaagagcgaggccgugcgggaggagugccgccugcugaacgccccgcccgugccgccccggagcgcgaagccccuguccacgagccccuccaucccgccccgcaccgugaagcccgcccggcagcagacccgcagccccucccccacccucagcuacuacuccagcggccugcacaacaucuccgucacgaagaccgacaccaaccccagcgaguccacccccgugagcugcuaccccugcaaccgggugaagacggacuccgucgaccucaagagccccuucggcucccccagcgccgaggccguguccagccgccugagcuggcccaaccacuacuccggggccagcgagucccagacccggagcgacuuccugcuggaccccucccgcagcuacuccuacccgcggcagaagacccccggcacccccaagcgcaacugccccgcgccguucgacuucgacgggugcgagcuccuggccagccccacgucccccgugaccgccgaguucagcuccagcgucuccggcugccccaagagcgccuccuacagccuggaguccaccgacgucaagagccucgccgcgggggugaccaagcaguccaccagcugcccggcccugccgccccgggcccccaagcugguggaggagaagguggccagcgagacgagcccccucccccugaagaucgacggcgcggaggaggaccccaaguccggcucccccgaccugagcgaggaccaguacuucgugaagaaggggaugcaggacaucuucuccgccagcuacccguucuccagcccccuccaccuccagcuggcgccccgcuccugcggcgacgggagccccuggcagccgcccgccgaccuguccggccugagcaucgaggaggucuccaagagccugcgguucaucggccucuccgaggacgugaucagcuucuucgugaccgagaagaucgacgggaaccugcugguccagcucaccgaggagauccuguccgaggacuucaagcugagcaagcuccaggugaagaagaucaugcaguucaucaacggcuggcgccccaagaucuga

SEQ ID NO: 30454 - RNA, 2976 nt, Artificial Sequence
  derived and/or modified sequence opt1 from GARNL3__Homo_sapiens__NP_001273708
augaaguccuccgugagcgaggaccugggcugccgccgcggggacuucucccggaagcacuacggcagcgucgagcuccugaucuccagcgacgccgacggggccauccagcgggcgggccgcuuccggguggagaacggguccagcgacgagaacgccaccgcccugcccggcaccuggcgccggacggacgugcaccucgagaacccggaguaccacacccgcugguacuucaaguacuuccugggccagguccaccagaacuacaucgggaacgacgccgagaagucccccuucuuccugagcgugacccucuccgaccagaacaaccagcgggugccccaguaccgcgccauccuguggcggaagaccggcacgcagaagaucugccugcccuacagcccgaccaagacccucuccgucaagagcauccuguccgcgaugaaccuggacaaguucgagaaggggccccgcgagaucuuccaccccgagauccagaaggaccuccuggugcuggaggagcaggagggcagcgugaacuucaaguucgggguccucuucgccaaggacggccagcugaccgacgacgagauguucuccaacgagaucggcagcgagcccuuccagaaguuccugaaccuccugggggacacgaucacccugaagggcuggaccggguaccggggcggccucgacaccaagaacgacacgaccgggauccacuccguguacaccguguaccagggccacgagaucauguuccacgucagcaccaugcugccguacagcaaggagaacaagcagcaggucgagcgcaagcggcacaucgggaacgacaucgugacgaucgucuuccaggagggcgaggaguccagccccgccuucaagcccuccaugauccgcagccacuucacccacaucuucgcccuggugcgguacaaccagcagaacgacaacuaccgccucaagaucuucuccgaggagagcgugccccuguucgggccgccccugcccacgcccccgguguucaccgaccaccaggaguuccgggacuuccuccuggugaagcugaucaacggcgagaaggcgacccucgagacccccaccuucgcccagaagcgccggcgcacccuggacaugcugauccgcagccuccaccaggaccugaugcccgaccugcacaagaacaugcucaaccggcgcagcuucuccgacgugcugcccgagagcccgaaguccgcccggaagaaggaggaggcccgccaggccgaguucguccggaucggccaggcgcugaagcucaagagcaucgugcgcggggacgcccccuccagccuggccgccuccggcaucugcaagaaggagcccugggagccccagugcuucugcagcaacuucccgcacgaggccgugugcgcggaccccugggggcaggcccugcucgucuccacggacgccggcgugcugcuggucgacgacgaccuccccagcgugcccguguucgaccggacccugccggucaagcagaugcacgugcuggagacccucgaccugcuggugcugcgcgccgacaaggggaaggacgcccgccucuucgucuuccggcuguccgcgcugcagaagggccucgagggcaagcaggccggcaagagccggagcgacugccgcgagaacaagcuggagaagaccaaggggugccaccuguacgccaucaacacgcaccacucccgggagcuccgcaucgugguggccauccggaacaagcugcugcucaucacccgcaagcacaacaagcccagcggggucaccuccaccagccugcugagcccccucuccgaguccccgguggaggaguuccaguacauccgggagaucugccugagcgacucccccauggugaugacgcuggucgacggccccgccgaggagagcgacaaccucaucugcguggcguaccgccaccaguucgacguggucaacgaguccaccggggaggccuuccggcugcaccacguggaggccaaccgcgugaacuucgucgccgcgaucgacguguacgaggacggcgaggccggccugcuccugugcuacaacuacagcugcaucuacaagaaggugugccccuucaacgggggcuccuuccugguccagccgagcgccuccgacuuccaguucugcuggaaccaggcccccuacgccaucgugugcgcguuccccuaccuccuggccuucaccaccgacagcauggagauccgccugguggucaacgggaaccucgugcacacggccguggucccccagcugcagcugguggccucccggagcgacaucuacuucaccgccaccgcggccgugaacgaggucagcuccggcggcagcuccaagggggccagcgcccgcaacuccccgcagaccccgcccggccgggacacccccguguuccccagcucccucggggagggcgagauccagagcaagaaccuguacaagaucccccugcgcaaccucguggggcgguccaucgagcgcccccucaagagcccccuggucuccaaggugaucacgccgcccacccccaucagcgugggccuggccgcgauccccgucacccacucccugagccugucccggauggagaucaaggagaucgccagccgcacccggcgcgagcuccugggccuguccgacgagggcgggcccaagagcgagggggccccgaaggccaaguccaagccccggaagcgccucgaggagagccagggcgggcccaagccgggcgcggugcggagcuccagcuccgaccgcauccccagcggcucccuggagagcgccuccacgagcgaggccaaccccgaggggcacuccgccagcuccgaccaggacccgguggccgaccgggagggcagccccgucuccgggagcucccccuuccagcugaccgcguucagcgacgaggacaucaucgaccucaaguga

SEQ ID NO: 30455 - RNA, 2220 nt, Artificial Sequence
  derived and/or modified sequence opt1 from GARS__Homo_sapiens__NP_002038
augcccagcccgcgccccgugcugcuccggggcgcccgcgccgcgcugcugcuccugcugccgccccggcuccuggcccgccccucccugcuccugcggcgcagccuguccgccgccagcugcccgcccaucucccuccccgccgcggccagccgguccagcauggacggggccggcgccgaggagguccuggcgccccugcgccucgccgugcggcagcagggggaccuggugcgcaagcugaaggaggacaaggcgccccaggucgacguggacaaggccguggccgagcucaaggcgcggaagcgcguccuggaggccaaggagcuggcccuccagcccaaggacgacaucguggaccgggccaagauggaggacacccugaagcgccgguucuucuacgaccaggccuucgcgaucuacggcgggguguccggccuguacgacuucggccccgucgggugcgcccucaagaacaacaucauccagaccuggcgccagcacuucauccaggaggagcagauccuggagaucgacugcacgaugcugaccccggagcccgugcucaagaccagcggccacguggacaaguucgccgacuucauggucaaggacgugaagaacggggagugcuuccgggccgaccaccuccugaaggcccaccuccagaagcugauguccgacaagaagugcagcguggagaagaaguccgagauggagagcguccuggcgcagcuggacaacuacggccagcaggagcuggccgaccuguucgugaacuacaacgugaagucccccaucaccgggaacgaccucagcccgcccgucuccuucaaccugauguucaagacguucaucggccccggcgggaacaugcccggcuaccugcgccccgagaccgcccaggggaucuuccucaacuucaagcggcugcuggaguucaaccagggcaagcucccguucgccgccgcgcagaucggcaacagcuuccgcaacgagaucagcccccgguccgggcugauccgcgugcgcgaguucaccauggccgagaucgagcacuucguggaccccagcgagaaggaccaccccaaguuccagaacgucgccgaccugcaccucuaccuguacuccgccaaggcccaggugagcggccaguccgcccggaagaugcgccugggggacgccguggagcagggcgucaucaacaacaccgugcucggguacuucaucggccggaucuaccuguaccugacgaaggucggcaucagcccggacaagcugcgcuuccggcagcacauggagaacgagauggcccacuacgccugcgacugcugggacgcggaguccaagaccagcuacggguggaucgagaucgugggcugcgccgaccgcuccugcuacgaccucagcugccacgcccgggccaccaaggugccccuggucgccgagaagccccugaaggagcccaagaccgugaacgugguccaguucgagccguccaagggggcgaucggcaaggccuacaagaaggacgccaagcucgugauggaguaccuggccaucugcgacgagugcuacaucacggagauggagaugcugcucaacgagaagggggaguucaccaucgagaccgagggcaagaccuuccagcugacgaaggacaugaucaacgugaagcgcuuccagaagacccuguacgucgaggagguggugcccaacgucaucgagcccagcuucggccucgggcggaucauguacaccguguucgagcacaccuuccacgugcgcgagggcgacgagcagcggacguucuucuccuucccggccgucguggcgcccuucaagugcagcgugcugccccugucccagaaccaggaguucaugcccuucgucaaggagcucagcgaggcccugacccgccacggggugucccacaagguggacgacagcuccggcagcaucgggcggcgcuacgcccggaccgacgagaucggcgucgccuucggcgugaccaucgacuucgacacggugaacaagaccccgcacaccgcgacccugcgcgaccgggacuccaugcgccagauccgggccgagaucagcgagcuccccagcaucguccaggaccuggccaacgggaacaucacgugggccgacguggaggcccgcuacccccuguucgagggccaggagaccgggaagaaggagaccaucgaggaguga

SEQ ID NO: 30456 - RNA, 1302 nt, Artificial Sequence
  derived and/or modified sequence opt1 from GART__Homo_sapiens__NP_780294
auggccgcccgcgugcugaucaucggcagcgggggccgggagcacacccucgcguggaagcuggcccagucccaccacgucaagcagguccugguggcccccgggaacgccggcaccgccugcagcgagaagaucuccaacacggcgaucagcaucuccgaccacaccgcccucgcccaguucugcaaggagaagaagaucgaguucguggugguggggccggaggcgccccuggcggccggcaucgucggcaaccugcgcagcgccggggugcagugcuucggccccaccgccgaggccgcgcagcucgaguccagcaagcgguucgccaaggaguucauggaccgccacgggauccccaccgcccaguggaaggccuucacgaagccggaggaggccugcuccuucauccugagcgcggacuuccccgcccugguggucaaggccuccggccucgccgccgggaagggcgugaucguggccaagagcaaggaggaggccugcaaggccguccaggagaucaugcaggagaaggccuucggcgccgcgggggagaccaucgugaucgaggagcugcuggacggcgaggagguguccugccucugcuucaccgacgggaagaccgucgcccccaugcccccggcccaggaccacaagcggcugcuggagggcgacggcgggcccaacacgggcgggaugggcgccuacugccccgcgccccaggugagcaacgaccuccugcugaagaucaaggacaccgugcuccagcgcaccgucgacgggaugcagcaggagggcaccccguacacgggcauccuguacgccgggaucaugcugaccaagaacggccccaaggugcucgaguucaacugccgguucggggaccccgagugccaggugauccugccccugcucaaguccgaccuguacgaggucauccagagcacccuggacggccuccugugcaccucccugccgguguggcucgagaaccacacggcccugaccguggucauggccagcaagggguaccccggcgacuacaccaagggcguggagaucaccggguuccccgaggcccaggcgcugggccucgaggucuuccacgccgggacggcccugaagaacggcaagguggugacccacgggggccgcguccuggccgugaccgccauccgggagaaccucaucuccgcgcuggaggaggccaagaagggccuggccgccaucaaguucgagggggccaucuaccgcaaggacgugggcuuccgggcgaucgccuuccuccagcagccccgcuga

SEQ ID NO: 30457 - RNA, 1038 nt, Artificial Sequence
  derived and/or modified sequence opt1 from GAS1__Homo_sapiens__NP_002039
augguggccgcccugcucggcgggggcggggaggcgcgcggcgggaccguccccggcgccuggcugugccugauggcccuccugcagcugcucggcagcgccccgcggggguccggccuggcccacgggcgccggcugaucugcuggcaggcgcuccugcagugccagggcgagcccgagugcagcuacgccuacaaccaguacgccgaggccugcgcgcccgugcuggcccagcacgggggcggcgacgcccccggggccgccgcggccgccuucccggccuccgccgcgagcuucuccagccgcuggcggugccccucccacugcaucagcgcccucauccagcugaaccacacccgccggggccccgcccuggaggacugcgacugcgcccaggacgagaacugcaaguccaccaagcgcgccaucgagcccugccucccgcggaccagcgggggcggcgccgggggccccggggcgggcggggugaugggcugcaccgaggcccgccggcgcugcgaccgggacucccgcugcaaccuggcccugagccgguaccucaccuacugcggcaaggucuucaacgggcugcgcugcacggacgagugccggaccgugaucgaggacaugcuggccaugcccaaggcggcccuccugaacgacugcgugugcgacggccuggagcgccccaucugcgaguccgucaaggagaacauggcccggcucugcuucggggccgagcugggcaacgggccgggcagcuccggcagcgacgggggccuggacgacuacuacgacgaggacuacgacgacgagcagcgcaccgggggcgccgggggcgagcagccccucgacgacgacgacggcgugccccacccgccccggcccggguccggcgcggccgccagcgggggccgcggcgaccugcccuacgggcccggccgccgguccagcgggggcgggggccgccuggccccgcggggcgcguggacgccccucgccagcauccugcugcuccugcuggggccccucuucuga

SEQ ID NO: 30458 - RNA, 942 nt, Artificial Sequence
  derived and/or modified sequence opt1 from GAS2__Homo_sapiens__NP_001137302
augugcaccgcccugagccccaaggugcgcuccggcccggggcucagcgacaugcaccaguacucccaguggcuggccagccggcacgaggcgaaccugcuccccaugaaggaggaccuggcccuguggcucaccaaccugcugggcaaggagaucacggccgagaccuucauggagaagcucgacaacggggcccugcugugccagcucgccgagaccaugcaggagaaguucaaggaguccauggacgcgaacaagcccaccaagaaccugccccugaagaagaucccgugcaagacgagcgcccccuccggcagcuucuucgcccgcgacaacaccgccaacuuccucuccuggugccgggaccugggggucgacgagaccugccuguucgagagcgagggccucgugcugcacaagcagccccgcgaggugugccugugccuccuggagcugggccggaucgcggcccgcuacggggucgagcccccgggccucaucaagcuggagaaggagaucgagcaggaggagacccuguccgcccccagccccucccccagcccguccagcaaguccagcgggaagaaguccacgggcaaccuccuggacgacgccgugaagcggaucagcgaggacccgcccugcaagugccccaacaaguucugcguggagcgccugagccaggggcgguaccgcgucggcgagaagauccucuucauccggaugcugcacaacaagcacgugauggugcgcgucggcgggggcugggagaccuucgccggguaccugcucaagcacgaccccugccggaugcugcagaucucccgcguggacggcaagaccagccccauccaguccaagagccccacccugaaggacaugaaccccgacaacuaccucguggucuccgcgagcuacaaggccaagaaggagaucaaguga

SEQ ID NO: 30459 - RNA, 1365 nt, Artificial Sequence
  derived and/or modified sequence opt1 from GAS2L1__Homo_sapiens__NP_001265659
auggccgaccccguggccggcaucgcggggagcgccgccaaguccguccgcccguuccggagcuccgaggccuacguggaggccaugaaggaggaccuggcggaguggcucaacgcccuguacggccuggggcuccccggcgggggcgacggcuuccugaccgggcuggccaccggcaccacccucugccagcacgccaacgcggugaccgaggccgcccgcgcccuggccgcggcccggcccgcccgcggggucgccuuccaggcccacagcguggugcccggcuccuucauggcgcgggacaacgucgccaccuucaucggguggugccgcguggagcugggcgugccggagguccucauguucgagacggaggaccuggugcugcggaagaacgagaaguccgugguccucugccugcuggagguggcccgccggggcgcccgccucgggcugcuggcgccccggcucgugcaguucgagcaggagaucgagcgcgagcugcgggccgccccgcccgcccccaacgcccccgccgcgggcgaggacaccaccgagaccgcccccgcccccgggacgccggcccgcggcccccggaugacccccagcgaccugcgcaaccucgacgagcugguccgggagauccugggccgcugcacgugccccgaccaguucccgaugaucaaggugagcgaggggaaguaccgggugggcgacuccagccuccugaucuucguccgcgugcugcggucccacgugaugguccgcgucgggggcgggugggacacccucgagcacuaccuggacaagcacgaccccugccgcugcagcuccaccgcgcaccggccgccccagccccgcgugugcaccuucagcccccagcgggugucccccaccaccagcccccgcccggccucccccgugcccggcagcgagcggcgcggcucccggcccgagaugacgccggucagccugcgcagcaccaaggaggggcccgagacgcccccguccagcuccagcuccagccucuccgugcugggcgggaagugcggccagcccggggacagcggccggaccgccaacggccugcccgggccccgcucccaggcccucagcuccagcuccgacgagggcagcccgugccccgggaugggcgggccccuggacgcccccggcuccccgcuggcgugcaccgagcccagccggaccugggcccgcggccggauggacacccagcccgaccgcaagcccucccggaucccgacgccccgcgggccccggcgccccagcggcccggccgagcucgggaccuggcacgcccugcacuccgugacgccccgggccgagcccgacagcuggauguga

SEQ ID NO: 30460 - RNA, 2037 nt, Artificial Sequence
  derived and/or modified sequence opt1 from GAS6__Homo_sapiens__NP_000811
auggcccccagccuguccccgggccccgccgcgcuccgccgggcgccccagcugcugcuccugcugcucgccgccgagugcgcccuggccgcccugcuccccgcccgcgaggccacccaguuccugcggccgcgccagcggcgcgcguuccagguguucgaggaggccaagcaggggcaccuggagcgggagugcgucgaggagcucugcagccgcgaggaggcccgggagguguucgagaacgaccccgagaccgacuacuucuacccccgcuaccuggacugcaucaacaaguacggcucccccuacacgaagaacagcggguucgcgaccugcgugcagaaccugccggaccagugcacccccaaccccugcgaccggaagggcacccaggccugccaggaccucauggggaacuucuucugccugugcaaggccggcuggggcgggcgccugugcgacaaggacgucaacgagugcucccaggagaacggcgggugccuccagaucugccacaacaagcccggcagcuuccacugcuccugccacagcggguucgagcuguccagcgacggccggacgugccaggacaucgacgagugcgccgacuccgaggccugcggcgaggcccgcugcaagaaccugccggggagcuacuccugccucugcgacgagggcuucgccuacagcucccaggagaaggcgugccgggacguggacgagugccugcaggggcgcugcgagcaggucugcgugaacagccccggcuccuacacgugccacugcgacggccgcgggggccugaagcucagccaggacauggacacgugcgaggacauccugcccugcgugcccuucuccguggccaagagcgucaagagccuguaccucgggcggauguucuccggcaccccggugauccggcugcgcuucaagcggcugcagcccacccgccucguggccgaguucgacuuccgcaccuucgaccccgaggggauccugcuguucgccggcggccaccaggacagcaccuggaucguccucgcccugcgggcggggcgccuggagcuccagcugcgguacaacggcguggggcgcgugaccuccagcggccccgucaucaaccacgggauguggcagaccaucuccguggaggagcuggcccggaaccucgugaucaaggucaaccgcgacgccgugaugaagaucgccguggccggcgaccuguuccagccggagcggggccuguaccaccucaaccugaccgucgggggcauccccuuccacgagaaggaccuggugcagcccaucaacccccgccucgacgggugcaugcggagcuggaacuggcugaacggcgaggacaccaccauccaggagacggugaaggucaacacccgcaugcagugcuucuccgugaccgagcgggggagcuucuacccgggcuccggcuucgcguucuacagccuggacuacaugcgcacgccccucgacgucgggaccgaguccaccugggagguggagguggucgcccacauccggcccgccgccgacaccggcgugcuguucgcgcugugggcccccgaccugcgcgccgugccgcucagcgucgcccugguggacuaccacuccaccaagaagcugaagaagcagcucgugguccuggccguggagcacacggcgcuggcccucauggagaucaaggugugcgacgggcaggagcacgucgugaccgugagccugcgggacggcgaggccacccuggaggucgacggcacccgcgggcaguccgaggugagcgccgcccagcuccaggagcggcuggcggugcuggagcgccaccuccggucccccguccugacguucgccggcgggcugcccgacgugccggugaccagcgcccccgucaccgccuucuaccgcggcugcaugacccucgaggugaaccgccggcugcuggaccucgacgaggccgcguacaagcacuccgacaucacggcccacagcugcccgcccguggagcccgccgccgcguga

SEQ ID NO: 30461 - RNA, 1239 nt, Artificial Sequence
  derived and/or modified sequence opt1 from GAS7__Homo_sapiens__NP_001124303
auggugcccccgccgcccggcgaggagagccagaccgucauccugccgcccggguggcaguccuaccucagcccccagggccgccgguacuacgugaacaccacgaccaacgagaccaccugggagcgccccuccagcucccccgggauccccgccagccccggcucccaccggagcucccugccgcccacggugaacggguaccacgccagcggcacccccgcgcacccgcccgagaccgcccacauguccguccgcaagagcaccggcgacucccagaaccuggggagcuccagccccuccaagaagcagagcaaggagaacacgaucaccaucaacugcgugaccuucccccaccccgacaccaugcccgagcagcagcuccugaagcccacggagugguccuacugcgacuacuucugggccgacaagaaggacccgcagggcaacgggaccguggccggcuucgagcugcuccugcagaagcagcugaaggggaagcagaugcagaaggagaugagcgaguucauccgggagcgcaucaagaucgaggaggacuacgccaagaaccucgcgaagcugagccagaacucccuggccagccaggaggagggcucccucggcgaggccugggcccaggucaagaagucccuggcggacgaggccgaggugcaccugaaguucagcgccaagcuccacagcgagguggagaagccccugaugaacuuccgggagaacuucaagaaggacaugaagaagugcgaccaccacaucgccgaccugcgcaagcagcucgccucccgguacgcgagcgucgagaaggcccgcaaggcccugaccgagcggcagcgcgaccuggagaugaagacccagcagcucgagaucaagcuguccaacaagacggaggaggacaucaagaaggcccggcgcaagagcacccaggccggggacgaccugaugcggugcguggaccucuacaaccaggcgcaguccaagugguucgaggagauggugaccaccacgcuggagcuggagcgccucgaggucgagcggguggagaugauccgccagcaccugugccaguacacccagcugcggcacgagaccgacauguucaaccagagcaccguggagcccgucgaccagcuccugcgcaagguggaccccgccaaggaccgggagcugugggugcgcgagcacaagacgggcaacauccgcccggucgacauggagaucuga

SEQ ID NO: 30462 - RNA, 861 nt, Artificial Sequence
  derived and/or modified sequence opt1 from GAS8__Homo_sapiens__NP_001273137
augaagaugcugcgcgacgagcucgaccugcggcgcaagaccgagcugcacgagguggaggagcggaagaacggccagauccacacccucaugcagcgccacgaggaggccuucacggacaucaagaacuacuacaacgacaucacccugaacaaccuggcccucaucaacagccugaaggagcagauggaggacaugcggaagaaggaggaccaccuggagcgcgagauggcggaggucuccgggcagaacaagcggcucgccgacccccugcagaaggcccgcgaggagaugagcgagaugcagaagcagcuggccaacuacgagcgggacaagcagauccuccugugcaccaaggcccgccugaaggugcgggagaaggagcucaaggaccugcagugggagcacgaggugcuggagcagcgcuucaccaagguccagcaggagcgggacgagcucuaccgcaaguucacggcggccauccaggaggugcagcagaagaccggcuucaagaaccuggugcuggagcggaagcuccaggcccuguccgccgcggucgagaagaaggaggugcaguucaacgaggugcuggccgccagcaaccucgacccggccgcccugacccuggucucccgcaagcucgaggacgugcuggagagcaagaacuccaccaucaaggaccugcaguacgagcucgcccaggugugcaaggcgcacaacgaccugcugcggacguacgaggccaagcuccuggccuucgggaucccccuggacaacgucggcuucaagccccucgagaccgccgugaucgggcagacccugggccagggccccgcggggcuggugggcaccccgacguga

SEQ ID NO: 30463 - RNA, 306 nt, Artificial Sequence
  derived and/or modified sequence opt1 from GAST__Homo_sapiens__NP_000796
augcagcgccugugcguguacguccucaucuucgcccuggcccuggcggccuucagcgaggccuccuggaagccccggagccagcagccggacgcgccccucggcaccggggccaaccgcgaccuggagcugcccuggcucgagcagcagggccccgccucccaccaccggcgccagcuggggccgcagggcccgccccaccugguggccgaccccagcaagaagcaggggcccuggcucgaggaggaggaggaggccuacggcuggauggacuucggccggcgcuccgccgaggacgagaacuga

SEQ ID NO: 30464 - RNA, 1242 nt, Artificial Sequence
  derived and/or modified sequence opt1 from GATA1__Homo_sapiens__NP_002040
auggaguuccccggccuggggagccucggcaccuccgagccgcugccccaguucguggaccccgcccuggucagcuccacccccgagagcgggguguucuucccguccggccccgaggggcucgacgccgccgccagcuccacggcccccagcaccgccaccgccgcggccgccgcccuggcguacuaccgcgacgccgaggccuaccggcacucccccguguuccaggucuacccgcugcucaacugcauggagggcauccccggcgggagccccuacgccggcugggccuacgggaagaccggccuguaccccgcguccacggugugcccgacccgcgaggacagcccgccccaggccguggaggaccuggacgggaagggcuccaccagcuuccucgagacccugaagacggagcggcugucccccgaccuccugacccugggccccgcccuccccagcucccugcccguccccaacagcgccuacgggggcccggacuucuccagcaccuucuucagccccaccgggagcccccugaacuccgccgcguacuccagccccaagcuccgcggcacgcugccgcugccgcccugcgaggcccgggagugcgugaacugcggcgccaccgccacgccccucuggcgccgggaccgcaccgggcacuaccugugcaacgccugcggccuguaccacaagaugaacgggcagaaccggccccucauccgccccaagaagcggcugaucguguccaagcgcgcgggcacccagugcaccaacugccagaccaccacgaccacccuguggcggcgcaacgccagcggggaccccgucugcaacgccugcggccucuacuacaagcugcaccaggugaaccggccgcugaccaugcgcaaggacggcauccagacgcggaaccgcaaggccuccgggaagggcaagaagaagcgggggagcucccucggcgggaccggcgccgcggagggccccgccgggggcuucaugguggucgccgggggcagcggguccggcaacugcggcgagguggccagcgggcugacccugggcccgcccgggaccgcgcaccucuaccagggccugggccccgugguccuguccgggcccgugagccaccucaugcccuuccccggcccgcugcuggggucccccacgggcagcuuccccaccgggcccaugccgcccaccaccuccacgaccguggucgcgccccucagcuccuga

SEQ ID NO: 30465 - RNA, 1443 nt, Artificial Sequence
  derived and/or modified sequence opt1 from GATA2__Homo_sapiens__NP_001139133
auggagguggcccccgagcagccgcgcuggauggcccaccccgcgguccugaacgcccagcaccccgacagccaccaccccggccucgcccacaacuacauggagccggcccagcugcugccgcccgacgagguggacguguucuucaaccaccucgacucccaggggaaccccuacuacgccaaccccgcgcacgcccgggcccgcgucagcuacucccccgcccacgcgcggcugaccggcgggcagaugugccgcccccaccuccugcacagccccggccugccguggcuggacgggggcaaggccgcccucuccgccgccgcggcccaccaccacaaccccuggaccgugagccccuucuccaagacgccccugcacccgagcgccgccggcgggcccggcgggccccuguccguguaccccggcgccgggggcggcagcgggggcggguccggcagcuccgucgcgagccucaccccgaccgccgcccacuccggcagccaccuguucggguucccgcccaccccgcccaaggaggugucccccgaccccagcacgaccggcgccgccucccccgcgagcagcuccgccgggggcagcgccgcccggggcgaggacaaggacggcgugaaguaccaggucucccugaccgagagcaugaagauggaguccggcagcccccuccgccccgggcuggccaccaugggcacgcagcccgcgacccaccacccgauccccaccuaccccuccuacgugcccgccgccgcccacgacuacagcuccgggcuguuccacccgggcggguuccucggcggccccgcgagcuccuucacccccaagcagcggagcaaggcccgcuccugcagcgaggggcgggagugcgugaacugcggcgccacggccacgccccuguggcgccgggacgggaccggccacuaccugugcaacgccugcgggcucuaccacaagaugaacggccagaaccgcccgcugaucaagcccaagcggcgccuguccgcggcccggcgcgccgggaccugcugcgccaacugccagaccaccaccaccacgcucuggcggcgcaacgccaacggggaccccgucugcaacgcgugcggccuguacuacaagcugcacaacgugaaccggccccucaccaugaagaaggaggggauccagacccgcaaccggaagaugagcaacaaguccaagaaguccaagaagggcgccgagugcuucgaggagcugagcaagugcaugcaggagaaguccagcccguucagcgccgccgcccuggcgggccacauggcccccguggggcaccucccgcccuucagccacuccggccacauccugcccacccccacgcccauccaccccagcuccagccuguccuucgggcacccgcaccccagcuccauggucaccgccaugggcuga

SEQ ID NO: 30466 - RNA, 1332 nt, Artificial Sequence
  derived and/or modified sequence opt1 from GATA3__Homo_sapiens__NP_002042
auggaggugaccgccgaccagccccgcugggucagccaccaccacccggccgugcugaacggccagcaccccgacacccaccaccccgggcucucccacagcuacauggacgcggcccaguacccccugccggaggagguggacguccuguucaacaucgacggccaggggaaccacgugccgcccuacuacggcaacuccgugcgggccacgguccagcgcuacccgcccacccaccacgggagccaggugugccggccgccccuccugcacggcucccugcccuggcucgacggcgggaaggcccugggcagccaccacaccgccucccccuggaaccugagccccuucuccaagaccagcauccaccacgggucccccggcccccucagcguguacccgcccgcguccagcuccagccuguccgggggccacgccagcccccaccuguucacguucccgcccaccccgcccaaggacgucucccccgaccccagccucagcacccccggcuccgccgggagcgcccgccaggacgagaaggagugccugaaguaccaggugccccugcccgacuccaugaagcucgagagcucccacagccggggcuccaugaccgcgcucgggggcgccagcuccagcacgcaccaccccaucaccaccuacccgcccuacgugcccgaguacuccagcggccuguucccgcccuccagccugcucgggggcucccccaccggguucggcugcaagagccgccccaaggcccgguccagcacggggcgcgagugcgucaacugcggcgccaccuccacgccccuguggcggcgcgacggcaccgggcacuaccugugcaacgccugcggccuguaccacaagaugaacgggcagaaccggccccugaucaagcccaagcgccggcucagcgcggcccgccgggccggcaccagcugcgccaacugccagaccaccaccacgacccuguggcgccggaacgccaacggggacccggugugcaacgcgugcggccuguacuacaagcuccacaacaucaaccgcccccugaccaugaagaaggagggcauccagacccggaaccgcaagauguccagcaaguccaagaagugcaagaaggugcacgacagccuggaggacuuccccaagaacuccagcuucaaccccgccgcccucucccggcacaugagcucccugagccacaucuccccguucagccacuccagccacaugcugacgacccccacccccaugcacccgcccuccagccucuccuucgggccccaccaccccagcagcauggucaccgccaugggcuga

SEQ ID NO: 30467 - RNA, 1329 nt, Artificial Sequence
  derived and/or modified sequence opt1 from GATA4__Homo_sapiens__NP_002043
auguaccagagccuggccauggccgcgaaccacgggcccccgcccggggccuacgaggccggcgggcccggcgccuucaugcacggggccggcgcggccuccagccccguguacgucccgaccccgcgcgugcccuccagcgugcucggccuguccuaccugcagggcggcggggccggcagcgccuccgggggcgcgagcggcggguccagcggcggggccgccuccggcgccggccccgggacccagcagggcagccccggguggucccaggccggcgcggacggggccgccuacacgcccccgcccgucagcccccgguucuccuuccccggcaccaccggcagccucgccgccgcggccgccgccgccgcggcccgcgaggccgccgccuacuccagcgggggcggggcggccggcgccgggcuggccggccgggagcaguacggccgcgcgggguucgccggcuccuacagcagccccuaccccgccuacauggccgacgugggggccuccugggcggccgccgccgccgcgagcgccggcccguucgacucccccgugcugcacagccuccccgggcgggccaaccccgccgcccgccacccgaaccuggacauguucgacgacuucuccgagggccgggagugcgucaacugcggcgcgaugagcacgccccuguggcgccgggacgggaccggccacuaccucugcaacgccugcgggcuguaccacaagaugaacggcaucaaccgcccccugaucaagccccagcggcgccucuccgccagccggcgcgugggccuguccugcgccaacugccagaccaccaccacgacccuguggcggcgcaacgcggagggggagccggugugcaacgccugcggccucuacaugaagcugcacggggucccccggccccuggccaugcgcaaggagggcauccagacccggaagcgcaagcccaagaaccucaacaagagcaagaccccggccgcccccuccgggagcgagucccugcccccggcgagcggcgccuccagcaacuccagcaacgccacgaccuccagcagcgaggagaugcggcccaucaagaccgagcccggccuguccagccacuacgggcacuccagcuccgugagccagaccuucuccgugagcgccauguccggccacgggcccagcauccacccgguccucuccgcccugaagcugagcccccagggcuacgcgucccccgugagccagagcccccagacguccuccaagcaggacagcuggaacagccucgugcuggccgacucccacggggacaucaucaccgccuga

SEQ ID NO: 30468 - RNA, 1194 nt, Artificial Sequence
  derived and/or modified sequence opt1 from GATA5__Homo_sapiens__XP_006723762
auguaccagucccuggcccucgccgcgagcccccgccaggccgccuacgccgacuccggcuccuuccugcacgccccgggggcgggcagccccauguucgugccgcccgcccggguccccuccaugcugagcuaccucuccgggugcgagcccagcccccagcccccggagcuggccgcccgccccggcugggcgcagaccgccaccgccgacuccagcgccuucgggcccggcagcccccacccgcccgccgcgcacccgcccggcgccacggccuuccccuucgcccacucccccuccgggcccggcagcgggggcuccgccgggggccgggacggcagcgcguaccagggggcccugcucccccgcgagcaguucgccgccccgcugggccggcccguggggaccuccuacagcgccaccuaccccgcguacgugucccccgacgucgcccagagcuggaccgccggcccguucgacggcagcgugcugcacgggcuccccggccgccggcccacguucguguccgacuuccuggaggaguuccccggggagggccgcgagugcgucaacugcggggcccugagcaccccgcucuggcggcgcgacggcaccggccacuaccugugcaacgccugcgggcuguaccacaagaugaacggcgugaaccggccccucgugcgcccccagaagcggcuguccagcucccgccgggcggggcugugcugcaccaacugccacacgaccaacaccacccucuggcgccggaacagcgagggcgagccggucugcaacgccugcgggcuguacaugaagcugcacggcgugccccgcccccucgccaugaagaaggaguccauccagacgcggaagcgcaagcccaagaccaucgccaaggcgcggggcagcuccgggagcacccgcaacgccuccgccagcccguccgccguggccagcaccgacuccagcgcggccacguccaaggccaagcccagccuggccucccccgucugccccggcccgagcauggcgccccaggccagcgggcaggaggacgacucccuggcccccggccaccucgaguucaaguucgagcccgaggacuucgccuucccgagcaccgcccccagcccccaggccgggcugcgcggcgcgcugcggcaggaggccuggugcgcccucgcccuggcguga

SEQ ID NO: 30469 - RNA, 1788 nt, Artificial Sequence
  derived and/or modified sequence opt1 from GATA6__Homo_sapiens__NP_005248
auggcccugaccgacggcggguggugccuccccaagcgcuucggcgccgcgggggccgacgccagcgacucccgggccuucccggcccgcgagcccagcaccccgcccucccccaucagcuccagcuccagcuccugcagccggggcggggagcgcggccccggcggggcguccaacugcggcacgccccagcuggacaccgaggccgccgccgggcccccggcgcggagccugcuccuguccagcuacgccucccaccccuucggcgcgccccacgggcccagcgccccgggcguggccggccccgggggcaaccuguccagcugggaggaccuccugcuguucaccgaccucgaccaggccgccaccgccuccaagcugcuguggagcagccgcggggccaagcucucccccuucgcccccgagcagccggaggagauguaccagacgcuggcggcccugagcucccagggccccgccgccuacgacggcgcccccgggggcuucguccacagcgcggccgccgccgccgcggccgccgccgcggccuccagccccguguacgugccgaccacccgggucggguccaugcuccccggccugcccuaccaccuccaggggagcggcuccggccccgccaaccacgccgggggcgccggggcgcacccgggcuggccccaggccagcgccgacuccccgcccuacgggagcggcggcggggccgccggcgggggcgcggccgggcccggcggcgccggguccgccgccgcgcacgugagcgcccgcuuccccuacucccccagcccgcccauggccaacggcgccgcgcgggagcccgggggcuacgccgccgccggcuccgggggcgccgggggcgugagcgggggcggcuccagccuggcggccaugggcgggcgcgagccccaguacagcucccugagcgccgcccggccgcugaacgggaccuaccaccaccaccaccaccaccaccaccaccaccccucccccuacagccccuacgucggcgccccgcucacgcccgcguggcccgccgggcccuucgagaccccggugcugcacucccugcagagccgcgccggcgcgccccuccccgugccccggggcccguccgccgaccugcuggaggaccucagcgagucccgcgagugcgucaacugcgggagcauccagacgccccuguggcggcgcgacggcaccgggcacuaccugugcaacgccugcggccucuacuccaagaugaacgggcugagccggccccugaucaagccccagaagcgcgugccguccagccggcgccucggccuguccugcgccaacugccacaccaccaccaccacgcuguggcggcgcaacgccgagggcgagcccgugugcaacgccugcgggcucuacaugaagcugcacggcgucccccgcccccuggcgaugaagaaggaggggauccagacccggaagcgcaagccgaagaacaucaacaagagcaagaccugcuccggcaacagcaacaacagcauccccaugacccccacguccaccagcuccaacagcgacgacugcuccaagaacaccagcccgaccacgcagcccaccgccuccggggccggcgcccccgugaugaccggcgccggggagagcaccaaccccgagaacuccgagcucaaguacagcggccaggacgggcuguacaucggcgugucccuggcgagcccggccgaggucacguccagcgugcggcccgacuccuggugcgcccucgcccuggccuga

SEQ ID NO: 30470 - RNA, 810 nt, Artificial Sequence
  derived and/or modified sequence opt1 from GATAD1__Homo_sapiens__NP_066990
augccccugggccucaagccgaccugcagcgugugcaagaccacguccagcuccauguggaagaagggggcccagggcgagauccugugccaccacugcaccgggcgcggcggggccggcagcggcggggcgggcuccggggccgccggcgggaccggcggcagcgggggcgggggcuucggcgccgccaccuucgcguccacgagcgccaccccgccccaguccaacgggggcgggggcgggaagcagagcaagcaggagauccaccggcgcuccgcccggcugcgcaacaccaaguacaagagcgcccccgcggccgagaagaaggucuccaccaagggcaagggccggcgccacaucuucaagcucaagaaccccaucaaggcccccgagagcguguccacgaucaucaccgccgagagcaucuucuacaaggggguguacuaccagaucggcgacgucguguccgugaucgacgagcaggacgggaagcccuacuacgcccagauccggggcuucauccaggaccaguacugcgagaaguccgcggcccugaccuggcugauccccacccucagcagcccgcgcgaccaguucgaccccgccagcuacaucaucgggcccgaggaggaccugccccggaagauggaguaccuggaguucgucugccacgccccguccgaguacuucaagagccgcuccagccccuuccccacggugcccacccggccggagaagggcuacaucuggacccacgugggccccacccccgccaucacgaucaaggaguccgucgcgaaccaccucuga

SEQ ID NO: 30471 - RNA, 1905 nt, Artificial Sequence
  derived and/or modified sequence opt1 from GATAD2A__Homo_sapiens__NP_001287875
augaccgaggaggccugccgcacccggagccagaagcgcgcccuggagcgggaccccacggaggacgacguggaguccaagaagaucaagauggagcgcggccuccuggcgagcgaccugaacaccgacggggacaugcgggucacccccgagcccggcgccgggcccacccagggccuccugcgcgccacggaggccaccgccauggcgauggggcggggcgagggccuggugggggacggccccguggacaugcgcaccucccacagcgacaugaaguccgagcggcgcccgcccagccccgacgucaucgugcucuccgacaacgagcagcccagcuccccgcgggugaacgggcugaccacggucgcccugaaggagaccagcaccgaggcccucaugaaguccagccccgaggagcgcgagcggaugaucaagcagcugaaggaggagcugcgccucgaggaggccaagcuggugcugcucaagaagcugcggcagucccagauccagaaggaggcgaccgcccagaagcccacgggcagcgugggguccaccgucaccacgcccccgccccuggugcgcggcacccagaacauccccgccggcaagcccagccuccagaccuccagcgcccggaugccgggguccgugaucccgccgccccugguccgcggcgggcagcaggccagcagcaagcugggcccccaggcguccagccagguggugaugccgccccucguccggggcgcccagcagauccacuccauccgccagcacagcuccaccgggcccccgccccugcugcucgcgccccgggccagcgugcccuccgugcagauccagggccagcgcaucauccagcaggggcugauccgcgucgccaacgugcccaacaccagccugcucgugaacaucccccagcccacgcccgccucccugaagggcaccaccgccaccagcgcccaggccaacuccacgcccaccagcgucgccuccguggugaccagcgcggagucccccgccagccggcaggccgccgccaagcuggcgcuccgcaagcagcuggagaagacccugcucgagaucccgccgcccaagccgcccgcccccgagaugaacuuccugcccuccgccgccaacaacgaguucaucuaccuggucgggcucgaggaggugguccagaaccugcuggagacgcaggcgggccggaugagcgccgccaccgugcucucccgcgagcccuacaugugcgcccagugcaagaccgacuucacgugccgguggcgcgaggagaaguccggcgccaucaugugcgagaacugcaugaccaccaaccagaagaaggcgcugaagguggagcacaccagccggcugaaggccgccuucgucaaggcccuccagcaggagcaggagaucgagcagcgccugcugcagcaggggaccgcccccgcgcaggccaaggccgagcccacggccgcgccccaccccgugcucaagcaggucaucaagccccggcgcaagcuggccuuccggagcggcgaggcccgcgacuggagcaacggggccgugcugcaggccuccagccagcucucccggggcagcgcgaccaccccgcgcggggugcugcacaccuucucccccagccccaagcugcagaacuccgccagcgccaccgcccuggugucccggacgggccgccacagcgagcggaccgucuccgccggcaaggggagcgcgaccuccaacuggaagaagacgccccucagcaccggcgggacccuggccuucguguccccgagccuggccgugcacaagagcuccagcgccgucgaccgccagcgggaguaccuccuggacaugaucccgccccgcuccaucccccagagcgccaccuggaaguga

SEQ ID NO: 30472 - RNA, 1782 nt, Artificial Sequence
  derived and/or modified sequence opt1 from GATAD2B__Homo_sapiens__XP_006711532
auggaccgcaugaccgaggacgcccugcggcucaaccugcugaagcgcagccucgaccccgccgacgagcgggacgacgugcuggcgaagcgccugaagauggagggccacgaggccauggagcggcucaagaugcuggcccugcucaagcgcaaggaccuggccaaccuggaggucccgcacgagcuccccaccaagcaggacggguccggcgugaagggguacgaggagaagcugaacggcaaccugcggccccacggggacaaccgcacggccggccggcccggcaaggagaacaucaacgacgagccgguggacaugagcgcgcgccgguccgagcccgagcgcgggcggcucacccccagccccgacaucaucguccuguccgacaacgaggccagcuccccgcgcagcuccagccggauggaggagcgccugaaggccgccaaccucgagauguucaagggcaaggggaucgaggagcggcagcagcugaucaagcagcugcgcgacgagcuccggcuggaggaggcgcgccuggugcuccugaagaagcugcggcagucccagcuccagaaggagaacgugguccagaagacccccguggugcagaacgccgccagcaucguccagcccucccccgcccacgugggccagcaggggcugagcaagcugccgucccgccccggcgcccagggcguggagccccagaaccuccgcacccugcaggggcacagcgucauccgguccgcgacgaacaccacccugccccacaugcucaugagccagcgcgugaucgccccgaaccccgcccagcugcagggccagcgggggccgcccaagcccggccuggugcgcaccacgacccccaacaugaaccccgccaucaacuaccagccccaguccagcagcuccgucccgugccagcggaccaccagcuccgccaucuacaugaaccucgcgagccacauccagcccggcacggugaaccgcguguccagcccccugcccuccccgagcgccaugaccgacgccgccaacucccaggccgcggccaagcuggcccuccggaagcagcuggagaagacccugcucgagaucccgccgcccaagccgcccgcgccccugcugcacuuccuccccagcgccgccaacuccgaguucaucuacauggucgggcuggaggagguggugcagagcgucaucgacucccagggcaagagcugcgccucccugcuccgcguggagcccuucgugugcgcccagugccggaccgacuucacgccccacuggaagcaggagaagaacgggaagauccugugcgagcagugcaugaccagcaaccagaagaaggcccugaaggcggagcacaccaaccgccugaagaacgccuucgucaaggcccuccagcaggagcaggagaucgagcagcggcugcagcagcaggccgcccugucccccaccacggcgcccgccgugagcuccgucagcaagcaggagaccaucaugcgccaccacacccuccggcaggcgccccagccccagagcucccugcagcgcggcauccccaccagcgcccgguccaugcugagcaacuucgcccaggccccgcagcucuccgugcccgggggccugcugggcaugcccggggugaacaucgccuaccucaacacgggcaucgggggccacaaggggcccagccuggccgaccgccagcgggaguaccugcucgacaugaucccgccccgcuccaucagccaguccaucagcggccagaaguga

SEQ ID NO: 30473 - RNA, 1674 nt, Artificial Sequence
  derived and/or modified sequence opt1 from GATB__Homo_sapiens__NP_004555
auggccgcccccaugcugcgcuggggcugccgggggcgccggugggcguucgcccgcguggacggcgggagcugccaccggcgcggcgccccgaccggguccaccagcaaccagauccggggcgaguccagcgucgcccagcagccccuccacacggcccagaagacccgcaagggcgagcacaagugggcggccgugguggggcuggagauccacgcccagaucuccagcaacuccaagcuguucagcggcucccagguccgguucagcgccccgcccaacucccucgugagcuucuucgacgcgucccugccggggacccugcccgugcucaaccgccggugcgucgaggccgccgugaugaccggccuggcccugaacugccacaucaacaagaagucccucuucgaccgcaagcacuacuucuacgccgaccugcccgcgggguaccagaucacgcagcagcggcugcccaucgccgugaacggcagccucaucuacggcgucugcgccgggaagaagcagagccaggugaucccgaagaccgugcgcaucaagcagauccagcuggagcaggacuccggcaagagccugcacgacaaccuccggucccagacccugaucgaccugaaccgcgccggggucggccuccuggagguggugcuggagcccgacaugagcugcggcgaggaggccgcgaccgccguccgggagcuccagcugauccugcaggcccucgggacgagccaggccaacauggccgagggccagcugcgcguggacgcgaacaucuccgugcaccaccccggggagccccugggcguccggaccgaggugaagaaccucaacagcauccgcuuccuggccaaggccaucgacuacgagauccagcggcagaucaacgagcuggagaacgggggcgagauccucaacgagacccgcuccuuccaccacaagcugggcugcaccaugagcaugcgcgacaaggaggggaagcaggacuaccgguucaugccggagcccaaccugccgccccucgugcuguacgacgccacgucccugcccgccggcgcggacccccagcaggucaucaacaucgaccagauccgcgagacccuccccgagcugcccagcgugacccgggagaagcuggugcagcaguacgggaugcuccuggagcacuccuucacccugcucaacgaggucggccugcuggaguucuuccagaacgugaucaaggagacgcgcgccgagccgaagaaggucaccagcugggugcucaacaccuuccugggguaccugaagcagcagaaccucgccguguccgagagccccgucacccccuccgcccuggcggagcugcuggaccuccuggacagccggacgaucuccagcuccgccgccaagcaggucuucgaggagcuguggaagcgcgagggcaagacccccggccagaucgugagcgagaagcagcucgagcugaugcaggaccagggggcccuggagcagcucugccacuccgugauggaggcccacccccagguggugauggacgucaagaaccggaacccccgcgcgaucaacaagcugaucggccuggugcggaaggccacccagagccgcgccgaccccgugaugaucaaggagauccucgagaagaagcugucccuguga

SEQ ID NO: 30474 - RNA, 1272 nt, Artificial Sequence
  derived and/or modified sequence opt1 from GATM__Homo_sapiens__NP_001473
augcugcgcgugcggugccuccgcggcgggagccggggcgccgaggccguccacuacaucgggucccgccugggccggacccugaccgggugggugcagcgcacguuccagagcacccaggcggccaccgccuccagccggaacuccugcgccgccgacgacaaggcgaccgagccccucccgaaggacugccccgugagcuccuacaacgagugggacccccuggaggaggucaucgugggccgcgccgagaacgccugcgugcccccguucacgaucgaggucaaggccaacaccuacgagaaguacuggcccuucuaccagaagcagggcgggcacuacuuccccaaggaccaccugaagaaggcgguggccgagaucgaggagaugugcaacauccucaagaccgagggcgugaccguccggcgccccgacccgaucgacuggagccugaaguacaagacgcccgacuucgaguccaccgggcuguacagcgccaugccccgggacauccucaucguggugggcaacgagaucaucgaggcccccauggccuggcgcucccgguucuucgaguaccgcgcguaccggagcaucaucaaggacuacuuccaccgcggggccaaguggaccaccgccccgaagcccacgauggccgacgagcuguacaaccaggacuaccccauccacuccgucgaggaccggcacaagcuggccgcgcagggcaaguucgugaccaccgaguucgagcccugcuucgacgccgccgacuucauccgcgccggccgggacaucuucgcccagcgcagccaggugaccaacuaccucgggaucgaguggaugcggcgccaccuggcgccggacuaccgcguccacaucaucuccuucaaggaccccaaccccaugcacaucgacgccacguucaacaucaucggccccgggaucgugcugagcaacccggaccggcccugccaccagaucgaccucuucaagaaggccggcuggaccaucaucaccccgcccacccccaucauccccgacgaccacccccuguggauguccagcaaguggcuguccaugaacgugcucaugcuggacgagaagcgcgucaugguggacgccaacgaggugcccauccagaagauguucgagaagcugggcaucacgaccaucaaggucaacauccggaacgccaacagccucgggggcggguuccacugcuggaccugcgacgugcgccggcgcggcacccugcagagcuaccuggacuga

SEQ ID NO: 30475 - RNA, 2784 nt, Artificial Sequence
  derived and/or modified sequence opt1 from GBA2__Homo_sapiens__NP_065995
augggcacccaggaccccgggaacaugggcaccggggugccggccagcgagcagaucuccugcgccaaggaggacccccaggucuacugccccgaggagacgggcgggaccaaggacguccaggugaccgacugcaagagccccgaggacucccgcccgcccaaggagaccgacugcugcaaccccgaggacagcggccagcugaugguguccuacgagggcaaggcgaugggguaccaggugcccccguucggcuggcggaucugccucgcccacgaguucacggagaagcgcaagcccuuccaggccaacaacgugagccuguccaacaugaucaagcacaucgggaugggccugcgguaccuccaguggugguaccgcaagacccacgucgagaagaagacccccuucaucgacaugaucaacagcgugccccugcggcagaucuacgggugcccgcugggcggcaucgggggcgggaccaucacgcgcggcuggcggggccaguucugccgcuggcagcucaaccccgggauguaccagcaccggaccgugaucgccgaccaguucaccgucugccugcgccgggagggccagaccguguaccagcagguccugucccucgagcgccccagcgugcugcgguccuggaacugggggcugugcggcuacuucgccuucuaccacgcgcucuacccccgcgccuggacgguguaccagcugccggggcagaacgugacccugaccugccggcagaucacccccauccucccccacgacuaccaggacagcucccugcccgucggcguguucgugugggacgucgagaacgagggcgacgaggcccuggacgugagcaucauguucuccaugcgcaacgggcucggcgggggcgacgacgcccccgggggccuguggaacgagccguucugccuggagcggagcggcgagacggugcgcgggcuccugcugcaccaccccacccuccccaacccguacaccauggcggucgccgcccgggugaccgccgccacgaccgugacccacaucaccgcguucgaccccgacuccacgggccagcaggucuggcaggaccugcugcaggacgggcagcucgacagccccaccggccaguccacccccacccagaagggggugggcaucgccggcgccgucugcgugagcagcaagcugcgcccgcgggggcagugccgccuggaguucucccucgccugggacaugccccgcaucauguucggcgccaagggccaggugcacuaccggcgcuacacgcgguucuucgggcaggacggcgacgcggcccccgcccugagccacuacgcccugugccgcuacgccgagugggaggagcggaucuccgcguggcagagcccgguccucgacgaccgcucccugcccgccugguacaagagcgcccuguucaacgagcucuacuuccuggccgacgggggcaccguguggcuggaggugcucgaggacucccugcccgaggagcuggggcggaacaugugccaccuccgccccacccugcgggacuacggccgcuucggguaccuggagggccaggaguaccggauguacaacaccuacgacguccacuucuacgccagcuucgcgcucaucaugcuguggccgaagcuggagcucucccugcaguacgacauggcccuggccacgcugcgcgaggaccucacccggcgccgguaccugaugagcggcgugauggcccccgugaagcgccggaacgucaucccccacgacaucggggaccccgacgacgagccguggcugcgcgugaacgcguaccucauccacgacaccgccgacuggaaggaccugaaccugaaguucgugcuccaggucuaccgggacuacuaccugaccggcgaccagaacuuccugaaggacauguggcccgugugccucgccgugauggaguccgagaugaaguucgacaaggaccacgacgggcugaucgagaacggcggguacgccgaccagacguacgacggcugggucaccaccggccccagcgccuacugcgggggccuguggcucgcggccguggccgugaugguccagauggccgcccugugcggggcgcaggacauccaggacaaguucuccagcauccugucccgcggccaggaggccuacgagcgccuccuguggaacgggcgguacuacaacuacgacagcuccagccgcccccagucccggagcgugaugagcgaccagugcgccggccagugguuccugaaggccugcggccucggggagggcgacaccgagguguucccgacccagcacgucgugcgcgcccugcagacgaucuucgagcugaacgugcaggcguucgccgggggcgccaugggggccgucaacggcaugcagccccacggcgugcccgacaaguccagcgugcaguccgacgaggucuggguggggguggucuacggccucgcggccaccaugauccaggaggggcugaccugggagggcuuccagaccgccgagggcugcuaccggacggugugggagcgccuggggcucgccuuccagacccccgaggccuacugccagcagcggguguuccgcagccuggcguacaugcggccgcuguccaucugggccaugcagcucgcccugcagcagcagcagcacaagaaggccagcuggcccaaggucaagcagggcaccgggcugcgcaccggccccauguucgggcccaaggaggccauggcgaaccucuccccggaguga

SEQ ID NO: 30476 - RNA, 1350 nt, Artificial Sequence
  derived and/or modified sequence opt1 from GBA__Homo_sapiens__NP_001165282
auggagcugagcaugggccccauccaggccaaccacaccgggaccggccuccugcugacgcuccagccggagcagaaguuccagaaggugaagggguucggcggggccaugaccgacgcggccgcccugaacauccuggcccucuccccgcccgcccagaaccugcugcucaagagcuacuucuccgaggagggcaucggcuacaacaucauccgcguccccauggcgagcugcgacuucuccauccggaccuacaccuacgccgacacgcccgacgacuuccagcugcacaacuucagccugcccgaggaggacaccaagcucaagaucccccugauccaccgcgcccugcagcucgcccagcggcccgugucccugcuggcgagcccguggaccucccccaccuggcucaagacgaacggggccgugaacggcaaggggagccugaagggccagcccggggacaucuaccaccagaccugggcccgcuacuucgucaaguuccuggacgccuacgccgagcacaagcuccaguucugggcggugaccgccgagaacgagcccuccgccggccugcugagcggcuacccguuccagugccucggguucacccccgagcaccagcgggacuucaucgcccgcgaccugggccccacgcuggccaacuccacccaccacaacgugcggcuccugaugcuggacgaccagcgccuccugcugccccacugggcgaaggucgugcucaccgacccggaggccgccaaguacgugcacgggaucgccguccacugguaccuggacuuccuggcccccgcgaaggccacccucggcgagacgcaccggcuguuccccaacaccaugcuguucgccagcgaggccugcgugggcuccaaguucugggagcagagcgugcgccucggguccugggaccggggcaugcaguacagccacuccaucaucaccaaccugcuguaccacgucgugggguggaccgacuggaaccucgcccugaaccccgagggcgggccgaacugggugcgcaacuucgucgacagccccaucaucguggacaucacgaaggacaccuucuacaagcagcccauguucuaccaccugggccacuucagcaaguucauccccgagggcucccagcggguggggcucgucgcgagccagaagaacgaccuggacgccguggcccugaugcacccggacggcuccgccguggucguggugcucaaccgcagcuccaaggacgucccccugaccaucaaggaccccgcggugggguuccuggagaccaucagccccggcuacuccauccacacguaccuguggcggcgccaguga

SEQ ID NO: 30477 - RNA, 744 nt, Artificial Sequence
  derived and/or modified sequence opt1 from GBAS__Homo_sapiens__NP_001189398
auggccgcccgcgugcugcgggcgcgcggcgccgccugggccgggggccuccugcagcgggccgcgcccugcagccugcucccgcgccugcggaccuggaccuccagcuccaaccgcagccgggaggacuccuggcucaagagccuguucguccgcaagguggacccccggaaggacgcccacuccaaccugcuggccaagaaggagacgagcaaccucuacaagcugcaguucaagcgcugcugccagcgguucaccaagaucaacaccacccuggugcucuggugggggcugggcacgcgcgggauggccucccggaccaagcuggaguuccucgaguuccgcaaggcgcggagcgacaugcugcugucccgcaagaaccagcuccugcuggaguucagcuucuggaacgagcccgucccccgguccggcccgaacaucuacgagcuccgcagcuaccagcugcggcccggcaccaugaucgagugggggaacuacugggcccgcgccauccgguuccgccaggacggcaacgaggccgucgggggcuucuucucccagaucgggcagcuguacauggugcaccaccucugggccuaccgcgaccugcagacccgggaggacauccgcaacgcggccuggcacaagcacggcugggaggagcugguguacuacacggugccccucauccaggagauggagagccggaucaugaucccccugaagaccuccccgcugcaguga

SEQ ID NO: 30478 - RNA, 2109 nt, Artificial Sequence
  derived and/or modified sequence opt1 from GBE1__Homo_sapiens__NP_000149
auggccgcccccaugaccccggcggcccgccccgaggacuacgaggccgcccugaacgccgcgcucgccgacgugcccgagcuggcccggcugcucgagaucgaccccuaccugaagccguacgccgucgacuuccagcgccgguacaagcaguucagccagauccugaagaacaucggcgagaacgagggcgggaucgacaaguucucccgcggguacgagagcuucggggugcaccggugcgcggacgggggccucuacugcaaggagugggcccccggcgccgaggggguguuccugaccggcgacuucaacggguggaaccccuucuccuaccccuacaagaagcuggacuacggcaagugggagcucuacaucccgcccaagcagaacaagagcguccuggugccccacggguccaagcugaagguggucaucacgagcaaguccggcgagauccucuaccgcaucagccccugggccaaguacguggugcgggagggcgacaacgucaacuacgacuggauccacugggacccggagcacuccuacgaguucaagcacagccgccccaagaagccccggucccugcgcaucuacgagagccacguggggaucuccagccacgagggcaagguggccuccuacaagcacuucacgugcaacguccugccccggaucaaggggcucggcuacaacugcauccagcugauggcgaucauggagcacgccuacuacgccagcuucggcuaccagaucaccuccuucuucgccgccagcucccgcuacgggaccccggaggagcugcaggagcucguggacaccgcgcacagcaugggcaucaucgugcugcuggacgucgugcacagccacgccuccaagaacagcgccgacgggcucaacauguucgacggcaccgacuccugcuacuuccacagcgggccccggggcacccacgaccugugggacucccgccuguucgccuacagcuccugggaggugcuccgguuccugcugagcaacauccgcugguggcucgaggaguaccgguucgacggcuuccgcuucgacggggucaccuccaugcuguaccaccaccacggcguggggcagggcuucagcggggacuacuccgaguacuucggccuccagguggacgaggacgcccugacguaccugaugcuggcgaaccaccucguccacacccugugccccgacagcaucaccaucgccgaggacguguccggcaugcccgcccugugcagcccgaucucccagggcggcgggggcuucgacuaccggcucgccauggccauccccgacaaguggauccagcugcugaaggaguucaaggacgaggacuggaacaugggggacaucguguacacccucacgaaccgccgguaccuggagaagugcaucgcguacgccgagagccacgaccaggcccuggucggcgacaagucccucgccuucuggcugauggacgcggagauguacaccaacaugagcgugcugacccccuucacccccgucaucgaccgcggcauccagcuccacaagaugauccgccugaucacgcacgggcugggcggggagggcuaccucaacuucaugggcaacgaguucgggcacccggaguggcuggacuucccccggaagggcaacaacgaguccuaccacuacgcccgccggcaguuccaccugaccgacgacgaccugcuccgcuacaaguuccugaacaacuucgaccgggacaugaaccgccuggaggagcgguacggguggcucgccgcgccccaggccuacgugagcgagaagcacgagggcaacaagaucaucgccuucgagcgcgccgggcugcuguucaucuucaacuuccaccccagcaaguccuacaccgacuaccgggugggcaccgcccucccgggcaaguucaagaucguccuggacagcgacgccgccgaguacgggggccaccagcgccuggaccacuccacggacuucuucagcgaggcguucgagcacaacgggcggcccuacucccuccugguguacauccccagccgcguggcccugauccuccagaacgucgaccugccgaacuga

SEQ ID NO: 30479 - RNA, 5580 nt, Artificial Sequence
  derived and/or modified sequence opt1 from GBF1__Homo_sapiens__NP_004184
augguggacaagaacaucuacaucauccagggcgagaucaacaucgucgugggggccaucaagcgcaacgcccggugguccacccacacgccccuggacgaggagcgcgacccccugcugcacuccuucggccaccugaaggaggugcucaacagcaucaccgagcuguccgagaucgagcccaacgucuuccugcggcccuuccucgaggugauccgcagcgaggacaccaccgggcccaucaccggccuggcgcugacguccgugaacaaguuccucagcuacgcccugaucgaccccacccacgaggggaccgccgagggcauggagaacauggccgacgccgucacccacgcgcgguucgugggcacggaccccgccuccgacgaggugguccugaugaagauccuccaggugcugcgcacccugcuccugacccccgugggggcccaccugaccaacgagagcgucugcgagaucaugcaguccugcuuccggaucugcuucgagaugcgccucagcgagcugcugcggaaguccgccgagcacacgcucguggacauggugcagcugcuguucacccgccucccccaguucaaggaggagcccaagaacuacgucggcaccaacaugaagaagcugaagaugcgggcgggcggcaugagcgacuccagcaaguggaagaagcagaagcgcagcccccggccgccccggcacaugaccaaggugacgcccgggagcgagcugcccacccccaacggcaccacccucuccagcaaccugacgggcgggaugcccuucaucgacgugccgacccccaucuccagcgccagcuccgaggccgccagcgccgucgugucccccagcaccgacuccggccuggaguucagcucccagaccacgagcaaggaggaccucaccgaccuggagcagcccggguccccgggcuacagcaccgcgaccgagcccggcuccagcgagcugggggugcccgagcagcccgaccuccaggagggcacgcacgucgagaagucccagagcgccuccguggagagcaucccggaggugcuggaggagugcaccucccccgccgaccacagcgacuccgccagcguccacgacauggacuacgugaacccccgcggggugcgcuucacccagagcucccagaaggagggcaccgcccuggugcccuacgggcucccgugcauccgggagcuguuccgcuuccugaucagccucacgaacccccacgaccggcacaacuccgaggugaugauccacaugggccugcaccuccugaccgucgcgcuggagagcgcccccguggcccagugccagacccugcucggccugaucaaggacgagaugugccgccaccuguuccagcuccuguccaucgagcggcugaaccuguacgccgccagccuccgcgugugcuuccugcuguucgaguccaugcgcgagcaccucaaguuccagauggagauguacaucaagaagcugauggagaucaucaccgucgagaacccgaagaugcccuacgagaugaaggagauggcgcuggaggccaucgugcagcucuggcggauccccagcuucgugacggagcuguacaucaacuacgacugcgacuacuacugcuccaaccuguucgaggagcucaccaagcugcugagcaagaacgccuuccccgucuccgggcagcucuacaccacccaccuccugagccucgacgcccugcugaccgugaucgacuccacggaggcccacugccaggcgaaggugcucaacagccugacccagcaggagaagaaggagaccgcccgcccguccugcgagaucgucgacggcacccgggaggccagcaacacggagcgcaccgccuccgacgggaaggcggugggcauggccagcgacauccccgggcugcaccuccccggcggcgggcggcugcccccggagcacggcaagagcgggugcuccgaccuggaggaggccguggacagcggcgccgacaagaaguucgcccgcaagccgccccgguucuccugccuccugcccgacccgcgcgagcugaucgagaucaagaacaagaagaagcuccugaucaccgggaccgagcaguucaaccagaagcccaagaagggcauccaguuccugcaggagaagggccuccugacgauccccauggacaacaccgaggucgcgcaguggcugcgggagaacccccgccucgacaagaagaugaucggggaguucgugagcgaccggaagaacaucgaccugcuggaguccuucgugagcaccuucuccuuccagggccuccgccuggacgaggcccugcggcucuaccuggaggccuuccgccugccgggggaggcccccgucauccagcggcuccuggaggccuucaccgagcgcuggaugaacugcaacggcagccccuucgcgaacuccgacgccugcuucagccuggccuacgccgugaucaugcucaacacggaccagcacaaccacaacgugcggaagcagaacgcccccaugacccuggaggaguuccgcaagaaccugaagggcgucaacgggggcaaggacuucgagcaggacauccucgaggacauguaccacgcgaucaagaacgaggagaucgugaugccggaggagcagaccgggcuggugcgggagaacuacgucuggaacgugcugcuccaccgcggcgccacccccgaggggaucuuccugcgcgugcccacggccuccuacgaccuggaccucuucaccaugaccuggggccccaccaucgccgcgcugagcuacgucuucgacaagucccuggaggagacgaucauccagaaggccaucagcggcuuccggaagugcgccaugaucuccgcccacuacgggcucagcgacguguucgacaaccugaucaucucccugugcaaguucaccgcccucagcuccgagagcaucgagaaccugccgagcguguucggcuccaaccccaaggcgcacaucgccgccaagaccgucuuccaccuggcccaccgccacggggacauccuccgggagggcuggaagaacaucauggaggccaugcugcagcuguuccgcgcgcagcuccugcccaaggccaugaucgagguggaggacuucguggacccgaacgggaagaucagccugcagcgggaggagacccccuccaaccgcggcgagagcacgguccucuccuucgugagcuggcugacccuguccggccccgagcagagcuccgugcgggggcccagcaccgagaaccaggaggccaagcgcgucgcccucgagugcaucaagcagugcgacccggagaagaugaucaccgaguccaaguuccugcagcuggagagccuccaggagcugaugaaggcccugguguccgugacgcccgacgaggagaccuacgacgaggaggacgcggccuucugccucgagaugcugcugcggaucguccucgagaaccgcgaccgggugggcugcguguggcagaccguccgcgaccaccuguaccaccugugcgugcaggcccaggacuucugcuuccucguggagcgggccgucguggggcugcugcgccucgcgauccggcugcugcgccgggaggagaucagcgcccaggugcuccugucccugcgcauccuccugcugaugaagcccagcguccugucccgggugagccaccagguggccuacggccuccacgagcugcugaagaccaacgccgccaacauccacuccggggacgacugggcgacccuguucacccugcuggagugcaucggcagcggcgucaagcccccggccgcccuccaggccaccgcccgcgcggacgcccccgacgccggggcccagagcgacuccgagcugcccagcuaccaccagaacgacgugucccuggaccggggcuacaccagcgacuccgaggucuacacggaccacgggcgccccggcaagauccaccgcagcgccaccgacgcggacguggugaacuccggguggcucgucgugggcaaggacgacguggacaacagcaagccgggccccucccggcccgggcccagcccgcugaucaaccaguacucccugaccgucggccucgaccuggggccccacgacaccaagagccugcucaagugcguggagucccugagcuucaucgugcgcgacgccgcccacaucacccccgacaacuucgagcugugcgucaagacgcuccggaucuucguggaggccucccugaacggcggcugcaagagccaggagaagcgcgggaagucccacaaguacgacagcaagggcaaccgguucaagaagaaguccaaggaggggagcaugcugcgccggccccgcaccagcucccagcacgccagccggggcgggcaguccgacgacgacgaggacgagggcgugccggcgagcuaccacaccgucucccuccaggugagccaggaccugcuggaccucaugcacacccugcacacgcgcgccgccuccaucuacagcuccugggccgaggagcagcggcaccuggagaccggcgggcagaagaucgaggcggacagccgcacccucugggcccacugcuggugcccccugcugcagggcaucgccugccucugcugcgacgcccggcgccaggugcggaugcaggcccugaccuaccugcagcgcgcgcuccugguccacgaccugcagaagcucgacgcccuggagugggaguccugcuucaacaaggugcuguucccccuccugacgaagcugcucgagaacaucagccccgccgacgucgggggcauggaggagacccggaugcgcgccuccacccugcugagcaaggucuuccuccagcaccuguccccgcugcucagccuguccaccuucgccgcgcuguggcucacgauccuggacuucauggacaaguacaugcacgccgggagcuccgaccugcucagcgaggccauccccgagagccugaagaacaugcugcucgugauggacaccgccgagaucuuccacuccgccgacgcgcggggcggcgggcccagcgcccugugggagaucaccugggagcgcaucgacugcuuccugccccaccuccgcgacgagcuguucaagcagaccgugauccaggacccgaugcccauggagccccagggccagaagccgcuggccuccgcccaccucacgagcgcggccggggacacccggacccccggccacccgcccccgcccgagauccccuccgagcugggggccugcgacuucgagaagcccgagagcccccgcgccgccuccagcuccagccccggcucccccgucgcgagcucccccagccggcuguccccgacccccgacgggccgccgccccucgcccagccgccccugauccugcagccccucgccagcccccuccaggugggggugccgcccaugacgcugcccaucauccucaacccggcccugaucgaggccaccucccccgucccccugcucgcgacgccccgcccgaccgaccccauccccacgagcgaggugaacuga

SEQ ID NO: 30480 - RNA, 885 nt, Artificial Sequence
  derived and/or modified sequence opt1 from GBGT1__Homo_sapiens__NP_001269558
augcaccgccggcgccuggcccucggccugggguucugccugcucgccggcaccagccuguccgugcugugggucuaccucgagaacuggcugcccgugagcuacgugccguacuaccugcccugccccgagaucuucaacaugaagcuccacuacaagcgggagaagccccugcagccggucguguggucccaguacccccagcccaagcugcucgagcaccgccccacccagcugcugacgcucaccccguggcuggcgcccaucgugagcgaggggaccuucaaccccgagcugcuccagcacaucuaccagccccugaaccugaccaucggcgucacgguguucgccguggggaacccguccuggagccagccccgguccagcuccugcgucggcaccggcugcaccaccacgagcucccucaccacccugcagcccuuccccgggagccgcugggugccgaccggcuucuccgcccccagccccucccgggugacgcccaccgggcgccggcacccgugcgccggcuggcgccccagcgccuccacccugcuccgggggcugaccggccgcuggacgaccagcuccgcgcugauguggaccuggugcuucggcacccgcggggcccuccggcccugggagacgugguggcugcccuucacccaggccaccaccccguuccccgccagcagcucccccaugagcgcgggcgucuucccccugccgcucuggcagacggccaaggggaccuccaucauggugggccagagcuccggcgggcgguggcccggcuacaugagccugcugggggccgccaccuggcccuccuggcgcacccggccgauggccagcuggcuccccggcgggcgcaaggcgacguga

SEQ ID NO: 30481 - RNA, 1092 nt, Artificial Sequence
  derived and/or modified sequence opt1 from GBX1__Homo_sapiens__NP_001092304
augcagcgcgccggcgggggcagcgcccccgggggcaacgggggcggcgggggcgggggcccggggaccgcguucuccaucgacagccugaucgggcccccgccgccccgguccggccaccuccuguacaccggcuaccccauguucaugcccuaccgcccccuggugcucccccaggcccuggcccccgcgccccugcccgccggccucccgccccuggcgccccuggccagcuucgccgggcggcucacgaacaccuucugcgccggccugggccaggccguccccuccaugguggcccugaccaccgcccucccgagcuucgccgagccgcccgacgccuucuacgggccccaggagcuggcggccgccgccgccgcggccgccgccacggccgcgcgcaacaaccccgagcccggcgggcggcgccccgagggcgggcuggaggccgacgagcuccugcccgcccgggagaagguggccgagccgcccccgccgcccccgccccacuucuccgagaccuuccccagccugcccgccgagggcaaggucuacuccagcgacgaggagaagcucgaggcguccgccggcgaccccgccgggagcgagcaggaggaggagggcuccgggggcgacagcgaggacgacggguuccuggacuccagcgccggcggccccggggcgcugcucggccccaagcccaagcugaaggggucccugggcaccggggccgaggagggcgcccccgugaccgccggcgugacggcccccgggggcaagagccgccggcgccggaccgcguucaccuccgagcagcuccuggagcuggagaaggaguuccacugcaagaaguaccucagccugaccgagcgcagccagaucgcccacgcccugaagcucuccgagguccaggugaagaucugguuccagaaccggcgcgccaaguggaagcggaucaaggccgggaacgugagcucccgcagcggcgagccgguccggaaccccaagaucguggugcccauccccguccacgugaaccgcuucgcggugcggucccagcaccagcagauggagcagggcgcccgcccguga

SEQ ID NO: 30482 - RNA, 1047 nt, Artificial Sequence
  derived and/or modified sequence opt1 from GBX2__Homo_sapiens__NP_001476
augagcgccgccuucccgcccucccugaugaugaugcagcgcccccucggcagcuccaccgcguucagcaucgacucccugaucgggagcccgccccagcccucccccggccacuucguguacaccggguaccccauguucaugcccuaccggccggucgugcugcccccgccgcccccgccgccgcccgcccucccccaggccgcccugcagcccgcccugccgcccgcgcacccccaccaccagauccccagccuccccacgggcuucugcuccagccuggcccaggggauggcccugaccuccacccucauggccacccugcccggcggcuucagcgcgagcccccagcaccaggaggccgccgccgcccgcaaguucgcgccccagccccugcccgggggcgggaacuucgacaaggccgaggcccuccaggccgacgccgaggacggcaagggguuccuggcgaaggagggcucccugcucgccuucuccgccgccgagacggugcaggccagccuggucggcgcggugcgggggcagggcaaggacgaguccaagguggaggacgaccccaaggggaaggaggagagcuucucccuggagagcgacgucgacuacagcuccgacgacaaccucaccggccaggccgcccacaaggaggaggaccccggccacgcccuggaggagaccccgcccagcuccggggccgcgggcagcaccacguccaccgggaagaaccgccggcgccggaccgccuucaccagcgagcagcugcucgagcuggagaaggaguuccacugcaagaaguaccugucccucacggagcgcagccagaucgcccacgcccugaagcuguccgagguccaggugaagaucugguuccagaaccggcgcgcgaaguggaagcgggugaaggccggcaacgccaacagcaagaccggggagcccucccgcaaccccaagaucguggugcccauccccguccacgugagccgguucgccauccgcucccagcaccagcagcucgagcaggcccggcccuga

SEQ ID NO: 30483 - RNA, 654 nt, Artificial Sequence
  derived and/or modified sequence opt1 from GCA__Homo_sapiens__NP_036330
auggccuaccccggcuacgggggcggguucggcaacuucagcauccaggugccggggaugcagaugggccagcccguccccgagaccggccccgccauccugcuggacggguacuccggcccggcguacagcgacaccuacuccagcgccggggacuccguguacacguacuucagcgccguggccggccaggacggggaggucgacgccgaggagcugcagcgcugccugacccaguccggcaucaacggcaccuacagccccuucucccucgagaccugccggaucaugaucgcgaugcuggaccgcgaccacacggggaagaugggcuucaacgccuucaaggagcugugggccgcccucaacgcguggaaggagaacuucaugaccguggaccaggacgggagcggcaccguggagcaccacgagcugcggcaggccaucggccugaugggguaccgccucagcccccagacccugacgaccaucgucaagcgguacuccaagaacggccgcaucuucuucgacgacuacguggccugcugcgugaagcugcgggcccucaccgacuucuuccgcaagcgggaccaccuccagcagggguccgccaacuucaucuacgacgacuuccugcagggcaccauggcgaucuga

SEQ ID NO: 30484 - RNA, 2328 nt, Artificial Sequence
  derived and/or modified sequence opt1 from GCC1__Homo_sapiens__NP_078799
auggagaaguucggcaugaacuucgggggcgggcccagcaagaaggaccugcucgagaccaucgagacccagaagaagcagcugcugcaguaccaggcccgccucaaggacguggugcgggccuacaagucccugcugaaggagaaggaggcgcucgaggccagcaucaaggugcuguccgugagccacgaggccgacgucggccuggccggggugcagcucccgggccugacguuccccgacuccguggacgaccgcugcagcacccacuccgaggacagcaccggcaccgccacgucccuggacaccgcggccagccucaccuccaccaagggggaguucggcgucgaggacgaccggcccgcccgcgggcccccgccgcccaagagcgaggaggccuccuggagcgaguccggcgugagcuccagcuccggggacggccccuucgcgggcggggagguggacaagcggcugcaccagcugaagacgcagcucgccacccugaccagcagccuggccaccgucacgcaggagaagucccgcauggaggccagcuaccucgccgacaagaagaagaugaagcaggaccuggaggacgcguccaacaaggccgaggaggagcgggcccgccuggagggcgagcucaaggggcugcaggagcagaucgccgagaccaaggcccggcugaucacccagcagcacgaccgcgcgcaggagcagagcgaccacgcccucaugcugcgggagcugcagaagcuccugcaggaggagcgcacccagcggcaggaccuggagcuccgccuggaggagacgcgggaggcccuggccggccgcgccuacgcggccgagcagauggagggcuucgagcuccagaccaagcagcugacccgggagguggaggagcugaaguccgagcuccaggccauccgcgacgagaagaaccagcccgacccccggcugcaggagcugcaggaggaggccgcccgccucaagagccacuuccaggcgcagcugcagcaggagaugcggaagaccgcccuggccgaggaccagcuccgccagcagucccagguggaggagcagcgcgucgccgcgcuggagaaccagaucagcgagguguccgagcugcucgggacguacgagaaggccaagcagaaggaccagcuggccauccagaagcugaaggagcggauccuccagcuggaccuggagaacaagacccuggcccucgccgcgagcucccgcagcccccuggacucccacggcgaggagagcucccuggacgugaacguccucaaggacaagauggagaagcugaagcggcugcuccagguggccgcccgcaagagccaggugacccuggacgucgagaagcugugcgaccucgagaucaugcccuccagcgaggccgccgacggggagaaggcgaccgcccuguacuaccagcaggagcugaagcagcucaaggaggaguucgagcgguacaagaugcgcgcccagguggugcugaaguccaagaacacgaaggacggcaaccuggggaaggagcucgaggccgcccaggagcagcuggcggagcugaaggagaaguacaucagccuccggcugagcugcgaggagcuggagcaccagcaccagcaggaggccgacgacuggaagcaggagcucgcccgccugcagcagcugcaccggcaggagcucgagcgcugccagcuggacuuccgggaccgcacccugaagcucgaggaggagcugcacaagcagcgggaccgcgcccuggcgguccucaccgagaaggaccuggagcuggagcagcuccgguccguggcccuggccagcggccugccgggccgccggucccccgucgggggcgggggccccggggaccccgccgacaccagcuccagcgacucccucacgcaggcccugcagcuggcggccgccaacgagccgaccuucuuccucuacgccgagcagcuggcccgcaaggagguggagaucaccagccugcggaagcagaagcaccgccucgagguggagguccaccagcugcaggaccgccugcucgaggagggcgagcggcaccgcgaggagguggcggcccugcagucccacaucgagaagaacauccgggaccagagccgcgagggcgccaaccuggaguaccucaagaacaucaucuaccgguuccugacccugcccgacucccucgggcgccagcagacgcugaccgccauccugaccauccuccacuucagccccgaggagaagcaggucaucaugcggcugcccaccuccgccagcugguggccguccggcaagcgcuga

SEQ ID NO: 30485 - RNA, 1317 nt, Artificial Sequence
  derived and/or modified sequence opt1 from GCDH__Homo_sapiens__NP_000150
auggcccugcgcggcgugagcguccggcuccugucccgcgggcccggccugcacgugcuccggaccugggugagcuccgccgcgcagaccgagaagggcgggcgcacgcagagccagcuggccaaguccagccggccggaguucgacuggcaggacccccugguccucgaggagcagcugaccaccgacgagauccugauccgcgacaccuuccggacguacugccaggagcgccucaugccccggauccugcuggccaaccgcaacgagguguuccaccgggagaucaucuccgagaugggggagcucggcgugcugggccccaccaucaagggguacggcugcgccggggucagcuccguggccuacggccugcucgcgcgcgagcuggagcggguggacagcggguaccgcuccgccaugagcguccaguccagccuggugaugcacccgaucuacgccuacggcuccgaggagcagcggcagaaguaccucccccagcuggccaagggcgagcugcucgggugcuucggccugaccgagcccaacagcggguccgaccccagcuccauggagacccgcgcgcacuacaacagcagcaacaaguccuacacgcugaacggcaccaagaccuggaucaccaacagcccgauggccgaccucuucguggucugggcccggugcgaggacggcugcauccgcggguuccugcuggagaagggcaugcgggggcucuccgcgccccgcauccagggcaaguucagccugcgggccuccgccacggggaugaucaucauggacggcguggaggugcccgaggagaacguccugcccggcgccagcucccucgggggcccguucgggugccugaacaacgcccgcuacggcaucgccuggggcgugcugggggccagcgaguucugccuccacaccgcgcgccaguacgcccuggaccggaugcaguucggcgugccccuggcccgcaaccagcucauccagaagaagcuggccgacaugcugaccgagaucacccucgggcugcacgccugccugcagcucggccggcugaaggaccaggacaaggcggcccccgagauggucucccugcucaagcgcaacaacugcgggaaggcccuggacaucgcccggcaggcccgcgacaugcugggcgggaacggcaucagcgacgaguaccacgugauccggcacgcgaugaaccucgaggccgugaacacguacgagggcacccacgacauccacgcccugauccuggggcgcgccaucaccggcauccaggcguucaccgccuccaaguga

SEQ ID NO: 30486 - RNA, 2346 nt, Artificial Sequence
  derived and/or modified sequence opt1 from GCFC2__Homo_sapiens__NP_003194
auggcccaccgccccaagcggaccuuccgccagcgggccgcggacagcuccgacagcgacggcgccgaggaguccccggccgagcccggggcgccccgcgagcugcccgugccgggcagcgccgaggaggagccgcccuccgggggcgggcgggcccaggucgccggccucccccaccgcgugcggggcccccgcgggcggggccgcgugugggccagcucccggcgcgccaccaaggcggcgccccgggccgacgaggggagcgagucccgcacgcuggacgucagcaccgacgaggaggacaagauccaccacuccagcgaguccaaggacgaccagggccugagcuccgacagcuccagcucccucggggagaaggagcugagcagcaccgugaagauccccgacgccgccuucauccaggccgcccggcgcaagcgggagcuggcccgcgcccaggacgacuacaucucccucgacgugcagcacaccagcuccaucagcggcaugaagcgggaguccgaggacgaccccgagagcgagccggacgaccacgagaagcgcauccccuucacgcugcggccccagacccugcgccagcgcauggccgaggaguccaucagccggaacgaggagaccuccgaggagagccaggaggacgagaagcaggacaccugggagcagcagcagaugcgcaaggcggucaagaucaucgaggagcgggacaucgaccucuccugcggcaacgggagcuccaaggugaagaaguucgacacgagcaucuccuucccgcccgugaaccuggagaucaucaagaagcagcugaacacccgccucacccugcugcaggagacccaccggagccaccuccgcgaguacgagaaguacguccaggacgugaaguccagcaaguccacgauccagaaccuggagagcagcuccaaccaggcccugaacugcaaguucuacaagagcaugaagaucuacguggagaaccucaucgacugccugaacgagaagaucaucaacauccaggagaucgaguccagcaugcacgcccugcuccugaagcaggccaugaccuucaugaagcggcgccaggacgagcugaagcacgaguccaccuaccuccagcagcugagccggaaggacgagaccuccacgagcggcaacuucuccgucgacgagaagacccaguggauccuggaggagaucgagagccgccggaccaagcgccggcaggcccgcgugcucuccgggaacugcaaccaccaggagggcaccagcuccgacgacgagcugcccagcgcggagaugaucgacuuccagaagucccagggcgacauccugcagaagcagaagaagguguucgaggagguccaggacgacuucugcaacauccagaacauccuccugaaguuccagcaguggcgggagaaguuccccgacagcuacuacgaggccuucaucucccugugcauccccaagcuccugaacccgcugauccgcgugcagcucaucgacuggaacccccugaagcuggagagcacggggcucaaggagaugcccugguucaagagcguggaggaguucauggacuccagcgucgaggacuccaagaaggagagcuccagcgacaagaaggugcuguccgccaucaucaacaagaccaucaucccccggcugaccgacuucguggaguuccucugggacccgcugagcaccucccagacgaccagccugaucacccacugccgcgucauccucgaggagcacuccacgugcgagaacgaggugagcaagucccggcaggaccugcugaaguccaucgugucccgcaugaagaaggccgucgaggacgacguguucaucccccucuaccccaagagcgccgucgagaacaagaccagcccccacagcaaguuccaggagcgccaguucugguccggccugaagcuguuccggaacauccugcucuggaacgggcugcugaccgacgacacccuccaggagcugggccuggggaagcuccugaaccgcuaccugaucaucgcgcuccugaacgccaccccgggccccgacguggugaagaagugcaaccaggucgccgccugccugcccgagaagugguucgagaacagcgcgaugcggacgagcaucccgcagcucgagaacuucauccaguuccugcugcaguccgcccacaagcucagccgcuccgaguuccgggacgagguggaggagaucauccugauccuggugaagaucaaggcccucaaccaggccgagagcuucaucggcgagcaccaccuggaccaccugaagucccucaucaaggaggacuga

SEQ ID NO: 30487 - RNA, 543 nt, Artificial Sequence
  derived and/or modified sequence opt1 from GCG__Homo_sapiens__NP_002045
augaaguccaucuacuucguggccggccuguucgucaugcucgugcaggggagcuggcagcgcagccugcaggacaccgaggagaagucccggagcuucuccgccagccaggcggacccccuguccgacccggaccagaugaacgaggacaagcgccacagccagggcaccuucacguccgacuacagcaaguaccucgacucccggcgcgcccaggacuucgugcaguggcugaugaacaccaagcggaaccgcaacaacaucgccaagcggcacgacgaguucgagcgccacgccgaggggaccuucaccagcgacgucuccagcuaccuggagggccaggccgcgaaggaguucaucgccuggcucgugaaggggcggggccgccgggacuuccccgaggagguggccaucgucgaggagcugggccgccggcacgccgacggguccuucagcgacgagaugaacacgauccuggacaaccucgcggcccgcgacuucaucaacuggcugauccagaccaagaucaccgaccggaaguga

SEQ ID NO: 30488 - RNA, 1434 nt, Artificial Sequence
  derived and/or modified sequence opt1 from GCGR__Homo_sapiens__XP_006722340
augcccccgugccagccccagcgcccccugcuccugcugcuccugcugcucgccugccagccccaggugccgagcgcccaggucauggacuuccuguucgagaaguggaagcuguacggcgaccagugccaccacaaccucucccugcugcccccgcccaccgagcucgugugcaaccggaccuucgacaaguacagcugcuggcccgacacccccgcgaacaccaccgccaacaucuccugccccugguaccugcccuggcaccacaaggugcagcaccgcuucgucuucaagcggugcgggccggacggccagugggugcgcgggccccggggccagcccuggcgcgacgccagccagugccagauggacggggaggagaucgaggugcagaaggaggucgccaagauguacuccagcuuccaggugauguacaccgugggcuacucccugagccucggcgcccugcugcucgcgcuggccauccucgggggccuguccaagcugcacugcacgcggaacgccauccacgccaaccuguucgcgagcuucguccucaaggccuccagcgugcuggugaucgacgggcugcuccgcacccgguacucccagaagaucggcgacgaccugagcgucuccaccuggcugagcgacggggccguggccggcugccgcguggccgcggucuucaugcaguacggcaucguggccaacuacugcuggcuccugguggaggggcuguaccuccacaaccugcugggccucgccacccugcccgagcgguccuucuucagccuguaccucgggaucggcuggggcgccccgaugcuguucgucgugcccugggccguggucaagugccuguucgagaacgugcagugcuggacguccaacgacaacaugggguucugguggauccuccgcuuccccguguuccuggcgauccugaucaacuucuucaucuucguccggaucgugcagcuccuggucgccaagcugcgcgcccggcagaugcaccacaccgacuacaaguuccgccucgccaagagcacccugacccugaucccccugcucggcgugcacgagguggucuucgccuucgugacggacgagcacgcgcaggggacccugcggagcgccaagcuguucuucgaccucuuccuguccagcuuccagggccugcucguggccguccuguacugcuuccugaacaaggaggugcaguccgagcuccgccggcgcuggcaccgguggcgccuggggaaggugcugugggaggagcgcaacaccagcaaccaccgggccuccagcuccccgggccacggcccgcccagcaaggagcuccaguucgggcgcggcgggggcucccaggacagcuccgccgagacgccccuggccgggggccugccccggcucgcggagagccccuucuga

SEQ ID NO: 30489 - RNA, 753 nt, Artificial Sequence
  derived and/or modified sequence opt1 from GCH1__Homo_sapiens__NP_001019195
auggagaagggccccgugcgcgccccggccgagaagccccgcggggcgcggugcagcaacggcuuccccgagcgggacccgccccgccccgggcccucccggcccgccgagaagccgccccgccccgaggccaagagcgcccagcccgccgacggcuggaagggggagcggccgcgcuccgaggaggacaacgagcugaaccuccccaaccuggcggccgccuacagcuccauccugagcucccucggcgagaacccccagcggcagggccugcugaagacccccuggcgcgccgcgagcgccaugcaguucuucaccaagggguaccaggagacgaucuccgacguccucaacgacgccaucuucgacgaggaccacgacgagauggugaucgugaaggacaucgacauguucagcaugugcgagcaccaccuggucccguucgugggcaaggugcacaucggguaccugcccaacaagcagguccucggccuguccaagcuggcccggaucguggagaucuacagccgccggcuccaggugcaggagcgccugaccaagcagaucgccgucgcgaucaccgaggcccugcggcccgccggggugggcguggucguggaggccacccacaugugcauggugaugcgcggcguccagaagaugaacuccaagacggugaccagcaccaugcucgggguguuccgggaggaccccaagacccgcgaggaguuccugacgcugauccgguccuga

SEQ ID NO: 30490 - RNA, 255 nt, Artificial Sequence
  derived and/or modified sequence opt1 from GCHFR__Homo_sapiens__NP_005249
augcccuaccugcucaucagcacccagauccgcauggaggugggccccaccauggucggggacgagcaguccgaccccgagcugaugcagcaccugggcgccagcaagcggcgcgcccucgggaacaacuucuacgaguacuacguggacgacccgccccggaucgugcuggacaagcuggagcgccggggcuuccgcguccucuccaugacgggggugggccagacccugguguggugccugcacaaggaguga

SEQ ID NO: 30491 - RNA, 1425 nt, Artificial Sequence
  derived and/or modified sequence opt1 from GC__Homo_sapiens__NP_000574
augaagcgcgugcugguccuccugcuggccguggccuucggccacgcgcucgagcgggggcgcgacuacgagaagaacaaggugugcaaggaguucagccaccugggcaaggaggacuucaccucccugagccucguccuguacucccggaaguuccccagcgggaccuucgagcaggucucccagcuggugaaggagguggugagccucacggaggccugcugcgccgagggcgccgacccggacugcuacgacacccgcaccuccgcccugagcgcgaaguccugcgagagcaacucccccuuccccgugcaccccgggaccgccgagugcugcacgaaggagggccuggagcggaagcucugcauggccgcccugaagcaccagccgcaggaguuccccaccuacgucgagcccaccaacgacgagaucugcgaggcguuccgcaaggaccccaaggaguacgccaaccaguucaugugggaguacagcaccaacuacggccaggccccgcugucccuccuggugagcuacacgaaguccuaccugagcauggugggguccugcugcaccagcgccucccccaccgucugcuuccucaaggagcggcugcagcugaagcaccucagccugcugaccacgcucagcaaccgcgugugcucccaguacgccgcguacggcgagaagaagucccggcuguccaaccugaucaagcucgcccagaaggugcccaccgccgaccuggaggacguccugccccucgccgaggacaucaccaacauccugagcaagugcugcgaguccgccagcgaggacugcauggcgaaggagcugccggagcacaccgugaagcucugcgacaaccuguccacgaagaacagcaaguucgaggacugcugccaggagaagaccgccauggacguguucgucugcaccuacuucaugcccgccgcccagcugcccgagcuccccgacguggagcugccgaccaacaaggacgugugcgaccccgggaacacgaaggucauggacaaguacaccuucgagcugucccgccggacccaccuccccgagguguuccugagcaaggugcuggagcccacccucaagucccugggcgagugcugcgacgucgaggacagcacgaccugcuucaacgccaaggggccgcugcucaagaaggagcuguccagcuucaucgacaagggccaggagcugugcgcggacuacuccgagaacaccuucaccgaguacaagaagaagcucgccgagcgccugaaggccaagcugcccgacgccacgcccaccgagcuggccaagcucgugaacaagcacagcgacuucgcguccaacugcugcagcaucaacagcccgccccuguacugcgacagcgagaucgacgccgagcugaagaacauccucuga

SEQ ID NO: 30492 - RNA, 1398 nt, Artificial Sequence
  derived and/or modified sequence opt1 from GCK__Homo_sapiens__NP_000153
augcuggacgaccgcgcccggauggaggccgcgaagaaggagaagguggagcagauccucgccgaguuccagcugcaggaggaggaccugaagaaggucaugcgccggaugcagaaggagauggaccgcggccuccggcuggagacccacgaggaggccagcgugaagaugcugcccaccuacgugcgcuccacgccggaggggagcgaggucggcgacuuccucucccuggaccucgggggcaccaacuuccgggugaugcuggugaaggucggggagggcgaggagggccaguggagcgugaagaccaagcaccagauguacuccauccccgaggacgccaugaccgggacggccgagaugcuguucgacuacaucagcgagugcaucuccgacuuccuggacaagcaccagaugaagcacaagaagcucccccugggcuucaccuucagcuuccccgugcgccacgaggacaucgacaaggggauccugcucaacuggaccaagggcuucaaggcguccggggccgagggcaacaacgucgugggccugcugcgggacgccaucaagcgccgcggggacuucgagauggacguggucgccauggugaacgacaccguggcgacgaugaucagcugcuacuacgaggaccaccagugcgaggucggcaugaucguggggaccggcugcaacgccugcuacauggaggagaugcagaacguggagcucgucgagggcgacgaggggcggaugugcgugaacaccgaguggggcgccuucggggacuccggcgagcuggacgaguuccugcucgaguacgaccggcugguggacgagagcuccgccaacccggggcagcagcuguacgagaagcucaucggcggcaaguacaugggggagcugguccgccuggugcuccugcggcugguggacgagaaccuccuguuccacggcgaggccagcgagcagcugcgcacccgcggggcguucgagacgcgguucgucucccagguggagagcgacaccggcgaccggaagcagaucuacaacauccucuccacccuggggcugcgccccagcaccacggacugcgacaucguccggcgcgccugcgaguccgugagcacccgcgccgcccacaugugcagcgccggccucgcgggcgugaucaaccggaugcgcgagucccggagcgaggacgucaugcgcaucaccguggggguggacggcuccgucuacaagcugcaccccagcuucaaggagcgguuccacgccuccgugcgccggcugacccccagcugcgagaucacguucaucgaguccgaggaggggagcggccgcggggccgcccucguguccgccgucgcgugcaagaaggccugcaugcugggccaguga

SEQ ID NO: 30493 - RNA, 1878 nt, Artificial Sequence
  derived and/or modified sequence opt1 from GCKR__Homo_sapiens__NP_001477
augcccggcaccaagcgcuuccagcacgugaucgagaccccggagcccgggaagugggagcugagcggcuacgaggccgccguccccaucacggagaaguccaacccccucacccaggaccuggacaaggcggacgccgagaacaucgugcggcugcucgggcagugcgacgccgagaucuuccaggaggagggccaggcccugagcaccuaccagcgccuguacuccgagagcauccucaccacgauggugcaggucgccgggaaggugcaggaggugcugaaggagccggacggcggccuggucgugcucuccgggggcgggaccagcggccggauggcguuccugauguccgugagcuucaaccagcugaugaaggggcucggccagaagccccuguacaccuaccugaucgccggcggggaccgcuccgucguggccagccgggagggcaccgaggacuccgcccuccacgggaucgaggagcugaagaagguggcggccggcaagaagcgcgucaucgugaucggcaucagcguggggcuguccgcccccuucgucgccggccagauggacugcugcaugaacaacacggccguguuccuccccgugcuggucggguucaacccggugagcauggcgcggaacgaccccaucgaggacugguccagcaccuuccgccagguggccgagcggaugcagaagaugcaggagaagcagaaggccuucguccugaaccccgccaucggccccgaggggcucuccggcagcucccgcaugaagggcgggagcgccaccaagauccugcuggagacccuccugcuggcggcccacaagacgguggaccagggcaucgccgccagccagcggugccuccuggagauccugcgcaccuucgagcgggcccaccaggugaccuacucccagagcccgaagaucgcgacccucaugaaguccgucagcacgucccuggagaagaaggggcacguguaccuggucggcuggcagacccucgggaucaucgccaucauggacggcguggagugcauccacaccuucggcgccgacuuccgcgacgugcggggguuccugaucggcgaccacagcgacauguucaaccagaaggccgagcugaccaaccaggggccccaguucacguucucccaggaggacuuccucaccagcauccugcccucccugaccgagaucgacaccgucguguucaucuucacgcucgacgacaaccugaccgaggugcagaccaucgucgagcaggucaaggagaagaccaaccacauccaggcccuggcgcacagcacggugggccagacccuccugaucccccugaagaagcuguucccguccaucaucagcaucaccuggccccugcuguucuucgaguacgaggggaacuucauccagaaguuccagcgcgagcucuccaccaagugggugcugaacacggugagcaccggcgcccacgugcugcugggcaagauccuccagaaccacaugcuggaccugcggaucuccaacagcaagcuguucuggcgcgcccucgccaugcugcagcgguucuccgggcagagcaaggcgcgcugcaucgagucccuccugcgggccauccacuucccccagccccugagcgacgacauccgcgccgccccgaucagcugccacguccagguggcccacgagaaggagcaggucauccccaucgcgcuccugucccuccucuuccgcugcagcaucaccgaggcccaggcccaccuggccgccgcgcccuccgugugcgaggccgugcggagcgcccuggccggccccgggcagaagcgcaccgccgacccgcucgagauccuggagcccgacgugcaguga

SEQ ID NO: 30494 - RNA, 1914 nt, Artificial Sequence
  derived and/or modified sequence opt1 from GCLC__Homo_sapiens__NP_001489
augggccugcucagccaggggagcccccuguccugggaggagaccaagcgccacgccgaccacgugcggcgccacggcauccugcaguuccuccacaucuaccacgccgucaaggaccggcacaaggacgugcugaaguggggcgacgagguggaguacaugcuggucuccuucgaccacgagaacaagaaggugcgccucgugcugagcggggagaagguccuggagacccuccaggagaagggggagcggacgaacccgaaccaccccacccuguggcgccccgaguacggcuccuacaugaucgagggcacccccgggcagccguacggcgggaccaugagcgaguucaacacgguggaggcgaacaugcggaagcgccggaaggaggccaccuccauccuggaggagaaccaggcccucugcaccaucaccagcuucccccgccugggcugccccggguucacgcugcccgaggugaagccgaaccccgucgagggcggcgccuccaagagccucuucuuccccgacgaggccaucaacaagcacccccgguucuccacccugacccgcaacauccggcaccgccgcggggagaagguggugaucaacgucccgaucuucaaggacaagaacacccccagccccuucaucgagacguucaccgaggacgacgaggcgucccgggccagcaagcccgaccacaucuacauggacgccaugggcuucgggaugggcaacugcugccuccaggugaccuuccaggccugcuccaucagcgaggcgcgguaccuguacgaccagcuggccaccaucugcccgaucgugauggcccuguccgccgccagccccuucuaccgcggcuacgucuccgacaucgacugccgguggggcgugaucagcgcgagcguggacgaccgcacgcgggaggagcgcgggcucgagccccugaagaacaacaacuaccgcaucuccaagagccgguacgacuccaucgacagcuaccuguccaagugcggggagaaguacaacgacaucgaccucaccaucgacaaggagaucuacgagcagcugcugcaggagggcaucgaccaccuccuggcccagcacgucgcccaccuguucauccgcgacccccucacccuguucgaggagaagauccaccuggacgacgccaacgagagcgaccacuucgagaacauccaguccaccaacuggcagacgaugcgguucaagccgcccccgcccaacagcgacaucggguggcgcguggaguuccggcccauggaggugcagcucaccgacuucgagaacuccgccuacgucguguucgugguccugcugacccgcgugauccucagcuacaagcuggacuuccugaucccccucuccaaggucgacgagaacaugaagguggcgcagaagcgggacgccgugcugcagggcauguucuacuuccgcaaggacaucugcaagggcgggaacgccgucguggacggcugcgggaaggcccagaacagcaccgagcuggccgcggaggaguacacgcucauguccaucgacaccaucaucaacggcaaggaggggguguuccccggccugauccccauccugaacagcuaccucgagaacauggaggucgacguggacacccggugcuccauccugaacuaccugaagcucaucaagaagcgcgccagcggcgagcugaugaccguggcccgguggaugcgcgaguucaucgccaaccacccggacuacaagcaggacuccgucaucacggacgagaugaacuacagccugauccugaagugcaaccagaucgccaacgagcucugcgagugccccgagcugcugggguccgcguuccggaaggugaaguacagcggcagcaagaccgacuccagcaacuga

SEQ ID NO: 30495 - RNA, 1311 nt, Artificial Sequence
  derived and/or modified sequence opt1 from GCM1__Homo_sapiens__NP_003634
auggagcccgacgacuucgacagcgaggacaaggagauccuguccugggacaucaacgacgugaagcucccgcagaacgucaagaagaccgacugguuccaggaguggcccgacagcuacgccaagcacaucuacuccagcgaggacaagaacgcccagcgccaccuguccagcugggcgaugcggaacaccaacaaccacaacucccgcauccugaagaaguccugccucggcgugguggucugcgggcgggacugccuggccgaggagggccgcaagaucuaccugcggcccgccaucugcgacaaggcccgccagaagcagcagcggaagcgcugccccaacugcgacgggccgcucaagcugauccccugccggggccacgggggcuuccccgugacgaacuucuggcgccacgacggccgguucaucuucuuccagagcaagggggagcacgaccaccccaagccggagaccaagcuggaggccgaggcgcgccgggccaugaagaaggugaacaccgcccccagcuccgucagccucucccugaagggcagcaccgagacgcgcucccugcccggggagacccagagccagggcucccucccccugaccuggagcuuccaggagggggugcagcugccgggcuccuacagcggccaccucaucgccaacacgccccagcagaacagccugaacgacugcuucuccuucagcaaguccuacgggcugggcgggaucaccgaccucaccgaccagaccagcaccguggaccccaugaagcuguacgagaagcggaagcuguccagcucccgcacguacagcuccggcgaccuccugcccccgagcgcguccggcgucuacagcgaccacggggaccugcaggccugguccaagaacgccgcccucggccggaaccaccuggccgacaacugcuacagcaacuaccccuucccccugaccuccuggcccugcagcuucuccccgagccagaacuccagcgagcccuucuaccagcagcucccccuggagcccccggcggccaagaccgggugcccgccccuguggcccaaccccgccggcaaccucuacgaggagaaggugcacguggacuucaacagcuacguccagucccccgccuaccacagcccccaggaggacccguuccuguucaccuacgccucccacccccaccagcaguacagccugcccuccaagagcuccaagugggacuucgaggaggagaugacguaccucgggcuggaccacugcaacaacgacaugcugcucaaccugugcccccugcgcuga

SEQ ID NO: 30496 - RNA, 1521 nt, Artificial Sequence
  derived and/or modified sequence opt1 from GCM2__Homo_sapiens__XP_011513293
augcccgccgccgcggugcaggaggccgucggcgugugcagcuacgggaugcagcuguccugggacaucaacgacccgcagaugccccaggagcucgcccuguucgaccaguuccgcgaguggcccgacggcuacgugcgguucaucuacagcuccgacgagaagaaggcccagcgccaccugagcgggugggccaugcggaacaccaacaaccacaacggccacauccucaagaaguccugccugggggucguggugugcacccaggcgugcacgcugcccgacggcagccgccuccagcugcggccggccaucugcgacaaggcccgccugaagcagcagaagaaggccugccccaacugccacuccgcgcucgagcugauccccugccggggccacagcggguaccccgucaccaacuucuggcgccuggacggcaacgccaucuucuuccaggccaagggggugcacgaccacccgcggcccgaguccaagagcgagaccgaggcccgccgguccgccaucaagcgccagauggcgagcuucuaccagccccagaagaagcggauccgcgaguccgaggccgaggagaaccaggacagcuccggccacuucagcaacaucccgccccucgagaaccccgaggacuucgacaucgugaccgagacguccuuccccauccccgggcagccgugccccagcuuccccaaguccgacgucuacaaggcgaccugcgaccuggccaccuuccagggcgacaagaugcccccguuccagaaguacagcagcccccggaucuaccugccccggcccccgugcuccuacgagcucgccaaccccggcuacaccaacagcucccccuaccccacgcuguacaaggacagcaccuccaucccgaacgacaccgacugggugcaccugaacacccuccagugcaacgugaacagcuacuccagcuacgagcgcuccuucgacuucacgaacaagcagcacggguggaagcccgcccugggcaagcccagccuggucgagcgcaccaaccacgggcaguuccaggccauggccacccggccguacuacaaccccgagcuccccugccgcuaccugaccacgcccccgcccggcgcccccgcccugcagaccgugaucaccaccacgaccaagguguccuaccaggcguaccagcccccggccaugaaguacagcgacuccguccgggaggucaagagccucuccagcugcaacuacgcccccgaggacaccggcauguccguguaccccgagcccugggggccgcccgugaccgugacgcgcgccgccagccccuccgggcccccgcccaugaagaucgcgggcgacugccgcgccauccggcccaccguggccaucccccacgagccggucagcagccgcaccgacgaggccgagaccugggacgugugccuguccggccuggggagcgcgguguccuacagcgaccgggucggccccuucuucacguacaacaacgaggacuucuga

SEQ ID NO: 30497 - RNA, 8016 nt, Artificial Sequence
  derived and/or modified sequence opt1 from GCN1L1__Homo_sapiens__NP_006827
auggccgccgacacccaggugagcgagacccugaagcgcuucgccggcaaggugaccaccgccagcgugaaggagcggcgcgagauccugagcgagcuggggaagugcguggccggcaaggaccugcccgagggggccgugaagggccugugcaagcuguucugccugacccugcaccgguaccgcgacgccgccagccggcgcgcccugcaggccgccauccagcagcuggccgaggcccagcccgaggccaccgccaagaaccuccugcacagccugcagagcagcgggaucggcuccaaggccggcgugcccagcaaguccagcggguccgcggcccuccuggcccugaccuggaccugccuccuggugcggaucguguuccccagccgcgccaagcggcagggcgacaucuggaacaagcugguggaggugcagugccuccugcugcucgagguccucgggggcucccacaagcacgccguggacggggcggugaagaagcugaccaagcucuggaaggagaaccccggccuggucgagcaguaccugagcgccauccucucccuggagcccaaccagaacuacgccggcaugcuggggcuccuggugcaguucugcaccagccacaaggagauggacguggucucccagcacaagagcgcccugcucgacuucuacaugaagaacauccugauguccaaggugaagccgcccaaguaccugcucgacagcugcgcgccccugcugcgcuaccucagccacuccgaguucaaggaccugauccugcccacgauccagaagucccuccugcggucccccgagaacgugaucgagaccaucagcucccugcucgcgagcgucacccuggaccugucccaguacgccauggacaucgugaagggccucgccgggcaccugaaguccaacagcccccggcugauggacgaggccgugcuggcccuccggaaccuggcgcgccagugcagcgacuccagcgccauggagucccugaccaagcaccucuucgccauccugggcggcagcgaggggaagcugacggucguggcccagaagauguccgugcucagcggcaucggguccgucagccaccacguggucuccggccccagcagccaggugcugaacgggaucguggcggagcuguucauccccuuccuccagcaggagguccacgagggcacccuggugcacgccguguccguccuggcccucuggugcaaccgguucaccauggaggugcccaagaagcugaccgagugguucaagaaggccuucagccugaagacguccaccagcgccgugcgccacgcguaccuccagugcaugcuggccuccuaccggggcgacacccugcuccaggcccuggaccugcucccccugcugauccagaccgucgagaaggccgccagccaguccacccaggugcccaccaucaccgaggggguggcggccgcccuccugcugcucaagcugagcgucgccgacucccaggccgaggcgaagcugagcuccuucuggcagcucaucguggacgagaagaagcaggucuucaccagcgagaaguuccuggucauggccuccgaggacgcccugugcacggugcuccaccugaccgagcgccuguuccucgaccacccccaccggcugaccggcaacaaggugcagcaguaccaccgcgcccuggucgcggugcuccugagccggaccuggcacgugcgccgccaggcccagcagacgguccggaagcugcucuccagccucgggggcuucaagcuggcccacgggcuccuggaggagcugaagaccgugcucuccagccacaaggugcugccccuggaggcccucgucaccgacgccggcgaggugaccgaggcgggcaaggccuacgugccgccccgcguccugcaggaggcccugugcgugaucagcggggugccgggccucaagggggacgucacggacaccgagcagcuggcccaggagaugcugaucaucucccaccaccccagccucguggccgugcaguccggccuguggcccgcgcugcucgcccggaugaagaucgaccccgaggccuucaucacccgccaccuggaccagaucaucccgcggaugaccacgcagagcccccugaaccaguccagcaugaacgccauggggucccucagcguccugucccccgaccgcgugcugccccagcucaucagcaccaucaccgccuccgugcagaacccggcgcugcggcuggucacccgcgaggaguucgccaucaugcagacccccgccggcgagcucuacgacaagagcaucauccaguccgcccagcaggacagcaucaagaaggcgaacaugaagcgggagaacaaggccuacuccuucaaggagcagaucaucgagcuggagcugaaggaggagaucaagaagaagaagggcaucaaggaggaggugcagcucacgagcaagcagaaggagaugcugcaggcccagcuggaccgcgaggcccaggugcggcgccggcuccaggagcuggacggggagcuggaggccgcgcucggccugcuggacaucauccucgccaagaaccccuccgggcugacccaguacaucccgguccugguggacagcuuccucccccugcucaagagcccccuggccgcgccccgcaucaagaacccguuccugagccuggccgcgugcgugaugcccagccggcugaaggcccugggcacccuggucucccacgugacccuccgccugcugaagcccgagugcgugcuggacaagagcuggugccaggaggagcucuccgucgccgugaagcgggccgugaugcugcugcacacgcacaccaucaccagccgcgucggcaagggggagcccggcgccgcgccgcucuccgcccccgccuucagccugguguuccccuuccugaagauggugcucaccgagaugccccaccacuccgaggaggaggaggaguggauggcccagauccugcagauccugacgguccaggcccagcuccgggcgagcccgaacacgccgcccgggcgcguggacgagaacggccccgagcugcugccgcgcgucgccaugcuccggcugcugaccugggugaucgggaccggcagcccccgccuccaggugcuggccagcgacacgcugaccacccucugcgccuccagcuccggcgacgacgggugcgcguucgccgagcaggaggaggucgacgugcugcugugcgcccuccagagccccugcgccuccgugcgggagaccguccugcgcggccugauggagcuccacauggugcugcccgccccggacacggacgagaagaacgggcugaaccuccugcggcgccuguggguggucaaguucgacaaggaggaggagauccggaagcucgcggagcgccuguggagcaugaugggccuggaccuccagcccgaccugugcucccugcucaucgacgacgugaucuaccacgaggccgccgugcggcaggccggggccgaggcgcugagccaggccgucgcccgcuaccagcggcaggccgccgaggugaugggccgccugauggagaucuaccaggagaagcucuaccggccgccgcccgugcuggacgcgcugggccgcgucaucuccgaguccccgcccgaccagugggaggcccggugcgggcucgcccuggcccugaacaagcucagccaguaccuggacuccagccaggugaagccccuguuccaguucuucgugcccgacgcgcucaacgaccgccaccccgacguccggaagugcaugcuggacgccgcccuggccacccucaacacccacggcaaggagaacgugaacucccugcugcccguguucgaggaguuccucaagaacgccccgaacgacgcgagcuacgacgccguccgccaguccguggugguccugauggggagccuggccaagcaccucgacaaguccgaccccaaggugaagcccaucguggccaagcugaucgccgcgcugagcacccccucccagcagguccaggagagcguggccuccugccucccgccccuggugcccgccaucaaggaggacgccggcgggaugauccagcggcugaugcagcagcuccuggagagcgacaaguacgccgagcgcaagggcgcggccuacggccuggccgggcucgucaagggccuggggauccugucccucaagcagcaggagaugauggccgcgcugacggacgccauccaggacaagaagaacuuccggcgccgcgagggcgcccuguucgccuucgagaugcucugcaccaugcuggggaagcuguucgagcccuacguggugcacguccucccgcaccuccugcucugcuucggcgacggcaaccaguacgugcgggaggccgcggacgacugcgccaaggccgugaugagcaaccuguccgcccacggggucaagcuggugcuccccagccugcuggccgcgcucgaggaggaguccuggcgcaccaaggccggcagcguggagcugcugggggccauggccuacugcgcccccaagcagcucuccagcugccugcccaacaucgucccgaagcugaccgaggugcucacggacagccacgugaagguccagaaggcgggccagcaggcccugcggcagaucggcuccgugauccgcaaccccgagauccuggccaucgcccccgugcuccuggacgcccugaccgaccccagccggaagacccagaagugccuccagacccugcuggacacgaaguucguccacuucaucgacgcgccgucccucgcccugaucaugcccaucgugcagcgcgccuuccaggaccggagcaccgacacccgcaagauggccgcgcagaucaucgggaacauguacucccugaccgaccagaaggaccuggcccccuaccuccccagcgugacgccgggccugaaggccucccugcucgaccccguccccgaggugcggaccgugagcgccaaggcccugggggcgauggucaagggcaugggggaguccugcuucgaggaccugcuccccuggcugauggagacccugaccuacgagcagagcuccguggaccgcagcggcgccgcccagggccucgccgaggucauggccgggcugggcguggagaagcuggagaagcucaugccggagaucguggcgacggccuccaaggucgacaucgcgccccacgugcgggacggguacaucaugauguucaacuaccugcccaucaccuucggcgacaaguucaccccguacguggggcccaucauccccugcauccugaaggcccucgccgacgagaacgaguucguccgcgacaccgcgcugcgggccggccagcgcgugaucagcauguacgccgagaccgccaucgcgcugcuccugccccagcuggagcagggccucuucgacgaccuguggcggauccgcuucuccagcgugcagcugcucggggaccugcuguuccacaucuccggcgucacggggaagaugaccaccgagaccgccagcgaggacgacaacuucggcacggcccaguccaacaaggccaucaucaccgcccucgggguggagcggcgcaaccgggugcuggcgggccuguacaugggccgcagcgacacccagcucgucgugcgccaggccagccugcacguguggaagaucgucguguccaacaccccgcggacgcugcgcgagauccuccccacccuguucgggcugcuccugggcuuccuggccuccacgugcgccgacaagcggaccaucgccgcgcgcacgcucggggaccuggugcggaagcugggcgagaagauccuccccgagaucauccccauccuggaggagggccugcgcucccagaaguccgacgagcggcagggggucugcaucggccucuccgagaucaugaaguccaccucccgcgacgccgugcuguacuucagcgagucccuggugccgaccgcccggaaggcccucugcgacccccuggaggagguccgcgaggccgcggccaagaccuucgagcagcugcacagcacgaucgggcaccaggcccucgaggacauccugcccuuccugcucaagcagcuggacgacgaggagguguccgaguucgcccuggacggccucaagcaggucauggcgaucaagagccgggucgugcugcccuaccuggugccgaagcucaccacgccgcccgucaacacccgcgugcuggccuuccuguccagcguggccggggacgcccucacgcggcaccugggcgucauccugcccgccgugaugcucgcgcugaaggagaagcugggcaccccggacgagcagcucgagauggccaacugccaggccgugauccuguccgucgaggacgacaccgggcaccgcaucaucaucgaggaccugcucgaggccacccggagccccgaggugggcaugcgccaggccgcggccaucauccugaacaucuacugcucccggagcaaggccgacuacacgucccaccuccgcagccucgugagcgggcugauccggcuguucaacgacuccagccccgucgugcucgaggaguccugggacgcccugaacgccaucaccaagaagcuggacgcgggcaaccagcucgcccugaucgaggagcugcacaaggagauccgccucaucgggaacgagagcaagggcgagcacgugcccggcuucugccugccgaagaagggggucaccuccauccugcccgugcuccgggagggcgugcugaccgggagccccgagcagaaggaggaggccgccaaggcccugggccucgucauccgccugacguccgcggacgcccugcgccccagcgugguguccaucaccgggccgcucauccggauccugggcgaccgcuucagcuggaacgucaaggccgcccugcucgagacccugucccugcugcucgcgaaggugggcaucgcccugaagcccuuccugccccagcuccagaccacguucaccaaggcccugcaggacagcaaccgcggggugcgccugaaggccgccgacgcgcucggcaagcugaucuccauccacaucaaggucgacccccuguucaccgagcuccugaacgggauccgggccauggaggacccgggcgugcgcgacaccaugcugcaggcccuccgguucgugauccagggggccggcgccaaggucgacgcggugauccgcaagaacaucgucagccugcugcucuccaugcugggccacgacgaggacaacacgcggaucagcuccgccgggugccugggcgagcucugcgccuuccugaccgaggaggagcugagcgccgugcuccagcagugccugcuggccgacgugagcgggaucgacuggaugguccgccacggccggucccucgcgcugagcguggccgugaacgucgcccccggccgccugugcgccgggcgguacuccagcgacgugcaggagaugauccucuccagcgcgaccgccgaccgcauccccaucgccguguccggcguccgggggaugggcuuccugaugcgccaccacaucgagaccgggggcggccagcugccggccaagcucagcucccuguucgugaagugccugcagaaccccagcuccgacauccggcucguggccgagaagaugaucuggugggcgaacaaggacccccugcccccgcuggacccccaggccaucaagcccauccucaaggcccugcuggacaacaccaaggacaagaacacggucgugcgcgccuacagcgaccaggccaucgugaaccuccugaagaugcggcagggggaggaggucuuccagucccugagcaagauccucgacguggcgucccuggaggugcugaacgaggucaaccgccgcagccucaagaagcuggccucccaggccgacagcaccgagcaggucgacgacaccauccugaccuga

SEQ ID NO: 30498 - RNA, 1287 nt, Artificial Sequence
  derived and/or modified sequence opt1 from GCNT1__Homo_sapiens__XP_006717115
augcugcgcacccuccugcggcgccggcuguucagcuaccccaccaaguacuacuucauggugcucguccugucccugaucacguucagcgugcuccgcauccaccagaagcccgaguucguguccguccggcaccuggagcuggccggcgagaaccccagcuccgacaucaacugcaccaaggugcuccagggggacgugaacgagauccagaaggucaagcuggagauccugaccgugaaguucaagaagcgcccccgguggacccccgacgacuacaucaacaugacgagcgacugcuccagcuucaucaagcgccggaaguacaucguggagccgcucuccaaggaggaggccgaguuccccaucgcguacagcaucgucgugcaccacaagaucgagaugcuggaccgccugcuccgggccaucuacaugccccagaacuucuacugcauccacguggacaccaaguccgaggacagcuaccuggccgccgucaugggcaucgccuccugcuucagcaacguguucguggcgucccgccuggagagcgucguguacgccuccuggagccgggugcaggccgaccucaacugcaugaaggaccuguacgccauguccgcgaacuggaaguaccugaucaaccucugcgggauggacuuccccaucaagaccaaccuggagaucguccgcaagcugaagcuccugaugggcgagaacaaccuggagaccgagcggaugccgagccacaaggaggagcgcuggaagaagcgguacgagguggugaacgggaagcucacgaacaccggcaccgucaagaugcugccgccccuggagacgccccucuucagcggcuccgccuacuucguggugagccgcgaguacgucggguacgugcugcagaacgagaagauccagaagcugauggagugggcccaggacaccuacucccccgacgaguaccucugggccaccauccagcggauccccgagguccccggcagccugcccgccucccacaaguacgaccugagcgacaugcaggcgguggcccgcuucgugaaguggcaguacuucgagggggacgucuccaagggcgccccguacccgcccugcgacggggugcacgugcggagcgucugcaucuucggcgccggcgaccucaacuggaugcugcgcaagcaccaccuguucgccaacaaguucgacguggacguggaccucuucgcgauccagugccuggacgagcaccuccgccacaaggcccuggagacccugaagcacuga

SEQ ID NO: 30499 - RNA, 1203 nt, Artificial Sequence
  derived and/or modified sequence opt1 from GCNT2__Homo_sapiens__NP_001482
augccccugagcaugcgcuaccucuucaucaucuccgugagcuccgucaucaucuucaucguguucagcguguucaacuucggcggggaccccuccuuccagcggcugaacaucagcgacccccugcgccucacccaggucugcaccuccuucaucaacggcaagacgcgguuccuguggaagaacaagcugaugauccacgagaaguccagcugcaaggaguaccucacccagagccacuacaucaccgcgccccuguccaaggaggaggccgacuucccccuggccuacaucauggugauccaccaccacuucgacaccuucgcccgccucuuccgggccaucuacaugccgcagaacaucuacugcgugcacgucgacgagaaggccacgaccgaguucaaggacgccguggagcagcugcugagcugcuuccccaacgcguuccucgccuccaagauggagcccguggucuacgggggcaucagccgccugcaggccgaccugaacugcauccgggaccucuccgccuucgaggugagcuggaaguacgugaucaacacgugcgggcaggacuucccccugaagaccaacaaggagaucguccaguaccugaagggcuucaagggcaagaacaucaccccgggggugcucccgcccgcgcacgccaucggccgcaccaaguacgugcaccaggagcaccuggggaaggagcuguccuacgucauccggaccaccgcccucaagccgccgccgccccacaaccugacgaucuacuucggcagcgccuacguggcccugucccgcgaguucgcgaacuucgugcuccacgacccccgggccgucgaccugcugcaguggagcaaggacaccuucagccccgacgagcacuucugggugacccucaaccgcauccccggggugcccggcuccaugcccaacgccagcuggaccggcaaccugcgggccaucaagugguccgacauggaggaccgccacgggggcugccacgggcacuacguccacggcaucugcaucuacggcaacggggaccugaaguggcucgugaacagccccucccuguucgccaacaaguucgagcugaacacguacccccucaccguggagugccuggagcugcggcaccgcgagcggacccucaaccagagcgagaccgcgauccagcccuccugguacuucuga

SEQ ID NO: 30500 - RNA, 1317 nt, Artificial Sequence
  derived and/or modified sequence opt1 from GCNT3__Homo_sapiens__NP_004742
auggugcaguggaagcgccugugccagcuccacuaccugugggcccugggcugcuacaugcuccuggccaccgucgcgcugaagcucagcuuccggcugaagugcgacuccgaccaccuggggcucgagagccgcgagucccagagccaguacugccggaacauccuguacaacuuccugaagcuccccgccaagcgcuccaucaacugcagcggcgugacccgcggggaccaggaggccgugcugcaggccauccugaacaaccucgaggucaagaagaagcgggagccguucacggacacccacuaccugucccugacccgggacugcgagcacuucaaggccgagcgcaaguucauccaguucccccucagcaaggaggagguggaguuccccaucgcguacuccauggugauccacgagaagaucgagaacuucgagcggcugcugcgcgccgucuacgcgccccagaacaucuacugcgugcacguggacgagaaguccccggagaccuucaaggaggccgucaaggccaucaucagcugcuuccccaacguguucaucgccagcaagcucgugcgggucguguacgccuccuggagccgcgugcaggccgaccugaacugcauggaggaccugcuccaguccagcguccccuggaaguacuuccugaacacgugcggcaccgacuuccccaucaaguccaacgccgagauggugcaggcgcugaagaugcucaacgggcggaacagcauggaguccgaggugccgcccaagcacaaggagacccgcuggaaguaccacuucgaggucgugcgggacacccugcaccugacgaacaagaagaaggacccgccgcccuacaaccucaccauguucaccggcaacgccuacaucguggccagccgcgacuucguccagcacgugcugaagaaccccaagagccagcagcugaucgagugggugaaggacaccuacucccccgacgagcaccucugggccacgcugcagcgggcccgcuggaugcccggcagcguccccaaccaccccaaguacgacaucuccgacaugaccagcaucgcgcggcuggugaaguggcaggggcacgagggcgacaucgacaagggggcccccuacgcccccugcuccggcauccaccagcgcgccaucugcgucuacggggccggcgaccucaacuggaugcugcagaaccaccaccuccuggcgaacaaguucgacccgaagguggacgacaacgcccugcagugccuggaggaguaccuccgguacaaggccaucuacggcaccgagcuguga

SEQ ID NO: 30501 - RNA, 1293 nt, Artificial Sequence
  derived and/or modified sequence opt1 from GCNT7__Homo_sapiens__NP_542182
augagccagcugcgcgccaccaaguccggccucgugguccgggccgugaucugcaucuucaucuuccuguaccugcgcaaccccaccccggcggagagcgaggaggagcccgcccagcccgagguggucgagugcggguucuaccccgacgagcucugcuccgcccuguucgagggcaagggggccgccccgcagaucgcgaaguucugcaagacgccccacaagagcgagauccacgcccaccuccacacccccggcaacugcucccggaucagccgcgggcugcacuucaucacccggccccuguccgccgaggagggcgacuucagccuggccuacaucaucaccauccacaaggagcucgcgauguucgugcagcugcugcgcgccaucuacgugccgcagaacgucuacugcauccacguggacgagaaggcccccaugaaguacaagacggccgugcagacccucgucaacugcuucgagaacguguucaucuccagcaagaccgagaagguggccuacgcgggcuucacccggcugcaggccgacaucaacugcaugaagguccuggugcacuccaaguuccaguggaacuacgugaucaaccucugcgggcaggacuuccccaucaagacgaaccgcgagaucauccacuacauccggagcaagugguccgacaagaacaucacccccggcgucauccagccgcugcacaucaagagcaagaccucccagagccaccuggaguucgugcccaagggguccaucuacgccccgcccaacaaccgcuucaaggacaagccgccccacaaccucaccaucuacuucggcagcgccuacuacgugcugacgcggaaguucgucgaguucauccugaccgacauccacgccaaggacaugcuccagugguccaaggacauccgcagccccgagcagcacuacugggugacccugaaccggcugaaggacgcgcccggggccacccccaacgccggcugggagggcaacgugcgcgccaucaagcgcaagagcgaggaggggaacguccacgacggcugcaaggggcgguacguggaggacaucugcguguacggccccggcgaccuccccuggcugauccagucccccagccuguucgccaacaaguucgagccguccacggacccccucgucgugaccugccuggagcggcgccaccggcugcagguccuccgccaggcggaggugcccaucgagccccacuggcacuuccagcagcagagccacuucaacaugcggcugaaccgcuga

SEQ ID NO: 30502 - RNA, 1653 nt, Artificial Sequence
  derived and/or modified sequence opt1 from GCOM1__Homo_sapiens__NP_001018100
augcugcgcagcaccuccaccgugacgcuccugagcggcggggccgcccggacccccggcgcgccgucccgccgggccaacgucugccgccugcggcucaccgugccgcccgagagccccgugcccgagcagugcgagaagaagaucgagcgcaaggagcagcugcuggaccucuccaacggggagcccacccggaagcugccccagggcgucguguacggggugguccgccggagcgaccagaaccagcagaaggagauggugguguacggcugguccacgagccagcugaaggaggagaugaacuacaucaaggacguccgcgccacccucgagaaggugcggaagcgcauguacggcgacuacgacgagaugcggcagaagauccgccagcugacccaggagcuguccgugagccacgcccagcaggaguaccucgagaaccacauccagacccaguccagcgcccuggaccgguucaacgcgaugaacuccgcccuggccagcgacuccaucgggcuccagaagacgcuggucgacgugacccuggagaacagcaacaucaaggaccagauccgcaaccuccagcagaccuacgaggccuccauggacaagcugcgggagaagcagcgccagcuggagguggcgcaggucgagaaccagcuccugaagaugaagguggagagcucccaggaggccaacgccgaggugaugcgggagaugaccaagaagcuguacagccaguacgaggagaagcuccaggaggagcagcgcaagcacagcgccgagaaggaggcccugcuggaggagacgaacuccuuccucaaggcgaucgaggaggccaacaagaagaugcaggccgccgagaucagccuggaggagaaggaccagcggaucggcgagcuggaccgccucaucgagcgcauggagaaggagcggcaccagcugcagcugcagcuccuggagcacgagaccgagauguccggggagcugaccgacagcgacaaggagcgcuaccagcagcucgaggaggccuccgcgagccugcgggagcgcauccggcaccuggacgacaugguccacugccagcagaagaaggugaagcagaugguggaggagaucgagucccucaagaagaagcugcagcagaagcagcugcucauccugcagcugcucgagaagaucagcuuccuggagggcgagaacaacgagcugcagucccgccucgacuaccugaccgagacgcaggccaagaccgaggucgagacccgggagaucggggugggcugcgaccugcugccccgccucccguuccggcagaacgacagcuccagccacugccagaaguccggcagccccaucuccagcgaggagcgccggcgccgggacaagcagcaccuggacgacaucaccgccgcccgccugcucccccugcaccacaugcccacgcagcugcucuccaucgaggagagccuggcccugcagaagcagcagaagcagaacuacgaggagaugcaggcgaagcucgccgcccagaagcuggccgagcggcugaacaucaagaugcgcuccuacaacccggagggggagagcagcggccgguaccgcgaggugcgggacgaggacgacgacugguccagcgacgaguucuga

SEQ ID NO: 30503 - RNA, 543 nt, Artificial Sequence
  derived and/or modified sequence opt1 from GCSAM__Homo_sapiens__NP_001177188
augggcaacagccugcuccgcgagaacuccuuccggcgccagcagaacacccaggagaugcccuggaacgugcggaugcagagcccgaagcagcgcaccucccggugcugggaccaccacaucgccgaggggugcuucugccugcccuggaagaagauccugaucuucgagaagcgccaggacagccagaacgagaacgagcggauguccagcacgcccauccaggacaacgucgaccagaccuacuccgaggagcucugcuacacccugaucaaccaccgcgugcugugcacccggcccagcggcaacuccgccgaggaguacuacgagaacgugccgugcaaggcggagcgcccccgggagagccucgggggcacggagaccgaguacucccugcugcacaugcccagcaccgacccccgccacgcccgguccccggaggacgaguacgagcuccugaugccccaccgcaucagcucccacuuccugcagcagccccggccccucauggccccgagcgagacccaguucucccaccuguga

SEQ ID NO: 30504 - RNA, 348 nt, Artificial Sequence
  derived and/or modified sequence opt1 from GCSAML__Homo_sapiens__NP_001268764
augggcaacuaccugcuccgcaagcugcggcaggagaugaccaccuucgagcgcaagcugcaggaccaggacaagaagucccaggaggugagcagcacguccaaccaggagaacgagaacgggagcggcuccgaggaggucugcuacaccgugaucaaccacaucccccaccagcggagcucccucagcuccaacgacgacggguacgagaacaucgacagccugacccgcaaggugcggcaguuccgcgagcgguccgagaccgaguacgcccugcuccgcacgagcgucucccggccgugcagcugcacccacgagcacgacuacgaggugguguucccccacuga

SEQ ID NO: 30505 - RNA, 522 nt, Artificial Sequence
  derived and/or modified sequence opt1 from GCSH__Homo_sapiens__NP_004474
auggcccugcgcgugguccggagcgugcgcgcccuccugugcacccugcgggcggugcccuccccggccgcccccugcccgccccgccccuggcagcucggcgucggggccgugcggacccugcgcacgggccccgcccugcucagcgugcggaaguucaccgagaagcacgagugggucaccaccgagaacgggaucggcacgguggggaucuccaacuucgcgcaggaggcccugggcgacguggucuacugcagccugcccgaggugggcaccaagcucaacaagcaggacgaguucggggcccuggaguccgugaaggccgcgagcgagcuguacagcccccucuccggcgaggucaccgagaucaacgaggcccuggccgagaacccggggcuggugaacaaguccugcuacgaggacggcuggcucaucaagaugacccugagcaaccccuccgagcuggacgagcucaugagcgaggaggccuacgagaaguacaucaaguccaucgaggaguga

SEQ ID NO: 30506 - RNA, 1416 nt, Artificial Sequence
  derived and/or modified sequence opt1 from GDA__Homo_sapiens__NP_001229434
augugcgccgcccagaugccgccccuggcgcacaucuuccgcggcaccuucgugcacagcaccuggacgugccccauggagguccuccgggaccaccuccuggggguguccgacagcggcaagaucguguuccuggaggaggccucccagcaggagaagcuggccaaggaguggugcuucaagcccugcgagauccgcgagcugagccaccacgaguucuucaugcccgggcucgucgacacccacauccacgccucccaguacagcuucgccggcuccagcaucgaccugccccugcucgaguggcugaccaaguacaccuuccccgcggagcaccgguuccagaacaucgacuucgccgaggagguguacacgcgcgugguccggcgcacccugaagaacgggaccaccacggccugcuacuucgccaccauccacaccgacuccagccuccugcuggcggacaucaccgacaaguucggccagcgggccuucgugggcaaggugugcauggaccucaacgacacguuccccgaguacaaggagaccaccgaggaguccaucaaggagaccgagcgcuucgucagcgagaugcugcagaagaacuacucccgggugaagcccaucgugacgccgcgcuucagccuguccugcagcgagacccucaugggggagcugggcaacaucgccaagacccgggaccugcacauccagucccacaucagcgagaaccgcgacgaggucgaggccgugaagaaccucuaccccuccuacaagaacuacaccagcguguacgacaagaacaaccugcugacgaacaagaccgucauggcccacgggugcuaccucagcgcggaggagcugaacguguuccacgagcggggcgccuccaucgcccacugccccaacagcaaccugucccucagcuccggguuccugaacgugcuggagguccucaagcacgaggugaagaucggccugggcaccgacguggccgggggcuacagcuacuccaugcuggacgccauccgccgggcggucauggugagcaacauccuccugaucaacaaggugaacgagaagucccugacccucaaggaggucuuccgccuggccacgcucgggggcagccaggcccugggccuggacggggagaucggcaacuucgagguggggaaggaguucgacgccauccugaucaaccccaaggccuccgacagcccgaucgaccucuucuacggcgacuucuucggggacaucuccgaggcggucauccagaaguuccuguaccugggcgacgaccggaacaucgaggagguguacgugggcgggaagcaggucgugcccuucagcuccagcgugaaggagaccauccaccuccccgccuccagcccccacccgccgcccuuccccuga

SEQ ID NO: 30507 - RNA, 873 nt, Artificial Sequence
  derived and/or modified sequence opt1 from GDAP1__Homo_sapiens__NP_001035808
augcgccugaacagcaccggcgaggugcccguccucauccacggggagaacaucaucugcgaggccacccagaucaucgacuaccuggagcagacguuccuggacgagcggaccccgcgccucaugcccgacaaggaguccauguacuacccccgggugcagcacuaccgcgagcugcuggacagccuccccauggacgccuacacccacggcugcauccugcacccggagcugaccguggacuccaugauccccgcguacgccacgacccggauccgcagccagaucgggaacaccgaguccgagcucaagaagcuggccgaggagaaccccgaccugcaggaggccuacaucgccaagcagaagcggcucaagagcaagcugcuggaccacgacaacgucaaguaccucaagaagauccuggacgagcuggagaaggugcucgaccagguggagaccgagcugcagcgccggaacgaggagacgcccgaggagggccagcagccguggcugugcggggaguccuucacccucgcggacgucagccuggccgugacccugcaccgccucaaguuccugggcuucgcccggcgcaacuggggcaacgggaagcggcccaaccuggagaccuacuacgagcgcgugcucaagcggaagacguucaacaagguccugggccacgugaacaacauccugaucuccgccgugcuccccaccgcguuccgcgucgccaagaagcgggcccccaaggugcuggggaccacccugguggucggccuccuggccggggugggcuacuucgccuucaugcuguuccgcaagcggcucggcagcaugauccuggcguuccgcccgcggcccaacuacuucuga

SEQ ID NO: 30508 - RNA, 996 nt, Artificial Sequence
  derived and/or modified sequence opt1 from GDE1__Homo_sapiens__NP_057725
auguggcugugggaggaccagggcgggcuccugggccccuucagcuuccugcuccuggugcugcuccuggucacccgcuccccggugaacgccugccugcucaccgggagccuguucgugcugcuccgggucuucuccuucgagcccgugcccagcugccgcgcccuccaggugcugaagccccgggaccgcaucuccgcgaucgcccaccggggcgggagccacgacgccccggagaacacgcuggccgccauccgccaggcggccaagaacggcgccaccggcgucgagcuggacaucgaguucaccuccgacgggauccccgugcugaugcacgacaacaccguggaccggacgaccgacggcaccgggcgccucugcgaccugaccuucgagcagauccggaagcugaaccccgccgcgaaccaccgccuccggaacgacuuccccgacgagaagaucccgacgcugcgcgaggccgucgccgagugccugaaccacaaccucaccaucuucuucgacgugaagggccacgcccacaaggccaccgaggcgcugaagaagauguacauggaguucccccagcuguacaacaacagcguggucugcuccuuccuccccgaggugaucuacaagaugcggcagaccgaccgcgacgugaucacggcccugacccaccggcccuggagccugucccacaccggggacggcaagccgcgcuacgacaccuucuggaagcacuucaucuucgucaugauggacauccuccuggacuggagcaugcacaacauccugugguaccucugcggcaucuccgccuuccugaugcagaaggacuucgugagccccgccuaccugaagaagugguccgccaaggggauccagguggucggcuggacggugaacaccuucgacgagaaguccuacuacgagagccaccucgggagcuccuacaucaccgacagcaugguggaggacugcgagccccacuucuga

SEQ ID NO: 30509 - RNA, 1437 nt, Artificial Sequence
  derived and/or modified sequence opt1 from GDF10__Homo_sapiens__NP_004953
auggcccacgugcccgcccgcaccagcccgggccccgggccccagcugcuccugcugcuccugccccuguuccuccugcugcuccgggacgucgcgggcucccaccgcgccccggccuggagcgcccugcccgccgcggccgacgggcugcagggcgaccgggaccuccagcgccaccccggggacgccgccgcgacccugggccccuccgcccaggacaugguggccgugcacaugcaccggcuguacgagaaguacagccgccagggcgcccggcccgggggcgggaacaccguccgcuccuuccgggcccgccucgaggugguggaccagaaggcggucuacuucuucaaccugaccagcaugcaggacuccgagaugauccugaccgccaccuuccacuucuacagcgagccgccccgguggccccgcgcccucgaggugcugugcaagccgcgggccaagaacgccuccggccgcccccugccccucgggcccccgacgcggcagcaccuccuguuccgcagccugucccagaacaccgcgacccagggccugcugcggggcgccauggcccucgccccgccgccccgcgggcuguggcaggccaaggacaucagccccaucgugaaggcggcccggcgcgacggcgagcugcuccuguccgcccagcuggacagcgaggagcgggaccccggggucccccgccccucccccuacgcccccuacauccucguguacgccaacgaccuggcgaucagcgagcccaacuccguggccgucacccugcagcgcuacgaccccuucccggccggcgaccccgagccccgggccgcgccgaacaacagcgccgacccccgcgugcggcgcgccgcccaggccacgggcccccuccaggacaacgagcugcccgggcuggacgagcggccgccccgcgcgcacgcccagcacuuccacaagcaccagcucuggcccucccccuuccgggcccugaagccgcgccccggccggaaggaccgccggaagaaggggcaggagguguucauggccgccagccagguccuggacuucgacgagaagaccaugcagaaggcgcgccggaagcagugggacgagccccgcgugugcagccggcgcuaccucaagguggacuucgccgacaucggcuggaacgaguggaucaucucccccaagagcuucgacgccuacuacugcgccggggccugcgaguucccgaugcccaagaucguccggcccuccaaccacgcgaccauccagagcaucgugcgcgccgugggcaucauccccggcaucccggagcccugcugcguccccgacaagaugaacucccugggggugcuguuccucgacgagaaccggaacgugguccugaagguguaccccaacaugagcgucgacacgugcgccugccgcuga

SEQ ID NO: 30510 - RNA, 1224 nt, Artificial Sequence
  derived and/or modified sequence opt1 from GDF11__Homo_sapiens__XP_006719257
auggugcuggccgcgccccuccugcugggcuuccuccugcuggcccucgagcugcgcccgcgcggggaggccgccgagggccccgccgccgcggccgccgccgcggccgccgccgccgcggccggggucggcggggagcggagcucccggcccgcccccagcguggccccggagcccgacggcugccccgugugcgucuggcgccagcacucccgggagcugcgccucgagagcaucaagucccagauccugagcaagcugcggcucaaggaggcccccaacaucucccgcgagguggugaagcagcugcugccgaaggcgccgccccuccagcagauccuggaccugcacgacuuccagggcgacgcccuccagcccgaggacuuccuggaggaggacgaguaccacgccaccaccgagacggucaucagcauggcccaggagaccgaccccgccgugcagaccgacgggagcccccugugcugccacuuccacuucucccccaaggugauguucaccaagguccucaaggcgcagcuguggguguaccugcggcccgugccgcgccccgccacggucuaccuccagauccugcggcugaagccccucaccggcgaggggaccgccggcgggggcggcgggggccgccggcacauccgcauccggucccugaagaucgagcugcacagccgcuccgggcacuggcagagcaucgacuucaagcagguccuccacuccugguuccggcagccccagagcaacuggggcaucgagaucaacgccuucgacccguccggcaccgaccuggccgugacgagccuggggcccggcgcggaggggcuccaccccuucauggagcugcgcgugcuggagaacaccaagcggucccgccggaaccucggccuggacugcgacgagcacagcagcgagucccgcugcugccgcuacccccugaccguggacuucgaggccuucgggugggacuggaucaucgccccgaagcgguacaaggccaacuacugcagcggccagugcgaguacauguucaugcagaaguacccccacacccaccucgugcagcaggcgaacccccgcggcuccgccgggcccugcugcacgccgaccaagaugagccccaucaacaugcuguacuucaacgacaagcagcagaucaucuacggcaagauccccgggauggucguggaccggugcggcugcuccuga

SEQ ID NO: 30511 - RNA, 927 nt, Artificial Sequence
  derived and/or modified sequence opt1 from GDF15__Homo_sapiens__NP_004855
augcccggccaggagcugcgcaccgugaacgggagccagaugcuccugguccugcucgugcuguccuggcugccgcacggcggggcccucagccuggccgaggcgucccgggccagcuuccccggccccuccgagcugcacagcgaggacucccgcuuccgggagcuccgcaagcgguacgaggaccugcugacccgccuccgggccaaccagagcugggaggacuccaacacggaccuggugcccgccccggccguccgcauccugacccccgaggugcggcucgggagcggcggccaccuccaccuccgcaucucccgggcggcccugcccgaggggcugcccgaggccagccgccugcaccgggcccuguuccgccuguccccgaccgcgagccgguccugggacgugacccgcccccugcggcgccagcucagccuggcccggccccaggcccccgcccugcaccuccgccuguccccgccgcccagccaguccgaccagcugcucgccgagagcagcuccgcgcggccccagcuggagcugcaccuccgcccccaggccgcccgcggccggcgccgggcccgcgcccggaacggggaccacugcccccugggccccgggcgcugcugccggcugcacacgguccgcgcgagccucgaggaccugggcugggccgacugggugcugagcccccgggaggugcaggucaccaugugcaucggcgccugcccgucccaguuccgcgccgccaacaugcacgcgcagaucaagaccucccuccaccggcugaagcccgacaccgugcccgcccccugcugcgugccggccagcuacaaccccaugguccugauccagaagacggacaccggggugucccuccagaccuacgacgaccugcuggccaaggacugccacugcaucuga

SEQ ID NO: 30512 - RNA, 1119 nt, Artificial Sequence
  derived and/or modified sequence opt1 from GDF1__Homo_sapiens__NP_001483
augcccccgccccagcagggccccugcgggcaccaccuccugcugcugcucgcccugcugcuccccagccugccgcugacccgcgcccccgugccgcccggccccgcggccgcccuccugcaggcccuggggcuccgggacgagccccagggcgcgccccgccugcggcccgucccgcccgugauguggcgccuguuccggcgccgggacccccaggagacccgcuccgggagccggcgcacgucccccggcgugacccuccagccgugccacgucgaggagcugggcguggccgggaacaucgugcggcacauccccgaccgcggcgcccccacccgggccagcgagcccgccuccgcggccgggcacugcccggaguggaccgucguguucgaccugagcgccguggagcccgccgagcgccccucccgggcccgccucgagcugcgguucgcggccgccgccgccgcggcccccgagggcgggugggagcugagcgucgcccaggccggccagggcgccggggcggacccgggccccgugcuccugcgccagcuggugcccgcccucgggcccccgguccgggccgagcugcugggcgccgccugggcgcgcaacgccuccuggccccggagccuccgccuggcccuggcccuccgcccccgggcgccggccgccugcgcccgccuggccgaggcgucccugcuccuggugacgcuggacccccggcucugccacccccuggcccgcccccggcgcgacgccgagccggugcugggcgggggccccgggggcgccugccgggcccgccggcucuacgucagcuuccgcgaggugggguggcaccggugggugaucgcgccccgcggcuuccuggccaacuacugccagggccagugcgcccugcccgucgcccucuccgggagcggcgggccgcccgcccugaaccacgcggugcugcgggcccucaugcacgccgccgcgcccggcgccgccgaccugcccugcugcgugccggcccgccugucccccaucagcguccucuucuucgacaacuccgacaacguggugcugcggcaguacgaggacauggucguggacgagugcgggugccgcuga

SEQ ID NO: 30513 - RNA, 1290 nt, Artificial Sequence
  derived and/or modified sequence opt1 from GDF2__Homo_sapiens__NP_057288
augugccccggcgcccuguggguggcccucccgcugcugagccuccuggcggggucccugcagggcaagccccuccagagcugggggcgcggcuccgccgggggcaacgcccacagcccccugggcguccccgggggcgggcugccggagcacaccuucaaccucaagauguuccuggagaacgugaagguggacuuccugcggucccucaaccugagcggcguccccucccaggacaagacccgcguggagccgccccaguacaugaucgaccuguacaaccgguacacgagcgacaaguccaccacccccgccagcaacaucgugcgcuccuucagcauggaggacgccaucuccaucaccgcgacggaggacuuccccuuccagaagcacauccuccuguucaacaucagcaucccccggcacgagcagaucacccgcgccgagcugcggcucuacgucuccugccagaaccacguggaccccagccacgaccugaagggguccguggucaucuacgacgugcuggacggcaccgacgccugggacagcgccaccgagacgaagaccuuccucgugucccaggacauccaggacgagggcugggagacccuggaggucagcagcgcggugaagcgcugggugcgguccgacagcaccaaguccaagaacaagcuggaggucacgguggagagccaccgcaaggggugcgacacccucgacaucuccgugccgcccggcagccggaaccugcccuucuucgucguguucuccaacgaccacagcuccgggaccaaggagacccgccuggagcuccgggagaugaucagccacgagcaggaguccgugcugaagaagcugagcaaggacggcuccacggaggccggcgagagcucccacgaggaggacaccgacgggcacgucgccgccggcagcacccucgcccgccggaagcgcuccgcgggggccggcagccacugccagaagaccucccugcgggugaacuucgaggacaucgggugggacagcuggaucaucgcccccaaggaguacgaggccuacgagugcaagggcggcugcuucuucccgcuggccgacgacgugacgcccaccaagcacgcgaucguccagacccucgugcaccugaaguuccccaccaaggucgggaaggccugcugcgugcccacgaagcugagcccgaucuccgugcucuacaaggacgacaugggcguccccacccugaaguaccacuacgaggggaugagcguggccgagugcggcugccgcuga

SEQ ID NO: 30514 - RNA, 1095 nt, Artificial Sequence
  derived and/or modified sequence opt1 from GDF3__Homo_sapiens__NP_065685
augcugcgcuuccuccccgaccuggccuucagcuuccugcucauccuggcccugggccaggcggugcaguuccaggaguacgucuuccuccaguuccuggggcuggacaaggccccgagcccccagaaguuccagcccgugcccuacauccucaagaagaucuuccaggaccgggaggccgccgccaccaccggcgugucccgcgaccugugcuacgucaaggagcugggggugcggggcaacgugcuccgcuuccugccggaccagggguucuuccuguaccccaagaagaucucccaggcgagcuccugccuccagaagcugcuguacuucaaccucagcgccaucaaggagcgggagcagcugacgcuggcccagcucggccuggaccugggccccaacuccuacuacaaccucgggcccgagcuggagcuggcccucuuccugguccaggagccgcacguguggggccagaccacccccaagcccgggaagauguucgugcugcgcagcguccccuggccgcagggcgcggugcacuucaaccuccuggacguggccaaggacuggaacgacaacccccggaagaacuucgggcuguuccucgagauccuggucaaggaggaccgcgacuccggcgugaacuuccagcccgaggacacgugcgcccggcugcgcugcagccuccacgccucccugcugguggucacccucaaccccgaccagugccacccgagccggaagcgccgggccgcgauccccgugcccaagcuguccugcaagaaccugugccaccgccaccagcuguucaucaacuuccgggaccucggcuggcacaaguggaucaucgcccccaagggguucauggccaacuacugccacggcgagugcccguucagccugaccaucucccucaacagcuccaacuacgccuucaugcaggcccugaugcacgcgguggaccccgagaucccccaggccgucugcauccccaccaagcugagcccgaucuccaugcucuaccaggacaacaacgacaacgugauccugcgccacuacgaggacaugguggucgacgagugcgggugcggcuga

SEQ ID NO: 30515 - RNA, 1506 nt, Artificial Sequence
  derived and/or modified sequence opt1 from GDF5__Homo_sapiens__NP_001306067
augcgccugcccaagcuccugaccuuccugcucugguaccuggccuggcuggaccucgaguucaucugcaccgugcugggcgccccggaccuggggcagcggccccagggcacgcgccccgggcucgcgaaggccgaggccaaggagcggcccccgcuggcccgcaacgucuuccggcccggcgggcacagcuacggcggcggggccaccaacgcgaacgcccgcgccaagggcgggaccggccagaccgggggccugacgcagcccaagaaggacgagcccaagaagcucccgccccggcccggcgggcccgagccgaagcccggccaccccccccagacccgccaggccaccgcgcggaccgugacgccgaaggggcagcugcccggcggcaaggccccccccaaggccggguccgugccgagcuccuuccugcucaagaaggcccgcgagcccggccccccccgggagccgaaggagcccuuccgcccccccccgaucaccccccacgaguacaugcugagccuguaccggacccucuccgacgccgaccgcaaggggggcaacagcuccgucaagcuggaggcggggcuggccaacaccaucacgagcuucaucgacaagggccaggacgaccggggccccguggugcgcaagcagcgguacgucuucgacaucuccgcccucgagaaggacgggcugcugggcgccgagcuccgcauccugcggaagaagccgagcgacaccgccaagcccgcggcccccgggggcgggcgcgccgcccagcugaagcucuccagcugccccuccggccggcagccggccgcgcugcuggacgugcgcagcgugcccggccucgacggguccggcugggaggucuucgacaucuggaagcuguuccgcaacuucaagaacagcgcccagcugugccucgagcuggaggccugggagcgggggcgcgccguggaccugcggggccucggguucgaccgcgccgcgcggcaggugcacgagaaggcccuguuccuggucuucggccgcaccaagaagcgggaccucuucuucaacgagaucaaggcccgcuccggccaggacgacaagaccguguacgaguaccuguucagccagcggcgcaagcggcgcgccccccuggcgacgcggcaggggaagcgccccuccaagaaccucaaggcccggugcagccgcaaggcccugcacgugaacuucaaggacaugggcugggacgacuggaucaucgccccgcuggaguacgaggccuuccacugcgaggggcucugcgaguucccccugcggagccaccuggagcccaccaaccacgcggucauccagacccucaugaacuccauggaccccgagagcaccccgcccacgugcugcgugcccacccgccugucccccaucagcauccuguucaucgacuccgccaacaacguggucuacaagcaguacgaggacauggugguggagagcugcggcugccgguga

SEQ ID NO: 30516 - RNA, 1368 nt, Artificial Sequence
  derived and/or modified sequence opt1 from GDF6__Homo_sapiens__NP_001001557
auggacacgccccgcgugcugcucagcgccgucuuccugaucuccuuccugugggaccucccgggcuuccagcaggccagcaucuccagcuccagcuccagcgcggagcugggguccaccaagggcaugcggagccgcaaggaggggaagaugcagcgggcgccccgcgacuccgacgccggccgggaggggcaggagccccagccccgcccgcaggacgagccccgggcccagcagccccgcgcccaggagcccccgggccggggcccccgcguggugccccacgaguacaugcugagcaucuaccggaccuacuccaucgccgagaagcucgggaucaacgccagcuucuuccaguccagcaaguccgccaacaccaucaccagcuucgucgaccgcggccuggacgaccugucccacacgccccuccggcgccagaaguaccuguucgacgugagcaugcugagcgacaaggaggagcucgugggggccgagcugcggcuguuccgccaggcgccguccgcccccuggggcccgcccgccgggccccuccacguccagcuguuccccugccugagcccccuccugcuggacgcccggacccucgacccccagggcgccccgcccgcgggcugggagguguucgacguguggcaggggcugcgccaccagcccuggaagcagcugugccucgagcugcgggccgccuggggcgagcuggacgccggggaggccgaggcgcgcgcccggggcccccagcagccgcccccgcccgaccuccgcucccugggcuucgggcgccggguccgcccgccccaggagcgggcccugcucgugguguucacccgcagccagcggaagaaccuguucgccgagaugcgcgagcagcugggcuccgccgaggcggccgggcccggcgccggggccgagggcagcuggcccccgcccuccggcgcccccgacgcgcggcccuggcuccccagccccgggcgccggcgccggcgcaccgccuucgccucccggcacggcaagcgccacgggaagaagucccggcugcgcugcagcaagaagccccugcacgucaacuucaaggagcucggcugggacgacuggaucaucgccccgcuggaguacgaggcguaccacugcgagggggugugcgacuucccccugcggagccaccucgagcccaccaaccacgccaucauccagacgcugaugaacuccauggaccccggcagcaccccgcccuccugcugcgugcccaccaagcugacccccaucagcauccucuacaucgacgccggcaacaacgucguguacaagcaguacgaggacaugguggucgaguccugcgggugccgcuga

SEQ ID NO: 30517 - RNA, 1353 nt, Artificial Sequence
  derived and/or modified sequence opt1 from GDF7__Homo_sapiens__NP_878248
auggaccugagcgccgccgcggcccucugccuguggcugcucuccgccugccgcccccgggacggccuggaggccgccgcggugcugcgcgccgccggggccggcccgguccggagccccgggggcgggggcggcgggggcgggggcgggcgcacccucgcgcaggccgccggcgccgccgcggugcccgccgccgccgugccccgggcccgcgcggcccggcgcgccgccggcuccggguuccggaacggcagcgucgugccgcaccacuucaugaugucccuguaccgcagccuggccgggcgggcgcccgccggcgccgccgccguguccgcgagcggccacgggcgcgccgacaccaucacgggcuucaccgaccaggccacccaggacgaguccgccgcggagaccgggcagagcuuccucuucgacgucuccagccugaacgacgccgacgagguggugggcgccgagcugcggguccuccgccgggggucccccgagagcggccccggcuccuggacgagcccgccccugcugcuccuguccacgugccccggggccgcccgcgcgccccggcugcucuacagccgcgccgccgagccgcuggugggccagcggugggaggccuucgacguggccgacgcgaugcgccggcaccgccgcgagccccggccgccccgcgccuucugccugcuccugcgggccgucgccgggcccgugcccagcccccuggcccuccgccggcugggcuucggguggcccggcggcgggggcuccgcggccgaggagcgcgccgugcuggucgugagcucccggacccagcgcaaggagagccucuuccgggagauccgcgcccaggcgcgggcccugggggccgcccuggccuccgagccgcuccccgaccccggcaccgggaccgcgagcccccgcgccgugaucggcggccggcgccggcgccggaccgcccuggccgggacccgcaccgcccagggcuccgggggcggcgcggggcggggccacgggcgccgcggccggagccgcugcucccggaagccgcugcacgucgacuucaaggagcucgggugggacgacuggaucaucgcgccccuggacuacgaggccuaccacugcgagggccugugcgacuucccccuccgcagccaccuggagcccacgaaccacgccaucauccagacccugcucaacuccauggccccggacgccgcccccgccagcugcugcgugcccgcccggcuguccccgaucagcauccuguacaucgacgcggccaacaacguggucuacaagcaguacgaggacauggugguggaggccugcggcugccgcuga

SEQ ID NO: 30518 - RNA, 1365 nt, Artificial Sequence
  derived and/or modified sequence opt1 from GDF9__Homo_sapiens__XP_011541610
auggcccgccccaacaaguuccugcucugguucugcugcuucgccuggcugugcuucccgaucagccugggcucccaggcgagcgggggcgaggcccagaucgccgccuccgccgagcucgagagcggggcgaugcccuggucccugcugcagcacaucgacgagcgggaccgcgccggccuccugcccgcccuguucaaggugcucagcgucgggcggggcggcagcccccgccugcagccggacagccgggcccugcacuacaugaagaagcucuacaagaccuacgcgaccaaggaggggauccccaaguccaaccgcagccaccuguacaacacggugcggcuguucacccccugcacccgccacaagcaggcccccggcgaccaggugaccgggauccucccguccgucgagcugcuguucaaccucgaccggaucacgaccguggagcaccuccugaaguccgugcugcuguacaacaucaacaacuccgucagcuucuccagcgccgugaagugcgugugcaaccugaugaucaaggagcccaaguccagcucccgcacccucggccgggcccccuacagcuucaccuucaacagccaguucgaguucgggaagaagcacaaguggauccagaucgacgucacgucccugcugcagccccucguggccagcaacaagcgcuccauccacaugagcaucaacuucacgugcaugaaggaccagcuggagcacccguccgcgcagaacggccuguucaacaugacccucgugagccccucccugauccuguaccucaacgacaccagcgcccaggccuaccacuccugguacagccugcacuacaagcggcgccccucccagggccccgaccaggagcggagccuguccgccuacccggucggggaggaggccgcggaggacggccgcagcucccaccaccggcaccgccgggggcaggagaccgugagcuccgagcucaagaagccccugggccccgccagcuucaaccuguccgaguacuuccgccaguuccuccugccccagaacgagugcgagcugcacgacuuccggcucagcuucagccagcugaagugggacaacuggaucguggccccgcaccgcuacaacccccgcuacugcaagggcgacugcccccgggccgucgggcaccgcuacggcucccccgugcacaccauggugcagaacaucaucuacgagaagcuggacagcuccgucccgcggcccagcugcgugcccgccaaguacagcccccucuccgugcugaccaucgagccggacggguccaucgcguacaaggaguacgaggacaugaucgccaccaagugcacgugccgcuga

SEQ ID NO: 30519 - RNA, 1344 nt, Artificial Sequence
  derived and/or modified sequence opt1 from GDI1__Homo_sapiens__NP_001484
auggacgaggaguacgacgugaucguccugggcaccgggcucaccgagugcauccugagcggcaucauguccgugaacgggaagaaggugcugcacauggaccgcaaccccuacuacggcggggagagcuccagcaucacgccgcucgaggagcuguacaagcgguuccagcugcucgagggcccgcccgaguccaugggccgcgggcgggacuggaacgucgaccugauccccaaguuccugauggccaacggccagcucgugaagaugcugcuguacaccgaggugacccgcuaccucgacuucaaggucguggaggggagcuucguguacaagggcgggaagaucuacaagguccccuccaccgagacggaggcccuggcgagcaaccugaugggcauguucgagaagcggcgcuuccggaaguuccucguguucguggccaacuucgacgagaacgaccccaagaccuucgagggcgucgacccccagaccaccuccaugcgcgacguguaccggaaguucgaccuggggcaggacgugaucgacuucacgggccacgcccuggcccucuaccgcaccgacgacuaccuggaccagcccugccuggagaccgucaaccggaucaagcucuacagcgagucccuggcccgcuacggcaagagcccguaccuguacccccucuacgggcugggcgagcugccccagggguucgcgcggcucuccgccaucuacggcgggaccuacaugcugaacaagcccguggacgacaucaucauggagaacggcaagguggucggggucaagagcgagggcgagguggcccgcugcaagcagcugaucugcgacccguccuacauccccgaccgggugcgcaaggccggccaggugauccggaucaucugcauccucagccaccccaucaagaacacgaacgacgcgaacuccugccagaucaucaucccccagaaccaggugaaccgcaagagcgacaucuacgucugcaugaucuccuacgcccacaacguggccgcccaggggaaguacaucgccaucgcgagcaccaccgucgagaccacggacccggagaaggagguggagcccgcccuggagcugcucgagcccaucgaccagaaguucguggccaucagcgaccuguacgagcccaucgacgacggcugcgagucccaggucuucugcagcugcuccuacgacgccaccacccacuucgagaccacgugcaacgacaucaaggacaucuacaagcggauggccgggaccgcguucgacuucgagaacaugaagcgcaagcagaacgacguguucggcgaggccgagcaguga

SEQ ID NO: 30520 - RNA, 1203 nt, Artificial Sequence
  derived and/or modified sequence opt1 from GDI2__Homo_sapiens__NP_001108628
augaacgaggaguacgacgugaucguccugggcaccgggcucaccgagugcauccugagcggcaucauguccgugaacgggaagaaggugcugcacauggaccgcaaccccuacuacggcggggagagcgccuccaucacgccgcucgaggaccuguacaagcgguucaagauccccggcagcccgcccgaguccaugggccgcgggcgggacuggaacgucgaccugauccccaaguuccucauggccaacggccugauggggcuguucgagaagcgccgguuccgcaaguuccucguguacguggcgaacuucgacgagaaggacccccggaccuucgagggcaucgaccccaagaagaccaccaugcgcgacgucuacaagaaguucgaccuggggcaggacgugaucgacuucacgggccacgcccuggcccucuaccggaccgacgacuaccuggaccagcccugcuacgagaccaucaaccgcaucaagcuguacagcgagucccucgcccgguacggcaagagcccguaccuguacccccuguacgggcucggcgagcugccccagggguucgcccgccuguccgcgaucuacggcggcaccuacaugcucaacaagcccaucgaggagaucaucgugcagaacgggaaggucaucggcgucaagagcgagggggagaucgcccggugcaagcagcugaucugcgacccguccuacgugaaggaccgcguggagaaggugggccaggugauccgggucaucugcauccugagccaccccaucaagaacacgaacgacgccaacuccugccagaucaucaucccccagaaccaggugaaccgcaagagcgacaucuacgugugcaugaucuccuucgcccacaacgucgcggcccaggggaaguacaucgccaucgugagcaccaccguggagaccaaggagcccgagaaggagauccggccggcccucgagcugcuggagcccaucgagcagaaguucgucuccaucagcgaccuccuggugcccaaggaccugggcacggagucccagaucuucaucagccgcaccuacgacgccaccacccacuucgagacgaccugcgacgacaucaagaacaucuacaagcggaugaccggcagcgaguucgacuucgaggagaugaagcgcaagaagaacgacaucuacggggaggacuga

SEQ ID NO: 30521 - RNA, 687 nt, Artificial Sequence
  derived and/or modified sequence opt1 from GDNF__Homo_sapiens__NP_001177397
augcagagccugcccaacuccaacggcgccgccgcggggcgcgacuucaagaugaagcucugggacguggucgccgugugccuggugcugcuccacaccgccagcgccuucccgcugcccgccggcaagcggccgcccgaggcgcccgccgaggaccgcucccuggggcggcgccgggcccccuucgcccucagcuccgacagcaacaugcccgaggacuaccccgaccaguucgacgacgucauggacuucauccaggcgaccaucaagcgccugaagcgguccccggacaagcagauggccgugcugccccgccgggagcgcaaccggcaggccgccgccgcgaaccccgagaacagccgcggcaaggggcggcgcggccagcggggcaagaaccgcgggugcgugcucacggccauccaccugaacgucaccgaccugggccucggguacgagaccaaggaggagcugaucuuccgguacugcuccggcagcugcgacgccgccgagaccacguacgacaagauccugaagaaccucucccgcaaccggcgccuggugagcgacaagguggggcaggccugcugccggcccaucgcguucgacgacgaccuguccuuccucgacgacaaccuggucuaccacauccugcgcaagcacagcgccaagcgcugcggcugcaucuga

SEQ ID NO: 30522 - RNA, 957 nt, Artificial Sequence
  derived and/or modified sequence opt1 from GDPD3__Homo_sapiens__NP_077283
augagccugcuccuguacuacgcccugcccgcccucggcuccuacgcgaugcugagcaucuucuuccugcgccggccgcaccuccugcacacgccccgcgcccccaccuuccggauccgccugggggcccaccggggcggguccggcgagcuccuggagaacaccauggaggccauggagaacagcauggcccagcgcuccgaccugcucgagcuggacugccagcugacccgggaccgcguggucguggugagccacgacgagaaccucugccggcaguccgggcugaaccgcgacgucggcagccuggacuucgaggaccucccccuguacaaggagaagcuggagguguacuucuccccgggccacuucgcgcacgggagcgaccggcgcauggugcggcucgaggaccuguuccagcgcuucccccggacccccauguccgucgagaucaagggcaagaacgaggagcugauccgcgagaucgccgggcucgugcggcgcuacgaccggaacgagaucaccaucugggccagcgagaaguccagcgugaugaagaagugcaaggccgcgaaccccgagaugccgcuguccuucacgaucagccgcggcuucuggguccugcucuccuacuaccuggggcugcuccccuucauccccauccccgagaaguucuucuucugcuuccugccgaacaucaucaaccggaccuacuuccccuucagcugcuccugccugaaccagcuccuggccguggugagcaaguggcugaucaugcgcaagagccucauccgccaccuggaggagcggggcguccaggugguguucuggugccugaacgaggaguccgacuucgaggccgccuucagcgucggcgccaccggggugaucaccgacuaccccacggcgcuccgccacuaccuggacaaccacggccccgccgcccggaccuccuga

SEQ ID NO: 30523 - RNA, 1818 nt, Artificial Sequence
  derived and/or modified sequence opt1 from GDPD5__Homo_sapiens__NP_110419
auggugcgccaccagccccugcaguacuacgagccgcagcucugccugagcugccugaccggcaucuacgggugccgguggaagcgcuaccagcggucccacgacgacaccacgcccugggagcgccucugguuccugcugcucaccuucaccuucggccugacccugacguggcucuacuucuggugggagguccacaacgacuacgacgaguucaacugguaccuguacaaccggaugggguacuggagcgacuggcccgugcccauccuggugaccaccgccgccgcguucgccuacaucgccggccuccugguccuggcccucugccacaucgccguggggcagcagaugaaccugcacuggcugcacaagaucggccucguggucauccuggcguccaccgugguggccaugagcgccgucgcccagcugugggaggacgagugggaggugcuccugaucucccugcagggcacggcgccguuccuccacgugggggccgucgccgccgugaccaugcugagcuggaucguggccggccaguucgcgcgcgccgagcggaccuccagccaggucaccauccugugcacguucuucaccgugguguucgcccucuaccuggcgccccugaccaucuccagccccugcaucauggagaagaaggaccucgggcccaagccggcccugaucggccaccgcggggcccccaugcuggcccccgagcacacccucauguccuuccggaaggcccuggagcagaagcuguacggccuccaggccgacaucacgaucagccuggacggcguccccuuccugaugcacgacaccacccuccgccggaccacgaacguggaggaggaguucccggagcuggcccgccggcccgcguccaugcugaacuggaccacccuccagcgccugaacgccgggcagugguuccugaagaccgaccccuucuggacggccagcucccucagccccuccgaccaccgggaggcccagaaccagagcaucugcucccuggccgagcugcucgagcuggcgaagggcaacgccacccugcugcucaaccugcgcgacccgccccgggagcaccccuaccgcagcagcuucaucaacgugacccuggaggccguccuccacuccggguucccccagcaccaggugauguggcugccgagccggcagcgcccccuggugcggaaggucgcccccggcuuccagcagaccuccggcagcaaggaggcgguggccucccuccgccgcgggcacauccagcggcugaaccugcgcuacacgcaggucagccggcaggagcuccgcgacuacgccuccuggaaccugagcgugaaccuguacaccgugaacgcccccuggcuguucucccuccuguggugcgccggcgucccgagcgugaccuccgacaacagccacgcgcucucccaggugcccagcccccuguggaucaugcccccggacgaguacugccugaugugggucaccgccgaccucguguccuucacgcugaucguggggaucuucguccugcagaaguggcggcucggcgggauccgcagcuacaaccccgagcagaucaugcuguccgccgccgugcggcgcaccagccgggacguguccaucaugaaggagaagcugaucuucagcgagaucagcgacggcgucgagguguccgacgugcucagcgucugcuccgacaacagcuacgacaccuacgccaacuccaccgcgacgcccgugggcccgcgcgggggcgggagccacaccaagacccugaucgagcgguccggccgcuga

SEQ ID NO: 30524 - RNA, 891 nt, Artificial Sequence
  derived and/or modified sequence opt1 from GEM__Homo_sapiens__NP_859053
augacccugaacaacgugaccaugcgccagggcacggucgggaugcagccccagcagcagcgguggagcaucccggccgacggccgccaccucauggugcagaaggagccccaccaguacucccaccggaaccgccacagcgccacccccgaggaccacugccggcgcuccuggagcuccgacagcaccgacuccgugaucagcuccgagagcgggaacaccuacuaccgggucgugcugaucggcgagcagggggugggcaaguccacgcuggcgaacaucuucgccggcguccacgacagcauggacuccgacugcgaggugcucggggaggacaccuacgagcgcacccugaugguggacggcgagagcgccaccaucauccugcucgacaugugggagaacaagggggagaacgaguggcugcacgaccacugcaugcaggucggcgacgccuaccugaucguguacuccaucacggaccgggccagcuucgagaaggcguccgagcuccgcauccagcugcggcgcgcccggcagaccgaggacauccccaucauccugguggggaacaagagcgaccucguccgcugccgggagguguccgugagcgagggccgcgccugcgccgucguguucgacugcaaguucaucgagaccagcgcggccgugcagcacaacgucaaggagcuguucgagggcaucgugcgccaggugcggcugcggcgcgacuccaaggagaagaacgagcggcgccucgccuaccagaagcgcaaggagagcaugccgcggaaggcccgccgguucugggggaagaucgucgccaagaacaacaagaacauggcguucaagcugaaguccaagagcugccacgaccuguccgugcucuga

SEQ ID NO: 30525 - RNA, 798 nt, Artificial Sequence
  derived and/or modified sequence opt1 from GEMIN2__Homo_sapiens__NP_001009182
augcgccgggccgagcuggccggccucaagaccauggcgugggugcccgccgagagcgccgucgaggagcugaugccgcgccugcuccccguggagcccugcgaccugaccgagggguucgaccccuccgugccgccccggacgccccaggaguaccugcgccggguccagaucgaggccgcccagugccccgacgugguggucgcgcagaucgacccgaagaagcucaagcgcaagcagagcgugaacaucucccugagcggcugccagcccgcccccgagggguacucccccacccugcaguggcagcagcagcaggucgcccaguucagcaccgugcggcagaacgugaacaagcaccgcucccacuggaagucccagcagcucgacagcaacgugaccaugcccaagagcgaggacgaggagggcuggaagaaguucugccugggggagaagcugugcgccgacggcgcggucggcccggccacgaacgagucccccgggaucgacuacgugcaggccaccgugaccagcguccucgaguaccuguccaacugguucggcgagcgggacuucacccccgagcuggggcgcuggcucuacgcccugcuggccugccucgagaagccgcugcugcccgaggcgcacagccucauccggcagcuggcccgccggugcuccgaggugcgccugcucguggacagcaaggacgacgagcggguccccgcccugaaccugcucaucugccuggugucccgcuacuucgaccagcgggaccuggccgacgagcccagcuga

SEQ ID NO: 30526 - RNA, 3177 nt, Artificial Sequence
  derived and/or modified sequence opt1 from GEMIN4__Homo_sapiens__NP_056536
auggaccugggcccccucaacaucugcgaggagaugaccauccugcacgggggcuuccugcucgccgagcagcuguuccacccgaaggcccuggcggagcucaccaagagcgacugggagcgcguggggcggcccaucgucgaggcccugcgcgagaucuccagcgccgccgcccacucccagcccuucgcguggaagaagaaggcccugaucaucaucugggccaaggugcuccagccccacccggugacgcccagcgacaccgagacccgguggcaggaggaccuguucuucuccgucggcaacaugauccccaccaucaaccacacgauccuguucgagcuccucaagagccuggaggccuccgggcuguucauccagcugcugauggcgcuccccaccaccaucugccacgccgagcuggagcgcuuccuggagcacgugaccguggacacgagcgccgaggacgucgccuucuuccucgacguguggugggaggugaugaagcacaagggccacccgcaggacccccugcugucccaguucagcgccauggcgcacaaguaccuccccgcccuggacgaguucccccacccgcccaagcggcugcgcuccgaccccgacgccugccccaccaugccgcuccuggccaugcugcuccggggccugacccagauccagagccgcauccuggggcccggccggaagugcugcgcccucgcgaaccuggccgacaugcugaccgucuucgcccucacggaggacgacccccaggagguguccgccaccguguaccuggacaagcuggccaccgucaucagcguguggaacuccgacacccagaaccccuaccaccagcaggcgcucgccgagaaggugaaggaggccgagcgcgacgucagccugacgucccuggccaagcucccgagcgagaccaucuucguggggugcgaguuccugcaccaccuccuccgggaguggggcgaggagcugcaggccgugcugcgcuccagccaggggaccagcuacgacuccuaccggcucugcgacagccugaccuccuucagccagaacgcgacgcuguaccugaaccgcaccucccucagcaaggaggaccggcaggucguguccgagcuggccgagugcgugcgcgacuuccugcggaagaccagcaccguccucaagaaccgcgcccuggaggacaucacggccuccaucgcgauggccgugauccagcagaagauggaccggcacauggaggugugcuacaucuucgccagcgagaagaagugggccuucuccgacgagugggucgccugccugggcagcaaccgcgcgcuguuccggcagcccgaccuggugcugcgccuccuggagaccgucaucgacguguccaccgccgaccgcgccauccccgagagccagauccgccaggugauccaccugauccucgagugcuacgccgaccugucccugcccggcaagaacaagguccucgccgggauccugcggagcuggggccggaaggggcuguccgagaagcuccuggcguacguggagggcuuccaggaggaccugaacaccacguucaaccagcucacccagagcgccuccgagcagggccuggccaaggccguggccagcgucgcgcgccuggugaucgugcacccggaggucaccgugaagaagaugugcagccucgccguggucaaccuggggacccacaaguuccuggcccagauccucacggccuuccccgcgcugcgguucguggaggagcagggccccaacuccagcgccaccuucaugguguccugccugaaggagaccgucuggaugaaguucagcacccccaaggaggagaagcaguuccucgagcugcugaacugccucauguccccggugaagccccaggggauccccguggccgcccugcuggagccggacgagguccucaaggaguucgugcugcccuuccugcgccucgacguggaggaggucgaccugagccugcggaucuucauccagacgcucgaggccaacgcgugccgcgaggaguacuggcugcagaccugcucccccuucccccuccucuucagccugugccagcugcucgaccgguucuccaaguacuggcagcugccgaaggagaagcgcugccugagccucgaccggaaggaccuggccauccacauccuggagcuccugugcgagaucguguccgccaacgccgagaccuucagccccgacguguggaucaagucccugagcuggcuccaccgcaagcuggagcagcuggacuggaccgucggccuccggcugaaguccuucuucgaggggcacuucaagugcgaggugcccgccacccuguucgagaucugcaagcucagcgaggacgaguggacgucccaggcgcaccccggcuacggcgccgggaccggccugcuggccuggauggagugcugcugcgugagcagcgggaucuccgagcgcaugcucagccugcuggucguggacgugggcaacccggaggagguccggcuguucuccaagggguuccugguggcccuggugcaggucaugcccuggugcagcccccaggaguggcagcgccuccaccagcugacccggcgccugcucgagaagcagcugcugcacgugcccuacucccucgaguacauccaguucgugccgcugcugaaccucaagcccuucgcccaggagcugcagcugagcguccucuuccugcggaccuuccaguuccugugcucccacagcugccgcgacuggcucccccuggagggcuggaaccacguggugaagcugcucugcggcucccugacgcgccugcucgacagcguccgggcgauccaggccgccgggcccugggugcagggcccggagcaggaccugacccaggaggcccuguucguguacacccaggucuucugccacgcgcugcacaucauggccaugcuccaccccgaggugugcgagccccuguacgugcuggcccucgagacccugacgugcuacgagacccuguccaagaccaaccccagcgucuccagccuccugcagcgcgcccacgagcagcgguuccugaaguccaucgccgaggggaucggcccggaggagcgccggcagacccuccugcagaagaugagcuccuucuga

SEQ ID NO: 30527 - RNA, 504 nt, Artificial Sequence
  derived and/or modified sequence opt1 from GEMIN6__Homo_sapiens__NP_079051
augagcgaguggaugaagaagggcccccuggaguggcaggacuacaucuacaaggaggugcgcgucaccgccuccgagaagaacgaguacaaggggugggugcucaccacggacccggugagcgccaacaucguccuggugaacuuccuggaggacggcuccaugagcgugaccgggaucaugggccacgccguccagaccguggagaccaugaacgagggggaccaccgggugcgcgagaagcucaugcaccuguucacguccggcgacugcaaggccuacagccccgaggaccuggaggagcggaagaacucccucaagaaguggcuggagaagaaccacauccccaucaccgagcagggcgacgcgccccgcacccugugcgucgccggggugcucaccaucgacccgcccuacggccccgagaacugcagcuccagcaacgagaucauccugucccgggugcaggaccugaucgaggggcaccucacggccagccaguga

SEQ ID NO: 30528 - RNA, 2727 nt, Artificial Sequence
  derived and/or modified sequence opt1 from GEN1__Homo_sapiens__NP_872431
augggcgugaacgaccuguggcagauccucgagcccgucaagcagcacaucccgcugcgcaaccugggcggcaagaccaucgccguggaccucagccugugggugugcgaggcccagaccgucaagaagaugaugggguccgugaugaagccccaccuccggaaccucuucuuccgcaucagcuaccugacgcagauggacgugaagcuggucuucgugauggagggcgagccgcccaagcucaaggcggacgugaucuccaagcggaaccagagccgcuacggguccagcggcaaguccuggagccagaagaccggccggucccacuucaagagcguccugcgcgagugccugcacaugcucgagugccuggggauccccugggugcaggccgccggcgaggccgaggccaugugcgcguaccugaacgccgggggccacguggacgggugccucaccaacgacggcgacaccuuccuguacggcgcccagacggucuaccggaacuucaccaugaacaccaaggacccccacguggacugcuacaccauguccagcaucaaguccaagcuggggcucgaccgcgacgcccuggugggccuggcgauccuccuggggugcgacuaccugcccaagggcguccccggcguggggaaggagcaggcccucaagcugauccagauccugaagggccagagccuccugcagcgguucaaccgcuggaacgagacguccugcaacagcuccccgcagcugcucgugaccaagaagcuggcccacugcagcgucugcucccaccccgggagccccaaggaccacgagcggaacggcugccgccugugcaagagcgacaaguacugcgagccccacgacuacgaguacugcugcccgugcgaguggcaccggaccgagcacgaccgccagcucaacgagguggagaacaacaucaagaagaaggccugcugcugcgagggguuccccuuccacgaggugauccaggaguuccugcugaacaaggacaagcucgucaaggugauccgguaccagcgccccgaccugcugcuguuccagcgguucacccuggagaagauggaguggcccaaccacuacgccugcgagaagcugcucgugcugcugacgcacuacgacaugaucgagcgcaagcucggcucccggaacagcaaccagcugcagccgauccgcaucgucaagacccggauccgcaacggcgugcacugcuucgagaucgagugggagaagcccgagcacuacgcgauggaggacaagcagcacggggaguucgcccugcucaccaucgaggaggagucccuguucgaggccgccuaccccgagaucgucgccguguaccagaagcagaagcuggagaucaagggcaagaagcagaagcgcaucaagcccaaggagaacaaccugccggagcccgacgaggugaugagcuuccagucccacaugacccucaagcccacgugcgagaucuuccacaagcagaacagcaagcugaacuccgggaucagccccgacccgacccugccccaggaguccaucagcgcgucccucaacagccugcugcuccccaagaacacccccugccugaacgcccaggagcaguucauguccagccugcggccgcucgccauccagcagaucaaggccgucuccaagagccugaucuccgagagcucccagcccaacaccagcagccacaacaucuccgugaucgccgaccugcaccucagcacgaucgacugggagggcaccuccuucagcaacucccccgcgauccagcgcaacaccuucagccacgaccugaaguccgagguggagagcgagcuguccgccaucccggacggguucgagaacauccccgagcagcucagcugcgaguccgagcgguacaccgccaacaucaagaagguccuggacgaggacagcgacggcaucucccccgaggagcaccuccugagcggcaucacggaccugugccugcaggaccucccccugaaggagcgcaucuucaccaagcuguccuacccgcaggacaaccuccagcccgacgugaaccugaagacccugagcauccucuccgugaaggagagcugcaucgccaacagcggguccgacugcaccagccaccuguccaaggaccugcccggcaucccccuccagaacgagagccgggacuccaagauccugaagggggaccagcugcuccaggaggacuacaaggucaacacgagcgugccguacuccgugagcaacaccgucgugaagaccugcaacgugcgcccgcccaacaccgcccuggaccacucccggaaggucgacaugcagacgacccgcaagauccugaugaagaaguccgugugccucgaccggcacagcagcgacgagcaguccgcgcccguguucggcaaggccaaguacaccacccagcgcaugaagcacagcucccagaagcacaacagcucccacuucaaggagagcgggcacaacaagcuguccagccccaagauccacaucaaggagacggagcagugcguccggagcuacgagaccgccgagaacgaggaguccugcuuccccgacagcaccaaguccagccuguccagccuccagugccacaagaaggagaacaacuccgggaccugccuggacagcccccugccccuccgccagcggcugaagcugcgcuuccaguccaccuga

SEQ ID NO: 30529 - RNA, 984 nt, Artificial Sequence
  derived and/or modified sequence opt1 from GET4__Homo_sapiens__NP_057033
auggccgccgcggccgccauggccgagcaggagagcgcccgcaacggcgggcggaaccgcggcggggugcagcgggucgagggcaagcugcgcgcguccguggagaagggggacuacuacgaggcccaccagauguaccggacccucuucuuccgcuacaugagccaguccaagcacaccgaggcccgggagcugauguacagcggcgcccuccucuucuucucccacggccagcagaacagcgcggccgaccuguccaugcuggugcucgagagccuggagaaggccgaggucgagguggccgacgagcugcucgagaaccuggccaagguguucucccugauggaccccaacagcccggagcgcgucacguucgugucccgggcgcucaaguggagcuccgggggcagcgggaagcugggccacccccgccugcaccagcuccuggcccugacccucuggaaggagcagaacuacugcgagucccgguaccacuuccugcacagcgccgacggggagggcugcgccaacaugcugguggaguacuccaccagccgcggcuuccgguccgaggucgacauguucguggcccaggcggugcuccaguuccugugccugaagaacaagagcagcgccuccgucguguucaccacguacacccagaagcaccccagcaucgaggacgggcccccguucguggagccccuccugaacuucaucugguuccugcuccuggccgucgacggcgggaagcugaccguguucaccgugcucugcgagcaguaccagcccucccugcgccgggaccccauguacaacgaguaccuggaccgcaucggccagcuguucuucggcgucccgcccaagcagacgagcuccuacgggggccugcuggggaaccuccugaccagccugaugggcuccagcgagcaggaggacggggaggagucccccagcgacggcucccccaucgagcucgacuga

SEQ ID NO: 30530 - RNA, 1296 nt, Artificial Sequence
  derived and/or modified sequence opt1 from GFAP__Homo_sapiens__NP_001124491
auggagcgccggcgcaucaccagcgccgcccggcgcuccuacgugagcuccggcgagaugauggucgggggccuggcgcccgggcggcgccugggccccgggacccggcugagccuggcccgcaugcccccgccccuccccacgcggguggacuucucccuggccggcgcccugaacgccggcuucaaggagacccgcgcgagcgagcgggccgagaugauggagcucaacgaccgcuucgccuccuacaucgagaaggugcgguuccuggagcagcagaacaaggcccuggcggccgagcucaaccagcugcgcgccaaggagcccaccaagcuggccgacgucuaccaggccgagcuccgggagcugcgccugcggcucgaccagcugaccgcgaacagcgcccgccuggagguggagcgggacaaccucgcccaggaccuggccacggugcgccagaagcugcaggacgagaccaaccuccggcuggaggccgagaacaaccuggcggccuaccgccaggaggccgacgaggccacccucgcccgccuggaccuggagcggaagaucgagucccucgaggaggagauccgcuuccugcggaagauccacgaggaggagguccgcgagcugcaggagcagcucgcgcggcagcagguccacguggagcuggacguggccaagcccgaccugaccgccgcccucaaggagauccgcacgcaguacgaggccauggcgagcuccaacaugcacgaggccgaggagugguaccggagcaaguucgccgaccugaccgacgccgcggcccgcaacgccgagcugcuccggcaggccaagcacgaggccaacgacuaccgccggcagcugcagucccugaccugcgaccucgagagccugcgcgggaccaacgagucccuggagcggcagaugcgcgagcaggaggagcggcacgugcgcgaggcggccagcuaccaggaggcccucgcccggcuggaggaggagggccagucccugaaggacgagauggcccgccaccuccaggaguaccaggaccugcugaacgugaagcucgcgcuggacaucgagaucgccacguaccggaagcugcuggagggggaggagaaccgcaucaccauccccguccagaccuucagcaaccuccagauccgcggcgggaaguccaccaaggacggcgagaaccacaaggugacgcgguaccucaagagccugaccauccgcgugaucccgauccaggcccaccagaucgucaacggcaccccgcccgcccggggguga

SEQ ID NO: 30531 - RNA, 618 nt, Artificial Sequence
  derived and/or modified sequence opt1 from GFER__Homo_sapiens__NP_005253
auggccgcccccggcgagcgcgggcgguuccacggcgggaaccuguucuuccugccgggcggggcgcgcagcgagaugauggacgaccuggccaccgacgcccggggccgcggcgccgggcggcgcgacgccgcggccuccgccagcacccccgcccaggcgcccacguccgacagccccguggccgaggacgccucccggcgccggccgugccgcgccugcgucgacuucaagaccuggaugcggacccagcagaagcgcgacaccaaguuccgggaggacugcccgcccgaccgcgaggagcugggccggcacagcugggccgugcuccacacgcuggcggccuacuaccccgaccugcccacccccgagcagcagcaggacauggcccaguucauccaccucuucuccaaguucuaccccugcgaggagugcgccgaggaccugcgcaagcggcugugccgcaaccaccccgacacccggacccgcgccugcuucacgcaguggcucugccaccuccacaacgaggugaaccggaagcuggggaagccggacuucgacugcagcaaggucgacgagcgcuggcgcgacggcuggaaggacggguccugcgacuga

SEQ ID NO: 30532 - RNA, 855 nt, Artificial Sequence
  derived and/or modified sequence opt1 from GFI1B__Homo_sapiens__NP_001128503
augccccgcagcuuccuggugaaguccaagaaggcccacaccuaccaccagccgcggguccaggaggacgagccccucuggccgcccgcccugacccccgugccccgcgaccaggcgcccagcaacucccccgugcugagcacgcuguucccgaaccagugccuggacuggaccaaccugaagcgggagcccgagcucgagcaggaccagaaccuggcccgcauggcccccgcccccgagggcccgaucguccugucccggccccaggacggggacagcccccucuccgacagcccgcccuucuacaagcccuccuucagcugggacacccuggccaccacguacggccacuccuaccgccaggcgcccagcaccaugcaguccgccuuccuggagcacagcgugucccucuacgggagcccccuggugccguccaccgagcccgcccuggacuucagccuccgguacucccccggcauggacgccuaccacugcgucaagugcaacaaggagcgcagcuucgagugccggaugugcgggaaggcguucaagcgcagcuccacccugagcacgcaccuccucauccacuccgacacccggcccuacccgugccaguucugcggcaagcgcuuccaccagaaguccgacaugaagaagcacaccuacauccacaccggcgagaagccccacaagugccaggugugcgggaaggccuucagccagagcuccaaccugaucacgcacagccggaagcacaccggcuucaagcccuucuccugcgagcugugcaccaagggguuccagcgcaagguggaccuccggcgccaccgggagagccagcacaaccugaaguga

SEQ ID NO: 30533 - RNA, 1269 nt, Artificial Sequence
  derived and/or modified sequence opt1 from GFI1__Homo_sapiens__XP_011539548
augccccgcagcuuccuggugaaguccaagaaggcccacagcuaccaccagccgcggucccccggccccgacuacagccuccgccuggagaacguccccgccccgucccgggcggacagcaccuccaacgccgggggcgccaaggccgagccccgcgaccggcugagccccgagucccagcucaccgaggcccccgaccgcgcgagcgccuccccggacagcugcgagggguccgugugcgagcggagcuccgaguucgaggacuucuggcgcccgcccagccccuccgccagccccgccuccgagaaguccaugugccccagccuggacgaggcgcagcccuucccccugccguucaagcccuacagcuggagcggccucgccggguccgaccugcggcaccuggugcagagcuaccgccccugcggcgcccucgagcggggcgccgggcugggccuguucugcgagcccgccccggagcccgggcaccccgcggcccucuacggccccaagcgcgccgccgggggcgccggcgcgggggccccgggcuccugcagcgccggggccggcgccacggcgggccccgggcugggccuguacggggacuucggcuccgccgccgccgggcucuacgagcggcccaccgccgcggccggccugcuguaccccgagcgcggccacgggcuccacgccgacaagggcgccggggucaagguggagagcgagcugcugugcacccggcuccugcugggcgggggcuccuacaagugcaucaagugcagcaagguguucuccaccccgcacggccucgagguccacgugcgccggagccacuccgggacgcgccccuucgcgugcgagaugugcggcaagaccuucgggcacgccgugagccuggagcagcacaaggccguccacucccaggagcggagcuucgacugcaagaucugcggcaaguccuucaagcgcagcuccacccugagcacccaccuccugauccacagcgacacgcggcccuacccgugccaguacugcgggaagcgcuuccaccagaaguccgacaugaagaagcacaccuucauccacaccggcgagaagccccacaagugccaggugugcggcaaggccuucagccaguccagcaaccugaucacccacucccgcaagcacacgggguucaagcccuucggcugcgaccucugcgggaagggcuuccagcggaagguggaccugcgccggcaccgcgagacccagcacggccugaaguga

SEQ ID NO: 30534 - RNA, 2256 nt, Artificial Sequence
  derived and/or modified sequence opt1 from GFM1__Homo_sapiens__NP_079272
augcgccugcucggcgccgccgcgguggccgcccuggggcggggccgcgcccccgccagccugggguggcagcggaagcaggucaacuggaaggcgugccgcugguccagcuccggcgugaucccgaacgagaagauccggaacaucgggaucagcgcccacaucgacuccggcaagaccacccucacggagcgcgugcuguacuacaccggccggaucgccaagaugcacgaggucaaggggaaggacggcgugggggccgugauggacagcauggagcuggagcgccagcggggcaucaccauccaguccgcggccaccuacacgauguggaaggacgucaacaucaacaucaucgacacccccgggcacguggacuucaccaucgagguggagcgcgcccuccggguccuggacggcgccgugcuggugcucugcgccgucggcggggugcagugccagaccaugacggugaaccgccagaugaagcgguacaacguccccuuccugaccuucaucaacaagcuggaccgcaugggcagcaaccccgcgcgggcccuccagcagaugcgcuccaagcugaaccacaacgccgccuucaugcagaucccgauggggcuggagggcaacuucaagggcaucguggaccucaucgaggagcgggccaucuacuucgacggggacuucggccagaucgugcgcuacggggagauccccgcggagcugcgggccgccgccaccgaccaccgccaggagcugaucgagugcgucgccaacagcgacgagcagcucggcgagauguuccuggaggagaagauccccuccaucagcgaccugaagcucgcgauccggcgcgccacccugaagcgcuccuucacgcccguguuccuggggagcgcccucaagaacaagggcgugcagccgcugcuggacgccguccucgaguaccugcccaaccccuccgaggugcagaacuacgccauccugaacaaggaggacgacagcaaggagaagaccaagauccucaugaacuccagccgggacaacucccaccccuucgugggccuggcguucaagcuggaggucgggcgcuucggccagcucaccuacgugcggagcuaccagggggagcugaagaagggcgacaccaucuacaacacgcgcacccggaagaagguccgccugcagcggcucgcccgcaugcacgccgacaugauggaggacguggaggagguguacgccggggacaucugcgcgcuguucggcaucgacugcgccagcggcgacaccuucaccgacaaggccaacuccgggcugagcauggaguccauccacgucccggaccccgugaucagcaucgccaugaagcccuccaacaagaacgaccucgagaaguucagcaagggcaucgggcgguucacgcgcgaggaccccaccuucaagguguacuucgacaccgagaacaaggagaccgucaucuccggcaugggggagcugcaccuggagaucuacgcccagcggcucgagcgcgaguacggcugcccgugcaucacgggcaagcccaagguggcguuccgggagaccaucaccgcccccgugcccuucgacuucacccacaagaagcagagcgggggcgccgggcaguacggcaaggucaucggcgugcuggagccgcuggaccccgaggacuacacgaagcucgaguucuccgacgagaccuucgggagcaacauccccaagcaguucgugcccgccgucgagaagggcuuccuggacgccugcgagaaggggccgcuguccggccacaagcucagcgggcugcgcuucgugcugcaggacggcgcgcaccacaugguggacuccaacgagaucagcuucauccgggccggcgagggggcccugaagcaggcccucgccaacgcgacccugugcauccuggagcccaucauggccgucgaggugguggcccccaacgaguuccagggccaggucaucgccgggaucaaccgccggcacggcgugaucaccgggcaggacggcguggaggacuacuucacgcucuacgcggacgucccccugaacgacauguucggcuacuccaccgagcugcgcagcugcaccgaggggaagggcgaguacaccauggaguacucccgguaccagccgugccuccccagcacgcaggaggacgugaucaacaaguaccuggaggccaccgggcagcugcccgugaagaagggcaaggccaagaacuga

SEQ ID NO: 30535 - RNA, 2100 nt, Artificial Sequence
  derived and/or modified sequence opt1 from GFPT1__Homo_sapiens__NP_001231639
augugcggcaucuucgcguaccugaacuaccacgugccccgcacccggcgcgagauccucgagacccugaucaaggggcugcagcggcucgaguaccgcggcuacgacagcgccggggucggcuucgacgggggcaacgacaaggacugggaggcgaacgccugcaagauccagcugaucaagaagaagggcaaggugaaggcccuggacgaggaggugcacaagcagcaggacauggaccucgacaucgaguucgacguccaccuggggaucgcccacacgcggugggccacccacggcgagccgucccccgugaacagccacccccagcgcuccgacaagaacaacgaguucaucgugauccacaacgggaucaucaccaacuacaaggaccugaagaaguuccucgagagcaagggcuacgacuucgaguccgagaccgacacggagaccaucgcgaagcuggucaaguacauguacgacaaccgggagagccaggacaccuccuucaccacgcugguggagcgcgugauccagcagcucgagggggccuucgcccuggucuucaagagcgugcacuuccccggccaggccgugggcacccggcgcggguccccgcugcucaucggcguccggagcgagcacaagcuguccaccgaccacauccccauccuguaccgcaccgcgcggacgcagaucgggagcaaguucacccgcuggggcucccagggcgagcgggggaaggacaagaagggcagcugcaaccucucccgcguggacagcacgaccugccuguuccccguggaggagaaggccgucgaguacuacuucgccuccgacgccagcgccgugaucgagcacaccaaccgggugaucuuccuggaggacgacgacgucgcggccgugguggacgggcgccucuccauccaccggaucaagcgcaccgccggcgaccaccccgggcgggccguccagacccugcagauggagcugcagcagaucaugaagggcaacuucagcagcuucaugcagaaggagaucuucgagcagccggaguccguggugaacaccaugcgcggccgcgucaacuucgacgacuacacggugaaccucgggggccugaaggaccacaucaaggagauccagcggugccgccggcugauccucaucgccugcgggaccagcuaccacgcgggcgucgccacccgccaggugcuggaggagcugaccgagcuccccgugauggucgagcuggccuccgacuuccuggaccggaacacgcccguguuccgcgacgacgugugcuucuuccucagccaguccggggagaccgccgacacccugaugggccugcgguacugcaaggagcgcggcgcccucaccgucgggaucacgaacaccgugggcagcuccaucagccgggagaccgacugcggggugcacaucaacgcgggccccgagaucggggucgccuccaccaaggccuacacgagccaguucgugucccuggugauguucgcccugaugaugugcgacgaccgcaucagcaugcaggagcggcgcaaggagaucaugcucggccugaagcggcugccggaccucaucaaggagguccuguccauggacgacgagauccagaagcuggccaccgagcucuaccaccagaaguccgugcugaucaugggccgcggguaccacuacgcgaccugccuggagggcgcccucaagaucaaggagaucaccuacaugcacagcgaggggauccuggccggcgagcugaagcacggcccccuggcccucguggacaagcugaugcccgucaucaugaucaucaugcgggaccacacguacgcgaagugccagaacgcccugcagcaggucguggcccgccaggggcggcccguggugaucugcgacaaggaggacaccgagaccaucaagaacaccaagcgcaccaucaaggugccgcacagcgucgacugccuccagggcauccuguccgugaucccccugcagcuccuggccuuccaccuggccgugcuccggggguacgacgucgacuucccccgcaaccuggccaagagcgugacgguggaguga

SEQ ID NO: 30536 - RNA, 2049 nt, Artificial Sequence
  derived and/or modified sequence opt1 from GFPT2__Homo_sapiens__NP_005101
augugcggcaucuucgccuacaugaacuaccgcgugccccggacccgcaaggagaucuucgagacccugaucaaggggcuccagcggcuggaguaccgcggcuacgacagcgccggggucgcgaucgacggcaacaaccacgaggugaaggagcggcacauccagcuggugaagaagcgcgggaaggucaaggcccucgacgaggagcuguacaagcaggacuccauggaccugaagguggaguucgagacgcacuucggcaucgcccacacccggugggccacccacggcgugccgagcgccgucaacucccacccccagcgcagcgacaaggggaacgaguucguggugauccacaacggcaucaucaccaacuacaaggaccuccggaaguuccuggaguccaagggguacgaguucgagagcgagacggacaccgagaccaucgcgaagcugaucaaguacgucuucgacaaccgcgagaccgaggacaucacguucuccacccucguggagcgggugauccagcagcuggagggcgccuucgcccuggucuucaagagcgugcacuaccccggggaggccguggcgacccgccggggcagcccccuccugaucggcguccgcuccaaguacaagcuguccaccgagcagaucccgauccucuaccggacgugcacccuggagaacgugaagaacaucugcaagacccgcaugaagcggcuggacagcuccgccugccuccacgccgugggggacaaggccgucgaguucuucuucgccagcgacgcguccgccaucaucgagcacaccaaccgcgugaucuuccuggaggacgacgacaucgccgccguggccgacggcaagcugagcauccaccgggucaagcgcuccgcgagcgacgaccccucccgggccauccagacgcuccagauggagcugcagcagaucaugaaggggaacuucagcgccuucaugcagaaggagaucuucgagcagcccgagagcguguucaacaccaugcgcggccgcgugaacuucgagaccaacaccguccugcucggcgggcugaaggaccaccugaaggagauccggcgcugccggcgccucaucgugaucggcugcgggacguccuaccacgccgccgucgcgacccgccaggugcuggaggagcugaccgagcuccccgugauggucgagcuggccagcgacuuccuggaccggaacaccccgguguuccgggacgacgugugcuucuucaucucccagagcggcgagacggccgacacccuccuggcccugcgcuacugcaaggaccgcggggcccucaccgucggcgugaccaacacggugggcuccagcaucucccgggagaccgacugcgggguccacaucaacgcgggccccgagaucgggguggccagcaccaaggccuacaccucccaguucaucagccuggugauguucggccugaugauguccgaggaccggaucagccuccagaaccgccggcaggagaucauccgcgggcugcggucccugcccgagcucaucaaggagguccugagccuggaggagaagauccacgaccucgcccuggagcuguacacgcagcgcucccuccuggugaugggccggggcuacaacuacgcgaccugccuggagggggcccugaagaucaaggagaucaccuacaugcacagcgagggcauccucgccggggagcugaagcacggcccccuggcccucaucgacaagcagaugccggugaucauggucaucaugaaggaccccugcuucgccaagugccagaacgcgcugcagcaggucaccgcccgccaggggcggcccaucauccugugcuccaaggacgacacggagagcuccaaguucgccuacaagaccaucgagcucccccacaccguggacugccugcagggcauccugagcgugaucccgcuccagcugcugagcuuccaccucgccgugcugcgcggcuacgacguggacuucccccgcaaccuggccaaguccgucaccguggaguga

SEQ ID NO: 30537 - RNA, 1383 nt, Artificial Sequence
  derived and/or modified sequence opt1 from GFRA1__Homo_sapiens__NP_001138925
auguuccuggccacccucuacuucgcccugccccugcucgaccugcugcucagcgcggagguguccggcggggaccgccuggacugcgucaaggccagcgaccagugccugaaggagcaguccugcagcaccaaguaccggacgcuccgccagugcguggccggcaaggagaccaacuucucccuggccagcgggcuggaggccaaggacgagugccgguccgcgauggaggcccucaagcagaagucccuguacaacugccgcugcaagcggggcaugaagaaggagaagaacugccugcgcaucuacuggagcauguaccagagccuccaggggaacgaccugcuggaggacuccccguacgagcccgugaacagccggcucuccgacaucuuccgcgucgugcccuucaucagcguggagcacauccccaagggcaacaacugccuggacgccgccaaggcgugcaaccuggacgacaucugcaagaaguaccgguccgccuacaucaccccgugcaccacgagcgucuccaacgacgugugcaaccgccggaagugccacaaggcccuccgccaguucuucgacaaggugcccgccaagcacagcuacggcaugcuguucugcuccugccgggacaucgccugcaccgagcgccggcgccagaccaucguccccgugugcagcuacgaggagcgggagaagcccaacugccugaaccuccaggacagcugcaagaccaacuacaucugccgcucccggcuggcggacuucuucacgaacugccagccggagagccgcuccgugagcuccugccugaaggagaacuacgccgacugccuccuggccuacagcgggcugaucggcaccgucaugacccccaacuacaucgacuccagcucccucagcguggcccccuggugcgacugcuccaacagcgggaacgaccuggaggagugccugaaguuccucaacuucuucaaggacaacacgugccugaagaacgccauccaggcguucggcaacggguccgacgugaccgucuggcagcccgccuucccggugcagaccaccaccgccacgaccaccaccgcccugcgggugaagaacaagccccucggccccgccggcagcgagaacgagauccccacgcacguccugccgcccugcgcgaaccugcaggcccagaagcucaaguccaacgugagcgggaacacccaccugugcaucuccaacggcaacuacgagaaggaggggcugggcgccagcucccacaucaccaccaagagcauggccgccccgcccagcugcggccucagcccccugcuggugcucgucgugacggcgcuguccacccugcucucccugaccgagaccagcuga

SEQ ID NO: 30538 - RNA, 996 nt, Artificial Sequence
  derived and/or modified sequence opt1 from GFRA2__Homo_sapiens__NP_001158511
augauccuggccaacguguucugccucuucuucuuccugggcaccggggccgaccccgucgugagcgcgaaguccaaccacugccuggacgccgccaaggccugcaaccucaacgacaacugcaagaagcugcgcagcuccuacaucagcaucugcaaccgggagaucuccccgaccgagcgcugcaaccggcgcaagugccacaaggcccugcggcaguucuucgaccgcgugcccagcgaguacacguaccggaugcuguucugcuccugccaggaccaggcgugcgccgagcgccggcgccagaccauccuccccagcugcuccuacgaggacaaggagaagcccaacugccuggaccuccggggcgucugccgcaccgaccaccugugccggagccgccuggccgacuuccacgccaacugccgggcguccuaccagaccgugacgagcugcccggccgacaacuaccaggccugccucggguccuacgccggcaugaucggguucgacaugacccccaacuacguggacagcucccccaccggcaucgucgugagccccuggugcuccugccgcggcagcgggaacauggaggaggagugcgagaaguuccugcgggacuucaccgagaacccgugccugcgcaacgccauccaggcguucggcaacgggacggacgugaacgucucccccaagggccccagcuuccaggccacccaggcgccccggguggagaagaccccgagccuccccgacgaccuguccgacagcaccucccuggggacgagcgugaucacgaccugcaccuccguccaggagcagggccucaaggccaacaacagcaaggagcuguccaugugcuucaccgagcugaccaccaacaucauccccggcagcaacaaggugaucaagcccaacuccgggccgagccgcgcccggcccuccgccgcccucaccgugcugagcguccugaugcucaagcuggcccuguga

SEQ ID NO: 30539 - RNA, 1203 nt, Artificial Sequence
  derived and/or modified sequence opt1 from GFRA3__Homo_sapiens__NP_001487
auggugcgcccccugaacccgcggccccucccgcccgucgugcugaugcugcuccugcugcucccgcccagcccccugccccuggccgccggcgacccccuccccaccgagucccgccugaugaacagcugccugcaggcgcggcgcaagugccaggccgacccgaccugcuccgccgccuaccaccaccucgacagcugcacguccagcaucuccacgccccugcccagcgaggagcccuccgugcccgccgacugccuggaggcggcccagcagcuccggaacagcucccugaucgggugcaugugccaccgccggaugaagaaccaggucgccugccuggacaucuacuggaccgugcaccgcgcccggagccucggcaacuacgagcuggacgugucccccuacgaggacaccgucaccagcaagccguggaagaugaaccuguccaagcucaacaugcugaagcccgacagcgaccugugccucaaguucgcgaugcugugcacccugaacgacaagugcgaccgccuccggaaggccuacggggaggccugcuccggcccccacugccagcgccacgugugccugcggcagcugcucaccuucuucgagaaggccgccgagccccacgcgcaggggcugcugcucugcccgugcgcccccaacgaccgcggcugcggcgagcggcgccggaacaccaucgcccccaacugcgcccugcccccgguggcccccaacugccuggagcuccgccggcugugcuucagcgacccccugugccgcucccggcucgucgacuuccagacgcacugccaccccauggacauccuggggaccugcgcgaccgagcagagccgcugccugcgcgccuaccucggccugaucgggaccgccaugacgccgaacuucgugagcaacgugaacaccuccgucgcccugagcugcacgugccggggcuccgggaaccuccaggaggagugcgagaugcuggagggcuucuucagccacaaccccugccugaccgaggccaucgcggccaagaugcgcuuccacucccagcuguucagccaggacuggccccacccgaccuucgccgugauggcccaccagaacgagaaccccgccgugcggccccagcccugggucccgucccucuucagcugcacccugccccugauccuccugcugucccucugguga

SEQ ID NO: 30540 - RNA, 810 nt, Artificial Sequence
  derived and/or modified sequence opt1 from GFRA4__Homo_sapiens__NP_071422
auggugcgcugccugggccccgcccuccugcugcuccugcugcucgggagcgccuccagcgucggcgggaaccggugcguggacgcggccgaggccugcaccgccgacgcccgcugccagcggcugcgcuccgaguacguggcgcagugccugggccgggccgcccagggcgggugcccgcgcgcccggugccgccgggcgcuccgccgguucuucgcccgcggcccgcccgcccugacccacgcccuccucuucugccccugcgccgggcccgcgugcgccgagcggcgccggcagacguucguccccagcugcgccuucuccggccccgggcccgccccgcccagcugccuggagccccugaacuucugcgagcgcucccgggugugccgcccccggcuccuggccuuccaggugagcugcaccccggcgcccuccgcccccgacggcugccugcucgaccagggggcccgcugccugcgggccuacgccggccuggucggcaccgcggugacccccaacuacguggacaacgucagcgcccgcguggccccguggugcgacugcggggccuccggcaaccgccgggaggacugcgaggccuuccgcgggcuguucacgcggaaccgcugccuggacggcgcgauccaggccuucgccagcggcuggccgcccgugcugcucgaccagcugaacccccagggggaccccgagcacucccugcuccaggucagcuccaccggccgggcccuggagcgccggagccugcucuccauccugcccgugcuggcgcuccccgcccugcuguga

SEQ ID NO: 30541 - RNA, 1659 nt, Artificial Sequence
  derived and/or modified sequence opt1 from GGA1__Homo_sapiens__NP_001001560
auggagcccgccauggagccggagacccuggaggcccgcaucaaccgggcgaccaacccccucaacaaggagcuggacugggccagcaucaacggcuucugcgagcagcugaacgaggacuucgaggggcccccccucgccacgcgccugcuggcccacaagauccaguccccgcaggagugggaggccauccaggcgcucaccgugcuggagaccugcaugaagagcugcggcaagcgguuccacgacgaggucgggaaguuccgcuuccugaacgagcucaucaagguggugucccccaaguaccugggcagccggaccuccgagaaggucaagaacaagauccuggagcuccuguacagcuggacgguggggcugcccgaggaggugaagaucgccgaggccuaccagaugcucaagaagcagggcaucgucaaguccgaccccaagcugccggacgacaccaccuucccccugccccccccgcgccccaagaacgugaucuucgaggacgaggagaagagcaagaugcucgcccggcugcugaaguccagccaccccgaggaccuccgcgcggccaacaagcugaucaaggagauggugcaggaggaccagaagcggauggagaagaucuccaagcgcgucaacgccaucgaggaggugaacaacaacgugaagcugcucaccgagauggucaugagccacucccagggcggggccgccgcgggcagcuccgaggaccugaugaaggagcuguaccagcggugcgagcgcaugcggcccacgcucuuccgccuggccagcgacaccgaggacaacgacgaggcccuggggcucuccgacccgaccccccccagcggccccucccuggacgggaccggcuggaacagcuuccagagcuccgacgccacggagccgcccgcccccgcgcuggcccaggcccccagcauggagucccggccgcccgcccagaccagccuccccgccuccagcggccuggacgaccuggaccuccuggggaagacccugcuccagcagucccugcccccggagagccagcaggugcgcugggagaagcagcagcccaccccccggcugacgcuccgcgaccugcagaacaaguccagcuccugcagcuccccgagcuccagcgcgaccucccugcuccacaccgugagccccgagcccccccggccgccccagcagcccguccccaccgagcugucccuggccagcaucacggugccgcucgagagcaucaagcccuccaacauccugcccgugaccgucuacgaccagcacggcuuccgcauccuguuccacuucgcccgggacccccugccggggcgcagcgacgugcucguggucgugguguccaugcugagcaccgccccccagcccauccgcaacaucgucuuccaguccgccgugcccaaggucaugaaggugaagcugcagccgcccagcggcaccgagcuccccgcguucaaccccaucgugcacccguccgccaucacgcagguccugcugcucgccaacccccagaaggagaaggugcggcugcgcuacaagcugaccuucaccaugggcgaccagaccuacaacgagaugggggacguggaccaguucccccccccggagacguggggcagccucuga

SEQ ID NO: 30542 - RNA, 1779 nt, Artificial Sequence
  derived and/or modified sequence opt1 from GGA3__Homo_sapiens__NP_001166175
auggcccugcccgaggaggccaagaucaaggacgcguaccacaugcucaagcgccagggcaucgugcagagcgacccgcccauccccgucgaccggacccugauccccuccccgccgccccgccccaagaaccccguguucgacgacgaggagaaguccaagcugcucgccaagcugcugaaguccaagaaccccgacgaccuccaggaggccaacaagcugaucaagagcauggugaaggaggacgaggcccggauccagaaggucaccaagcgccugcacacgcucgaggaggugaacaacaacgugcggcugcuguccgagaugcuccugcacuacagccaggaggacuccagcgacggggaccgcgagcugaugaaggagcuguucgaccagugcgagaacaagcggcgcacccuguucaagcuggccuccgagaccgaggacaacgacaacagccucggcgacauccugcaggcguccgacaaccugagccgggucaucaacuccuacaagaccaucaucgagggccaggugaucaacggcgagguggccacgcucacccugcccgacagcgaggggaacucccagugcagcaaccaggggacccucaucgaccucgccgagcuggacaccacgaacagccugagcuccgugcucgcccccgcgccgaccccgcccagcagcggcauccccauccugcccccgccgccccaggccuccgggccgccccgcagccgguccagcucccaggccgaggccacccugggccccagcuccaccagcaacgcccucuccuggcuggacgaggagcugcucugccuggggcuggcggaccccgcccccaacgugccgcccaaggagagcgccggcaacucccaguggcaccuccugcagcgcgagcagagcgaccuggacuucuucagcccccggcccgggacggccgccugcggcgcgagcgacgcgccccuccugcagcccuccgccccgagcuccagcuccagccaggcgccccugccgccgcccuuccccgcccccgugguccccgccagcgugcccgcccccuccgccggcagcucccucuucagcaccgggguggcccccgcccuggcccccaaggucgagccggccgugcccggccaccacgggcuggcccucggcaacuccgcccugcaccaccuggacgcgcucgaccagcugcuggaggaggccaaggugaccagcggccuggucaagcccaccacgagcccccucaucccgaccaccacccccgcccgcccccugcugcccuucuccacggggccgggcagcccccucuuccagccccuguccuuccagucccagggguccccgcccaagggccccgagcugucccucgccagcauccacgugccccuggaguccaucaagcccagcuccgcccugcccgugaccgcguacgacaagaacggguuccggauccucuuccacuucgccaaggagugcccgcccggccgccccgacguccuggugguggucgugagcaugcugaacaccgcgccccuccccgucaagagcaucgugcugcaggccgccgugcccaaguccaugaaggucaagcugcagccgcccagcggcaccgagcucucccccuucagccccauccagccgcccgccgccaucacccaggugaugcugcuggccaacccccucaagaagcagguccuguccuuccuggggaaggccugccuccagcccuggggccaggccauccugcugacgaccagcugccucgcguga

SEQ ID NO: 30543 - RNA, 462 nt, Artificial Sequence
  derived and/or modified sequence opt1 from GGACT__Homo_sapiens__NP_149101
auggcccugguguucgucuacggcacccucaagcgcgggcagcccaaccaccgggugcugcgcgacggcgcccacgggagcgcggccuuccgggcccgcggccggacccuggagccguacccccucgugaucgccggggagcacaacauccccuggcugcugcaccuccccggcuccggccgccuggucgagggggagguguacgccguggacgagcggaugcugcgcuuccucgacgacuucgagagcugcccggcgcuguaccagcggacgguccugcgcgugcagcuccuggaggaccgggcccccggcgccgaggagccgcccgcccccaccgcggugcagugcuucgucuacucccgcgccaccuucccgcccgagugggcccagcugccccaccacgacagcuacgacuccgaggggccccacggccuccgguacaacccccgcgagaaccgguga

SEQ ID NO: 30544 - RNA, 501 nt, Artificial Sequence
  derived and/or modified sequence opt1 from GGCT__Homo_sapiens__NP_001186744
auggccaacagcggcugcaaggacgugaccgggcccgacgaggaguccuuccuguacuucgccuacggcagcaaccuccugaccgagcgcauccaccuccggaacccguccgcggccuucuucugcgucgcccgccugcaggacuucaagcuggacuucgggaacagccagggcaagacgucccagaccuggcacgggggcaucgccaccaucuuccagagccccggcgacgagguguggggcguggucuggaagaugaacaaguccaaccugaacagccucgacgaguggcggaagaagcgccacaccgccuuccagaaccagggcaaccaccccugcaagcacaagacgcggaugugggaccgcgaccccaagaucccggugcagaaccugucccuggcgcucugcuggcaggcccagagcgggcacgggaccugcaaccggcuguucgccugggugcagaagaagauggucugccgcugguccaucaagcggagcuga

SEQ ID NO: 30545 - RNA, 2277 nt, Artificial Sequence
  derived and/or modified sequence opt1 from GGCX__Homo_sapiens__NP_000812
auggccgugagcgccggcuccgcgcgcaccagccccuccagcgacaagguccagaaggacaaggccgagcugaucuccgggccgcggcaggacagccgcaucggcaagcuccugggguucgaguggaccgaccuguccagcuggcggcgccucgugacgcugcugaaccggcccaccgaccccgccucccucgccguguuccgcuuccuguucggcuuccugaugguccucgacaucccccaggagcgggggcugagcucccuggaccgcaaguaccucgacggccuggacgugugccgguucccgcugcucgacgcccugcgcccccugccccucgacuggauguaccugguguacaccaucauguuccugggcgcgcucgggaugaugcugggccugugcuaccggaucagcugcguccucuuccugcugcccuacugguacguguuccuccuggacaagaccuccuggaacaaccacagcuaccuguacgggcuccuggccuuccagcugacguucauggacgccaaccacuacugguccguggacggccuccugaacgcccaccgccggaacgcgcacgucccgcuguggaacuacgccgugcuccgcgggcagaucuucaucguguacuucaucgccggcgucaagaagcuggacgccgacuggguggagggcuacagcauggaguaccugucccggcacuggcuguucagccccuucaagcuccugcucuccgaggagcugaccagccugcucgugguccacuggggcgggcugcugcucgaccugagcgccggguuccugcuguucuucgacgugucccgcagcaucggccucuucuucguguccuacuuccacugcaugaacagccagcuguucuccaucggcauguucagcuacgucaugcuggcguccagcccccucuucugcucccccgaguggccgcggaagcuggugagcuacugcccccgccggcugcagcagcuccugccccugaaggccgcgccccagccguccgugagcugcgucuacaagcgcucccggggcaagagcgggcagaagcccgggcuccgccaccagcugggcgccgccuucacccugcucuaccugcuggagcagcuguuccuccccuacucccacuuccugacccagggguacaacaacuggacgaacggccucuacggcuacagcugggacaugauggugcacucccgcagccaccagcacgugaagaucaccuaccgggacgggcgcaccggcgagcugggguaccugaaccccggcgucuucacccagucccggcgcuggaaggaccacgccgacaugcucaagcaguacgccacgugccugagccggcugcucccgaaguacaacgugaccgagccccagaucuacuucgacaucugggucagcaucaacgaccgcuuccagcagcggaucuucgacccccgcguggacaucgugcaggccgccuggucccccuuccagcggaccagcuggguccagccgcugcugauggaccucucccccuggcgcgccaagcugcaggagaucaagagcucccuggacaaccacaccgaggugguguucaucgcggacuuccccgggcuccaccuggagaacuucgucagcgaggaccugggcaacacguccauccagcuccugcagggcgaggugaccguggagcuggucgccgagcagaagaaccagacccuccgggagggggagaagaugcagcugcccgccggcgaguaccacaagguguacaccacgagcccgucccccagcugcuacauguacguguacgucaacaccaccgagcuggcccucgagcaggaccuggccuaccugcaggagcucaaggagaagguggagaacggguccgagaccggcccccugccgcccgagcugcagccccuccuggagggggaggugaagggcggccccgagccgacgccccugguccagaccuuccuccgccggcagcagcgccugcaggagaucgagcggcgccggaacacccccuuccacgagcgcuucuuccgguuccugcuccgcaagcuguacguguuccgccggagcuuccugaugaccugcaucucccuccgcaaccugauccuggggcggcccagccucgagcagcuggcgcaggaggugacguacgccaaccugcgcccguucgaggccgucggcgagcucaaccccuccaacaccgacagcucccacagcaacccgcccgagagcaaccccgaccccgugcacuccgaguucuga

SEQ ID NO: 30546 - RNA, 957 nt, Artificial Sequence
  derived and/or modified sequence opt1 from GGH__Homo_sapiens__NP_003869
auggccagccccggcugccugcucugcgugcuggggcugcuccugugcggcgccgcgucccuggagcucagccgcccgcacggggacaccgccaagaagcccaucaucggcauccugaugcagaagugccggaacaaggucaugaagaacuacgggcgcuacuacaucgccgccuccuacgugaaguaccuggagagcgccggcgcgcgggugguccccgugcgccucgaccugaccgagaaggacuacgagauccuguucaaguccaucaacggcauccucuuccccgggggcagcguggaccugcggcgcuccgacuacgccaaggucgccaagaucuucuacaaccugagcauccaguccuucgacgacggggacuacuucccgguguggggcacgugccucggguucgaggagcugagccugcucaucuccggcgagugccugcugaccgccaccgacaccguggacgucgcgaugccccucaacuucacgggcgggcagcugcacagccggauguuccagaacuuccccaccgagcugcuccugucccuggccguggagccccucaccgccaacuuccacaaguggagccuguccgugaagaacuucaccaugaacgagaagcugaagaaguucuucaacguccucacgaccaacaccgacggcaagaucgaguucaucagcaccauggagggguacaaguacccgguguacggcgugcaguggcaccccgagaaggcccccuacgaguggaagaaccuggacggcaucucccacgcccccaacgcggucaagacggccuucuaccuggccgaguucuucgugaacgaggcccgcaagaacaaccaccacuucaagagcgaguccgaggaggagaaggcccucaucuaccaguucagcccgaucuacaccgggaacaucagcuccuuccagcagugcuacaucuucgacuga

SEQ ID NO: 30547 - RNA, 2094 nt, Artificial Sequence
  derived and/or modified sequence opt1 from GGNBP2__Homo_sapiens__NP_079111
auggcccgccugguggccgucugccgggacggcgaggaggaguuccccuucgagcgccggcagaucccgcucuacaucgacgacacccugaccauggugauggaguuccccgacaacgugcugaaccucgacgggcaccagaacaacggcgcgcagcugaagcaguucauccagcgccacgggaugcugaagcagcaggaccucagcaucgccauggucgugacgucccgggaggugcugagcgcccugucccagcucguccccugcgugggcugccgccggagcguggagcgccuguucucccagcuggucgagagcgggaaccccgcccucgagccgcugaccgugggccccaagggcgugcuguccgucacccggagcugcaugaccgacgccaagaagcucuacacgcuguucuacgugcacggguccaagcugaacgacaugaucgacgcgauccccaagagcaagaagaacaagcgcugccagcuccacucccuggacacccacaagcccaagccgcugggcgggugcuggauggacgugugggagcucaugagccaggagugccgggacgaggucgugcugaucgacuccagcugccugcucgagacccuggagaccuaccugcgcaagcaccgguucugcacggacugcaagaacaaggugcuccgcgccuacaacauccugaucggcgagcuggacugcuccaaggagaagggguacugcgccgcccucuacgagggccugcggugcugcccccacgagcgccacauccacgucugcugcgagaccgacuucaucgcgcaccuccucggccgggccgagcccgaguucgccgggggccgccgggagcgccacgccaagaccaucgacaucgcccaggaggaggugcugaccugccuggggauccaccucuacgagcggcugcaccgcaucuggcagaagcugcgcgcggaggagcagacguggcagaugcuguucuaccugggcguggacgcccugcgcaagagcuucgagaugaccgucgagaaggugcagggcaucucccggcucgagcagcugugcgaggaguucagcgaggaggagcgggugcgcgagcugaagcaggagaagaagcggcagaagcgcaagaaccggcgcaagaacaagugcgucugcgacauccccaccccgcuccagaccgccgacgagaaggaggugucccaggagaaggagacggacuucaucgagaacagcagcugcaaggccugcggguccaccgaggacggcaacacgugcgucgaggugaucgugaccaacgagaacacgagcugcacgugccccuccagcgggaaccugcugggcucccccaagaucaagaaggggcucagcccccacugcaacggcuccgacugcggcuacagcuccagcauggagggguccgagaccggcagccgggagggguccgacgucgccugcaccgagggcaucugcaaccacgacgagcacggggacgacagcugcgugcaccacugcgaggacaaggaggacgacggcgacuccugcguggagugcugggcgaacagcgaggagaacgacaccaagggcaagaacaagaagaagaagaagaaguccaagauccugaagugcgacgagcacauccagaagcuggggagcugcaucaccgacccgggcaaccgcgagaccuccgggaacaccaugcacacggucuuccaccgggacaagaccaaggacacccaccccgagagcugcugcagcuccgagaagggcgggcagccccugcccugguucgagcaccgcaagaacgugccgcaguucgccgagcccaccgagacccucuucggccccgacagcggcaagggggccaagucccugguggagcugcucgacgagagcgagugcaccuccgacgaggagaucuucaucagccaggacgagauccaguccuucauggccaacaaccagagcuucuacuccaaccgggagcaguaccgccagcaccugaaggagaaguucaacaaguacugccggcugaacgaccacaagcgccccaucugcagcggcuggcucaccaccgccggggcgaacuga

SEQ ID NO: 30548 - RNA, 1959 nt, Artificial Sequence
  derived and/or modified sequence opt1 from GGN__Homo_sapiens__NP_689870
augggcaaccugcagagcgagcccuccgccgggggcgggagccgcaaggugcagccguccgaccgggcccccgacagccgccggaccucccucgucgagcccgagaugaccagccaggcgaugcgccugacgcggggccugggggugugguuccccggcuccgccaccccgcccggccucauggugccccgcgagccccaggccagcccguccacccugccccugacccucgagcggcccagccccgucaugccgccccccgaggaggccgccgcgguguccgcccccccgcccgcccccgccgggacgcugcugcccggcccgagcaaguggcagaagcccgcggggacccccgugccccgcauccggcgccuccuggaggccucccaccggggccagggggacccgcccagccugcgcccccucaagcccccgccccccccgcggcagcuguccgucaaggacaccgugccccgcgcccccagccaguuccccccgccccuggagaccuggaagccccccccgccccuccccuccgagcggcagcccgccgaccgccggaucacgccggcccuggcgacccccgccagcccccccaccgagucccaggccggcccgcgcaaccagggccagaccgccgggcgggcccgcggcggggcgcccccccacgccggcgagggcgagauggcccagcccgccgacagcgagagcgggcugucccuccugugcaagaucacguucaagagccggccgucccuggccccccccgcggccagcuccagccucgccgccaaggccucccugggcgggggcgggggcggcgggcuguucgcggccagcggcgccaucuccuacgccgaggugcucaagcaggggccccugccgcccggcgcggcccgcccccugggggaggucagccgcggcgcccaggaggccgagggcggggacggcgacggggagggcugcuccgggccgcccagcgcccccgcgucccaggcccgggcccuccccccgccccccuacaccaccuuccccggcagcaagccgaaguucgacuggguguccgcccccgacggccccgagcgccacuuccgguucaacggggccggcgggggcaucggcgcgccccgccggcgcgccgccgcccugagcgggccguggggcucccccccccccccgcccgagcagauccacagcgcccccgggccccggcgcccggcgcccgcccugcucgccccccccaccuucaucuucccggcccccacgaacggcgagcccaugcggcccgggccgcccggccugcaggagcugcccccgcuccccccccccaccccgccccccacccugcagcccccggcgcugcagcccaccccccuccccguggccccgccccugacgcccggccuggggcacaaggaguccgcccucgcccccaccgccgcgccggcccugccccccgcccuggccgccgaccaggcgcccgccccgagccccgcccccgcccccaccgucgccgagccgagcccccccguguccgcgcccgccccggccgccgcgcccaucaagacccgcacgcggcgcaacaagggcagccgggccgcccgcggggccacccggaaggacggccuccacggggacggcccccgcgagcgggccaccgcgaccgugccggacuccagcggcgggggcgggggcggguccggcgccagccagacgggcgccgccaacacccgcgccgcgcggcacuggcugcccuuccagguccugaacuccugccccugcaagugcuacugccaccaccagccccgccaccgccggcucccgcgcaacgugagcgccuggcuguccaccagcaccaaccaccugggggagccccccuggguggccacgaucaagcucuccggcagccuggucgccaagcuggagcacuacgaccugcaggccacccacuccaacuga

SEQ ID NO: 30549 - RNA, 903 nt, Artificial Sequence
  derived and/or modified sequence opt1 from GGPS1__Homo_sapiens__NP_001032354
auggagaagacccaggagaccgugcagcgcauccugcucgagcccuacaaguaccugcugcagcucccgggcaagcagguccggacgaagcugagccaggccuucaaccacuggcugaaggugcccgaggacaagcuccagaucaucaucgaggugaccgagaugcugcacaacgccucccugcucaucgacgacaucgaggacaacagcaagcugcgccggggguuccccgucgcgcacuccaucuacggcauccccagcgugaucaacuccgccaacuacguguacuuccuggggcucgagaagguccugacccuggaccacccggacgccgugaagcuguucacccgccagcuccuggagcuccaccagggccaggggcuggacaucuacuggcgggacaacuacacgugccccaccgaggaggaguacaaggccauggugcugcagaagaccggcggccucuucgggcuggccgucggccugaugcagcuguucagcgacuacaaggaggaccucaagccccugcucaacacccuggggcuguucuuccagauccgcgacgacuacgcgaaccuccacuccaaggaguacagcgagaacaaguccuucugcgaggaccugacggagggcaaguucagcuuccccaccauccacgccaucuggucccggccggagagcacccaggugcagaacauccugcgccagcggaccgagaacaucgacaucaagaaguacugcgugcacuaccucgaggacgucggguccuucgaguacacgcgcaacacccugaaggagcuggaggccaaggccuacaagcagaucgacgcgcggggcggcaaccccgagcucguggcccuggugaagcaccugagcaagauguucaaggaggagaacgaguga

SEQ ID NO: 30550 - RNA, 1710 nt, Artificial Sequence
  derived and/or modified sequence opt1 from GGT1__Homo_sapiens__NP_038347
augaagaagaagcuggugguccucggccugcuggccguggugcucguccuggugaucguggggcugugccucuggcugcccagcgccuccaaggagccggacaaccacgucuacacccgcgcggccguggccgccgacgccaagcagugcagcaagaucggccgggacgcgcugcgcgacgggggcuccgccguggacgccgccaucgcggcccuccugugcgucgggcugaugaacgcccacagcaugggcaucggcgggggccucuuccugaccaucuacaacuccacgacccggaaggccgaggugaucaacgcccgcgagguggcgccccggcuggccuucgccaccauguucaacagcuccgagcagagccagaagggcgggcucuccgucgccgugcccggggagauccgcggcuacgagcuggcccaccagcggcacggccgccugcccugggcgcgccucuuccagccgagcauccagcuggcccggcagggguuccccgugggcaaggggcuggccgccgcccucgagaacaagcggaccgucaucgagcagcagcccgugcugugcgagguguucugccgcgaccggaagguccugcgcgagggcgagcggcucacgcugccccagcuggcggacaccuacgagacccucgccaucgagggcgcccaggccuucuacaacgggucccugaccgcccagaucgugaaggacauccaggcggccggcgggaucgugacggccgaggaccugaacaacuaccgcgccgagcucaucgagcacccgcugaacaucagccugggcgacgucgugcucuacaugcccuccgcgccccugagcgggcccgugcuggcccucauccugaacauccugaagggcuacaacuucucccgggagagcgucgaguccccggagcagaagggccucaccuaccaccgcaucguggaggccuuccgguucgccuacgccaagcgcacccugcugggggaccccaaguucgucgacgugaccgaggugguccggaacaugacgagcgaguucuucgcggcccagcuccgcgcccagaucuccgacgacaccacccaccccaucagcuacuacaagcccgaguucuacaccccggacgacggcgggacggcccaccugagcgugguggccgaggacggcuccgcggucagcgccaccuccaccaucaaccuguacuucgggagcaaggugcgcucccccgugagcggcauccucuucaacaacgagauggacgacuucuccagccccuccaucaccaacgaguucggcgugcccccgagccccgccaacuucauccagcccgggaagcagccccuguccagcaugugcccgacgaucauggugggccaggacgggcagguccggauggucgugggcgccgccgggggcacccagaucaccaccgcgacggcccuggccaucaucuacaaccucugguucggcuacgacgugaagcgcgccgucgaggagccccggcugcacaaccagcugcugcccaacgugaccaccguggagcgcaacaucgaccaggcggucaccgccgcccucgagacgcggcaccaccacacccagaucgccuccaccuucaucgccguggugcaggcgaucguccgcaccgccgggggcugggccgccgccagcgacucccggaagggcggggagcccgcgggcuacuga

SEQ ID NO: 30551 - RNA, 678 nt, Artificial Sequence
  derived and/or modified sequence opt1 from GGT2__Homo_sapiens__XP_011528923
augaccagcgaguucuucgccgcccagcugcgcucccagaucagcgaccacaccacgcaccccaucuccuacuacaagccggaguucuacacccccgacgacggcgggaccgcgcaccucagcguggucgccgaggacggcuccgccgugagcgccaccuccacgaucaaccuguacuucgggagcaaggugugcucccccgucagcggcauccuguucaacaacgaguggaccaccuccgcccuccccgcguucaccaacgaguucggggccccgcccagccccgccaacuucauccagcccggcaagcagccgcugcuguccaugugccucacgaucauggugggccaggacggccaggugcggauggucgugggggccgccgggggcacccagaucaccaccgacacggcgcuggccaucaucuacaaccugugguucggguacgacgugaagcgcgccgucgaggagccccggcuccacaacaagcugcugcccaacgugaccaccguggagcgcaacaucgaccaggccgucaccgcggcccucgagacgcggcaccaccacacccagaucgccagcaccuucaucgccguggugcaggccaucguccgcaccgcgggcggcugggccgccgccuccgacagccggaagggcggggagcccgccggguacuga

SEQ ID NO: 30552 - RNA, 1764 nt, Artificial Sequence
  derived and/or modified sequence opt1 from GGT5__Homo_sapiens__NP_001093251
auggcccgcggcuacggggccaccgugagccugguccuccugggccuggggcucgcgcuggccgugaucgugcuggccgucgugcucucccggcaccaggcccccugcggcccgcaggccuucgcgcacgccgccguggccgcggacagcaaggucugcuccgacaucgggcgcgccauccugcagcagcagggcagccccguggacgccaccaucgccgcccuggugugcacguccgucgugaacccccagagcaugggccucgggggcggggugaucuucaccaucuacaacgucaccaccggcaagguggaggugaucaacgcgcgggagacgguccccgccucccacgccccgagccugcuggaccagugcgcccaggcccucccccuggggaccggcgcgcaguggaucggcgugcccggggagcugcgcggcuacgccgaggcccaccggcgccacgggcggcuccccugggcccagcuguuccagccgaccaucgcccugcuccgcggcggccacguggucgcgcccgugcugucccgguuccugcacaacagcauccuccgccccucccugcaggccagcacccugcggcagcuguucuucaacgggacggagccccuccgcccgcaggacccccugcccuggcccgcccucgccaccacccuggagaccguggccacggagggcgucgagguguucuacaccgggcggcugggccagaugcucguggaggacaucgcgaaggaggggucccagcugacccugcaggaccucgccaaguuccagccggaggucguggacgcccuggaggucccccugggcgacuacacccucuacagcccgccgccgcccgccggcggggcgauccuguccuucauccugaacgugcuccgcggcuucaacuucagcacggaguccauggcccggcccgaggggcgcgugaacgucuaccaccaccugguggagacccugaaguucgccaagggccagcgguggcgccucggggacccccggagccaccccaagcugcagaacgccucccgcgaccugcucggcgagacccuggcccagcugauccggcagcagaucgacggccgcggggaccaccagcucagccacuacagccuggcggaggccuggggccacgggaccggcacgucccacgugagcguccugggggaggacggcuccgccguggccgccaccagcaccaucaacacccccuucggcgcgaugguguacagcccccgcacggggaucauccugaacaacgagcuccuggaccugugcgagcggugcccccgcggcuccgggaccacccccucccccgccgucagcggcgaccgggugggcggggcccccggccgcugcuggccgcccgugcccggggagcggucccccagcuccauggucccgagcauccucaucaacaaggcccagggcuccaagcuggugaucgggggcgccggcggggagcugaucaucagcgcgguggcccaggccaucauguccaagcucuggcugggcuucgaccugcgcgccgcgaucgccgcccccauccuccacgucaacagcaaggggugcguggaguacgagcccaacuucucccaggaggugcagcggggccugcaggaccgcgggcagaaccagacccagcggcccuucuuccugaacgucgugcaggccgugagccaggagggcgccugcgucuacgcgguguccgaccuccgcaagagcggcgaggccgccggguacuga

SEQ ID NO: 30553 - RNA, 678 nt, Artificial Sequence
  derived and/or modified sequence opt1 from GGTLC1__Homo_sapiens__XP_005260922
augaccagcgaguucuucuccgcccagcugcgcgcccagaucagcgacgacaccacgcaccccaucuccuacuacaagccggaguucuacaugcccgacgacggcgggaccgcgcaccucagcguggucgccgaggacggcuccgccgugagcgccaccuccaccaucaaccuguacuucgggagcaaggugcggucccccgucagcggcauccugcucaacaacgagauggacgacuucuccagcacguccaucaccaacgaguucggggugcccccgagccccgccaacuucauccagcccggcaagcagccccuguccagcaugugcccgaccaucauggugggccaggacgggcagguccgcaugguggugggcgcggccgggggcacccagaucacgauggccaccgcccuggcgaucaucuacaaccucugguucggguacgacgucaagugggccguggaggagccccggcugcacaaccagcugcuccccaacgugaccaccgucgagcgcaacaucgaccaggaggugacggccgcccuggagacccggcaccaccacacccagaucaccuccacguucaucgccgugguccaggcgaucgugcgcauggccggcggcugggccgccgccagcgacucccggaagggcggggagcccgcgggguacuga

SEQ ID NO: 30554 - RNA, 654 nt, Artificial Sequence
  derived and/or modified sequence opt1 from GH1__Homo_sapiens__NP_000506
auggccaccggcagccgcaccucccugcuccuggccuucgggcugcucugccugcccuggcugcaggagggcagcgcguucccgacgaucccccucucccggcuguucgacaacgccaugcugcgcgcccaccggcuccaccagcuggccuucgacaccuaccaggaguucgaggaggccuacauccccaaggagcagaaguacagcuuccugcagaacccccagaccucccucugcuucagcgaguccaucccgacccccagcaaccgcgaggagacgcagcagaaguccaaccuggagcugcuccggaucagccugcugcucauccaguccuggcuggagcccgugcaguuccugcgcagcgucuucgcgaacucccucguguacggggccagcgacuccaacguguacgaccugcugaaggaccucgaggagggcauccagacccugauggggcggcuggaggacggcagcccccgcaccggccagaucuucaagcagaccuacuccaaguucgacacgaacagccacaacgacgacgcccuccugaagaacuacgggcugcucuacugcuuccggaaggacauggacaaggucgagaccuuccugcgcaucgugcagugccgguccguggagggcagcugcggguucuga

SEQ ID NO: 30555 - RNA, 654 nt, Artificial Sequence
  derived and/or modified sequence opt1 from GH2__Homo_sapiens__NP_002050
auggccgccggcagccgcaccucccugcuccuggcguucgggcugcucugccugagcuggcugcaggagggcuccgccuuccccaccaucccgcucagccggcuguucgacaacgccaugcugcgcgcccggcgccucuaccagcuggccuacgacacguaccaggaguucgaggaggcguacauccugaaggagcagaaguacuccuuccuccagaacccccagaccagccugugcuucuccgagagcauccccacccccuccaaccgggugaagacccagcagaaguccaaccuggagcuccugcgcaucucccugcuccugauccagagcuggcuggagccgguccagcuccugcgguccguguucgccaacagccugguguacggggccuccgacagcaacgucuaccgccaccucaaggaccuggaggagggcauccagacgcugauguggcggcucgaggacgggagcccccgcaccggccagaucuucaaccagagcuacuccaaguucgacaccaagagccacaacgacgacgcccugcugaagaacuacggccuccuguacugcuuccggaaggacauggacaagguggagaccuuccugcgcaucgugcagugccggagcgucgagggguccugcggcuucuga

SEQ ID NO: 30556 - RNA, 1038 nt, Artificial Sequence
  derived and/or modified sequence opt1 from GHITM__Homo_sapiens__NP_055209
augcuggccgcccgccucgugugccugcggacccugcccagccgcgucuuccacccggcguucaccaaggccucccccguggugaagaacagcaucacgaagaaccaguggcuccugacccccucccgggaguacgccaccaagacccgcaucggcauccggcgcgggcggacgggccaggagcugaaggaggccgcccucgagcccagcauggagaagaucuucaagaucgaccagauggggcgcugguucgucgcgggcggggccgccgugggccugggcgcccugugcuacuacgggcucggccuguccaacgagaucggggcgaucgagaaggccgugaucuggccgcaguacgucaaggaccggauccacagcaccuacauguaccuggccggcuccaucgggcucaccgcccugagcgccaucgcgaucucccgcacccccgugcugaugaacuucaugaugcggggcagcugggugacgaucggcgucaccuucgccgccauggugggggccggcaugcucgugcgcuccauccccuacgaccagagccccgggccgaagcaccuggccuggcugcuccacuccggcgucaugggcgcggugguggcgccccugaccauccucgggggcccccugcugauccgggccgccugguacaccgccgggaucgucggcgggcugagcacgguggccaugugcgcccccuccgagaaguuccucaacaugggcgccccgcugggcguggggcugggccucgucuucgugagcucccuggggagcauguuccugccgcccaccaccguggccggcgccacccucuacuccgucgcgauguacgggggccuggugcuguucagcauguuccuccuguacgacacgcagaaggugaucaagcgcgccgaggucagccccauguacggcgugcagaaguacgaccccaucaacuccaugcugagcaucuacauggacacccucaacaucuucaugcgggucgccaccaugcuggccaccgggggcaaccgcaagaaguga

SEQ ID NO: 30557 - RNA, 327 nt, Artificial Sequence
  derived and/or modified sequence opt1 from GHRH__Homo_sapiens__XP_011527089
augccccuguggguguucuucuucgucauccucacccugagcaacuccagccacugcuccccgccccccccccugacccuccgcaugcggcgcuacgccgacgccaucuucacgaacagcuaccggaaggugcugggccagcuguccgcgcgcaagcuccugcaggacaucaugagccggcagcagggggaguccaaccaggagcgcggcgcccgggcccgccuggggcggcagguggacagcaugugggccgagcagaagcagauggagcucgaguccauccuggucgcccugcuccagaagcacagccgcaacucccagggcuga

SEQ ID NO: 30558 - RNA, 1938 nt, Artificial Sequence
  derived and/or modified sequence opt1 from GHR__Homo_sapiens__NP_001229328
augaacuggggccccaccgggauggaccuguggcagcuccugcugacccucgcccuggccggcagcuccgacgcguucagcggguccgaggccacggccgccauccugagccgcgccccguggucccuccagagcgugaaccccggccugaagaccaacuccagcaaggagcccaaguucaccaagugccggucccccgagcgcgagaccuucagcugccacuggacggacgagguccaccacgggaccaagaaccugggcccgauccagcuguucuacacccggcgcaacacccaggaguggacgcaggaguggaaggagugccccgacuacguguccgcgggcgagaacagcugcuacuucaacuccagcuucaccuccaucuggauccccuacugcaucaagcucaccagcaacgggggcaccguggacgagaagugcuucuccgucgacgagaucgugcagcccgacccgcccaucgcccugaacuggacgcuccugaacgugagccugaccgggauccacgccgacauccagguccggugggaggcgccccgcaacgccgacauccagaagggcuggauggugcucgaguacgagcugcaguacaaggaggugaacgagaccaaguggaagaugauggaccccauccugaccacguccgucccgguguacagccucaagguggacaaggaguacgagguccgggugcgcagcaagcagcggaacuccgggaacuacggcgaguucagcgaggugcuguacgucacccugccccagaugucccaguucacgugcgaggaggacuucuacuuccccuggcuccugaucaucaucuucggcaucuucgggcugaccgugaugcuguucguguuccucuucagcaagcagcagcgcaucaagaugcugauccugcccccgguccccgugcccaagaucaagggcaucgaccccgaccuccugaaggaggggaagcucgaggaggugaacaccauccuggccauccacgacuccuacaagccggaguuccacagcgacgacuccugggucgaguucaucgagcuggacaucgacgagcccgacgagaagaccgaggagagcgacaccgaccggcuccuguccagcgaccacgagaagucccacagcaaccugggcgugaaggacggcgacuccgggcgcaccagcugcugcgagcccgacauccucgagacggacuucaacgccaacgacauccacgagggcaccuccgagguggcccagccccagcggcugaagggggaggccgaccugcucugccuggaccagaagaaccagaacaacagcccguaccacgacgcgugccccgccacccagcagcccuccgucauccaggccgagaagaacaagccccagccgcugcccaccgagggcgccgagagcacgcaccaggccgcgcacauccagcucuccaaccccagcagccuguccaacaucgacuucuacgcccaggugagcgacaucaccccggccggguccgucgugcugagccccggccagaagaacaaggccggcaugucccagugcgacaugcaccccgagauggugagccucugccaggagaacuuccugauggacaacgccuacuucugcgaggcggacgccaagaagugcauccccgucgccccgcacaucaagguggagucccacauccagcccagccugaaccaggaggacaucuacaucaccaccgagucccucacgaccgccgccgggcgccccggcaccggggagcacgugcccggcagcgagaugccgguccccgacuacaccuccauccacaucgugcagagcccccaggggcugauccugaacgcgacggcccugccccucccggacaaggaguuccuguccagcugcggcuacguguccaccgaccagcugaacaagaucaugcccuga

SEQ ID NO: 30559 - RNA, 1272 nt, Artificial Sequence
  derived and/or modified sequence opt1 from GHRHR__Homo_sapiens__NP_000814
auggaccgccggauguggggcgcccacguguucugcguccugagcccccucccgaccgugcuggggcacaugcaccccgagugcgacuucaucacccagcugcgcgaggacgaguccgccugccuccaggcggccgaggagaugcccaacacgacccugggcugccccgccaccugggacgggcugcucugcuggccgaccgccggcagcggggagugggugacgcugcccugccccgacuucuucucccacuucagcuccgagagcggcgccgucaagcgggacugcaccaucaccggcugguccgagcccuucccgcccuaccccguggcgugccccgugccgcuggagcuccuggccgaggaggagagcuacuucuccaccgucaagaucaucuacacgguggggcacagcaucuccaucguggcccuguucgucgccaucaccauccucguggcgcugcgccggcugcacugcccccgcaacuacgugcacacccagcuguucaccacguucauccucaaggccggcgccgucuuccugaaggacgccgcccucuuccacagcgacgacaccgaccacugcuccuucagcaccgugcugugcaagguguccgucgcggccagccacuucgccaccaugacgaacuucuccuggcugcucgccgaggccguguaccugaacugccugcucgcgagcaccucccccagcagccggcgcgccuucugguggcuggugcuggccggguggggccuccccguccuguucaccgggaccuggguguccugcaagcuggccuucgaggacaucgccugcugggaccucgacgacacgagcccguacugguggaucaucaagggccccaucgugcuguccgucggcgugaacuucgggcuguuccucaacaucauccggauccuggugcgcaagcuggagcccgcgcagggcagccuccacacccagucccaguacuggcggcugagcaaguccacccuguuccucaucccccuguucgggauccacuacaucaucuucaacuuccugccggacaacgccggccucggcauccgccugccccuggagcucgggcugggcagcuuccagggguucaucgucgccauccuguacugcuuccucaaccaggaggugcggaccgagaucucccgcaaguggcacggccacgaccccgagcugcugcccgccuggcggacgcgcgccaaguggaccaccccgagccgguccgcggccaagguccugaccagcaugugcuga

SEQ ID NO: 30560 - RNA, 318 nt, Artificial Sequence
  derived and/or modified sequence opt1 from GHRL__Homo_sapiens__NP_001128416
auguucaccugcugguggagcuaccugcgcuccacccucgccgccgugcccggcgaggcgagccggguccagcagcgcaaggaguccaagaagccgcccgccaagcugcagccccgggcccuggccggguggcuccgccccgaggacggcgggcaggccgagggcgcggaggacgagcuggaggugcgguucaacgccccguucgacguggggaucaagcugagcggcguccaguaccagcagcacucccaggcccucggcaaguuccugcaggacauccugugggaggaggccaaggaggcgcccgccgacaaguga

SEQ ID NO: 30561 - RNA, 870 nt, Artificial Sequence
  derived and/or modified sequence opt1 from GHSR__Homo_sapiens__NP_004113
auguggaacgccacccccagcgaggagccgggcuucaaccugacccucgccgaccuggacugggacgcgucccccgggaacgacagccugggcgacgagcuccugcagcuguuccccgcgccccuccuggccggggugacggcgaccugcgucgcccuguucguggugggcaucgccgggaaccuccugaccaugcuggucgugucccgcuuccgggagcuccgcaccacgaccaaccuguaccugagcuccauggccuucagcgaccuccugaucuuccugugcaugccgcucgaccuggugcggcuguggcaguaccgccccuggaacuucggcgaccuccugugcaagcuguuccaguucgucuccgagagcugcaccuacgccaccgugcucacgaucaccgcccuguccguggagcgguacuucgccaucugcuucccccugcgcgccaaggucguggugaccaagggccgggucaagcucgugaucuucgugaucugggccgucgccuucugcagcgccgggcccaucuucgugcuggugggcgucgagcacgagaacgggaccgacccgugggacacgaacgagugccgccccaccgaguucgcggugcgguccggccugcucaccgugauggucugggugagcuccaucuucuucuuccugcccguguucugccugaccguccucuacagccugaucgggcgcaagcuguggcggcgccggcgcggcgacgccguggucggcgccucccuccgggaccagaaccacaagcagacggugaagaugcucgggggcagccagcgcgcccugcggcugucccuggccgggcccauccugagccucugccugcugccgucccucuga

SEQ ID NO: 30562 - RNA, 687 nt, Artificial Sequence
  derived and/or modified sequence opt1 from GID8__Homo_sapiens__NP_060366
augagcuacgccgagaagcccgacgagaucaccaaggacgaguggauggagaagcugaacaaccuccacgugcagcgcgccgacaugaaccggcugaucaugaacuaccuggucaccgagggcuucaaggaggcggccgagaaguuccgcauggaguccgggaucgagccgagcguggaccucgagacgcuggacgagcggaucaagauccgcgagaugauccugaagggccagauccaggaggccaucgcccucaucaacucccugcaccccgagcugcucgacaccaaccgguaccuguacuuccaccuccagcagcagcaccugaucgagcugauccgccagcgggagaccgaggccgcgcuggaguucgcccagacccagcucgccgagcagggggaggagagccgcgagugccugacggagauggagcggacccuggcccuccuggcguucgacucccccgaggagagccccuucggcgaccugcuccacaccaugcagcgccagaaggugugguccgaggucaaccaggccgugcuggacuacgagaaccgggagagcaccccgaagcuggccaagcuccugaagcugcuccugugggcccagaacgagcuggaccagaagaaggugaaguaccccaagaugacggaccucuccaagggggucaucgaggagcccaaguga

SEQ ID NO: 30563 - RNA, 1254 nt, Artificial Sequence
  derived and/or modified sequence opt1 from GIF__Homo_sapiens__NP_005133
auggccugguucgcccuguaccuccugagccugcucugggcgaccgccggcaccuccacgcagacccagagcuccugcagcgugcccuccgcccaggagccgcuggucaacgggauccaggugcugauggagaacagcgugaccuccagcgccuaccccaaccccuccauccucaucgccaugaaccuggcgggcgccuacaaccugaaggcccagaagcuccugaccuaccagcugaugagcuccgacaacaacgaccucacgaucgggcagcugggccugaccaucauggcccucaccagcuccugccgcgaccccggggacaaggucagcauccugcagcggcagauggagaacugggcgccguccagccccaacgccgaggccuccgccuucuacggccccagccuggccauccucgcgcugugccagaagaacuccgaggccacccugcccaucgccgugcgcuucgccaagacgcuccuggccaacagcagcccguucaacguggacaccggcgcgauggccacccuggcccugaccugcauguacaacaagauccccgucggguccgaggagggcuaccggagccuguucggccaggugcugaaggacaucguggagaagaucuccaugaagaucaaggacaacgggaucaucggggacaucuacagcacgggccucgccaugcaggcccuguccgucacccccgagcccagcaagaaggaguggaacugcaagaagaccaccgacaugauccugaacgagaucaagcagggcaaguuccacaacccgauguccaucgcgcagauccuccccagccugaaggggaagacguaccuggacgugccccaggugaccugcucccccgaccacgagguccagccgacccuccccagcaaccccggccccgggccgaccuccgccagcaacaucacggugaucuacaccaucaacaaccagcugcgcggcguggagcuccucuucaacgagaccaucaacgucuccgucaagagcggcuccgugcugcugguggugcucgaggaggcccagcggaagaaccccauguucaaguucgagaccacgaugaccagcugggggcugguggucuccagcaucaacaacaucgccgagaacgugaaccacaagaccuacuggcaguuccuguccggcgugacgccccucaacgagggggucgccgacuacauccccuucaaccacgagcacaucaccgcgaacuucacccaguacuga

SEQ ID NO: 30564 - RNA, 3108 nt, Artificial Sequence
  derived and/or modified sequence opt1 from GIGYF1__Homo_sapiens__XP_005250589
auggccgccgagacccugaacuucggccccgaguggcuccgcgcgcugagcgggggcggguccguggccagcccgccccccucccccgccaugccgaaguacaagcuggccgacuaccgguacggccgcgaggagaugcucgcccuguacgucaaggagaacaaggugcccgaggagcugcaggacaaggaguucgcggccgugcuccaggacgagccccugcagccccuggcccucgagccgcugaccgaggaggagcagcggaacuucagccuguccgucaacagcguggccgugcuccgccugauggggaagggcgcgggccccccccuggccgggacgucccggggccgcgggagcacccggucccgcggccgggggcgcggcgacagcugcuucuaccagcgguccaucgaggagggcgacggggccuucggccgcagcccccgggagauccagcgcucccagagcugggacgaccggggggagcgccgguucgagaaguccgcccgccgggacggcgcccgcugcggcuucgaggaggggggcgcggggccgcggaaggagcacgcccgcagcgacuccgagaacuggcgcagccuccgggaggagcaggaggaggaggaggagggcuccuggcgccugggggccggcccccggcgcgacggcgaccgguggcgcagcgccagccccgacgggggcccccgguccgccggguggcgcgagcacggcgagcggcgccggaaguucgaguucgaccugcgcggggaccggggcggcugcggggaggaggagggccgcgggggcgggggcagcucccaccuccggcgcugccgggcgccggagggcuucgaggaggacaaggacgggcugcccgaguggugccuggacgacgaggacgaggagaugggcaccuucgacgccagcggggccuuccucccccugaagaagggccccaaggagccgauccccgaggagcaggagcuggacuuccagggccucgaggaggaggaggagcccuccgaggggcuggaggaggagggccccgaggccgggggcaaggagcugaccccgcuccccccccaggaggagaagagcuccagccccuccccgcugcccacgcuggggccccucuggggcaccaacggcgacggggacgagaccgccgagaaggagccgcccgcggccgaggacgacauccgcggcauccagcugagccccggggucggcuccagcgccgggcccccgggcgaccuggaggacgacgagggccucaagcaccugcagcaggaggccgagaagcugguggccucccuccaggacagcucccuggaggaggagcaguucaccgcggccaugcagacgcaggggcugcggcacagcgccgccgcgaccgcccucccccugucccacggcgccgcccgcaagugguucuacaaggacccccagggggagauccagggccccuucaccacccaggagauggccgagugguuccaggcgggguacuucagcaugucccugcucgugaagcgcggcugcgacgagggcuuccagccgcugggggaggucaucaagauguggggccgggugcccuucgcccccgggcccagcccgcccccccugcucggcaacauggaccaggagcgccugaagaagcagcaggagcuggccgccgccgcgcucuaccagcagcugcagcaccagcaguuccugcagcuggugagcucccggcagcucccccagugcgcccugcgcgagaaggccgcccugggggaccucacgccgcccccccccccgcccccccagcagcagcagcagcagcugaccgccuuccugcagcagcuccaggcgcugaagcccccgcggggcggcgaccagaaccugcuccccaccaugagccgcucccugagcguccccgacuccgggcggcugugggacgugcacaccagcgccuccagccaguccggcggggaggccagccucugggacaucccgaucaacuccagcacgcagggccccauccuggagcagcugcagcuccagcacaaguuccaggagcgccgggagguggagcugcgcgccaagcgggaggaggaggagcgcaagcggcgcgaggagaagcggcgccagcagcagcaggaggagcagaagcggcgccaggaggaggaggagcuguuccggcgcaagcacguccggcagcaggagcuccugcugaagcuccugcagcagcagcaggcggugcccgugcccccggcccccuccagcccccccccgcugugggccggccucgccaagcaggggcuguccaugaagacccugcucgagcugcagcuggagggcgagcgccagcuccacaagcagccccccccccgcgagccggcccgggcgcaggcccccaaccaccgcguccagcuggggggccuggggaccgccccccucaaccagugggugagcgaggccggcccccuguggggcgggccggacaaguccggcgggggcagcagcgggcugggccucugggaggacacccccaaguccggcgggagccuggugcggggccuggggcucaagaacucccgcagcucccccagccuguccgacagcuacucccaccugagcggccggcccauccgcaagaagacggaggaggaggagaagcuccugaagcugcuccaggggaucccgcggccccaggacggcuucacccaguggugcgagcagaugcugcacacccuguccgccaccggcagccucgacguccccauggcgguggccauccugaaggagguggagucccccuacgacguccacgacuacauccgcagcugccugggggacacgcucgaggccaaggaguucgccaagcaguuccuggagcggcgcgccaagcagaaggcgucccagcagcggcagcagcagcaggaggccuggcugagcuccgccagccuccagaccgccuuccaggcgaaccacuccaccaagcugggcccgggggagggcagcaaggccaagcgccgggcccugaugcuccacagcgaccccuccauccugggcuacagccugcacggguccagcggcgagaucgaguccguggacgacuacuga

SEQ ID NO: 30565 - RNA, 3900 nt, Artificial Sequence
  derived and/or modified sequence opt1 from GIGYF2__Homo_sapiens__NP_001096616
auggccgccgagacccagacccugaacuucggccccgaguggcuccgcgcgcugagcuccgggggcagcaucacguccccgccccugagccccgcccuccccaaguacaagcuggccgacuaccgguacgggcgcgaggagaugcuggcccucuuccugaaggacaacaagaucccguccgaccugcucgacaaggaguuccugcccauccugcaggaggagccccuccccccgcuggcccuggugcccuucaccgaggaggagcagcggaacuucagcauguccgucaacagcgcggccgugcuccgccugaccggccgggggggcggcgggaccguggucggcgccccccgcgggcgguccagcucccgcggccgggggcgcggccggggcgagugcggguucuaccagcgcagcuucgacgagguggagggcguguucgggcggggcggcgggcgcgagaugcaccggucccagagcugggaggagcgcggcgaccggcgcuucgagaagcccgggcggaaggacgucggccgcccgaacuucgaggaggggggccccacguccgugggccggaagcacgaguucauccgcagcgaguccgagaacuggcgcaucuuccgggaggagcagaacggggaggacgaggacggcggguggcgccuggccggcagccggcgcgacggggagcgguggcgcccccacucccccgacggcccgcggagcgcgggcuggcgcgagcacauggagcggcgccggcgcuucgaguucgacuuccgggaccgcgacgacgagcggggguaccgccgggugcgcagcggcuccgggagcaucgacgacgaccgggacucccuccccgaguggugccuggaggacgccgaggaggagaugggcaccuucgacagcuccggggccuuccugagccucaagaagguccagaaggagcccauccccgaggagcaggagauggacuuccgcccgguggacgagggcgaggagugcuccgacagcgagggcucccacaacgaggaggccaaggagcccgacaagaccaacaagaaggagggggagaagaccgaccgcgugggcgucgaggccagcgaggagacgccccagaccuccagcuccagcgcgcggcccgggaccccguccgaccaccagagccaggaggccucccaguucgagcgcaaggacgagcccaagaccgagcagacggagaaggccgaggaggagacccggauggagaacagccugcccgccaaggugcccucccgcggcgacgagaugguggccgacguccagcagccgcugagccagauccccagcgacaccgcguccccccuccugauccugccgccccccgugcccaacccgagccccacccuccggcccguggagacgcccgucgugggcgccccggggaugggcuccgugagcaccgagcccgacgacgaggaggggcugaagcaccuggagcagcaggccgagaagauggucgccuaccuccaggacuccgcccuggacgacgagcgccuggcgagcaagcuccaggagcaccgggccaagggcguguccaucccccugaugcacgaggccaugcagaagugguacuacaaggacccccagggggagauccagggcccguucaacaaccaggagauggccgagugguuccaggccggcuacuucaccaugagccugcucgugaagcgcgcgugcgacgaguccuuccagccccugggggacaucaugaagauguggggccggguccccuucagccccgggccggccccccccccccacaugggcgagcuggaccaggagcgccucacccggcagcaggagcugacggcccuguaccagaugcagcaccuccaguaccagcaguuccugauccagcagcaguacgcccaggugcuggcgcagcagcagaaggccgcccucuccagccagcagcagcagcagcuggcccugcuccugcagcaguuccagacccugaagaugcgcaucuccgaccagaacaucaucccgagcgucacccgguccgugagcgugcccgacaccggguccaucugggagcugcagcccacggccagccagcccaccgucugggagggcggcagcgugugggaccucccgcuggacaccaccacgcccgggcccgcgcuggagcagcuccagcagcuggagaaggccaaggccgccaagcuggagcaggagcgccgggaggccgagaugcgcgcgaagcgggaggaggaggagcgcaagcggcaggaggagcuccgccggcagcaggaggagauccugcgccgccagcaggaggaggagcggaagcgccgggaggaggaggagcuggcccgccggaagcaggaggaggcccuccgccggcagcgcgagcaggagaucgcccugcggcgccagcgggaggaggaggagcgccagcagcaggaggaggcccugcggcgccucgaggagcggcgccgggaggaggaggagcgccggaagcaggaggagcugcugcgcaagcaggaggaggaggcggccaagugggcccgcgaggaggaggaggcccagcggcgccucgaggagaaccggcugcgcauggaggaggaggcggcccggcugcgccacgaggaggaggagcggaagcgcaaggagcucgaggugcagcggcagaaggagcugaugcgccagcggcagcagcagcaggaggcccugcgccggcuccagcagcagcagcagcagcagcagcuggcccagaugaagcugccguccagcuccaccuggggccagcagagcaacaccaccgccugccagucccaggcgacgcucagccuggccgagauccagaagcuggaggaggagcgcgagcggcagcuccgcgaggagcagcggcgccagcagcgggagcugaugaaggcccugcagcagcagcagcagcagcagcagcagaagcucuccggguggggcaacgucagcaagcccuccgggaccaccaagagccugcuggagauccagcaggaggaggcccgccagaugcagaagcagcagcagcagcagcagcagcaccagcagcccaaccgggcccgcaacaacacccacuccaaccuccacacgagcaucggcaacuccguguggggcagcaucaacaccgggcccccgaaccagugggcguccgaccuggugagcuccaucuggagcaacgccgacaccaagaacuccaacaugggcuucugggacgacgccgucaaggagguggggccccgcaacagcaccaacaagaacaagaacaacgccagccuguccaagagcgugggcgucuccaaccggcagaacaagaagguggaggaggaggagaagcuccugaagcuguuccagggggugaacaaggcccaggacggcuucacccaguggugcgagcagaugcuccacgcgcugaacacggccaacaaccuggacguccccaccuucgugagcuuccucaaggagguggagucccccuacgagguccacgacuacauccgcgccuaccugggcgacaccagcgaggccaaggaguucgcgaagcaguuccuggagcggcgcgccaagcagaaggccaaccagcagcggcagcagcagcagcucccgcagcagcagcagcagcagcccccccagcagcccccgcagcagccccagcagcaggacuccgugugggggaugaaccacagcacccugcacuccguguuccagacgaaccagagcaacaaccagcaguccaacuucgaggccguccagagcggcaagaagaagaagaagcagaagauggugcgcgccgaccccucccugcucggguucagcgugaacgcguccagcgagcggcugaacaugggcgagaucgagacccuggacgacuacuga

SEQ ID NO: 30566 - RNA, 924 nt, Artificial Sequence
  derived and/or modified sequence opt1 from GIMAP5__Homo_sapiens__NP_060854
augggcggguuccagcgcggcaaguacgggaccauggccgagggccggagcgaggacaaccuguccgccacgcccccggcgcuccgcaucauccugguggggaagaccggcugcggcaagagcgccaccgggaacuccauccugggccagcccgucuucgagagcaagcuccgggcccaguccgugacccggaccugccaggugaagacggggaccuggaacggccgcaagguccuggugguggacacccccagcaucuucgagucccaggccgacacccaggagcuguacaagaacaucggggacugcuaccuccugagcgcccccggcccgcacguccugcuccuggugauccagcugggccgcuucacggcgcaggacaccguggccauccggaaggucaaggagguguucgggaccggcgccaugcgccacguggucauccucuucacccacaaggaggaccucgggggccaggcccuggacgacuacguggcgaacacggacaacugcucccugaaggaccuggugcgggagugcgagcgccgguacugcgccuucaacaacuggggcagcgucgaggagcagcgccagcagcaggccgagcugcucgccgugaucgagcggcuggggcgcgagcgggagggcuccuuccacagcaacgaccuguuccucgacgcccagcugcugcagcgcaccggggcgggcgccugccaggaggacuaccggcaguaccaggccaagguggaguggcaggucgagaagcacaagcaggagcuccgcgagaacgaguccaacugggccuacaaggcccugcugcgggugaagcaccucaugcugcugcacuacgagaucuucguguuccuccugcugugcagcauccucuucuucaucaucuuccuguucaucuuccacuacaucuga

SEQ ID NO: 30567 - RNA, 903 nt, Artificial Sequence
  derived and/or modified sequence opt1 from GIMAP7__Homo_sapiens__NP_694968
auggccgagagcgaggaccgcucccugcggaucgugcucgucggcaagaccgggagcggcaaguccgccaccgcgaacacgauccugggggaggagaucuucgacagccgcaucgccgcccaggccgugaccaagaacugccagaaggccucccgggaguggcagggccgcgaccugcucguggucgacacccccgggcuguucgacaccaaggagagccuggacacgaccugcaaggagaucucccggugcaucaucagcuccugcccgggcccccacgcgaucgugcucgugcugcugcucggccgcuacaccgaggaggagcagaagaccgucgcccugaucaaggccguguucggcaagagcgccaugaagcacauggugauccuguucacgcggaaggaggagcucgaggggcaguccuuccacgacuucaucgcggacgccgacgucgggcucaagagcaucgugaaggagugcggcaaccgcugcugcgccuucuccaacagcaagaagaccuccaaggccgagaaggagagccaggugcaggagcuggucgagcugaucgagaagauggugcagugcaacgagggggccuacuucuccgacgacaucuacaaggacaccgaggagcggcugaagcagcgcgaggaggugcugcggaagaucuacaccgaccagcucaacgaggagaucaagcuggucgaggaggacaagcacaagagcgaggaggagaaggagaaggagaucaagcugcucaagcugaaguacgacgagaagaucaagaacauccgcgaggaggcggagcggaacaucuucaaggacguguucaaccgcaucuggaagaugcuguccgagaucuggcaccgguuccucagcaagugcaaguucuacagcuccuga

SEQ ID NO: 30568 - RNA, 1998 nt, Artificial Sequence
  derived and/or modified sequence opt1 from GIMAP8__Homo_sapiens__XP_005250007
augagcgagcaguccugccagaugagcgagcugcgccuccugcugcucggcaagugccgguccggcaagagcgccaccgggaacgccauccuggggaagcacguguucaaguccaaguucagcgaccagaccgucaucaagaugugccagcgcgaguccugggugcugcgggagcgcaagguggucgugaucgacacgcccgaccucuucagcuccaucgcgugcgccgaggacaagcagcggaacauccagcacugccuggagcugagcgccccgucccuccacgcccugcugcucgugaucgccaucggccacuucacccgcgaggacgaggagaccgcgaaggggauccagcaggucuucggcgccgaggcccggcgccacaucaucaucguguucacccggaaggacgaccugggcgacgaccugcuccaggacuucaucgagaagaacaagccccugaagcagcuggugcaggacuacgaggggcgcuacugcaucuucaacaacaagacgaacagcaaggacgagcagaucacccagguccucgagcugcugcggaagguggagucccucgugaacaccaacggcgggcccuaccacgucaacuucaagaccgagggcagccgcuuccaggacugcgugaacgaggccgcgucccaggagggggacaagccccagggcccgcgggagcgccagcugcagagcacgggccccgagcagaaccccgggaccuccgagcugaccgugcuccuggucggcaagcgcggggccggcaagagcgccgccggcaacuccauccuggggcggcaggccuuccagaccggcuucagcgagcagagcgugacgcaguccuuccucagcgagucccggagcuggcgcaagaagaagguguccaucaucgacgcgcccgacaucagcucccugaagaacaucgacagcgagguccggaagcacaucugcaccgggccgcacgccuuccugcucgugacgccccugggcuucuacaccaagaacgacgaggccgugcuguccaccauccagaacaacuucggggagaaguucuucgaguacaugaucauccuccugacccgcaaggaggaccugggcgaccaggaccucgacaccuuccugcggaacagcaacaaggcccuguacggccucauccagaagugcaagaaccgcuacuccgccuucaacuaccgcgcgaccggggaggaggagcagcggcaggccgacgagcugcuggagaagaucgagagcaugguccaccagaacggcaacaagcacugcguguuccgcgagaaggagacgcucaacaucgugcuggucgggcgguccggcaccggcaagagcgccaccgggaacuccauccugggcagccucguguucaccucccgccugcgggcccagcccgucacgaagaccagccaguccgggcgccggaccugggacggccaggaggugguggucguggacacccccagcuucaaccagaugcuggacguggagaaggacccgagccgccucgaggaggaggucaagcggugccuguccugcugcgagaagggggacacguucuucgugcugguguuccagcugggccgcuucaccgaggaggacaagaccgccgucgcgaagcucgaggccaucuucggggccgacuucaccaaguacgccaucaugcuguucacgcggaaggaggaccugggcgccggcaaccucgaggacuucaugaagaacagcgacaacaaggcgcugcgccggaucuucaagaagugcgggcgccgggugugcgccuucaacaacaaggagaccggccaggcccaggagacccaggugaaggcccugcucaccaaggucaacgaccugcgcaaggaguccggguggagcggcuacccccacacgcaggagaacguguccaagcugaucaagaacgugcaggagaugagccaggcggagaagcuccugaagaaccugaucggcauccuccaguga

SEQ ID NO: 30569 - RNA, 1569 nt, Artificial Sequence
  derived and/or modified sequence opt1 from GIN1__Homo_sapiens__NP_060146
auggugcgcagcggcaagaacggggaccugcaccucaagcagaucgccuacuacaagcggaccggcgaguaccacuccaccacgcugcccagcgagcgcuccgggauccggcgcgccgcgaagaaguucgucuucaaggagaagaagcuguucuacgugggcaaggaccggaagcagaaccgccucgugaucgucagcgaggaggagaagaagaaggugcugcgggagugccacgagaacgacuccggggcccaccacggcaucagccgcacccugacccucguggaguccaacuacuacuggaccagcgucacgaacgacgugaagcaguggguguacgccugccagcacugccaggucgccaagaacaccgugaucguggccccgaagcagcaccuccugaaggucgagaaccccuggucccuggugaccguggaccugaugggccccuuccacaccagcaaccggucccacgucuacgcgaucaucaugacggaccuguucaccaaguggaucgugauccucccccugugcgacgugagcgccuccgaggucagcaaggccaucaucaacaucuucuuccuguacgggccgccccagaagaucaucauggaccagcgcgacgaguucauccagcagaucaacaucgagcucuaccggcuguucggcaucaagcagaucgugaucucccacaccagcgggaccgugaaccccacggaguccacccccaacaccaucaaggccuuccugagcaagcacugcgcggaccacccgaacaacugggacgaccaccucuccgccgucagcuucgccuucaacgugacccaccuggagcccacgaagaacacccccuacuuccagauguucagccgcaaccccuacaugccggagaccuccgacagccugcacgagguggacggcgacaacaccuccauguucgccaagauccucgacgccaucaaggaggcggacaagaucauggagaacaagacgaccagccuggggcagauggagaacaacaaccuggacgagcucaacaaguccaagaucaucgucaagaagaagcccaagcagcugaaccccuuccaccugaaggugggccacgagguccuccggcagcgcaagaacugguggaaggacggccgguuccagagcgaguggguggggcccugcgugaucgacuacaucaccgaguccggcugcgccguccugcgcgacaacaccggggugcggcugaagcgcccgaucaagaugagccaccucaagcccuacauccgggaguccagcgagcaggagucccuguaccugcuccagggcagcguggucgccgaccacgacuacaucggccugcccgagauccccaucggggccuaccaggccaacauccugguggaggacgcgacgaucggcaucguggacaacgagcuccugaccuccagcaaggaccgcgagcugcucgaguaccggaacaccaagaucuccccgcugaucgacgaccacagcucccuggagaagcagaccuucagccuccuggacuccagcaaccagguccuggaguaccucagcuga

SEQ ID NO: 30570 - RNA, 591 nt, Artificial Sequence
  derived and/or modified sequence opt1 from GINS1__Homo_sapiens__NP_066545
auguucugcgagaaggccauggagcugauccgcgagcuccaccgggcccccgagggccagcugccggcguucaacgaggacgggcugcgccaggugcucgaggagaugaaggcccuguacgagcagaaccagagcgacgucaacgaggccaaguccggcgggcggagcgaccugauccccaccaucaaguuccgccacugcucccuccugcggaaccgccggugcaccguggccuaccuguacgaccgccuccugcggauccgcgcccugcggugggaguacggcagcgugcuccccaacgcgcugcgcuuccacauggccgccgaggagauggagugguucaacaacuacaagcggucccuggccacguacaugcgcagccucgggggcgacgagggccuggacaucacccaggacaugaagcccccgaagucccuguacaucgagguccggugccucaaggacuacggggaguucgagguggacgacggcaccagcgugcugcugaagaagaacucccagcacuuccucccccgcuggaagugcgagcagcugauccggcaggggguccuggagcacauccucagcuga

SEQ ID NO: 30571 - RNA, 558 nt, Artificial Sequence
  derived and/or modified sequence opt1 from GINS2__Homo_sapiens__NP_057179
auggacgccgccgagguggaguuccuggcggagaaggagcucgucaccaucauccccaacuucagccuggacaagaucuaccugaucggcggggaccucggcccguucaaccccgggcugcccguggaggugccccuguggcucgccaucaaccugaagcagcgccagaagugccggcugcucccgcccgaguggauggacgucgagaagcuggagaagaugcgcgaccacgagcggaaggaggagaccuucacgcccaugcccuccccguacuacauggagcugaccaagcuccugcugaaccacgccagcgacaacauccccaaggccgacgagauccgcacccucgugaaggacaugugggacacccggaucgccaagcugcgcguguccgcggacagcuucguccggcagcaggaggcccacgccaagcuggacaaccucacgcugauggagaucaacaccuccggcaccuuccugacccaggcccucaaccacauguacaagcugcgcacgaaccugcagccccucgagagcacccagucccaggacuucuga

SEQ ID NO: 30572 - RNA, 1002 nt, Artificial Sequence
  derived and/or modified sequence opt1 from GIPC1__Homo_sapiens__NP_005707
augccccugggccucgggcgccggaagaaggccccgccccugguggagaacgaggaggccgagcccggccgcgggggccugggggucggcgagcccggcccgcucgggggcgggggcagcgggggcccccagaugggccugcccccgcccccgcccgcgcugcggccccgccucguguuccacacccagcuggcccacgggucccccaccggccggaucgagggguucacgaacgugaaggagcuguacggcaagaucgccgaggccuuccgccuccccaccgccgaggucauguucugcacccugaacacccacaagguggacauggacaagcugcucggcgggcagaucggccuggaggacuucaucuucgcgcacgugaaggggcagcggaaggaggucgagguguucaagagcgaggacgcccugggccucacgaucaccgacaacggggccggcuacgccuucaucaagcgcaucaaggagggcuccgugaucgaccacauccaccugaucagcgucggggacaugaucgaggcgaucaacggccagucccugcucgggugccggcacuacgagguggcccgccugcugaaggagcucccccggggccgcaccuucacccugaagcugacggagccccggaaggccuucgacaugaucagccagcgcuccgccgggggccggccgggcagcgggccccagcucggcaccgggcgcggcacccugcggcugcgcucccgggggcccgccaccguggaggaccuccccagcgcguucgaggagaaggccaucgagaaggucgacgaccugcuggaguccuacaugggcauccgcgacacggagcucgccgccaccaugguggagcugggcaaggacaagcggaacccggacgagcuggccgaggcgcucgacgagcgccugggggacuucgccuuccccgacgaguucguguucgacgucuggggcgccaucggggacgccaaggugggccgcuacuga

SEQ ID NO: 30573 - RNA, 939 nt, Artificial Sequence
  derived and/or modified sequence opt1 from GIPC3__Homo_sapiens__NP_573568
auggagggcgccgccgcgcgcgaggcccgggggaccgagacgccccgcgccagcgccccgccgcccgcccccuccgagccgcccgcggcgccccgggcccgcccccggcugguguuccgcacgcagcucgcccacggcagcccgaccgggaagaucgagggcuucaccaacguccgggagcuguacgcgaagaucgccgaggccuucgggaucgcccccaccgagauccuguucugcacgcucaacucccacaagguggacaugcagaagcugcugggcggccagaucgggcucgaggacuucaucuucgcccacgugcgcggcgagaccaaggaggucgaggugaccaagaccgaggacgcccuggggcugaccaucaccgacaacggcgccggguacgccuucaucaagcggaucaaggagggcagcaucaucaaccgcaucgaggccgugugcgucggcgacuccaucgaggccaucaacgaccacagcaucguggggugccggcacuacgagguggcgaagaugcuccgcgagcugcccaagucccagcccuucacccugcggcucguccagcccaagcgcgccuucgacaugaucggccagcggagccgcuccagcaagugccccguggaggccaaggugaccuccgggcgggagacgcugcgccugcggagcggcggcgccgccaccgucgaggaggcgcccuccgaguucgaggaggaggccagccgcaagguggacgaccuccuggaguccuacauggggauccgggaccccgagcuggccagcaccaugguggagaccuccaagaagacggccagcgcccaggaguucgcgcgcugccucgacuccguccugggcgaguucgccuucccggacgaguucgugguggaggucugggccgccaucggggaggcgcgcgaggccugcggcuga

SEQ ID NO: 30574 - RNA, 462 nt, Artificial Sequence
  derived and/or modified sequence opt1 from GIP__Homo_sapiens__NP_004114
augguggccaccaagaccuucgcccugcuccugcugagccucuuccuggcggucggccugggggagaagaaggagggccacuucuccgcccuccccagccugccgguggggucccacgccaaggugagcagcccccagccccgcggcccccgguacgccgaggggacguucaucuccgacuacuccaucgccauggacaagauccaccagcaggacuucgucaacuggcugcucgcgcagaagggcaagaagaacgacuggaagcacaacaucacccagcgcgaggcccgggcccuggagcuggccagccaggcgaaccgcaaggaggaggaggccguggagccgcaguccagccccgccaagaaccccuccgacgaggaccuccugcgggaccugcucauccaggagcugcuggccugccuccuggaccagaccaaccugugccgccuccggagccgcuga

SEQ ID NO: 30575 - RNA, 1401 nt, Artificial Sequence
  derived and/or modified sequence opt1 from GIPR__Homo_sapiens__NP_000155
augaccaccagccccauccugcagcuccugcugcgccucucccugugcggccugcuccugcagcgggccgagacggggagcaagggccagaccgccggggagcuguaccagcgcugggagcgguaccgccgggagugccaggagacccucgcggccgccgagccgcccuccggccuggccugcaacgggagcuucgacauguacgugugcugggacuacgccgcgcccaacgccaccgcccgcgccuccugccccugguaccugccguggcaccaccacgucgcggccggcuucgugcuccggcagugcggcagcgacgggcaguggggccuguggcgcgaccacacgcagugcgagaaccccgagaagaacgaggccuuccuggaccagcggcucauccuggagcgccuccaggugauguacaccgucggguacucccugagccuggccacccugcuccuggcccugcucauccugucccuguuccggcgccuccacugcacccggaacuacauccacaucaaccuguucacgagcuucaugcugcgcgcggccgccauccucucccgggaccgccugcugccccggcccggcccguaccucggggaccaggcccuggcccuguggaaccaggcgcucgccgccugccgcaccgcccagaucgugacccaguacugcgugggcgccaacuacaccuggcugcuggucgagggcguguaccuccacagccugcuggugcucgucgggggcuccgaggaggggcacuuccgguacuaccugcugcucggcuggggcgcgcccgcccuguucgugauccccugggugaucguccgcuaccuguacgagaacacgcagugcugggagcggaacgaggugaaggccaucugguggaucauccgcacccccauccucaugaccauccugaucaacuuccugaucuucauccgcauccuggggauccuccugagcaagcugcggacccgccagaugcggugccgcgacuaccggcuccgccuggcccgguccacgcugacccucgugccgcugcugggcguccacgaggugguguucgcccccgucaccgaggagcaggcgcgcggggcccuccgguucgccaagcugggcuucgagaucuuccugagcuccuuccagggguuccucgugagcgugcuguacugcuucaucaacaaggagguccaguccgagauccgccggggcuggcaccacugccgccugcggcgcagccucggcgaggagcagcggcagcugcccgagcgcgccuuccgggcgcugcccagcggguccggcccgggggaggugcccaccagccgcggccucuccagcgggacgcugcccggccccggcaacgaggccucccgggagcuggagagcuacugcuga

SEQ ID NO: 30576 - RNA, 2313 nt, Artificial Sequence
  derived and/or modified sequence opt1 from GIT1__Homo_sapiens__NP_001078923
augagccgcaagggcccccgggccgaggugugcgccgacugcuccgcgccggaccccgggugggccagcaucucccgcggcguccuggugugcgacgagugcugcagcgugcaccggucccucgggcgccacaucagcaucgucaagcaccuccggcacuccgccuggccgcccacccugcuccagauggugcacacccuggccagcaacggcgccaacuccaucugggagcacagccugcucgacccggcccaggugcaguccgggcgccggaaggcgaacccccaggacaagguccaccccaucaagagcgaguucauccgcgccaaguaccagaugcuggccuucgugcacaagcugcccugccgggacgacgacggcgugacggcgaaggaccucuccaagcagcugcacagcuccguccgcaccggcaaccuggagaccugccuccggcugcugagccucggggcccaggccaacuucuuccacccggagaagggcaccacgccccugcacguggccgccaaggcggggcagacccugcaggccgagcuccugguggucuacggcgccgaccccgggucccccgacgugaacggccgcaccccgaucgacuacgcccggcaggccggccaccacgagcuggcggagcgccucguggagugccaguacgagcugaccgaccggcuggccuucuaccucugcgggcgcaagcccgaccacaagaacggccacuacaucaucccccagauggccgaccggagccgccagaagugcaugucccagagccuggaccugagcgagcucgccaaggccgcgaagaagaagcugcaggcccuguccaaccggcuguucgaggagcuggccauggacgucuacgacgagguggaccgccgggagaacgacgccguguggcuggccacgcagaaccacagcacccucgucaccgagcgcuccgcggugcccuuccugccggugaaccccgaguacagcgccacccgcaaccaggggcggcagaagcuggcccgcuucaacgcccgggaguucgcgacgcucaucaucgacauccuguccgaggccaagcgccggcagcagggcaagagccuguccagccccaccgacaaccucgagcugucccugcgcagccaguccgaccucgacgaccagcacgacuacgacagcgucgccuccgacgaggacaccgaccaggagccccugcggagcaccggcgccacgcgcuccaaccgggcccgcagcauggacuccagcgaccuguccgacggggcggugacccuccaggaguaccuggagcugaagaaggcccucgccaccagcgaggccaaggugcagcagcugaugaaggucaacagcucccugagcgacgagcugcggcgccuccagcgggagauccacaagcugcaggccgagaaccugcagcuccgccagccgcccggccccgugcccaccccgccccugcccuccgagcgggcggagcacacgcccauggcccccgggggcagcacccaccgccgggaccgccaggccuucuccauguacgagcccgggagcgcccugaagcccuucggcggcccgcccggggacgagcucaccacccggcugcagcccuuccacuccacggagcuggaggacgacgccaucuacagcguccacgugcccgcgggccucuaccgcauccgcaaggggguguccgccagcgccgucccguucacccccuccagcccccugcuguccugcagccaggagggcucccggcacaccagcaagcucucccgccacgggagcggcgccgacagcgacuacgagaacacccaguccggcgacccccugcuggggcucgagggcaagcgguuccuggagcuggggaaggaggaggacuuccacccggagcucgagagccuggacggcgaccuggaccccgggcuccccuccacggaggacgugauccugaagaccgagcaggucaccaagaacauccaggagcugcuccgcgcggcccaggaguucaagcacgacagcuucguccccugcuccgagaagauccaccuggccgugaccgagauggccagccuguucccgaagcggcccgcccucgagcccgugcgcuccagccugcggcugcucaacgcguccgccuaccgccugcagagcgagugccggaagacggugcccccggagcccggcgcccccguggacuuccagcugcucacccagcaggucauccagugcgccuacgacaucgccaaggcggccaagcagcuggugaccaucaccacgcgcgagaagaagcaguga

SEQ ID NO: 30577 - RNA, 2046 nt, Artificial Sequence
  derived and/or modified sequence opt1 from GIT2__Homo_sapiens__NP_001128685
augagcaagcgccugcgguccagcgaggugugcgccgacugcuccggccccgacccgagcugggccuccgucaaccgcgggaccuuccucugcgacgagugcugcagcgugcaccggucccugggccgccacaucagccaggugcggcaccugaagcacacccccuggccgcccacgcuccugcagauggucgagacccuguacaacaacggggcgaacuccaucugggagcacagccuccuggaccccgccuccaucaugagcggccgccggaaggccaacccccaggacaaggugcaccccaacaaggccgaguucauccgcgccaaguaccagaugcuggcguucgugcaccggcuccccugccgcgacgacgacuccgucaccgccaaggaccugagcaagcagcugcacuccagcgugcggaccgggaaccucgagacgugccugcgccugcucucccugggcgcccaggccaacuucuuccacccggagaagggcaacacgccccugcacguggcgagcaaggccgggcagauccuccaggccgagcugcuggccgucuacggcgccgaccccgggacccaggacuccagcggcaagacccccguggacuacgcgcggcagggcgggcaccacgagcucgccgagcgccugguggagauccaguacgagcugaccgaccggcucgccuucuaccugugcggccgcaagccggaccacaagaacgggcagcacuucaucaucccccagauggccgaccggcgccugagccucgaccuguccgagcuggccaaggcggccaagaagaagcuccagagccuguccaaccaccuguucgaggagcucgccauggacgucuacgacgagguggaccggcgcgagaccgacgccguguggcuggccacccagaaccacagcgcgcuggucaccgagacgaccguggugcccuuccuccccgucaacccggaguacuccagcacccggaaccagggccgccagaagcuggcccgcuucaacgcccacgaguucgccacccuggugaucgacauccucuccgacgccaagcggcgccagcaggggagcucccugagcggcuccaaggacaacguggagcugauccucaagacgaucaacaaccagcacagcgucgagucccaggacaacgaccagcccgacuacgacagcguggcguccgacgaggacaccgaccuggagaccaccgccagcaagacgaaccggcagaagcugcagacccuccaguccgagaacagcaaccugcgcaagcaggccaccaccaacguguaccagguccagacgggcuccgaguacaccgacaccagcaaccacagcucccugaagcggcgccccagcgcccgggggucccgccccaugagcauguacgagaccggcuccgggcagaagccguaccuccccaugggcgaggcgagccggcccgaggagucccgcaugcggcugcagcccuucccggcccacgccagccgccuggagaagcagaacuccacgcccgagagcgacuacgacaacacccccaacgacauggagcccgacgggaugggcuccagccggaagggccgccagcgguccaugguguggccgggggacggccugguccccgacaccgccgagccccacguggccccgagccccacccuccccuccacggaggacgugauccgcaagaccgagcagaucaccaagaacauccaggagcugcugcgggcggcccaggagaacaagcacgacagcuacauccccugcuccgagcgcauccacgucgccgugaccgagauggccgcccucuucccgaagaagcccaagagcgacauggugcggacgagccugcgccugcucaccuccagcgcguaccgccugcaguccgagugcaagaagacccugcccggggaccccggcagcccgaccgacguccagcucgugacccagcaggucauccagugcgccuacgacaucgccaaggccgccaagcagcuggugacgaucaccaccaaggagaacaacaacuga

SEQ ID NO: 30578 - RNA, 1149 nt, Artificial Sequence
  derived and/or modified sequence opt1 from GJA1__Homo_sapiens__NP_000156
augggcgacuggagcgcccuggggaagcuccuggacaaggugcaggccuacuccaccgcgggcgggaaggucuggcugagcguccucuucaucuuccgcauccugcugcucggcaccgccguggaguccgccuggggcgacgagcagagcgccuuccggugcaacacgcagcagcccgggugcgagaacgugugcuacgacaaguccuucccgaucagccacgugcgcuucugggugcugcagaucaucuucgucuccgugcccacccugcucuaccuggcccacguguucuacgucaugcggaaggaggagaagcugaacaagaaggaggaggagcucaagguggcgcagaccgacggcgugaacgucgacaugcaccugaagcagaucgagaucaagaaguucaaguacgggaucgaggagcacggcaaggugaagaugcgcgggggccugcuccggaccuacaucaucagcauccuguucaaguccaucuucgagguggccuuccugcucauccagugguacaucuacggguucagccuguccgccgucuacacgugcaagcgcgaccccugcccccaccagguggacugcuuccugagccggccgaccgagaagaccaucuucaucaucuucaugcucguggucucccuggugagccuggcccucaacaucaucgagcuguucuacguguucuucaagggcgucaaggaccgcgugaagggcaaguccgaccccuaccacgcgaccagcggggcccugucccccgccaaggacugcggcagccagaaguacgccuacuucaacgggugcuccagccccacggccccgcucagccccauguccccgcccggcuacaagcuggugaccggcgaccggaacaacagcuccugccgcaacuacaacaagcaggcgagcgagcagaacugggccaacuacuccgccgagcagaaccggauggggcaggccggcagcaccaucuccaacagccacgcccagcccuucgacuuccccgacgacaaccagaacuccaagaagcuggcggccgggcacgagcuccagccccuggccaucgucgaccagcgccccagcucccgggccagcucccgcgccagcucccggccgcgccccgacgaccuggagaucuga

SEQ ID NO: 30579 - RNA, 1308 nt, Artificial Sequence
  derived and/or modified sequence opt1 from GJA3__Homo_sapiens__NP_068773
augggcgacuggagcuuccuggggcgccuccuggagaacgcccaggagcacuccaccgugaucggcaaggucuggcugaccgugcucuucaucuuccggauccuggugcugggggccgcggccgaggacgucuggggcgacgagcagagcgacuucacgugcaacacccagcagcccgggugcgagaacgugugcuacgaccgcgccuucccgaucucccacauccgguucugggcccuccagaucaucuucgugagcacccccacccugaucuaccugggccacguccuccacaucgugcgcauggaggagaagaagaaggagcgggaggaggaggagcagcugaagcgcgagucccccagccccaaggagccgccccaggacaaccccuccagccgggacgaccgcggccgggugcgcauggccggggcgcugcuccggacguacgucuucaacaucaucuucaagacccuguucgaggugggcuucaucgccgggcaguacuuccuguacggcuucgagcucaagccccuguaccgcugcgaccgguggccgugccccaacaccguggacugcuucaucucccgccccaccgagaagacgaucuucaucaucuucaugcuggccgucgccugcgcgagccuccugcugaacaugcucgagaucuaccaccugggguggaagaagcugaagcagggcgugaccucccggcucggccccgacgccagcgaggccccgcuggggaccgccgacccccccccccugccgcccuccagccgcccccccgccguggcgaucggcuucccgcccuacuacgcccacaccgccgccccccucgggcaggcccgggcggucggcuaccccggcgccccgccccccgccgccgacuucaagcugcuggcccucacggaggcgcgcgggaagggccaguccgccaagcuguacaacgggcaccaccaccugcucaugaccgagcagaacugggccaaccaggccgccgagcggcagcccccggcgcugaaggccuaccccgccgccagcacccccgcggccccgucccccgugggcagcuccagccccccccuggcccacgaggccgaggccggggcggccccgcuccugcuggacggcagcggcuccagccucgagggguccgcccuggccggcacccccgaggaggaggagcaggccgugacgaccgcggcccagaugcaccagcccccccugccgcucggggaccccggccgcgccagcaaggccucccgggccagcuccgggcgcgcgcgccccgaggaccuggccaucuga

SEQ ID NO: 30580 - RNA, 1284 nt, Artificial Sequence
  derived and/or modified sequence opt1 from GJA8__Homo_sapiens__XP_011507719
augggcgacuggagcuuccuggggaacauccucgaggaggugaacgagcacuccaccgucaucggccgcguguggcugaccgugcuguucaucuuccggauccucauccuggggacggccgccgaguucgucuggggcgacgagcagagcgacuucgugugcaacacccagcagcccgggugcgagaacgugugcuacgacgaggcguucccgaucucccacauccgccuguggguccuccagaucaucuucgugagcacccccucccugauguacgugggccacgccguccacuacgugcggauggaggagaagcgcaagagccgggaggccgaggagcugggccagcaggccgggaccaacggcgggcccgaccagggcuccgugaagaaguccuccgggagcaagggcacgaagaaguuccgccucgagggcacccugcugcggaccuacaucugccacaucaucuucaagacccucuucgaggucggguucaucgugggccacuacuuccuguacggguuccgcauccugccccucuaccggugcucccgcuggccgugccccaacguggucgacugcuucgugagccggcccacggagaagaccaucuucauccuguucaugcuguccguggccagcgucucccucuuccugaacgugauggagcugggccaccucggccugaaggggauccgcagcgcgcugaagcggcccguggagcagccgcucggcgagauccccgagaagucccugcacagcaucgccgucuccagcauccagaaggccaagggguaccagcugcucgaggaggagaagaucgugagccacuacuucccccugaccgaggugggcauggucgagaccagcccccugccggccaagcccuucaaccaguucgaggagaagaucagcacggggccccucggcgaccugucccgcggcuaccaggagacccugcccagcuacgcccaggugggggcgcaggaggucgagggcgaggggccgcccgccgaggagggcgccgagcccgaggugggggagaagaaggaggaggccgagcggcucaccaccgaggagcaggagaagguggcgguccccgagggcgagaagguggagacgccgggcguggacaaggagggggagaaggaggagccccaguccgagaaggucagcaagcagggccugcccgccgagaagacccccucccugugcccggagcucaccaccgacgacgcccgcccccugagccggcuguccaaggccagcucccgcgcccgguga

SEQ ID NO: 30581 - RNA, 852 nt, Artificial Sequence
  derived and/or modified sequence opt1 from GJB1__Homo_sapiens__NP_000157
augaacuggaccggccuguacacccuccugagcggggugaaccgccacuccacggccaucggccgggucuggcugagcgugaucuucaucuuccgcaucauggugcucgucguggccgcggaguccguguggggcgacgagaaguccagcuucaucugcaacacccugcagcccgggugcaacagcgucugcuacgaccaguucuucccgaucucccacgugcggcuguggagccuccagcugauccugguguccacccccgcccuccuggucgccaugcacguggcccaccagcagcacaucgagaagaagaugcugcgccucgaggggcacggcgacccccugcaccuggaggaggugaagcggcacaagguccacaucagcggcacccucugguggacguacgugaucuccguggucuuccgccugcuguucgaggccguguucauguacguguucuaccuccuguaccccggguacgcgaugguccggcuggugaagugcgacguguacccgugccccaacaccgucgacugcuucgugagccgccccaccgagaagaccguguucacggucuucaugcucgccgccuccggcaucugcaucauccugaacguggccgaggucguguaccugaucauccgggcgugcgcccgccgggcccagcgccggagcaacccgcccucccgcaaggggagcggcuucgggcaccggcucucccccgaguacaagcagaacgagaucaacaagcugcugagcgagcaggacggcucccucaaggacauccugcgccggagccccggcaccggggccggccuggccgagaaguccgaccgcugcagcgcgugcuga

SEQ ID NO: 30582 - RNA, 681 nt, Artificial Sequence
  derived and/or modified sequence opt1 from GJB2__Homo_sapiens__NP_003995
auggacugggggacccugcagaccauccucgggggcgugaacaagcacagcacguccaucgggaagaucuggcugaccguccuguucaucuuccgcaucaugauccucgugguggccgccaaggaggucuggggcgacgagcaggcggacuucgugugcaacacccugcagcccgggugcaagaacgugugcuacgaccacuacuucccgaucagccacauccggcugugggcccuccagcugaucuucgucuccacccccgcccugcucguggccaugcacguggccuaccgccggcacgagaagaagcgcaaguucaucaagggcgagaucaagagcgaguucaaggacaucgaggagaucaagacgcagaagguccggaucgagggcucccugugguggaccuacaccagcuccaucuucuuccgcgugaucuucgaggcggccuucauguacguguucuacgucauguacgacggguucagcaugcagcggcuggugaagugcaacgccuggcccugccccaacaccguggacugcuucgucucccgcccgacggagaagaccguguucaccguguucaugaucgccgucagcggcaucugcauccuccugaacgugaccgagcugugcuaccuccugauccgguacugcuccggcaagagcaagaagcccguguga

SEQ ID NO: 30583 - RNA, 786 nt, Artificial Sequence
  derived and/or modified sequence opt1 from GJB6__Homo_sapiens__NP_001103691
auggacuggggcacccugcacaccuucaucgggggcgugaacaagcacagcacguccaucgggaaggucuggaucaccgugaucuucaucuuccgcgugaugauccucgucguggccgcccaggagguguggggcgacgagcaggaggacuucgucugcaacacccugcagcccgggugcaagaacgugugcuacgaccacuucuucccggugagccacauccggcugugggcgcuccagcugaucuucgucuccacccccgcccugcucguggccaugcacguggccuacuaccgccacgagacgacccggaaguuccgccggggcgagaagcgcaacgacuucaaggacaucgaggacaucaagaagcagaagguccggaucgagggcagccugugguggaccuacaccuccagcaucuucuuccgcaucaucuucgaggccgcguucauguacguguucuacuuccuguacaacggguaccaccuccccugggugcugaagugcggcaucgaccccugcccgaaccuggucgacugcuucaucucccggcccacggagaagaccguguucaccaucuucaugaucagcgccuccgugaucugcaugcuccugaacgucgccgagcugugcuaccuccugcugaaggugugcuuccgccggagcaagcgcgcccagacccagaagaaccaccccaaccacgcgcucaaggaguccaagcagaacgagaugaacgagcugaucagcgacuccgggcagaacgccaucacgggcuuccccagcuga

SEQ ID NO: 30584 - RNA, 1191 nt, Artificial Sequence
  derived and/or modified sequence opt1 from GJC1__Homo_sapiens__NP_001073852
augagcugguccuuccugacccgccuccuggaggagauccacaaccacagcaccuucgugggcaagaucuggcugacgguccucaucguguuccggaucgugcugaccgccgucgggggcgaguccaucuacuacgacgagcagagcaaguucgugugcaacaccgagcagcccgggugcgagaacgugugcuacgacgccuucgcgccgcugucccacguccgcuucuggguguuccagaucauccucguggccacccccagcgucauguaccugggcuacgccauccacaagaucgccaagauggagcacggggaggccgacaagaaggcggcccgguccaagcccuacgccaugcgcuggaagcagcaccgggcccuggaggagacggaggaggacaacgaggaggaccccaugauguacccggagauggagcucgagagcgacaaggagaacaaggagcagucccagcccaagcccaagcacgacggccgccggcgcauccgggaggacggccugaugaagaucuacgugcugcagcuccuggcgcgcaccguguucgaggucggguuccugaucggccaguacuuccucuacggguuccaggugcaccccuucuacgugugcagccggcugccgugcccccacaagaucgacugcuucaucucccgccccaccgagaagaccaucuuccugcucaucauguacggcgucacggggcugugccugcuccugaacaucugggagaugcugcaccucggcuucggcaccauccgggacagccugaacuccaagcgccgggagcuggaggaccccggggccuacaacuacccguucaccuggaacacccccagcgccccgcccggcuacaacaucgccgugaagcccgaccagauccaguacacggagcucuccaacgccaagaucgcguacaagcagaacaaggccaacaccgcccaggagcagcaguacgggagccacgaggagaaccugcccgccgaccuggaggcccuccagcgcgagauccggauggcgcaggagcgccuggaccuggccgugcaggccuacucccaccagaacaacccccacggcccccgggagaagaaggccaaggucggcagcaaggccggguccaacaagagcaccgcgagcuccaagagcggcgacgggaagaccuccguguggaucuga

SEQ ID NO: 30585 - RNA, 1320 nt, Artificial Sequence
  derived and/or modified sequence opt1 from GJC2__Homo_sapiens__NP_065168
augaccaacaugagcugguccuuccugacccgccuccuggaggagauccacaaccacagcacguucgugggcaaggucuggcugaccgugcucguggucuuccggaucgugcugaccgccgucgggggcgaggccaucuacuccgacgagcaggcgaaguucacgugcaacacccgccagcccgggugcgacaacgugugcuacgacgccuucgccccgcugagccacgugcgguucuggguguuccagaucgucgugaucuccacccccagcgugauguaccucggcuacgccguccaccgccuggcccgggcguccgagcaggagcgccggcgcgcccugcggcgccggcccgggccccgccgggccccgcgcgcccaccucccgccgccccacgcgggcuggcccgagcccgccgaccugggcgaggaggagcccaugcuggggcucggcgaggaggaggaggaggaggagaccggggccgccgagggcgccggggaggaggcggaggaggccggcgccgaggaggccugcaccaaggccgugggcgcggacgggaaggccgccggcacgcccgggcccaccggccagcacgacggccggcgccggauccagcgcgaggggcugaugcggguguacgucgcccagcugguggcccgcgcggccuucgagguggccuuccucgucggccaguaccugcuguacggguucgaggugcggcccuucuuccccugcagccgccagcccugcccgcacguggucgacugcuucgugucccgccccaccgagaagaccguguuccuccuggucauguacguggucagcugccugugccuccugcugaaccucugcgagauggcccaccugggccugggguccgcccaggacgcggugcggggccgccggggcccgcccgccagcgcccccgcccccgcgccccggcccccgcccugcgccuuccccgccgccgccgcggggcucgccugcccgcccgacuacucccuggugguccgcgccgccgagcgcgcccgggcgcacgaccagaaccuggccaaccucgcccugcaggcccugcgcgacggcgccgcggccggggaccgggaccgcgacagcucccccugcgugggccuccccgccgccagccgggggccgccccgcgcgggcgcccccgccucccggacgggcagcgccaccuccgccgggaccgugggcgagcaggggcgccccggcacccacgagcggccgggggcgaagccccgcgccggcagcgagaagggcagcgccuccagccgggacgggaagacgaccgucuggaucuga

SEQ ID NO: 30586 - RNA, 840 nt, Artificial Sequence
  derived and/or modified sequence opt1 from GJC3__Homo_sapiens__NP_853516
augugcggccgcuuccugcggcgccuccuggccgaggagagccggcgcuccacccccguggggcggcugcuccugccgguccugcucggcuuccgccuggugcugcucgccgcgagcgggcccggcguguacggggacgagcaguccgaguucgucugccacacccagcagcccggcugcaaggccgccugcuucgacgccuuccacccccugagcccgcugcgguucuggguguuccaggugauccucgucgccgugcccuccgcgcuguacaugggcuucacgcuguaccacgugaucuggcacugggagcucagcgggaagggcaaggaggaggagacccugauccaggggcgcgagggcaacaccgacguccccggggccggcucccugcggcuccugugggccuacguggcccagcugggcgcgcgccucgugcuggagggggccgcccugggccuccaguaccaccuguacggguuccagaugcccagcuccuucgccugccggcgcgagccgugccugggcagcaucacgugcaaccucucccggcccagcgagaagaccaucuuccugaagaccauguucggcgucuccggguucugccuccuguucaccuuccuggagcuggugcuccugggccuggggcgcugguggcggaccuggaagcacaagagcuccagcuccaaguacuuccucacgagcgaguccacccgccggcacaagaaggccaccgacagccugcccguggucgagaccaaggagcaguuccaggaggcggugcccggccgcagccuggcccaggagaagcagcggccgguggggccccgcgacgccuga

SEQ ID NO: 30587 - RNA, 966 nt, Artificial Sequence
  derived and/or modified sequence opt1 from GJD2__Homo_sapiens__NP_065711
augggcgaguggaccauccuggagcgccuccuggaggccgccgugcagcagcacagcaccaugaucgggcggauccugcucacggucguggugaucuuccgcauccugaucgucgcgaucgugggcgagaccguguacgacgacgagcagaccauguucgucugcaacacccugcagcccgggugcaaccaggccugcuacgaccgggccuucccgaucucccacauccgcuacuggguguuccagaucaucauggugugcacgcccagccucugcuucaucaccuacuccguccaccagagcgccaagcagcgggagcgccgguacuccaccguguuccuggcccuggaccgcgacccgcccgagagcaucggcgggcccggcggcaccgggggcgggggcuccgggggcggcaagcgggaggacaagaagcuccagaacgcgaucgugaacgggguccugcagaacacggagaacaccagcaaggagaccgagcccgacugccuggaggugaaggagcucacgccccaccccuccggccugcgcaccgccagcaaguccaagcugcggcgccaggaggggaucagccgguucuacaucauccagguggucuuccgcaacgcccucgagaucggcuuccuggugggccaguacuuccuguacggguucuccgugccgggccucuacgagugcaaccgguaccccugcaucaaggaggucgagugcuacgugagccgccccaccgagaagaccguguuccuggucuucauguucgccguguccgggaucugcgugguccugaaccucgcggagcugaaccaccugggcuggcggaagaucaagcucgccgugcgcggggcccaggccaagcgcaagagcaucuacgagauccggaacaaggaccugccccgggucuccgugccgaacuucggccgcacccagagcuccgacagcgccuacguguga

SEQ ID NO: 30588 - RNA, 885 nt, Artificial Sequence
  derived and/or modified sequence opt1 from GJD3__Homo_sapiens__NP_689343
augggcgagugggccuuccuggggagccuccuggacgccgugcagcugcagagcccccucgucggccgccuguggcugguggugaugcucaucuuccggauccugguccuggcgaccgucgggggcgccguguucgaggacgagcaggaggaguucgugugcaacacccuccagcccgggugccgccagacgugcuacgaccgggccuuccccgugucccacuaccgcuucuggcuguuccacauccugcuccuguccgccccgcccgugcuguucgucguguacagcaugcaccgggccggcaaggaggcgggcggggccgaggccgccgcgcagugcgcccccggccuccccgaggcccagugcgcccccugcgcccugcgcgcgcggcgcgcccggcgcugcuaccugcucuccguggcccugcggcugcucgccgagcugaccuuccucgggggccaggcccugcuguacggguuccgcgucgcgccccacuucgccugcgccggcccgcccugcccccacaccguggacugcuucgugagccggcccaccgagaagacggucuucgugcuguucuacuucgccgugggccuccuguccgcccugcucagcgucgcggagcuggggcaccuccuguggaagggccgcccccgggccggggagcgcgacaaccggugcaaccgcgcccacgaggaggcccagaagcugcugcccccgccgcccccgccgccgcccccgcccgcccuccccucccggcgccccggccccgagcccugcgcgccgcccgccuacgcccaccccgcccccgcgagccugcgggagugcggcuccgggcgcggcaaggccagccccgccaccgggcgccgggaccuggccaucuga

SEQ ID NO: 30589 - RNA, 1575 nt, Artificial Sequence
  derived and/or modified sequence opt1 from GK__Homo_sapiens__NP_000158
auggccgccagcaagaaggcggugcugggcccccucgucggggccguggaccagggcaccuccagcacccgcuuccugguguucaacuccaagacggccgagcugcucagccaccaccaggucgagaucaagcaggaguucccgcgggagggguggguggagcaggaccccaaggagauccugcacuccguguacgagugcaucgagaagaccugcgagaagcugggccagcucaacaucgacaucagcaacaucaaggccaucggggucuccaaccagcgcgagaccaccguggugugggacaagaucacgggcgagccccuguacaacgccgucguguggcuggaccuccggacccagagcaccguggagucccugagcaagcgcauccccggcaacaacaacuucgucaaguccaagaccgggcugccgcucagcacguacuucuccgcggugaagcugcgguggcugcucgacaacgugcgcaagguccagaaggccguggaggagaagcgggcccuguucggcaccaucgacagcuggcugaucuggucccucaccgggggcgugaacgggggcguccacugcaccgacgugacgaacgccagccgcaccaugcuguucaacauccacucccuggagugggacaagcagcucugcgaguucuucggcauccccauggagauccugcccaacgugcggagcuccagcgagaucuacgggcugaugaaggcgggcgcccucgaggggguccccaucagcggcugccugggcgaccaguccgccgcccugguggggcagaugugcuuccagaucggccaggccaagaacaccuacgggaccggcugcuuccuccugugcaacacggggcacaagugcguguucagcgaccacggccugcucaccaccgucgcguacaagcugggccgcgacaagccgguguacuacgcccuggagggguccgucgccaucgccggcgccgugauccgguggcuccgcgacaaccuggggaucaucaagaccagcgaggagaucgagaagcuggcgaaggaggugggcacguccuacgggugcuacuucguccccgccuucagcggccucuacgcccccuacugggagcccuccgcccggggcaucaucugcgggcugacccaguucaccaacaagugccacaucgccuucgcggcccuggaggccgugugcuuccagacccgcgagauccucgacgccaugaaccgggacugcggcaucccgcugagccaccuccagguggacgggggcaugacguccaacaagauccugaugcagcugcaggccgacauccuguacauccccgucgugaagcccagcaugcccgagaccaccgcgcucggggccgccauggccgcgggcgccgccgagggcgugggggucuggucccuggagccggaggaccugagcgccgugaccauggagcgcuucgagccccagaucaacgccgaggaguccgagauccgguacagcacguggaagaaggcggugaugaaguccaugggcugggucaccacccagagccccgaguccgggauccccuga

SEQ ID NO: 30590 - RNA, 600 nt, Artificial Sequence
  derived and/or modified sequence opt1 from GKN1__Homo_sapiens__NP_062563
augcuggccuacagcuccgugcacugcuuccgcgaggacaagaugaaguucaccaucgucuucgccggccuccuggggguguuccuggcgcccgcccucgccaacuacaacaucaacgugaacgacgacaacaacaacgccggcagcgggcagcaguccgucagcgugaacaacgagcacaacguggccaacgucgacaacaacaacggcugggacuccuggaacagcaucugggacuacgggaacggcuucgcggccacccggcuguuccagaagaagacgugcaucgugcacaagaugaacaaggaggugaugccguccauccagagccuggacgcccucgucaaggagaagaagcugcagggcaaggggcccggcgggcccccgcccaagggccugauguacuccgugaaccccaacaagguggacgaccucagcaaguucgggaagaacaucgccaacaugugccgcggcauccccaccuacauggcggaggagaugcaggaggccucccuguucuucuacagcgggaccugcuacaccacguccguccuguggaucguggacaucagcuucugcggcgacaccguggagaacuga

SEQ ID NO: 30591 - RNA, 555 nt, Artificial Sequence
  derived and/or modified sequence opt1 from GKN2__Homo_sapiens__NP_872342
augaagauccugguggccuuccucgucgugcugaccaucuucggcauccagagccacggguacgagguguucaacaucaucucccccagcaacaacggcgggaacguccaggagaccgugacgaucgacaacgagaagaacaccgccaucaucaacauccacgcgggcuccugcagcuccaccaccaucuucgacuacaagcacggguacaucgccagccgcgugcugucccggcgcgccugcuucauccucaagauggaccaccagaacaucccgccccugaacaaccugcagugguacaucuacgagaagcaggcccucgacaacauguucagcuccaaguacacgugggucaaguacaacccccuggagagccugaucaaggacguggacugguuccuccugggcucccccaucgagaagcugugcaagcacaucccgcucuacaagggcgagguggucgagaacacccacaacgugggggccggcgggugcgcgaaggccggccugcuggggauccucggcaucagcaucugcgccgacauccacguguga

SEQ ID NO: 30592 - RNA, 1290 nt, Artificial Sequence
  derived and/or modified sequence opt1 from GLA__Homo_sapiens__NP_000160
augcagcugcgcaaccccgagcuccaccugggcugcgcccuggcccuccgguuccuggcgcuggugagcugggacaucccgggggcccgcgcccucgacaacggccuggcccggacccccaccaugggguggcugcacugggagcgcuucaugugcaaccucgacugccaggaggagcccgacuccugcaucagcgagaagcuguucauggagauggccgagcugauggucuccgagggcuggaaggacgcgggguacgaguaccucugcaucgacgacugcuggauggcgccccagcgggacagcgagggccgccugcaggccgacccgcagcgguucccccacggcauccgccagcuggccaacuacgugcacuccaaggggcucaagcugggcaucuacgccgacguggggaacaagacgugcgccggcuuccccgggagcuucggcuacuacgacaucgacgcccagaccuucgccgacuggggcgucgaccugcucaaguucgacgggugcuacugcgacucccuggagaaccuggccgacggcuacaagcacaugagccucgcgcugaaccggaccgggcgcuccaucguguacagcugcgaguggccccuguacauguggccguuccagaagcccaacuacaccgagauccggcaguacugcaaccacuggcgcaacuucgccgacaucgacgacuccuggaaguccaucaaguccauccucgacuggacgagcuucaaccaggagcggaucguggacgucgccggccccggcggguggaacgaccccgacaugcuggugaucggcaacuucgggcuguccuggaaccagcaggucacccagauggcccucugggccaucauggcggccccgcuguucaugagcaacgaccugcgccacaucagcccccaggccaaggcccuccugcaggacaaggacgugaucgccaucaaccaggacccccugggcaagcagggguaccagcuccggcagggcgacaacuucgaggugugggagcgcccccugagcggccuggcgugggccguggccaugaucaaccggcaggagaucgggggcccgcgcuccuacaccaucgccgucgccagccucgggaagggcguggcgugcaaccccgccugcuucaucacccagcugcugcccgugaagcggaagcucggguucuacgaguggacgagccgccugcggucccacaucaaccccaccggcaccguccugcuccagcuggagaacaccaugcagaugagccugaaggaccuccuguga

SEQ ID NO: 30593 - RNA, 2034 nt, Artificial Sequence
  derived and/or modified sequence opt1 from GLB1__Homo_sapiens__NP_000395
augcccggcuuccuggugcgcauccucccccugcugcucguccugcugcuccuggggcccacccggggccugcgcaacgccacccagcggauguucgagaucgacuacagccgcgacuccuuccucaaggacgggcagcccuuccgguacaucagcggcuccauccacuacagccgcgugccccgguucuacuggaaggaccgccugcugaagaugaagauggccgggcucaacgcgauccagacguacgugccguggaacuuccacgagcccuggcccggccaguaccaguucuccgaggaccacgacgucgaguacuuccugcggcuggcccacgagcucggccugcuggugauccuccgccccgggccguacaucugcgccgagugggagaugggcgggcugcccgccuggcugcucgagaaggagagcauccugcugcgguccagcgaccccgacuaccucgccgcgguggacaaguggcugggcguccugcuccccaagaugaagccgcugcuguaccagaacgggggccccgugaucaccgugcaggucgagaacgaguacggcuccuacuucgccugcgacuucgacuaccuccgcuuccugcagaagcgguuccgccaccaccugggggacgacgugguccucuucaccaccgacggcgcccacaagacguuccugaagugcggggcccugcagggccucuacaccaccguggacuucggcaccgggagcaacaucacggacgcguuccugucccagcggaagugcgagcccaagggcccccugaucaacagcgaguucuacaccggguggcucgaccacuggggccagccgcacuccaccaucaagaccgaggccguggccagcucccuguacgacauccuggcccgcggggccagcgugaaccucuacauguucaucggcggcacgaacuucgcguacuggaacggggccaacucccccuacgccgcccagcccaccagcuacgacuacgacgcgccccuguccgaggccggcgaccugaccgagaaguacuucgcccuccggaacaucauccagaaguucgagaaggucccggaggggcccaucccgcccagcacccccaaguucgccuacggcaaggugacgcuggagaagcugaagaccgugggggccgcccucgacauccugugccccagcggccccaucaagucccuguacccccugaccuucauccaggucaagcagcacuacggcuucgugcucuaccgcaccacgcugccgcaggacugcagcaaccccgcgccccuguccagcccgcucaacggggugcacgaccgggccuacgucgccguggacggcaucccccagggggugcuggagcgcaacaacgucaucacccugaacaucaccggcaaggccggggccacccucgaccugcugguggagaacaugggccgggucaacuacggcgcguacaucaacgacuucaaggggcucguguccaaccugacgcugagcuccaacauccucaccgacuggaccaucuucccccuggacaccgaggacgccgugcgcagccaccugggcggguggggccaccgcgacuccggccaccacgacgaggccugggcccacaacagcuccaacuacacgcuccccgcguucuacauggggaacuucagcaucccguccggcauccccgaccugccccaggacaccuucauccaguuccccggguggaccaagggccaggucuggaucaacggguucaaccugggccgguacuggccggcccgcggcccccagcucacccuguucgugccccagcacauccugaugacgagcgcccccaacaccaucaccgugcucgagcuggagugggccccgugcuccagcgacgaccccgagcugugcgccgucaccuucguggaccggcccgugaucggguccagcgucacguacgaccaccccuccaagccgguggagaagcgccucaugcccccgccgccccagaagaacaaggacagcuggcuggaccacguguga

SEQ ID NO: 30594 - RNA, 1644 nt, Artificial Sequence
  derived and/or modified sequence opt1 from GLCCI1__Homo_sapiens__NP_612435
augagcaccgccuccagcuccagcuccagcuccagcucccagacgccccacccgcccagccagcgcaugcggcgcuccgccgcgggcagcccgcccgccguggccgccgccggguccggcaacggggcgggcgggggcggcggggucggcugcgcccccgccgccggggcgggccggcugcuccagcccauccgcgccaccgugcccuaccagcugcugcgggggagccagcacucccccacccgcccgcccguggccgccgccgcggccagccucggcucccugcccggccccggggccgcccggggcccgagccccuccagccccacgcccccggccgcggccgcccccgccgagcaggcgccccgcgccaaggggcggccccgccggagcccggagucccaccgccggagcuccagccccgagcgccggucccccggcagccccgucugccgcgccgacaaggccaagucccagcagguccggaccagcuccaccauccgccggaccagcucccuggacaccaucaccggcccguaccucacggggcaguggccccgcgacccccacgugcacuaccccagcugcaugaaggacaaggccacccagaccccguccugcugggccgaggagggcgcggagaagcggagccaccagcgcuccgccagcuggggguccgccgaccagcugaaggagcagaucgccaagcugcgccagcagcuccagcggagcaagcaguccagccgccacagcaaggagaaggaccggcagagcccccugcacggcaaccacaucaccaucucccacacgcaggcgaccgggucccgcagcgugcccaugccgcuguccaacaucagcgugcccaaguccagcgugucccggguccccugcaacguggagggcaucagccccgagcucgagaagguguucaucaaggagaacaacggcaaggaggaggucuccaagccgcuggacauccccgacgggcgccgggccccgcugcccgcccacuaccgcagcuccagcacccgguccaucgacacccagacgcccagcgugcaggagcgcuccagcagcugcuccagccacucccccugcgugagccccuucugcccgcccgagucccaggacggcagccccugcuccaccgaggaccuccuguacgaccgggacaaggacagcggguccagcagcccccugcccaaguacgccuccuccccgaagcccaacaacagcuacauguucaagcgcgagccgcccgagggcugcgagcgggucaagguguucgaggagauggccucccgccagcccaucagcgcgccccucuucuccugccccgacaagaacaaggugaacuucauccccaccgggagcgccuucugcccggucaagcugcugggcccccuccugcccgccuccgaccugaugcucaagaacagcccgaacagcggccaguccagcgcccuggccacccugacgguggagcagcucuccagccggguguccuucaccagccuguccgacgacaccagcaccgcgggguccauggaggccagcguccagcagcccucccagcagcagcagcugcuccaggagcugcagggcgaggaccacaucagcgcccagaacuacgugaucaucuga

SEQ ID NO: 30595 - RNA, 1854 nt, Artificial Sequence
  derived and/or modified sequence opt1 from GLCE__Homo_sapiens__XP_005254355
augcgcugccuggccgcccgggugaacuacaagacccucaucaucaucugcgcgcuguucacccuggucacggugcuccuguggaacaagugcagcuccgacaaggccauccaguucccccgccggagcuccagcggcuuccgcguggacggguucgagaagcgggccgccgccuccgagagcaacaacuacaugaaccacgucgcgaagcagcaguccgaggaggccuucccgcaggagcagcagaaggccccgcccguggugggcggguucaacagcaacgucggcuccaaggugcuggggcucaaguacgaggagaucgacugccugaucaacgacgagcacaccaucaagggccgccgggagggcaacgagguguuccugcccuucaccugggucgagaaguacuucgacguguacgggaaggugguccaguacgacggcuacgaccgcuucgaguucagccacuccuacagcaagguguacgcccagcgggcgcccuaccaccccgacgggguguucauguccuucgagggcuacaacgucgaggugcgcgaccgggugaagugcaucagcggggucgagggcgugccccucuccacccaguggggcccccagggguacuucuacccgauccagaucgcccaguacggccugagccacuacuccaagaaccugacggagaagccgccccacaucgagguguacgagaccgccgaggaccgcgacaagaacaagcccaacgacuggaccguccccaaggggugcuucauggccaacguggccgacaagagccgguucaccaacgugaagcaguucaucgcgcccgagacguccgagggcgucagccuccagcugggcaacaccaaggacuucaucaucagcuucgaccugaaguuccucaccaacggguccgugagcgucgugcuggagaccacggagaagaaccagcuguucaccauccacuacguguccaacgcccagcucaucgccuucaaggagcgcgacaucuacuacggcaucgggccccggaccagcugguccaccgucacgcgcgaccuggugaccgaccugcggaagggcguggggcucagcaacaccaaggccgucaagcccaccaagaucaugccgaagaagguggugcgccugaucgccaagggcaagggcuuccuggacaacaucacgaucuccaccaccgcgcacauggccgccuucuucgccgccagcgacuggcucguccggaaccaggacgagaagggcggguggcccaucauggugacccgcaagcugggggagggcuucaagucccuggagcccgggugguacagcgcgauggcccagggccaggccaucuccacgcucgugcgggccuaccugcugaccaaggaccacaucuuccucaacagcgcccugcgcgcgaccgcccccuacaaguuccuguccgagcagcacggcgucaaggccguguucaugaacaagcacgacugguacgaggaguacccgaccacgcccagcuccuucgugcucaacggguucauguacagccugaucggccuguacgaccucaaggagaccgccggggagaagcugggcaaggaggcgcgcucccuguacgagcgggggauggagagccucaaggccaugcugccccuguacgacaccggcuccggcaccaucuacgaccuccgccacuucaugcuggggaucgcccccaaccuggcccggugggacuaccacacgacccacaucaaccagcuccagcugcugagcaccaucgacgagagcccggucuucaaggaguucgugaagcgcuggaaguccuaccucaagggcagccgggccaagcacaacuga

SEQ ID NO: 30596 - RNA, 3063 nt, Artificial Sequence
  derived and/or modified sequence opt1 from GLDC__Homo_sapiens__NP_000161
augcagagcugcgcccgcgccuggggccugcggcucgggcgcggcgucgggggcgggcggcgccuggcgggcggcuccgggcccugcugggccccgcggagccgcgacuccagcuccggcgggggcgacagcgccgccgccggggcgucccggcugcucgagcgccugcugccccggcacgacgacuucgcccgccggcacaucggccccggcgacaaggaccagcgcgagaugcuccagacccuggggcuggccagcaucgacgagcucaucgagaagaccgugcccgccaacauccggcugaagcgcccgcugaagauggaggaccccgugugcgagaacgagauccucgcgacccugcacgccaucuccagcaagaaccagaucuggcgguccuacaucggcaugggguacuacaacugcagcgugccccagaccauccugcgcaaccuccuggagaacuccggcuggaucacccaguacacccccuaccagccggaggucagccagggccggcuggagucccuccugaacuaccagacgauggugugcgacaucaccgggcuggacauggccaacgccagccuccuggacgagggcaccgccgcggccgaggcccugcagcucugcuaccgccacaacaagcggcgcaaguuccugguggacccccggugccacccccagaccaucgccgucgugcagacgcgcgccaaguacaccggggugcugaccgagcucaagcugcccugcgagauggacuucuccggcaaggacgucagcggggugcuguuccaguacccggacaccgagggcaagguggaggacuucacggagcucgucgagcgcgcgcaccaguccggcagccuggccugcugcgccaccgaccugcucgcccugugcauccugcggccgcccggggaguucggcguggacaucgcccucgggagcucccagcgcuucggcgugccccugggguacggcggcccccacgcggccuucuucgccguccgggagagccuggugcgcaugaugcccgggcggauggugggcgucacccgcgacgccaccgggaaggagguguaccggcucgcccugcagacgcgcgagcagcacauccggcgcgacaaggcgaccuccaacaucugcaccgcccaggcccugcucgccaacauggcggccauguucgccaucuaccacggcagccacgggcuggagcacaucgcccggcgcgugcacaacgccacccugauccucuccgagggccugaagcgggcgggccaccagcugcagcacgaccucuucuucgacacgcugaagauccagugcgggugcagcgucaaggaggugcugggccgcgccgcccagcggcagaucaacuuccgccuguucgaggacgggacccucggcaucucccuggacgagaccgugaacgagaaggaccuggacgaccuccuguggaucuucggcugcgagagcuccgccgagcuggucgccgagagcaugggggaggagugccggggcauccccggguccguguucaagcgcaccagccccuuccucacgcaccaggucuucaacuccuaccacagcgagaccaacaucgugcgguacaugaagaagcuggagaacaaggacaucucccuggugcacagcaugaucccgcucggcuccugcaccaugaagcugaacagcuccagcgagcuggcgcccaucaccuggaaggaguucgccaacauccaccccuucgucccccucgaccaggcccagggguaccagcagcuguuccgcgagcuggagaaggaccucugcgagcugacgggcuacgaccaggugugcuuccagccgaacagcggcgcccagggggaguacgccggccuggcgaccauccgcgccuaccucaaccagaagggggagggccaccggaccgugugccugauccccaaguccgcccacgggaccaaccccgccagcgcgcacauggccggcaugaagauccagcccgucgagguggacaaguacggcaacaucgacgccgugcaccugaaggccauggucgacaagcacaaggagaaccucgccgcgaucaugaucacguacccguccaccaacgggguguucgaggagaacaucagcgacgugugcgaccugauccaccagcacggcgggcaggucuaccuggacggcgccaacaugaacgcccagguggggaucugccgccccggcgacuucggcuccgacgugagccaccucaaccugcacaagaccuucugcaucccccacgggggcgggggcccggggaugggccccaucggcgucaagaagcaccuggcccccuuccuccccaaccacccggugaucucccugaagcggaacgaggacgccugccccguggggaccgucagcgcggcccccuggggcuccagcuccauccugcccaucagcugggccuacaucaagaugaugggcgggaagggccucaagcaggccacggagaccgccauccugaacgcgaacuacauggccaagcgccuggagacccacuaccggauccucuuccgcggggcccggggcuacguggggcacgaguucauccuggacacccgcccguucaagaaguccgccaacaucgaggcgguggacgucgccaagcggcugcaggacuacggcuuccacgcccccaccaugagcuggcccguggccgggacgcucaugguggagcccaccgaguccgaggacaaggccgagcuggaccgcuucugcgacgcgaugaucagcauccggcaggagaucgccgacaucgaggagggccgcaucgacccgcgggucaacccccugaagaugagcccccacucccugaccugcgugaccagcucccacugggaccgccccuacagccgggagguggccgccuucccgcuccccuucgucaagcccgagaacaaguucuggcccacgaucgcccgcaucgacgacaucuacggcgaccagcaccuggugugcacgugcccgcccauggagguguacgagucccccuucagcgagcagaagcgggcguccagcuga

SEQ ID NO: 30597 - RNA, 1656 nt, Artificial Sequence
  derived and/or modified sequence opt1 from GLDN__Homo_sapiens__NP_861454
auggcccgcggcgccgagggcggccgcggggacgcgggcugggggcugcggggcgcccucgccgccguggcccugcugagcgcgcucaacgccgccggcaccgucuucgcccugugccaguggcgggggcuguccagcgcgcuccgcgcccuggaggcccagcggggccgcgagcagcgggaggacuccgcccugcgcagcuuccucgccgagcugucccgggcgccccgcggggccagcgccccgccccaggaccccgccuccagcgcccggaacaagcgcucccacagcggcgagcccgcgccgcacauccgggccgagucccacgacaugcugaugaugaugaccuacagcauggugcccauccgcgugauggucgaccucugcaacuccacgaaggggaucugccugaccggccccagcggcccgcccgggccgcccggcgccgggggccugcccggccacaacgggcucgacggccagcccgggccccagggccccaagggggagaagggcgccaacggcaagcgggggaagaugggcauccccggggccgcgggcaaccccggggagcgcggcgagaagggcgaccacggggagcugggccugcaggggaacgagggcccgcccgggcagaagggcgagaagggcgacaagggggacguguccaacgacgugcuccuggccggcgccaagggggaccaggggccgcccggcccgcccgggccgcccggcccgcccgggccgcccggcccgcccgggagccggcgcgccaagggcccccggcagcccuccauguucaacggccagugccccggggagaccugcgccauccccaacgacgacacccuggucggcaaggcggacgagaaggccagcgagcaccacagcccccaggccgaguccaugaucacgagcaucgggaaccccguccaggugcucaaggugaccgagaccuucggcaccuggauccgcgaguccgccaacaagagcgacgaccggaucugggugacggagcacuucuccgggaucauggugaaggaguucaaggaccagcccagccugcugaacggcuccuacaccuucauccaccuccccuacuacuuccacggcugcgggcacgucguguacaacaacagccuguacuaccacaagggcggguccaacacccuggugcgcuucgaguucggccaggagaccagccagacgcucaagcuggagaacgcgcuguacuucgaccgcaaguaccucuucgccaacuccaagaccuacuucaaccuggccgucgacgagaaggggcuguggaucaucuacgccagcuccguggacggcagcuccauccucguggcccagcuggacgagcggaccuucagcgucgugcagcacgugaacaccacguaccccaaguccaaggcgggcaacgccuucaucgcccgcgggauccuguacgucaccgacaccaaggacaugcgggugaccuucgccuucgaccuccugggcgggaagcagaucaacgccaacuucgaccugcgcacgagccaguccgugcucgcgaugcuggccuacaacaugcgggaccagcaccuguacagcugggaggacggccaccucaugcuguaccccguccaguuccuguccaccacccucaaccaguga

SEQ ID NO: 30598 - RNA, 2097 nt, Artificial Sequence
  derived and/or modified sequence opt1 from GLE1__Homo_sapiens__NP_001003722
augcccagcgagggccgcugcugggagacccugaaggcccuccgguccagcgacaaggggcgccugugcuacuaccgggacuggcugcuccgccgggaggacgugcuggaggagugcaugucccugccgaagcucagcuccuacagcggcugggucguggagcacgugcugccccacaugcaggagaaccagccccuguccgagaccagccccuccagcacguccgccagcgcgcucgaccagccguccuucguccccaagagccccgacgccuccagcgccuucucccccgccagcccggccacccccaacgggaccaagggcaaggacgagucccagcacaccgagagcauggugcugcagagcucccgcgggaucaagguggagggcugcguccggauguacgagcuggugcaccgcaugaagggcacggaggggcuccggcuguggcaggaggagcaggagcgcaaggugcaggcgcugagcgagauggccuccgagcagcucaagcgguucgacgaguggaaggagcugaagcagcacaaggaguuccaggaccugcgcgaggucauggagaaguccagccgggaggcccucggccaccaggagaagcugaaggccgagcaccgccaccgggcgaagauccugaaccucaagcugcgcgaggccgagcagcagcgggugaagcaggccgagcaggagcgccugcggaaggaggaggggcagauccgccuccgggcccuguacgcccugcaggaggagaugcuccagcugagccagcagcuggacgcguccgagcagcacaaggcccuccugaagguggaccuggccgccuuccagacccgcggcaaccagcucugcagccugaucuccgggaucauccgcgccagcuccgagagcuccuaccccaccgcggagagccaggccgaggccgagcgggcccugcgcgagaugcgggaccuccugaugaaccugggccaggagaucacccgcgccugcgaggacaagcggcgccaggacgaggaggaggcgcaggucaagcuccaggaggcccagaugcagcagggccccgaggcccacaaggagccgcccgcccccucccaggggcccggcgggaagcagaacgaggaccuccaggugaaggugcaggacaucacgaugcagugguaccagcagcugcaggacgccagcaugcagugcguccugaccuucgagggccugaccaacuccaaggacagccaggcgaagaagaucaagauggaccugcagaaggccgccaccaucccggugucccagaucagcacgaucgccggcagcaagcucaaggagaucuucgacaagauccacucccugcugagcgggaagcccgugcaguccggcgggcggagcgucuccgugacccucaacccccagggccuggacuucgugcaguacaagcuggcggagaaguucgucaagcagggggaggaggagguggccagccaccacgaggccgccuuccccaucgccguggucgcguccggcaucugggagcugcacccgcgcgugggcgaccucauccuggcccaccuccacaagaagugccccuacagcguccccuucuaccccaccuucaaggaggggauggcccuggaggacuaccagcggaugcugggcuaccaggugaaggacuccaagguggagcagcaggacaacuuccugaagcgcaugagcgggaugauccggcucuacgccgccaucauccagcugcgcuggccguacggcaaccggcaggagauccacccccacgggcugaaccacggcuggcgcuggcucgcgcagauccugaacauggagccccuguccgacgucaccgccacgcuccuguucgacuuccuggaggugugcggcaacgcccucaugaagcaguaccaggugcaguucuggaagaugcugauccugaucaaggaggacuacuucccccggaucgaggccaucaccagcuccgggcagaugggcagcuucauccgccucaagcaguuccuggagaagugccugcagcacaaggacaucccgguccccaagggguuccucaccuccagcuucuggcgguccuga

SEQ ID NO: 30599 - RNA, 3579 nt, Artificial Sequence
  derived and/or modified sequence opt1 from GLG1__Homo_sapiens__NP_001139138
auggccgccugcggccgcgugcggcgcauguuccggcugagcgcggcccuccaccuccugcugcuguucgccgccggggccgagaagcugcccggccaggggguccacucccagggccaggggccgggcgcgaacuucgugagcuucgugggccaggccgggggcgggggccccgccgggcagcagcucccccagcugccccaguccagccagcugcagcagcagcagcagcagcagcagcagcagcagcagccgcagccgccccagccgcccuuccccgccggcggcccgcccgcgcgccgcgggggcgccggggccggcggcggguggaagcucgccgaggaggaguccugccgggaggacgucacccgggugugccccaagcacaccuggagcaacaaccuggccgugcuggagugccuccaggacguccgcgagcugcuguggaacuacaagcucaaccugacgaccgaccccaaguucgaguccguggcgcgggaggugugcaagagcaccaucaccgagaucaaggagugcgccgacgagcccgucggcaagggguacaugguguccugccugguggaccaccgcggcaacaucacggaguaccagugccaccaguacaucaccaagaugaccgccaucaucuucagcgacuaccggcucaucugcggguucauggacgacugcaagaacgacaucaacauccugaagugcggcuccauccgccugggcgagaaggacgcccacagccagggggaggucguguccugccucgagaagggccuggugaaggaggccgaggagcgggagcccaagauccaggucagcgagcugugcaagaaggcgauccuccgcguggccgagcuguccagcgacgacuuccaccuggaccggcaccucuacuucgccugccgcgacgaccgggagcgcuucugcgagaacacccaggccggggagggccggguguacaagugccuguucaaccacaaguucgaggaguccaugagcgagaagugccgcgaggcccugacgacccggcagaagcucaucgcgcaggacuacaaggucuccuacagccuggccaagagcugcaaguccgaccugaagaaguaccgcugcaacguggagaaccucccgcgcagccgggaggcccgccuguccuaccugcucaugugccuggagagcgccgugcaccgggggcgccaggucuccagcgagugccagggcgagaugcuggacuaccggcgcaugcucauggaggacuucucccugagccccgagaucauccuguccugccggggcgagaucgagcaccacugcagcgggcuccaccgcaagggccggacccugcacugccugaugaagguggugcgcggggagaagggcaaccucgggaugaacugccagcaggcccugcagacccugauccaggagacggaccccggcgcggacuaccggaucgaccgcgcccucaacgaggccugcgaguccgucauccagaccgccugcaagcacauccggagcggcgaccccaugauccuguccugccugauggagcaccuguacaccgagaagaugguggaggacugcgagcaccgccuccuggagcugcaguacuucaucagccgggacuggaagcucgaccccguccuguaccgcaagugccagggggacgcgucccggcugugccacacccacggcuggaacgagacgagcgaguucaugccccagggggccguguucuccugccucuaccgccacgccuaccggaccgaggagcagggccgccgccugagccgggagugccgcgccgaggugcagcggauccugcaccagcgcgccauggacgucaagcucgaccccgcgcugcaggacaagugccugaucgaccucggcaaguggugcuccgagaagaccgagaccgggcaggagcuggagugccugcaggaccaccucgacgaccuggugguggagugccgggacaucgucggcaaccugacggagcucgagagcgaggacauccagaucgaggcccugcugaugcgcgccugcgagcccaucauccagaacuucugccacgacguggccgacaaccagaucgacagcggggaccucauggagugccugauccagaacaagcaccagaaggacaugaacgagaagugcgccaucggcgugacccacuuccagcugguccagaugaaggacuuccgguucuccuacaaguucaagauggcgugcaaggaggacgugcucaagcugugcccgaacaucaagaagaagguggacgucgugaucugccugagcaccaccgugcgcaacgacacgcuccaggaggccaaggagcaccgggucucccugaagugccgccggcagcugcgcguggaggagcucgagaugaccgaggacauccggcuggagcccgaccuguacgaggccugcaagagcgacaucaagaacuucugcuccgccgugcaguacgggaacgcccagaucaucgagugccucaaggagaacaagaagcagcugagcacccgcugccaccagaaggucuucaagcugcaggagaccgagaugauggaccccgagcucgacuacacgcugaugcgggugugcaagcagaugaucaagcgcuucugccccgaggcggacuccaagaccaugcugcagugccucaagcagaacaagaacagcgagcugauggacccgaagugcaagcagaugaucaccaagcggcagaucacccagaacacggacuaccgccugaaccccaugcuccggaaggccugcaaggccgacauccccaaguucugccacggcauccugaccaaggccaaggacgacuccgagcuggagggccaggugaucagcugccucaagcugcgcuacgcggaccagcggcuguccagcgacugcgaggaccagauccgcaucaucauccaggaguccgcccucgacuaccgccuggacccgcagcugcagcuccacugcagcgacgagaucuccagccugugcgccgaggaggccgccgcgcaggagcagaccgggcaggucgaggagugccugaaggugaaccuccugaagaucaagaccgagcugugcaagaaggaggugcucaacaugcugaaggaguccaaggccgacaucuucgucgaccccgugcugcacacggccugcgcccucgacaucaagcaccacugcgccgcgaucacccccggccgggggcgccagaugagcugccugauggaggcccuggaggacaagcgggugcgccuccagcccgagugcaagaagcggcugaacgaccgcaucgagauguggagcuacgccgccaaggucgccccggcggacggcuucuccgaccuggccaugcaggucaugaccagccccuccaagaacuacauccucagcgugaucuccgggagcaucugcauccuguuccugaucggccucaugugcggccggaucaccaagcgcgugacccgggagcugaaggaccgccugcaguaccgguccgagacgauggccuacaaggggcucguguggagccaggacgugaccggcucccccgccuga

SEQ ID NO: 30600 - RNA, 3198 nt, Artificial Sequence
  derived and/or modified sequence opt1 from GLI1__Homo_sapiens__NP_001161081
auguucaacagcaugacccccccgcccaucuccagcuacggcgagcccugcugccugcgcccccucccgucccagggggcccccagcgugggcaccgaggucaagcugacgaagaagcgggcccuguccaucagcccccucuccgacgcgagccuggaccugcagaccgugauccgcaccucccccagcucccucguggccuucaucaacagccggugcaccuccccggggggcagcuacgggcaccuguccaucggcacgaugagccccucccugggcuuccccgcccagaugaaccaccagaaggggcccagcccguccuucggcguccagcccugcgggccccacgacagcgcccgcggcgggaugaucccccacccgcagagccggggccccuuccccaccugccagcucaaguccgagcuggacaugcuggugggcaagugccgcgaggagccccucgagggggacaugagcuccccgaacagcaccggcauccaggacccccugcuggggaugcucgacggccgggaggaccuggagcgcgaggagaagcgggagcccgaguccguguacgagaccgacugccgcugggacggcugcagccaggaguucgacucccaggagcagcugguccaccacaucaacagcgagcacauccacggggagcggaaggaguucgugugccacuggggcgggugcucccgcgagcuccggcccuucaaggcccaguacaugcuggugguccacaugcgccggcacacgggcgagaagccgcacaagugcaccuucgaggggugccgcaagagcuacucccggcuggagaaccucaagacccaccugcgcagccacaccggcgagaagcccuacaugugcgagcacgagggcugcuccaaggcguucagcaacgccuccgaccgggccaagcaccagaaccgcacgcacagcaacgagaagcccuacgugugcaagcugcccgggugcaccaagcgguacaccgacccguccagccuccgcaagcacgugaagaccguccacggccccgacgcccacgugacgaagcgccaccggggggacggcccccugccgcgcgcgcccuccaucagcaccguggagcccaagcgggagcgcgaggggggccccauccgggaggagagccgccugaccgucccggagggcgccaugaagccccagcccucccccggggcccagagcuccugcagcuccgaccacagcccggccggcuccgccgcgaacaccgacagcgggguggagaugacgggcaacgccgggggcuccaccgaggaccucagcucccuggacgagggccccugcaucgccgggaccggccugagcacccuccggcgccuggagaaccugcggcucgaccagcugcaccagcugcgccccaucgggacgcggggccucaagcugcccucccugagccacaccggcaccaccgugucccgccgggucgggccgcccgugagccucgagcgccgguccagcagcuccagcuccaucagcuccgccuacacggugagccgccgguccagccuggccucccccuuccccccgggcagcccccccgagaacggggcguccagccugcccggccucaugccggcccagcacuaccugcugcgcgcccgguacgccuccgcccgcgggggcggcaccagccccaccgcggccuccagccucgaccgcaucgggggccugcccaugcccccguggcggucccgcgccgaguaccccggguacaaccccaacgccggcgucacccggcgcgccagcgacccggcgcaggccgccgaccggcccgcccccgcgcgcgugcagcgguucaagucccuggggugcgugcacacgcccccgaccgucgccggcggcgggcagaacuucgaccccuaccuccccaccagcguguacagcccccagccgcccuccaucaccgagaacgccgccauggacgcccgcggccugcaggaggagcccgaggucgggacgagcauggugggcuccgggcugaaccccuacauggacuucccgcccaccgacacccugggcuacggcgggcccgagggcgcggccgccgagcccuacggggcccggggcccggggagccucccccugggccccggccccccgaccaacuacgggcccaaccccugcccccagcaggccuccuacccggaccccacccaggagacguggggcgaguuccccagccacuccgggcuguaccccggcccgaaggcgcucggcgggaccuacagccagugcccccgccuggagcacuacggccaggugcaggucaagcccgagcaggggugcccggugggcuccgacagcaccgggcuggcccccugccucaacgcccaccccuccgagggccccccgcacccccagccccuguucagccacuacccccagccgucccccccccaguaccugcagagcggccccuacacccagccgccccccgacuaccuccccuccgagccgcggcccugccuggacuucgacagccccacgcacuccaccgggcagcugaaggcccagcucgugugcaacuacguccagagccagcaggagcugcugugggagggcgggggccgcgaggacgcccccgcgcaggagccguccuaccagagccccaaguuccucgggggcagccaggugucccccagccgggccaaggcccccgugaacaccuacggcccgggguucggccccaaccugcccaaccacaaguccgggagcuaccccaccccgucccccugccacgagaacuucgucgugggcgccaaccgcgcgagccaccgggccgccgcccccccgcgccugcuccccccccugcccacgugcuacgggccgcugaaggugggcggcaccaaccccuccugcgggcaccccgaggucggccggcucgggggcggccccgcccuguacccgccccccgaggggcaggugugcaacccccuggacagccucgaccuggacaacacccagcuggacuucguggcgauccucgacgagccgcagggccugucccccccccccagccacgaccagcgcggguccagcggccacaccccgccccccuccgggcccccgaacauggccgucggcaacaugagcgugcugcuccggucccugcccggcgagacggaguuccugaacagcuccgccuga

SEQ ID NO: 30601 - RNA, 4761 nt, Artificial Sequence
  derived and/or modified sequence opt1 from GLI2__Homo_sapiens__NP_005261
auggagaccagcgccuccgccaccgcgagcgagaagcaggaggccaaguccggcauccuggaggccgccggguuccccgacccgggcaagaaggccagcccccucguggucgcggccgccgccgcggccgccguggccgcccagggggugccccagcaccugcugcccccguuccacgcgccccuccccaucgacaugcgccaccaggagggccgguaccacuacgagccccacuccguccacggggugcacggcccgcccgcccugagcggcucccccgugaucagcgacaucucccugauccgccucagcccccacccggccgggcccggcgagucccccuucaacgccccccacccguacgucaacccccacauggagcacuaccugcggagcgugcacuccagccccacgcuguccaugaucagcgccgcgcgcgggcucucccccgccgacguggcccaggagcaccugaaggagcggggccuguucgggcucccggcccccggcaccacccccagcgacuacuaccaccagaugacccuggucgccggccaccccgcgccguacggggaccugcucaugcaguccggcggggccgccagcgccccccaccugcacgacuaccugaaccccguggacgugagccgcuucuccagcccccgggucacgccgcgccucucccggaagcgcgcccugagcaucuccccccugagcgacgcgucccucgaccugcagcggaugauccgcaccagccccaacucccugguggccuacaucaacaacagccgguccagcuccgccgccagcggcuccuacggccaccucagcgcgggggcccuguccccggccuucaccuucccccaccccaucaaccccguggccuaccagcagauccugagccagcagcgcggccucggguccgccuucggccacaccccgccccugauccagcccagccccacguuccuggcgcagcagccgauggcccucaccagcaucaacgccacccccacccagcuguccagcuccagcaacugccuguccgacacgaaccagaacaagcagagcuccgagagcgccgucuccagcaccgugaaccccguggccauccacaagcgguccaaggucaagaccgagcccgaggggcuccgcccggcgagcccccuggcccugacccagggccagguguccggccacgggagcugcggcugcgcccucccccugucccaggagcagcuggccgaccucaaggaggaccuggaccgggacgacugcaagcaggaggccgagguggucaucuacgagacgaacugccacugggaggacugcaccaaggaguacgacacccaggagcagcuggugcaccacaucaacaacgagcacauccacggggagaagaaggaguucgugugccgcuggcaggcgugcacccgggagcagaagcccuucaaggcccaguacaugcucgucgugcacaugcgccggcacacgggcgagaagccgcacaagugcaccuucgaggggugcagcaaggccuacucccgccuggagaaccugaagacccaccuccgcagccacaccggcgagaagcccuacgucugcgagcacgagggcugcaacaaggccuucagcaacgcguccgaccgggccaagcaccagaaccgcacgcacagcaacgagaagcccuacaucugcaagauccccgggugcaccaagcgguacaccgacccguccagccugcgcaagcacgugaagaccgugcacggccccgacgcccacgucacgaagaagcagcggaacgacgugcaccugcgcaccccccuccugaaggagaacggggacuccgaggccggcaccgagcccgggggcccggagagcaccgaggccuccagcacgucccaggcgguggaggacugccugcacguccgggccaucaagaccgagagcuccggccugugccagagcucccccggggcccagagcuccugcagcuccgagcccagcccgcucggcuccgcccccaacaacgacagcgggguggagaugcccggcaccggccccgggagccugggcgaccugaccgcccucgacgacacgccgcccggggcggacaccuccgcccuggccgcccccagcgccggcgggcugcagcuccgcaagcacaugaccaccaugcaccgguucgagcagcugaagaaggagaagcugaagucccucaaggacagcugcuccugggcgggccccaccccgcacacgcgcaacaccaagcugcccccccugcccggcagcggguccauccucgagaacuucagcggcuccgggggcgggggcccggccggccugcugcccaacccccggcucagcgagcuguccgccagcgaggugaccaugcugucccagcuccaggagcgccgggacagcuccaccagcacggucuccagcgccuacaccgugucccgccggagcagcgggaucucccccuacuucagcucccgccggagcuccgaggcgagcccgcugggcgccgggcgcccccacaacgccuccagcgccgacuccuacgaccccaucagcaccgacgccucccggcgcagcuccgaggcgagccagugcuccggcgggagcggccugcucaaccugacccccgcccagcaguacucccugcgcgccaaguacgccgccgcgacgggcgggccgccccccaccccccucccgggccuggagcggaugagccugcgcacccggcucgcccugcuggacgcccccgagcgcacccuccccgccgggugcccccggccgcugggcccccgccggggguccgacggccccacguacggccacgggcacgccggcgcggccccggccuucccccacgaggcccccgggggcggcgcccgccgggcgagcgaccccgugcgccggccggacgcccugagccucccccgcguccagcgguuccacuccacccacaacgugaaccccgggccccugccgcccugcgccgaccgccggggccugcgccuccagagccaccccuccaccgacgggggccuggcccggggggcguacagcccccgcccgcccuccaucagcgagaacguggccauggaggccgucgccgccggcguggacggcgcggggcccgaggccgaccugggccuccccgaggacgaccuggugcugccggacgacgucgugcaguacaucaaggcccacgccuccggggcccucgacgagggcaccgggcagguguaccccacggagagcaccggcuucuccgacaacccccggcugcccagcccgggccugcacgggcagcgccggauggucgcggccgacuccaacgugggccccagcgcccccaugcucgggggcugccagcugggguucggcgcccccuccagccugaacaagaacaacaugccggugcaguggaacgaggucuccagcggcaccguggacgcccucgcgucccaggugaagcccccccccuucccgcaggggaaccuggccgucgugcagcagaagcccgccuucggccaguaccccggguacagcccgcagggccugcaggccucccccggcgggcucgacagcacccagccccaccugcagccccgcagcggcgcgccgucccaggggaucccccgcgugaacuacaugcagcagcugcggcagcccgucgccggcagccagugccccgggaugacgaccaccauguccccgcacgccugcuacggccaggugcacccccagcucagccccuccaccaucagcggcgcccugaaccaguucccccaguccugcagcaacaugccggccaagcccgggcaccugggccacccccagcagacggagguggcgcccgacccgaccaccauggggaaccgccaccgggagcucggcguccccgacuccgcccuggccggggugccccccccgcaccccgugcagagcuacccccagcagucccaccaccuggccgccagcaugucccaggagggcuaccaccagguccccagccuccugccggcgcgccagcccggcuucauggagccccagaccgggccgaugggcguggccacggccggguucggccuggugcagccccggcccccccucgagccgucccccaccgggcgccaccggggcguccgcgccgugcagcagcagcuggccuacgcgcgggccaccggccacgccauggccgcgaugcccagcucccaggagaccgccgaggccgugcccaagggggccaugggcaacauggggagcgucccgccccagccccccccgcaggacgccggcggggcgcccgaccacuccaugcuguacuacuacggccagauccacauguacgagcaggacggcgggcucgagaaccugggcagcugccaggugaugcgcagccagcccccccagccgcaggccugccaggacuccauccagccccagccccugcccagcccgggggugaaccaggucuccagcacgguggacucccagcuccuggaggccccccagaucgacuucgacgccaucauggacgacggcgaccacagcucccuguucagcggcgcccucucccccagccugcugcacucccucagccagaacuccagccggcugaccaccccccgcaacucccugacccucccgagcauccccgcggggaucuccaacauggccgugggcgacaugagcagcaugcugacgucccuggccgaggagagcaaguuccucaacaugaugaccuga

SEQ ID NO: 30602 - RNA, 4743 nt, Artificial Sequence
  derived and/or modified sequence opt1 from GLI3__Homo_sapiens__XP_011513575
auggaggcccagagccacuccagcaccaccacggagaagaagaagguggagaacuccaucgucaagugcagcacccgcaccgacguguccgagaaggccguggcgagcuccaccacgagcaacgaggacgagucccccggccagaccuaccaccgggagcgccggaacgccaucaccaugcagccgcagaacguccaggggcugagcaagguguccgaggagcccagcaccuccagcgacgagcgcgccucccucaucaagaaggagauccacggcagccugccccacguggccgagcccuccgucccguaccgggggacgguguucgccauggacccccgcaacggcuacauggagccccacuaccaccccccgcaccuguuccccgcguuccacccccccgugccgaucgacgcccggcaccacgaggggcgcuaccacuacgaccccagccccauccccccgcuccacaugaccuccgcccugagcagcucccccaccuaccccgaccugcccuucauccggaucagcccgcaccgcaaccccaccgccgcguccgagagccccuucucccccccgcaccccuacaucaaccccuacauggacuacauccggagccuccacuccagccccucccugagcaugaucuccgccacgcgcggccugagcccgaccgacgccccccacgccggcgucucccccgccgaguacuaccaccagauggcgcuccugaccgggcagcggagcccguacgccgacaucauccccuccgccgccaccgccggcacgggggcgauccacauggaguaccugcacgccauggacagcacccgcuucuccagcccccggcucuccgcccgccccagccggaagcgcacccugagcaucuccccgcugagcgaccacuccuucgaccuccagaccaugauccggacgagccccaacucccuggugaccauccugaacaacagccgcuccagcuccagcgccuccggcagcuacgggcaccucuccgccagcgcgaucucccccgcccugagcuucaccuacuccagcgcccccgugagccugcacaugcaccagcagauccucucccggcagcagagccugggcuccgccuucggccacagcccgccccugauccaccccgcccccaccuucccgacgcagcgccccauccccgggauccccaccguccucaacccggugcagguguccagcggccccuccgagagcucccagaacaagcccaccagcgaguccgcggucagcuccaccggggaccccaugcacaacaagcgcagcaagaucaagccggacgaggaccugcccucccccggcgcccggggccagcaggagcagcccgaggggacgacccuggugaaggaggagggcgacaaggacgagagcaagcaggagccggaggugaucuacgagaccaacugccacugggaggggugcgcccgcgaguucgacacccaggagcagcucguccaccacaucaacaacgaccacauccacggcgagaagaaggaguucgugugccgguggcuggacugcucccgcgagcagaagcccuucaaggcccaguacaugcuggugguccacaugcggcgccacacgggggagaagccccacaagugcaccuucgagggcugcaccaaggcguacagccggcucgagaaccugaagacccaccugcgcucccacacgggcgagaagccguacgugugcgagcacgaggggugcaacaaggccuucagcaacgccagcgaccgggccaagcaccagaaccgcacccacuccaacgagaagcccuacgugugcaagauccccggcugcaccaagcgguacaccgaccccagcucccuccgcaagcacgucaagaccgugcacgggccggaggcccacgucacgaagaagcagcggggcgacauccacccccgcccccccccgccccgggacagcgggucccacagccagucccgcagccccggccggcccacccagggcgcgcugggggagcagcaggaccuguccaacaccaccagcaagcgcgaggagugccuccaggugaagacggugaaggccgagaagccgaugaccucccagcccagccccggcgggcaguccagcugcuccagccagcagucccccaucagcaacuacuccaacagcggccuggagcugccgcucaccgacgggggcagcaucggcgaccuguccgccaucgacgagacccccaucauggacagcacgaucuccaccgccaccaccgcccuggcgcuccaggcccggcgcaaccccgccgggacgaaguggauggagcacgucaagcuggagcgccugaagcaggugaacggcauguucccccggcucaacccgauccugccccccaaggcccccgccgugagcccgcugaucgggaacggcacccaguccaacaacaccugcagccucggcgggcccaugacccugcugcccggccgcuccgaccugagcggggucgacgugacgaugcucaacaugcugaaccggcgcgacuccagcgcguccaccaucagcuccgccuaccugagcucccggcgcagcuccggcaucagccccugcuucuccagccggcgcagcuccgaggccagccaggccgaggggcggccgcagaacguguccgucgcggacagcuacgaccccaucuccaccgacgccagccgccgguccagcgaggccucccagagcgacggccuccccucccugcugagccucaccccggcccagcaguaccgccugaaggccaaguacgcggccgccacgggcgggcccccccccaccccgcugcccaacauggagcggaugucccucaagacccgccuggcccugcucggcgacgcccuggagcccgggguggcgcugcccccggugcacgccccccggcgcugcagcgacggcggggcccacggcuacggccggcgccaccuccagccccacgacgcccccgggcacggcguccggcgcgccuccgacccggugcggaccgggagcgagggccuggcgcugccccgcgugccccgcuucuccagccucuccagcugcaaccccccggccauggccacgagcgccgagaagcggucccugguccugcagaacuacacccgccccgaggggggccagagccggaacuuccacuccagccccugccccccguccaucaccgagaacgugacccucgagagccugacgauggacgcggacgccaaccugaacgacgaggacuuccuccccgacgacgugguccaguaccugaacucccagaaccaggccggcuacgagcagcacuuccccagcgcccugcccgacgacuccaaggugccgcacgggcccggcgacuucgacgcccccgggcuccccgacagccacgcgggccagcaguuccacgcccuggagcagccgugccccgagggguccaagaccgaccugcccauccaguggaacgaggugagcuccggcagcgccgaccucuccagcuccaagcugaagugcggcccgcgccccgccgucccccagacccgggccuucggguucugcaacggcaugguggugcacccccagaacccgcugcgcagcgggcccgcgggcggcuaccagacccucggggagaacuccaaccccuacggcgggcccgagcaccugaugcugcacaacagcccgggcagcgggacguccggcaacgccuuccacgagcagcccugcaaggccccccaguacggcaacugccucaaccggcagcccgucgccccgggggcccuggacggcgcgugcggggccggcauccaggccagcaagcugaaguccacccccaugcaggggagcggcggccagcucaacuucgggcugcccguggcccccaacgaguccgccggcagcauggugaacgggaugcagaaccaggacccggucggccagggguaccuggcgcaccagcuccugggcgacuccaugcagcaccccggcgccgggcgccccggccagcagaugcuggggcagaucagcgccaccucccacaucaacaucuaccagggccccgagagcugccucccgggcgcccacgggaugggcucccagcccagcucccuggcgguggugcggggguaccagcccugcgccagcuucggcgggucccgccggcaggccaugccccgcgacagccuggcccuccaguccggccagcugagcgacaccagccagacgugccgggucaacggcaucaagauggagaugaaggggcagccgcacccccugugcuccaaccuccagaacuacagcggccaguucuacgaccagaccgugggguucucccagcaggacaccaaggccggcagcuucuccaucagcgacgcguccugccugcugcaggggaccagcgccaagaacuccgagcuccugagccccggcgccaaccaggugaccuccacggucgacagccuggacucccacgaccucgagggcgugcagaucgacuucgacgccaucaucgacgacggggaccacagcucccugaugagcggcgcccuguccccgagcaucauccagaaccucucccacagcagcucccgccugaccaccccccgggcgagccugcccuuccccgcccucuccaugagcaccacgaacauggccaucggggacauguccagccugcugaccucccucgccgaggagagcaaguuccuggccgugaugcaguga

SEQ ID NO: 30603 - RNA, 801 nt, Artificial Sequence
  derived and/or modified sequence opt1 from GLIPR1__Homo_sapiens__NP_006842
augcgcgugacccuggccaccaucgccuggauggucagcuucguguccaacuacagccacacggcgaacauccuccccgacaucgagaacgaggacuucaucaaggacugcgugcggauccacaacaaguuccgcuccgaggucaagccgaccgccagcgacaugcuguacaugaccugggaccccgcccuggcccagaucgccaaggcgugggccuccaacugccaguucagccacaacacccggcucaagccgccccacaagcugcaccccaacuucacgucccugggcgagaacaucuggaccgggagcgugcccaucuucuccgugagcuccgccaucaccaacugguacgacgagauccaggacuacgacuucaagacccgcaucugcaagaaggucugcggccacuacacccagguggugugggccgacagcuacaaggucgggugcgcggugcaguucugccccaagguguccggcuucgacgcccucagcaacggggcccacuucaucugcaacuacggccccggcgggaacuacccgaccuggcccuacaagcggggcgccacgugcuccgccugccccaacaacgacaagugccuggacaaccugugcgucaaccgccagcgggaccaggugaagcgcuacuacagcguggucuaccccggguggccgaucuacccccggaaccgcuacaccucccucuuccugaucgugaacagcgugauccugauccucuccgucaucaucacgauccuggugcagcacaaguaccccaaccuggugcuccuggacuga

SEQ ID NO: 30604 - RNA, 387 nt, Artificial Sequence
  derived and/or modified sequence opt1 from GLIPR2__Homo_sapiens__NP_001273939
augggcaagagcgccuccaagcaguuccacaacgaggugcucaaggcccacaacgaguaccgccagaagcacggggugcccccgcucaagcugugcaagaaccugaaccgggaggcgcagcaguacagcgaggcccucgccuccacccgcauccugaagcacagccccgaguccagccggggccagugcggggagaaccuggccugggccuccuacgaccagaccggccacuucacggcgauggucuggaagaacaccaagaagaugggggugggcaaggccagcgccuccgacggcagcuccuucgucguggcccgcuacuuccccgcggggaacguggucaacgagggcuucuucgaggagaacgugcugcccccgaagaaguga

SEQ ID NO: 30605 - RNA, 1575 nt, Artificial Sequence
  derived and/or modified sequence opt1 from GLIS2__Homo_sapiens__NP_001305847
augcacagccuggacgagccccucgaccugaagcuguccaucaccaagcuccgcgccgcccgggagaagcgcgagcggacccugggcgugguccgcccgcgggcgcugcaccgcgagcucgggcugguggacgacagccccacgcccggcucccccgggagcccgcccuccggcuuccugcucaacagcaaguuccccgagaagguggaggggcgguucuccgccgcgccccuggucgaccugagccucuccccgcccagcggccuggacucccccaacggcagcuccagccugucccccgagcgccaggggaacggcgaccucccgcccgugcccagcgccuccgacuuccagccccugcgguaccuggacggggugccgagcuccuuccaguucuuccucccccugggcagcgggggcgcccugcaccuccccgcgagcuccuuccugaccccgcccaaggacaagugccugagccccgaccucccccugcccaagcagcuggucugccgcugggccaagugcaaccagcuguucgagcuccugcaggaccucguggaccacgugaacgacuaccacgucaagccggagaaggacgccggcuacugcugccacugggaggggugcgcccggcacggccgcggguucaacgcgcgguacaagaugcugauccacauccgcacccacaccaacgagaagccccaccggugccccacgugcuccaagagcuucucccgccuggagaaccucaagauccacaaccggagccacaccggcgagaagcccuacgugugcccguacgagggcugcaacaagcgcuacuccaacagcuccgaccgguucaagcacacccgcacccacuacguggacaagcccuacuacugcaagaugcccgggugccacaagcgguacacggacccgagcucccugcgcaagcacaucaaggcccacggccacuucgucagccacgagcagcaggagcugcuccagcugcgcccgccgcccaagccgccccugcccgcccccgacgggggccccuacguguccggggcccagaucaucauccccaaccccgccgcccucuucggcggccccgggcugcccggccugccccucccccuggcccccgggccgcuggaccucagcgcccuggccugcggcaacgggggcggcuccgggggcgggggcgggaugggccccggccugcccgggcccgugcucccgcugaaccuggccaagaacccccugcuccccagccccuucggcgccgggggccugggccugccggucgugucccuccuggcgggggccgccggcgggaaggccgagggcgagaaggggcggggcagcgugcccacccgcgcgcugggcauggaggggcacaagacgccccucgagcggaccgaguccagcugcagccgcccgucccccgacggccugccccugcuccccgggaccguccuggaccugagcaccggcgugaacuccgccgccagcuccccggaggcccucgcccccggguggguggucaucccgcccggcagcgugcugcugaagcccgcgguggucaacuga

SEQ ID NO: 30606 - RNA, 1719 nt, Artificial Sequence
  derived and/or modified sequence opt1 from GLIS3__Homo_sapiens__XP_006716794
augaacggccgcagcugcuccaugagccugcaccggaccuccgggacgccccagggcccccgcauggugagcgggcaccacauccccgccauccgggcccacuccggcacccccgggcccagccccugcggcuccaccagcucccccaccauggcgagccucgccaacaaccugcaccugaagaugcccuccggcgggggcauggcgccccagaacaacgucgccgagagccgcauccaccuccccgcccugagcccccggcgccagaugcugaccaacgggaagccccgguuccaggugacgcaggccggcgggauguccggcucccacacccucaagcccaagcagcaggaguucggcagcccguucccgcccaaccccgggaagggcgcccugggguucggcccgcagugcaaguccaucggcaaggggagcugcaacaaccugguggucaccuccagccccaugauggugcagcgccucggccugaucagcccgcccgccucccaggugagcaccgccugcaaccagaucucccccagccugcagcgggcgaugaacgccgccaaccucaacaucccgcccuccgacacccgcagccugaucucccgggagagccuggccuccaccacccucagccugaccgagucccagagcgccuccagcaugaagcaggaguggucccagggguaccgcgcgcugcccagccucuccaaccacggcagccagaacgggcuggaccugggcgaccuccugucccugccgcccggcacgagcaugagcuccaacagcgucuccaacagccuccccuccuaccuguucgggaccgagagcucccacagccccuaccccagcccccggcacuccuccacccgcagccacuccgcccggagcaagaagcgcgcccugucccucagcccccuguccgacggcaucgggaucgacuucaacaccaucauccggacgagcccgaccagccugguggccuacaucaacggcucccgcgccagccccgcgaaccucagcccccagcccgagguguacgggcacuuccugggcguccggggcuccugcaucccgcagccccgccccgugcccgggucccagaagggcgugcuggucgcccccgggggccucgcccugcccgccuacggggaggacggcgcccuggagcacgagcggaugcagcagcucgagcacggcgggcugcagcccggccuggugaaccacauggugguccagcacgggcuccccggcccggacagccaguccgcgggccuguucaagaccgagcgccuggaggaguuccccgggagcaccguggaccucccgcccgccccgccccugccgccccugcccccgccgcccgggccgccgccgcccuaccacgcccacgcccaccuccaccaccccgagcugggcccccacgcccagcagcuggcgcucccccaggccacgcuggacgacgacggcgagauggacgggaucggcggcaagcacugcugccgcuggaucgacugcuccgcccuguacgaccagcaggaggagcuggugcggcacaucgagaagguccacaucgaccagcgcaagggggaggacuucacgugcuucugggccggcugcccccggcgcuacaagcccuucaacgcgcgguacaagcuccugauccacaugcgcgugcacagcggggagaagcccaacaagugcaccgccgccuga

SEQ ID NO: 30607 - RNA, 1785 nt, Artificial Sequence
  derived and/or modified sequence opt1 from GLMN__Homo_sapiens__XP_011538848
auggccguggaggagcugcagagcaucaucaagcgcugccagauccucgaggagcaggacuucaaggaggaggacuucggccuguuccagcuggccgggcagcggugcaucgaggagggccacaccgaccagcuccuggagaucauccagaacgagaagaacaaggucaucaucaagaacaugggguggaaccuggugggccccgugguccgcugccuccugugcaaggacaaggaggacuccaagcggaagguguacuuccugaucuucgaccuccuggugaagcugugcaaccccaaggagcuccugcuggggcuccuggagcugaucgaggagcccagcggcaagcagaucucccagagcauccuccugcugcuccagccccugcagaccgucauccagaagcugcacaacaaggcguacuccaucggccucgcccugagcacgcuguggaaccagcucucccugcugcccgugccguacagcaaggagcagauccagauggacgacuacgggcucugccagugcugcaaggcccugaucgaguucaccaagcccuucguggaggaggucaucgacaacaaggagaacucccuggagaacgagaagcucaaggacgagcugcugaaguucugcuucaagagccucaagugcccccugcugaccgcccaguucuucgagcaguccgaggagggcgggaacgaccccuuccgcuacuucgccagcgagaucaucggcuuccucuccgcgaucgggcacccguuccccaagaugaucuucaaccacggccggaagaagcgcaccuggaacuaccuggaguucgaggaggaggagaacaagcagcuggccgacagcauggccucccucgccuaccugguguucgugcagggcauccacaucgaccagcugcccaugguccucagcccccuguaccugcuccaguucaacauggggcacaucgagguguuccugcagcggacggaggaguccgugaucagcaagggccuggagcugcucgagaacucccugcugcgcaucgaggacaacagccuccuguaccaguaccuggagaucaagagcuuccucaccgucccgcaggggcuggugaaggugaugacccugugccccaucgagacccuccggaagaagucccuggcgaugcugcagcucuacaucaacaagcuggacagccagggcaaguacacgcuguuccgcugccuccugaacaccuccaaccacagcggcgucgaggccuucaucauccagaacaucaagaaccagaucgacaugucccugaagcggacccgcaacaacaagugguucaccgggccccagcucaucagccugcuggaccucgugcuguuccugcccgagggcgccgagacggaccuccugcagaacuccgaccggaucauggccagccugaaccuccugcgcuaccuggugaucaaggacaacgagaacgacaaccagaccgggcucuggaccgagcugggcaacaucgagaacaacuuccugaagccgcuccacaucgggcugaacauguccaaggcccacuacgaggcggagaucaagaacagccaggaggcccagaaguccaaggaccugugcagcaucaccgucuccggcgaggagauccccaacaugccgcccgagaugcagcucaaggugcugcacagcgcccuguucacguucgaccucaucgaguccgugcuggcccgggucgaggagcugaucgagaucaagaccaagagcaccuccgaggagaacaucggcaucaaguga

SEQ ID NO: 30608 - RNA, 555 nt, Artificial Sequence
  derived and/or modified sequence opt1 from GLO1__Homo_sapiens__NP_006699
auggccgagccccagccgcccagcggcgggcugaccgacgaggccgcgcucuccugcugcagcgacgccgaccccuccaccaaggacuuccugcugcagcagacgaugcuccgcgugaaggaccccaagaagucccuggacuucuacacccggguccugggcaugacccucauccagaagugcgacuucccgaucaugaaguucagccuguacuuccuggccuacgaggacaagaacgacauccccaaggagaaggacgagaagaucgccugggcccucagccgcaaggcgacccuggagcugacgcacaacugggggaccgaggacgacgagacccaguccuaccacaacggcaacagcgacccccggggguucggccacaucggcaucgccgugcccgacguguacuccgccugcaagcgcuucgaggagcucggggucaaguucgugaagaagccggacgacggcaagaugaaggggcuggccuucauccaggaccccgacggcuacuggaucgagauccugaaccccaacaagauggcgacccucauguga

SEQ ID NO: 30609 - RNA, 897 nt, Artificial Sequence
  derived and/or modified sequence opt1 from GLOD4__Homo_sapiens__NP_057164
auggccgcccgccgggcgcugcacuucguguucaaggucggcaaccgcuuccagaccgcccgguucuaccgcgacgugcucgggaugaaggugcugcggcacgaggaguucgaggagggcugcaaggccgccugcaacgggcccuacgacggcaaguggagcaagaccauggucggguucggcccggaggacgaccacuucguggccgagcugaccuacaacuacggcgugggggacuacaagcucggcaacgacuucauggggaucacccuggcguccagccaggccgucuccaacgcccgcaagcuggaguggccccucaccgagguggccgagggcguguucgagaccgaggcgcccgggggcuacaaguucuaccugcagaaccggagccugccccaguccgacccgguccucaaggugacgcuggccgugagcgaccugcagaagucccucaacuacuggugcaaccugcugggcaugaagaucuacgagaaggacgaggagaagcagcgcgcccuccugggguacgccgacaaccagugcaagcuggagcuccagggcgucaagggcgggguggaccacgccgcggccuucggccggaucgccuucagcugcccccagaaggagcugcccgaccuggaggaccucaugaagcgcgagaaccagaagauccugacgccccuggugucccucgacaccccggggaaggccaccguccagguggugauccuggccgaccccgacggccacgagaucugcuucgucggggacgaggcguuccgggagcugagcaagauggaccccgagggcuccaagcuccuggacgacgccauggccgccgacaagagcgacgagugguucgccaagcacaacaagcccaaggcguccggguga

SEQ ID NO: 30610 - RNA, 1392 nt, Artificial Sequence
  derived and/or modified sequence opt1 from GLP1R__Homo_sapiens__NP_002053
auggccggcgcccccgggccgcugcgccucgcgcugcugcuccugggcaugguggggcgggccggcccccgcccccagggggccaccgucagccugugggagaccgugcagaaguggcgggaguaccgccggcagugccagcgcucccucacggaggacccgccgcccgccaccgaccuguucugcaaccggaccuucgacgaguacgccugcuggcccgacggcgagcccggcagcuucgugaacgucuccugccccugguaccugcccugggcgagcuccgugccccaggggcacguguaccgcuucugcaccgccgagggccucuggcugcagaaggacaacagcucccugcccuggcgggaccucagcgagugcgaggaguccaagcgcggggagcggagcuccccggaggagcagcugcuguuccucuacaucaucuacacggucggcuacgcccugagcuucuccgcccuggugaucgcgagcgccauccuccugggguuccgccaccuccacugcacccggaacuacauccaccugaaccuguucgccuccuucauccugcgcgcccucagcguguucaucaaggacgccgcgcugaaguggauguacuccaccgccgcccagcagcaccagugggacggccugcucagcuaccaggacucccugagcugccggcuggucuuccuccugaugcaguacugcguggccgccaacuacuacuggcugcucguggagggcgucuaccuguacacccugcucgcguucagcgugcuguccgagcaguggaucuuccgccuguacgugagcaucggguggggcgucccccuccuguucguggugcccugggggaucgucaaguaccuguacgaggacgagggcugcuggacgcggaacuccaacaugaacuacuggcucaucauccgccugcccauccuguucgccaucggcgugaacuuccucaucuucgugcgggucaucugcaucguggugagcaagcugaaggccaaccugaugugcaagaccgacaucaagugccgccucgccaaguccacccugacccugaucccgcugcucgggacgcacgaggucaucuucgccuucgugauggacgagcacgcgcggggcacccugcgcuucaucaagcuguucaccgagcucagcuucaccuccuuccaggggcugauggucgccauccuguacugcuucgugaacaacgaggugcagcucgaguuccgcaagagcugggagcgguggcgccuggagcaccuccacauccagcgggacuccagcaugaagccccugaagugccccacguccagccuguccagcggcgccaccgccggguccagcauguacaccgcgaccugccaggccuccugcagcuga

SEQ ID NO: 30611 - RNA, 1662 nt, Artificial Sequence
  derived and/or modified sequence opt1 from GLP2R__Homo_sapiens__NP_004237
augaagcugggcagcucccgcgccgggcccggccgggggagcgccggccuccugccgggggugcacgagcugcccaugggcauccccgcgcccuggggcaccuccccgcucagcuuccaccgcaagugcucccugugggcccccgggcggcccuuccugacccucguccugcuggugagcaucaagcaggucacgggcucccuccuggaggagaccacccgcaagugggcccaguacaagcaggccugccugcgggaccuccugaaggagcccagcgggaucuucugcaacggcaccuucgaccaguacgugugcuggccgcacuccagccccgggaacguguccgugcccugccccagcuaccugccguggugguccgaggagagcuccggccgcgccuaccggcacugccucgcgcagggcacguggcagaccaucgagaacgccaccgacaucuggcaggacgacagcgagugcuccgagaaccacagcuucaagcagaacgucgaccgcuacgcccugcuguccacccuccagcugauguacacggugggguacagcuucagccugaucucccucuuccuggcccugacccuccugcuguuccuccggaagcugcacugcacccgcaacuacauccacaugaaccuguucgcgagcuucauccuccggacccuggccgugcuggucaaggacgugguguucuacaacuccuacagcaagcgccccgacaacgagaacggcuggauguccuaccucagcgagauguccacgagcugccgguccguccaggugcugcugcacuacuucgugggggccaacuaccucuggcugcuggucgagggccucuaccugcacacccugcucgagcccaccgugcugcccgagcgccggcuguggccgcgcuaccuccugcugggcugggccuuccccguccucuucguggugcccuggggguucgcccgggcgcaccuggagaacaccggcugcuggacgaccaacgggaacaagaagaucugguggaucauccgcggccccaugaugcugugcgugaccgucaacuucuucaucuuccugaagauccucaagcugcugaucagcaagcucaaggcccaccagaugugcuuccgggacuacaaguaccgccuggccaaguccacccuggugcucaucccgcugcugggggugcacgagauccucuucagcuucaucacggacgaccaggucgagggcuucgccaagcugauccggcuguucauccagcucacccuguccagcuuccacggcuuccugguggcccuccaguacggguucgcgaacggcgaggucaaggccgagcugcgcaaguacugggugcgcuuccugcucgcccggcacuccgggugccgcgccugcgugcugggcaaggacuuccgguuccuggggaagugccccaagaagcucagcgagggcgacggcgccgagaagcugcgcaagcugcagcccucccucaacagcgggcggcugcugcaccucgcgaugcgcggccugggggagcugggcgcccagccccagcaggaccacgcccgguggccgcgcggguccagccucagcgagugcuccgagggcgacgucaccauggccaacaccauggaggagauccuggaggagagcgagaucuga

SEQ ID NO: 30612 - RNA, 1350 nt, Artificial Sequence
  derived and/or modified sequence opt1 from GLRA1__Homo_sapiens__NP_000162
auguacagcuucaacacccugcgccucuaccugugggagaccaucguguucuucucccuggccgccagcaaggaggcggaggccgcccgguccgcccccaagccgaugagccccuccgacuuccucgacaagcugaugggccgcacgagcggguacgacgcccggauccgccccaacuucaaggggcccccggucaacguguccugcaacaucuucaucaacagcuucggcuccaucgcggagaccaccauggacuaccgggugaacaucuuccugcgccagcaguggaacgacccccggcucgccuacaacgaguaccccgacgacagccuggaccuggaccccuccaugcucgacagcaucuggaagccggaccuguucuucgccaacgagaagggcgcccacuuccacgagaucaccacggacaacaagcugcuccgcaucucccggaacgggaacguccuguacagcauccgcaucacccugacccucgcgugccccauggaccugaagaacuuccccauggacgugcagaccugcaucaugcagcuggaguccuucggcuacacgaugaacgaccucaucuucgaguggcaggagcagggcgccgugcaggucgccgacgggcugacccugccccaguucauccucaaggaggagaaggaccugcgguacugcaccaagcacuacaacaccggcaaguucacgugcaucgaggcccgcuuccaccuggagcggcagaugggguacuaccucauccagauguacaucccgagccugcugaucgugauccucuccuggaucagcuucuggaucaacauggacgccgcgcccgcccgcgugggccuggggaucaccaccguccugaccaugacgacccaguccagcggcagccgggccucccuccccaaggugagcuacgugaaggccaucgacaucuggauggccgucugccugcuguucguguucuccgcgcuccuggaguacgccgccgugaacuucgucagccgccagcacaaggagcugcuccgguuccgccggaagcgccggcaccacaaggaggacgaggccggcgaggggcgcuucaacuucuccgccuacggcauggggcccgcgugccugcaggccaaggacggcaucagcgugaagggcgccaacaacuccaacaccaccaacccgccgcccgcccccagcaagucccccgaggagaugcgcaagcuguucauccagcgggccaagaagaucgacaagaucagccgcaucggguuccccauggcguuccucaucuucaacauguucuacuggaucaucuacaagaucgugcggcgcgaggacguccacaaccaguga

SEQ ID NO: 30613 - RNA, 1359 nt, Artificial Sequence
  derived and/or modified sequence opt1 from GLRA2__Homo_sapiens__NP_001112357
augaaccgccagcuggugaacauccucaccgcccuguucgccuucuuccuggagaccaaccacuuccggacggcguucugcaaggaccacgacagccgcuccggcaagcagcccagccagacccucucccccagcgacuuccuggacaagcugauggggcggaccuccggcuacgacgcccgcauccggcccaacuucaaggggccgcccgucaacgugaccugcaacaucuucaucaacagcuucggcuccgugacggagaccaccauggacuaccgcgucaacaucuuccuccggcagcaguggaacgacagccgccuggccuacuccgaguaccccgacgacagccuggaccucgaccccuccaugcuggacagcaucuggaagcccgaccuguucuucgccaacgagaagggggccaacuuccacgacgugaccacggacaacaagcuccugcggaucuccaagaacggcaaggugcuguacagcauccgccucacccugacccuguccugccccauggaccucaagaacuucccgauggacguccagaccugcacgaugcagcuggagagcuucggcuacaccaugaacgaccugaucuucgaguggcucuccgacgggcccguccagguggcggagggccugacccugccccaguucauccucaaggaggagaaggagcugggguacugcaccaagcacuacaacacgggcaaguucacgugcaucgaggugaaguuccaccuggagcggcagaugggguacuaccucauccagauguacauccccagccugcugaucgugauccucuccugggugagcuucuggaucaacauggacgccgccccggcccgcgucgcgcugggcaucaccaccgugcugaccaugaccacccagagcuccggcagccgggccucccuccccaaggugagcuacgucaaggccaucgacaucuggauggccgugugccugcuguucguguucgccgcgcuccuggaguacgccgccgucaacuucgugucccgccagcacaaggaguuccugcggcuccgccggcgccagaagcggcagaacaaggaggaggacgugacccgcgagagccgguucaacuucuccggguacggcauggggcacugccugcaggucaaggacggcacggccgugaaggccacccccgcgaacccccugccgcagccgcccaaggacggcgacgccaucaagaagaaguucguggaccgcgccaagcgcaucgacaccaucagccgggccgccuucccccucgcguuccugaucuucaacaucuucuacuggaucaccuacaagaucauccgccacgaggacguccacaagaaguga

SEQ ID NO: 30614 - RNA, 1350 nt, Artificial Sequence
  derived and/or modified sequence opt1 from GLRA3__Homo_sapiens__NP_001036008
auggcccacgugcgccacuuccggacccuggucagcggcuucuacuucugggaggccgcgcuccugcugucccucguggccaccaaggagacggacagcgcccgcucccggagcgcccccauguccccgagcgacuuccuggacaagcugauggggcgcaccuccggcuacgacgcccggauccgccccaacuucaaggggccgcccgugaacgugaccugcaacaucuucaucaacagcuucggcuccaucgcggagaccacgauggacuaccgggugaacaucuuccuccgccagaaguggaacgacccccggcuggccuacagcgaguaccccgacgacucccuggaccucgaccccagcaugcuggacuccaucuggaagcccgaccuguucuucgccaacgagaagggggccaacuuccacgaggugaccaccgacaacaagcuccugcgcaucuucaagaacggcaacguccuguacagcauccggcucacccugacgcuguccugcccgauggaccucaagaacuuccccauggacgugcagaccugcaucaugcagcuggagagcuucggcuacaccaugaacgaccugaucuucgaguggcaggacgaggcgcccgugcaggucgccgaggggcucacccugccccaguuccugcucaaggaggagaaggaccugcgcuacugcacgaagcacuacaacaccggcaaguucacgugcaucgaggugcgguuccaccuggagcgccagaugggguacuaccucauccagauguacaucccgucccugcugaucgugauccucagcugggucuccuucuggaucaacauggacgccgcccccgcccggguggcgcugggcaucaccaccgugcugaccaugaccacccagagcagcgggucccgcgccagccuccccaaggucuccuacgugaaggccaucgacaucuggauggccgugugccugcuguucgucuucagcgcccuccuggaguacgcggccgugaacuucgugucccggcagcacaaggagcugcuccgcuuccggcgcaagcggaagaacaaggacgacgagguccgcgagagccgcuucuccuucacggccuacggcaugggccccugccugcaggccaaggacgggaugaccccgaagggccccaaccaccccguccaggugaugcccaagagcccggacgagaugcggaaggucuucaucgaccgcgccaagaagaucgacaccaucucccgggcgugcuucccccuggccuuccucaucuucaacaucuucuacugggugaucuacaagauccugcgccacgaggacauccaccagcagcaggacuga

SEQ ID NO: 30615 - RNA, 1494 nt, Artificial Sequence
  derived and/or modified sequence opt1 from GLRB__Homo_sapiens__NP_001159532
augaaguuccugcucaccaccgccuuccugauccugaucagccucuggguggaggaggccuacuccaaggagaaguccagcaagaagggcaaggggaagaagaagcaguaccugugccccagccagcaguccgcggaggaccuggcccgcgucccggccaacagcacguccaacauccucaaccggcugcuggugagcuacgacccccgcauccggcccaacuucaagggcauccccguggacgucguggugaacaucuucaucaacuccuucgggagcauccaggagaccaccauggacuaccgcgucaacaucuuccuccggcagaaguggaacgacccgcgccugaagcugcccuccgacuuccggggcagcgacgcccucaccguggaccccacgauguacaagugccuguggaagcccgaccuguucuucgccaacgagaaguccgcgaacuuccacgacgugacccaggagaacauccuccuguucaucuuccgcgacggggacguccuggugagcaugcggcucuccaucacccugagcugcccgcuggaccucacccuguuccccauggacacgcagcgcugcaagaugcagcuggaguccuucggcuacaccaccgacgaccuccgguucaucuggcagagcggcgaccccgugcagcuggagaagaucgcccugccccaguucgacaucaagaaggaggacaucgaguacgggaacugcaccaaguacuacaagggcacgggguacuacacgugcgucgaggugaucuucacccuccgccgccaggugggcuucuacaugaugggggucuacgccccgacccugcugaucguggugcucuccuggcugagcuucuggaucaaccccgacgccagcgcggcccgggucccccugggcaucuucuccgugcucagccuggccuccgagugcaccacccuggccgccgagcuccccaaggugagcuacgucaaggcgcuggacguguggcugaucgccugccuccuguucggcuucgccucccugguggaguacgccgucgugcaggucaugcucaacaacccgaagcggguggaggccgagaaggcgcgcaucgccaaggccgagcaggccgacgggaagggcgggaacguggccaagaagaacaccgucaacggcaccggcacgcccgugcacaucagcacccuccaggugggggagacccggugcaagaaggucugcaccuccaagagcgaccugcgcuccaacgacuucagcaucgugggcucccugccccgggacuucgagcugagcaacuacgacugcuacgggaagcccaucgaggugaacaacggccuggggaagucccaggcgaagaacaacaagaagccgccgcccgccaagcccgucauccccacggccgccaagcgcaucgaccucuacgcccgggcgcuguuccccuucugcuuccuguucuucaacgugaucuacuggagcaucuaccuguga

SEQ ID NO: 30616 - RNA, 498 nt, Artificial Sequence
  derived and/or modified sequence opt1 from GLRX2__Homo_sapiens__NP_057150
augaacccccgcgacaagcaggucagccgguucuccccgcugaaggacguguacaccuggguggcccucgccggcauccagcgcagcgggucccccggccggacccgcagcgcggcccggcgcauggaguccaacacgagcuccagccuggagaaccuggccaccgcccccgugaaccagauccaggagaccaucuccgacaacugcgucgugaucuucagcaagaccuccugcagcuacugcacgauggccaagaagcuguuccacgacaugaacgugaacuacaaggucguggagcucgaccugcucgaguacgggaaccaguuccaggacgcgcuguacaagaugaccggcgagcggaccgugccccgcaucuucgucaacgggaccuucaucggcggcgccacggacacccaccggcugcacaaggaggggaagcuccugccgcuggugcaccagugcuaccucaagaaguccaagcgcaaggaguuccaguga

SEQ ID NO: 30617 - RNA, 1008 nt, Artificial Sequence
  derived and/or modified sequence opt1 from GLRX3__Homo_sapiens__NP_006532
auggccgccggcgcggccgaggccgccguggccgcgguggaggagguggggagcgccggccaguucgaggagcugcuccgccugaaggccaagucccugcucgugguccacuucugggcccccugggcgccgcagugcgcccagaugaacgaggugauggccgagcuggccaaggagcugccccaggugagcuucgucaagcucgaggccgagggggugcccgagguguccgagaaguacgagaucagcuccguccccaccuuccuguucuucaagaacagccagaagaucgaccggcuggacggcgcgcacgccccggagcucaccaagaaggugcagcgccacgccuccagcggguccuuccugcccagcgccaacgagcaccugaaggaggaccucaaccugcggcugaagaagcucacgcacgccgcgcccugcaugcuguucaugaagggcacgccccaggagccgcgcugcggcuucuccaagcagaugguggagauccugcacaagcacaacauccaguucagcuccuucgacaucuucagcgacgaggagguccggcaggggcucaaggccuacuccagcuggcccaccuacccccagcuguacguguccggcgagcugaucgggggccucgacaucaucaaggagcuggaggccagcgaggagcuggacaccaucugccccaaggccccgaagcucgaggagcgccugaaggugcugaccaacaaggccuccgucaugcuguucaugaaggggaacaagcaggaggcgaagugcggcuucagcaagcagauccucgagauccugaacagcaccggcguggaguacgagaccuucgacauccucgaggacgaggaggugcggcaggggcugaaggccuacuccaacuggcccaccuacccccagcuguacgucaagggcgagcucgucgggggccuggacaucgugaaggagcugaaggagaacggcgagcuccugcccauccugcgcggggagaacuga

SEQ ID NO: 30618 - RNA, 474 nt, Artificial Sequence
  derived and/or modified sequence opt1 from GLRX5__Homo_sapiens__NP_057501
augagcggcucccuggggcgcgccgccgcggcccuccugcgguggggccgcggggccggcgggggcggccugugggggccgggcgugcgggccgccgggagcggcgccgggggcggcggguccgcggagcagcucgacgcccuggucaagaaggacaaggugguggucuuccugaagggcaccccggagcagccccagugcggguucagcaacgccguggugcagauccuccgccugcacggcguccgggacuacgcggccuacaacgugcuggacgaccccgagcuccgccagggcaucaaggacuacuccaacuggcccaccaucccccagguguaccugaacggggaguucgucggcgggugcgacauccugcuccagaugcaccagaacggcgaccugguggaggagcugaagaagcucgggauccacagcgcccugcuggacgagaagaaggaccaggacuccaaguga

SEQ ID NO: 30619 - RNA, 321 nt, Artificial Sequence
  derived and/or modified sequence opt1 from GLRX__Homo_sapiens__NP_001230588
auggcccaggaguucgugaacugcaagauccagcccggcaaggucgugguguucaucaagccgaccugccccuacugccgccgggcccaggagauccugagccagcuccccaucaagcaggggcugcuggaguucgucgacaucaccgcgacgaaccacaccaacgagauccaggacuaccuccagcagcugaccggcgcccgcaccgugccccggguguucaucgggaaggacugcaucggcgggugcuccgaccuggucagccuccagcaguccggcgagcugcugacgcgccucaagcagaucggcgcccugcaguga

SEQ ID NO: 30620 - RNA, 1809 nt, Artificial Sequence
  derived and/or modified sequence opt1 from GLS2__Homo_sapiens__NP_037399
augcgcagcaugaaggcccugcagaaggcccucucccgggcgggcagccacugcgggcgcggcggguggggccaccccucccggagcccgcugcucgggggcggcgugcgccaccaccucuccgaggccgccgcccaggggcgggagacgccccacagccaccagccccagcaccaggaccacgacuccagcgaguccggcaugcugagccgccugggggaccuccuguucuacaccaucgccgagggccaggagcggauccccauccacaaguucaccaccgcgcugaaggccaccgggcuccagaccuccgacccgcgccugcgggacugcaugagcgagaugcaccgcgucgugcaggaguccagcuccggcggccugcucgaccgggaccuguuccgcaagugcgugagcuccaacaucguccugcucacgcaggccuuccggaagaaguucgugauccccgacuucgaggaguucaccgggcacguggaccgcaucuucgaggacgucaaggagcugaccggcgggaagguggccgcguacaucccccagcuggccaagagcaaccccgaccucuggggcgugucccugugcaccgucgacggccagcggcacagcguggggcacacgaagaucccguucugccugcagagcugcgugaagccccucaccuacgccaucuccaucagcacccugggcaccgacuacguccacaaguucguggggaaggagcccuccggccugcgcuacaacaagcucagccugaacgaggaggggaucccccacaacccgauggugaacgccggcgccaucgucguguccagccugaucaagauggacugcaacaaggcggagaaguucgacuucgugcuccaguaccugaacaagauggccggcaacgaguacaugggguucuccaacgccacguuccagagcgagaaggagaccggcgaccggaacuacgccaucggguacuaccugaaggagaagaagugcuuccccaagggcgucgacaugauggccgcgcucgaccuguacuuccagcugugcuccguggaggugaccugcgagagcggguccgucauggccgccacccucgccaacggcggcaucugccccaucacgggggagagcgugcuguccgccgaggcggugcgcaacacccugagccucaugcacuccugcggcauguacgacuucagcgggcaguucgccuuccacgucggccugcccgccaaguccgccgugagcggggccauccugcucgucgugccgaacgugaugggcaugaugugccuguccccgccccuggacaagcucggcaacagccaccgggggaccagcuucugccagaagcuggucucccuguucaacuuccacaacuacgacaaccuccgccacugcgcgcggaagcuggacccccgccgcgagggcgccgagauccggaacaagaccguggugaaccugcuguucgccgccuacagcggggacgucuccgcgcugcgccgguucgcccugagcgccauggacauggagcagaaggacuacgacucccgcacggcccugcacguggccgcggccgagggccacaucgagguggucaaguuccucaucgaggccugcaaggugaaccccuucgccaaggaccgguggggcaacaucccccuggacgacgccgugcaguucaaccaccuggaggucgugaagcuccugcaggacuaccaggacagcuacacccuguccgagacccaggcggaggccgccgccgaggcccucagcaaggagaaccuggaguccaugguguga

SEQ ID NO: 30621 - RNA, 1797 nt, Artificial Sequence
  derived and/or modified sequence opt1 from GLS__Homo_sapiens__NP_001243239
augaugcgccugcggggcagcgggaugcuccgcgaccugcugcuccggagccccgccggcgugagcgccacccugcgccgggcgcagccgcuggucacccucugccgccggccccgcgggggcgggcggcccgccgccggccccgccgccgcggcccgccugcacccgugguggggcgggggcggguggcccgccgagccccuggcccggggccucuccagcucccccagcgagauccugcaggagcuggggaagggcuccacgcacccgcagcccggcgugagcccgcccgcggcccccgccgcccccgggcccaaggacggccccggggagaccgacgccuucggcaacuccgagggcaaggagcucguggcgagcggggagaacaagaucaagcagggccugcugccgucccucgaggaccugcuguucuacaccaucgccgaggggcaggagaagauccccguccacaaguucaucaccgcccucaagagcacgggccugcgcaccuccgacccccggcugaaggagugcauggacaugcuccgccugacccugcagaccacgagcgacggggugaugcucgacaaggaccuguucaagaagugcgugcaguccaacaucguccugcucacccaggccuuccggcgcaaguucgugauccccgacuucaugagcuucaccucccacaucgacgagcuguacgagagcgccaagaagcaguccggcggcaagguggcggacuacaucccgcagcuggccaaguucagccccgaccucuggggcgucagcgugugcaccguggacgggcagcggcacuccacgggggacaccaagguccccuucugccugcagagcugcgugaagccccugaaguacgccaucgccgugaacgaccucggcaccgaguacguccaccgcuacguggggaaggagccguccggccugcgguucaacaagcuguuccucaacgaggacgacaagccccacaaccccauggugaacgccggcgcgaucgucgugaccagccugaucaagcagggggugaacaacgccgagaaguucgacuacgucaugcaguuccugaacaagauggccggcaacgaguacgugggguucuccaacgccacguuccagagcgagcgcgaguccggcgaccggaacuucgccaucggguacuaccucaaggagaagaagugcuuccccgagggcaccgacauggugggcauccuggacuucuacuuccagcugugcagcaucgaggugaccugcgaguccgcgagcgucauggccgccacccucgccaacgggggcuucugcccgaucacgggggagcgcguccugucccccgaggcggugcgcaacacccugagccucaugcacuccugcggcauguacgacuucagcggccaguucgccuuccacguggggcugcccgccaaguccggcgucgccgggggcauccugcucguggugccgaacgucauggggaugaugugcuggagcccgccccuggacaagaugggcaacuccgugaagggcauccacuucugccacgaccuggugagccugugcaacuuccacaacuacgacaaccuccggcacuucgccaagaagcuggacccccgccgggagggcggggaccagcgccacuccuucgggccccuggacuacgagagccuccagcaggagcuggcgcugaaggagaccgucuggaagaaggugagccccgaguccaacgaggacaucagcaccacgguggucuaccggauggagucccucggcgagaaguccuga

SEQ ID NO: 30622 - RNA, 801 nt, Artificial Sequence
  derived and/or modified sequence opt1 from GLT1D1__Homo_sapiens__NP_653270
augcgccuccuguuccuggccgugcugcggccccacaccggcaacgccgucaccgcgcagcgcgugcgggcccaccucgaggccgccgggcacgugugcguccugaaggacgccuucgacuucgagagccgcuccgagaucgcgaaccugauccucgccgagaacugcgaggccgcccuggcgcugcaccucuaccggggcgggcgccugcugcagggccaccggaucccguucggggugaucuucggcggcacggacgugaacgaggacgccaaccaggccgagaagaacaccgucauggggcgcgugcucgaggaggcccgguucgccguggcguucaccgagagcaugaaggagauggcccaggcccagugggucgaccccguguucacccgcgaggugaaggccaaggucaagcgggccgcgggcgugcgccugaucggggagaugccccaggaggaccugcacgccguggucaagaacugcuucgccguggugaacuccagcgucuccgagggcaugagcgccgccauccucgaggcgauggaccuggaggugcccgugcuggcccggaacaucccggggaacgccgccgucgugaagcacgaggugacgggccuccuguucuccaacccccaggaguucguccaccuggccaagcgccucgugagcgaccccgcgcuggagaaggagaucgucgugaacggccgggaguacgugcgcauguaccacuccuggcaggucgagcgggacaccuaccagcagcugauccgcaagcucgaggggagcaccgaggacuga

SEQ ID NO: 30623 - RNA, 831 nt, Artificial Sequence
  derived and/or modified sequence opt1 from GLT6D1__Homo_sapiens__XP_011516939
augaacagcaagcgcaugcugcuccuggugcuguucgccuucucccucaugcugguggagcgguacuuccgcaaccaccagguggaggagcugcggcucagcgacugguuccacccccgcaagcggccggacgugaucaccaagaccgacuggcuggcccccguccugugggagggcaccuucgaccgccgggugcucgagaagcacuaccgccggcgcaacaucaccguggggcuggcggucuucgccaccggccgguucgccgaggaguaccugcgccccuuccuccacuccgccaacaagcacuucaugaccggguaccgggugaucuucuacaucaugguggacgccuucuucaagcugcccgacaucgagccgagcccccugcgcacguucaaggcguucaaggucggcaccgagcggugguggcucgacgggccccuggugcacgugaagucccugggcgagcacaucgccagccacauccaggacgaggucgacuuccucuucuccauggccgccaaccagguguuccagaacgaguucggcguggagacccuggggccccuggucgcgcagcuccacgccuggugguacuuccgcaacaccaagaacuucccguacgagcggcgccccacgagcgccgccugcauccccuucggccagggggacuucuacuacggcaaccugauggucgggggcacgccccacaacauccuggacuucaucaaggaguaccucaacggcgugauccacgacaucaagaacgggcugaacuccaccuacgagaagcaccugaacaaguacuucuaccucaacaagccgaccuga

SEQ ID NO: 30624 - RNA, 1116 nt, Artificial Sequence
  derived and/or modified sequence opt1 from GLT8D1__Homo_sapiens__NP_001010983
augagcuuccgcaaggugaacaucaucauccugguccucgccguggcccuguuccugcucgugcugcaccacaacuuccugucccucagcucccugcugcggaacgaggucaccgacagcggcaucguggggccccagccgaucgacuucgugcccaacgcgcuccgccacgccgucgacggccggcaggaggagauccccguggugaucgccgccuccgaggaccgccucgggggcgccaucgcggccaucaacagcauccagcacaacacccgguccaacgucaucuucuacaucgugacgcugaacaacaccgccgaccaccuccgcagcuggcugaacuccgacagccugaaguccauccgguacaagaucgugaacuucgaccccaagcuccuggaggggaaggucaaggaggacccggaccagggcgagagcaugaagccccugaccuucgcccgcuucuaccuccccauccuggugcccuccgcgaagaaggccaucuacauggacgacgacgugaucguccagggcgacauccuggcccucuacaacaccgcccugaagccggggcacgccgcggccuucagcgaggacugcgacuccgccagcacgaagguggugauccggggcgccgggaaccaguacaacuacaucggcuaccuggacuacaagaaggagcgcauccggaagcucuccaugaaggccagcacgugcuccuucaaccccggggucuucguggcgaaccugaccgaguggaagcgccagaacaucaccaaccagcuggagaaguggaugaagcucaacguggaggagggccuguacagccggacccuggccggcagcaucaccaccccgccccugcugaucgucuucuaccagcagcacuccaccaucgaccccauguggaacgugcgccaccuggggagcuccgccggcaagcgguacagcccccaguucgugaaggccgccaagcuccugcacuggaacgggcaccugaagcccuggggccgcacggcguccuacaccgacgucugggagaagugguacauccccgacccgaccggcaaguucaaccucauccggcgcuacaccgagaucagcaacaucaaguga

SEQ ID NO: 30625 - RNA, 4683 nt, Artificial Sequence
  derived and/or modified sequence opt1 from GLTSCR1__Homo_sapiens__XP_005258890
auggacgacgaggacggccgcugccugcucgacgugaucugcgacccccaggcccugaacgacuuccugcacgggagcgagaagcucgacuccgacgaccugcuggacaacccgggcgaggcccagagcgcguucuacgaggggcccggccuccacguccaggaggccuccgggaaccaccugaaccccgagcccaaccagccggcccccagcguggaccuggacuuccucgaggacgacauccugggcucccccgccaccggcgggggcgggggcgggagcggcggcgccgaccagcccugcgacauccugcagcagucccuccaggaggcgaacaucaccgagcagacgcuggaggccgaggccgagcuggaccucgggccguuccagcugcccacccugcagcccgccgacggcggggcgggccccaccggcgccgggggcgccgccgccguggcggccgggccgcaggcccucuuccccggcagcaccgaccugcuggggcuccagggcccccccacgguccugacccaccaggcccuggugccgccccaggacguggucaacaaggcccucuccgugcagcccuuccugcagcccgugggccuggggaacgucacccuccagccgauccccggccugcaggggcugcccaacggcagccccgggggcgcgaccgccgccacgcucggccuggccccgauccaggugguggggcagcccgucauggcccugaacacccccaccucccagcuccuggcgaagcaggugcccgugagcggcuaccuggccuccgccgccgggccgagcgagcccgucacccucgccuccgcgggcgugagcccccagggggccggccuggugauccagaagaaccuguccgccgccgucgcgacgacccucaacggcaacagcguguucgggggcgccggggccgccuccgccccgaccggcacccccagcggccagccccuggcgguggcccccgggcugggcagcuccccgcucguccccgcccccaacgugauccugcaccggacgcccaccccgauccagcccaagcccgccggggugcugcccccgaagcucuaccagcugacccccaagcccuucgcccccgcgggcgccacccugacgauccagggggagccgggcgcccucccccagcagcccaaggccccccagaaccugaccuucauggccgcgggcaaggccgggcagaacgucgugcugagcggcuucccggcccccgcccugcaggcgaacgucuucaagcagccccccgccaccaccacgggggccgccccgccccagcccccgggcgcccucuccaagcccaugagcgugcaccugcugaaccagggguccagcaucgugauccccgcgcagcacaugcuccccggccagaaccaguuccugcugccgggcgcccccgccguccagcucccccagcagcuguccgcccugcccgccaacguggggggccagauccucgcggccgccgccccgcacaccgggggccagcugaucgccaaccccauccugaccaaccagaaccucgcggggccccugagccugggccccgugcucgccccgcacuccggcgcccacagcgcccacauccuguccgcggcccccauccaggucgggcagcccgcccuguuccagaugcccgugagccucgccgccggcucccugccgacccagagccagcccgcgcccgccgggcccgccgccacgaccgugcugcagggcgucacccucccgcccuccgccguggcgaugcugaacacccccgacgggcuggugcagcccgccacgccggccgccgccaccggcgaggcggcccccguccucaccgugcagcccgccccccaggccccgcccgccgugagcaccccccugccgcugggccuccagcagccccaggcgcagcagcccccccaggccccgacgccccaggccgccgcgcccccccaggccaccaccccgcagcccucccccgggcuggccagcucccccgagaagaucguccugggccagccgcccagcgccacccccaccgccauccucacgcaggacagccugcagauguuccugccccaggagcgcucccagcagccgcucagcgcggaggggccccaccuguccgugcccgccagcgugaucgucuccgcccccccgcccgcccaggaccccgcccccgcgaccccgguggccaagggcgccggccuggggccccaggcccccgacagccaggccucccccgcgccggccccccagauccccgccgccgcgccgcucaagggccccgggcccagcuccagccccucccugccgcaccaggccccccugggcgacagcccccaccuccccuccccgcaccccacccggccccccagccgcccgcccucccggccccagagcgugucccgccccccgagcgagcccccccugcaccccugcccgcccccccaggcccccccgacccugcccgggaucuucgucauccagaaccagcucggcgugcccccgcccgccagcaaccccgcccccacggcgccgggccccccccagcccccgcugcggccccagucccagccccccgaggggccgcugccccccgccccccaccucccgcccagcuccaccagcuccgccguggccagcuccagcgagaccuccagccgccugcccgcccccaccccguccgacuuccagcugcaguucccccccagccagggcccccacaaguccccgacgcccccccccacccuccaccuggucccggagcccgcggcccccccgcccccccccccgcggaccuuccagauggugaccacgcccuuccccgcccugccccagccgaaggcccuccuggagcgcuuccaccaggugcccagcgggaucauccugcagaacaaggccggcggggcgcccgccgccccccagaccuccaccagccucggcccgcugaccucccccgccgcgagcguccugguguccggccaggcccccagcgggacgcccaccgccccgagccacgcccccgcccccgcgcccauggccgccaccggccucccgccccugcugcccgccgagaacaaggccuucgcguccaaccuccccacccugaacguggccaaggccgccagcuccgggccgggcaagcccagcgggcugcaguacgaguccaagcucagcggccugaagaagccccccacgcugcagccguccaaggaggccugcuuccucgagcaccugcacaagcaccagggcagcguccugcaccccgacuacaagaccgcguuccccuccuucgaggacgcccuccaccggcugcugccguaccacguguaccagggggcccuccccagccccuccgacuaccacaagguggacgaggaguucgagaccgucagcacccagcugcugaagcgcacgcaggccaugcucaacaaguaccggcugcugcuccuggaggagucccgccgggugagccccuccgccgagauggugaugaucgaccgcauguucauccaggaggagaagaccacccuggcgcucgacaagcagcuggccaaggagaagccggacgaguacgucagcuccagccggucccugggccuccccaucgccgccagcagcgaggggcaccgccugcccggccacggcccccuguccagcuccgcgccgggggccagcacccagccccccccccaccucccgacgaagcuggugauccggcacggcggggccggcgggucccccagcgugaccugggcccgcgccuccagcucccugagcuccagcuccagcuccagcuccgcggccagcucccucgacgccgacgaggacggccccaugcccagccggaaccgcccgcccaucaagaccuacgaggcccgcagccggaucggccugaagcugaagaucaagcaggaggccgggcucuccaaggucgugcacaacaccgcgcuggaccccgugcaccagcccccgcccccccccgccacgcugaaggucgccgagccgcccccccgccccccgccccccccgccccccaccggccagaugaacgggaccguggaccaccccccgcccgccgcccccgagcggaagccccugggcaccgcgccgcacugcccccgccucccccugcggaagacguaccgcgagaacguggggggccccggcgccccggaggggacccccgccggccgggcccgcgggggcagccccgcgccccugccggccaaggucgacgaggccaccuccgggcucauccgggagcuggccgccguggaggacgagcuguaccagcgcaugcucaagggccccccccccgagccggcggccagcgccgcccagggcaccggggaccccgacugggaggcccccggccugcccccggcgaagcggcgcaaguccgagagccccgacguggaccaggccuccuucagcuccgacagcccccaggacgacacccugacggagcaccuccaguccgccaucgacagcauccugaaccugcagcaggccccggggcggacccccgcccccuccuacccccacgcggccagcgccggcaccccggccuccccccccccccuccaccgcccggaggcguacccccccagcucccacaacgggggccugggcgcccggacccugacgcgcuga

SEQ ID NO: 30626 - RNA, 1437 nt, Artificial Sequence
  derived and/or modified sequence opt1 from GLTSCR2__Homo_sapiens__NP_056525
auggccgccggcgggagcggcgucgggggcaagcgcuccagcaaguccgacgcggacagcggguuccugggccuccggcccaccuccguggacccggcccugcgccggcgccggcgcggcccccggaacaagaagcgcggguggcggcgccuggcccaggagccccucggccuggagguggaccaguuccuggaggacgugcggcuccaggagcgcaccagcgggggccugcuguccgaggcccccaacgagaagcuguucuucgucgacacggggagcaaggagaagggccucaccaagaagcggaccaaggugcagaagaagucccugcuccugaagaagccgcugcgcguggaccucauccuggagaacaccagcaagguccccgcccccaaggacgugcuggcgcaccaggugcccaacgccaagaagcuccggcgcaaggagcagcugugggagaagcuggccaagcagggcgagcucccgcgggagguccgccgggcccaggcgcgccugcugaaccccuccgccacgcgggccaagcccgggccccaggacaccguggagcgcccguucuacgaccucugggccagcgacaacccccuggaccgcccccuggugggccaggacgaguucuuccucgagcagaccaagaagaagggggucaagcggcccgcccgccugcacaccaagccgucccaggcgcccgccguggagguggcccccgccggcgccagcuacaaccccuccuucgaggaccaccagacgcugcucagcgcggcccacgaggucgagcugcagcggcagaaggaggccgagaagcuggagcgccagcucgcccugccggccaccgagcaggcggccacccaggaguccaccuuccaggagcugugcgagggccuccuggaggagagcgacggggagggcgagcccgggcagggcgaggggcccgaggccggcgacgccgaggugugccccacgccggcccggcuggcgaccaccgagaagaagaccgagcagcagcgccggcgcgagaaggccgugcaccggcuccgcguccagcaggccgcccugcgggcggcccgccugcggcaccaggagcuguuccgccuccggggcaucaaggcccagguggcccugcgccucgccgagcuggcgcggcgccagcggcgccgccaggcccggcgcgaggccgaggccgacaagccccggcgccuggggcggcucaaguaccaggcccccgacaucgacgugcagcuguccagcgagcugacggacagccugcgcacccucaagcccgagggcaacauccugcgggaccgcuucaaguccuuccagcggcgcaacaugaucgagccgcgggagcgcgcgaaguucaagcggaaguacaaggucaagcugguggagaagcgcgccuuccgggagauccagcucuga

SEQ ID NO: 30627 - RNA, 1677 nt, Artificial Sequence
  derived and/or modified sequence opt1 from GLUD1__Homo_sapiens__NP_005262
auguaccgcuaccugggcgaggcccuccugcugagccgggccgggcccgcggcccucggcuccgccagcgccgacuccgccgcgcugcuggggugggcccgcggccagccggccgccgcgccccagcccgggcucgcccuggccgcccggcgccacuacagcgaggccguggcggaccgggaggacgaccccaacuucuucaagauggucgagggcuucuucgaccgcggcgccuccaucguggaggacaagcugguggaggaccuccggacccgcgagagcgaggagcagaagcggaaccgcguccgggggauccugcgcaucaucaagccgugcaaccacgugcugucccucagcuuccccauccggcgcgacgacggcuccugggaggugaucgagggguaccgggcccagcacagccagcaccgcacccccugcaagggcgggauccgguacuccacggacgucagcguggacgaggugaaggcccuggccucccugaugaccuacaagugcgcggucguggacgugcccuucggcggcgccaaggccggggucaagaucaacccgaagaacuacaccgacaacgagcucgagaagaucacccgccgguucacgauggagcuggccaagaagggcuucaucgggcccggcaucgacgugcccgcccccgacaugagcaccggcgagcgcgagauguccuggaucgcggacaccuacgccagcaccaucgggcacuacgacaucaacgcccacgccugcgugacgggcaagccgaucucccagggcgggauccacgggcggaucagcgccaccggccgcggcgucuuccacgggaucgagaacuucaucaacgaggcguccuacaugagcauccugggcaugacccccggguucggcgacaagaccuucguggugcagggguucggcaacgucggccuccacagcaugcgcuaccugcaccgguucggggccaagugcaucgccgugggcgaguccgacgggagcaucuggaaccccgacggcaucgaccccaaggagcuggaggacuucaagcuccagcacggguccauccugggcuucccgaaggccaagcccuacgagggcagcauccuggaggcggacugcgacauccucauccccgccgccuccgagaagcagcugaccaagagcaacgcgccccgcgugaaggccaagaucaucgccgagggggccaacggcccgacgacccccgaggccgacaagaucuuccuggagcggaacaucauggucauccccgaccucuaccugaacgccgggggcgugaccguguccuacuucgaguggcugaagaaccucaaccacgucagcuacggccgccugacguucaaguacgagcgggacuccaacuaccaccuccugaugagcgugcaggagucccuggagcgcaaguucgggaagcacggcgggaccauccccaucgucccgaccgccgaguuccaggaccggaucagcggcgcguccgagaaggacaucgugcacagcgggcuggccuacaccauggagcgcuccgcccggcagaucaugcgcacggccaugaaguacaaccucggccuggaccugcggaccgccgcguacgugaacgccaucgagaaggucuucaagguguacaacgaggccggcgugaccuucaccuga

SEQ ID NO: 30628 - RNA, 1677 nt, Artificial Sequence
  derived and/or modified sequence opt1 from GLUD2__Homo_sapiens__NP_036216
auguaccgcuaccuggccaaggcccuccugcccagccgggcgggcccggccgcccugggguccgccgccaaccacagcgcggcccuccugggccgcgggcggggccagcccgccgccgcgucccagcccgggcuggcccucgccgcccgccggcacuacagcgagcugguggccgaccgcgaggacgaccccaacuucuucaagauggucgagggcuucuucgaccggggcgcguccaucguggaggacaagcuggugaaggaccuccgcacccaggagagcgaggagcagaagcggaaccgcguccgggggauccugcgcaucaucaagccgugcaaccacgugcugucccucagcuuccccauccggcgcgacgacggcuccugggaggugaucgagggguaccgggcccagcacagccagcaccgcacccccugcaagggcgggauccgguacuccacggacgucagcguggacgaggugaaggcccuggccucccugaugaccuacaagugcgccgucguggacgugcccuucggcggcgcgaaggccggggucaagaucaacccgaagaacuacaccgagaacgagcucgagaagaucacccgccgguucacgauggagcuggccaagaagggcuucaucgggcccggcguggacgugcccgcccccgacaugaacaccggcgagcgcgagaugagcuggaucgccgacaccuacgcguccaccaucgggcacuacgacaucaacgcccacgccugcgucacgggcaagccgaucagccagggcgggauccacgggcggaucuccgccaccggccgcggcguguuccacgggaucgagaacuucaucaacgaggccagcuacauguccauccugggcaugacccccggguuccgcgacaagaccuucgugguccagggcuucgggaacgugggccuccacagcaugcgguaccugcaccgcuucggcgcgaagugcaucgccgugggggagagcgacggcuccaucuggaaccccgacgggaucgaccccaaggagcuggaggacuucaagcuccagcacggcagcauccugggguucccgaaggccaagcccuacgagggcuccauccuggaggucgacugcgacauccucauccccgccgcgacggagaagcagcugaccaagagcaacgcgccccgggugaaggccaagaucaucgccgagggcgccaacgggccgaccacccccgaggccgacaagaucuuccuggagcgcaacauccucgugauccccgaccuguaccugaacgccggcggggucacgguguccuacuucgaguggcucaagaaccugaaccacgucagcuacggccggcugaccuucaaguacgagcgcgacuccaacuaccaccuccugcugagcgugcaggagucccucgagcggaaguucggcaagcacgggggcaccauccccaucgugccgaccgccgaguuccaggacagcaucuccggggccagcgagaaggacaucguccacuccgcccuggcguacacgauggagcgcagcgcccggcagaucaugcacaccgccaugaaguacaaccugggccucgaccugcgcaccgccgccuacgugaacgcgaucgagaagguguucaaggucuacuccgaggccggggugaccuucacguga

SEQ ID NO: 30629 - RNA, 1122 nt, Artificial Sequence
  derived and/or modified sequence opt1 from GLUL__Homo_sapiens__XP_006711341
augaccaccagcgccuccagccaccugaacaagggcaucaagcaggucuacaugucccucccccagggggagaaggugcaggccauguacaucuggaucgacggcacgggggagggccugcgcugcaagacccggacccuggacagcgagccgaagugcguggaggagcuccccgaguggaacuucgacggguccagcacccugcaguccgagggcagcaacuccgacauguaccuggugcccgcggccauguuccgcgaccccuuccggaaggacccgaacaagcucguccugugcgagguguucaaguacaaccgccggcccgccgagacgaaccugcgccacacgugcaagcggaucauggacauggugagcaaccagcaccccugguucggcauggagcaggaguacacccucauggggaccgacggccaccccuucggguggccguccaacggcuuccccgggccccagggccccuacuacugcggcgucggggccgaccgcgccuacggccgggacaucguggaggcgcacuaccgcgccugccuguacgccggggugaagaucgccggcaccaacgcggaggucaugccggcccagugggaguuccagaucggccccugcgaggggaucagcaugggcgaccaccuguggguggcccgguucauccuccaccgcgugugcgaggacuucggggucaucgccaccuucgaccccaagcccaucccgggcaacuggaacggggccggcugccacaccaacuucuccaccaaggcgaugcgggaggagaacggccugaaguacaucgaggaggccaucgagaagcugagcaagcgccaccaguaccacauccgggccuacgaccccaagggcgggcucgacaacgcccgccggcugacgggguuccacgagaccuccaacaucaacgacuucagcgccggcguggcgaaccgcuccgccagcauccggaucccccgcaccguggggcaggagaagaagggcuacuucgaggaccggcgccccuccgccaacugcgacccguucagcgucaccgaggcccugauccgcacgugccuccugaacgagaccggcgacgagcccuuccaguacaagaacuga

SEQ ID NO: 30630 - RNA, 492 nt, Artificial Sequence
  derived and/or modified sequence opt1 from GLYAT__Homo_sapiens__NP_005829
augaugcugccccuccagggcgcccagaugcugcagaugcuggagaagucccuccgcaagagccugccggccagccugaagguguacgggaccgucuuccacaucaaccacggcaaccccuucaaccucaaggcggugguggacaaguggcccgacuucaacaccgucguggugugcccccaggagcaggacaugacggacgaccuggaccacuacaccaacaccuaccagaucuacuccaaggacccgcagaacugccaggaguuccuggggagccccgagcucaucaacuggaagcagcaccuccagauccaguccagccagcccucccugaacgaggccauccagaaccuggccgccaucaagagcuucaaggucaagcagacccagcggauccuguacauggccgcggagacggccaaggagcugacccccuuccuccugaaguccaagauccugagcccgaacggcgggaagcccaaggccauguga

SEQ ID NO: 30631 - RNA, 867 nt, Artificial Sequence
  derived and/or modified sequence opt1 from GLYATL3__Homo_sapiens__NP_001010904
augcuggugcucaacugcagcaccaagcugcugauccucgagaagaugcugaaguccugcuuccccgagagccugaaggucuacggcgccgugaugaacaucaaccgcgggaacccguuccagaaggaggugguccucgacuccuggcccgacuucaaggccgugaucacccggcgccagcgggaggcggagacggacaaccuggaccacuacaccaacgccuacgccguguucuacaaggacguccgcgccuaccggcagcugcucgaggagugcgacguguucaacugggaccagguguuccagauccagggccugcagagcgagcuguacgacgucuccaaggccguggcgaacagcaagcagcucaacaucaagcugaccuccuucaaggccgugcacuucagccccgucuccagccugcccgacaccuccuuccucaaggggccgagcccccgccugacguaccuguccguggccaacgccgaccuccugaaccggaccuggagccgcggcgggaacgagcagugccugcgguacaucgcgaaccucaucuccugcuuccccagcgugugcguccgcgacgagaagggcaaccccguguccuggagcaucaccgaccaguucgccaccaugugccacggcuacacgcugccggagcaccggcgcaagggguacucccggcugguggcccucacccuggcccgcaagcugcagagccggggcuuccccagccaggggaacguccucgacgacaacaccgccuccaucagccugcugaagucccuccacgcggaguuccugcccugccgcuuccaccggcugauccucacccccgccacguucagcggccugccgcaccuguga

SEQ ID NO: 30632 - RNA, 705 nt, Artificial Sequence
  derived and/or modified sequence opt1 from GLYCTK__Homo_sapiens__NP_001138423
auggccgccgcgcuccaggugcugccccgccuggcccgggccccgcugcacccccuccuguggcgcggcagcgucgcccggcuggccuccagcauggcgcucgccgagcaggcccgccagcuguucgaguccgccgugggggcggugcugcccggccccaugcuccaccgggcccugagccuggaccccgggggccgccagcucaagguccgggaccgcaacuuccagcugcggcagaaccuguaccucgugggguucggcaaggccgugcugggcauggccgccgcggccgaggagcugcucgggcagcaccugguccagggcgugaucuccgugcccaaggggauccgcgccgccauggagcgggccggcaagcaggagaugcugcucaagccccacagccgcguccagguguucgagggggcggaggacaaccugcccgaccgggacgcccugcgcgccgcccucgccauccagcagcuggcggagggccugaccgccgacgaccuccugcuggugcucaucuccggcggggagccgcaccccguccggugcggcgggggccccugcggcggggacugccaguggccccaccgcggccaguucccgcagugcgcccggcugcccgccuacccccagagccugcgcccgccgugcucccccgccaccuucugcgaggacugcgcggugagcgggcggcucuga

SEQ ID NO: 30633 - RNA, 582 nt, Artificial Sequence
  derived and/or modified sequence opt1 from GM2A__Homo_sapiens__NP_000396
augcagagccugaugcaggcgccccuccugaucgcccugggccuccugcuggccgccccggcccaggcccaccucaagaagcccucccagcugagcuccuucagcugggacaacugcgacgaggggaaggaccccgccgugauccgcucccugacccucgagcccgacccgaucaucguccccggcaacgugacccugagcgugaugggguccacgagcgucccccuguccagcccccucaagguggaccuggugcuggagaaggaggucgcgggccucuggaucaagaucccgugcaccgacuacaucggguccugcaccuucgagcacuucugcgacgugcuggacaugcugauccccaccggcgagcccugccccgagccgcuccggacguacggccugcccugccacugccccuucaaggaggggaccuacagccugcccaaguccgaguucguggucccggaccucgagcugcccagcuggcugaccaccggcaacuaccgcaucgaguccgugcucagcuccagcgggaagcggcugggcugcaucaagaucgccgccucccugaaggggaucuga

SEQ ID NO: 30634 - RNA, 1548 nt, Artificial Sequence
  derived and/or modified sequence opt1 from GMCL1__Homo_sapiens__NP_848526
augggcagccuguccagccgcgugcuccggcagccccgcccggcccuggcccagcaggcgcagggggcccgggccggcggguccgcccgccggcccgacaccggcgacgacgccgcggggcacggcuucugcuacugcgccggcagccacaagcgcaagcgguccagcggguccuucugcuacugccaccccgacagcgagaccgacgaggacgaggaggagggcgacgagcagcagcgccugcucaacacgccccggcgcaagaagcugaaguccaccagcaaguacaucuaccagacccuguuccucaacggggagaacuccgacaucaagaucugcgcccugggcgaggaguggagccugcacaagaucuaccucugccaguccggguacuucagcuccauguucagcggcuccuggaaggagagcuccaugaacaucaucgagcuggagaucccggaccagaacaucgacgucgaggcccuccagguggcguucggcagccucuaccgggacgacgugcugaucaagcccagccgcgucguggccauccuggccgccgccugccuccugcagcuggacgggcucauccagcagugcggcgagaccaugaaggagacggugaacgucaagaccgugugcggguacuacaccuccgcgggcaccuacggccuggacagcgugaagaagaagugccuggaguggcuccugaacaaccugaugacgcaccagaacgucgagcuguucaaggagcuguccaucaacgugaugaagcagcugaucgggagcuccaaccucuucgugaugcaggucgagauggacaucuacaccgcccugaagaaguggauguuccugcagcucgugcccagcuggaacggcucccugaagcagcugcucaccgagaccgacgugugguucagcaagcagcggaaggacuucgaggggauggccuuccuggagacggagcagggcaagcccuucgucuccguguuccgccaccuccggcugcaguacaucaucagcgaccuggccuccgcccgcaucaucgagcaggacgcgguggucccgagcgaguggcuguccagcguguacaagcagcagugguucgccaugcuccgggccgagcaggacuccgagguggggccccaggagaucaacaaggaggagcuggagggcaacagcaugcgcugcggccggaagcuggccaaggacggggaguacugcuggcgcuggaccggcuucaacuucggguucgaccuccuggucaccuacaccaaccgguacaucaucuucaagcgcaacacgcugaaccagcccugcuccggcagcgugucccuccagccccgccggagcaucgccuuccgccugcggcuggcgagcuucgacuccagcgggaagcucaucugcucccgcaccaccggcuaccagauccugacccuggagaaggaccaggagcaggucgugaugaaccuggacagccggcuccugaucuucccgcuguacaucugcugcaacuuccucuacaucucccccgagaagaagaacuga

SEQ ID NO: 30635 - RNA, 1029 nt, Artificial Sequence
  derived and/or modified sequence opt1 from GMDS__Homo_sapiens__NP_001240775
augugcaagauggacggcagcuaccuggccgaguuccuccuggagaagggguacgaggugcacggcaucguccgccgguccagcuccuucaacaccgggcgcaucgagcaccuguacaagaacccccaggcccacaucgagggcaacaugaagcuccacuacggggaccugaccgacagcacgugccuggugaagaucaucaacgaggugaagccgaccgagaucuacaaccucggcgcgcagucccacgucaagaucagcuucgaccuggccgaguacaccgccgacguggacggcguggggacccugcggcuccuggacgccgucaagacgugcggccugaucaacuccgugaaguucuaccaggccagcaccuccgagcucuacgggaaggugcaggagaucccccagaaggagaccacccccuucuacccccgcagcccguacggcgcggccaagcuguacgccuacuggaucgucgugaacuuccgggaggccuacaaccuguucgcggugaacgggauccucuucaaccacgagagcccccgccggggcgccaacuucgucacgcgcaagaucagccgguccguggccaagaucuaccugggccagcuggagugcuucagccucgggaaccuggacgccaagcgcgacuggggccacgccaaggacuacguggaggcgauguggcugaugcuccagaacgacgagcccgaggacuucgucaucgccaccggggaggugcacuccgugcgggaguucgucgagaaguccuuccugcacaucggcaagaccaucgugugggagggcaagaacgagaacgagguggggcgcugcaaggagaccggcaagguccacgugacgguggaccugaaguacuaccggcccaccgaggucgacuuccuccagggggacugcaccaaggccaagcagaagcugaacuggaagccgcgcguggccuucgacgagcugguccgggagauggugcacgccgacguggagcucaugcgcaccaaccccaacgcguga

SEQ ID NO: 30636 - RNA, 429 nt, Artificial Sequence
  derived and/or modified sequence opt1 from GMFB__Homo_sapiens__NP_004115
augagcgagucccugguggucugcgacguggccgaggaccucguggagaagcugcgcaaguuccgguuccgcaaggagaccaacaacgccgcgaucaucaugaagaucgacaaggacaagcggcuggucgugcucgacgaggagcuggagggcaucagccccgacgagcugaaggacgagcucccggagcgccagccccgguucaucguguacuccuacaaguaccagcacgacgacgggcgcgucagcuacccccugugcuucaucuucuccagccccgugggcugcaagccggagcagcagaugauguacgccggguccaagaacaagcuggugcagaccgccgagcucacgaaggucuucgagauccggaacaccgaggaccugaccgaggaguggcugcgcgagaagcucggcuucuuccacuga

SEQ ID NO: 30637 - RNA, 429 nt, Artificial Sequence
  derived and/or modified sequence opt1 from GMFG__Homo_sapiens__NP_004868
augagcgacucccugguggucugcgagguggaccccgagcucaccgagaagcugcgcaaguuccgguuccgcaaggagaccgacaacgccgccaucaucaugaagguggacaaggaccggcagauggucgugcuggaggaggaguuccagaacaucagcccggaggagcucaagauggagcugcccgagcgccagccccgguucguggucuacuccuacaaguacgugcacgacgacggccgcgugagcuacccccugugcuucaucuucuccagcccggucgggugcaagcccgagcagcagaugauguacgcgggcuccaagaaccggcucgugcagacggccgagcugaccaagguguucgagauccgcaccaccgacgaccugacggaggccuggcuccaggagaagcugagcuucuuccgguga

SEQ ID NO: 30638 - RNA, 2826 nt, Artificial Sequence
  derived and/or modified sequence opt1 from GMIP__Homo_sapiens__NP_001275927
auggacgccgccgagcccggccugccgcccgggcccgagggccgcaagcgguacagcgacaucuuccgcucccucgacaaccuggagaucagccuggggaacgugacccucgagaugcuggcgggcgacccccugcucuccgaggacccggagcccgacaagacccccacggccaccgucaccaacgaggccagcugcugguccgggcccagcccggagggccccgugccccugaccggcgaggagcuggaccuccggcugauccgcacgaaggggggcguggacgccgcccuggaguacgcgaagaccuggucccgguacgccaaggagcuccuggccuggaccgagaagcgcgccagcuacgagcuggaguucgcgaaguccaccaugaagaucgccgaggccgggaaggucagcauccagcagcagucccacaugccccuccaguacaucuacacgcuguuccuggagcacgaccucagccugggcacccuggccauggagaccguggcccagcagaagcgggacuacuaccagccgcucgcggccaagcgcaccgagaucgagaaguggcggaaggaguucaaggagcaguggaugaaggagcagaagcgcaugaacgaggccgugcaggcccugcggcgcgcccagcugcaguacguccagcgguccgaggaccuccgcgcgcggagccaggggucccccgaggacagcgccccccaggccucccccggcccgagcaagcagcaggagcgccggcgccggucccgcgaggaggcccaggccaaggcgcaggaggccgaggcccuguaccaggccugcgugcgggaggccaacgcgcgccagcaggaccuggagaucgccaagcagcgcaucgugagccacguccggaagcucguguuccagggcgacgaggugcugcgccgggucacgcugagccucuucgggcugcgcggcgcccaggccgagcgggggccccgcgcguucgccgcccuggccgagugcugcgcccccuucgagcccggccagcgguaccaggaguucgugcgcgcgcuccggccggaggcccccccccccccgccccccgccuucuccuuccaggaguuccugcccagccugaacuccagcccgcucgacauccgcaagaagcuguccggcccccugcccccgcggcucgacgagaacagcgccgagcccgggcccugggaggaccccggcaccggguggcgcuggcagggcccgacccccggguccgacguggacagcgucggcggcggguccgagagccggucccuggacagccccaccuccagccccgaccugggcgacgggcucgagaacggccugggguccccguucggcaaguggacgcugagcuccgccgcgcagacccaccagcuccgccggcugcgcggccccgccaagugccgggagugcgaggccuucauggugagcgggaccgagugcgaggagugcuuccugaccugccacaagcgcugccucgagacgcugcugauccugugcggccaccggcgccuccccgcccgcaccccccuguucgggguggacuuccugcagcucccgcgggacuuccccgaggagguccccuucguggugaccaagugcaccgccgagaucgagcaccgcgcgcuggacguccagggcaucuaccggguguccgggagccgcgugcgggucgagcgccugugccaggccuucgagaacggccgggcccucguggagcugagcggcaacuccccccacgacgucagcuccgugcugaagcgcuuccuccaggagcugacggagccggugauccccuuccaccuguacgacgccuucaucagccucgcgaagacccugcacgccgaccccggggacgaccccggcaccccgucccccagccccgaggucauccggucccugaagacccuccuggugcagcugcccgacagcaacuacaacacgcuccgccaccugguggcccaccuguuccgggucgccgcccgcuucauggagaacaagauguccgcgaacaaccucgggaucguguucggcccgacccugcugcggccccccgacggcccgcgcgccgccagcgccauccccgugaccugccuccuggacuccgggcaccaggcccagcuggucgaguuccucaucgugcacuacgagcagaucuucggcauggacgagcugccccaggcgaccgagcccccgccccaggacagcucccccgcccccgggccgcugacgaccagcucccagcccccccccccgcaccucgaccccgacagccagccccccgugcuggccuccgacccgggccccgacccccagcaccacagcacccuggagcagcaccccaccgccacgccgaccgagauccccaccccccagagcgaccagcgggaggacgucgccgaggacaccaaggacgggggcggcgagguguccagccaggggcccgaggacucccuccugggcacccagagccgcgggcacuucucccggcagccggugaaguacccccgcggcgggguccggcccgugacgcaccagcugagcucccucgcgcugguggccagcaagcugugcgaggagacccccaucaccuccgucccgcgcggcagccuccggggccgcgggcccucccccgccgccgcgagcccggagggcuccccccugcgccggaccccccugcccaagcacuucgagaucacgcaggagaccgcccgccuccugagcaagcuggacuccgaggccgugccgcgggccaccugcugccccgacgugcagcccgaggaggccgaggaccaccucuga

SEQ ID NO: 30639 - RNA, 510 nt, Artificial Sequence
  derived and/or modified sequence opt1 from GML__Homo_sapiens__XP_011515271
auggagcccggcagccgccugcuccgggaggugaugcugcuguucgcccuccugcuggccauggagcucccgcuggucgcggccuccgccaccaugcgcgcccaguggaccuacagccugcggugccacgacugcgccgugaucaacgacuucaacugccccaacauccgcgugugccccuaccacauccggcgcugcaugacgaucuccauccggaucaacagccgcgagcuccuggucuacaagaacugcaccaacaacugcaccuucguguacgcggccgagcagcccccggaggcccccgggaagaucuucaagaccaacuccuucuacugggugugcugcugcaacagcauggucugcaacgccggcgggcccacgaaccuggagcgggacaugcuccccgacgaggugaccgaggaggagcugccggagggcaccgugcgccugggggucuccaagcuccugcugagcuucgcguccaucaucgugagcaacauccuccccuga

SEQ ID NO: 30640 - RNA, 630 nt, Artificial Sequence
  derived and/or modified sequence opt1 from GMNN__Homo_sapiens__XP_005249216
augaaccccagcaugaagcagaagcaggaggagaucaaggagaacaucaagaacuccagcgugccgcgccggacccugaagaugauccagcccuccgccagcggcucccucgucgggcgcgagaacgagcugagcgccggccuguccaagcggaagcaccgcaacgaccaccucaccagcacgaccuccagccccggggugaucgugcccgaguccagcgagaacaagaaccugggcggggucacccaggaguccuucgaccugaugaucaaggagaacccgagcucccaguacuggaaggagguggcggagaagcggcgcaaggcccucuacgaggcccugaaggagaacgagaagcugcacaaggagaucgagcagaaggacaacgagaucgcccggcucaagaaggagaacaaggagcuggccgagguggcggagcacguccaguacauggccgagcugaucgagcgccucaacggcgagccccuggacaacuucgagagccuggacaaccaggaguucgacuccgaggaggagaccguggaggacagccucguggaggacuccgagaucggcacgugcgccgaggggaccgucagcagcuccaccgacgccaagcccugcaucuga

SEQ ID NO: 30641 - RNA, 1263 nt, Artificial Sequence
  derived and/or modified sequence opt1 from GMPPA__Homo_sapiens__NP_995319
augcugaaggccgugauccucaucggcgggccccagaagggcacccgcuuccggccgcugagcuucgagguccccaagccccuguuccccguggccggggugccgaugauccagcaccacaucgaggcgugcgcccagguccccggcaugcaggagauccuccugaucggguucuaccagcccgacgagccccugacccaguuccucgaggccgcccagcaggaguucaaccugccggugcgcuaccugcaggaguucgccccgcucggcacgggcgggggccuguaccacuuccgggaccagauccuggcggggucccccgaggccuucuucgugcucaacgccgacgucugcagcgacuucccccuguccgccaugcuggaggcgcaccgccggcagcgccacccguuccuccugcugggcaccaccgccaaccggacccagagccucaacuacgggugcaucguggagaacccccagacgcacgaggugcugcacuacgucgagaagcccuccaccuucaucagcgacaucaucaacugcggcaucuaccuguucucccccgaggcccucaagccgcugcgcgacguguuccagcggaaccagcaggacggccagcuggaggacagccccgggcucuggcccggcgccgggaccauccgccuggagcaggacguguucuccgcccuggcgggccagggccagaucuacguccaccucaccgacgggaucuggagccagaucaaguccgccggcagcgcccuguacgccucccggcuguaccucagccgcuaccaggacacgcaccccgagcggcuggccaagcacacccccgggggccccuggauccgcgggaacguguacauccaccccaccgcgaagguggcccccuccgccguccugggcccgaacgugagcaucggcaagggggugaccgucggcgagggggugcggcuccgcgaguccaucgugcugcacggcgccacgcugcaggagcacacgugcguccuccacagcaucgugggguggggcuccaccgugggccggugggcccgcgucgaggggacccccagcgaccccaaccccaacgacccgcgggcgcgcauggacagcgagucccuguucaaggacggcaagcugcuccccgccaucaccauccuggggugccgggugcgcauccccgccgagguccugauccucaacagcaucgugcugccgcacaaggagcugucccgcagcuucaccaaccagaucauccucuga

SEQ ID NO: 30642 - RNA, 1164 nt, Artificial Sequence
  derived and/or modified sequence opt1 from GMPPB__Homo_sapiens__NP_037466
augaaggcccugauccucgugggcggguacggcacccgccugcggccccugacccucagcacgccgaagccccuggucgacuucugcaacaagcccauccugcuccaccagguggaggcccuggcggccgccgggguggaccacgucauccuggccguguccuacaugagccaggugcucgagaaggagaugaaggcccaggagcagcgccugggcauccggaucuccaugagccacgaggaggagccccuggggaccgcgggcccgcucgcccuggcccgcgaccugcucuccgagaccgccgaccccuucuucguccugaacagcgacgugaucugcgacuuccccuuccaggcgauggugcaguuccaccggcaccacggccaggagggguccauccuggucaccaagguggaggagcccagcaaguacggcguggucgugugcgaggccgacacggggcgcauccaccgguucguggagaagccgcaggucuucguguccaacaagaucaacgccggcauguacauccucagccccgccgugcugcgccggauccagcugcagcccaccuccaucgagaaggaggucuuccccaucauggccaaggaggggcagcucuacgcgauggagcugcagggcuucuggauggacaucggccagccgaaggacuuccugaccgggaugugccucuuccugcagagccugcgccagaagcagcccgagcggcucugcuccggccccgggaucgugggcaacgugcuggucgaccccagcgcccgcaucggccagaacugcuccaucgggccgaacgugagccugggccccgggguggucguggaggacggcgucugcauccggcgcugcaccgugcuccgggacgcccgcauccggucccacagcuggcuggaguccugcaucgugggguggcgcugccgggucggccagugggugagccugugggccggccucgggggcgagcgcgggggcgagugcgccugccugcccgacaaggcguacccccugcucgaggugcggauggagaacgucacggugcugggggaggacgugaucgucaacgacgagcuguaccucaacggcgccagcgugcugccgcacaaguccaucggcgagagcgugcccgagccccgcaucaucauguga

SEQ ID NO: 30643 - RNA, 1047 nt, Artificial Sequence
  derived and/or modified sequence opt1 from GMPR2__Homo_sapiens__NP_001002000
augccccacaucgacaacgacgugaagcuggacuucaaggacgugcuccugcgcccgaagcggagcacccugaagucccgcagcgagguggaccucacccgguccuucagcuuccgcaacuccaagcagacguacagcggcgugcccaucaucgccgccaacauggacaccgucgggaccuucgagauggcgaaggugcugugcaaguucucccuguucaccgccgugcacaagcacuacagccucguccaguggcaggaguucgccggccagaaccccgacugccuggagcaccuggccgccuccagcgggacgggcuccagcgacuucgagcagcucgagcagauccuggaggcgaucccccaggugaaguacaucugccuggacguggccaacggguacuccgagcacuucgucgaguucgugaaggacgugcggaagcgcuucccgcagcacaccaucauggccggcaacgucgugaccggcgagaugguggaggagcucauccugagcggggccgacaucaucaaggucggcaucgggcccggcuccgugugcaccacgcggaagaagaccggggugggcuacccccagcugagcgcggucauggagugcgccgacgccgcccacggccucaaggggcacaucaucuccgacggcgggugcagcugccccggcgacguggccaaggcguucggcgccggggccgacuucgugaugcugggcgggaugcuggccggccacuccgagagcgggggcgagcucaucgagcgcgacggcaagaaguacaagcuguucuacgggaugagcuccgagauggccaugaagaaguacgcgggcggggucgccgaguaccgggccagcgagggcaagaccguggaggugccguucaagggggacgucgagcacaccauccgcgacauccugggcggcauccgguccacgugcaccuacgugggggccgccaagcucaaggagcugagccgccggaccaccuucauccgcgucacgcagcaggucaaccccaucuucuccgaggcgugcuga

SEQ ID NO: 30644 - RNA, 1038 nt, Artificial Sequence
  derived and/or modified sequence opt1 from GMPR__Homo_sapiens__NP_006868
augccccgcaucgacgccgaccugaagcucgacuucaaggacgugcugcugcggccgaagcgcagcucccucaagagccgggccgaggucgaccuggagcgcaccuucaccuuccggaacuccaagcagacguacagcggcauccccaucaucguggcgaacauggacaccguggggaccuucgagauggccgccgucaugucccagcacagcauguucaccgccauccacaagcacuacucccuggacgacuggaagcuguucgccacgaaccaccccgagugccugcagaacguggcggugagcuccggcagcgggcagaacgaccuggagaagaugaccuccauccucgaggccgucccccaggugaaguucaucugccuggacguggccaacggcuacagcgagcacuucgucgaguucgugaagcuggugcgcgccaaguucccggagcacaccaucauggcggggaacgucgugaccggcgagaugguggaggagcucauccuguccggcgccgacaucaucaaggucggggugggccccgggagcgugugcacgacccggaccaagaccggcgucggguacccccagcuguccgccgugaucgagugcgccgacagcgcccacggccucaagggccacaucaucuccgacgggggcugcacgugccccggggacguggcgaaggccuucggcgccggcgccgacuucgucaugcucgggggcauguucagcgggcacaccgagugcgccggcgagguguucgagcgcaacgggcggaagcugaagcuguucuacggcauguccagcgacaccgcgaugaacaagcacgccggcgggguggccgaguaccgcgccagcgagggcaagaccgucgaggugccguacaagggggacgucgagaacacgauccucgacauccugggcgggcuccgguccacgugcaccuacgugggcgccgcgaagcugaaggagcugagccgccgggccaccuucauccgcgugacccagcagcacaacaccgucuucuccuga

SEQ ID NO: 30645 - RNA, 2082 nt, Artificial Sequence
  derived and/or modified sequence opt1 from GMPS__Homo_sapiens__NP_003866
auggcccugugcaacggcgacagcaagcucgagaacgccgggggcgaccugaaggacgggcaccaccacuacgagggcgcgguggucauccuggacgccggggcccaguacggcaaggugaucgaccgccgggugcgcgagcuguucguccaguccgagaucuucccccucgagaccccggccuucgccaucaaggagcagggcuuccgggcgaucaucaucagcgggggccccaacuccguguacgccgaggacgcccccugguucgaccccgccaucuucaccaucgggaagccggugcugggcaucugcuacgggaugcagaugaugaacaaggucuucggcggcacggugcacaagaaguccgugcgcgaggacggggucuucaacaucagcguggacaacacgugcagccucuuccggggccugcagaaggaggaggugguccugcucacccacggggacuccguggacaagguggcggacggcuucaaggucguggcccgcagcggcaacaucguggccgggaucgccaacgaguccaagaagcuguacggcgcccaguuccaccccgaggucgggcugaccgagaacggcaaggugauccucaagaacuuccuguacgacaucgcggggugcagcggcaccuucaccgugcagaaccgggagcuggagugcauccgcgagaucaaggagcgggucggcaccuccaaggugcucgugcugcugagcgggggcgucgacuccaccgugugcacggcccuccugaaccgcgcccugaaccaggagcaggucaucgccgugcacaucgacaacggguucaugcggaagcgcgagagccaguccguggaggaggcccucaagaagcugggcauccaggucaaggugaucaacgcggcccacagcuucuacaacgggaccaccacccugcccaucuccgacgaggaccggacgccccgcaagcggaucagcaagacccucaacaugaccaccuccccggaggagaagcgcaagaucaucggcgacacguucgugaagaucgccaacgaggucaucggcgagaugaaccugaagcccgaggagguguuccuggcccaggggacccuccggcccgaccugaucgagagcgccagccugguggcguccggcaaggccgagcucaucaagacccaccacaacgacaccgagcugauccgcaagcugcgggaggaggggaaggucaucgagccccucaaggacuuccacaaggacgaggugcgcauccugggccgggagcuggggcucccggaggagcuggugagccgccaccccuuccccggccccggccuggccauccgcgucaucugcgccgaggagccguacaucugcaaggacuuccccgagacgaacaacauccucaagaucguggccgacuucuccgcgagcgugaagaagccccacacccugcugcagcgggucaaggccugcaccaccgaggaggaccaggagaagcucaugcagaucacgucccugcacagccugaacgccuuccuccugcccaucaagaccgugggggugcagggcgacugccgcuccuacagcuacgucugcgggaucuccagcaaggacgagccggacugggagucccugaucuuccucgcccggcugaucccccgcaugugccacaacgugaaccggguggucuacaucuucggcccgcccgugaaggagccgcccaccgacgugacccccacguuccugaccaccggcguccugagcacccuccgccaggcggacuucgaggcccacaacauccugcgggaguccggguacgccggcaagaucagccagaugcccgugauccugacgccccuccacuucgaccgcgacccccugcagaagcagcccuccugccagcggagcguggucauccgcaccuucaucaccuccgacuucaugaccgggaucccggccacgcccggcaacgagauccccguggaggugguccugaagauggugaccgagaucaagaagauccccgggaucagccggaucauguacgaccucaccuccaagccgcccggcaccaccgagugggaguga

SEQ ID NO: 30646 - RNA, 1080 nt, Artificial Sequence
  derived and/or modified sequence opt1 from GNA11__Homo_sapiens__NP_002058
augacccuggagagcaugauggccugcugccucuccgacgaggugaaggagagcaagcgcaucaacgccgagaucgagaagcagcugcggcgcgacaagcgggacgcgcgccgggagcugaagcuccugcugcucggcaccggggaguccggcaagagcacguucaucaagcagaugcgcaucauccacggggccggcuacuccgaggaggacaagcggggguucaccaagcuggucuaccagaacaucuucaccgccaugcaggccaugauccgcgccauggagacccugaagauccucuacaaguacgagcagaacaaggcgaacgcccugcugauccgggagguggacguggagaaggucacgaccuucgagcaccaguacgugagcgccaucaagacccucugggaggaccccggcauccaggagugcuacgaccgccggcgcgaguaccagcuguccgacagcgccaaguacuaccugaccgacguggaccggaucgcgacgcucggcuaccugccgacccagcaggacguccugcgcgugcgggugcccaccaccgggaucaucgaguaccccuucgaccucgagaacaucaucuuccgcauggucgacgugggcgggcagcgguccgagcgccggaaguggauccacugcuucgagaacgugacgagcaucauguuccuggucgcccuguccgaguacgaccaggugcucguggagagcgacaacgagaaccgcauggaggaguccaaggcccuguuccggaccaucaucaccuaccccugguuccagaacagcuccgucauccuguuccucaacaagaaggaccugcuggaggacaagauccucuacagccaccugguggacuacuucccggaguucgacggcccccagcgcgacgcccaggccgcgcgcgaguucauccugaagauguucguggaccucaaccccgacuccgacaagaucaucuacagccacuucacgugcgccaccgacaccgagaacauccgguucgucuucgccgccgugaaggacaccauccugcagcugaaccucaaggaguacaaccugguguga

SEQ ID NO: 30647 - RNA, 918 nt, Artificial Sequence
  derived and/or modified sequence opt1 from GNA12__Homo_sapiens__NP_001269369
auggcgccccgcgccggccugggggccggcccgcuccugcugcggagccgcgccgacugggugugcgggggcugggaggccgcccucuccgccccgccgcccuucugcaccgcgugggucgagcggaccgggcuggugcacuuccugcgcgagggcggccacggggccugcuucccccucgcccugcugcaccccggcagcguggucuccuuccagaugaucuacccccucaucgugcugccccugugcgccagcuggcacugggggcucauccggaagggcaucgugcuguucuggggcgaguccgucaaguacuuccuggacaaccucgaccgcaucgggcagcugaacuacuuccccagcaagcaggacauccugcucgcgcggaaggccacgaagggcaucguggagcacgacuucgugaucaagaagauccccuucaagauggucgacgucgggggccagcgcucccagcggcagaagugguuccagugcuucgacgggaucaccagcauccuguucaugguguccagcuccgaguacgaccaggugcugauggaggaccgccggaccaaccgccucguggagagcaugaacaucuucgagaccaucgugaacaacaagcuguucuucaacgucuccaucauccuguuccucaacaagauggaccugcugguggagaaggugaagacggucagcaucaagaagcacuuccccgacuuccggggcgacccccaccgccucgaggacgugcagcgguaccuggugcagugcuucgaccgcaagcggcgcaaccgguccaagccgcuguuccaccacuucaccaccgccaucgacaccgagaacguccgcuucguguuccacgccgugaaggacacgauccuccaggagaaccugaaggacaucaugcugcaguga

SEQ ID NO: 30648 - RNA, 849 nt, Artificial Sequence
  derived and/or modified sequence opt1 from GNA13__Homo_sapiens__NP_001269354
augcgcgugcuggucgacgcccgggagaagcuccacauccccuggggcgacaacagcaaccagcagcacggggacaagaugauguccuucgacacccgcgccccgauggcggcccagggcaugguggagacccggguguuccugcaguaccugcccgccauccgcgcccucugggccgacagcgggauccagaacgcguacgaccggcgccgggaguuccagcugggcgaguccgucaaguacuuccuggacaaccucgacaagcugggggagcccgacuacauccccagccagcaggacauccugcucgcccgccggccgacgaagggcauccacgaguacgacuucgagaucaagaacgugcccuucaagaugguggacgucggcgggcagcgcuccgagcggaagcgcugguucgagugcuucgacagcgugaccuccauccuguuccuggugagcuccagcgaguucgaccagguccucauggaggaccggcugaccaaccgccugaccgagucccucaacaucuucgagacgaucgugaacaaccggguguucagcaacgucuccaucauccuguuccugaacaagaccgaccuccuggaggagaaggugcagaucgugagcaucaaggacuacuuccuggaguucgagggcgacccccacugccuccgcgacguccagaaguuccugguggagugcuuccggaacaagcgccgggaccagcagcagaagccccuguaccaccacuucaccaccgccaucaacacggagaacauccgccucguguuccgggacgucaaggacaccauccugcacgacaaccugaagcagcucaugcugcaguga

SEQ ID NO: 30649 - RNA, 1068 nt, Artificial Sequence
  derived and/or modified sequence opt1 from GNA14__Homo_sapiens__NP_004288
auggccggcugcugcugccugagcgccgaggagaaggagucccagcgcaucagcgcggagaucgagcggcagcuccgccgggacaagaaggacgcccgccgggagcugaagcugcuccugcuggggaccggcgaguccggcaagagcaccuucaucaagcagaugcgcaucauccacggguccggguacagcgacgaggaccggaagggcuucacgaagcucguguaccagaacaucuucaccgccaugcaggccaugauccgcgccauggacacccugcggauccaguacgucugcgagcagaacaaggagaacgcgcagaucauccgcgagguggagguggacaaggucuccaugcugagccgggagcaggucgaggccaucaagcagcucuggcaggaccccggcauccaggagugcuacgaccgccggcgcgaguaccagcuguccgacagcgccaaguacuaccugaccgacaucgaccggaucgccacgccguccuucgugcccacccagcaggacgugcuccgcgugcgggugcccaccaccgggaucaucgaguaccccuucgaccuggagaacaucaucuuccgcauggucgacgugggcgggcagcggagcgagcgccggaaguggauccacugcuucgaguccgugacgagcaucaucuuccuggucgcgcucuccgaguacgaccaggugcuggccgagugcgacaacgagaaccgcauggaggagagcaaggcccuguucaagaccaucaucaccuacccgugguuccucaacuccagcgugauccuguuccugaacaagaaggaccuccuggaggagaagaucauguacucccaccugaucagcuacuuccccgaguacaccggccccaagcaggacguccgcgccgcccgggacuucauccucaagcuguaccaggaccagaaccccgacaaggagaaggugaucuacagccacuucacgugcgcgaccgacaccgacaacauccgcuucguguucgccgccgucaaggacaccauccugcagcucaaccugcgggaguucaaccugguguga

SEQ ID NO: 30650 - RNA, 1125 nt, Artificial Sequence
  derived and/or modified sequence opt1 from GNA15__Homo_sapiens__NP_002059
auggcccgcagccugaccuggcggugcugccccuggugccucaccgaggacgagaaggccgcggcccgcguggaccaggagaucaaccggauccugcuggagcagaagaagcaggaccgcggcgagcucaagcugcugcuccuggggccgggcgaguccggcaagagcacguucaucaagcagaugcggaucauccacggggccggguacuccgaggaggagcgcaagggcuuccggccccuggucuaccagaacaucuucgugagcaugcgcgccaugaucgaggccauggagcggcuccagauccccuucucccgccccgagagcaagcaccacgcgucccuggugaugagccaggacccguacaaggucaccaccuucgagaagcgguacgccgccgccaugcaguggcuguggcgcgacgcgggcauccgggccugcuacgagcgccggcgcgaguuccaccuccuggacuccgccguguacuaccugagccaccucgagcggaucaccgaggagggguacgugcccacggcccaggacguccugcgcucccggaugcccaccaccggcaucaacgaguacugcuucagcgugcagaagaccaaccugcgcaucguggacgucgggggccagaaguccgagcggaagaaguggauccacugcuucgagaacgugaucgcccucaucuaccuggcgagccuguccgaguacgaccagugccucgaggagaacaaccaggagaaccgcaugaaggagagccuggcccuguucgggacgauccucgagcugcccugguucaaguccaccagcgugauccuguuccucaacaagaccgacauccuggaggagaagaucccgaccucccaccuggccacguacuuccccagcuuccagggccccaagcaggacgccgaggccgcgaagcgcuucauccucgacauguacacccggauguacaccggcugcgucgacgggcccgagggcagcaagaagggggcccgcucccggcgccuguucagccacuacacgugcgccaccgacacccagaacauccggaagguguucaaggacgugcgcgacuccguccuggcccgguaccucgacgagaucaaccugcuguga

SEQ ID NO: 30651 - RNA, 909 nt, Artificial Sequence
  derived and/or modified sequence opt1 from GNAI1__Homo_sapiens__NP_001243343
augaagaucauccacgaggccggcuacagcgaggaggagugcaagcaguacaaggccguggucuacuccaacaccauccagagcaucaucgcgaucauccgcgccauggggcggcugaagaucgacuucggcgacuccgcccgcgccgacgacgcccggcagcuguucgugcucgcgggggccgccgaggagggcuucaugaccgccgagcuggcgggggugaucaagcgccucuggaaggacagcggcguccaggccugcuucaaccggucccgcgaguaccagcugaacgacagcgccgccuacuaccugaacgaccucgaccggaucgcccagcccaacuacauccccacgcagcaggacgugcugcgcacccgggugaagaccaccggcaucgucgagacgcacuucaccuucaaggaccugcacuucaagauguucgacgucgggggccagcgcuccgagcggaagaaguggauccacugcuucgagggggugaccgcgaucaucuucugcguggcccucagcgacuacgaccuggugcuggccgaggacgaggagaugaaccgcaugcacgaguccaugaagcuguucgacagcaucugcaacaacaagugguucaccgacacguccaucauccucuuccugaacaagaaggaccucuucgaggagaagaucaagaaguccccgcugaccaucugcuaccccgaguacgccggcagcaacaccuacgaggaggccgcggccuacauccagugccaguucgaggaccugaacaagcggaaggacaccaaggagaucuacacgcacuucacgugcgccaccgacaccaagaacgugcaguucgucuucgacgccgugaccgacgugaucaucaagaacaaccucaaggacugcgggcuguucuga

SEQ ID NO: 30652 - RNA, 957 nt, Artificial Sequence
  derived and/or modified sequence opt1 from GNAI2__Homo_sapiens__NP_001159897
augcgcggcgccggggagagcggcaaguccaccaucgugaagcagaugaagaucauccacgaggacggguacagcgaggaggagugccggcaguaccgcgccgucguguacuccaacaccauccagagcaucauggcgaucgugaaggccaugggcaaccugcagaucgacuucgccgaccccucccgggccgacgacgcccgccagcuguucgcgcucagcugcacggccgaggagcaggggguccugccggacgaccucuccggcgugauccggcgccugugggccgaccacggcgugcaggccugcuucgggcggagccgcgaguaccagcugaacgacuccgcggccuacuaccucaacgaccuggagcggaucgcccagagcgacuacauccccacccagcaggacguccugcgcacccgggugaagaccacgggcaucguggagacccacuucaccuucaaggaccuccacuucaagauguucgacgucgggggccagcgcuccgagcggaagaaguggauccacugcuucgagggggugaccgccaucaucuucugcguggcccugagcgcguacgaccugguccucgccgaggacgaggagaugaaccgcaugcacgaguccaugaagcuguucgacagcaucugcaacaacaagugguucacggacaccuccaucauccuguuccucaacaagaaggaccuguucgaggagaagaucacccacagcccccugaccaucugcuuccccgaguacacgggcgccaacaaguacgacgaggccgccuccuacauccagagcaaguucgaggaccucaacaagcggaaggacaccaaggagaucuacacccacuucacgugcgcgaccgacaccaagaacgugcaguucguguucgacgccgucaccgacgugaucaucaagaacaaccugaaggacugcggccuguucuga

SEQ ID NO: 30653 - RNA, 525 nt, Artificial Sequence
  derived and/or modified sequence opt1 from GNAL__Homo_sapiens__NP_001248373
auguucgacgugggcgggcagcgcgacgagcggcgcaaguggauccagugcuucaacgacgucaccgccaucaucuacguggccgcgugcagcuccuacaacauggugauccgggaggacaacaacaccaaccgccugcgggagagccucgaccuguucgaguccaucuggaacaaccgcuggcugcggaccaucagcaucauccucuuccugaacaagcaggacaugcuggccgagaagguccucgccggcaaguccaagaucgaggacuacuuccccgaguacgccaacuacaccgugccggaggacgccacccccgacgcgggggaggaccccaaggugacccgcgccaaguucuucauccgggaccuguuccugcgcaucagcacggccaccggcgacgggaagcacuacugcuacccccacuucacgugcgccgucgacaccgagaacauccggcgcguguucaacgacugccgggacaucauccagcgcaugcaccucaagcaguacgagcugcuguga

SEQ ID NO: 30654 - RNA, 1065 nt, Artificial Sequence
  derived and/or modified sequence opt1 from GNAO1__Homo_sapiens__NP_066268
augggcugcacccugagcgccgaggagcgcgccgcgcucgagcgguccaaggccaucgagaagaaccugaaggaggacgggaucagcgccgccaaggacgugaagcugcuccugcugggcgccggggaguccggcaagagcaccaucgucaagcagaugaagaucauccacgaggacggguucuccggcgaggacgugaagcaguacaagcccguggucuacagcaacacgauccagucccucgcggccaucgugcgcgccauggacacccugggcaucgaguacggggacaaggagcggaaggccgacgcgaagauggugugcgacgucgugagccgcauggaggacaccgagccguucuccgccgagcugcucagcgccaugaugcggcuguggggcgacuccgggauccaggagugcuucaaccgcagccgggaguaccagcugaacgacuccgccaaguacuaccucgacagccuggaccgcaucggcgccgcggacuaccagcccaccgagcaggacauccugcggacgcgcgugaagaccaccgggaucgucgagacccacuucacguucaagaaccuccacuuccggcuguucgacgugggcggccagcgcuccgagcggaagaaguggauccacugcuucgaggacgugaccgccaucaucuucugcgucgcccugagcggguacgaccaggugcuccacgaggacgagaccaccaaccgcaugcacgagucccugaugcuguucgacagcaucugcaacaacaaguucuucaucgacacguccaucauccucuuccugaacaagaaggaccuguucggcgagaagaucaagaaguccccgcucaccaucugcuuccccgaguacaccgggcccaacaccuacgaggacgccgccgcguacauccaggcccaguucgagagcaagaaccggagccccaacaaggagaucuacugccacaugacgugcgccaccgacaccaacaacauccagguggucuucgacgccgugaccgacaucaucaucgccaacaaccugcgcggcugcggccuguacuga

SEQ ID NO: 30655 - RNA, 1080 nt, Artificial Sequence
  derived and/or modified sequence opt1 from GNAQ__Homo_sapiens__NP_002063
augacccuggagagcaucauggccugcugccucuccgaggaggccaaggaggcgcgccggaucaacgacgagaucgagcgccagcugcggcgcgacaagcgggacgcccgccgggagcugaagcuccugcugcucggcaccggggagagcggcaaguccacguucaucaagcagaugcgcaucauccacgggagcggcuacuccgacgaggacaagcggggguucaccaagcugguguaccagaacaucuucaccgccaugcaggccaugauccgcgccauggacacccugaagauccccuacaaguacgagcacaacaaggcgcacgcccagcucguccgggagguggacguggagaaggucagcgccuucgagaacccguacguggacgccaucaagucccuguggaacgaccccggcauccaggagugcuacgaccgccggcgcgaguaccagcugagcgacuccacgaaguacuaccucaacgaccuggaccggguggcggaccccgccuaccugcccacccagcaggacguccuccgcgugcgggugccgaccaccggcaucaucgaguaccccuucgaccugcagagcgucaucuuccgcaugguggacgucgggggccagcgguccgagcgccggaaguggauccacugcuucgagaacgugacgagcaucauguuccugguggcccucuccgaguacgaccaggugcuggucgagagcgacaacgagaaccgcauggaggaguccaaggcccuguuccgcaccaucaucaccuaccccugguuccagaacagcuccgugauccucuuccugaacaagaaggaccugcucgaggagaagaucauguacagccaccugguggacuacuuccccgaguacgacgggccgcagcgggacgcccaggcggcccgcgaguucauccugaagauguucgucgaccucaaccccgacuccgacaagaucaucuacagccacuucacgugcgccaccgacaccgagaacauccgguucguguucgccgccgugaaggacaccauccugcagcugaaccucaaggaguacaaccuggucuga

SEQ ID NO: 30656 - RNA, 1185 nt, Artificial Sequence
  derived and/or modified sequence opt1 from GNAS__Homo_sapiens__NP_000507
augggcugccuggggaacagcaagaccgaggaccagcgcaacgaggagaaggcccagcgggaggccaacaagaagaucgagaagcagcuccagaaggacaagcaggucuaccgcgcgacccaccggcugcugcuccugggcgccggggaguccggcaagagcaccaucgugaagcagaugcgcauccugcacgugaacggguucaacggcgagggcggggaggaggacccccaggccgcccgguccaacagcgacggcgagaaggccaccaaggugcaggacaucaagaacaaccucaaggaggcgaucgagaccaucgucgccgccauguccaaccuggugccgcccguggagcuggccaaccccgagaaccaguuccgcgucgacuacauccucagcgugaugaacgugcccgacuucgacuucccgcccgaguucuacgagcacgcgaaggcccugugggaggacgaggggguccgggccugcuacgagcgcuccaacgaguaccagcugaucgacugcgcccaguacuuccucgacaagaucgacgugaucaagcaggccgacuacgugcccagcgaccaggaccugcugcggugccgcguccucaccuccggcaucuucgagacgaaguuccagguggacaaggugaacuuccacauguucgacgucgggggccagcgggacgagcgccggaaguggauccagugcuucaacgacgugaccgcgaucaucuucguggucgccagcuccagcuacaacauggugauccgcgaggacaaccagaccaaccggcugcaggaggcccugaaccucuucaaguccaucuggaacaaccgcuggcugcggaccaucagcgugauccuguuccucaacaagcaggaccugcuggccgagaagguccucgccggcaaguccaagaucgaggacuacuuccccgaguucgcgcgcuacacgaccccggaggacgccacccccgagcccggggaggacccccgggugacccgcgccaaguacuucauccgggacgaguuccugcgcaucagcacggccuccggcgacgggcgccacuacugcuacccgcacuucacgugcgccguggacaccgagaacauccggcgcgucuucaacgacugccgggacaucauccagcgcaugcaccuccggcaguacgagcugcuguga

SEQ ID NO: 30657 - RNA, 1053 nt, Artificial Sequence
  derived and/or modified sequence opt1 from GNAT1__Homo_sapiens__NP_653082
augggcgccggggccagcgcggaggagaagcacucccgcgagcuggagaagaagcucaaggaggacgccgagaaggacgcccggaccgugaagcugcugcuccugggcgccggggagagcggcaaguccaccaucgucaagcagaugaagaucauccaccaggacggguacagccuggaggagugccucgaguucaucgccaucaucuacggcaacacgcugcaguccauccuggcgaucgugcgcgccaugaccacccucaacauccaguacggcgacagcgcccggcaggacgacgcccgcaagcugaugcacauggcggacaccaucgaggaggggacgaugcccaaggagauguccgacaucauccagcggcuguggaaggacagcggcauccaggccugcuucgagcgcgccuccgaguaccagcucaacgacagcgccggguacuaccuguccgaccuggagcggcucgugaccccgggcuacguccccaccgagcaggacgugcugcgcagccgggugaagaccacggggaucaucgagacccaguucuccuucaaggaccugaacuuccgcauguucgacgucggcggccagcggagcgagcgcaagaaguggauccacugcuucgagggggugaccugcaucaucuucaucgccgcgcucuccgccuacgacauggugcuggucgaggacgacgaggugaaccggaugcacgagagccugcaccucuucaacuccaucugcaaccaccgcuacuucgccaccacgagcaucgugcuguuccugaacaagaaggacgucuucuucgagaagaucaagaaggcccaccucuccaucugcuuccccgacuacgacggccccaacaccuacgaggacgccgggaacuacaucaaggugcaguuccuggagcugaacaugcggcgcgacgugaaggagaucuacagccacaugaccugcgcgaccgacacgcagaacgucaaguucguguucgacgccgugaccgacaucaucaucaaggagaaccucaaggacugcggccuguucuga

SEQ ID NO: 30658 - RNA, 1065 nt, Artificial Sequence
  derived and/or modified sequence opt1 from GNAT3__Homo_sapiens__NP_001095856
augggcagcgggaucuccagcgaguccaaggagagcgccaagcgcuccaaggagcuggagaagaagcuccaggaggacgccgagcgggacgcgcgcaccgugaagcugcugcuccugggcgccggggagagcggcaaguccaccaucgucaagcagaugaagaucauccacaagaacggguacagcgagcaggagugcauggaguucaaggccgugaucuacuccaacacgcugcagagcauccucgccaucgugaaggccaugaccacccugggcaucgacuacgucaacccccgguccgcggaggaccagcgccagcuguacgccauggccaacacccucgaggacggcgggaugacgccgcagcuggccgaggugaucaagcggcuguggcgcgaccccggcauccaggcgugcuucgagcgggccagcgaguaccagcucaacgacuccgccgccuacuaccugaacgaccuggaccgcaucaccgccagcggguacgugcccaacgagcaggacguccuccacucccgggugaagaccaccggcaucaucgagacgcaguucagcuucaaggaccugcacuuccgcauguucgacgucgggggccagcgguccgagcgcaagaaguggauccacugcuucgagggcgugaccugcaucaucuucugcgcggcccugagcgccuacgacauggugcucguggaggacgaggaggucaaccggaugcacgagucccugcaccuguucaacagcaucugcaaccacaaguacuucagcaccaccuccaucguccucuuccugaacaagaaggacaucuuccaggagaaggugacgaaggugcaccugagcaucugcuuccccgaguacaccgggccgaacaccuucgaggacgccggcaacuacaucaagaaccaguuccucgaccugaaccugaagaaggaggacaaggagaucuacucccacaugaccugcgccacggacacccagaacgugaaguucguguucgacgcggucaccgacaucaucaucaaggagaaccucaaggacugcgggcuguucuga

SEQ ID NO: 30659 - RNA, 1068 nt, Artificial Sequence
  derived and/or modified sequence opt1 from GNAZ__Homo_sapiens__NP_002064
augggcugccgccagagcuccgaggagaaggaggccgcccggcgcagccggcgcaucgaccggcaccuccgcuccgagagccagcggcagcgccgggagaucaagcuccugcugcucgggaccuccaacagcggcaaguccaccaucgugaagcagaugaagaucauccacagcgggggcuucaaccuggaggcgugcaaggaguacaagccccugaucaucuacaacgccaucgacucccucacgcgcaucauccgggcccuggccgcccugcgcaucgacuuccacaacccggaccgggcguacgacgccguccagcuguucgcccugaccgggcccgccgagagcaagggcgagaucacccccgagcugcucggcgugaugcgccggcugugggcggaccccggggcccaggccugcuucucccgcagcuccgaguaccaccuggaggacaacgccgccuacuaccucaacgaccuggagcggaucgcggccgccgacuacaucccgaccguggaggacauccugcgcagccgggacaugacgaccggcaucgucgagaacaaguucaccuucaaggagcucaccuucaagaugguggacgucgggggccagcgcuccgagcggaagaaguggauccacugcuucgagggggugacggccaucaucuucugcguggagcugagcggcuacgaccugaagcucuacgaggacaaccagaccucccgcauggccgagagccugcgccuguucgacuccaucugcaacaacaacugguucaucaacaccagccucauccuguuccugaacaagaaggaccuccuggcggagaagauccggcgcaucccccugaccaucugcuuccccgaguacaagggccagaacacguacgaggaggccgccguguacauccagcggcaguucgaggaccucaaccgcaacaaggagaccaaggagaucuacagccacuucacgugcgccaccgacaccuccaacauccaguucgucuucgacgccgugaccgacgugaucauccagaacaaccugaaguacaucgggcugugcuga

SEQ ID NO: 30660 - RNA, 984 nt, Artificial Sequence
  derived and/or modified sequence opt1 from GNB1L__Homo_sapiens__NP_443730
augaccgcccccugcccgcccccgccgcccgacccccaguucgugcugcgcggcacccagagccccguccacgcccuccacuucugcgagggggcgcaggcccagggccggccccugcuguucuccgggagccaguccggccucgugcacaucuggagccugcagacgcgccgggccgugaccacccuggacgggcacggcggccagugcgucaccuggcuccagacgcugccccaggggcgccagcugcucucccagggccgggaccugaagcugugccucugggaccuggccgaggggcgcagcgccgugguggacuccgucugccuggagagcgugggcuucugccgguccagcauccucgccgggggccagccccgcuggacccuggcggugcccggccggggguccgacgagguccagauccuggagaugcccagcaagaccuccgugugcgcccucaagccgaaggccgacgcgaagcugggcaugcccaugugccugcgccucuggcaggccgacugcagcucccggccccugcugcucgccggguacgaggacggcagcgugguccugugggacguguccgagcagaaggugugcagccgcaucgccugccacgaggagcccgucauggaccuggacuucgacucccagaaggcccggggcaucagcgggagcgcgggcaaggcccucgccguguggucccuggacuggcagcaggcccuccaggugcgcgggacccacgagcugacgaacccgggcaucgccgaggucaccauccggcccgaccgcaagauccuggcgaccgccgggugggaccaccggauccgcguguuccacuggcggaccaugcagccccuggccgugcucgccuuccacagcgccgcgguccagugcguggccuucacggccgacggccugcuggccgccggcuccaaggaccagcgcaucagccucuggucccuguacccccgggcguga

SEQ ID NO: 30661 - RNA, 954 nt, Artificial Sequence
  derived and/or modified sequence opt1 from GNB2L1__Homo_sapiens__NP_006089
augaccgagcagaugacccugcgcggcacgcucaaggggcacaacggcugggugacccagaucgccaccacgccccaguucccggacaugauccugagcgccucccgggacaagaccaucaucauguggaagcugacccgcgacgagaccaacuacgggaucccccagcgggcgcuccgcggccacagccacuucguguccgacguggugaucagcuccgacgggcaguucgcccugagcggcuccugggacggcacccugcggcucugggaccugacgaccgggaccaccacgcgccgguucgucggccacaccaaggacgugcugagcguggccuucuccagcgacaaccgccagaucgucuccgggagccgggacaagaccaucaagcucuggaacacccugggcgugugcaaguacacggugcaggacgagucccacagcgagugggucuccugcgugcgcuucagccccaacuccagcaaccccaucaucguguccugcgggugggacaagcuggucaagguguggaaccucgccaacugcaagcugaagaccaaccacaucggccacaccggcuaccugaacaccgugacggucagcccggacgggagccucugcgccuccggcgggaaggacggccaggcgaugcugugggaccugaacgagggcaagcaccucuacacccuggacgggggcgacaucaucaacgcccugugcuucagccccaaccgguacuggcucugcgccgccaccgggcccuccaucaagaucugggaccuggagggcaagaucaucguggacgagcugaagcaggaggugaucagcaccuccagcaaggcggagcccccgcagugcacgucccucgccuggagcgccgacgggcagacccuguucgccggcuacaccgacaaccugguccgcguguggcaggucaccaucggcacgcgguga

SEQ ID NO: 30662 - RNA, 1023 nt, Artificial Sequence
  derived and/or modified sequence opt1 from GNB3__Homo_sapiens__NP_002066
augggcgagauggagcagcugcgccaggaggccgagcagcucaagaagcagaucgccgacgcgcggaaggccugcgccgacgugacccuggccgagcuggucagcgggcucgagguggugggccgcguccagaugcggacccgccggacgcugcgcgggcaccuggccaagaucuacgcgaugcacugggccaccgacuccaagcuccuggugagcgccucccaggacggcaagcugaucgugugggacagcuacaccaccaacaagguccacgccaucccccuccgguccagcugggugaugacgugcgcguacgccccguccgggaacuucguggccugcggcggccuggacaacaugugcagcaucuacaaccugaagucccgcgaggggaacgucaaggugagccgggagcucuccgcccacaccggcuaccugagcugcugccgcuuccuggacgacaacaacaucgugaccuccagcggggacaccacgugcgcccucugggacaucgagaccggccagcagaagaccgucuucguggggcacaccggcgacugcaugucccuggcggugagccccgacuucaaccuguucaucuccggcgccugcgacgccagcgccaagcucugggacguccgggaggggacgugccgccagaccuucaccggccacgaguccgacaucaacgccaucugcuucuuccccaacggggaggcgaucugcaccggcagcgacgacgccagcugccggcuguucgaccugcgcgccgaccaggagcucaucugcuucucccacgagagcaucaucugcggcaucacguccguggccuucagccuguccgggcggcuccuguucgccggcuacgacgacuucaacugcaacgugugggacagcaugaaguccgagcgcgucgggauccugagcggccacgacaaccggguguccugccugggggugaccgcggacggcauggccgucgccaccggcagcugggacuccuuccucaagaucuggaacuga

SEQ ID NO: 30663 - RNA, 1023 nt, Artificial Sequence
  derived and/or modified sequence opt1 from GNB4__Homo_sapiens__XP_006713784
augagcgagcuggagcagcuccgccaggaggccgagcagcugcggaaccagauccaggacgcccgcaaggcgugcaacgacgccacccuggugcagaucaccuccaacauggacagcgucggccggauccagaugcgcacgcggcgcacccuccgggggcaccuggccaagaucuacgccaugcacuggggcuacgacucccgccugcucgugagcgccucccaggacgggaagcugaucaucugggacagcuacaccaccaacaagaugcacgcgaucccccugcgguccagcugggugaugacgugcgccuacgccccguccggcaacuacgucgccugcgggggccucgacaacaucugcagcaucuacaaccugaagacccgcgagggcaacgugcgggugucccgcgagcugcccgggcacaccggcuaccucagcugcugccgguuccuggacgacucccagaucgucaccagcuccggggacacgaccugcgcgcugugggacaucgagaccgcccagcagaccacgaccuucaccggccacagcggggacgugaugucccucagccugucccccgacaugcgcaccuucgugagcggcgccugcgacgccagcuccaagcugugggacauccgggacggcaugugccgccagagcuucacggggcacgucuccgacaucaacgccgugagcuucuuccccaacggcuacgcguucgccaccggguccgacgacgcgaccugccgccucuucgaccugcgggccgaccaggagcugcuccuguacagccacgacaacaucaucugcggcaucaccuccguggccuucagcaaguccggccggcugcuccuggccggguacgacgacuucaacugcaacgucugggacacgcugaagggcgaccgcgccggggugcucgccggccacgacaaccgggugagcugccugggggucaccgacgacggcauggccguggccaccggcuccugggacagcuuccugcgcaucuggaacuga

SEQ ID NO: 30664 - RNA, 1062 nt, Artificial Sequence
  derived and/or modified sequence opt1 from GNB5__Homo_sapiens__NP_006569
auggccaccgagggccugcacgagaacgagacccucgccagccugaaguccgaggcggagagccugaaggggaagcucgaggaggagcgcgccaagcugcacgacguggagcugcaccaggucgccgagcggguggaggcccucggccaguucgugaugaagacgcgccggacccugaaggggcacggcaacaagguccugugcauggacuggugcaaggacaagcgccggaucguguccagcucccaggacgggaaggugaucgucugggacagcuucaccaccaacaaggagcacgccgugacgaugcccugcaccugggugauggcgugcgccuacgccccguccggcugcgccaucgcgugcggcgggcucgacaacaagugcagcgucuacccccugaccuucgacaagaacgagaacauggccgccaagaagaaguccguggccaugcacaccaacuaccugagcgccugcuccuucacgaacagcgacaugcagauccucaccgcguccggcgacgggaccugcgcccugugggacguggagagcggccagcugcuccaguccuuccacgggcacggcgccgacguccugugccuggaccucgcccccagcgagaccggcaacacguucguguccgggggcugcgacaagaaggccauggugugggacaugcgcagcgggcagugcguccaggcguucgagacccacgaguccgacaucaacagcgugcgguacuaccccagcggcgacgccuucgccuccggcagcgacgacgcgaccugccgccuguacgaccugcgggccgaccgcgagguggccaucuacuccaaggagagcaucaucuucggggccuccagcgucgacuucucccucagcggccggcugcuguucgccggguacaacgacuacaccaucaacgugugggacgugcucaagggcucccgcgucagcauccuguucgggcacgagaaccggguguccacgcugcgcgugagcccggacggcaccgccuucugcuccggcagcugggaccacacccuccgggucugggccuga

SEQ ID NO: 30665 - RNA, 2262 nt, Artificial Sequence
  derived and/or modified sequence opt1 from GNE__Homo_sapiens__NP_001121699
auggagaccuacggcuaccugcagcgcgagagcugcuuccaggggccccacgagcucuacuucaagaaccuguccaagcggaacaagcagaucauggagaagaacggcaacaaccgcaagcugcgggugugcgucgcgaccugcaaccgcgccgacuacagcaagcucgccccgaucauguucgggaucaagacggagcccgaguucuucgagcuggacguggugguccugggcucccaccucaucgacgacuacgggaacaccuaccggaugaucgagcaggacgacuucgacaucaacacccgccugcacaccaucgugcggggcgaggacgaggccgccaugguggagagcgucggccuggcccucgugaagcugcccgacgugcugaaccgccucaagcccgacaucaugaucguccacggggaccgguucgacgcccuggcgcuggccacguccgccgcccucaugaacauccgcauccugcacaucgagggcggggaggugagcggcaccaucgacgacuccauccggcacgcgaucaccaagcuggcccacuaccacgugugcugcacccgcagcgccgagcagcaccucaucuccaugugcgaggaccacgaccggauccugcuggccgggugcccgagcuacgacaagcuccuguccgccaagaacaaggacuacaugagcaucauccgcauguggcugggcgacgacgucaaguccaaggacuacaucguggcgcuccagcaccccgugacgaccgacaucaagcacagcaucaagauguucgagcugacccuggacgcccucaucuccuucaacaagcggacccugguccuguuccccaacaucgacgccggcagcaaggagauggugcgcgugaugcggaagaaggggaucgagcaccaccccaacuuccgcgccgucaagcacgugccguucgaccaguucauccagcucguggcccacgcgggcugcaugaucgggaacuccagcugcggcguccgggaggugggcgccuucgggacgcccgugaucaaccugggcacccgccagaucgggcgggagaccggcgagaacguccugcacgugcgcgacgccgacacccaggacaagauccuccaggcccugcaccuccaguucgggaagcaguaccccugcuccaagaucuacggcgacggcaacgccgucccccgcauccugaaguuccucaagagcaucgaccugcaggagccgcugcagaagaaguucugcuucccgcccgugaaggagaacaucagccaggacaucgaccacauccuggagacgcuguccgcgcucgccguggaccucgggggcaccaaccugcgggucgccaucgugagcaugaagggggagaucgugaagaaguacacccaguucaaccccaagaccuacgaggagcgcaucaaccugauccugcagaugugcgucgaggccgccgcggaggccgugaagcugaacugccggauccucggcguggggaucuccacgggcggccgcgucaacccccgggaggggaucgugcugcacagcaccaagcugauccaggaguggaacuccguggaccugcgcacgccccucagcgacacccugcaccuccccgucuggguggacaacgacggcaacugcgccgcccuggcggagcggaaguucgggcagggcaaggggcuggagaacuucgugacccugaucaccggcaccggcaucgggggcgggaucauccaccagcacgagcucauccacggcuccagcuucugcgccgccgagcugggccaccuggucgugucccucgacgggcccgacugcagcugcggcucccacgggugcaucgaggccuacgccagcggcauggcgcugcagcgcgaggccaagaagcugcacgacgaggaccuccugcugguggaggggauguccgucccgaaggacgaggccgugggcgcccuccaccugauccaggccgcgaagcugggcaacgccaaggcccagagcauccuccggaccgccgggacggcccugggccuggggguggucaacauccuccacaccaugaaccccucccuggugauccugagcggcgugcucgcgucccacuacauccacaucgucaaggacgugauccgccagcaggcccugagcuccgugcaggacgucgacgugguggucagcgaccugguggaccccgcccuccugggggccgcgagcauggugcuggacuacaccacccggcgcaucuacuga

SEQ ID NO: 30666 - RNA, 207 nt, Artificial Sequence
  derived and/or modified sequence opt1 from GNG10__Homo_sapiens__NP_001017998
augagcuccggcgccagcgccuccgcgcugcagcgccucguggagcagcugaagcuggaggccggggucgagcggaucaaggugagccaggccgccgccgagcuccagcaguacugcaugcagaacgcgugcaaggacgcccugcuggugggcguccccgccggguccaacccguuccgcgagccccggagcugcgcccuccuguga

SEQ ID NO: 30667 - RNA, 222 nt, Artificial Sequence
  derived and/or modified sequence opt1 from GNG11__Homo_sapiens__NP_004117
augcccgcccugcacaucgaggaccucccggagaaggagaagcugaagauggagguggagcagcugcgcaaggaggucaagcuccagcggcagcaggucagcaagugcuccgaggagaucaagaacuacaucgaggagcgcagcggcgaggacccccuggugaaggggauccccgaggacaagaaccccuucaaggagaagggcuccugcgugaucagcuga

SEQ ID NO: 30668 - RNA, 216 nt, Artificial Sequence
  derived and/or modified sequence opt1 from GNG2__Homo_sapiens__XP_011535148
auggccagcaacaacaccgccuccaucgcgcaggcccgcaagcugguggagcagcucaagauggaggccaacaucgaccggaucaaggucagcaaggccgccgcggaccugauggccuacugcgaggcccacgccaaggaggacccccugcucaccccggugcccgcguccgagaaccccuuccgcgagaagaaguucuucugcgccauccuguga

SEQ ID NO: 30669 - RNA, 228 nt, Artificial Sequence
  derived and/or modified sequence opt1 from GNG4__Homo_sapiens__NP_004476
augaaggagggcaugagcaacaacuccaccaccagcaucucccaggcccgcaaggccguggagcagcugaagauggaggcgugcauggaccgggucaaggugagccaggccgccgccgaccuccuggccuacugcgaggcgcacgugcgcgaggacccccugaucaucccgguccccgccuccgagaaccccuuccgggagaagaaguucuucugcacgauccucuga

SEQ ID NO: 30670 - RNA, 207 nt, Artificial Sequence
  derived and/or modified sequence opt1 from GNG7__Homo_sapiens__NP_443079
augagcgccaccaacaacaucgcccaggcgcgcaagcugguggagcagcuccggaucgaggccggcaucgagcgcaucaaggucuccaaggccgccagcgaccugauguccuacugcgagcagcacgcccggaacgacccccugcucgugggggugccggcgagcgagaaccccuucaaggacaagaagcccugcaucauccuguga

SEQ ID NO: 30671 - RNA, 213 nt, Artificial Sequence
  derived and/or modified sequence opt1 from GNG8__Homo_sapiens__NP_150283
augagcaacaacauggccaagaucgccgaggcgcgcaagaccguggagcagcugaagcucgaggucaacaucgaccggaugaaggugucccaggccgccgccgagcugcuggccuucugcgagacccacgcgaaggacgacccccucgugacgccgguccccgccgccgagaaccccuuccgcgacaagcggcuguucugcgugcugcucuga

SEQ ID NO: 30672 - RNA, 225 nt, Artificial Sequence
  derived and/or modified sequence opt1 from GNGT1__Homo_sapiens__NP_068774
augcccgugaucaacaucgaggaccugaccgagaaggacaagcucaagauggaggucgaccagcugaagaaggaggugacccuggagcgcaugcucgugagcaagugcugcgaggagguccgggacuacguggaggagcgcuccggcgaggacccgcuggugaaggggauccccgaggacaagaaccccuucaaggagcugaagggcgggugcgucaucagcuga

SEQ ID NO: 30673 - RNA, 210 nt, Artificial Sequence
  derived and/or modified sequence opt1 from GNGT2__Homo_sapiens__XP_006721882
auggcccaggaccugagcgagaaggaccuccugaagauggagguggagcagcugaagaaggaggucaagaacacccgcauccccaucuccaaggccggcaaggagaucaaggaguacguggaggcgcaggccgggaacgacccguuccucaagggcauccccgaggacaagaaccccuucaaggagaagggcgggugccugaucagcuga

SEQ ID NO: 30674 - RNA, 1824 nt, Artificial Sequence
  derived and/or modified sequence opt1 from GNL1__Homo_sapiens__NP_005266
augccccgcaagaagccguucagcgugaagcagaagaagaagcagcugcaggacaagcgggagcgcaagcggggccuccaggacgggcugcgcuccagcuccaacagccgguccggcagccgcgagcggcgcgaggagcagaccgacaccuccgacggggagagcgucacgcaccacauccggcgccugaaccagcagcccucccagggccucgggccccggggcuacgaccccaaccgcuaccggcugcacuucgagcgcgacagccgggaggagguggagcgccggaagcgcgccgcccgggagcagguccugcagccgguguccgcggagcuccuggagcuggacauccgcgagguguaccagcccggcagcgugcucgacuucccccggcgcccgcccugguccuacgagaugagcaaggagcagcugaugucccaggaggagcgcagcuuccaggacuaccuggggaagauccacggcgccuacuccagcgagaagcucuccuacuucgagcacaaccuggagaccuggcggcagcuguggcgcguccucgagaugagcgacaucgugcugcugaucaccgacauccggcaccccguggucaacuucccgcccgcccucuacgaguacgugaccggggagcugggccuggcccucgugcugguccugaacaagguggaccucgccccgcccgcgcugguggucgccuggaagcacuacuuccaccagcacuacccccagcugcacgugguccucuucacgagcuucccccgcgacccccggacgccccaggaccccuccagcgugcugaagaagucccgccggcgcgggcggggcuggacccgcgcccugggccccgagcagcuccugcgggccugcgaggcgaucaccguggggaagguggaccugagcuccuggcgcgagaagaucgcccgggacgucgccggcgccaccugggggaacggcagcggcgaggaggaggaggaggaggacgggccggccgugcucguggagcagcagaccgacuccgcgauggagcccaccggccccacccaggagcgcuacaaggacggggucgugacgaucggcugcgucggguuccccaacgugggcaagagcucccugaucaacggccugguggggcggaaggucgugagcgugucccgcaccccgggccacacccgguacuuccagaccuacuuccucacgcccagcgucaagcugugcgacugccccgggcugaucuuccccucccuccugccgcgccagcuccaggugcuggccggcaucuaccccaucgcccagauccaggagcccuacaccgccgugggguaccuggccagccggaucccgguccaggcgcugcuccaccuccgccaccccgaggccgaggaccccuccgccgagcaccccuggugcgccugggacaucugcgaggccugggcggagaagcgcggcuacaagaccgccaaggccgcccggaacgacguguaccgcgccgcgaacagccugcugcggcuggccguggacggccgccugucccugugcuuccacccgcccggguacagcgagcagaagggcaccugggagucccaccccgagacgaccgagcucgucgugcugcaggggcgggugggccccgccggggacgaggaggaggaggaggaggaggagcugagcagcuccugcgaggaggagggcgaggaggaccgcgacgccgacgaggagggcgagggggacgaggagaccccgaccagcgcgcccggcuccagccucgccgggcggaaccccuacgcccugcugggcgaggacgagugcuga

SEQ ID NO: 30675 - RNA, 1650 nt, Artificial Sequence
  derived and/or modified sequence opt1 from GNL3__Homo_sapiens__NP_055181
augaagcgccccaagcugaagaaggccagcaagcggaugaccugccacaagcgcuacaagauccagaagaaggugcgggagcaccaccgcaagcuccggaaggaggccaagaagcgcggccacaagaagccccggaaggaccccgggguccccaacuccgcgcccuucaaggaggcccugcugcgcgaggccgagcuccggaagcagcgccuggaggagcugaagcagcagcagaagcucgaccggcagaaggagcuggagaagaagcgcaagcuggagaccaaccccgacaucaagcccagcaacguggagcccauggagaaggaguucggccucugcaagacggagaacaaggccaaguccgggaagcagaacagcaagaagcuguacugccaggagcugaagaaggugaucgaggccuccgacgucgugcucgaggugcuggacgcgcgggacccccugggcugccgcugcccgcaggucgaggaggccaucgugcagagcgggcagaagaagcucgugcugauccugaacaaguccgaccucguccccaaggagaaccuggagagcuggcugaacuaccucaagaaggagcugcccaccgugguguuccgggccuccaccaagcccaaggacaagggcaagaucaccaagcgcgucaaggccaagaagaacgcggccccguuccggagcgaggugugcuucggcaaggaggggcuguggaagcuccugggcggguuccaggagacgugcuccaaggccauccgcgugggcgucaucggguuccccaacgugggcaagagcuccaucaucaacagccugaagcaggagcagaugugcaacgugggcgucuccauggggcucacccggagcaugcaggucgugccccuggacaagcagaucaccaucaucgacucccccagcuucaucguguccccgcugaacagcagcuccgcccucgcccugcgcagccccgcguccaucgagguggugaagcccauggaggccgccagcgccauccugucccaggccgacgcgcggcaggucgugcucaaguacaccguccccggcuaccgcaacagccuggaguucuucacggugcuggcccagcgccgggggaugcaccagaagggcggcaucccgaacguggagggggccgccaagcuccugugguccgaguggaccggcgccagccuggcguacuacugccacccgcccaccuccuggacgccgccgcccuacuucaacgagagcaucgucguggacaugaaguccggguucaaccucgaggagcuggagaagaacaacgcccagagcauccgcgccaucaagggcccccaccuggccaacuccauccucuuccagagcuccgggcugaccaacggcaucaucgaggagaaggacauccacgaggagcugcccaagcggaaggagcgcaagcaggaggagcgggaggacgacaaggacagcgaccaggagaccguggacgaggaggucgacgagaacuccagcggcauguucgccgcggaggagaccggggaggcccucuccgaggagaccacggccggcgagcagagcacccgcagcuucauccuggacaagaucaucgaggaggacgacgccuacgacuucuccaccgacuacguguga

SEQ ID NO: 30676 - RNA, 1749 nt, Artificial Sequence
  derived and/or modified sequence opt1 from GNL3L__Homo_sapiens__NP_061940
augaugaagcugcgccacaagaacaagaagcccggcgaggggagcaagggccacaagaagaucuccuggccguacccccagcccgccaagcagaacgggaagaaggccaccagcaaggugcccuccgcgccgcacuucguccaccccaacgaccacgccaaccgggaggccgagcucaagaagaaguggguggaggagaugcgcgagaagcagcaggccgcccgggagcaggagcgccagaagcggcgcaccaucgagagcuacugccaggacgugcugcggcgccaggaggaguucgagcacaaggaggagguccugcaggagcucaacauguucccccagcuggacgacgaggcgacgcggaaggccuacuacaaggaguuccgcaaggugguggaguacuccgacgucauccuggaggugcucgacgcccgggacccccugggcugccgcugcuuccagauggaggaggccgugcugcgggcgcaggggaacaagaagcucguccuggugcugaacaagaucgaccucgugccgaaggaggucguggagaaguggcuggacuaccugcgcaacgagcuccccaccguggccuucaaggccagcacccagcaccaggucaagaaccugaaccggugcuccgugcccguggaccaggccagcgagucccugcucaagagcaaggccugcuucggcgcggagaaccugaugcgcguccugggcaacuacugccggcucggggaggugcgcacccacauccgggugggcgucguggggcugcccaacgugggcaaguccagccugaucaacucccucaagcgcagccgggccugcuccgucggggccgugccgggcaucacgaaguucaugcaggaggucuaccuggacaaguucauccgccugcucgacgcccccggcaucgugcccgggcccaacagcgaggugggcaccauccugcgcaacugcguccacgugcagaagcuggccgacccggugacccccgucgagaccauccuccagcggugcaaccuggaggagaucuccaacuacuacggggugagcggcuuccagacgaccgagcacuuccugaccgcgguggcccaccgccucggcaagaagaagaagggcgggcuguacucccaggagcaggccgccaaggccguccuggcggacugggugagcgggaagaucagcuucuacaucccgccgcccgccacccacacgcuccccacccaccuguccgccgagaucgugaaggagaugaccgaggucuucgacaucgaggacaccgagcaggccaacgaggacacgauggagugccuggccaccggcgagagcgacgagcuccugggggacaccgacccccuggagauggagaucaagcuccugcacucccccaugaccaagaucgcggacgccaucgagaacaagacgaccguguacaagaucggcgaccugaccggcuacugcaccaaccccaaccggcaccagauggggugggccaagcgcaacguggaccaccggcccaagagcaacuccauggucgacgugugcagcguggaccgccgguccguccuccagcgcaucauggagacggacccccugcagcagggccaggcccuggcgagcgcccucaagaacaagaagaagaugcagaagcgggccgacaagaucgccuccaagcugagcgacuccaugaugagcgcccuggaccuguccgggaacgcggacgacggcgugggggacuga

SEQ ID NO: 30677 - RNA, 519 nt, Artificial Sequence
  derived and/or modified sequence opt1 from GNLY__Homo_sapiens__NP_001289687
auggccaccugggcccugcuccugcuggcggccaugcuccugggcaaccccgggcuggaggugagcgucuccccgaagggcaagaacaccagcgggcgcgaguccggcuucgggugggccaucuggauggagggccucguguucagccggcugucccccgaguacuacgaccuggcccgcgcccaccuccgggacgaggagaaguccugccccugccuggcgcaggagggcccccagggggaccugcucacgaagacccaggagcugggccgcgacuaccggaccugccugaccaucgugcagaagcucaagaagauggucgacaagccgacgcagcgcagcgugagcaacgccgccacccgggugugccgcaccgggcggucccgcuggcgggacgucugccgcaacuucaugcggcgcuaccagagccgggugacccagggccugguggccggggagacggcgcagcagaucugcgaggaccugcgccucugcauccccuccaccggcccccuguga

SEQ ID NO: 30678 - RNA, 888 nt, Artificial Sequence
  derived and/or modified sequence opt1 from GNMT__Homo_sapiens__NP_061833
augguggacagcgucuaccgcacccggucccugggcguggccgccgaggggcuccccgaccaguacgcggacggcgaggccgcccgcguguggcagcuguacaucggggacacccggagccgcacggccgaguacaaggccuggcugcucggccugcugcggcagcacgggugccagcgcguccucgacguggcgugcggcaccggcguggacuccaucaugcuggucgaggagggguucagcgugaccuccguggacgccagcgacaagaugcugaaguacgcccucaaggagcgguggaaccgccggcacgagccggccuucgacaagugggucaucgaggaggcgaacuggaugacccuggacaaggacgugccccaguccgccgagggcggguucgacgccgugaucugccugggcaacagcuucgcccaccuccccgacugcaagggggaccaguccgagcaccgccuggcccugaagaacaucgcgagcaugguccgggccggcggccuccuggugaucgaccaccgcaacuacgaccacauccuguccacggggugcgcgcccccgggcaagaacaucuacuacaagagcgaccucaccaaggacgugaccaccuccguccugaucgugaacaacaaggcccacauggugacgcuggacuacaccguccaggugcccggggccggccaggacggcagccccgggcucuccaaguuccggcugagcuacuacccccacugccuggccuccuucaccgagcuccugcaggccgccuucggcgggaagugccagcacagcgugcugggcgacuucaagccguacaagcccgggcagaccuacauccccugcuacuucauccacguccucaagcgcacggacuga

SEQ ID NO: 30679 - RNA, 2043 nt, Artificial Sequence
  derived and/or modified sequence opt1 from GNPAT__Homo_sapiens__NP_055051
auggagagcuccagcuccagcaacuccuacuucagcgugggccccaccuccccgagcgccgucgugcugcucuacuccaaggagcugaagaagugggacgaguucgaggacauccuggaggagcgccggcacgugagcgaccucaaguucgccaugaagugcuacacgccccuggucuacaaggggaucacccccugcaagcccaucgacaucaagugcuccgugcugaacagcgaggagauccacuacgugaucaagcagcucuccaaggagagccugcaguccgucgacgugcugcgcgaggaggugagcgagauccucgacgagaugucccacaagcugcggcugggcgcgauccgcuucugcgccuucacccucagcaaggucuucaagcagaucuucuccaaggugugcgugaacgaggaggggauccagaagcugcagcgggccauccaggagcacccggucgugcugcuccccagccaccgcagcuacaucgacuuccugaugcuguccuuccuccuguacaacuacgaccugcccgugcccgucaucgccgccggcauggacuuccucgggaugaagauggugggcgagcugcugcggaugagcggcgcguucuucaugcgccggaccuucgggggcaacaagcucuacugggccguguucuccgaguacgucaagaccaugcugcgcaacggguacgccccgguggaguucuuccuggagggcacgcggagccgcuccgccaagacccucacccccaaguucgggcugcugaacaucgugauggagcccuucuucaagcgggaggucuucgacaccuaccucgugcccaucagcaucuccuacgacaagauccuggaggagacgcuguacguguacgagcuccugggcgucccgaagcccaaggagagcaccaccggccugcucaaggcgcgcaagauccuguccgagaacuucgggagcauccacguguacuucggcgaccccgucucccugcggagccucgccgccgggcgcaugucccggagcuccuacaaccuggugccccgcuacaucccgcagaagcagagcgaggacaugcacgccuucgugaccgaggucgccuacaagauggagcugcuccagaucgagaacauggugcugucccccuggacgcugaucguggcgguccuccugcagaaccggcccagcauggacuucgacgcccugguggagaagacccucuggcugaagggccugacccaggccuucggcggguuccugaucuggcccgacaacaagccggccgaggaggugguccccgccuccauccuccugcacagcaacaucgcgagccuggugaaggaccaggugauccucaaggucgacuccggcgacagcgaggugguggacgggcugaugcugcagcacaucacccuccugaugugcuccgccuaccgcaaccagcugcucaacaucuucguccggcccagccugguggccguggcccugcagaugacgcccggcuuccgcaaggaggacgucuacuccugcuuccgcuuccuccgggacguguucgccgacgaguucaucuuccugccggggaacacccugaaggacuucgaggagggcugcuaccuccugugcaagagcgaggcgauccaggugaccaccaaggacauccuggucacggagaagggcaacaccgugcucgaguuccugguggggcuguucaagcccuucgucgaguccuaccagaucaucugcaaguaccuccugagcgaggaggaggaccacuucuccgaggagcaguaccuggccgccgugcgcaaguucaccagccagcuccuggaccagggcaccucccagugcuacgacgugcugagcuccgacguccagaagaacgcccucgccgcgugcgugcggcuggggguggucgagaagaagaagaucaacaacaacugcaucuucaacgugaacgagcccgccacgaccaagcuggaggagaugcucggcugcaagacccccaucgggaagccggccaccgccaagcuguga

SEQ ID NO: 30680 - RNA, 957 nt, Artificial Sequence
  derived and/or modified sequence opt1 from GNPDA1__Homo_sapiens__XP_005268405
augagcuccuucuggagcgacuaccuguuccccuucgugcucuggggcaagcugaagacccagcgcgggucccagagcaaggacaagaugaagcugaucauccucgagcacuacucccaggccagcgagugggccgcgaaguacauccggaaccgcaucauccaguucaacccgggccccgagaaguacuucacccuggggcugcccacgggcuccacgccccucgggugcuacaagaagcugaucgaguacuacaagaacggcgaccugagcuucaaguacgucaagaccuucaacauggacgaguacgugggccucccgcgggaccaccccgaguccuaccacagcuucauguggaacaacuucuucaagcacaucgacauccaccccgagaacacccacauccuggacgggaacgccguggaccugcaggccgagugcgacgccuucgaggagaagaucaaggccgcgggcgggaucgagcuguucgucggcgggaucggccccgacggccacaucgccuucaacgagccgggguccagccucgugucccgcacccgggugaagacccuggccauggacaccauccucgccaacgcgcgcuucuucgacggcgagcugaccaagguccccacgauggcccugaccgugggggugggcaccgucauggacgcccgggaggugaugauccucaucaccggcgcccacaaggccuucgcgcuguacaaggccaucgaggagggggugaaccacauguggacggucagcgccuuccagcagcacccccgcaccguguucgugugcgacgaggacgccacccuggagcucaaggucaagaccgugaaguacuucaagggccugaugcuggugcacaacaagcucgucgacccccuguacuccaucaaggagaaggagacggagaagucccagagcagcaagaagccguacuccgacuga

SEQ ID NO: 30681 - RNA, 729 nt, Artificial Sequence
  derived and/or modified sequence opt1 from GNPDA2__Homo_sapiens__NP_001257809
augcgccuggugauccucgacaacuacgaccuggccagcgagugggccgcgaaguacaucugcaaccggaucauccaguucaagcccggccaggaccgcuacuucacccuggggcucccgaccggccugccccggaaccaccccgaguccuaccacagcuacauguggaacaacuucuucaagcacaucgacaucgaccccaacaacgcccacauccuggacgggaacgccgccgaccuccaggccgagugcgacgcguucgagaacaagaucaaggaggccggcgggaucgaccuguucgucggcggcaucgggccggacggccacaucgccuucaacgagcccggguccagccuggugucccgcacgcggcucaagacccuggccauggacaccauccuggcgaacgccaaguacuucgacggcgaccucagcaaggugcccaccauggcccugacggucggggugggcaccgugauggacgcccgcgaggucaugauccugaucaccggcgcccacaaggcguucgcccucuacaaggccaucgaggagggggugaaccacauguggaccguguccgccuuccagcagcacccccggacgaucuucgucugcgacgaggacgccacccuggagcugcgcgugaagaccgugaaguacuucaagggccucaugcacguccacaacaagcugguggacccgcuguucagcaugaaggacgggaacuga

SEQ ID NO: 30682 - RNA, 3771 nt, Artificial Sequence
  derived and/or modified sequence opt1 from GNPTAB__Homo_sapiens__NP_077288
augcuguucaagcuccugcagcgccagaccuacacgugccugagccaccgguacggccucuacgugugcuuccugggggucguggugaccaucgucuccgccuuccaguucggcgagguggugcuggaguggagccgcgaccaguaccacguccucuucgacuccuaccgggacaacaucgccggcaagagcuuccagaaccgccugugccugcccaugccgaucgacgugguguacaccugggucaacgggaccgaccucgagcugcugaaggagcuccagcagguccgggagcagauggaggaggagcagaaggcgaugcgcgagauccuggggaagaacaccacggagcccaccaagaaguccgagaagcagcuggagugccuccugacccacugcaucaaggugcccaugcuggugcucgaccccgcccugccggccaacaucacccugaaggaccuccccagccuguaccccuccuuccacagcgccuccgacaucuucaacguggccaagcccaagaacccgagcacgaacguguccgucgugguguucgacagcaccaaggacgucgaggacgcgcacuccggccugcucaagggcaacagccggcagaccguguggcgcggguaccugaccacggacaaggaggugcccggccugguccucaugcaggaccuggccuuccuguccggguucccgcccaccuucaaggagaccaaccagcucaagaccaagcugcccgagaaccugagcuccaaggugaagcuccugcagcuguacagcgaggccuccguggcccuccugaagcugaacaaccccaaggacuuccaggagcucaacaagcagacgaagaagaacaugaccaucgacggcaaggagcugaccaucagccccgcguaccugcucugggaccugagcgccaucucccagagcaagcaggacgaggacaucuccgccagccgguucgaggacaacgaggagcugcgcuacucccuccggagcaucgagcgccacgcccccuggguccggaacaucuucaucgugaccaacgggcagaucccguccuggcugaaccuggacaacccccgcgucacgaucgugacccaccaggacguguuccggaaccucagccaccuccccaccuucuccagccccgccaucgagucccacauccaccgcaucgagggccugagccagaaguucaucuaccugaacgacgacgucauguucggcaaggacguguggccggacgacuucuacucccacagcaaggggcagaagguguaccugaccuggcccguccccaacugcgcggagggcugccccggguccuggaucaaggacggcuacugcgacaaggccugcaacaacagcgccugcgacugggacggcggggacugcuccggcaacagcgggggcucccgguacaucgccgggggcggcgggacgggcagcaucggggugggccagccguggcaguucgggggcggcaucaacagcguguccuacugcaaccaggggugcgccaacagcuggcuggcggacaaguucugcgaccaggccugcaacguccuguccugcggcuucgacgccggggacugcggccaggaccacuuccacgagcucuacaaggugauccugcugcccaaccagacccacuacaucauccccaagggggagugccuccccuacuucagcuucgccgagguggccaagcgcggcgucgagggcgcguacuccgacaacccgaucauccggcacgccagcaucgccaacaaguggaagaccauccaccugaucaugcacuccgggaugaacgccaccacgauccacuucaaccugaccuuccagaacaccaacgacgaggaguucaagaugcagaucaccguggagguggacacgcgcgagggccccaagcucaacagcaccgcccagaagggguacgagaaccuggucucccccaucacccugcucccggaggcggagauccuguucgaggacauccccaaggagaagcgguuccccaaguucaagcgccacgacgugaacagcacccgccgggcccaggaggaggugaagaucccccuggucaacaucucccuccugccgaaggacgcccagcugagccucaacacgcuggaccugcagcucgagcacggcgacaucacccugaagggcuacaaccuguccaagagcgcccuccugcgcuccuuccugaugaacagccagcacgcgaagaucaagaaccaggccaucaucaccgacgagaccaacgacucccucguggcgccccaggagaagcagguccacaagagcauccugcccaacagccuggggguguccgagcggcuccagcgccugaccuuccccgccgugagcgugaaggucaacggccacgaccaggggcagaacccgccccuggaccucgagacgaccgcccgguuccgcguggagacccacacccagaagacgaucggcgggaacgugaccaaggagaagccgcccucccugaucgucccccuggagagccagaugaccaaggagaagaagaucaccggcaaggagaaggagaacucccggauggaggagaacgccgagaaccacaucggcgugacggaggugcuccuggggcgcaagcugcagcacuacaccgacagcuaccucggcuuccugcccugggagaagaagaaguacuuccaggaccugcucgacgaggaggagucccugaagacccagcuggccuacuucaccgacagcaagaacacggggcggcagcucaaggacaccuucgccgacucccugcgcuacgucaacaagauccugaacagcaaguucggcuucaccucccggaaggugcccgcccacaugccccacaugaucgaccgcaucgugaugcaggagcuccaggacauguucccggaggaguucgacaagaccagcuuccacaagguccggcacuccgaggacaugcaguucgccuucagcuacuucuacuaccugauguccgcggugcagccccugaacaucagccagguguucgacgaggucgacacggaccaguccggggugcucagcgaccgcgagauccggacccuggccacccgcauccacgagcugccccucucccugcaggaccugaccggccucgagcacaugcugaucaacugcagcaagaugcugcccgccgacaucacgcagcucaacaacaucccgcccacccaggagagcuacuacgaccccaaccugcccccggugaccaagucccuggucaccaacugcaagcccgugacggacaagauccacaaggccuacaaggacaagaacaaguaccgguucgagaucaugggcgaggaggagaucgccuucaagaugauccgcaccaacgugagccacgucguggggcagcucgacgacauccggaagaacccccgcaaguucgugugccugaacgacaacaucgaccacaaccacaaggacgcgcagaccgucaaggccgugcugcgcgacuucuacgaguccauguucccgauccccagccaguucgagcucccccgggaguaccgcaaccgguuccugcacaugcacgagcugcaggaguggcgcgccuaccgggacaagcucaaguucuggacccacugcgugcuggccacgcugaucauguucaccaucuucuccuucuucgcggagcagcucaucgcccugaagcgcaagaucuucccccggcgccggauccacaaggaggccagcccgaaccgcauccgggucuga

SEQ ID NO: 30683 - RNA, 918 nt, Artificial Sequence
  derived and/or modified sequence opt1 from GNPTG__Homo_sapiens__NP_115909
auggccgccggccuggcgcgccuccugcugcuccuggggcugagcgccggcgggcccgccccggccggcgccgcgaagaugaagguggucgaggagcccaacgccuucggggugaacaaccccuuccucccccaggccucccggcugcaggccaagcgcgacccgagccccguguccggccccguccaccuguuccggcucagcggcaagugcuucucccugguggagagcaccuacaaguacgaguucugccccuuccacaacgugacccagcacgagcagacguuccgcuggaacgcguacuccgggauccugggcaucuggcacgagugggagaucgccaacaacaccuucaccgggauguggaugcgggacggcgacgccugccgcagccggucccgccagagcaaggucgagcucgccugcgggaaguccaaccggcuggcccacgugagcgagccguccacgugcguguacgcgcugacguucgagaccccgcucgucugccacccccacgcccugcugguguaccccacccuccccgaggcccugcagcgccagugggaccagguggagcaggaccuggccgacgagcucaucacgccccagggccacgagaagcugcugcggacccucuucgaggacgccggcuaccugaagacccccgaggagaacgagcccacccagcuggagggcgggccggacagccucggguucgagacccuggagaacugccgcaaggcgcacaaggagcuguccaaggagaucaagcggcucaagggccugcugacccagcacggcauccccuacacccgccccaccgagaccagcaaccucgagcaccuggggcacgagacgccccgggccaaguccccggagcagcugcgcggcgaccccgggcuccggggcagccuguga

SEQ ID NO: 30684 - RNA, 291 nt, Artificial Sequence
  derived and/or modified sequence opt1 from GNRH1__Homo_sapiens__NP_000816
augugccugcgcaugaagcccauccagaagcuccuggccggccugauccuccugaccuggugcguggaggggugcagcucccagcacuggagcuacggccugcggcccgggggcaagcgcgacgccgagaaccucaucgacuccuuccaggagaucgucaaggagguggggcagcuggcggagacccagcgguucgagugcacgacccaccagccgcgcagcccccugcgggaccucaagggcgcccuggagucccugaucgaggaggagaccggccagaagaagaucuga

SEQ ID NO: 30685 - RNA, 342 nt, Artificial Sequence
  derived and/or modified sequence opt1 from GNRH2__Homo_sapiens__NP_847901
auggccagcucccgccggggccugcuccugcugcuccugcugaccgcccaccucgggcccagcgaggcgcagcacuggucccacggcugguaccccgggggcaagcgcgcccugagcuccgcccaggacccccagaacgcccugcggccgcccgccgggagccccgugcagaccgcgcacggccuccccuccgacgcccuggcgccccuggacgacagcaugcccugggagggccgcacgaccgcccaguggucccuccaccggaagcgccaccuggcccggacccugcucaccgccgcccgcgagccgcggcccgccccgcccagcuccaacaaggucuga

SEQ ID NO: 30686 - RNA, 987 nt, Artificial Sequence
  derived and/or modified sequence opt1 from GNRHR__Homo_sapiens__NP_000397
auggccaacagcgccucccccgagcagaaccagaaccacugcagcgcgaucaacaacuccaucccgcugaugcagggcaaccuccccacccugacccugagcgggaagauccgcgugacggucaccuucuuccucuuccugcuguccgccaccuucaacgccagcuuccuccugaagcugcagaaguggacccagaagaaggagaagggcaagaagcucucccggaugaagcugcugcucaagcaccugacgcuggccaaccuccuggagacccugaucgugaugccccucgacgggauguggaacaucaccgugcagugguacgccggcgagcugcugugcaagguccucagcuaccugaagcuguucuccauguacgcgcccgccuucaugaugguggugaucagccucgaccgcucccuggccaucacccggccgcuggcccucaagagcaacuccaaggucgggcagagcauggugggccuggcguggauccuguccagcguguucgccggcccccagcucuacaucuuccgcaugauccaccuggccgacuccagcgggcagacgaaggucuucucccagugcgugacccacugcagcuucagccagugguggcaccaggccuucuacaacuucuucaccuucuccugccuguucaucaucccccucuucaucaugcugaucugcaacgccaagaucaucuucacccugacgcgggugcuccaccaggacccccacgagcugcagcugaaccagagcaagaacaacaucccgcgcgcgcggcucaagacccugaagaugaccgucgccuucgccaccuccuucacggugugcuggacccccuacuacgugcugggcaucugguacugguucgaccccgagaugcucaaccgccugagcgaccccgucaaccacuucuucuuccuguucgccuuccucaacccgugcuucgacccccugaucuacggguacuucucccuguga

SEQ ID NO: 30687 - RNA, 1659 nt, Artificial Sequence
  derived and/or modified sequence opt1 from GNS__Homo_sapiens__NP_002067
augcgccugcugccccuggccccgggccggcugcgccgggggagcccccgccaccuccccuccugcagccccgcccugcugcuccuggugcugggcgggugccucggcgucuucgggguggcggccggcacccggcgcccgaacgugguccugcugcucaccgacgaccaggacgaggugcugggcgggaugacgccccugaagaagaccaaggcccucaucggcgagauggggaugaccuucuccagcgccuacgugcccuccgcccugugcugccccagccgggcguccauccugaccggcaaguacccgcacaaccaccacgucgugaacaacacgcucgaggggaacugcagcuccaagagcuggcagaagauccaggagcccaacaccuuccccgccauccugcgcuccaugugcggcuaccagaccuucuucgccggcaaguaccugaacgaguacggggcccccgacgcgggcgggcucgagcacgugccgcugggcuggagcuacugguacgcccuggagaagaacuccaaguacuacaacuacacccucagcaucaacggcaaggcccggaagcacggggagaacuacuccgucgacuaccugacggacgugcuggccaacgugagccucgacuuccuggacuacaaguccaacuucgagcccuucuucaugaugaucgccacccccgcgccccacagcccguggaccgccgcgccccaguaccagaaggccuuccagaacgucuucgcgccccgcaacaagaacuucaacauccacggcaccaacaagcacuggcugauccggcaggccaagacgcccaugaccaacuccagcauccaguuccucgacaacgccuuccgcaagcgguggcagacccugcugagcguggacgaccucguggagaagcuggucaagcgccuggaguucaccggggagcucaacaacacguacaucuucuacaccuccgacaacggcuaccacaccgggcaguucagccugccgaucgacaagcggcagcuguacgaguucgacaucaaggugccccuccuggugcgcggccccggcaucaagcccaaccagaccuccaagaugcuggucgccaacaucgaccucgggccgacgauccuggacaucgccggcuacgaccugaacaagacccagauggacgggaugagccuccugcccauccugcggggcgccuccaaccucaccuggcgcagcgacgugcugguggaguaccagggggagggccggaacgucaccgaccccacgugccccucccugagcccgggcgugucccagugcuuccccgacugcgugugcgaggacgccuacaacaacaccuacgccugcguccgcaccaugagcgcccuguggaaccuccaguacugcgaguucgacgaccaggagguguucgucgagguguacaaccugaccgccgaccccgaccagaucacgaacaucgccaagaccaucgacccggagcugcucgggaagaugaacuaccggcugaugaugcugcaguccugcagcggcccgaccugccgcacccccgggguguucgaccccggcuaccgcuucgacccccggcucauguucuccaaccgcgggagcguccggacgcgccgguucuccaagcaccuccuguga

SEQ ID NO: 30688 - RNA, 2304 nt, Artificial Sequence
  derived and/or modified sequence opt1 from GOLGA1__Homo_sapiens__NP_002068
auguucgccaagcugaagaagaagaucgccgaggagaccgcgguggcccagcgccccggcggggccacccggaucccgcgcagcgucuccaaggagagcguggccuccaugggcgccgacagcggggacgacuucgcguccgacggcagcuccagccgggaggaccucuccagccagcugcugcgccggaacgagcagauccgcaagcucgaggcccggcuguccgacuacgccgagcagguccgcaaccugcagaagaucaaggagaagcucgagaucgcccuggagaagcaccaggacagcuccaugcggaaguuccaggagcagaacgagacguuccaggcgaaccgcgccaagauggccgaggggcuggcccucgcccuggcgcggaaggaccaggaguggagcgagaagauggaccagcuggagaaggagaagaacauccucaccgcccagcugcaggagaugaagaaccaguccaugaaccuguuccagcgccgggacgagauggacgagcucgagggcuuccagcagcaggagcugagcaagaucaagcacaugcugcucaagaaggaggagucccugggcaagauggagcaggagcuggaggcccgcacccgggagcucagccgcacccaggaggagcugaugaacuccaaccagaugagcagcgaccugucccagaagcucgaggagcugcagcggcacuacagcacgcuggaggagcagcgcgaccacgugaucgccuccaagaccggggccgagagcaagaucaccgcgcucgagcagaaggagcaggagcugcaggcccugauccagcagcucuccaucgaccugcagaaggugaccgccgagacgcaggagaaggaggacgugaucacccaccuccaggagaaggucgccagccucgagaagcggcuggagcagaaccuguccggcgaggagcacgugcaggagcuccugaaggagaagacccuggccgagcagaaccucgaggacacccgccagcagcugcuggcggcccggagcucccaggccaaggccaucaacacgcucgagacccgcgugcgcgagcuggagcagacccugcaggccagcgaggagcagcuccagcaguccaaggggaucgucgcggcccaggagacccagauccaggagcuggccgccgcgaaccaggagagcucccacgugcagcagcaggcccuggcccucgagcagcaguuccuggagcggacgcaggcccuggaggcccagaucguggcgcuggagcgcacccgggccgccgaccagaccaccgccgagcagggcaugcgccagcucgagcaggagaacgccgcgcugaaggagugccggaacgaguacgagcgcagccugcagaaccaccaguucgagcucaagaagcugaaggaggaguggucccagcgggagaucgucagcguggccauggcccaggcccuggaggaggugcgcaagcagcgggaggaguuccagcagcaggccgcgaaccucacggccaucaucgacgagaaggagcagaaccugcgcgagaagaccgagguccugcuccagaaggagcaggagauccugcagcuggagcgggggcacaacuccgcccuccugcagauccaccagcugcaggccgagcucgaggcgcugcgcacccugaaggccgaggaggccgccgugguggccgagcaggaggaccuccugcggcugcgcggcccccuccaggcggaggcccugagcgucaacgagucccacgugaccagccgggccaugcaggaccccguguuccagcugcccacggccggccgcaccccgaacggggaggucggcgccauggaccucacccagcugcagaaggagaagcaggaccuggagcagcagcuccuggagaagaacaagaccaucaagcagaugcagcagcggaugcuggagcuccgcaagacgcugcagaaggagcugaagauccggcccgacaacgagcuguucgaggugcgcgagaagcccgggcccgagauggcgaacauggccccgagcgugaccaacaacaccgaccugaccgacgcccgcgagaucaacuucgaguaccugaagcacgucgugcucaaguucauguccugccgggagagcgaggccuuccaccugaucaaggccgucuccgugcugcucaacuucagccaggaggaggagaacaugcugaaggagacgcuggaguacaagauguccugguucggcagcaagcccgcgcccaagggcuccauccgccccagcaucuccaacccgcggauccccuggagcuga

SEQ ID NO: 30689 - RNA, 3009 nt, Artificial Sequence
  derived and/or modified sequence opt1 from GOLGA2__Homo_sapiens__NP_004477
auguggccccagccgcgccugccgccccggcccgccaugagcgaggagacccgccaguccaagcucgccgcggccaagaagaagcugcgggaguaccagcagcgcaacagccccggcgugcccaccggggccaagaagaagaagaagaucaagaacggcuccaaccccgagacgaccaccagcgggggcugccacucccccgaggacaccccgaaggacaacgccgccacgcugcagcccagcgacgacaccguccuccccgggggcgugcccuccccgggcgcgagccugaccuccauggccgccagccagaaccacgacgccgacaacgugcccaaccugauggacgagaccaagacguucuccagcaccgagucccuccggcagcugagccagcagcugaacgggcucgucugcgaguccgcgaccugcgugaacggcgaggggcccgccagcuccgccaaccugaaggaccuggagagccgcuaccagcagcucgccguggcccuggacuccagcuacgucaccaacaagcagcugaacaucacgaucgagaagcucaagcagcagaaccaggagaucaccgaccagcuggaggaggagaagaaggagugccaccagaagcagggcgcgcugcgggagcagcuccaggugcacauccagaccaucgggauccuggugagcgagaaggccgagcugcagaccgcccucgcccacacgcagcacgccgcgcgccagaaggagggcgaguccgaggaccuggccagccggcugcaguacucccgccggcgcgucggcgagcucgagcgggcccugagcgccguguccacccagcagaagaaggccgaccgcuacaacaaggagcugaccaaggagcgggacgcgcuccgccuggagcuguacaagaacacccagagcaacgaggaccucaagcaggagaaguccgagcuggaggagaagcugcgggugcucgucacggagaaggccgggaugcagcugaaccuggaggagcuccagaagaagcuggagaugaccgagcugcuccugcagcaguucagcucccgcugcgaggcccccgacgccaaccagcagcugcagcaggccauggaggagcgggcgcagcucgaggcccaccugggccaggugauggagagcgugcgccagcugcagauggagcgggacaaguacgccgagaaccucaagggggaguccgccauguggcgccagcgcaugcagcagaugagcgagcagguccacacccugcgggaggagaaggagugcuccaugagccgcgugcaggagcuggagaccucccucgcggagcugcggaaccagauggccgagccgcccccgcccgagccgcccgccggccccagcgagguggagcagcagcugcaggccgaggccgagcaccuccgcaaggagcuggagggccuggcggggcagcugcaggcccagguccaggacaacgagggccucucccggcugaaccgcgagcaggaggagcggcugcucgagcuggagcgcgccgccgagcuguggggcgagcaggccgaggcgcggcgccagauccucgagacgaugcagaacgaccggaccaccaucagccgcgcccugucccagaaccgggagcugaaggagcagcucgccgagcugcagagcggguucgugaagcugaccaacgagaacauggagaucacgagcgcccuccaguccgagcagcacgugaagcgcgagcuggggaagaagcugggcgagcuccaggagaagcugagcgagcugaaggagaccgucgagcucaagucccaggaggcccagagccugcagcagcagcgggaccaguaccugggccaccuccagcaguacguggcggccuaccagcagcugaccuccgagaaggaggugcugcacaaccagcuccugcugcagacccagcucgucgaccagcugcagcagcaggaggcccaggggaaggccguggcggagauggcccgccaggagcugcaggagacgcaggagcggcucgaggccgccacccagcagaaccagcagcugcgcgcccagcugagccucauggcgcaccccggcgagggggacggccuggaccgggaggaggaggaggacgaggaggaggaggaggaggaggccgucgccgugccccagcccaugcccuccauccccgaggaccuggagagccgcgaggccaugguggccuucuucaacuccgcggucgccagcgccgaggaggagcaggcccgccuccgggggcagcugaaggagcagcgcgugcggugccgccggcuggcccaccuccuggcguccgcccagaaggagccggaggccgccgcgcccgcccccggcaccggcggggacagcgugugcggcgagacccaccgcgcccugcagggggccauggagaagcuccagucccgguucauggagcugaugcaggagaaggccgaccugaaggagcgcgucgaggagcucgagcaccggugcauccagcugagcggcgagacggacaccaucggggaguacaucgcgcuguaccagucccagcgcgccgugcucaaggagcggcaccgcgagaaggaggaguacaucagccggcuggcccaggacaaggaggagaugaaggugaagcugcucgagcugcaggagcugguccuccgccuggugggcgaccggaacgaguggcacggccgcuuccuggccgccgcgcagaacccggccgacgagcccaccuccggggcccccgcgccccaggagcucggcgccgccaaccagcagggggaccugugcgaggugagccuggccggcagcgucgagccggcccagggcgaggcccgggaggggagcccccgcgacaaccccaccgcccagcagaucaugcagcuccugcgggagaugcagaacccccgcgagcggccgggccugggguccaaccccugcauccccuucuucuaccgcgcggacgagaacgacgaggugaagaucaccgugaucuga

SEQ ID NO: 30690 - RNA, 3405 nt, Artificial Sequence
  derived and/or modified sequence opt1 from GOLGA3__Homo_sapiens__NP_001166028
auggacggcgccagcgccgagcaggacgggcugcaggaggaccgcucccacagcggccccuccagccucccggaggcgccccugaagccgcccgggccccuggugccgcccgaccagcaggacaagguccagugcgccgaggugaaccgggccuccaccgagggcgagagccccgacgggcccggccagggcgggcucugccagaacggccccaccccgcccuuccccgacccgcccuccagccuggaccccacgaccucccccguggggcccgacgccagccccggcgucgccggguuccacgacaaccugcgcaagucccagggcaccagcgcggagggcuccgugcggaaggaggcccuccagagccugcgccugucccuccccaugcaggagacccagcugugcagcacggacuccccgcugccccucgagaaggaggagcagguccggcugcaggcccgcaaguggcuggaggagcagcucaagcaguaccgggugaagcgccagcaggagcggagcucccagcccgccaccaagacccgccuguucagcacccuggaccccgagcucaugcugaacccggagaaccugccccgggcgagcacgcucgccaugaccaaggaguacuccuuccugcgcaccagcgugccccgggggcccaaggugggcucccuggggcucccggcccacccccgcgagaagaagaccagcaaguccagcaagauccggucccuggccgacuaccgcacggaggacagcaacgccggcaacuccggcgggaacguccccgcgccggacagcaccaagggcucccugaagcagaaccggagcuccgccgccagcgugguguccgagaucagccucucccccgacaccgacgaccgccuggagaacaccagccuggccggggacuccgucagcgagguggacggcaacgacagcgacuccagcuccuacagcuccgccagcacgcgggggaccuacggcauccucuccaagaccgugggcacccaggacacgcccuacauggucaacgggcaggagauccccgcggacacccugggccaguucccgagcaucaaggacgugcugcaggccgccgccgccgagcaccaggaccaggggcaggaggugaacggcgagguccgcucccggcgcgacagcaucugcuccagcgugucccucgagagcuccgcggccgagacccaggaggagaugcuccaggugcugaaggagaagaugcgccuggaggggcagcuggaggcccugagccucgaggccucccaggcccugaaggagaaggcggagcugcaggcccagcucgccgcccugagcaccaagcugcaggcgcaggucgagugcagccacuccagccagcagcggcaggacucccucagcuccgagguggacacgcugaagcagagcugcugggaccuggagcgcgccaugaccgaccuccagaacaugcuggaggccaagaacgccucccuggccagcuccaacaacgaccuccagguggcggaggagcaguaccagcggcugauggccaaggucgaggacaugcagcgcagcaugcuguccaaggacaacaccgugcacgaccugcggcagcagaugaccgcccuccagagccagcugcagcagguccagcuggagcgcacgacccucaccuccaagcugaaggccagccaggccgagaucuccagccugcaguccgugcggcagugguaccagcagcagcucgcgcuggcccaggaggcccgcgugcggcugcagggcgagauggcccacauccaggucggccagaugacccaggccgggcuccuggagcaccugaagcucgagaacgugagccugucccagcagcugacggagacccagcaccgcagcaugaaggagaagggccggaucgcggcccagcuccaggggaucgaggccgacaugcuggaccaggaggccgcguucaugcagauccaggaggccaagaccaugguggaggaggaccugcagcgccggcucgaggaguucgagggcgagcgcgagcggcugcagcgcauggccgacagcgccgccucccuggagcagcagcucgagcaggucaagcugacccugcuccagcgggaccagcagcuggaggcgcugcagcaggagcaccucgaccugaugaagcagcugacgcucacccaggaggcccugcagagccgcgagcagucccuggacgcccuccagacccacuacgacgagcugcaggcccggcugggggagcuccagggcgaggccgcgagccgcgaggacaccaucugccugcugcagaacgagaagaucauccucgaggccgcccugcaggccgccaaguccggcaaggaggagcuggaccgcggggcgcggcgccucgaggagggcaccgaggagacgagcgagacccuggagaagcugcgggaggagcucgccaucaaguccggccagguggagcaccuccagcaggagaccgccgcccugaagaagcagaugcagaagaucaaggagcaguuccugcagcagaaggugauggucgaggcguaccgccgggacgccaccagcaaggaccagcugaucuccgagcugaaggccacgcgcaagcggcucgacagcgagcugaaggagcugcgccaggagcucaugcagguccacggggagaagcggaccgccgaggccgagcugucccgccugcaccgggagguggcccaggugcgccagcacauggcggaccucgagggccaccuccagagcgcccagaaggagcgggacgagauggagacccaccuccagucccugcaguucgacaaggagcagaugguggccgugaccgaggccaacgaggcgcugaagaagcagaucgaggagcugcagcaggaggcccgcaaggccaucacggagcagaagcagaagaugcggcgccuggggagcgaccugaccuccgcccagaaggagaugaagaccaagcacaaggccuacgagaacgcggucggcauccugagccggcgccuccaggaggcccuggccgccaaggaggccgcggacgccgagcuggggcagcuccgggcccagggcggguccagcgacuccagccuggcccugcacgagcgcauccaggcgcucgaggccgagcugcaggccgugagccacuccaagacccugcucgagaaggagcugcaggaggugaucgcccugacgagccaggagcucgaggagucccgggagaagguccuggagcuggaggacgaggugcgccccggccaccuccuguggcgccagcggggcgccgggcacgugagccccggccacgcggccacccgcgagacccggcgcaccaagcugcaccggguccccuccguggccacguucgggguggccaccuucuga

SEQ ID NO: 30691 - RNA, 6732 nt, Artificial Sequence
  derived and/or modified sequence opt1 from GOLGA4__Homo_sapiens__NP_001166184
auguucaagaagcugaagcagaagaucagcgaggagcagcagcagcuccagcaggcccuggcccccgcgcaggccuccagcaacuccagcaccccgacccgcaugcggucccgcacgagcuccuucaccgagcagcuggacgagggcacccccaaccgggagaacgccagcacccacgccuccaagagccccgacuccgugaacgggagcgagcccuccaucccgcagagcggcgacacgcaguccuucgcccagaagcuccagcugcgcguccccagcguggagucccuguuccggagccccaucaaggagucccucuuccgcagcagcuccaaggagagccuggugcggaccuccagccgcgagucccugaaccggcucgaccuggacagcuccaccgcgagcuucgaccccccguccgacauggacagcgaggccgaggaccuggucgggaacuccgacagccucaacaaggagcagcugauccagcgccugcggcgcauggagcggucccucagcuccuaccgcggcaaguacagcgagcuggugaccgccuaccagaugcugcagcgggagaagaagaagcuccaggggauccugucccagagccaggacaagucccugcgccggaucgccgagcuccgcgaggagcugcagauggaccagcaggcgaagaagcaccugcaggaggaguucgacgccagccucgaggagaaggaccaguacaucagcgugcugcagacgcaggucucccugcucaagcagcggcugcgcaacggccccaugaacguggacgugcugaagccccucccccagcuggagccgcaggccgaggucuucaccaaggaggagaaccccgagagcgacggcgagcccgugguggaggacgggaccuccgucaagacccuggagacgcuccagcagcgggugaagcgccaggagaaccugcugaagcgcugcaaggagaccauccagagccacaaggagcagugcacccuccugaccuccgagaaggaggcccugcaggagcagcucgacgagcggcugcaggagcuggagaagaucaaggaccuccacauggccgagaagacgaagcugaucacccagcugcgcgacgcgaagaaccucaucgagcagcuggagcaggacaagggcauggugaucgccgagaccaagcggcagaugcacgagacccuggagaugaaggaggaggagaucgcccagcuccgcagccggaucaagcagaugacgacccagggggaggagcugcgcgagcagaaggagaaguccgagcgggccgccuucgaggagcuggagaaggcgcugagcaccgcccagaagaccgaggaggcccgccggaagcucaaggccgagauggacgagcagaucaagacgaucgagaagaccuccgaggaggagcgcaucagccugcagcaggagcugucccgggucaagcaggaggugguggacgucaugaagaagagcuccgaggagcagaucgccaagcuccagaagcugcacgagaaggagcuggcgcgcaaggagcaggagcucaccaagaagcugcagacccgggagcgcgaguuccaggagcagaugaagguggcccuggagaagagccaguccgaguaccucaagaucagccaggagaaggagcagcaggagucccuggcccuggaggagcucgagcugcagaagaaggccauccugacggagagcgagaacaagcuccgggaccugcagcaggaggccgagaccuaccgcacccggauccuggagcucgagagcucccuggagaagagccugcaggagaacaagaaccaguccaaggaccucgcggugcaccuggaggccgagaagaacaagcacaacaaggagaucaccgucaugguggagaagcacaagacggagcuggagagccucaagcaccagcaggacgcccuguggaccgagaagcugcaggugcucaagcagcaguaccagaccgagauggagaagcugcgcgagaagugcgagcaggagaaggagacccugcucaaggacaaggagaucaucuuccaggcccacaucgaggagaugaacgagaagacgcuggagaagcuggacgucaagcagaccgagcucgagucccugagcuccgagcugagcgaggugcucaaggcgcggcacaagcuggaggaggagcuguccguccucaaggaccagaccgacaagaugaagcaggagcuggaggccaagauggacgagcagaagaaccaccaccagcagcagguggacagcaucaucaaggagcacgagguguccauccagcgcaccgagaaggcccugaaggaccagaucaaccagcucgagcugcugcucaaggagcgcgacaagcaccugaaggagcaccaggcccacgucgagaaccuggaggccgacaucaagcggagcgagggcgagcuccagcaggcguccgccaagcuggacguguuccagagcuaccaguccgccacccacgagcagacgaaggccuacgaggagcagcuggcccagcuccagcagaagcugcuggaccucgagaccgagcgcauccugcugaccaagcagguggcggaggucgaggcccagaagaaggacgugugcaccgagcucgacgcccacaagauccaggugcaggaccugaugcagcagcuggagaagcagaacagcgagauggagcagaaggucaagucccucacgcagguguacgagagcaagcuggaggacgggaacaaggagcaggagcagaccaagcagauccugguggagaaggagaacaugauccuccagaugcgggagggccagaagaaggagaucgagauccugacccagaagcuguccgccaaggaggacagcauccacauccucaacgaggaguacgagaccaaguucaagaaccaggagaagaagauggagaaggucaagcagaaggccaaggagaugcaggagacgcugaagaagaagcugcucgaccaggaggcgaagcugaagaaggagcuggagaacaccgcccucgagcugagccagaaggagaagcaguucaacgccaagaugcuggagauggcccaggcgaacuccgccggcaucagcgacgccgugucccgccucgagaccaaccagaaggagcagaucgagagccugaccgaggugcaccggcgcgagcugaacgacgucaucuccaucugggagaagaagcucaaccagcaggccgaggagcugcaggagauccacgagauccagcugcaggagaaggagcaggagguggccgagcucaagcagaagauccugcuguucgggugcgagaaggaggagaugaacaaggagaucacguggcucaaggaggagggcgugaagcaggacaccacccugaacgagcugcaggagcagcucaagcagaagagcgcgcacgucaacucccuggcccaggacgagaccaagcugaaggcccaccucgagaagcuggagguggaccugaacaagagccucaaggagaacacguuccugcaggagcagcugguggagcugaagaugcucgccgaggaggacaagcggaaggucuccgagcugaccagcaagcugaagaccaccgacgaggaguuccagucccucaagagcucccacgagaagagcaacaagucccuggaggacaagagccuggaguucaagaagcucuccgaggagcuggccauccagcuggacaucugcugcaagaagacggaggcgcuccuggaggccaagaccaacgagcugaucaacaucagcuccagcaagaccaacgccauccucagccgcaucucccacugccagcaccggaccacgaaggugaaggaggcccugcugaucaagaccugcaccgugagcgagcucgaggcccagcugcgccagcugaccgaggagcagaacacgcucaacaucuccuuccagcaggcgacccaccagcuggaggagaaggagaaccagaucaagagcaugaaggccgacaucgagucccuggucaccgagaaggaggcccuccagaaggaggggggcaaccagcagcaggccgcgagcgagaaggaguccugcaucacccagcugaagaaggagcugagcgagaacaucaacgccgugacgcucaugaaggaggagcugaaggagaagaagguggagaucuccagccuguccaagcagcucaccgaccugaacguccagcugcagaacagcaucucccucagcgagaaggaggccgccaucuccagccugcggaagcaguacgacgaggagaagugcgagcugcucgaccaggugcaggaccuguccuucaagguggacacccugagcaaggagaagaucuccgcccucgagcaggucgacgacuggagcaacaaguucagcgaguggaagaagaaggcgcagucccgcuucacccagcaccagaacacggugaaggagcugcagauccagcuggagcucaagagcaaggaggccuacgagaaggacgagcagaucaaccugcugaaggaggagcucgaccagcagaacaagcgguucgacugccugaagggcgagauggaggacgacaaguccaagauggagaagaaggagagcaaccuggagaccgagcucaagucccagaccgcccgcaucauggagcuggaggaccacaucacccagaagaccaucgagaucgagagccugaacgaggugcucaagaacuacaaccagcagaaggacaucgagcacaaggagcugguccagaagcugcagcacuuccaggagcucggggaggagaaggacaaccgggugaaggaggccgaggagaagauccugacgcuggagaaccagguguacuccaugaaggccgagcucgagaccaagaagaaggagcuggagcacgucaaccugagcgugaaguccaaggaggaggagcucaaggcgcuggaggaccgccuggagagcgaguccgccgccaagcucgccgagcugaagcggaaggccgagcagaagaucgcggccaucaagaagcagcugcucagccagauggaggagaaggaggagcaguacaagaagggcaccgagucccaccugagcgagcugaacaccaagcuccaggagcgcgagcgggaggugcacauccuggaggagaagcugaaguccgucgagagcucccagagcgagacgcucaucgugccccgcuccgccaagaacguggccgccuacaccgagcaggaggaggcggacagccaggggugcguccagaagaccuacgaggagaagaucagcgugcugcagcggaaccugaccgagaaggagaagcuccugcagcgcgugggccaggagaaggaggagacggucuccagccacuucgagaugcgcugccaguaccaggagcggcugaucaagcucgagcacgccgaggccaagcagcacgaggaccaguccaugaucgggcaccugcaggaggagcuggaggagaagaacaagaaguacagccucaucguggcccagcacguggagaaggagggcggcaagaacaacauccaggcgaagcagaaccuggagaacgucuucgacgacgugcagaagacccugcaggagaaggagcucaccugccagauccuggagcagaagaucaaggagcuggacuccugccucgugcgccagaaggagguccaccggguggagauggaggagcugaccagcaaguacgagaagcugcaggcccuccagcagauggacgggcgcaacaagccgacggagcugcuggaggagaacaccgaggagaaguccaagagccaccucguccagcccaagcugcuguccaacauggaggcccagcacaacgaccucgaguucaagcuggccggcgccgagcgggagaagcagaagcuggggaaggagaucgugcgccuccagaaggaccugcggaugcugcgcaaggagcaccagcaggagcucgagauccugaagaaggaguacgaccaggagcgggaggagaagaucaagcaggagcaggaggaccuggagcugaagcacaacagcacccucaagcagcugaugcgcgaguucaacacccagcuggcgcagaaggagcaggagcucgagaugacgaucaaggagaccaucaacaaggcccaggagguggaggccgagcugcuggagucccaccaggaggagaccaaccagcuccugaagaagaucgccgagaaggacgacgaccugaagcggaccgccaagcgcuacgaggagauccucgacgcgcgggaggaggagaugacggccaagguccgcgaccugcagacccagcuggaggagcuccagaagaaguaccagcagaagcuggagcaggaggagaaccccggcaacgacaacacccagcuggcccagaagaccacgcucaucagcgacuccaagcugaaggagcaggaguuccgggagcagauccacaaccuggaggaccgccucaagaaguacgagaagaacguguacgccaccaccguggggacccccuacaagggcggcaaccuguaccacacggacgucagccuguucggggagccgaccgaguucgaguaccuccggaaggugcuguucgaguacaugaugggccgcgagaccaagaccauggccaaggugaucacgaccguccugaaguuccccgacgaccagacccagaagauccucgagcgggaggacgcgcgccugauguccuggcugcgcagcuccagcuga

SEQ ID NO: 30692 - RNA, 2196 nt, Artificial Sequence
  derived and/or modified sequence opt1 from GOLGA5__Homo_sapiens__NP_005104
augagcugguucguggaccuggccggcaaggccgaggaccuccugaaccgcgucgaccagggggcggccaccgcccugucccggaaggacaacgccagcaacaucuacuccaagaacaccgacuacacggagcuccaccagcagaacaccgaccugaucuaccagaccggccccaagagcaccuacaucuccagcgccgcggacaacauccgcaaccagaaggccacgauccuggccgggaccgccaacgugaaggugggcucccggaccccggucgaggcgagccaccccguggagaacgccuccgugccccgccccagcucccacuucguccggcgcaagaaguccgagccggacgacgagcuccuguucgacuuccugaacagcagccagaaggagcccaccgggcggguggagauccgcaaggagaagggcaagacgcccguguuccaguccagccagaccuccagcgucuccagcgugaaccccagcgugaccaccaucaagacgaucgaggagaacuccuucggcagccagacccacgaggccgccuccaacagcgacuccagccacgaggggcaggaggaguccagcaaggagaacgucuccagcaacgccgcgugcccggaccacacccccacccccaacgacgacggcaagucccacgagcucagcaaccugcggcuggagaaccagcuccugcgcaacgaggugcagucccugaaccaggagauggccagccuccugcagcgguccaaggagacgcaggaggagcugaacaaggcccgcgcccggguggagaaguggaacgccgaccacagcaaguccgaccgcaugacccgggggcuccgcgcgcaggucgacgaccugaccgaggccguggccgccaaggacagccagcuggccgugcucaagguccggcugcaggaggcggaccagcugcucuccacccgcacggaggcccuggaggcccugcagagcgagaagucccggaucaugcaggaccagagcgagggcaacagccuccagaaccaggcccugcagacccugcaggagcgccuccacgaggccgacgcgacccugaagcgggagcaggaguccuacaagcagaugcagagcgaguucgccgcccgccugaacaagguggagauggagcgccagaaccucgccgaggcgaucacccuggccgagcggaaguacuccgacgagaagaagcgcguggacgagcugcagcagcaggucaagcucuacaagcugaaccuggagagcuccaagcaggagcucaucgacuacaagcagaaggccacgcggauccugcagagcaaggagaagcugaucaacucccucaaggaggggagcggcuucgagggccuggacuccagcaccgccuccagcauggagcuggaggagcuccgccacgagaaggagaugcagcgggaggagauccagaagcugauggggcagauccaccagcugcgcuccgagcuccaggacauggaggcccagcaggucaacgaggcggagagcgcccgggagcagcugcaggaccugcacgaccagaucgccggccagaaggccuccaagcaggagcuggagaccgagcucgagcgccugaagcaggaguuccacuacaucgaggaggaccuguaccggaccaagaacacgcuccagagccgcaucaaggaccgggacgaggagauccagaagcugcgcaaccagcugaccaacaagacccucagcaacuccagccaguccgagcuggagaaccggcugcaccagcucaccgagacgcugauccagaagcagaccaugcuggagagccucuccaccgagaagaacagccugguguuccagcuggagcgccucgagcagcagaugaacuccgccagcggguccagcuccaacggcagcuccaucaacaugagcggcaucgacaacggggagggcacccggcugcgcaacgugcccgugcuguucaacgacacggagaccaaccucgcggggauguacggcaagguccggaaggccgccuccagcaucgaccaguucuccauccgccuggggaucuuccugcggcgcuacccgaucgcccgcguguucgugaucaucuacauggcccuccugcaccugugggucaugaucgugcuccugaccuacacccccgagaugcaccacgaccagcccuacggcaaguga

SEQ ID NO: 30693 - RNA, 1812 nt, Artificial Sequence
  derived and/or modified sequence opt1 from GOLGA8B__Homo_sapiens__NP_001018861
auggccgaggagaccggccagagcaagcuggccgcggccaagaagaaguucaaggaguacuggcagcgcaaccggcccggggugccggccgccgccaagcgcaacaccaaggcgaacggcuccagccccgagacggccgccuccgggggcugccacagcuccgaggccagcuccagcgcguccagcucccuccacgcccggcagagccccugccaggagcaggccgccguccugaacucccgcagcaucaagaucucccggcugaacgacaccaucaagagccucaagcagcagaagaagcaggucgagcaccagcuggaggaggagaagaaggccaacaacgagaagcagaaggcggagcgcgagcuggaggggcagauccagcggcucaacaccgagaagaagaagcugaacaccgaccuguaccacaugaagcacucccuccgcuacuucgaggaggagagcaaggaccuggccggccggcugcagcgcuccagccagcggaucggcgagcucgaguggagccugugcgccguggccgccacgcagaagaagaagcccgacggguucuccagccgcuccaaggcgcugcucaagcggcagcuggagcagagcauccgcgagcagauccugcucaagggccacgugacccagcugaaggagucccugaaggaggugcagcucgagcgggaccaguacgccgagcagaucaagggggagcgcgcccaguggcagcagcggaugcgcaagaugagccaggaggugugcacccugaaggaggagaagaagcacgacacccaccgggucgaggagcuggagcgcucccucagccggcugaagaaccagauggccgagccgcugccgcccgacgcccccgcgguguccagcgagguggagcuccaggaccugcgcaaggagcuggagcgcgucgccggcgagcuccaggcccagguggagaacaaccagugcaucucccugcugaaccgggggcagaaggagcgccuccgggagcaggaggagcgccugcaggagcagcaggagcggcugcgcgagcgggagaagcgccuccagcagcuggccgagccgcagagcgaccuggaggagcucaagcacgagaacaaguccgcccugcagcuggagcagcaggucaaggagcuccaggagaagcugggccaggugauggagacgcugaccagcgcggagaaggagcccgaggccgccgugcccgccuccggcaccgggggcgagagcuccgggcucauggaccugcuggaggagaaggcggaccuccgggagcacguggagaagcuggagcugggcuucauccaguaccgccgggagcgcugccaccagaagguccaccggcugcucaccgagcccggcgacagcgccaaggacgccucccccgggggcgggcaccaccaggccggccccgggcagggcggcgaggagggggaggccgcgggcgccgccggggacggcguggccgccugcgggagcuacagcgagggccacggcaaguuccuggcggccgcccgcaaccccgccgccgagcccuccccgggggcgcccgcgccccaggagcugggcgccgccgacaagcacggggaccucugcgaggccagccugacgaacuccguggagcccgcccagggcgaggcccgggaggggagcucccaggacaacccgaccgcccagcccguccugcagcuccugggcgagaugcaggaccaccaggagcaccccggccuggggagcaacugcugcgugcccugcuucugcugggccuggcucccgcgccggcgccgguga

SEQ ID NO: 30694 - RNA, 9810 nt, Artificial Sequence
  derived and/or modified sequence opt1 from GOLGB1__Homo_sapiens__NP_001243415
augcugagccgccuguccggccuggccaacguggugcugcacgagcugagcggggacgacgacaccgaccagaacaugcgggcgccccuggaccccgagcugcaccaggaguccgacauggaguucaacaacaccacgcaggaggacgugcaggagcgccuggccuacgccgagcagcuggugguggagcugaaggacaucauccggcagaaggacgugcagcuccagcagaaggacgaggcccugcaggaggagcgcaaggccgccgacaacaagaucaagaagcugaagcuccacgccaaggccaagcugaccagccugaacaaguacaucgaggagaugaaggcccagggcgggaccgugcuccccaccgagccccaguccgaggagcagcugagcaagcacgacaaguccagcacggaggaggagauggagaucgagaagaucaagcacaagcugcaggagaaggaggagcucaucuccacccugcaggcccagcugacccaggcgcaggccgagcagcccgcccagagcuccaccgagauggaggaguucgugaugaugaagcagcagcuccaggagaaggaggaguucaucagcacgcugcaggcccagcugucccagacccaggccgagcaggcggcccagcucagcuccaugcagcaggucgugcgggagaaggacgcccgcuucgagacccaggugcggcugcacgaggacgagcugcuccagcuggugacccaggccgacguggagacggagaugcagcagaagcugcgcguccuccagcggaagcuggaggagcacgaggagagccuggugggccgcgcccagguggucgaccuccugcagcaggagcugaccgcggccgagcagcggaaccagauccucucccagcagcugcagcagauggaggccgagcacaacacccugcgcaacaccguggagacggagcgggaggagagcaagauccuccuggagaagauggagcuggagguggccgagcgcaagcucuccuuccacaaccugcaggaggagaugcaccaccuccuggagcaguucgagcaggccgggcaggcgcaggccgagcuggagagccgguacagcgcccuggagcagaagcacaaggccgagauggaggagaagaccucccacauccucagccugcagaagaccggccaggagcugcaguccgccugcgacgcgcugaaggaccagaacagcaagcuccugcaggacaagaacgagcaggccguccaguccgcccagaccauccagcagcuggaggaccagcuccagcagaaguccaaggagaucagccaguuccugaaccgccugccgcuccagcagcacgagacggccagccagaccuccuuccccgacguguacaacgagggcacccaggcggugaccgaggagaacaucgccagccugcagaagcgggucguggagcuggagaacgagaagggggcccuccugcuguccagcaucgagcucgaggagcugaaggccgagaacgagaagcuguccagccagaucacgcuccuggaggcccagaaccgcaccggcgaggcggaccgggagguguccgagaucagcaucgucgacaucgccaacaagcgcuccagcuccgccgaggagagcgggcaggacgugcuggagaacaccuucagccagaagcacaaggagcucuccguccugcugcucgagaugaaggaggcccaggaggagaucgccuuccugaagcugcagcuccagggcaagcgggcggaggaggccgaccacgaggugcuggaccagaaggagaugaagcagauggagggggagggcaucgcccccaucaagaugaagguguuccuggaggacaccggccaggacuucccccucaugccgaacgaggagagcucccugcccgccgucgagaaggagcaggccagcacggagcaccagucccgcaccagcgaggagaucucccugaacgacgcggggguggagcucaagagcaccaagcaggacggcgacaagucccugagcgccgugcccgacaucgggcagugccaccaggacgagcuggagcgccucaagucccagauccuggagcuggagcucaacuuccacaaggcccaggagaucuacgagaagaaccuggacgagaaggccaaggagaucagcaaccugaaccagcucaucgaggaguucaagaagaacgcggacaacaacuccagcgccuucaccgcccuguccgaggagcgggaccagcugcucagccaggucaaggagcuguccauggugacggagcugcgcgcccaggugaagcagcucgagaugaaccuggccgaggcggagcggcagcgccggcuggacuacgagagccagaccgcccacgacaaccuccugaccgagcagauccacagccuguccaucgaggccaagagcaaggacgucaagaucgaggugcuccagaacgagcuggacgacgugcagcugcaguucuccgagcagagcacccucauccgcucccugcagagccagcugcagaacaaggaguccgagguccucgagggcgccgagcgggugcgccacaucagcuccaagguggaggagcugagccaggcccugucccagaaggagcucgagaucacgaagauggaccagcugcugcucgagaagaagcgggacgucgagacccugcagcagaccaucgaggagaaggaccagcaggucaccgagaucagcuucuccaugaccgagaagauggugcagcugaacgaggagaaguucagccucggcgucgagaucaagacgcugaaggagcagcugaaccuccugucccgcgcggaggaggccaagaaggagcaggucgaggaggacaacgaggugagcuccgggcugaagcagaacuacgacgagaugagccccgccggccagaucuccaaggaggagcuccagcacgaguucgaccugcugaagaaggagaacgagcagcggaagcgcaagcuccaggccgcccugaucaaccggaaggagcugcuccagcgcgucagccggcuggaggaggagcuggcgaaccucaaggacgagagcaagaaggagaucccgcuguccgagaccgagcgcggggagguggaggaggacaaggagaacaaggaguacagcgagaagugcgugaccuccaagugccaggagaucgagaucuaccugaagcagaccaucagcgagaaggaggucgagcuccagcacauccggaaggaccuggaggagaagcuggccgccgaggagcaguuccaggcccucgugaagcagaugaaccagacgcugcaggacaagaccaaccagaucgaccugcuccaggcggagaucuccgagaaccaggccaucauccagaagcugaucaccagcaacaccgacgccuccgacggcgacagcguggcccuggucaaggagacgguggugaucagcccgcccugcaccgggagcuccgagcacuggaagcccgagcucgaggagaagauccuggcccuggagaaggagaaggagcagcugcagaagaagcuccaggaggcgcugaccagccgcaaggccauccugaagaaggcccaggagaaggagcggcaccuccgcgaggagcugaagcagcagaaggacgacuacaaccgccugcaggagcaguucgacgagcaguccaaggagaacgagaacaucggcgaccagcuccggcagcugcagauccagguccgcgagagcaucgacggcaagcugccguccaccgaccagcaggagagcugcuccagcacgcccgggcucgaggagccccuguucaaggccaccgagcagcaccacacccagcccgugcuggaguccaaccucugcccggacuggcccagccacagcgaggacgccuccgcgcugcagggcgggaccagcguggcccagaucaaggcccagcugaaggagaucgaggccgagaaggucgagcucgagcugaagguguccagcacgaccuccgagcugaccaagaaguccgaggagguguuccagcuccaggagcagaucaacaagcagggccuggagaucgagucccugaagaccgucagccacgaggccgaggugcacgcggagucccuccagcagaagcuggagagcucccagcugcagaucgccgggcucgagcaccuccgggagcugcagcccaagcucgacgagcugcagaagcugaucagcaagaaggaggaggacguguccuaccucagcggccagcuguccgagaaggaggccgcccugacgaagauccagaccgagaucaucgagcaggaggaccucaucaaggcccugcacacccagcuggagaugcaggcgaaggagcacgacgagcgcaucaagcagcuccaggucgagcugugcgagaugaagcagaagcccgaggagaucggcgaggagagccgggccaagcagcagauccagcgcaagcugcaggccgcccucaucucccggaaggaggcgcugaaggagaacaagagccugcaggaggagcucucccuggcccgcgggaccaucgagcggcugaccaagagccucgccgacguggagagccagguguccgcccagaacaaggagaaggacaccguccugggccgccuggcccuccugcaggaggagcgggacaagcugaucaccgagauggaccgcagccuccuggagaaccagucccugagcuccagcugcgagucccucaagcuggcgcuggaggggcucaccgaggacaaggagaagcuggugaaggagaucgagagccugaaguccagcaagaucgccgaguccacggaguggcaggagaagcacaaggagcuccagaaggaguacgagauccugcugcagagcuacgagaacguguccaacgaggccgagcggauccagcacgucguggaggccgugcgccaggagaagcaggagcucuacggcaagcugcggagcaccgaggccaacaagaaggagaccgagaagcagcugcaggaggcggagcaggagauggaggagaugaaggagaagaugcgcaaguucgccaaguccaagcagcagaagauccucgagcuggaggaggagaacgaccggcugcgcgccgagguccacccggccggggacaccgccaaggagugcauggagacgcuccugagcuccaacgcgagcaugaaggaggagcuggagcgggugaagauggaguacgagacccucuccaagaaguuccagagccugaugagcgagaaggacucccugagcgaggaggugcaggaccucaagcaccagaucgagggcaacgucuccaagcaggccaaccuggaggccaccgagaagcacgacaaccagaccaacgugacggaggagggcacccagagcauccccggggagaccgaggagcaggacucccugagcauguccacccgccccacgugcagcgaguccguccccagcgccaaguccgcgaacccggccgugagcaaggacuucuccagccacgacgagaucaacaacuaccuccagcagaucgaccagcugaaggagcggaucgccggccuggaggaggagaagcagaagaacaaggaguucucccagacgcucgagaacgagaagaacacccugcugagccagaucuccaccaaggacggggagcucaagaugcugcaggaggaggugaccaagaugaaccugcucaaccagcagauccaggaggagcugagccgcgucacgaagcugaaggagaccgccgaggaggagaaggacgaccucgaggagcgccugaugaaccagcuggccgagcucaacggcuccaucggcaacuacugccaggacgugaccgacgcgcagaucaagaacgagcugcuggagagcgagaugaagaaccucaagaagugcgugagcgagcuggaggaggagaagcagcagcuggucaaggagaagaccaagguggaguccgagauccggaaggaguaccucgagaagauccagggggcccagaaggagcccggcaacaagagccacgccaaggagcugcaggagcugcugaaggagaagcagcaggaggugaagcagcuccagaaggacugcauccgcuaccaggagaagaucuccgcccuggagcggacggucaaggcccuggaguucgugcagaccgagagccagaaggaccucgagaucaccaaggagaaccuggcgcaggccguggagcaccgcaagaaggcccaggccgagcuggccuccuucaagguccuccuggacgacacccagagcgaggcggcccgggugcuggccgacaaccucaagcugaagaaggagcugcaguccaacaaggagagcgugaagucccagaugaagcagaaggacgaggaccucgagcgccggcuggagcaggccgaggagaagcaccugaaggagaagaagaacaugcaggagaagcucgacgcgcugcgccgggagaagguccaccuggaggagacgaucggggagauccaggugacccucaacaagaaggacaaggaggugcagcagcugcaggagaaccuggacagcaccgucacccagcucgccgccuucacgaaguccaugagcucccugcaggacgaccgcgaccgggugaucgacgaggccaagaagugggagcgcaaguucagcgacgccauccaguccaaggaggaggagauccggcugaaggaggacaacugcagcgugcucaaggaccagcugcgccagauguccauccacauggaggagcugaagaucaacaucagccggcucgagcacgacaagcagaucugggagagcaaggcgcagaccgagguccagcugcagcagaaggugugcgacacccugcagggcgagaacaaggagcuccugucccagcuggaggagacccgccaccucuaccacagcucccagaacgagcuggccaagcuggagagcgagcucaagucccugaaggaccagcugacggaccucagcaacucccuggagaagugcaaggagcagaaggggaaccuggagggcaucauccggcagcaggaggccgacauccagaacagcaaguucuccuacgagcagcucgagaccgaccugcaggccagccgcgagcugaccucccggcuccacgaggagaucaacaugaaggagcagaagaucaucagccugcuguccggcaaggaggaggccauccagguggcgaucgccgagcuccgccagcagcacgacaaggagaucaaggagcuggagaaccugcucagccaggaggaggaggagaacaucguccuggaggaggagaacaagaaggccguggacaagaccaaccagcugauggagacgcucaagaccaucaagaaggagaacauccagcagaaggcccagcuggacuccuucgucaagagcauguccagccugcagaacgaccgcgaccggaucgucggggacuaccagcagcucgaggagcgccaccuguccaucauccuggagaaggaccagcucauccaggaggccgcggccgagaacaacaagcugaaggaggagauccggggccugcgcagccacauggacgaccucaacagcgagaacgccaagcuggacgccgagcugauccaguaccgggaggaccucaaccaggugaucaccaucaaggacucccagcagaagcagcugcuggaggugcagcuccagcagaacaaggagcuggagaacaaguacgccaagcuggaggagaagcucaaggagagcgaggaggcgaacgaggaccugcgccgguccuucaacgcccugcaggaggagaagcaggaccucagcaaggagaucgagucccugaaggucagcaucucccagcugacccgccaggugacggcccuccaggaggaggggacccugggccuguaccacgcccagcucaaggugaaggaggaggagguccaccggcugagcgcgcuguucuccagcucccagaagcgcaucgccgagcucgaggaggagcuggugugcgugcagaaggaggccgccaagaaggucggggagaucgaggacaagcugaagaaggagcucaagcaccuccaccacgacgccggcaucaugcggaacgagaccgagaccgcggaggagcgcguggccgagcuggcccgggaccucguggagauggagcagaagcugcugauggucacgaaggagaacaagggccucaccgcccagauccagagcuucgggcgcuccaugagcucccugcagaacagccgggaccacgccaacgaggagcuggacgagcucaagcgcaaguacgacgcgucccugaaggagcuggcccagcugaaggagcagggccuccugaaccgggagcgcgacgcccugcucagcgagaccgccuucuccaugaacagcaccgaggagaacagccugucccaccuggagaagcucaaccagcagcugcugagcaaggacgagcagcuccugcaccuguccagccagcucgaggacuccuacaaccaggugcagagcuucuccaaggccauggcgagccugcagaacgagcgggaccaccuguggaacgagcucgagaaguuccgcaaguccgaggaggggaagcagcggagcgccgcccagcccuccacgagcccggccgaggugcagucccugaagaaggcgaugagcucccugcagaacgaccgcgaccgccuccugaaggagcugaagaaccuccagcagcaguaccugcagaucaaccaggagaucaccgagcugcacccccucaaggcccagcugcaggaguaccaggacaagaccaaggccuuccagaucaugcaggaggagcugcggcaggagaaccucagcuggcagcacgagcugcaccagcugcgcauggagaaguccagcugggagauccacgagcggcgcaugaaggagcaguaccucauggccaucuccgacaaggaccagcagcugagccaccuccagaaccucauccgggagcugcgcagcuccagcucccagacccagccccugaagguccaguaccagcggcaggccagccccgagaccuccgcgagcccggacggcucccagaaccucguguacgagacggagcugcugcgcacccagcucaacgacagccugaaggagauccaccagaaggagcugcggauccagcagcucaacuccaacuucagccagcugcuggaggagaagaacacccucuccauccagcugugcgacaccagccagucccugcgcgagaaccagcagcacuacggggaccuccugaaccacugcgccgugcuggagaagcagguccaggagcuccaggccgugagcaaggagaagggcccccugaacaucgacguggcccccggcgcgccccaggagaagaacgggguccaccggaaguccgacccggaggagcugcgcgagccccagcagagcuucuccgaggcgcagcagcagcucugcaacacgcggcaggaggugaacgagcugcgcaagcugcucgaggaggagcgggaccagcgcguggccgccgagaacgcccugagcgucgccgaggagcagauccggcgccuggagcacuccgagugggacagcagccggacccccaucaucggcuccugcgggacccaggagcaggcgcuccugaucgaccugaccagcaacuccugccgccgcacgcggagcggcgugggguggaagcgcguccuccggucccugugccacagccgcacccgggugccccugcucgccgccaucuacuuccugaugauccacgugcugcucauccugugcuucaccggccaccuguga

SEQ ID NO: 30695 - RNA, 1206 nt, Artificial Sequence
  derived and/or modified sequence opt1 from GOLM1__Homo_sapiens__NP_808800
augaugggccuggggaacggccgccggagcaugaaguccccgccccucgugcuggccgcccuggucgcgugcaucaucgugcucggguucaacuacuggaucgccagcucccgcagcguggaccugcagacccggaucauggagcuggagggccgcguccggcgcgccgccgccgagcgcggggcgguggagcucaagaagaacgaguuccagggcgagcuggagaagcagcgggagcagcuggacaagauccaguccagccacaacuuccagcucgaguccgugaacaagcuguaccaggacgagaaggccguccuggugaacaacaucaccacgggcgagcggcucauccgcgugcugcaggaccagcugaagacccuccagcggaacuacgggcgccugcagcaggacguccugcaguuccagaagaaccagaccaaccucgagcggaaguucagcuacgaccugucccagugcaucaaccagaugaaggaggugaaggagcagugcgaggagcgcaucgaggaggugaccaagaagggcaacgaggccgucgccagccgggaccuguccgagaacaacgaccagcgccagcagcuccaggcgcugagcgagccccagccccggcugcaggccgccgggcucccccacacggaggugccgcagggcaaggggaacgugcugggcaacuccaagagccagacccccgcccccuccagcgaggucgugcuggacuccaagcgccagguggagaaggaggagaccaacgagauccaggucgugaacgaggagccccagcgggaccgccucccgcaggagcccggccgggagcaggucguggaggaccgccccgucgggggccgcggguucggcggcgccggggagcugggccagacgccccaggugcaggcggcccugagcgugucccaggagaacccggagauggaggggcccgagcgggaccagcucgugauccccgacggccaggaggaggagcaggaggccgccggggagggccgcaaccagcagaagcugcggggcgaggacgacuacaacauggacgagaacgaggccgagagcgagaccgacaagcaggcggcccuggccgggaacgaccgcaacaucgacgucuucaacguggaggaccagaagcgggacaccaucaaccuccuggaccagcgcgagaagcggaaccacacccuguga

SEQ ID NO: 30696 - RNA, 897 nt, Artificial Sequence
  derived and/or modified sequence opt1 from GOLPH3__Homo_sapiens__NP_071413
augaccagccugacccagcgcuccagcggccucgugcagcggcgcacggaggccucccggaacgccgcggacaaggagcgcgccgccgggggcggggccggcagcuccgaggacgacgcccagagccggcgcgacgagcaggacgacgacgacaagggggacuccaaggagacccggcugacccugauggaggagguccuccugcugggccucaaggaccgcgagggcuacaccagcuucuggaacgacugcaucuccagcgggcugcggggcugcaugcugaucgagcucgcgcugcgcgggcggcugcagcucgaggccugcggcaugcgccggaagucccugcugacgcgcaaggugaucugcaagagcgacgcccccaccggggacgugcuccuggacgaggcccugaagcacgucaaggagacccagccgcccgagaccgugcagaacuggaucgagcuccuguccggcgagacguggaacccccugaagcuccacuaccagcugcggaacgugcgcgagcggcuggcgaagaaccucgucgagaagggcgugcugaccaccgagaagcagaacuuccuccuguucgacaugaccacgcacccccugaccaacaacaacaucaagcagcgccugaucaagaaggugcaggaggccguccucgacaagugggugaacgacccgcaccggauggaccgccggcugcuggcccucaucuaccuggcccacgccagcgacgugcuggagaacgcguucgcgccccuccuggacgagcaguacgaccuggccaccaagcgcguccgccagcuccuggaccuggaccccgagguggagugccucaaggccaacaccaacgaggugcugugggccgucguggccgccuucacgaaguga

SEQ ID NO: 30697 - RNA, 399 nt, Artificial Sequence
  derived and/or modified sequence opt1 from GOLT1A__Homo_sapiens__NP_940849
augaucagcaucaccgaguggcagaagaucggcguggggaucaccggcuucgggaucuucuucauccuguucggcacgcuccuguacuucgacuccguccugcucgcguucgggaaccugcuguuccucaccggccugagccugaucaucggccuccgcaagaccuucugguucuucuuccagcggcacaagcugaaggggaccuccuuccugcucggcgggguggugaucguccugcugcgcuggccccuccugggcauguuccuggagacguacggguucuucagccucuucaagggcuucuucccgguggccuucggcuuccuggggaacgugugcaacauccccuuccugggcgcccucuuccggcgccugcaggggaccuccagcauggucuga

SEQ ID NO: 30698 - RNA, 417 nt, Artificial Sequence
  derived and/or modified sequence opt1 from GOLT1B__Homo_sapiens__NP_057156
augaucagccugaccgacacccagaagaucggcauggggcucacgggcuucgggguguucuuccuguucuucggcaugauccuguucuucgacaaggcccuccuggccaucgggaacguccuguucguggcgggccucgccuucgugaucggccuggagcgcaccuuccgguucuucuuccagaagcacaagaugaaggccaccggguucuuccugggcggggucuucguggugcucaucggcuggccccugaucgggaugaucuucgagaucuacggcuucuuccuccuguuccgcggcuucuucccggucguggugggguucauccggcgcguccccgugcugggcucccugcucaaccugcccgggauccggagcuucguggacaaggucggcgaguccaacaacaugguguga

SEQ ID NO: 30699 - RNA, 6723 nt, Artificial Sequence
  derived and/or modified sequence opt1 from GON4L__Homo_sapiens__NP_001269787
augcuccccugcaagaagcgccggaccaccgugacggagagccuccagcacaagggcaaccaggaggagaacaacgucgaccuggagagcgccgugaagcccgagagcgaccaggugaaggaccugagcagcgucagccucagcugggaccccucccacgggcgcguggccggcuucgaggugcagagccugcaggacgccgggaaccagcugggcauggaggacaccucccucagcuccgggaugcugacccagaacaccaacguccccauccuggagggcguggacguggccaucagccagggcaucacccuccccucccuggagagcuuccacccccugaacauccacaucgggaagggcaagcuccacgccaccggguccaagcggggcaagaagaugacccugcgccccgggcccgucacccaggaggaccggugcgaccaccugacgcucaaggagcccuucagcggcgagcccuccgaggaggugaaggaggagggcgggaagccccagaugaacagcgagggcgagauccccucccugcccagcgggagccaguccgccaagcccgugagccagccccgcaaguccacccagcccgacgucugcgccagcccccaggagaagccccugcggacccucuuccaccagcccgaggaggagaucgaggacggcggccuguucauccccauggaggagcaggacaacgaggaguccgagaagcgccggaagaagaagaaggggaccaagcgcaagcgggacggccgcgggcaggagggcacgcuggccuacgaccucaagcuggacgacaugcuggaccggacccucgaggacggggccaagcagcacaaccugaccgccgugaacgugcgcaacauccugcacgaggucaucaccaacgagcacgugguggccaugaugaaggccgccaucagcgagacggaggacaugcccauguucgagcccaagaugacccgguccaagcucaaggaggucguggagaagggcguggucauccccaccuggaacaucagccccaucaagaaggccaacgagaucaagccgccccaguucguggacauccaccuggaggaggacgacuccagcgacgaggaguaccagcccgacgacgaggaggaggacgagaccgccgaggagucccugcucgagagcgacguggaguccacggccagcagcccccgcggcgcgaagaagucccggcugcgccaguccagcgagaugaccgagaccgacgaggaguccgggauccugagcgaggccgagaaggucaccacgcccgccauccggcacaucagcgccgaggugguccccauggggcccccgccgccgcccaagcccaagcagacccgcgacuccaccuucauggagaagcuccacgccguggacgaggagcuggcgagcucccccgugugcauggacagcuuccagcccauggacgacucccugaucgccuuccggacccgcagcaagaugccccucaaggacgucccccuggggcagcuggaggccgagcuccaggcccccgacaucacgcccgacauguacgaccccaacaccgccgacgacgaggacuggaagauguggcugggcgggcugaugaacgacgacgugggcaacgaggacgaggcggacgacgacgacgaccccgaguacaacuuccucgaggaccuggacgagcccgacaccgaggacuuccgcaccgaccgggccgugcgcaucacgaagaaggaggucaacgagcugauggaggagcuguucgagaccuuccaggacgagaugggcuucuccaacauggaggacgacgggcccgaggaggaggagugcguggccgagccccggcccaacuucaacaccccgcaggcccugcgcuucgaggagccccuggccaaccuccugaacgagcagcaccggaccgugaaggagcuguucgagcagcugaagaugaagaaguccuccgcgaagcagcuccaggaggucgagaaggugaagccccagagcgagaaggugcaccagacgcugauccuggaccccgcccagcgcaagcggcuccagcagcagaugcagcagcacguccagcugcugacccagauccaccuccuggcgaccugcaacccgaaccugaaccccgaggccaccaccacgcgcaucuuccucaaggagcugggcaccuucgcgcaguccagcaucgcccugcaccaccaguacaaccccaaguuccagacccucuuccagcccugcaaccugaugggggccaugcagcugaucgaggacuucuccacccacgugagcaucgacugcuccccgcacaagacggugaagaagaccgccaacgaguuccccugccuccccaagcaggucgccuggauccuggcgaccagcaagguguucauguacccggagcugcuccccgugugcucccugaaggccaagaacccccaggacaagaucgucuucaccaaggccgaggacaaccugcucgcccugggccugaagcacuucgaggggacggaguuccccaacccgcucaucagcaaguaccugcugaccugcaagaccgcccaccagcucaccgugcggaucaagaaccugaacaugaaccgcgcgcccgacaacaucaucaaguucuacaagaagacgaagcagcugcccgugcucggcaagugcugcgaggagauccagccccaccaguggaagccgcccaucgagcgggaggagcaccgccugcccuucuggcugaaggccagccuccccuccauccaggaggagcugcggcacauggccgacggcgcccgcgaggucgggaacaugaccggcaccaccgagaucaacagcgaccggucccuggagaaggacaaccucgagcuggggagcgagucccgcuacccgcugcuccugcccaagggcguggugcugaagcucaagcccgucgccacgcgguucccccgcaaggcguggcggcagaagcgcagcuccgugcugaagccgcugcucauccagcccagccccucccugcagcccagcuucaacccgggcaagacccccgcccgcuccacccacagcgaggcgccgcccuccaagauggugcugcggaucccgcaccccauccagcccgccaccguccuccagacggugcccggggugccgccccugggcgucagcgggggcgaguccuucgagagccccgcggcccugccggccgugccgcccgaggcccgcaccuccuucccccucagcgagucccagacccugcugagcagcgccccggugcccaaggucaugcuccccucccuggcgcccagcaaguuccggaagccguacgugcgccggcgccccuccaagcggcgcggggugaaggccagccccugcaugaagcccgccccggucauccaccaccccgccuccgugaucuucaccgugcccgccacgaccgucaagaucgugagccugggcggcgggugcaacaugauccagcccgugaacgcggccgucgcccaguccccgcagaccauccccaucaccacgcuccuggugaaccccaccagcuuccccugcccgcugaaccagucccucguggccagcuccgucagcccccugaucguguccggcaacagcgugaaccugcccauccccuccaccccggaggacaaggcccacgucaacguggacaucgcgugcgccguggccgacggggagaacgccuuccagggccucgagcccaagcuggagccccaggagcugagcccccucuccgcgaccgucuucccgaagguggagcacagccccgggcccccgcuggccgacgccgagugccaggagggccuguccgagaacagcgccugccgguggacggucgugaagaccgaggagggccgccaggcccucgagccccugccccaggggauccaggagagccugaacaaccccaccccgggcgaccucgaggagaucgugaagauggagcccgaggaggcgcgggaggagaucuccgggagccccgagcgcgacaucugcgacgacaucaaggucgagcacgccguggagcuggacaccggcgcccccuccgaggagcugagcuccgccggggaggugacgaagcagaccguccuccagaaggaggaggagcggagccagccgaccaagacccccuccagcucccaggagccgcccgacgagggcaccagcggcacggacgugaacaagggguccagcaagaacgcccuguccagcauggacccggaggugcgccuguccuccccgcccggcaagcccgaggacuccagcuccgucgacgggcagagcgugggcaccccgguggggcccgagaccggcggcgagaagaacgggcccgaggaggaggaggaggaggacuucgacgaccucacccaggacgaggaggacgagaugagcuccgcgagcgaggaguccguccugagcgugcccgagcugcaggagacgauggagaagcucaccuggcuggccuccgagcggcgcaugagccaggagggcgaguccgaggaggagaacagccaggaggagaacuccgagccggaggaggaggaggaggaggaggccgaggggauggagagccugcagaaggaggacgagaugaccgacgaggccgugggcgacuccgccgagaagccgcccaccuucgcgagccccgagacggccccggaggucgagaccucccggacgccgcccggcgagagcaucaaggccgccgggaagggccgcaacaaccaccgggcccgcaacaagcgggggucccgcgcgcgcgccagcaaggacaccuccaagcuccugcugcucuacgacgaggacauccuggagcgggacccgcugcgcgagcagaaggaccucgccuucgcccaggcguaccugacgcgggugcgcgaggcccugcagcacauccccggcaaguacgaggacuuccuccaggugaucuacgaguucgagagcuccacccagcggcgcaccgccgucgaccuguacaagagccugcagauccugcuccaggacuggccccagcugcugaaggacuucgccgccuuccuccugcccgagcaggcgcuggccugcggccucuucgaggagcagcaggccuucgagaagucccggaaguuccugcgccagcuggagaucugcuucgccgagaacccgucccaccaccagaagaucaucaaggugcuccagggcugcgccgacugccugccccaggagaucaccgagcugaagacgcagauguggcagcuccugaagggccacgaccaccuccaggacgaguucagcaucuucuucgaccaccuccggcccgcggccucccgcaugggggacuucgaggagaucaacuggaccgaggagaaggaguacgaguucgacggcuucgaggagguggcccugcccgacgucgaggaggaggaggagccgcccaagauccccaccgccagcaagaacaagcggaagaaggagaucggggugcagaaccacgacaaggagaccgaguggcccgacggcgccaaggacugcgcgugcuccugccacgagggcgggccggacagcaagcugaagaaguccaagcgccggagcugcucccacugcagcuccaaggugugcgacagcaaguccuacaagagcaaggagccccacgagcucgucggcuccagcccccaccgcgaggccucccccaugccgggggccaaggaggccggccaggggaaggacaugauggaggaggaggcgcccgaggagcgggagagcacggaggccacccagucccgcaccgugcggaccacgcgcaagggcgagaugcccgugagcgggcuggccgucggcagcacccugcccuccccgcgggaggugaccgugaccgagcgccuccugcuggacgggcccccgccccacagccccgagacgccccaguucccgcccaccaccggcgccguccucuacaccgugaagcgcaaccaggugggcccggagguccgguccugccccaaggccagcccccgccugcagaaggagcgggaggggcagaaggcgguguccgagagcgaggcccugaugcucgugugggacgccuccgagacggagaagcugccgggcaccgucgagccgcccgccagcuuccugucccccgugagcuccaagacccgcgacgccggccggcgccacgugagcgggaagccggacacccaggagcgguggcuccccuccagccgcgcgcgggucaagacgcgcgaccggaccugccccgugcacgagucccccagcggcaucgacaccuccgagaccagcccgaaggcgccccgcgggggccuggccaaggacagcgggacccaggccaagggccccgagggcgagcagcagcccaaggccgcggaggccacggugugcgccaacaacuccaaggucagcuccaccggggagaagguggugcuguggacccgggaggccgaccgcgucauccucaccaugugccaggagcagggcgcgcagccgcagacguucaacaucaucagccagcagcuggggaacaagacccccgccgaggugucccaccgguuccgcgagcugaugcagcuguuccacaccgccugcgaggccagcuccgaggacgaggacgacgccaccagcacguccaacgcggaccagcugagcgaccacggcgaccugcucuccgaggaggagcuggacgaguga

SEQ ID NO: 30700 - RNA, 1365 nt, Artificial Sequence
  derived and/or modified sequence opt1 from GOPC__Homo_sapiens__NP_001017408
augagcgccggcgggcccugcccggccgcggccggcgggggccccgggggcgccuccugcagcgugggcgcccccgggggcgucuccauguuccgcuggcuggaggugcucgagaaggaguucgacaaggccuucguggacgucgaccugcugcucggggagaucgaccccgaccaggcggacaucaccuacgagggccggcagaagaugaccagccuguccagcugcuucgcccagcugugccacaaggcccaguccgugagccagaucaaccacaagcucgaggcccagcugguggaccugaaguccgagcucacggagacccaggcggagaaggucgugcuggagaaggaggugcacgaccagcugcuccagcugcacagcauccagcugcagcuccacgccaagaccgggcaguccgccgacagcggcaccaucaaggccaagcuggagcgcgagcuggaggccaacaagaaggagaagaugaaggaggcgcagcucgaggccgaggucaagcugcugcggaaggagaacgaggcccuccgccggcacaucgccgugcugcaggccgagguguacggcgcgcgccuggccgccaaguaccucgacaaggagcuggccgggcggguccagcagauccagcugcucggccgcgacaugaaggggccggcccacgacaagcuguggaaccagcuggaggcggagauccaccuccaccggcacaagacggugauccgcgccugccggggccgcaacgaccugaagcggcccaugcaggccccgcccggccacgaccaggacucccugaagaagucccagggggugggccccauccgcaagguccuccugcugaaggaggaccacgaggggcucggcaucagcaucaccgggggcaaggagcacggcgugcccauccugaucagcgagauccaccccgggcagcccgccgaccggugcggcgggcugcacgugggcgacgccauccucgcggucaacggggugaaccugcgcgacaccaagcacaaggaggccgugaccauccugucccagcagcggggcgagaucgaguucgaggucguguacguggccccggaggucgacagcgacgacgagaacguggaguacgaggacgaguccggccaccgcuaccggcucuaccuggacgagcuggagggcggcgggaaccccggggccagcugcaaggacacgagcggggagaucaagguccuccagggcuucaacaagaaggcggugaccgacacccacgagaacggcgaccuggggaccgccuccgagacgccccuggacgacggcgccagcaagcucgacgaccugcacacccuguaccacaagaaguccuacuga

SEQ ID NO: 30701 - RNA, 741 nt, Artificial Sequence
  derived and/or modified sequence opt1 from GORAB__Homo_sapiens__NP_001139511
augagcugggccgccgugcuggcggucgccgccgcccgcuucggccacuucugggggugccgguggcccggccccauggcccaggggugggcgggcuucuccgaggaggagcuccgccggcugaagcagaccaaggaccccuucgagccccagcgccggcugcccgccaagaagucccgccagcagcuccagcgggagaaggcccugguggagcagagccagaagcuggggcuccaggacggcagcaccucccugcugccggagcagcuccugagcgcccccaagcagcgcgugaacguccagaagccgcccuucuccagccccacgcugcccucccacuucacccucaccagccccgugggcgacgggcagccccagggcaucgagucccagccgaaggagcuggggcuggagaacagccacgacggccacaacaacguggagauccucccgcccaagcccgacugcaagcuggagaagaagaaggucgagcugcaggagaagucccggugggaggugcuccagcaggagcagcgccugauggaggagaagaacaagcggaagaaggcgcugcucgccaaggccaucgccgagcgcagcaagcggacccaggccgagacgaugaagcugaagcgcauccagaaggagcugcaggcgcucgacgacaugguguccgccgacaucgggauccugcggaaccgcaucgaccaggccagccuggacuacuccuacgcccgguga

SEQ ID NO: 30702 - RNA, 1323 nt, Artificial Sequence
  derived and/or modified sequence opt1 from GORASP1__Homo_sapiens__NP_114105
augggccugggggugagcgccgagcagcccgccggcggggcggagggcuuccaccuccacgggguccaggagaacuccccggcccagcaggccggccuggagcccuacuucgacuucaucaucaccaucggccacagccgccugaacaaggagaacgacacccucaaggcccugcugaaggccaacguggagaagcccgugaagcucgaggucuucaacaugaagacgaugcgggugcgcgagguggaggucgugcccuccaacaugugggggggccaggggcugcugggcgcgagcgugcgguucugcuccuuccgccgggccagcgagcaggucuggcacgugcucgacguggagccguccagccccgccgcccuggcggggcugcgccccuacaccgacuacgucgugggcuccgaccagauccuccaggagagcgaggacuucuucacccugaucgagucccacgagggcaagccccugaagcucaugguguacaacagcaaguccgacagcugccgggaggucaccgugacgccgaacgccgccugggggggcgaggggucccugggcugcggcaucggguacggcuaccugcaccgcauccccacccagccccccagcuaccacaagaagccgcccgggaccccccccccguccgcccucccccugggcgccccccccccggacgcgcugccccccgggcccaccccggaggacagccccucccucgagacgggcagccggcagagcgacuacauggaggcccugcugcaggcccccggcuccagcauggaggacccccucccggggcccggcucccccagccacuccgccccggaccccgacgggcugccccacuucauggagaccccccugcagccgcccccccccgugcagcgcgucauggacccgggcuuccucgacgugagcgggaucucccugcuggacaacagcaacgccuccguguggcccagccuccccuccagcaccgagcugaccacgaccgcggucuccaccagcggccccgaggacaucugcuccagcuccagcucccacgagcggggcggggaggccaccuggagcggcagcgaguucgagguguccuuccuggacagcccgggggcccaggcccaggccgaccaccucccccagcugacgcugcccgacucccucaccagcgcggccucccccgaggacggccugagcgccgagcugcucgaggcccaggccgaggaggagccggcguccaccgaggggcuggacaccggcacggaggccgagggccuggacagccaggcccagaucuccaccaccgaguga

SEQ ID NO: 30703 - RNA, 1359 nt, Artificial Sequence
  derived and/or modified sequence opt1 from GORASP2__Homo_sapiens__NP_056345
augggcagcucccagagcguggagauccccgggggcgggaccgagggcuaccacguccugcgcgugcaggagaacuccccggggcaccgggccggccucgagcccuucuucgacuucaucgugagcaucaacggcucccgccugaacaaggacaacgacacccugaaggaccuccugaaggccaacgucgagaagcccgugaagaugcugaucuacagcuccaagacgcucgagcugcgggagaccagcgugacccccuccaaccugugggggggccaggggcuccugggcgucagcauccgcuucugcuccuucgacggggcgaacgagaacguguggcacgugcuggaggucgagagcaacuccccggccgcccucgccggccugcggccccacagcgacuacaucaucggcgccgacaccgugaugaacgaguccgaggaccuguucagccucaucgagacgcacgaggcgaagccccugaagcuguacguguacaacaccgacaccgacaacugccgcgaggucaucaucacccccaacuccgccugggggggcgaggggagccucggcugcggcaucggguacggcuaccugcaccggaucccgacgcgccccuucgaggaggggaagaagaucucccugcccggccagauggccgggacccccaucaccccgcucaaggacggcuucaccgaggugcagcugagcagcgugaacccccccucccugagccccccgggcacgaccgggaucgagcagucccucaccggccugagcaucuccagcaccccccccgccgucuccagcgugcuguccacgggggugcccaccgucccgcuccugcccccccaggugaaccagagccugaccuccgugcccccgaugaaccccgcgaccacgcuccccggccugaugccccugccggccgggcuccccaaccugcccaaccugaaccucaaccugccggccccccacaucaugcccggcgucggccugcccgagcucgugaacccggggcugcccccccugcccagcaugccgccccggaaccuccccggcaucgccccccugccgcugcccuccgaguuccuccccagcuucccccuggugccggaguccagcuccgccgcgagcuccggggagcugcucagcagccugccccccaccuccaacgcccccagcgacccggccaccaccacggccaaggccgacgcggccuccagccugaccgucgacgugaccccccccaccgccaaggcccccacgaccgucgaggaccgcgugggcgacuccaccccggugagcgagaagcccgucuccgccgcgguggacgccaacgccagcgagucccccuga

SEQ ID NO: 30704 - RNA, 747 nt, Artificial Sequence
  derived and/or modified sequence opt1 from GOSR1__Homo_sapiens__NP_001007026
auggccgccggcaccagcuccuacugggaggaccugcgcaagcaggcgcggcagcucgagaacgagcuggaccugaagcucgugagcuucuccaagcugugcaccagcuacucccacagcuccacgcgcgacgggcggcgcgacagcuccgacaccacgccccugcucaacggcagcucccaggaccggauguucgagaccauggccaucgagaucgagcagcugcuggcccgccucaccggggucaacgacaagauggccgaguacaccaacagcgccggcgugccgucccugaacgcggcccugaugcacacccuccagcggcaccgcgacauccugcaggacuacacccacgaguuccacaagacgaaggccaacuucauggccauccgggagcgcgagaaccugauggggagcgugcggaaggacaucgaguccuacaagagcggcuccggcgucaacaaccgccggaccgagcuguuccugaaggagcacgaccaccuccgcaacagcgaccggcucaucgaggagaccaucuccaucgcgauggccaccaaggagaacaugacgagccagcgcgggaugcucaagagcauccacuccaagaugaacacccuggccaaccgguuccccgccgugaacagccugauccagcgcaucaaccugcggaagcgccgggacucccugauccucggcggggugaucggcaucugcaccauccugcugcuccuguacgccuuccacuga

SEQ ID NO: 30705 - RNA, 588 nt, Artificial Sequence
  derived and/or modified sequence opt1 from GOSR2__Homo_sapiens__NP_001012529
auggacccccuguuccagcagacccacaagcagguccacgagauccagagcugcaugggccgccucgagaccgccgacaagcaguccgugcacaucguggagaacgagauccaggccagcaucgaccagaucuucucccggcuggagcgccuggagauccucagcuccaaggagccgcccaacaagcggcagaacgcgcgccugcggguggaccagcugaaguacgacguccagcaccuccagacggcccugcgcaacuuccagcaccggcgccacgcccgggagcagcaggagcgccagcgggaggagcugcucagccgcaccuucaccaccaacgacuccgacacgaccauccccauggacgagagccugcaguucaacuccagccugcagaaggugcacaacgggauggacgaccucauccuggacggccacaacauccuggacgggcuccggacccagcgccugacccugaaggugggcucccuccugggggaccgggagaaggccagcugcuucucccugauccagcaguucagcaacugcgucuacauccucaucacgugcccccagaucgugaucuucuga

SEQ ID NO: 30706 - RNA, 1242 nt, Artificial Sequence
  derived and/or modified sequence opt1 from GOT1__Homo_sapiens__NP_002070
auggcgcccccgagcguguucgccgaggucccccaggcccagcccgugcugguguucaagcucaccgccgacuuccgcgaggaccccgacccgcggaaggucaaccugggcgugggggccuaccgcaccgacgacugccaccccugggugcugcccgucgugaagaagguggagcagaagaucgccaacgacaacucccucaaccacgaguaccugcccauccugggccucgccgaguuccggagcugcgcgucccgccuggcccugggggacgacagcccggcccucaaggagaagcgggucggcggggugcagucccugggcggcacgggggcccugcgcaucggcgcggacuuccucgcccggugguacaacgggaccaacaacaagaacacccccguguacgucagcucccccaccugggagaaccacaacgccguguucagcgccgccggcuucaaggacauccgcuccuaccgguacugggacgcggagaagcgcgggcuggaccugcagggcuuccucaacgaccuggagaacgcccccgaguucagcaucgugguccugcacgccugcgcccacaacccgacgggcaucgaccccacccccgagcaguggaagcagaucgccuccgugaugaagcaccgguuccucuuccccuucuucgacagcgcguaccagggguucgccuccggcaaccuggagcgcgacgccugggccauccgguacuucgugagcgagggguucgaguucuucugcgcccaguccuucagcaagaacuucggccuguacaacgagcgcgucggcaaccucaccgugguggggaaggagccggaguccauccugcagguccugagccagauggagaagaucgugcggaucaccugguccaacccgcccgcgcagggcgcccgcaucguggccagcacgcucagcaaccccgagcuguucgaggaguggaccgggaacgucaagaccauggccgaccggauccugaccaugcgcuccgagcuccgggcccgccuggaggcgcugaagacgcccggcaccuggaaccacaucaccgaccagaucgggauguucagcuucaccggccucaaccccaagcaggucgaguaccuggugaacgagaagcacaucuaccugcuccccuccggccggaucaacgugagcgggcugacgaccaagaaccuggacuacguggccaccuccauccacgaggccgucaccaagauccaguga

SEQ ID NO: 30707 - RNA, 1164 nt, Artificial Sequence
  derived and/or modified sequence opt1 from GOT2__Homo_sapiens__NP_001273149
auggcccugcuccacagcggccgcgugcugcccgggaucgccgcggccuuccacccgggccuggccgccgccgcguccgcccgggccagcuccugguggacccacgucgagauggggccgcccgaccccauccucggcgugaccgaggccuucaagcgcgacacgaacagcaagaagaugaaccugggggugggcgcguaccgggacgacaacggcaagcccuacguccugcccuccgugcgcaaguucgugaccguccagaccaucagcgggaccggcgcccuccggaucggggccuccuuccugcagcgcuucuucaaguucagccgggacguguuccugcccaagcccacguggggcaaccacaccccgaucuuccgcgacgccgggaugcagcuccagggcuaccgguacuacgaccccaagaccugcggcuucgacuucaccggggccguggaggacaucuccaagauccccgagcagagcguccugcugcuccacgcgugcgcccacaaccccacgggcguggacccgcgccccgagcaguggaaggagaucgccaccguggucaagaagcggaaccuguucgccuucuucgacauggccuaccagggguucgcguccggcgacggcgacaaggacgccugggccgugcgccacuucaucgagcaggggaucaacgugugccugugccagagcuacgccaagaacaugggccucuacggggagcgggucggcgccuucaccauggugugcaaggacgcggacgaggccaagcgcguggagucccagcugaagauccugauccggcccauguacagcaacccgccccucaacggggcccgcaucgccgccgcgauccugaacacccccgaccugcggaagcaguggcuccaggaggucaaggugauggccgaccgcaucaucggcaugcggacgcagcugguguccaaccugaagaaggagggcagcacccacaacuggcagcacaucaccgaccagaucgggauguucugcuucaccggccucaagcccgagcaggucgagcgccugaucaaggaguucuccaucuacaugacgaaggacgggcggaucagcguggccggcgugaccuccagcaacgucggguaccuggcccacgcgauccaccaggugaccaaguga

SEQ ID NO: 30708 - RNA, 1959 nt, Artificial Sequence
  derived and/or modified sequence opt1 from GP1BA__Homo_sapiens__NP_000164
augccccugcuccugcugcuccugcugcucccgagcccccugcacccccaccccaucugcgagguguccaaggucgccagccaccuggaggugaacugcgacaagcgcaaccucaccgcccugccgcccgaccugcccaaggacaccacgauccuccaccuguccgagaaccugcucuacaccuucagccuggcgacccugaugcccuacacccggcucacgcagcugaaccuggaccgcugcgagcucaccaagcuccagguggacggcacccugccgguccucgggacccuggaccugucccacaaccagcuccagagccugccccugcucggccagacgcugcccgcccugaccgugcucgacguguccuucaaccggcugaccagccugccccucggggcccugcgcggccugggggagcuccaggagcuguaccugaagggcaacgagcucaagacccugccgcccggccugcucacgcccacccccaagcuggagaagcugucccucgccaacaacaaccugaccgagcugccggccgggcugcucaacggccuggagaaccuggacacccuccugcugcaggagaacagccucuacacgauccccaagggguucuucggcucccaccuccugcccuucgcguuccugcacgggaaccccuggcugugcaacugcgagauccuguacuuccggcgcuggcuccaggacaacgccgagaacgucuacguguggaagcagggcguggacgucaaggccaugaccagcaacguggccuccgugcagugcgacaacagcgacaaguucccggucuacaaguaccccggcaaggggugccccacccugggcgacgagggggacaccgaccuguacgacuacuaccccgaggaggacacggagggcgacaaggugcgggcgacccgcaccguggucaaguucccgaccaaggcccacacgacccccuggggccucuucuacuccuggagcaccgccucccuggacagccagaugcccuccagccugcaccccacccaggagagcacgaaggagcagaccaccuucccgccccgguggacccccaacuucacgcuccacauggaguccaucaccuucagcaagaccccgaaguccaccacggagcccacccccagccccaccaccuccgagccggugcccgagcccgcccccaacaugaccacgcuggagccgacccccagccccaccacccccgagccgacguccgagcccgcccccagccccaccaccccggagcccaccuccgagcccgcgcccagcccgacgacccccgagcccaccuccgagcccgccccgagccccaccacgcccgagccgacccccauccccaccaucgccaccucccccacgauccuggugagcgccaccucccucaucacccccaagagcaccuuccugacgaccaccaagccggucucccugcucgagagcaccaagaagacgauccccgagcuggaccagcccccgaagcugcgcggggugcuccagggccaccuggaguccagccggaacgaccccuuccugcaccccgacuucugcugccuccugccccugggguucuacgugcucggccuguucuggcugcuguucgccagcgucgugcugauccugcuccuguccuggguggggcacgucaagccgcaggcgcuggacagcggccagggcgccgcccucaccaccgccacccagacgacccaccuggagcugcagcgcgggcgccaggugaccgucccccgggccuggcuccuguuccugcggggcucccuccccaccuuccgcagcucccuguuccugugggugcggcccaacgggcgcgugggcccgcucgucgcggggcggcgccccagcgcccugucccagggccggggccaggaccugcucagcacgguguccauccgcuacagcgggcacucccuguga

SEQ ID NO: 30709 - RNA, 621 nt, Artificial Sequence
  derived and/or modified sequence opt1 from GP1BB__Homo_sapiens__NP_000398
augggcagcgggccccgcggcgcccugucccuccugcugcuccugcuggccccgcccagccggcccgcggccgggugccccgccccgugcuccugcgccggcacccucguggacugcgggcgccggggccugaccugggccagccugcccacggcguuccccgucgacaccaccgagcucgugcugaccggcaacaaccugacggcccugcccccggggcuccuggacgcccuccccgcccugcgcaccgcgcaccugggcgccaaccccuggcggugcgacugccgccucgugccccugcgggccuggcuggccgggcgcccggagcgggcccccuaccgcgaccuccggugcgucgcgccgcccgcccugcgcggccggcugcuccccuaccuggccgaggacgagcugcgcgccgccugcgcgcccgggccccucugcuggggcgcccuggccgcccagcuggcccuccugggccuggggcuccugcacgcgcugcuccuggugcugcuccugugccggcugcgccggcuccgcgcccgggcccgcgcccgggccgcggcccgccugucccugaccgacccccucguggccgagcgcgccggcaccgacgagagcuga

SEQ ID NO: 30710 - RNA, 1614 nt, Artificial Sequence
  derived and/or modified sequence opt1 from GP2__Homo_sapiens__NP_001007241
augccccaccugauggagcgcauggugggcagcgggcuccuguggcuggcccucgucuccugcauccugacccaggccagcgcggugcagcggggcuacgggaacccgaucgaggccuccagcuacggccuggaccucgacugcggggcccccggcacccccgaggcccacgugugcuucgaccccugccagaacuacacgcugcuggacgagccguuccgcuccaccgagaacagcgccggcucccaggggugcgacaagaacaugagcggcugguaccgguucgucggggagggcggggugcgcauguccgagaccugcgugcagguccaccggugccagaccgacgcgcccauguggcucaacggcacgcaccccgcccugggcgacgggaucaccaaccacaccgccugcgcccacuggagcggcaacugcugcuucuggaagaccgaggugcuggugaaggcgugccccgggggcuaccacgucuaccgccucgagggcacgccguggugcaaccugcgguacugcaccgugccccgcgaccccuccaccguggaggacaagugcgagaaggccugccggcccgaggaggagugccuggcccucaacagcaccugggggugcuucugccgccaggaccugaacuccagcgacguccacucccugcagccgcagcucgacugcggcccccgggagaucaaggugaagguggacaagugccugcucgggggccucgggcugggcgaggaggucaucgccuaccugcgcgaccccaacugcagcuccauccuccagacggaggagcggaacugggugagcgugaccucccccguccaggccagcgcgugccgcaacauccuggagcggaaccagacccacgccaucuacaagaacacccugagccucgugaacgacuucaucauccgcgacacgauccugaacaucaacuuccagugcgccuacccgcuggacaugaaggugucccuccaggccgcccugcagcccaucgucagcucccugaacgugagcguggacggcaacggggaguucaucguccggauggcccucuuccaggaccagaacuacaccaaccccuacgagggcgacgcgguggagcuguccgucgagagcgugcuguacgugggggccauccucgagcagggcgacaccucccgcuucaaccugguccugcggaacugcuacgccacccccacggaggacaaggccgaccucgugaaguacuucaucauccgcaacagcugcuccaaccagcgggacagcaccauccacguggaggagaacgggcaguccagcgagucccgcuucagcguccagauguucauguucgcgggccacuacgaccugguguuccugcacugcgagauccaccucugcgacucccugaacgagcagugccagccgagcugcucccgcagccaggugcgguccgagguccccgccaucgaccuggcccgcgugcucgaccugggccccaucacccggcgcggggcccagagccccggcgugaugaacgggaccccgagcacggccggcuuccuggucgcguggcccauggugcuccugaccgugcugcuggccuggcuguucuga

SEQ ID NO: 30711 - RNA, 1683 nt, Artificial Sequence
  derived and/or modified sequence opt1 from GP5__Homo_sapiens__NP_004479
augcugcgcggcacccuccugugcgccgugcuggggcuccugcgggcccagcccuucccgugcccgcccgcgugcaagugcgucuuccgcgacgccgcccagugcagcggcggggacguggcccggaucuccgcccugggccuccccaccaaccugacgcacauccugcuguucgggaugggccgcggcgugcugcagagccaguccuucagcgggaugaccguccugcagcggcucaugaucuccgacagccacaucuccgcgguggcccccggcaccuucagcgaccugaucaagcugaagacccuccgccugucccggaacaagaucacgcaccuccccggggcccuccuggacaagauggugcugcucgagcagcuguuccuggaccacaacgcccuccgcggcaucgaccagaacauguuccagaagcuggucaaccugcaggagcucgcgcugaaccagaaccagcuggacuuccuccccgccagccuguucaccaaccuggagaaccucaagcugcuggaccucuccgggaacaaccugacccaccuccccaagggccugcugggcgcccaggccaagcuggagcggcuccugcugcacagcaaccgccucgugucccuggacagcgggcugcucaacucccugggcgcccugaccgagcugcaguuccaccggaaccacauccgcagcaucgcgccgggggccuucgaccggcuccccaaccuguccagccugacgcucucccgcaaccaccuggccuuccugcccagcgcccucuuccugcacagccacaaccugacccuccugacccuguucgagaacccccucgccgagcugccgggcgugcuguucggcgagaugggcgggcuccaggagcuguggcugaaccggacccagcuccgcacgcugcccgcggccgccuuccggaaccugucccgccuccgguaccugggggucacccugagcccccgccucuccgcccugccccagggcgccuuccaggggcugggcgagcuccaggugcuggcgcugcacagcaacggccucaccgcccugccggacgggcugcuccggggccuggggaagcugcgccaggugucccuccgccggaaccgccugcgggcccugccccgcgcccucuuccggaaccugagcucccuggagagcguccagcucgaccacaaccagcuggagacccugcccggcgacguguucggggcccucccccgccugacggaggugcugcucggccacaacuccuggcggugcgacugcggccuggggccguuccugggcuggcuccgccagcaccuggggcuggucggcggggaggagccgccccggugcgcgggccccggcgcccacgccgggcucccccugugggcccugcccggcggggacgcggagugccccggcccccgcggcccgccgccccggcccgccgccgacagcuccagcgaggcccccgugcaccccgcccucgcgcccaacuccagcgagccgugggugugggcccagcccgucaccaccgggaagggccaggaccacucccccuucuggggguucuacuuccugcugcucgccgugcaggccaugaucaccgugaucaucgucuucgccaugaucaagaucggccagcuguuccgcaagcugauccgggagcgcgcgcucggguga

SEQ ID NO: 30712 - RNA, 1863 nt, Artificial Sequence
  derived and/or modified sequence opt1 from GP6__Homo_sapiens__NP_001077368
augagccccuccccgaccgcccuguucugccucggccugugccuggggcgcgugcccgcccagagcggcccccuccccaagccgucccugcaggcgcugcccagcucccucgucccccuggagaagcccgugacccugcggugccaggggccgcccggcguggaccucuaccgccuggagaagcugagcuccagccgguaccaggaccaggccguccucuucauccccgccaugaagcgcucccuggccgggcgguaccgcugcagcuaccagaacggcucccuguggagccuccccuccgaccagcuggagcugguggccacgggcguguucgcgaagccgagccucuccgcccagcccgggcccgccgucagcuccggcggggacgugacccugcagugccagacccgguacggcuucgaccaguucgcccuguacaaggagggggaccccgcgccguacaagaaccccgagcgcugguaccgggccagcuuccccaucaucaccgugacggccgcccacuccggcaccuaccgcugcuacagcuucagcucccgggaccccuaccucuggagcgccccguccgacccccuggagcuggucgugaccggcaccagcgugacgcccucccgccuccccaccgagccgcccagccccgucgcggaguucuccgaggccaccgccgagcugaccgugagcuucacgaacgagguguucaccaccgagaccucccggagcaucacggccucccccaaggagagcgacuccccggccggggagagcugcccgcccguccugcaccagggccagcccgggcccgacaugccccgcggcugcgaccccaacaacccgggcgggguguccggccgggggcucgcgcagcccgaggaggcccccgccgcccagggccaggggugcgccgaggcggccagcgcgcccccggccccgcccgccgaccccgagaucaagcgcggcuccggcuggcggcccaccgggugcagccagccccgcgugauguucaugaccgccgagccccaggcccgguccuacccccgcgagggcagcuggcacgggcggcgccugaaggacuggcgcgucuggagcguggaggccggcgggcagcggcugcagcucuggaagcgcggccacgccgcguccagcuggugcuccauccgggagccguucggccagugccugagcgugugccugccccucugccugcgcgcccccuccaucugggacgggcggaaccuguggcgcccccacccgccgcccugcacccucuggaugacgugguaccccggcuggaccaccuacuggccccugagcuccaccagccugaucugggcccccgacgggucccuccgguuccccgcccugcgcgucgacagcgugccguccagcgugcagaacccgcccguccugcccuucggcccccucugcuccugccugguguucccccggaacagccacccccacuccaucagccacugcgggcugacgaaccuccuguccagccugcgcaccggccucgccggcagccuggggauguccuucaucuuccugagcgucaagcuggcgcggugcccccucccguucacccuggagaacaagaucucccugugcaacauggugaagccccaccucuaccagcagaacaagaagacccagaagcuggcccgcugcggcggggccagccuguacucccagcagcuccggggccugcgcugggagaacggccugagccucgggggccgggggugcuccgagcugcgcagccaccacugcacgcuggcccgggugaccaagcccgacuucgucuccaagaacaccggcaugaacaugagcaucacccucaucuga

SEQ ID NO: 30713 - RNA, 534 nt, Artificial Sequence
  derived and/or modified sequence opt1 from GP9__Homo_sapiens__NP_000165
augcccgccuggggcgcccuguuccuccugugggcgaccgccgaggccaccaaggacugcccgagccccugcacgugccgcgcccuggagaccauggggcucuggguggacugccggggccacgggcugaccgcccugcccgcgcuccccgcccgcacccggcaccuccugcuggccaacaacucccugcagagcgucccgcccggcgccuucgaccaccucccccagcugcagacgcuggacgugacccagaaccccuggcacugcgacugcucccugaccuaccuccgccuguggcuggaggaccggaccccggaggcgcuccuccaggugcgcugcgccagccccucccuggccgcccacgggccccugggccggcugacgggcuaccagcuggggagcugcggcuggcagcuccaggccuccuggguccgccccggggugcugugggacguggcgcuggucgccguggccgcccucggccuggcccugcucgcggggcugcugugcgccaccaccgaggcccucgacuga

SEQ ID NO: 30714 - RNA, 960 nt, Artificial Sequence
  derived and/or modified sequence opt1 from GPA33__Homo_sapiens__NP_005805
auggugggcaagauguggcccguccuguggacccucugcgccgugcgcgugaccgucgacgccaucagcguggagacgccccaggacgugcugcgggcgucccagggcaagagcgucacccugcccugcaccuaccacaccuccacgagcucccgcgaggggcucauccagugggacaagcugcugcucacccacaccgagcggguggugaucuggcccuucagcaacaagaacuacauccacggggagcuguacaagaaccgcgucuccaucagcaacaacgccgagcaguccgacgccagcaucaccaucgaccagcugacgauggccgacaacggcaccuacgagugcuccgugagccucauguccgaccuggaggggaacaccaagagccgggugcgccugcucguccuggugcccccguccaagcccgagugcggcaucgagggcgagaccaucaucgggaacaacauccagcugacgugccagagcaaggagggcucccccacgccccaguacagcuggaagcgguacaacauccucaaccaggagcagccgcuggcccagcccgcguccgggcagcccgugagccugaagaacaucagcaccgacaccuccggcuacuacaucugcaccagcuccaacgaggaggggacccaguucugcaacaucaccgucgccgugcgcagccccuccaugaacguggcccucuacgucggcaucgccgugggcguggucgcggcccugaucaucaucgggaucaucaucuacugcugcugcugccggggcaaggacgacaacaccgaggacaaggaggacgcccgcccgaaccgggaggccuacgaggagccgcccgagcagcugcgcgagcucagccgggagcgcgaggaggaggacgacuaccggcaggaggagcagcgcuccacggggcgggagagccccgaccaccuggaccaguga

SEQ ID NO: 30715 - RNA, 1866 nt, Artificial Sequence
  derived and/or modified sequence opt1 from GPAA1__Homo_sapiens__NP_003792
augggccugcucagcgaccccgugcgccggcgcgcccuggcccggcugguccuccgccugaacgcgccgcugugcgugcucuccuacguggccgggaucgccugguuccuggcccuggucuucccgccccucacccagcggaccuacaugagcgagaacgccaugggcuccacgaugguggaggagcaguucgccgggggcgaccgcgcccgggccuucgcccgcgacuucgcggcccaccggaagaaguccggggcccugcccguggccuggcuggagcgcaccaugcggagcgucggccucgagguguacacccagagcuucucccgcaagcugcccuuccccgacgagacccacgagcgguacauggugagcggcacgaacgucuacgggauccugcgcgcgccccgggcggccuccaccgagagccucgugcugaccgugcccugcggcuccgacagcaccaacucccaggccgucgggcugcuccuggcccuggccgcgcacuuccgcggccagaucuacugggccaaggacaucguguuccucgugacggagcacgaccugcuggggaccgaggccuggcucgaggccuaccacgacgucaacgugaccggcaugcagagcuccccgcugcagggccgggccggggcgauccaggccgccguggcccuggagcucagcuccgacgucgugaccagccuggacguggccgucgagggccugaacgggcagcuccccaaccuggaccugcucaaccuguuccagacguucugccagaagggcggccugcucugcacccugcaggggaagcugcagcccgaggacuggaccucccucgacggcccccugcaggggcugcagacccuccugcugauggugcuccgccaggcgagcggccggccgcacgggagccacggccuguuccugcgcuaccggguggaggcccucacgcugcgcggcaucaacuccuuccgccaguacaaguacgaccuggucgccguggggaaggcccuggagggcauguuccggaagcucaaccaccuccuggagcgccuccaccagagcuucuuccuguaccugcuccccgggcugucccgguucgucagcaucggccuguacaugcccgcggugggguuccuccugcuggugcucggccugaaggcccuggagcucuggaugcagcugcacgaggccggcauggggcuggaggagcccggcggggccccgggccccuccgucccccugcccccgagccagggggugggccuggccucccugguggcgccccuccugaucagccaggccaugggccuggcccucuacguccugcccgugcuggggcagcacguggccacccagcacuuccccgucgccgaggcggaggccguggugcucacccugcuggccaucuacgccgccggccucgcgcugccgcacaacacccaccgcgucguguccacgcaggcccccgaccggggguggauggcccugaagcucguggcccugaucuaccuggcgcuccagcugggcugcaucgcccugaccaacuucagccucggcuuccugcuggccaccaccaugguccccacggccgcccucgcgaagccccacgggccgcgcacccuguacgccgcccugcucgugcugaccucccccgccgccacccugcucggcagccuguuccuguggcgggagcuccaggaggcgccccugucccuggccgagggguggcagcuguuccucgccgcccuggcccagggcgugcucgagcaccacacguacggggcgcugcuguucccgcuccugagccugggccucuaccccugcuggcugcuguucuggaacguccucuucuggaaguga

SEQ ID NO: 30716 - RNA, 1023 nt, Artificial Sequence
  derived and/or modified sequence opt1 from GPALPP1__Homo_sapiens__NP_061029
auggcccgcgaccugaucggccccgcccucccgcccggguucaaggcgcggggcaccgccgaggacgaggagcgcgaccccagccccguggccgggccggcccugccgcccaacuacaaguccagcuccagcgacuccagcgacuccgacgaggacagcuccagccuguacgaggagggcaaccaggaguccgaggaggacgacagcgggcccaccgcccggaagcagcgcaagaaccaggacgacgacgacgacgacgacgacggcuucuucggccccgcgcucccgcccggguucaagaagcaggacgacagcccgccccggcccaucaucggccccgcccugccgcccggguucaucaagagcacgcagaaguccgacaagggccgcgacgaccccgggcagcaggagaccgacagcuccgaggacgaggacaucaucggccccaugcccgccaagggccccgucaacuacaacgugaccaccgaguucgagaagcgggcccagcgcaugaaggagaagcugacgaagggggacgacgacagcuccaagcccaucgugcgggagagcuggaugaccgagcucccgcccgagaugaaggacuucggccuggggccccgcaccuucaagcggcgcgcggacgacaccagcggcgaccgguccaucuggacggacacccccgccgaccgcgagcggaaggccaaggagacccaggaggcccgcaagagcuccagcaagaaggacgaggagcacauccuguccggccgggacaagcgccucgccgagcaggucagcuccuacaacgagagcaagcgguccgagagccugauggacauccaccacaagaagcugaaguccaaggcggccgaggacaagaacaagccccaggagcgcauccccuucgaccgggacaaggaccucaaggugaaccgcuucgacgaggcccagaagaaggcccugaucaagaagucccgcgagcugaacacccgguucucccacgggaagggcaacauguuccucuga

SEQ ID NO: 30717 - RNA, 2487 nt, Artificial Sequence
  derived and/or modified sequence opt1 from GPAM__Homo_sapiens__XP_005270055
auggacgagagcgcccugacccucggcaccaucgacguguccuaccugccccacagcuccgaguacagcgucgggcgcugcaagcacacguccgaggaguggggcgagugcggguuccggccgaccaucuuccgcagcgccacccugaaguggaaggagucccucaugagccggaagcgccccuucgugggccggugcugcuacuccugcacgccccagagcugggacaaguucuucaaccccuccaucccgagccuggggcugcgcaacgugaucuacaucaacgagacccacacccggcaccgcggcuggcucgcgcggcgccuguccuacguccuguucauccaggagcgggacgugcacaagggcauguucgccaccaacgugaccgagaacguccucaacagcucccgcgugcaggaggccaucgccgagguggccgcggagcugaaccccgacgggagcgcccagcagcaguccaaggccgucaacaaggugaagaagaaggccaagcggauccugcaggagaugguggcgacggucagccccgccaugauccgccucaccggcugggugcugcugaagcuguucaacuccuucuucuggaacauccagauccacaaggggcagcucgagauggugaaggccgccaccgagaccaaccugccccuccuguuccugccgguccaccggagccacaucgacuaccuccugcugacguucauccucuucugccacaacaucaaggcccccuacaucgcgagcggcaacaaccugaacauccccaucuucuccacccugauccacaagcucgggggcuucuucauccgccggcgccuggacgagacccccgacggccggaaggacgugcuguaccgcgcccuccugcacgggcacaucguggagcugcuccggcagcagcaguuccuggagaucuuccuggagggcacccgcagccgcuccgggaagacgagcugcgcccgggccggccuccuguccgucgugguggacacccugagcaccaacgucaucccggacauccucaucauccccgugggcaucuccuacgaccgcaucaucgaggggcacuacaacggcgagcagcuggggaagcccaagaagaacgagagccugugguccguggcccggggcgucauccgcaugcuccggaagaacuacgggugcgugcgcgucgacuucgcgcagcccuucagccugaaggaguaccuggagucccagagccagaagccgguguccgcccuccugagccuggagcaggcccuccugcccgccauccugcccucccggcccagcgacgccgcggacgagggccgcgacaccuccaucaacgagagccggaacgccacggacgagucccugcgccggcgccucaucgccaaccuggccgagcacauccuguucaccgccagcaagagcugcgcgaucauguccacccacaucguggccugccuccugcuguaccggcaccgccagggcaucgaccucagcacccuggucgaggacuucuucgugaugaaggaggaggugcuggcccgggacuucgaccucggguucuccggcaacagcgaggacgucgugaugcacgccauccagcugcuggggaacugcgugacgaucacccacaccucccgcaacgacgaguucuucaucaccccgagcacgaccguccccuccguguucgagcucaacuucuacagcaacggcgugcugcacgucuucaucauggaggcgaucaucgccugcucccuguacgccgugcucaacaagcgggggcugggcggccccaccagcacgcccccgaaccugaucucccaggagcagcucgugcgcaaggccgccagccugugcuaccugcucuccaacgaggggaccaucagccugcccugccagaccuucuaccaggucugccacgagaccgugggcaaguucauccaguacgggauccugaccguggcggagcacgacgaccaggaggacaucucccccagccucgccgagcagcagugggacaagaagcugcccgagccgcuguccuggcggagcgacgaggaggacgaggacagcgacuucggcgaggagcagcgcgacugcuaccucaaggucucccagagcaaggagcaccagcaguucaucacguuccugcagcgccugcucgggccccugcuggaggccuacuccagcgccgccaucuucgugcacaacuucuccggccccgugccggagcccgaguaccuccagaagcugcacaaguaccugaucacccggaccgagcgcaacgucgcgguguacgccgagagcgccaccuacugccucgugaagaacgccgucaagauguucaaggacaucggcguguucaaggagaccaagcagaagcggguguccguccuggagcugagcuccacguuccucccccagugcaaccgccagaagcugcuggaguacauccucagcuucguggugcuguga

SEQ ID NO: 30718 - RNA, 1071 nt, Artificial Sequence
  derived and/or modified sequence opt1 from GPANK1__Homo_sapiens__NP_149417
augagccgcccccugcucaucaccuucaccccggccacggaccccuccgaccuguggaaggacggccagcagcagccccagcccgagaagccggagagcacccuggacggggccgcggcccgggccuucuacgaggcccucaucggcgacgaguccagcgcccccgacucccagcgcagccagaccgagcccgcgcgggagcgcaagcggaagaagcgccggaucaugaaggcccccgccgccgaggcgguggccgagggggccuccggccgccacgggcagggccggagccuggaggccgaggacaagaugacccaccgcauccugcgggccgcgcaggagggcgaccucccggagcugcgccggcugcucgagccccacgaggccgggggcgccgggggcaacaucaacgcccgcgacgccuucugguggacgccccugaugugcgcggcccgggccgggcagggcgccgccgucuccuaccugcucggccgcggggcggccugggugggcgugugcgagcugagcgggcgggacgccgcccagcuggccgaggaggcgggcuuccccgaggucgcccgcauggugcgggagucccacggcgagacccgcagcccggagaaccggucccccacccccagccuccaguacugcgagaacugcgacacccacuuccaggacuccaaccaccgcacgagcaccgcccaccuccugucccugagccaggggccccagccgcccaaccugccccugggcgugcccaucuccagcccgggguucaagcuccugcugcgcggcgggugggagcccggcaugggccucgggccccggggcgaggggcgcgccaaccccaucccgaccguccugaagcgggaccaggagggccugggguaccgcagcgcgccccagccccgggugacccacuuccccgccugggacacgcgcgccguggccggccgggagcgcccgccccgggucgccacccucuccuggcgcgaggagcggcgccgggaggagaaggaccgcgcgugggagcgggaccugcgcaccuacaugaaccuggaguucuga

SEQ ID NO: 30719 - RNA, 2388 nt, Artificial Sequence
  derived and/or modified sequence opt1 from GPAT2__Homo_sapiens__NP_997211
auggccaccaugcuggagggccgcugccagacccagccccggagcuccccgagcgggcgcgaggccucccucuggagcuccggcuucgggaugaagcuggaggcggugacgcccuuccugggcaaguaccggcccuucgucgggcgcugcugccagaccugcacccccaagagcugggagucccucuuccaccggagcaucaccgaccugggcuucugcaacgugauccuggugaaggaggagaacacgcgcuuccggggcuggcucguccgccggcugugcuacuuccuguggucccucgagcagcacaucccgcccugccaggacgugccccagaagaucauggagagcaccggggugcagaaccugcuguccggccgcguccccgggggcaccggggagggccaggugccggaccucgugaagaaggagguccagcggauccugggccacauccaggccccgccccgccccuuccuggugcgccucuucagcugggcccugcugcgguuccucaacugccuguuccugaacgugcagcuccacaaggggcagaugaagaugguccagaaggccgcccaggcgggccugccccuggugcuccuguccacccacaagacgcugcucgacgggauccugcugcccuucaugcuccugagccagggccugggcgugcuccgggucgccugggacucccgcgccugcagccccgcccugcgggcgcugcuccgcaagcucgggggccuguuccugcccccggaggccucccugagccuggacuccagcgaggggcuccuggcccgggccguggugcaggccgucaucgagcagcugcucgugagcggccagccccugcugaucuuccucgaggagccgcccggggcgcugggcccccgccuguccgcccugggccaggccugggugggguucgucgugcaggccgugcaggucggcaucgugcccgacgcccuccugguccccguggcggugaccuacgaccugguccccgacgccccgugcgacaucgaccacgccagcgcgccccucgggcuguggaccggcgcccuggccgugcuccggucccuguggagccgcugggggugcucccaccgcaucugcagccgggugcaccuggcccagcccuucucccuccaggaguacaucgucagcgcccgcuccugcuggggcggccggcagacccuggagcagcugcuccagcccaucgugcuggggcagugcacggccgugccggacaccgagaaggagcaggaguggacccccaucaccggcccccugcucgcccugaaggaggaggaccagcugcucguccgccggcugagcugccacgugcuguccgcgagcgugggguccagcgccgucauguccacggccaucauggccacccuccugcuguucaagcaccagaagcuccugggcgaguucagcuggcugaccgaggagauccuccugcgcggguucgacgugggcuucuccggccagcugcggagccuccugcagcacucccugagccuccugcgcgcgcacguggcccugcuccggauccgccagggggaccugcuggucgugccgcagcccggccccgggcucacccaccuggcccagcugagcgccgagcuccugcccguguuccuguccgaggccgucggcgcgugcgccgugcggggccuccuggccgggcgcgugccgccccagggccccugggagcugcaggggauccuccugcugagccagaacgagcucuaccggcagauccugcugcucaugcaccuccugccccaggaccuccugcugcucaagccgugccaguccagcuacugcuacugccaggagguccuggaccgccugauccagugcggccuccugguggccgaggagacgcccgggucccggcccgccugcgacaccggccgccagcggcugagccgcaagcuccuguggaagcccuccggcgacuucaccgacagcgacuccgacgacuucggggaggcggacggccgguacuuccgccugagccagcagucccacugcccggacuucuuccucuuccugugccgccugcucagcccccugcugaaggccuucgcccaggccgccgcguuccuccggcaggggcagcugcccgacaccgagcugggcuacacggagcagcuguuccaguuccugcaggccaccgcccaggaggaggggaucuucgagugcgccgaccccaagcuggcgaucuccgccguguggaccuuccgcgaccucggcguccugcagcagaccccgagccccgccggcccccggcugcaccucucccccacguucgccagccuggacaaccaggagaagcuggagcaguucauccgccaguucaucugcuccuga

SEQ ID NO: 30720 - RNA, 2796 nt, Artificial Sequence
  derived and/or modified sequence opt1 from GPATCH1__Homo_sapiens__NP_060495
auggccgcccgcgacagcgacuccgaggaggaccuggugagcuacggcaccgggcucgagccccuggaggagggcgagcggccgaagaagcccaucccccugcaggaccagaccguccgcgacgagaaggggcgguacaagcgcuuccacggcgcguucuccgggggcuucagcgccggcuacuucaacacggugggguccaaggagggcuggacccccagcaccuucguguccagccggcagaaccgcgccgacaaguccguccucgggccggaggacuucauggacgaggaggaccugagcgaguucggcaucgcccccaaggccaucgugaccacggacgacuucgcguccaagaccaaggaccggauccgcgagaaggcccggcagcuggccgccgcgaccgcccccauccccggggccacccuccuggacgaccugaucacgccggccaagcucagcgugggcuucgagcugcugcgcaagaugggcuggaaggaggggcagggcgucgggccccgggugaagcgccggccccgccggcagaagcccgacccgggcgugaagaucuacggcugcgcccucccgcccggguccagcgagggcuccgagggggaggacgacgacuaccugcccgacaacgucaccuucgcgcccaaggacgugacccccguggacuucacccccaaggacaacguccacggccuggccuacaaggggcucgacccccaccaggcccuguucggcacgagcggcgagcacuucaaccuguucuccgggggcagcgagcgcgccggggaccucggcgagaucgggcugaacaagggccggaagcugggcaucuccgggcaggccuucggcgugggggcgcucgaggaggaggacgacgacaucuacgccaccgagacccugagcaaguacgacaccgugcugaaggacgaggagccgggcgacgggcucuacggcuggacggcgccccgccaguacaagaaccagaaggagagcgagaaggaccugcgguacgucggcaagauccuggacggguucucccucgccagcaagccccuguccagcaagaagaucuacccgccgcccgagcugccccgcgacuaccggcccgugcacuacuuccgccccaugguggccgccaccuccgagaacagccaccuccugcagguccuguccgagagcgccggcaaggccacccccgaccccgggacccacuccaagcaccagcucaacgccagcaagcgcgccgagcugcugggcgagacgccgauccagggcuccgcgaccagcgugcucgaguuccugucccagaaggacaaggagcggaucaaggagaugaagcaggccaccgaccugaaggccgcccagcucaaggcgcgcagccuggcccagaacgcccaguccagccgggcccagcugucccccgccgcggccgccgggcacugcagcuggaacauggcccucggcgggggcaccgccacgcugaaggcguccaacuucaagcccuucgccaaggaccccgagaagcagaagcgcuacgacgaguuccuggugcacaugaagcaggggcagaaggacgcccucgagcggugccuggacccgagcaugaccgagugggagcgcggccgggagcgcgacgaguucgcccgggccgcgcugcucuacgccagcucccacagcacccuguccagccgcuucacccacgccaaggaggaggacgacuccgaccaggucgaggugccccgggaccaggagaacgacgugggcgacaagcagagcgccgucaagaugaagauguucgggaagcugacgcgcgacaccuucgaguggcaccccgacaagcugcucugcaagcgguucaacgugcccgacccguaccccgacuccacccuggucggccugccccgcgugaagcgggacaaguacagcguguucaacuuccucacccugcccgagacggcgucccugccgaccacccaggccagcuccgagaaggucagccagcaccgcgggcccgacaagucccggaagcccagccgcugggacaccuccaagcacgagaagaaggaggacagcaucuccgaguuccucagccuggcccggagcaaggccgagcccccgaagcagcaguccagcccccuggugaacaaggaggaggagcacgcccccgagcucuccgcgaaccagacggugaacaaggacgucgacgcccaggccgagggcgaggggagccgccccuccauggaccuguuccgcgccaucuucgccagcuccagcgacgagaaguccagcuccagcgaggacgagcagggcgacuccgaggacgaccaggcgggcagcggggaggccaacuuccaguccagccaggacaccgaccugggcgagaccuccagcguggcccacgcccucgugccggcgccccaggagcccccgcccuccuuccccauccagaagaugcagaucgacgagcgggaggaguucgggccccgccugccgcccgucuucugccccaacgcccggcagacccuggaggugccccagaaggagaagcacaagaagaacaaggacaagcacaaggccaagaaggagcaccgccggaagaaggagaagaagaagaagcaccgcaagcacaagcacaagggcaagcagaagaacaagaagccggagaaguccagcuccagcgaguccagcgacuccagcgacucccagagcgacgaggagaccgccgacgugagcccccaggagcuccugcggcgccucaagagccugccccugcggcgccaguga

SEQ ID NO: 30721 - RNA, 1131 nt, Artificial Sequence
  derived and/or modified sequence opt1 from GPATCH2__Homo_sapiens__NP_001284683
auguucggcgccgccgggcgccagcccaucggcgcgccggccgccgggaacagcuggcacuucucccggaccauggaggagcuggugcacgaccucgucagcgcccuggaggaguccagcgagcaggcccgcggcggguucgcggagaccggcgaccacucccggagcaucuccugcccccugaagcgccaggcccggaagcgccggggccgcaagcggcgcagcuacaacgugcaccaccccugggagacggggcacugccucuccgagggcagcgacuccagccuggaggagcccuccaaggacuaccgggagaaccacaacaacaacaagaaggaccacagcgacuccgacgaccagaugcugguggccaagcgccggccgagcuccaaccucaacaacaacguccgcgggaagcggccccuguggcacgagagcgacuucgccguggacaacgugggcaaccgcacccugcggcgccggcgcaaggucaagcggauggcgguggaccucccccaggacaucuccaacaagcgcaccaugacccagcccccggaggggugccgcgaccaggacauggacagcgaccgggccuaccaguaccaggaguucacgaagaacaaggugaagaagcgcaagcugaagaucauccggcagggccccaagauccaggacgagggcgucgugcuggagagcgaggagaccaaccagaccaacaaggacaagauggagugcgaggagcagaagguguccgacgagcucaugagcgaguccgacagcuccagccuguccagcaccgacgccgggcuguucacgaacgacgagggccgccagggggacgacgagcaguccgacugguucuacgagaaggagagcggcggcgccugcgggaucaccggcgucgugcccuggugggagaaggaggaccccaccgagcucgacaagaacgugccggaccccgucuucgaguccauccugaccgggagcuucccccugaugucccaccccagccggcgcggcuuccaggcccggcucucccgccugcacgggaugagcuccaagaacaucaagaaguccggcggcacgccgaccagcauggcgaccaacuggaccagcgagaucccccuguga

SEQ ID NO: 30722 - RNA, 1449 nt, Artificial Sequence
  derived and/or modified sequence opt1 from GPATCH2L__Homo_sapiens__NP_060396
auggacgagcuggugcacgaccucgccagcgcccuggagcagaccuccgagcagaacaagcugggcgagcucugggaggagauggcgcugagcccccgccagcagcggcgccagcugcggaagcgccgggggcgcaagcggcgcuccgacuucacccaccucgccgagcacacgugcugcuacagcgaggccuccgagagcucccuggacgaggccaccaaggacugccgggaggucgccccggugaccaacuucagcgacuccgacgacaccaugguggcgaagcgccaccccgcccugaacgccaucgucaagagcaagcagcacuccuggcacgagagcgacuccuucacggagaacgcccccugccggccccuccgccggcgccggaaggugaagcgcgugaccagcgaggucgcggccucccugcagcagaagcugaaggugagcgacugguccuacgagcggggcugccgcuucaagagcgccaagaagcagcggcucucccgcuggaaggagaacaccccguggaccagcagcgggcacggccugugcgaguccgccgagaaccggacguuccugagcaagaccgggcgcaaggagcgcauggagugcgagaccgacgagcagaagcagggcuccgacgagaacaugagcgagugcgagaccuccagcgugugcuccagcuccgacacgggccucuucaccaacgacgaggggcggcagggcgacgacgagcagagcgacugguucuacgagggggagugcguccccggcuucaccgugcccaaccugcugcccaagugggccccggaccacugcuccgagguggagcgcauggacagcgggcucgacaaguucuccgacagcaccuuccugcugcccucccggcccgcgcagcgcggcuaccacacgcggcucaaccgccugcccggcgccgccgcccggugccugcgcaaggggcggcgccggcucgucggcaaggagaccagcaucaacacccuggggaccgagcgcaucucccacaucaucagcgacccgcggcagaaggagaagaacaaggcccuggcguccgacuucccccacaucagcgccugcgcccacgaguucaacccccucagcccccuguacucccuggacgugcucgccgacgccagccaccgccggugcuccccggcgcacugcagcgcccgccaggccaacgugcacuggggcccgcccugcucccgggacaucaagcgcaagcggaagcccgucgccacggccagccuguccagccccuccgcggugcacauggacgccguggagcccaccacccccgccagccaggcccccaaguccccgagcuccgaguggcugguccgcaccagcgcggccgagaaggccacggacgccaccaccgccaccuucuucaagaugccccaggagaagucccccggcuacagcuga

SEQ ID NO: 30723 - RNA, 4509 nt, Artificial Sequence
  derived and/or modified sequence opt1 from GPATCH8__Homo_sapiens__NP_001002909
auggccgaccgcuucagccgguucaacgaggaccgcgacuuccagggcaaccacuucgaccaguacgaggaggggcaccuggagaucgagcaggccucccucgacaagcccaucgagagcgacaacaucggccaccggcugcugcagaagcacggguggaagcucggccaggggcugggcaagucccugcagggccgcaccgacccgauccccaucguggucaaguacgacgugauggggaugggccggauggagauggagcucgacuacgcggaggacgccaccgagcgccggcgcgugcuggaggucgagaaggaggacacggaggagcugcggcagaaguacaaggacuacguggacaaggagaaggccaucgccaaggcccucgaggaccugcgcgcgaacuucuacugcgagcugugcgacaagcaguaccagaagcaccaggaguucgacaaccacaucaacagcuacgaccacgcccacaagcagcggcucaaggaccugaagcagcgcgaguucgcccggaacguguccagccgcucccggaaggacgagaagaagcaggagaaggcccugcgccggcuccacgagcuggcggagcagcgcaagcaggccgagugcgcccccgggagcggccccauguucaagccgaccaccgucgccguggacgaggaggggggcgaggacgacaaggacgaguccgccaccaacagcggcacgggggcgaccgccuccugcggccuggggagcgaguucuccaccgacaagggcggccccuucaccgccgugcagaucacgaacaccaccgggcucgcccaggcccccggccuggcgagccaggggaucuccuucggcaucaagaacaaccuggggaccccccuccagaagcugggcgucagcuucuccuucgccaagaaggccccggugaagcuggagagcaucgccuccguguucaaggaccacgccgaggagggcacgagcgaggacgggaccaagcccgacgagaagagcuccgaccagggccuccagaaggucggggacagcgacggcuccagcaaccuggacgggaagaaggaggacgaggacccccaggacggcggcucccuggcgagcacccucuccaagcugaagcggaugaagcgcgaggagggggccggcgccaccgagcccgaguacuaccacuacaucccgcccgcccacugcaaggugaagcccaacuuccccuuccugcucuucaugcgggccagcgagcagauggacggggacaacacgacccacccgaagaacgcgcccgaguccaagaagggcagcucccccaagcccaagagcugcaucaaggccgccgccucccagggggcggagaagaccgugagcgaggucuccgagcagccgaaggagaccagcaugacggagcccuccgagcccggcagcaaggccgaggccaagaaggcccugggcggggacguguccgaccagagccuggagagccacucccagaaggugagcgagacccagaugugcgaguccaacagcuccaaggagaccagccucgccacccccgcgggcaaggagucccaggaggggccgaagcaccccacgggccccuucuuccccguccugagcaaggacgaguccaccgcccugcaguggccgagcgagcuccugaucuucaccaaggccgagcccuccaucagcuacuccugcaacccccuguacuucgacuucaagcucagccgcaacaaggacgcccgcaccaagggcacggagaagccgaaggacaucggguccagcuccaaggaccaccugcagggccuggaccccggggagcccaacaagagcaaggaggugggcggggagaagaucgugcggagcuccggcggccgcauggacgcccccgcgagcggguccgccugcagcggccucaacaagcaggagccggggggcucccacgggagcgagaccgaggacaccggccggucccugcccagcaagaaggagcgcuccggcaagagccaccggcacaagaagaagaagaagcacaagaaguccagcaagcacaagcgcaagcacaaggccgacaccgaggagaaguccagcaaggccgaguccggggagaagagcaagaagcggaagaagcgcaagcggaagaagaacaaguccagcgcccccgcggacuccgagcgcggccccaagccggagccccccgggagcggcagccccgccccgccccggcgccggcgccgggcccaggacgacucccagcgccggagccugcccgccgaggagggguccagcggcaagaaggacgagggcgggggcggguccagcucccaggaccacggcgggcgcaagcacaagggcgagcuccccccgagcuccugccagcggcgcgcgggcacgaagcgcagcucccggagcucccaccgcagccagcccuccagcggggacgaggacuccgacgacgccagcucccaccggcugcaccagaagagccccagccaguacuccgaggaggaggaggaggaggacagcggcuccgagcacagccgcucccggagccgcuccgggcggcgccacagcucccaccggagcucccgccggagcuacuccagcuccagcgacgccuccagcgaccaguccugcuacagccgccagcggagcuacuccgacgacagcuacuccgacuacagcgaccgcucccggcgccacagcaagcggucccacgacagcgacgacuccgacuacgccagcuccaagcaccgcagcaagcggcacaaguacuccagcuccgacgacgacuacagccuguccugcagccagucccgcagccggagccgcucccacacccgcgagcggagccgcucccggggccgcagccgguccagcuccugcagccgcucccggagcaagcgccggucccgcagcaccaccgcccacuccuggcagcggagccgcuccuacagccgggaccgcucccggagcacgcgcucccccagccagcggagcggcucccgcaagcggagcugggggcacgaguccccggaggagcgccacagcggccgccgggacuucauccgcuccaagaucuaccggagccaguccccccacuacuuccgcagcgggcggggcgaggggcccggcaagaaggacgacggccgcggggacgacuccaaggcgaccggccccccgagccagaacuccaacaucgggaccggccgggggagcgagggcgacugcucccccgaggacaagaacagcgucaccgccaagcuccugcuggagaagauccagucccgcaagguggagcggaagcccagcguguccgaggagguccaggccaccccgaacaaggccggccccaagcugaaggaccccccccagggguacuucggcccgaagcucccccccagccuggggaacaagcccgugcugccgcucaucggcaagcugcccgccacgcgcaagcccaacaagaagugcgaggagagcgggcuggagcggggcgaggagcaggagcaguccgagaccgaggagggccccccggggagcuccgacgcgcucuucggccaccaguuccccagcgaggagaccaccgggccccugcuggaccccccgcccgaggaguccaagagcggcgaggccacggccgaccaccccgucgccccccucggcaccccggcccacuccgacugcuaccccggggaccccaccaucagccacaacuaccugcccgacccguccgacggcgacacccuggagagccucgacuccagcucccagcccgggcccguggagagcucccugcugcccaucgcgccggaccucgagcacuuccccagcuacgcccccccguccggcgaccccagcaucgaguccacggacggggccgaggacgccagccuggcgccccuggagagccagcccaucaccuucaccccggaggagauggagaaguacuccaagcuccagcaggccgcccagcagcacauccagcagcagcugcuggccaagcaggugaaggccuuccccgcgagcgccgcccucgcccccgccacccccgcgcugcagccgauccacauccagcagcccgccacggccuccgccaccagcaucaccaccguccagcacgccauccugcagcaccacgcggccgccgccgccgcggccaucggcauccacccccacccccacccgcagccccucgcccaggugcaccacaucccccagccccaccugacgccgaucucccugagccaccucacccacuccaucauccccggccaccccgccaccuuccuggcgagccaccccauccacaucaucccggccuccgccauccaccccgggcccuucaccuuccaccccgugccgcacgccgcccuguaccccacgcuccuggcgccccgccccgccgccgccgccgcgaccgcccugcaccuccacccgcugcugcaccccaucuucagcggccaggaccuccagcaccccccgucccacgggaccuga

SEQ ID NO: 30724 - RNA, 993 nt, Artificial Sequence
  derived and/or modified sequence opt1 from GPBAR1__Homo_sapiens__XP_011509046
augacccccaacagcaccggcgaggugccgucccccauccccaagggggcccugggccucagccuggcccuggcgucccucaucaucacggccaaccugcugcucgcccuggggaucgccugggaccgccggcugcgcagcccgcccgccggcugcuucuuccucucccugcugcucgcggggcugcugaccggccucgcccugcccacccugcccggccucuggaaccagagccggcgcggguacugguccugccugcuggucuaccucgcccccaacuucagcuuccugucccugcucgccaaccugcugcucgugcacggcgagcgguacauggcggugcugcgcccgcugcagccgcccgggagcauccggcucgcccugcugcucaccugggccggcccccugcuguucgccucccuccccgcccugggguggaaccacuggacgcccggcgcgaacugcagcucccaggccaucuuccccgcccccuaccuguaccucgaggucuacggccugcugcucccggccgugggggccgcggccuuccugagcgugcgcguccuggccaccgcccaccggcagcuccaggacaucugccgccuggagcgggccgugugccgcgacgagcccuccgcgcuggcccgggcccucaccuggcgccaggcccgggcccaggcgggcgccaugcugcuguucgggcugugcuggggccccuacguggccacccuccugcugagcguccucgccuacgagcagcggcccccgcugggccccgggacgcugcucucccugcugagccucggcuccgcgagcgccgccgccgugcccguggccauggggcugggcgaccagcgcuacaccgcgcccuggcgcgccgccgcccagcggugccugcaggggcucuggggccgcgccagccgggacuccccgggccccagcaucgcguaccaccccuccagccaguccagcgucgaccuggaccugaacuga

SEQ ID NO: 30725 - RNA, 1677 nt, Artificial Sequence
  derived and/or modified sequence opt1 from GPC1__Homo_sapiens__NP_002072
auggagcugcgcgcccggggcugguggcuccugugcgccgcggccgcccugguggccugcgcccgcggggaccccgcgagcaagucccggagcugcggcgagguccgccagaucuacggggccaagggcuucucccucagcgacgugccgcaggccgagaucuccggggagcaccuccggaucugcccccagggcuacacgugcugcaccagcgagauggaggagaaccuggccaaccgcucccacgcggagcuggagaccgcccugcgggacagcucccgcgugcugcaggccaugcucgccacccagcugcggagcuucgacgaccacuuccagcaccuccugaacgacuccgagcgcacccugcaggccaccuuccccggcgcguucggggagcuguacacgcagaacgcccgggccuuccgcgaccucuacagcgagcugcggcuguacuaccgcggcgccaaccuccaccuggaggagacccuggccgaguucugggcgcggcuccuggagcgccuguucaagcagcuccacccccagcugcugcucccggacgacuaccuggacugccuggggaagcaggccgaggcccuccggcccuucggcgaggcgccccgcgagcugcggcugcgcgccacccgggccuucgucgccgcccgcuccuucgugcaggggcucggcguggccagcgacgucgugcgcaagguggcccaggucccccugggcccggagugcucccgggcggugaugaagcugguguacugcgcccacugccucgggguccccggcgcccgccccugccccgacuacugccggaacgugcugaaggggugccuggccaaccaggcggaccucgacgccgaguggcgcaaccugcuggacagcauggugcucaucaccgacaaguucuggggcacguccggcgucgagagcgugaucggguccgugcacaccuggcuggccgaggccaucaacgcccugcaggacaaccgggacacccucaccgcgaaggucauccagggcugcgggaacccgaaggugaacccccagggccccgggcccgaggagaagcgccggcgcggcaagcuggccccgcgggagcgcccgcccagcggcacgcuggagaagcucgugagcgaggccaaggcccagcugcgggacguccaggacuucuggaucucccugcccgggacccugugcagcgagaagauggcccucuccaccgcgagcgacgaccgcugcuggaacggcauggcccgggggcgcuaccugcccgaggugaugggcgacgggcuggccaaccagaucaacaaccccgagguggaggucgacaucaccaagcccgacaugacgauccggcagcagaucaugcagcucaagaucaugaccaaccgccugcgguccgccuacaacggcaacgacguggacuuccaggacgccagcgacgacggcuccgggagcggcuccggggacggcugccuggacgaccucugcagccgcaaggucucccgcaagagcuccagcucccggacgccccugacccacgcgcugccggggcucagcgagcaggagggccagaagaccuccgccgccagcugcccccagccgcccaccuuccugcugccccuccugcuguuccucgcccugaccguggcgcgcccccgguggcgcuga

SEQ ID NO: 30726 - RNA, 1740 nt, Artificial Sequence
  derived and/or modified sequence opt1 from GPC2__Homo_sapiens__NP_689955
augagcgcccugcgcccccuccugcugcuccugcugccccucugccccggccccgggcccggcccgggguccgaggccaaggugacccggagcugcgcggagacccgccagguccugggcgcccggggguacucccugaaccucaucccgcccgcccugaucagcggcgagcaccuccgcgugugcccccaggaguacacgugcugcuccagcgagaccgagcagcggcugauccgcgagaccgaggccaccuuccggggccugguggaggacuccgggagcuuccugguccacacgcucgccgcgcgccaccggaaguucgacgaguucuuccuggagaugcuguccguggcccagcacagccucacccagcuguucucccacagcuacggccgccuguacgcccagcacgcccucaucuucaacgggcuguucucccggcugcgcgacuucuacggcgagagcggggagggccucgacgacacccuggcggacuucugggcccagcugcucgagcggguguucccccugcugcacccccaguacuccuucccgcccgacuaccuccugugccugagccgccucgccuccagcaccgacggcucccugcagcccuucggggacagcccccggcgccugcggcuccagaucacgcgcacccuggucgccgcccgggcguucgugcagggccuggagaccgggcgcaacguggucagcgaggcccucaaggugcccguguccgagggcugcagccaggcccugaugcggcugaucggcugcccccucugccgcggggucccgucccugaugcccugccagggcuucugccugaacguggugcgcgggugccucagcucccggggccuggagcccgacugggggaacuaccuggacggccuccugauccuggccgacaagcugcagggccccuucagcuucgagcucaccgccgaguccaucggggucaagaucagcgagggccugauguaccugcaggagaacuccgcgaaggugagcgcccagguguuccaggagugcgggccgcccgaccccguccccgcccgcaaccggcgcgccccgccgccccgggaggaggccggccgccucugguccauggugacggaggaggagcggcccaccaccgcggccgggaccaaccugcaccgccuggugugggagcuccgggagcgccuggcccggaugcgcggcuucugggcccggcugagccucacggucugcggcgacucccgcauggccgcggacgccagccuggaggccgcccccugcuggaccggggcgggccgggggcgcuaccugccgcccguggugggcgggucccccgccgagcaggucaacaaccccgagcucaagguggacgccagcggccccgacguccccacccggcgccggcgccugcagcugcgcgccgccaccgcgcggaugaagacggccgcccucggccacgaccuggacgggcaggacgccgacgaggacgccuccggcagcgggggcggccagcaguacgcggacgacuggauggccggggccguggccccgcccgcccgcccgccccggccgcccuacccgccccgccgggacggcuccgggggcaagggcgggggcgggagcgcgcgcuacaaccagggccggagccgcuccgggggcgccagcaucggguuccacacccagaccauccugauccucucccugagcgcccuggcccuccugggcccccgguga

SEQ ID NO: 30727 - RNA, 1812 nt, Artificial Sequence
  derived and/or modified sequence opt1 from GPC3__Homo_sapiens__NP_001158089
auggccggcaccgugcgcaccgccugccuggucguggcgaugcuccugagccuggacuuccccgggcaggcccagccgcccccgccgccgcccgacgccacgugccaccaggugcgguccuucuuccagcgccuccagcccggccugaaguggguccccgagacccccgugcccgggagcgaccuccaggugugccugcccaagggcccgaccugcugcucccggaagauggaggagaaguaccagcugaccgcccgccugaacauggagcagcuccugcagagcgccuccauggagcugaaguuccucaucauccagaacgcggccgucuuccaggaggccuucgagaucguggugcggcacgccaagaacuacacgaacgcgauguucaagaacaacuaccccagccugacgccccaggccuucgaguucgucggggaguucuucaccgacgugucccuguacauccucggcagcgacaucaacguggacgacauggucaacgagcuguucgacucccuguuccccgugaucuacacccagcucaugaaccccggccugccggacagcgcccuggacaucaacgagugccuccgcggggcccggcgcgaccugaagguguucggcaacuuccccaagcugaucaugacccaggucuccaagagccuccaggugacccggaucuuccugcaggcccugaaccucgggaucgaggugaucaacaccaccgaccaccugaaguucuccaaggacugcggccgcaugcugacgcggaugugguacugcagcuacugccaggggcucaugauggucaagcccugcggcggcuacugcaacguggugaugcaggggugcauggcgggcgucguggagaucgacaaguacuggcgcgaguacauccugucccuggaggagcucgugaacgggauguaccggaucuacgacauggagaacguccugcugggccucuucagcaccauccacgacuccauccaguacgugcagaagaacgccggcaagcugaccaccacggagaccgagaagaagaucuggcacuucaaguaccccaucuucuuccugugcaucgggcucgaccugcagaucggcaagcugugcgcccacagccagcagcgccaguaccgguccgccuacuaccccgaggaccucuucaucgacaagaagguccugaagguggcccacguggagcacgaggagacccugagcagccgccggcgcgagcucauccagaagcugaaguccuucaucagcuucuacuccgcgcugcccggguacaucugcagccacucccccgucgccgagaacgacacccucugcuggaacggccaggagcugguggagcgguacagccagaaggccgcccgcaacgggaugaagaaccaguucaaccugcacgagcugaagaugaagggccccgagccgguggucucccagaucaucgacaagcucaagcacaucaaccagcugcugcggacgaugagcaugcccaagggccgcgugcucgacaagaaccuggacgaggagggguucgaguccggcgacugcggggacgacgaggacgagugcaucggcgggagcggcgacggcaugaucaaggugaagaaccagcugcgcuuccucgccgagcuggcguacgaccuggacgucgacgacgcccccgggaacucccagcaggccacccccaaggacaacgagaucagcaccuuccacaaccucggcaacgugcacuccccgcugaagcugcucaccagcauggccaucuccguggucugcuucuucuuccuggugcacuga

SEQ ID NO: 30728 - RNA, 1671 nt, Artificial Sequence
  derived and/or modified sequence opt1 from GPC4__Homo_sapiens__NP_001439
auggcccgcuucggccugcccgcccuccugugcacccuggcggugcucagcgccgcccugcuggccgccgagcucaaguccaagagcugcuccgagguccggcgccuguacgugagcaagggguucaacaagaacgacgcgccgcugcacgagaucaacggcgaccaccucaagaucugcccccagggguccacgugcugcagccaggagauggaggagaaguacucccugcagagcaaggacgacuucaaguccguggucagcgagcagugcaaccaccuccaggccguguucgccucccgguacaagaaguucgacgaguucuucaaggagcugcuggagaacgccgagaagucccugaacgacauguucgugaagaccuacggccaccucuacaugcagaacagcgagcuguucaaggaccuguucgucgagcucaagcgcuacuacgugguggggaacgucaaccuggaggagaugcugaacgacuucugggcgcggcuccuggagcgcauguuccggcuggugaacagccaguaccacuucaccgacgaguaccucgagugcguguccaaguacaccgagcagcugaagcccuucggcgacgucccccgcaagcugaagcuccaggugacccgggccuucguggccgcccgcacguucgcccagggccuggcggucgccggggacguggugagcaaggucuccguggugaacccgaccgcccagugcacccacgcccugcucaagaugaucuacugcagccacugccggggccuggucaccgugaagcccugcuacaacuacugcuccaacaucaugcgcgggugccuggccaaccagggcgaccucgacuucgaguggaacaacuucaucgacgcgaugcugaugguggccgagcggcuggaggggcccuucaacaucgagagcgucauggaccccaucgacgugaagaucagcgacgccaucaugaacaugcaggacaacuccguccaggugagccagaagguguuccagggcugcggcccgcccaagccccuccccgccgggcgcaucucccggagcaucuccgagagcgccuucuccgcgcgcuuccggccgcaccaccccgaggagcgccccacgaccgccgccggcaccagccuggaccggcuggucaccgacgugaaggagaagcucaagcaggccaagaaguucugguccagccugcccuccaacgugugcaacgacgagcgcauggccgcggggaacggcaacgaggacgacugcuggaacggcaagggcaagagccgguaccuguucgccgucacggggaacgggcucgccaaccagggcaacaacccggagguccagguggacaccuccaagcccgacauccugauccugcgccagaucauggcccuccgcgugaugaccagcaagaugaagaacgcguacaacgggaacgacguggacuucuucgacaucuccgacgagagcuccggcgagggcagcggguccggcugcgaguaccagcagugccccagcgaguucgacuacaacgccaccgaccacgccggcaagagcgccaacgagaaggccgacuccgcgggggugcggcccggggcccaggccuaccugcugacggucuucugcauccucuuccuggugaugcagcgcgaguggcgguga

SEQ ID NO: 30729 - RNA, 1719 nt, Artificial Sequence
  derived and/or modified sequence opt1 from GPC5__Homo_sapiens__NP_004457
auggacgcccagaccuggcccgugggcuuccgcugccugcuccugcuggcccucgucgggagcgcgcgguccgagggcgugcagaccugcgaggaggugcgcaagcuguuccaguggcggcugcucggggccguccgcggccugccggacagcccccgggccgggcccgaccuccaggugugcaucuccaagaagcccacgugcugcacccgcaagauggaggagcgguaccagaucgccgcccgccaggacaugcagcaguuccugcagaccagcuccagcacccugaaguuccugaucucccggaacgcggccgccuuccaggagacgcucgagacccugaucaagcaggccgagaacuacaccagcauccuguucugcuccaccuaccgcaacauggcgcucgaggccgccgccagcgugcaggaguucuucacggacgucggccuguaccuguucggcgccgacgugaacccggaggaguucgugaaccgguucuucgacucccucuucccccuggucuacaaccaccugaucaaccccggggugaccgacagcucccucgaguacagcgagugcauccgcauggcgcggcgcgacgugucccccuucggcaacaucccgcagcgggucauggggcagaugggccgcagccugcugcccucccggaccuuccuccaggcccugaaccuggggaucgaggugaucaacaccacggacuaccuccacuucagcaaggagugcucccgcgcccugcugaagaugcaguacugcccccacugccagggccucgcccugaccaagcccugcaugggcuacugccugaacgugaugcgggggugccucgcccacauggcggagcugaacccgcacuggcacgccuacauccgcagccuggaggagcucagcgacgccaugcacggcaccuacgacaucgggcacguccugcugaacuuccaccuccuggugaacgacgccgugcugcaggcccaccucaacggccagaagcugcuggagcaggucaaccggaucugcggccgccccgugcgcacccccacgcagagcccccggugcuccuucgaccaguccaaggagaagcacgggaugaagaccaccacccgcaacagcgaggagacgcucgcgaaccggcgcaaggaguucaucaacucccugcggcuguaccgcagcuucuacggcgggcucgccgaccagcugugcgccaacgagcuggccgccgcggacggccugccgugcuggaacggggaggacaucgugaaguccuacacccagcgggucgugggcaacggcaucaaggcccagagcgggaaccccgaggugaaggucaagggcaucgaccccgugaucaaccagaucaucgacaagcucaagcacgucgugcagcugcugcaggggcgcucccccaagccggacaagugggagcuccugcagcugggcagcgggggcggcaugguggagcaggucuccggggacugcgacgacgaggacggcugcgggggcagcggguccggcgaggugaagcggacccucaagaucaccgacuggaugcccgacgacaugaacuucagcgacgugaagcagauccaccagacggacaccggcuccacccuggacaccacgggggccggcugcgccgucgcgaccgagagcaugaccuucacccugaucuccguggugaugcuccugcccgggaucugguga

SEQ ID NO: 30730 - RNA, 1668 nt, Artificial Sequence
  derived and/or modified sequence opt1 from GPC6__Homo_sapiens__NP_005699
augcccagcuggaucggcgccgugauccugccgcuccuggggcugcuccugucccugcccgccggcgcggacgucaaggcccgcagcugcggggaggugcggcaggccuacggcgccaagggguucucccucgccgacauccccuaccaggagaucgcgggcgagcaccuccgcaucugcccccaggaguacacgugcugcaccaccgagauggaggacaagcugagccagcaguccaagcucgaguucgagaaccugguggaggagaccagccacuucguccggaccaccuucgugucccgccacaagaaguucgacgaguucuuccgggagcugcucgagaacgccgagaagucccugaacgacauguucgugcgcacguacggcaugcuguacaugcagaacagcgaggucuuccaggaccucuucaccgagcugaagcgguacuacaccgggggcaacgugaaccuggaggagaugcucaacgacuucugggcccgccugcuggagcggauguuccagcucaucaacccgcaguaccacuucagcgaggacuaccuggagugcguguccaaguacaccgaccagcugaagcccuucggggacgucccccgcaagcucaagauccaggugacgcgggccuucaucgcggcccgcaccuucgugcagggccugaccgucgggcgggagguggccaaccgcgugagcaaggucucccccaccccgggcugcauccgggcccugaugaagaugcucuacugccccuacugccgcggccugcccacggugcggcccugcaacaacuacugccugaacgugaugaaggggugccucgccaaccaggcggaccuggacaccgaguggaaccuguucaucgacgccaugcuccuggucgccgagcgccuggagggcccguucaacaucgagagcgugauggaccccaucgacgugaagaucuccgaggccaucaugaacaugcaggagaacagcaugcaggucuccgccaagguguuccaggggugcggccagcccaagcccgcgccggcccuccggagcgcccgcuccgcccccgagaacuucaacacccgguuccgccccuacaaccccgaggagcgcccgaccacggccgcgggcaccagccuggaccggcuggugaccgacaucaaggagaagcucaagcugagcaagaaggucugguccgcccugcccuacaccaucugcaaggacgagagcgugacggccgggaccuccaacgaggaggagugcuggaacggccacagcaaggcccgcuaccuccccgagaucaugaacgacgggcugaccaaccagaucaacaaccccgaggucgacguggacaucacccggccggacacguucauccgccagcagaucauggcccugcgggugaugaccaacaagcucaagaacgcguacaacggcaacgacgucaacuuccaggacaccuccgacgagagcuccgggagcggcuccggcagcgggugcauggacgacgugugccccaccgaguucgaguucgugacgaccgaggcccccgccgucgaccccgaccgccgggagguggacuccagcgccgcgcagcgcggccacucccugcugagcuggucccugaccugcaucgugcuggcccugcagcggcugugccgcuga

SEQ ID NO: 30731 - RNA, 2019 nt, Artificial Sequence
  derived and/or modified sequence opt1 from GPCPD1__Homo_sapiens__NP_062539
augacccccagccagguggccuucgagauccgcggcacccugcucccgggggaggucuucgccaucugcggcuccugcgacgcgcuggggaacuggaacccccagaacgccguggcccugcuccccgagaacgacacgggcgagagcaugcuguggaaggccaccaucgugcugucccgcggggucagcgugcaguaccgguacuucaagggcuacuuccucgagcccaagaccaucggcgggccgugccaggugaucguccacaagugggagacccaccuccagccccgguccaucacgccccuggagagcgagaucaucaucgacgacggccaguucgggauccacaacggcguggagacccucgacuccggguggcugaccugccagaccgagauccgccugcggcuccacuacagcgagaagcccccgguguccaucacgaagaagaagcugaagaagucccgcuuccgggucaagcugacccucgagggccuggaggaggacgacgacgaccgcgugagccccaccgugcugcacaagaugagcaacucccucgagaucagccugaucuccgacaacgaguucaagugccggcacagccagcccgagugcggcuacgggcugcagcccgaccgcuggaccgaguacuccauccagacgauggagccggacaaccucgagcugaucuucgacuucuucgaggaggaccugagcgagcacgucgugcagggcgacgcccuccccgggcacgugggcaccgcgugccugcuguccagcaccaucgccgagagcggcaaguccgccgggauccucacccugcccaucaugagccggaacucccgcaagacgaucggcaagguccggguggacuacaucaucaucaagccccugccgggguacagcugcgacaugaaguccagcuucuccaaguacuggaagccccgcaucccccucgacgugggccaccgcggggccggcaacagcaccaccaccgcgcagcuggccaagguccaggagaacacgaucgccucccugcggaacgccgccagccacggcgcggccuucguggaguucgacgugcaccucuccaaggacuucguccccgugguguaccacgaccugaccugcugccugaccaugaagaagaaguucgacgccgacccggucgagcuguucgagauccccgugaaggagcugaccuucgaccagcugcagcuccugaagcugacgcacgucaccgcccucaagagcaaggaccggaaggaguccguggugcaggaggagaacagcuucuccgagaaccagcccuuccccagccugaagaugguccuggagucccucccggaggacgugggguucaacaucgagaucaaguggaucugccagcagcgcgacggcaugugggacgggaaccugagcaccuacuucgacaugaaccuguuccucgacaucauccugaagaccgugcuggagaacuccggcaagcggcgcaucgucuucagcagcuucgacgccgacaucugcacgauggugcggcagaagcagaacaaguaccccauccuguuccucacccaggggaaguccgagaucuaccccgagcugauggaccugcgcagccgcaccacccccaucgcgauguccuucgcccaguucgagaaccuccugggcaucaacgugcacacggaggaccugcuccggaacccgagcuacauccaggaggccaaggccaagggccuggucaucuucugcuggggcgacgacaccaacgaccccgagaaccgccggaagcugaaggagcucggggugaacgggcugaucuacgaccgcaucuacgacuggaugcccgagcagccgaacaucuuccagguggagcagcuggagcggcucaagcaggagcugcccgagcugaaguccugccucugccccaccgucagccgcuucgugcccuccagccugugcggcgaguccgacauccacguggacgccaacgggaucgacaacgucgagaacgcguga

SEQ ID NO: 30732 - RNA, 981 nt, Artificial Sequence
  derived and/or modified sequence opt1 from GPD1__Homo_sapiens__NP_001244128
auggccagcaagaaggugugcaucgucggcuccgggaacuggggcagcgccaucgcgaagaucgucgggggcaacgccgcccagcuggcccaguucgacccccgcgugaccauguggguguucgaggaggacaucgggggcaagaagcucaccgagaucaucaacacgcagcacgagaacgugaaguaccugccgggccacaagcugccgcccaacguguucaucgggaagaucugcgaccagcucaagggccaccugaaggccaacgcgaccgggaucucccugaucaagggcgucgacgaggggcccaacggccucaagcugaucagcgaggugaucggcgagcggcuggggauccccauguccgugcucaugggcgccaacaucgccagcgaggucgccgacgagaaguucugcgagaccaccaucgggugcaaggaccccgcgcagggccagcugcugaaggagcucaugcagacgcccaacuuccgcaucaccguggugcaggaggucgacaccguggagaucugcggcgcccugaagaacguggucgccgugggggccggcuucugcgacgggcugggcuucggggacaacaccaaggccgcggugauccggcucggccugauggagaugaucgccuucgccaagcuguucugcuccggccccgucagcuccgccacguuccucgagagcugcgggguggccgaccugaucacgaccugcuacggcgggcgcaaccggaagguggcggaggccuucgcccgcaccggcaaguccaucgagcagcuggagaaggagcuccugaacgggcagaagcugcagggcccggagaccgcccgggagcucuacagcauccugcagcacaagggccuggucgacaaguucccccucuucauggccguguacaaggugugcuacgaggggcagcccgucggcgaguucauccacugccugcagaaccaccccgagcacauguga

SEQ ID NO: 30733 - RNA, 1056 nt, Artificial Sequence
  derived and/or modified sequence opt1 from GPD1L__Homo_sapiens__NP_055956
auggccgccgcgccccugaaggugugcaucgucggcagcgggaacuggggcuccgccguggccaagaucaucgggaacaacgugaagaagcuccagaaguucgccagcaccgucaagauguggguguucgaggagaccgugaacggccgcaagcugacggacaucaucaacaacgaccacgagaacgucaaguaccugccggggcacaagcuccccgagaacgugguggccauguccaaccugagcgaggcgguccaggacgccgaccugcucguguucgugaucccccaccaguucauccaccggaucugcgacgagaucaccggccgcguccccaagaaggcccugggcaucacccugaucaaggggaucgacgagggcccggaggggcucaagcugaucuccgacaucauccgggagaagaugggcaucgacaucagcgugcugaugggggccaacaucgcgaacgagguggccgccgagaaguucugcgagaccacgaucggcuccaaggucauggagaacggccuccuguucaaggagcugcuccagacccccaacuuccgcaucaccgugguggacgacgccgacaccgucgagcugugcggggcccugaagaacaucguggcggugggcgccggguucugcgacggccuccggugcggcgacaacacgaaggccgccgucauccgccuggggcugauggagaugaucgccuucgcgcggaucuucugcaagggccaggugagcaccgccaccuuccucgaguccugcgggguggccgaccugaucaccacgugcuacggcgggcgcaaccggcgcgucgccgaggccuucgcgcggaccggcaagaccaucgaggagcuggagaaggagaugcucaacggccagaagcugcaggggccccagaccagcgccgagguguaccgcauccugaagcagaagggccuccuggacaaguucccccuguucacggccgucuaccagaucugcuacgagucccggccggugcaggagaugcucagcugccugcagucccaccccgagcacaccuga

SEQ ID NO: 30734 - RNA, 2184 nt, Artificial Sequence
  derived and/or modified sequence opt1 from GPD2__Homo_sapiens__NP_001076581
auggccuuccagaaggccgugaagggcaccauccuggucgggggcggggcgcucgccaccgugcugggccugagccaguucgcccacuaccgccggaagcagaugaaccucgccuacgugaaggccgcggacugcaucuccgagcccgucaaccgcgagccgcccagccgggaggcccagcugcugacgcuccagaacaccuccgaguucgacauccuggugaucgggggcggcgccaccgggagcggcugcgcccuggacgcggugacccgcgggcucaagacggcccuggucgagcgggacgacuucuccagcggcaccuccagccgcuccaccaagcugauccacgggggcgugcgguaccuccagaaggccaucaugaagcuggacaucgagcaguaccgcauggugaaggaggcccugcacgagcgggccaaccuccuggagaucgcgccccaccugagcgcgccccucccgaucaugcugcccgucuacaagugguggcagcugcccuacuacugggugggcaucaagcucuacgaccugguggccggguccaacugccucaagagcuccuacguccucagcaagucccgcgcccuggagcacuuccccaugcugcagaaggacaagcucgugggcgccaucguguacuacgacgggcagcacaacgacgcccggaugaaccuggccaucgcccugaccgccgcccgcuacggcgcggccacggccaacuacauggaggucgugagccuccugaagaagaccgacccgcagaccggcaaggugcgggucuccggggcccgcugcaaggacgugcugaccggccaggaguucgacgugcgggccaagugcgucaucaacgcgacggggcccuucaccgacagcgugcgcaagauggacgacaaggacgccgccgccaucugccagcccuccgcgggcgugcacaucgucaugcccggguacuacagcccggagagcaugggccuccuggaccccgccaccuccgacggccgggugaucuucuuccugcccuggcagaagaugaccaucgccgggacgaccgacacccccaccgacgucacgcaccacccgauccccagcgaggaggacaucaacuucauccucaacgaggugcgcaacuaccuguccugcgacguggagguccggcgcggcgacgugcuggccgccuggagcgggauccggccccucgugaccgaccccaaguccgcggacacccagagcaucucccgcaaccacgucguggacaucagcgaguccggccugaucaccaucgccgggggcaaguggacgaccuaccgcagcauggccgaggacaccaucaacgccgccgugaagacccacaaccugaaggcgggcccgucccggacggucgggcuguuccugcagggcgggaaggacuggagccccacccuguacauccgccucgugcaggacuacggccuggaguccgagguggcccagcaccuggccgccaccuacggggacaaggccuucgaggucgcgaagauggccagcgugaccggcaagcgguggcccaucgugggcguccgccucguguccgaguuccccuacaucgaggccgaggugaaguacgggaucaaggaguacgccugcacggcggucgacaugaucagccggcgcacccggcuggccuuccugaacgugcaggccgccgaggaggcccugccgcgcaucguggagcucaugggccgggagcugaacugggacgacuacaagaagcaggagcagcuggagaccgcgcgcaaguuccucuacuacgagaugggguacaagucccggagcgagcagcugaccgaccgcuccgagaucagccugcuccccagcgacaucgaccgguacaagaagcgcuuccacaaguucgacgccgaccagaagggcuucaucacgaucgucgacgugcagcgggugcuggaguccaucaacguccagauggacgagaacacccugcacgagauccucaacgagguggaccugaacaagaacggccagguggagcugaacgaguuccuccagcugaugagcgccauccagaaggggcgcgucuccggcagccggcuggccauccucaugaagaccgccgaggagaaccuggaccgccgggugcccauccccguggaccgcuccugcgggggccuguga

SEQ ID NO: 30735 - RNA, 1128 nt, Artificial Sequence
  derived and/or modified sequence opt1 from GPER1__Homo_sapiens__NP_001091671
auggacgugaccagccaggcccgcggcgucgggcuggagauguaccccggcaccgcccagccggcggcccccaacacgaccucccccgagcucaaccugagccacccccugcucgggaccgcccuggccaacggcaccggggagcuguccgagcaccagcaguacgugaucggccucuuccugagcugccuguacacgaucuuccucuucccgaucggcuucguggggaacauccugauccuggucgugaacaucuccuuccgggagaagaugaccauccccgaccucuacuucaucaaccuggccguggcggaccugauccucgucgccgacagccugaucgagguguucaaccugcacgagcgcuacuacgacaucgccgugcucugcaccuucaugucccuguuccugcaggucaacauguacagcuccguguucuuccucaccuggaugagcuucgaccgguacaucgcccuggcgcgcgccaugcggugcucccuguuccgcacgaagcaccacgcccggcucagcugcggccugaucuggauggccuccgugagcgccacccugguccccuucaccgcggugcaccuccagcacaccgacgaggccugcuucugcuucgccgacgugcgcgagguccaguggcuggaggugacgcugggguucaucgugcccuucgccaucaucggccucugcuacucccugaucguccgggugcuggugcgcgcccaccggcaccgcgggcuccggccgcgccggcagaaggcgcugcgcaugauccuggccgucgugcucguguucuucgucugcuggcugcccgagaacguguucaucagcguccaccuccugcagcggacccagcccggcgccgcccccugcaagcaguccuuccgccacgcccacccgcugaccggccacaucgugaaccuggcggccuucagcaacuccugccucaacccccugaucuacagcuuccugggggagaccuuccgggacaagcuccgccuguacaucgagcagaagacgaaccugcccgcccucaaccgguucugccacgccgcccugaaggcggugauccccgacagcaccgagcaguccgacguccgcuucagcuccgccguguga

SEQ ID NO: 30736 - RNA, 390 nt, Artificial Sequence
  derived and/or modified sequence opt1 from GPHA2__Homo_sapiens__NP_570125
augcccauggccagcccgcagacccuggugcucuaccugcugguccucgccgugaccgaggcguggggccaggaggccgugauccccgggugccaccuccaccccuucaacgucacggugcgcuccgaccggcaggggaccugccagggcagccacguggcccaggccugcgucggccacugcgaguccagcgccuuccccucccgcuacagcgugcugguggcguccggguaccggcacaacaucaccagcgucucccagugcugcaccaucagcggccugaagaaggugaaggugcagcugcagugcgucggcucccgccgggaggagcuggagaucuucacggcccgcgccugccagugcgacaugugccggcucagccgcuacuga

SEQ ID NO: 30737 - RNA, 2211 nt, Artificial Sequence
  derived and/or modified sequence opt1 from GPHN__Homo_sapiens__NP_001019389
auggccaccgagggcaugauccugaccaaccacgaccaccagauccgcguggggguccucacggugagcgacuccugcuuccggaaccuggccgaggaccgcagcggcaucaaccugaaggaccucgugcaggaccccucccugcucgggggcaccaucagcgcguacaagaucgucccggacgagaucgaggagaucaaggagacccugaucgacuggugcgacgagaaggagcugaaccugauccucaccaccgggggcacgggcuucgcgccccgggacgugacccccgaggccaccaaggaggugaucgagcgcgaggcccccgggauggcccuggccaugcugaugggcucccucaacgucacgccgcuggggaugcugagccggcccgugugcggcauccgcgggaagacccucaucaucaaccugcccggcuccaagaagggcagccaggagugcuuccaguucauccugcccgcccucccgcacgccaucgaccugcugcgggacgccaucgugaaggucaaggaggugcacgacgagcucgaggaccugcccuccccgcccccgccccugagcccgccgcccaccaccagcccccacaagcagacggaggacaagggggugcagugcgaggaggaggaggaggagaagaaggacuccggcgucgcguccaccgaggacagcuccagcucccacaucaccgccgccgccaucgccgcgaagauccccgacagcaucaucucccgcgggguccaggugcucccccgggacaccgccagccugagcacgacccccuccgagagcccccgcgcccaggccaccucccggcugagcaccgccuccugccccacgcccaaggugcagagccgcugcuccagcaaggagaacauccuccgggcgucccacagcgccguggacaucaccaagguggcccgccggcaccgcaugucccccuucccccugaccagcauggacaaggccuucaucaccguccuggagaugacgcccgugcucggcaccgagaucaucaacuaccgggacggcauggggcgcgugcuggcccaggacgucuacgcgaaggacaaccugcccccguuccccgccuccgugaaggacggcuacgccgugcgggccgccgacgggcccggcgaccgcuucaucaucggggagagccaggcgggcgagcagccgacccagaccgucaugcccggccaggugaugcgggucacgaccggggcccccauccccugcggcgccgacgccguggugcaggucgaggacaccgagcucauccgcgaguccgacgacgggaccgaggagcuggaggugcgcauccuggugcaggcgcggccgggccaggacauccgccccaucgggcacgacaucaagcggggcgagugcguccucgccaagggcacgcacauggggcccagcgagaucggccugcuggccaccgugggggugaccgaggucgaggugaacaaguuccccguggucgccgugauguccaccggcaacgagcuccugaacccggaggacgaccugcuccccgggaagauccgcgacagcaaccgguccacgcugcuggccaccauccaggagcacggcuaccccaccaucaaccucggcaucgugggggacaaccccgacgaccugcugaacgcgcucaacgagggcaucagccgcgccgacgucaucaucaccagcgggggcguguccaugggcgagaaggacuaccugaagcagguccuggacaucgaccugcacgcccagauccacuucgggcggguguucaugaagccgggccuccccaccacguucgccacccuggacaucgacggggugcgcaagaucaucuucgcccugcccggcaaccccgugagcgcggucgugaccugcaaccucuucguggucccggcccugcggaagaugcaggggauccuggacccccgccccaccaucaucaaggcccggcucuccugcgacgugaagcuggacccccgcccggaguaccaccggugcauccugacguggcaccaccaggagccccuccccugggcccagagcaccggcaaccagauguccagccgccugauguccaugcggagcgccaacggccugcucaugcugcccccgaagaccgagcaguacguggagcugcacaagggggaggucguggacgugauggucaucggccgccucuga

SEQ ID NO: 30738 - RNA, 555 nt, Artificial Sequence
  derived and/or modified sequence opt1 from GPIHBP1__Homo_sapiens__NP_835466
augaaggcccugggcgccgugcuccuggcgcugcuccuguucgggcgccccggccgggggcagacccagcaggaggaggaggaggaggacgaggaccacggcccggacgacuacgacgaggaggacgaggacgaggucgaggaggaggagaccaaccgccugcccgggggccggagccgcgugcuccugcggugcuacacgugcaagucccugccccgcgacgagcggugcaaccucacccagaacugcagccacggccagaccugcaccacgcugaucgcccacgggaacaccgaguccggccugcucaccacccacagcacguggugcaccgacuccugccagcccaucaccaagaccguggaggggacgcaggucaccaugaccugcugccagagcucccugugcaacgugccgcccuggcagagcucccgcgugcaggaccccaccggcaagggggccggcggcccccgggggagcuccgagacggucggcgccgcccugcuccugaaccugcucgcggggcugggcgccaugggcgcccgccggccguga

SEQ ID NO: 30739 - RNA, 1710 nt, Artificial Sequence
  derived and/or modified sequence opt1 from GPI__Homo_sapiens__NP_001171651
augguggcccugugcagccuccagcaccugggcuccagcgacccccgcgcccugccgacccuccccaccgcgacguccgggcagcggcccgccaagcgccggcgcaagagccccgccauggccgcccugacccgggacccgcaguuccagaagcugcagcagugguaccgcgagcaccgguccgagcucaaccugcgccggcuguucgacgcgaacaaggaccgcuucaaccacuucagccucacccugaacaccaaccacggccacauccuggucgacuacuccaagaaccucgugacggaggacgugaugcggaugcuggucgaccuggccaagagccgcgggguggaggccgcccgggagcgcauguucaacggcgagaagaucaacuacaccgaggggcgggcggugcuccacgucgcccugcgcaaccgguccaacacccccauccugguggacggcaaggacgugaugcccgaggucaacaaggugcucgacaagaugaaguccuucugccagggcccccugauggugaccgaggcccugaagccguacagcagcgggggcccccgcgucugguacguguccaacaucgacgggacgcacaucgccaagacccucgcccagcugaaccccgagagcucccuguucaucaucgcgagcaagaccuucaccacgcaggagaccaucaccaacgccgagaccgccaaggagugguuccuccaggccgccaaggaccccuccgcgguggccaagcacuucgucgcccugagcacgaacaccaccaaggugaaggaguucggcaucgacccgcagaacauguucgaguucugggacugggucgggggccgguacucccuguggagcgccaucggccucagcaucgcccugcacgugggguucgacaacuucgagcagcugcucuccggcgcgcacuggauggaccagcacuuccgcaccacgccccuggagaagaacgcccccgugcugcucgcccugcuggggaucugguacaucaacugcuucggcugcgagacccacgccaugcuccccuacgaccaguaccugcaccgguucgccgcguacuuccagcagggcgacauggagagcaacgggaaguacaucaccaaguccggcacccgcguggaccaccagacggggccgaucgucuggggcgagcccgggaccaacggccagcacgccuucuaccagcugauccaccagggcaccaagaugauccccugcgacuuccucauccccgugcagacccagcacccgauccgcaaggggcugcaccacaagauccugcucgccaacuuccuggcccagacggaggcgcugaugcggggcaagagcaccgaggaggcccgcaaggagcuccaggccgccgggaagucccccgaggaccuggagcggcugcucccccacaagguguucgagggcaaccgccccaccaacagcaucgucuucaccaagcugacgccguucaugcugggggcccugguggcgauguacgagcacaagaucuucguccagggcaucaucugggacaucaacuccuucgaccaguggggcguggagcucgggaagcagcuggccaagaagaucgagcccgagcuggacggcagcgcccaggugaccucccacgacgccagcaccaacgggcucaucaacuucaucaagcagcagcgggaggcccgcguccaguga

SEQ ID NO: 30740 - RNA, 1431 nt, Artificial Sequence
  derived and/or modified sequence opt1 from GPKOW__Homo_sapiens__NP_056513
auggccgacagcaaggagggcgugcugccccucaccgccgcguccaccgccccgaucagcuucggguucacgcgcaccuccgcccggcgccggcuggccgacagcggcgacggggccggccccucccccgaggagaaggacuuccugaagaccgucgaggggcgcgagcuccagagcgugaagccccaggaggcgccgaaggagcuggugaucccccugauccagaacggccaccggcgccagccgcccgcccggccgcccggccccuccaccgacacgggggcccucgccgacggcgucgugagccaggcggugaaggagcugaucgccgaguccaagaagucccuggaggagcgcgagaacgccggggucgaccccacccucgccauccccaugauccagaagggcugcacccccagcggggagggcgccgacagcgagccccgggcggagaccgugcccgaggaggccaacuacgaggccgugccggucgaggccuacggccuggccaugcugcgcgggaugggcuggaagcccggggagggcaucggccggacguucaaccagguggugaagccccgcgucaacucccuccggcccaaggggcugggccugggggcgaaccucaccgaggcccaggcccugaccccgaccggccccagccgcaugccccggcccgacgaggagcaggagaaggacaaggaggaccagccgcaggggcuggugcccggcggcgccguggucgugcucuccgggccccaccgcggccuguacgggaagguggagggccuggaccccgacaacguccgggccauggugcgccucgcgguggggagccgggucgugacgguguccgaguacuaccugcgcccggucagccagcaggaguucgacaagaacacccuggaccuccggcagcagaacggcaccgccuccagccgcaagacccuguggaaccaggagcuguacauccagcaggacaacagcgagcgcaagcggaagcaccuccccgaccgccaggacggccccgccgccaaguccgagaaggccgcgccgcggagccagcacuggcugcaccgcgaccugcgggugcgcuucgucgacaacauguacaagggcgggcaguacuacaacacgaagaugaucaucgaggacgugcucucccccgacacgugcgugugccggaccgacgaggggcgcguccuggagggccugcgggaggacaugcucgagacccuggugcccaaggccgagggggaccgcgugauggucgugcugggcccccagaccggccggguggggcaccuccugagccgcgaccgggcccgcucccgggcccugguccagcucccgcgcgagaaccaggugguggagcugcacuacgacgcgaucugccaguacaugggccccagcgacaccgacgacgacuga

SEQ ID NO: 30741 - RNA, 2523 nt, Artificial Sequence
  derived and/or modified sequence opt1 from GPLD1__Homo_sapiens__NP_001494
augagcgccuuccgccuguggcccggccuccugaucaugcuggggucccucugccaccggggcagcccgugcgggcuguccacccacguggagaucggccaccgcgcccuggaguuccuccagcugcacaacgggcgggucaacuaccgcgagcugcuccuggagcaccaggacgcguaccaggccggcaucguguuccccgacugcuucuaccccagcaucugcaagggcgggaaguuccacgacguguccgagagcacccacuggacgcccuuccugaacgccuccguccacuacauccgggagaacuacccgcuccccugggagaaggacaccgagaagcugguggccuuccuguucggcaucaccagccacauggccgcggacguguccuggcacagccucgggcuggagcagggcuuccugcgcaccaugggggccaucgacuuccacggcuccuacagcgaggcccacuccgccggcgacuucgggggcgacguccucagccaguucgaguucaacuucaacuaccuggcgcggcgcugguacgugcccgugaaggaccugcucgggaucuacgagaagcuguacggccggaaggucaucacggagaacgugaucguggacugcucccacauccaguuccuggagauguacggcgagaugcucgccgucagcaagcuguaccccaccuacuccaccaagagcccguuccugguggagcaguuccaggaguacuuccucgggggccuggacgacauggccuucugguccaccaacaucuaccaccugacgagcuucaugcucgagaacgggaccagcgacugcaaccugcccgagaacccccuguucaucgccugcggcgggcagcagaaccacacccagggcuccaagaugcagaagaacgacuuccaccgcaaccucaccacgagccugaccgaguccguggaccggaacaucaacuacaccgagcgcggcgucuucuucagcgugaacuccuggacccccgacagcauguccuucaucuacaaggcccuggagcggaacauccgcacgauguucaucgggggcagccagcucucccagaagcacgugagcuccccgcuggcgagcuacuuccuguccuuccccuacgcccggcucgggugggccaugaccagcgccgaccugaaccaggacggccacggggaccuggucgugggcgcccccggcuacucccgccccgggcacauccacaucggccggguguaccucaucuacgggaacgaccugggccugccgcccgucgaccucgaccuggacaaggaggcgcaccgcauccuggagggguuccagcccagcggccgguucggcuccgcccucgccgugcuggacuucaacguggacgggguccccgaccuggccgugggcgccccgagcgucggguccgagcagcugaccuacaagggcgcgguguacguguacuucggcagcaagcagggcgggaugagcuccagccccaacaucaccaucuccugccaggacaucuacugcaaccucggguggacgcugcuggccgccgacgucaacggcgacagcgagcccgaccucgugaucgggucccccuucgccccgggcggcgggaagcagaagggcaucguggccgcguucuacagcgggcccucccugagcgacaaggagaagcugaacgucgaggccgccaacuggaccgugcgcggcgaggaggacuucuccugguucggguacagccuccacggcgugaccgucgacaaccggacccugcugcucgugggcucccccacguggaagaacgccagccgccuggggcaccuccugcacauccgcgacgagaagaagucccugggccggguguacggguacuucccgcccaacggccagagcugguucaccaucuccggggacaaggcgaugggcaagcugggcaccagccucuccagcgggcacguccugaugaacggcacccugaagcagguccuccuggugggggcccccacguacgacgacgugagcaagguggccuuccugaccgugacccuccaccagggcggggccacccgcauguacgcccugacguccgacgcgcagccccugcuccugagcaccuucuccggcgaccggcgcuucagccgguucggcgggguccugcaccucuccgaccuggacgacgacggccuggacgagaucaucauggccgccccgcuccgcaucgccgacgugaccagcgggcugaucggcggcgaggacgggcggguguacgucuacaacggcaaggagaccacgcugggggacaugaccggcaagugcaaguccuggaucacccccugccccgaggagaaggcccaguacgugcucaucagccccgaggcguccagccgcuucggguccagccugaucaccgugcgguccaaggccaagaaccaggucgugaucgccgccggccgcagcucccugggcgcccggcucagcggggcgcugcacguguacucccugggcagcgacuga

SEQ ID NO: 30742 - RNA, 816 nt, Artificial Sequence
  derived and/or modified sequence opt1 from GPM6A__Homo_sapiens__NP_001248377
augaccgaccuggagggcugcuucgagugcugcaucaagugccucgggggcauccccuacgccagccugaucgccaccauccugcucuacgcggggguggcccuguucugcggcugcgggcacgaggcccuguccggcacggucaacauccuccagaccuacuucgagauggcccgcaccgccggcgacacccuggacguguucacgaugaucgacaucuucaaguacgugaucuacgggaucgcggccgccuucuucgucuacggcauccugcucaugguggagggguucuucaccaccggcgccaucaaggaccuguacggggacuucaagaucaccacgugcggccggugcgugagcgcgugguucaucaugcugaccuaccucuucaugcuggccuggcugggcgucaccgccuucaccucccucccgguguacauguacuucaaccuguggacgaucugccgcaacaccacccugguggagggggccaaccucugccuggaccugcggcaguucggcaucgucaccaucggggaggagaagaagaucugcacggugagcgagaacuuccuccgcaugugcgaguccaccgagcugaacaugaccuuccaccuguucaucguggcccucgcgggcgccggcgccgccgucaucgccauggugcacuaccugauggugcugagcgcgaacugggccuacgucaaggacgccugccggaugcagaaguacgaggacaucaaguccaaggaggagcaggagcuccacgacauccacagcacccgcuccaaggagcggcugaacgccuacacguga

SEQ ID NO: 30743 - RNA, 741 nt, Artificial Sequence
  derived and/or modified sequence opt1 from GPM6B__Homo_sapiens__NP_001001994
augggcugcuucgagugcugcaucaagugccucgggggcgugcccuacgccagccuggucgccaccauccugugcuucuccgggguggcgcuguucugcggcugcgggcacguggcccucgccggcaccgucgccauccuggagcagcacuucagcacgaacgccuccgaccacgcgcugcucagcgaggugauccagcugaugcaguacgugaucuacggcaucgccuccuucuucuuccuguacgggaucauccuccuggccgagggcuucuacaccaccagcgccgucaaggagcugcacggggaguucaagaccacggcgugcggccgcugcaucuccgggauguucguguuccucaccuacgugcugggcgucgccuggcugggcguguucggguucagcgccgugccggucuucauguucuacaacaucugguccacgugcgaggugaucaagagcccccagaccaacggcaccaccgggguggagcagaucugcgucgacauccggcaguacggcaucauccccuggaacgccuuccccggcaagaucugcggguccgcccucgagaacaucugcaacaccaacgaguucuacaugagcuaccaccuguucaucguggcgugcgccggcgccggggccaccgugaucgcccugcucaucuacaugauggcgacgaccuacaacuacgccguccugaaguucaagucccgcgaggacugcugcaccaaguucuga

SEQ ID NO: 30744 - RNA, 1089 nt, Artificial Sequence
  derived and/or modified sequence opt1 from GPN1__Homo_sapiens__NP_001138519
augaccggccacacccgcagcucccugccccggugcacggggaucgugcuccugaucaagcugcgcuucagcgagcggcucaccggccaccuccacgcccaggggaccccgcccuacgucaucaaccuggaccccgccgugcacgaggugcccuucccggcgaacaucgacauccgcgacaccgucaaguacaaggaggugaugaagcaguacggccucgggcccaacggcggcaucgugacgucccugaaccuguucgccacccgguucgaccaggucaugaaguucaucgagaaggcccagaacaugagcaaguacgugcucaucgacacccccgggcagaucgagguguucaccugguccgccagcggcacgaucaucaccgaggcccuggcguccagcuuccccaccgucgugaucuacgugauggacaccucccgcagcacgaacccggucaccuucauguccaacaugcuguacgccugcagcauccucuacaagaccaagcugcccuucaucguggugaugaacaagaccgacaucaucgaccacuccuucgccgucgaguggaugcaggacuucgaggccuuccaggacgcgcugaaccaggagacgaccuacgugagcaaccucacccgguccaugagccuggugcuggacgaguucuacuccagccuccgcgucguggggguguccgccguccugggcaccgggcuggacgagcuguucguccaggugacgagcgccgccgaggaguacgagcgggaguaccgccccgaguacgagcggcugaagaagucccuggccaacgcggagagccagcagcagcgcgagcagcucgagcggcugcgcaaggacaugggcagcguggcccuggacgccggcaccgccaaggacucccucagccccgugcugcacccguccgaccugauccucacccgggggacccuggacgaggaggacgaggaggccgacagcgacacggacgacaucgaccaccgcgucaccgaggagucccacgaggagcccgcguuccagaacuucaugcaggagagcauggcccaguacuggaagcggaacaacaaguga

SEQ ID NO: 30745 - RNA, 1719 nt, Artificial Sequence
  derived and/or modified sequence opt1 from GPNMB__Homo_sapiens__NP_001005340
auggagugccuguacuacuuccucggcuuccugcugcucgccgcccgccugccccuggacgcggccaagcgguuccacgacgugcucgggaacgagcgcccgagcgccuacaugcgggagcacaaccagcugaacggcugguccagcgacgagaacgacuggaacgagaagcuguaccccgucuggaagcgcggggacaugcgguggaagaacuccuggaagggcgggcgcgugcaggccgugcucaccagcgacucccccgcccuggucggcagcaacaucaccuucgcggugaaccugaucuucccccggugccagaaggaggacgccaacggcaacaucguguacgagaagaacugccgcaacgaggccgggcucuccgccgacccguacgucuacaacuggacggcguggagcgaggacuccgacggcgagaacgggaccggccagagccaccacaacguguuccccgacgggaagcccuucccccaccacccgggcuggcggcgcuggaacuucaucuacguguuccacacccugggccaguacuuccagaagcuggggcggugcuccguccgcgugagcgugaacaccgccaacgucacgcucggcccccagcugauggaggugaccguguaccggcgccacgggcgggccuacguccccaucgcccaggugaaggacguguacgucgugaccgaccagauccccguguucgucaccauguuccagaagaacgaccgcaacuccagcgacgagacguuccugaaggaccucccgaucauguucgacgugcugauccacgaccccucccacuuccugaacuacagcaccaucaacuacaagugguccuucggcgacaacaccggccucuucgugagcaccaaccacacggucaaccacaccuacgugcugaacgggaccuucucccugaaccucaccgucaaggccgcggcccccggccccugcccgcccccgccgcccccgccccggcccagcaagcccacgcccagccuggccaccacccugaaguccuacgacagcaacacccccgggcccgccggcgacaacccccucgagcugucccgcauccccgacgagaacugccagaucaaccgguacgggcacuuccaggccacgaucaccaucguggagggcauccuggaggugaacaucauccagaugaccgacguccucaugcccgugccguggcccgagagcucccugaucgacuucguggugaccugccagggcagcauccccacggaggucugcaccaucaucuccgacccgaccugcgagaucacccagaacacggugugcagccccgucgacguggacgagaugugccugcucaccgugcgccggaccuucaacggguccggcaccuacugcgucaaccugacgcugggggacgacaccagccucgcgcugaccuccacccugaucagcgugcccgaccgcgaccccgccagcccccuccgcauggccaacuccgcccugaucuccgugggcugccuggccaucuucgucacggugaucagccuccugguguacaagaagcacaaggaguacaacccgaucgagaacucccccgggaacgucgugcggagcaagggccuguccguguuccucaaccgcgcgaaggccgucuucuuccccggcaaccaggagaaggacccccugcugaagaaccaggaguucaagggggugagcuga

SEQ ID NO: 30746 - RNA, 1527 nt, Artificial Sequence
  derived and/or modified sequence opt1 from GPR101__Homo_sapiens__NP_473362
augaccagcacgugcaccaacuccacccgcgagagcaacuccagccacacgugcaugccccuguccaagaugccgaucagccucgcccacggcaucauccgguccaccgugcuggucaucuuccuggccgcgagcuucguggggaacaucgugcucgcccugguccugcagcgcaagccccagcuccuccaggugaccaaccgguucaucuucaaccugcucgugaccgaccugcugcagaucucccucgucgcccccugggugguggccaccagcgucccccuguucuggccgcugaacucccacuucugcaccgcccucgugagccugacgcaccuguucgcguucgccuccgugaacaccaucgucguggugagcgucgaccgcuaccucuccaucauccacccccugagcuaccccuccaagaugacccagcggcgcggcuaccugcuccuguacgggaccuggaucguggccauccugcagagcacgcccccgcucuacggcugggggcaggccgcguucgacgagcggaacgcccugugcuccaugaucuggggcgccagccccagcuacaccauccuguccguggucagcuucaucgugaucccccucaucgugaugaucgccugcuacuccgucguguucugcgccgcgcgccggcagcacgcccugcuguacaacgugaagcgccacagccucgagguccgggugaaggacugcgucgagaacgaggacgaggagggcgccgagaagaaggaggaguuccaggacgaguccgaguuccgccggcagcacgagggggaggugaaggccaaggagggccgcauggaggccaaggacgggagccugaaggcgaaggagggcuccaccgggaccagcgaguccagcguggaggcccggggcuccgaggagguccgcgagagcuccacgguggccagcgacggcuccauggaggggaaggagggcagcaccaagguggaggagaacuccaugaaggccgacaaggggcggaccgaggucaaccagugcagcaucgaccugggcgaggacgacauggaguucggcgaggacgacaucaacuucuccgaggacgacguggaggccgugaacauccccgagagccucccgcccagccgccggaacuccaacagcaacccgccccugccccgcugcuaccagugcaaggcggccaaggucaucuucaucaucaucuucuccuacgugcugagccucgggcccuacugcuuccuggccgugcuggccgucuggguggacguggagacccaggucccccagugggugaucacgaucaucaucuggcuguucuuccugcagugcugcauccaccccuacguguacggcuacaugcacaagaccaucaagaaggagauccaggacaugcugaagaaguucuucugcaaggagaagccgcccaaggaggacucccaccccgaccuccccgggaccgagggcgggaccgagggcaagaucgucccgagcuacgacuccgccacguuccccuga

SEQ ID NO: 30747 - RNA, 1008 nt, Artificial Sequence
  derived and/or modified sequence opt1 from GPR119__Homo_sapiens__NP_848566
auggagagcuccuucagcuucggcgugauccuggccguccucgccucccugaucaucgcgaccaacacccugguggccguggccguccuccugcugauccacaagaacgacggggugagccucugcuucacgcugaaccuggccguggccgacacccucaucggcgucgcgaucuccgggcugcugaccgaccagcucagcucccccagccgcccgacccagaagacgcugugcucccugcggauggccuucgugaccagcuccgccgccgcgagcgugcucaccgucaugcugaucaccuucgaccgcuaccuggccaucaagcagcccuuccgguaccucaagaucauguccggcuucguggccggggccugcaucgccggccuguggcuggugagcuaccucaucggcuuccugccccuggggauccccauguuccagcagacggcguacaagggccagugcuccuucuucgccgucuuccacccgcacuucgugcucacccugagcugcgugggguucuuccccgccaugcuccuguucgucuucuucuacugcgacaugcugaagaucgccuccaugcacagccagcagauccgcaagauggagcacgccggcgcgauggccgggggcuaccggagcccccgcacccccuccgacuucaaggcccugcggaccgugagcgugcucaucggcuccuucgcccugagcuggacgccguuccugaucaccgggaucguccagguggccugccaggagugccaccucuaccuggugcuggagcgcuaccucuggcugcugggcgucgggaacucccuccugaacccccugaucuacgcguacuggcagaaggaggugcggcuccagcuguaccacauggcccugggcgugaagaagguccucaccagcuuccugcuguuccucuccgcccgcaacugcggccccgagcggccccgcgagagcuccugccacaucgugaccaucagcuccagcgaguucgacggguga

SEQ ID NO: 30748 - RNA, 1005 nt, Artificial Sequence
  derived and/or modified sequence opt1 from GPR12__Homo_sapiens__NP_005279
augaacgaggaccugaaggugaaccucagcggccugccccgcgacuaccuggacgccgccgcggccgagaacaucuccgccgccgucagcucccgggugccggccguggagcccgagcccgagcucgucgugaaccccugggacaucgugcugugcaccagcgggacccugaucuccugcgagaacgcgaucgucgugcucaucaucuuccacaacccgagccugcgcgcccccauguuccugcucaucggcucccuggcccuggccgaccuccuggcggggaucggccugaucacgaacuucguguucgccuaccuccugcagagcgaggccaccaagcuggucaccaucgggcucaucguggccuccuucagcgccuccgugugcagccugcuggcgaucaccgucgaccgguaccucucccuguacuacgcccugacguaccacagcgagcgcaccgugaccuucaccuacgugaugcucgucaugcuguggggcacguccaucugccugggccuccugcccgugaugggguggaacugccugcgggacgagagcacgugcuccgugguccgcccccucaccaagaacaacgccgccauccugagcguguccuuccuguucauguucgcccucaugcugcagcuguacauccagaucugcaagaucgugaugcggcacgcgcaccagaucgcccuccagcaccacuuccuggccaccagccacuacgucaccacccgcaagggcgugagcacccuggccaucauccucgggaccuucgccgcgugcuggaugccguucacgcuguacucccugaucgccgacuacaccuaccccagcaucuacaccuacgccacccuccugcccgccacguacaacuccaucaucaaccccgugaucuacgccuuccggaaccaggagauccagaaggcgcugugccucaucugcugcggcugcaucccgagcucccuggcccagcgcgcccggagccccuccgacgucuga

SEQ ID NO: 30749 - RNA, 1143 nt, Artificial Sequence
  derived and/or modified sequence opt1 from GPR132__Homo_sapiens__NP_001265623
augugccccaugcugcucaagaacggcuacaacgggaacgccaccccggugaccacgaccgcccccugggcgagccugggccuguccgccaagaccugcaacaacgucagcuucgaggagucccgcaucgugcucguggucguguacagcgccgugugcacccuggggguccccgccaacugccugacggccuggcucgcgcugcuccaggugcugcagggcaacgugcuggccgucuaccugcucugccuggcccugugcgagcuccuguacaccgggacccugccccucugggugaucuacauccggaaccagcaccgcuggacccugggccugcucgccugcaaggugacggcguacaucuucuucugcaacaucuacgucuccauccuguuccugugcugcaucagcugcgaccgguucguggccguggucuacgcccucgagucccgcggccggcgccggcgccggaccgccauccugaucagcgccugcaucuucauccugguggggaucgugcacuacccggucuuccagaccgaggacaaggagaccugcuucgacaugcuccagauggacucccgcaucgcgggcuacuacuacgcccgguucacggugggguucgccaucccccugagcaucaucgccuucaccaaccaccgcaucuuccgguccaucaagcagagcaugggccuguccgccgcgcagaaggccaaggugaagcacagcgccaucgccgucguggugaucuuccucgucugcuucgcccccuaccaccuggugcugcucgucaaggcggccgccuucuccuacuaccgcggggaccggaacgccaugugcggccuggaggagcgccuguacaccgccagcgugguguuccucugccuguccaccgucaacggcguggcggaccccaucaucuacgugcuggccacggaccacagccggcaggaggucucccgcauccacaagggguggaaggaguggagcaugaagaccgacgugacccggcucacccacagccgcgacacggaggagcugcaguccccgguggcccuggccgaccacuacaccuucagccggcccguccacccgcccggcucccccugccccgcgaagcgccucaucgaggagagcugcuga

SEQ ID NO: 30750 - RNA, 1485 nt, Artificial Sequence
  derived and/or modified sequence opt1 from GPR135__Homo_sapiens__NP_072093
auggaggagccccagccgccccgcccgcccgccagcauggcccugcucggcucccagcacagcggggcgcccuccgccgccggcccgcccgggggcaccagcuccgccgccaccgcggccgugcugagcuucuccacggucgccaccgccgcgcuggggaaccucagcgacgccuccggcggcgggaccgccgccgcccccggcgggggcgggcugggcggcagcggggcggcccgggaggccggcgccgccgugcgccggccccuggggcccgaggcggcgccccuccugucccacggcgccgccguggccgcccaggcccugguccuccugcugaucuuccuccugagcucccugggcaacugcgccgugaugggggugaucgucaagcaccgccagcuccggaccgugacgaacgccuucauccugagccugucccucagcgaccugcugaccgcccuccugugccugcccgcggccuuccucgaccuguucaccccgcccggcggguccgcccccgccgcggccgccggccccuggcgcggguucugcgccgccagccgguucuucuccagcugcuucggcaucgugagcacccuguccgucgcgcucaucagccuggaccgcuacugcgccaucgugcggccgccccgcgagaagaucggccggcgccgggcccugcagcuccuggccggggccuggcugacggcgcucggcuucucccugcccugggagcugcucggggcgccccgcgagcuggccgccgcccagagcuuccacggcugccuguaccggaccuccccggaccccgcccagcucggggccgccuucagcgugggccuggucguggccugcuaccugcuccccuuccugcugaugugcuucugccacuaccacaucugcaagaccgugcgccucuccgacguccgggugcgccccgugaacaccuacgcgcggguccugcgcuucuucagcgaggugcggacggccaccaccgugcugaucaugaucgucuucgugaucugcugcuggggcccguacugcuuccucgugcugcuggccgccgcccgccaggcgcagaccaugcaggcccccucccugcucagcgucguggccgucuggcugacgugggccaacggggccaucaaccccgugaucuacgcgauccgcaaccccaacaucuccaugcugcucggccggaaccgcgaggagggguaccggacccgcaacguggacgccuuccugccgagccagggccccgggcugcaggcccggucccgcagccggcuccgcaaccgguacgccaaccgccugggcgccugcaaccggauguccagcuccaaccccgcgagcggcgucgccggggacguggccaugugggcccgcaagaacccggugguccuguucugccgggagggcccgcccgagcccgugaccgcggugaccaagcagcccaaguccgaggccggggacacgagccucuga

SEQ ID NO: 30751 - RNA, 1290 nt, Artificial Sequence
  derived and/or modified sequence opt1 from GPR137C__Homo_sapiens__NP_001093122
augcgcgugagcguccccggcccggccgccgccgccgcccccgccgccgggcgggagcccuccacccccggcgggggcagcgggggcggcggggcgguggccgccgccuccggcgcggccgugccggggagcguccagcuggcccucuccgugcugcacgcccugcucuacgccgcgcuguucgccuucgccuaccugcagcucuggcgccugcugcucuaccgggagcgccggcugagcuaccagucccugugccucuuccugugccugcucugggccgcccugcgcaccacgcuguucagcgcggccuucucccucagcggcucccugccccugcuccggccgcccgcccaccuccacuucuucccccacuggcugcucuacugcuuccccagcugccugcaguucuccacccugugccuccugaaccuguaccucgccgaggugaucugcaagguccgcugcgccaccgagcuggaccggcacaagauccugcuccaccugggguucaucauggcgagccugcuguuccugguggugaaccugaccugcgccaugcucguccacggcgacgugcccgagaaccagcugaaguggacgguguucguccgcgcccugaucaacgacucccucuucauccugugcgccaucagccuggugugcuacaucugcaagaucaccaagauguccagcgccaacguguaccucgaguccaagggcaugagccugugccagaccgucgugguggggagcgucgugauccugcucuacuccagccgggcgugcuacaaccugguggucgugaccaucucccaggacacgcuggagagccccuucaacuacggcugggacaaccuguccgacaaggcccacguggaggacaucagcggggaggaguacaucgucuucggcaugguccucuuccugugggagcacgugccggccugguccguggugcuguucuuccgcgcccagcggcucaaccagaaccuggcgcccgccggcaugaucaacagccacuccuacagcucccgcgccuacuucuucgacaacccccggcgcuacgacagcgacgacgaccugccccggcucggguccagccgcgagggcucccugccgaacagccagucccuggggugguacggcaccaugaccgggugcggcagcuccagcuacaccgucacgccccaccucaacggccccaugaccgacaccgcgccccugcuguucacgugcagcaaccucgaccugaacaaccaccacucccuguacgugaccccgcagaacuga

SEQ ID NO: 30752 - RNA, 1062 nt, Artificial Sequence
  derived and/or modified sequence opt1 from GPR139__Homo_sapiens__NP_001002911
auggagcacacccacgcccaccuggccgcgaacagcucccucagcugguggucccccggcagcgccugcgggcugggcuucgugccggucguguacuacucccugcuccugugccuggggcuccccgccaacauccugaccgugaucauccugagccagcucgucgcccgccggcagaaguccagcuacaacuaccugcuggcccucgcggccgccgacauccuggugcuguucuucaucguguucgucgacuuccuccuggaggacuucauccugaacaugcagaugccccaggugcccgacaagaucaucgaggugcucgaguucuccagcauccacacguccaucuggaucaccgucccgcugaccaucgaccgcuacaucgccgugugccacccccugaaguaccacaccgugagcuaccccgcgcggacgcgcaaggucaucguguccguguacaucacgugcuuccucaccagcauccccuacuacugguggccgaacaucuggaccgaggacuacaucuccaccagcguccaccacgugcugaucuggauccacugcuucaccguguaccugguccccugcuccaucuucuucauccucaacagcaucaucguguacaagcugcggcgcaaguccaacuuccggcugcgcggcuacagcaccgggaagaccacggccauccucuucaccaucaccagcaucuucgccacccugugggcgccccggaucaucaugauccuguaccaccucuacggcgcccccauccagaaccgcuggcuggugcacaucauguccgacaucgccaacaugcuggcccuccugaacacggccaucaacuucuuccuguacugcuucaucagcaagcgguuccgcaccauggccgccgcgacccucaaggccuucuucaagugccagaagcagccgguccaguucuacaccaaccacaacuucuccaucacgagcucccccuggaucagccccgccaacucccacugcaucaagaugcugguguaccaguacgacaagaacggcaagcccaucaaggugagcccguga

SEQ ID NO: 30753 - RNA, 1215 nt, Artificial Sequence
  derived and/or modified sequence opt1 from GPR143__Homo_sapiens__NP_000264
auggccagcccccgccugggcaccuucugcugcccgacccgggacgccgcgacgcagcucgugcuguccuuccagccccgcgccuuccacgcccugugccucgggagcggcgggcugcggcuggcccucggccugcugcagcuccugcccgggcgccggcccgccggcccgggcucccccgcgaccagcccgcccgccuccguccgcauccugcgggccgccgcggccugcgaccuccuggggugccugggcauggugauccgcagcaccguguggcucggguuccccaacuucgucgacuccgugagcgacaugaaccacaccgagaucuggcccgccgccuucugcgugggcuccgccauguggauccagcugcuguacagcgcgugcuucugguggcuguucugcuacgccgucgacgccuaccucgugauccggcgcuccgccgggcugagcacgauccuccuguaccacaucauggccuggggccuggcgacccuccugugcguggagggcgccgccaugcuguacuaccccuccgucagccggugcgagcgcgggcucgaccacgccaucccccacuacgugaccauguaccugccgcugcuccuggugcuggucgccaaccccauccucuuccagaagaccgugacggcgguggccucccugcugaagggccggcaggggaucuacaccgagaacgagcgccggaugggcgccgucaucaagauccgcuucuucaagaucaugcucgugcugaucaucugcuggcugagcaacaucaucaacgagucccuccuguucuaccuggagaugcagaccgacaucaacggcgggagccucaagcccgugcggaccgccgccaagacgaccugguucaucaugggcauccugaaccccgcgcagggguuccugcucucccuggccuucuacggcuggaccgggugcagccugggcuuccagagcccgcgcaaggagauccagugggagucccucaccacgagcgccgccgagggcgcgcaccccagcccccugaugccccacgagaacccggccuccgggaaggucucccaggugggcgggcagaccagcgacgaggcccuguccaugcugagcgagggcuccgacgccagcaccaucgagauccacaccgccuccgagagcugcaacaagaacgagggggaccccgcgcuccccacgcacggcgaccuguga

SEQ ID NO: 30754 - RNA, 1044 nt, Artificial Sequence
  derived and/or modified sequence opt1 from GPR148__Homo_sapiens__NP_997247
augggcgacgagcuggcccccugcccgguggggaccaccgccuggcccgcgcucauccagcugaucagcaagacgcccugcaugccccaggccgccuccaacaccagccugggccucggggaccugcgcgucccguccagcaugcuguacuggcuguuccugcccuccagccugcucgccgccgcgacccuggccgugagcccccugcuccuggugaccauccugcggaaccagcgccuccggcaggagccccacuaccugcugccggccaacauccuccuguccgaccuggccuacauccuccugcacaugcugaucuccagcuccagccucggcgggugggagcugggccgcauggcgugcggcauccugacggacgccgucuucgccgccugcaccuccaccauccucagcuucaccgccaucgugcugcacacguaccuggcggugauccacccccuccgguaccuguccuucaugagccacggggccgccuggaaggccgucgcccugaucuggcucguggcgugcugcuuccccaccuuccugaucuggcuguccaaguggcaggacgcccagcucgaggagcagggcgccagcuacauccugcccccguccauggggacccagcccggcugcgggcugcucgugaucgucaccuacacgagcauccugugcgugcuguuccucugcaccgcccugaucgccaacugcuucuggcgcaucuacgcggaggccaagaccagcggcaucuggggccagggguacucccgggcccgcggcacccugcucauccacagcgugcugaucacgcuguacgucuccaccggggugguguucagccucgacaugguccugacccgguaccaccacaucgacuccggcacccacacguggcugcuggccgccaacagcgaggugcucaugaugcugccccgcgcgaugcugaccuaccucuaccugcugcgguaccgccagcuccugggcauggugcgggggcaccuccccucccgccggcaccaggccaucuucaccaucagcuga

SEQ ID NO: 30755 - RNA, 2196 nt, Artificial Sequence
  derived and/or modified sequence opt1 from GPR149__Homo_sapiens__NP_001033794
augagccuguuccucuccaaccugagcaccaacgacuccagccuguggaaggagaaccacaacuccaccgaccuccugaacccgcccggcacgcugaacaucuaccucuucugccugaccugccugaugaccuucgccgcccucguggggagcaucuacucccugaucagccugcucaagaugcagaaccgcaccgucguguccaugcugguggcgagcugguccgucgacgaccugaugagcgugcucuccgugacgaucuucauguuccugcaguggcccaacgagguccccggcuacuuccaguuccugugcaccaccagcgcccucauguaccugugccaggggcuguccagcaaccucaaggccacccugcugguguccuacaacuucuacacgaugcaccggggcguggggagccagaccgccucccgccggagcggccagguccucggcguggugcugaccgucugggccgcgagccugcuccuguccgcccugccccucugcggguggggcgccuucgugcgcaccccgugggggugccugguggacugcagcuccagcuacguccuguuccucuccaucguguacgcccuggcguucggccugcucguggggcugagcgucccccugacgcaccggcuccugugcuccgaggagccgccccgccugcacagcaacuaccaggagaucucccggggcgccagcauccccggcaccccgcccaccgccgggcgcguggugucccucagccccgaggacgcccccggccccucccugcggcgcagcgggggcugcucccccagcuccgacaccgucuucggccccggggccccggcggccgccggcgccgaggccugccggcgcgagaaccgggggacgcuguacggcacccgcagcuucaccguguccguggcgcagaagcgguucgcccucauccuggcccugaccaaggucgugcucuggcugcccaugaugaugcacauggucgugcagaacguggucggguuccagagccugccccuggagacguucagcuuccuccugacccugcucgccaccaccgugacgcccguguucguccuguccaagcgcuggacccaccucccgugcggcugcaucaucaacugccggcagaacgccuacgcgguggccagcgacggcaagaagaucaagcgcaagggguucgaguucaaccuguccuuccagaaguccuacggcaucuacaagaucgcccacgaggacuacuacgacgacgacgagaacagcaucuucuaccacaaccugaugaacagcgagugcgagaccaccaaggacccccagcgggacaaccgcaacaucuucaacgccaucaagguggagaucuccacgacccccagccuggacuccagcacccagcgggggaucaacaagugcaccaacacggacaucaccgaggccaagcaggacuccaacaacaagaaggacgcguucagcgacaagaccggcggggacaucaacuacgaggagaccacguucuccgagggccccgagcgccgccucagccacgaggagucccagaagccggaccugagcgacugggaguggugccgguccaagagcgagcgcacgccccggcagcgcagcggcuacgcccuggccaucccccucugcgccuuccaggggaccgucucccugcacgcgcccaccggcaagacccugagccucuccaccuacgaggugagcgccgaggggcagaagaucaccccggccuccaagaagaucgagguguaccggagcaaguccgucggccacgagcccaacagcgaggacuccagcuccaccuucguggacaccagcgugaagauccaccuggagguccuggagaucugcgacaacgaggaggcccucgacacgguguccaucaucagcaacaucucccagagcuccacccaggugcgcagccccucccugcgguacagccgcaaggagaaccgguucgucagcugcgaccugggggagaccgccuccuacagccucuuccugccgaccuccaaccccgacggcgacaucaacaucagcauccccgacacgguggaggcgcaccgccagaacuccaagcggcagcaccaggagcgcgacggcuaccaggaggagauccagcugcucaacaaggccuaccggaagcgcgaggaggagagcaagggguccuga

SEQ ID NO: 30756 - RNA, 1305 nt, Artificial Sequence
  derived and/or modified sequence opt1 from GPR150__Homo_sapiens__NP_954713
auggaggaccuguucagccccuccauccucccgcccgcccccaacaucagcgugcccauccugcugggcugggggcucaaccugacccugggccagggggccccggcguccggcccgcccagccgccggguccgccucguguuccugggggugauccuggucguggccguggccggcaacaccacgguccucugccggcugugcggcgggggcgggcccugggccggcccgaagcgccggaagauggacuuccugcucgugcagcuggcccuggcggaccucuacgccugcgggggcaccgcccugucccagcuggccugggagcuccugggcgagccccgcgcggccaccggggaccuggccugccgguuccuccagcugcugcaggccagcggccgcggggccuccgcgcaccucgugguccugaucgcccuggagcggcgccgggccgugcgccucccccacggccggccccugcccgcccgcgcccuggcggcccucggcuggcugcuggcccuccugcuggcccugccgcccgccuucgugguccgcggggacagccccuccccgcugcccccgccgcccccgcccaccagccugcagcccggcgcgccgcccgccgcccgggccuggcccggggagcggcgcugccacggcaucuucgcgccccucccccgguggcaccuccagguguacgccuucuacgaggccguggccggguucgucgcccccgugacggugcugggcgucgcgugcggccaccuccuguccgugugguggcgccaccggccccaggcccccgccgccgccgcgcccuggagcgccucccccgggcgcgcccccgcccccagcgcccugccccgcgcgaaggugcagucccucaagaugagccugcugcucgcccugcuguucgucggcugcgagcugcccuacuucgccgcccggcucgccgcggccugguccagcgggcccgccggcgacugggagggggagggccuguccgccgcgcugcgcgugguggccauggccaacagcgcccucaacccguucgucuaccuguucuuccaggccggcgacugccggcugcgccggcagcuccgcaagcggcuggggagccugugcugcgcgccccagggcggggccgaggacgaggagggcccccgcgggcaccaggcccucuaccggcagcgcuggccccacccgcacuaccaccacgcccggcgcgagccccuggacgagggcggccugcggcccccgccgccccgcccccggccccuccccugcuccugcgagagcgccuucuga

SEQ ID NO: 30757 - RNA, 1260 nt, Artificial Sequence
  derived and/or modified sequence opt1 from GPR151__Homo_sapiens__NP_919227
augcuggccgccgcguucgccgacagcaacuccagcuccaugaacgugagcuucgcccaccuccacuucgccggcggguaccugcccuccgacagccaggacuggcgcaccaucaucccggcccugcucgucgcggugugccuggugggcuucgucgggaaccugugcgugaucggcauccuccugcacaacgccuggaaggggaagcccuccaugauccacagccugauccucaaccugucccuggccgaccucagccugcuccuguucuccgcccccauccgggcgaccgccuacagcaaguccgugugggaccugggcugguucgucugcaagagcuccgacugguucauccacacgugcauggccgccaagagccugaccaucgugguggucgccaaggugugcuucauguacgcguccgaccccgccaagcaggucagcauccacaacuacaccaucugguccgugcucguggccaucuggaccguggccagccugcugccgcuccccgagugguucuucagcacgauccgccaccacgagggcgucgagaugugccugguggacgugcccgccgucgcggaggaguucauguccauguucgggaagcuguacccccuccuggccuucggccugccccucuucuucgccagcuucuacuucuggcgggccuacgaccagugcaagaagcgcgggaccaagacccagaaccugcggaaccagauccgcuccaagcaggucaccgugaugcugcucagcaucgccaucaucuccgcgcugcuguggcuccccgaguggguggccuggcuguggguguggcaccugaaggccgccggccccgcgcccccgcagggguucaucgcccucagccaggugcugauguucuccaucagcuccgccaacccccugaucuuccucgucaugagcgaggaguuccgggagggccugaagggcguguggaaguggaugaucacgaagaagccgcccaccgucuccgagagccaggagaccccggccgggaacuccgagggccugcccgacaaggugcccagccccgaguccccggccagcauccccgagaaggagaagcccuccagccccuccagcgggaagggcaagaccgagaaggcggagaucccgauccuccccgacguggagcaguucuggcacgagcgcgacacgguccccagcgugcaggacaacgaccccaucccgugggagcacgaggaccaggagaccggcgagggggugaaguga

SEQ ID NO: 30758 - RNA, 1413 nt, Artificial Sequence
  derived and/or modified sequence opt1 from GPR152__Homo_sapiens__NP_996880
auggacaccaccauggaggccgaccugggcgccacggggcaccgcccccggaccgagcucgacgacgaggacagcuacccgcagggcgggugggacaccguguuccuggucgcgcugcuccugcugggccuccccgccaacgggcugauggccuggcuggccggcucccaggcccgccacggcgcggggacccggcucgcccugcugcuccugagccuggcccucuccgacuuccuguuccuggccgcggccgccuuccagauccucgagauccgccacggcgggcacuggccccugggcacggccgccugccgguucuacuacuuccuguggggcgugagcuacuccagcggccucuuccugcuggcggcccucucccuggaccgcugccugcucgcccugugcccccacugguacccggggcaccggcccgugcgccugccccucugggucugcgccggggugugggugcuggccacccuguucagcguccccuggcucguguucccggaggcggccguguggugguacgaccuggucaucugccuggacuucugggacuccgaggagcucagccugcggaugcuggaggugcucggcggguuccugcccuuccugcuccugcuggugugccacguccucacccaggccaccgccugccgcacgugccaccggcagcagcagcccgccgcgugccgcggcuucgcccggguggcccgcaccauccuguccgccuacgugguccugcggcuccccuaccagcuggcccagcugcuguaccucgcguuccugugggacguguacagcggcuaccugcucugggaggcccugguguacuccgacuaccugauccuccugaacagcugccuguccccguuccucugccugauggccagcgccgaccugcgcacccuccugcgguccguccugagcuccuucgcggccgcccucugcgaggagcgccccgggagcuucacccccacggagccccagacccagcuggacagcgagggcccgacccugcccgagcccauggccgaggcccagucccagauggaccccguggcgcagccccaggugaaccccacccuccagccccggagcgaccccacggcccagccgcagcugaaccccaccgcccagccccaguccgaccccaccgcccagccgcagcugaaccucauggcccagccccagagcgacuccgucgcgcagccccaggccgacaccaacgugcagacgccggcccccgccgccagcuccgugcccagccccugcgacgaggcguccccgacccccagcucccaccccacccccggggcccuggaggacccggccaccccgcccgccagcgagggcgagucccccagcuccacgccgcccgaggcggcccccggggccggccccaccuga

SEQ ID NO: 30759 - RNA, 1830 nt, Artificial Sequence
  derived and/or modified sequence opt1 from GPR153__Homo_sapiens__XP_011539736
augagcgacgagcgccggcugcccggcuccgccgugggguggcucgucugcggcgggcugagccugcucgccaacgcguggggcauccuguccgugggggccaagcagaagaaguggaagccgcuggaguuccuccugugcacccuggccgccacccacaugcucaacguggccguccccaucgcgacguacagcguggugcagcugcgccggcagcgccccgacuucgaguggaacgagggccugugcaaggucuucguguccaccuucuacacccucacccuggccacgugcuucagcgugaccucccugagcuaccaccggauguggauggucugcuggcccgugaacuaccgccucuccaacgccaagaagcaggccgugcacaccgucaugggcaucuggauggugagcuucauccuguccgcgcugccggccgugggguggcacgacaccagcgagcgguucuacacgcacggcugccgcuucaucgucgccgagaucgggcucggcuucggggugugcuuccugcugcucgugggcggcuccgucgccaugggggugaucugcaccgccaucgcgcuguuccagacccuggccgugcaggucggccggcaggccgaccgccgggccuucaccgugcccacgaucguggucgaggacgcccaggggaagcgccggagcuccaucgacggcagcgagcccgcgaagaccucccuccagaccaccggccuggugacgaccaucgucuucaucuacgacugccugaugggguuccccgugcucguggucagcuucuccagccugcgcgccgacgccagcgccccguggauggcccugugcgugcucuggugcuccguggcgcaggcccugcugcuccccgucuuccugugggccugcgaccgguaccgcgccgaccugaaggccgugcgggagaagugcauggcgcucauggccaacgacgaggagagcgacgacgagaccucccuggagggcgggaucagccccgaccuggugcucgagcgcucccuggacuacggcuacgggggcgacuucgucgcccuggaccggauggccaaguacgagaucagcgcgcucgagggcgggcugccccagcuguacccgcuccgcccccugcaggaggacaagaugcaguaccuccaggugccgcccacccggcgcuucucccacgacgacgccgacgugugggccgccgucccgcugcccgccuuccugccccgcuggggcagcggggaggaccuggcggcccuggcccaccucgugcugcccgccggcccggagcggcgccgggccucccugcucgcguucgccgaggacgccccgcccagccgcgcccggcgccgguccgccgagagccugcugucccuccgccccagcgcgcuggacuccgggccccggggcgcccgcgacagcccgcccggcagcccccggcgccggcccgggcccggcccccgcuccgccuccgccagccugcucccggacgcguucgcccugacggccuucgagugcgagccccaggcccugcggcgcccgcccgggcccuuccccgccgcgcccgccgcccccgacggcgccgacccgggggaggcccccaccccgcccagcuccgcgcagcggagccccggcccccgccccuccgcccacagccacgccggcucccuccggcccgggcugagcgccuccuggggcgagcccgggggccugcgcgccgcgggcgggggcgggagcaccuccagcuuccucuccagccccuccgagagcuccggcuacgccacccugcacagcgacucccuggggagcgccagcuga

SEQ ID NO: 30760 - RNA, 2529 nt, Artificial Sequence
  derived and/or modified sequence opt1 from GPR155__Homo_sapiens__NP_001253980
augaacagcaaccugcccgccgagaaccucaccaucgccgugaacaugaccaagacgcugccgaccgcggucacccacggcuucaacuccaccaacgacccgcccagcauguccaucacgcgccuguuccccgcccuccuggagugcuucgggaucgugcugugcggcuacaucgccgggcgggccaacgugaucaccagcacccaggccaagggccucgggaacuucgucucccgcuucgcgcugcccgcccuccuguucaagaacaugguggugcugaacuucagcaacgucgacugguccuuccuguacagcauccucaucgccaaggccuccguguucuucaucgugugcguccugacccugcucguggcgagccccgacucccgguucagcaaggccggccuguuccccaucuucgccacgcaguccaacgacuucgcccugggcuaccccaucguggaggcccucuaccagaccaccuacccggaguaccugcaguacaucuaccuggucgcgcccaucagccucaugaugcugaaccccaucggguucaucuucugcgagauccagaaguggaaggacacccagaacgccucccagaacaagaucaagaucgugggccuggggcuccugcgcgugcugcagaaccccaucgucuucaugguguucaucggcaucgccuucaacuucauccucgaccggaaggugccggucuacguggagaacuuccuggacgggcugggcaacagcuucuccggcagcgcccucuucuaccuggggcugacgauggugggcaagaucaagcgccucaagaaguccgccuucgucgugcugauccugcucaucaccgcgaagcugcuggugcucccccugcugugccgggagauggucgagcuccuggacaagggggacagcguggucaaccacaccagccuguccaacuacgccuuccucuacggcguguuccccguggcccccggcgucgccaucuucgccacccaguucaacauggagguggagaucaucacgagcgggauggugaucuccaccuucgucagcgcgccgaucauguacguguccgccuggcugcugaccuuccccaccauggaccccaagccccucgccuacgccauccagaacgugagcuucgacaucuccaucgucagccugaucucccugagcaucgugugcgccggcaugaugaucuggaacuucgugaaggagaagaacuucgucgggcagauccugguguucgugcuccuguacuccagccuguacuccacguaccucuggaccggccugcuggcgaucagccucuuccugcugaagaagcgcgagcggguccagaucccgguggggaucaucaucaucuccggcuggggcauccccgcccuccugguggggguccugcucaucaccggcaagcacaacggggacagcaucgacuccgccuucuucuacggcaaggagcagaugaucaccacggccgugacccuguucugcagcauccugaucgcggggaucucccucaugugcaugaaccagaccgcccaggccggcagcuacgagggcuucgaccagagccagucccacaagguggucgagcccgggaacaccgccuucgaggagagccccgccccggugaacgagcccgagcuguucacguccagcauccccgagaccuccugcugcagcugcuccaugggcaacggggagcugcacugccccagcaucgagccgaucgcgaacaccuccaccagcgagcccgugauccccuccuucgagaagaacaaccacugcgucagccgcugcaacucccagagcugcauccucgcccaggaggaggagcaguaccugcaguccggcgaccagcagcugacgcggcacgugcuccugugccugcuccugaucaucgggcuguucgccaaccucagcuccugccugugguggcuguucaaccaggagccgggccgccucuacguggagcugcaguucuucugcgccgucuucaacuucggccagggguucaucagcuucggcaucuucgggcuggacaagcaccucaucauccugcccuucaagcggcgccuggaguuccucuggaacaacaaggacaccgccgagaaccgggacagccccguguccgaggagaucaagaugaccugccagcaguucauccacuaccaccgcgaccugugcauccggaacaucgugaaggagcgccggugcggcgcgaagaccagcgccggcacguucugcgggugcgaccuggucuccuggcucaucgaggugggccuggccagcgaccgcggggaggccgugaucuacggcgaccggcugguccagggcggggugauccagcacaucaccaacgaguacgaguuccgcgacgaguaccucuucuaccgcuuccugcagaagucccccgagcagagcccgcccgccaucaacgcgaacacccugcagcaggagcgguacaaggagaucgagcacuccagcccgcccucccacagccccaagaccuga

SEQ ID NO: 30761 - RNA, 2433 nt, Artificial Sequence
  derived and/or modified sequence opt1 from GPR156__Homo_sapiens__NP_001161743
auggagcccgagaucaacugcagcgagcugugcgacuccuucccgggccaggagcucgaccgccggccccugcacgaccugugcaagaccaccaucacgagcucccaccacagcuccaagaccaucagcucccucagccccgugcugcuggggaucgucuggaccuuccucuccugcggccugcugcucauccuguucuuccuggccuucaccauccacugccgcaagaaccggaucgugaagaugagcucccccaaccucaacaucgugacgcugcuggggagcugccucaccuacuccagcgccuaccuguucggcauccaggacguccuggugggguccagcauggagacccucauccagacccgccuguccaugcugugcaucggcacgagccucguguucggcccgauccuggggaaguccuggcggcuguacaaggucuucacccagcgcgugcccgacaagcgggugaucaucaaggaccuccagcugcugggccucgucgcggcccugcugauggccgacgugauccuccugaugaccugggugcugaccgaccccauccagugccuccagauccugagcgucacggggaaggacgugagcugcaccuccaccagcacccacuucugcgccucccgcuacagcgacguguggaucgcccugaucuggggcugcaaggggcuccugcugcucuacggcgcguaccuggccggccugacggggcacgucuccagcccgcccgugaaccagucccucaccaucauggugggcgucaaccugcuggugcucgccgccgggcugcuguucguggucacccgguaccuccacagcuggcccaaccugguguucggccugaccuccggcgggaucuucgugugcacgaccaccaucaacugcuucaucuucaucccccagcugaagcaguggaaggcguucgaggaggagaaccagaccauccgccggauggccaaguacuucagcacgcccaacaaguccuuccacacccaguacggcgaggaggagaacugccacccgcgcggggagaaguccagcauggagcggcuccugaccgagaagaacgccgucaucgagagccugcaggagcaggucaacaacgccaaggagaagaucgugcgccucauguccgccgagugcaccuacgaccugcccgagggcgcggccccgcccgccagcucccccaacaaggacgugcaggccguggccagcguccacacgcuggcggccgcccaggggcccuccggccaccucagcgacuuccagaacgaccccggcauggccgcccgggacagccagugcaccuccgggcccagcuccuacgcgcagagccuggagggcccggggaaggacuccagcuucucccccggcaaggaggagaagaucagcgacuccaaggacuucagcgaccaccuggacuccgggugcagccagaagcccuggaccgagcagucccucggccccgagcgcggcgaccaggugccgaugaaccccagccagucccugcugcccgagcgcgggggcagcgacccccagcggcagcggcaccucgagaacuccgaggagccgcccgagcgccggagccgcgugagcuccgucauccgcgagaagcugcaggaggugcugcaggaccucgggcugggccccgaggccagccuguccaccgccccgagcugccaccagcagacguggaagaacuccgccgccuucagcccccagaagaugccccucuccaaggagcugggguucagccccuacauggugcggcgccggcgcgcggcccagcgggcccgcucccacuucccgggcagcgcccccuccagcgucggccaccgggcgaaccgcaccgugcccggggcccacucccggcugcacgugcagaacggcgacagccccucccucgccccgcagaccaccgacagccgcguccggcgccccuccagccggaagcccucccugcccagcgacccgcaggaccgccccgggacgcuggagggcagcaagcagucccagaccgagcccgagggcgcccgggggagcaaggccgcguuccuccgccagcccuccggcagcgggcgggccccgucccccgccgcccccugccugagcaaggccucccccgaccugccggagcaguggcagcucuggccgcccgugcccagcggcugcgcgucccugagcucccagcacagcuacuucgacaccgaguccagcuccagcgacgaguucuucugccgcugccaccggcccuacugcgagaucugcuuccaguccagcuccgacagcagcgacuccgggaccagcgacaccgaccccgagcccacgggcggccuggccuccugggagaagcucugggcccgcagcaagccgaucgugaacuucaaggacgaccugaagcccacccuggucuga

SEQ ID NO: 30762 - RNA, 3648 nt, Artificial Sequence
  derived and/or modified sequence opt1 from GPR158__Homo_sapiens__NP_065803
augggcgccauggccuacccccugcuccugugccugcuccuggcgcagcuggggcucggcgccgugggggccagccgcgacccgcagggccggcccgacagcccccgcgagcggacccccaaggggaagccgcacgcccagcagcccggccgcgccagcgcguccgacagcuccgcccccuggagccgguccaccgacggcacgauccuggcccagaagcuggccgaggagguccccauggacguggcgagcuaccucuacaccggggacucccaccagcugaagcgcgccaacugcagcggccgguacgagcuggccgggcucccgggcaaguggcccgcccuggccuccgcgcaccccagccugcaccgcgcccucgacacccugacccacgccacgaacuuccugaacgugaugcuccaguccaacaagagccgggagcagaaccugcaggacgaccuggacugguaccaggcccucgucuggucccugcuggagggggagcccagcaucucccgcgccgcgaucaccuucagcaccgacucccucagcgccccggcgccccagguguuccugcaggccacccgggaggagagccgcauccugcuccaggaccuguccagcuccgcgccccaccuggccaacgccacgcucgagaccgagugguuccacggccugcggcgcaaguggcggccccaccuccaccgccggggcccgaaccaggggccccgcggccuggggcacagcuggcggcgcaaggacggccugggcggggacaagucccacuucaaguggagcccgcccuaccuggagugcgagaacggcuccuacaagcccggguggcucgugacccugagcuccgccaucuacggccugcagcccaaccucguccccgaguuccgcggggugaugaagguggacaucaaccugcagaaggucgacaucgaccagugcagcuccgacggcugguucagcggcacccacaagugccaccugaacaacuccgagugcaugcccaucaaggggcucggcuucgugcugggggccuacgagugcaucugcaaggccggcuucuaccacccgggggugcugcccgucaacaacuuccggcgccggggccccgaccagcacaucagcggcuccacgaaggacgugagcgaggaggcguacgugugccuccccugccgcgaggggugcccguucugcgccgacgacucccccugcuucguccaggaggacaaguaccugcggcuggccaucaucagcuuccaggcccucugcaugcugcuggacuucguguccaugcugguggucuaccacuuccgcaaggccaagagcauccgggccagcggccucauccugcuggagaccauccucuucgggucccugcugcucuacuuccccguggugauccuguacuucgagccgagcaccuuccgcugcauccugcuccggugggcccgccugcugggcuucgccaccgucuacgggacggugacccucaagcugcaccgggugcugaaggucuuccucucccgcaccgcccagcggauccccuacaugaccggcggccgcgugaugcggaugcuggcggucauccugcucgugguguucugguuccugaucggguggacgagcuccgucugccagaaccuggagaagcagaucagccucaucggccaggggaagaccuccgaccaccugaucuucaacaugugccugaucgaccgcugggacuacaugaccgccguggccgaguuccucuuccugcuguggggcguguaccucugcuacgccguccggaccgugcccagcgccuuccacgagccccgcuacauggcgguggccguccacaacgagcugaucaucuccgccaucuuccacacgauccgguucgugcuggccagccgccuccaguccgacuggaugcugaugcuguacuucgcccacacccaccucaccgugaccgucacgaucggccugcugcucaucccgaaguucagccacuccagcaacaacccccgggacgacaucgcgaccgaggccuacgaggacgagcuggacauggggcgcuccggcagcuaccugaacuccagcaucaacagcgccugguccgagcacagccucgaccccgaggacauccgcgacgagcugaagaagcuguacgcccagcucgagaucuacaagcggaagaagaugaucaccaacaacccccaccuccagaagaagcgcugcuccaagaaggggcugggccggagcaucaugcgccggaucaccgagaucccggagacggugucccgccagugcagcaaggaggacaaggagggggcggaccacggcaccgccaagggcaccgcccugauccggaagaacccgcccgaguccagcgggaacaccggcaaguccaaggaggagacgcugaagaaccgcguguucagccugaagaagucccacagcaccuacgaccacguccgggaccagaccgaggaguccagcucccuccccaccgagagccaggaggaggagaccacggagaacuccacccuggagagccuguccgggaagaagcucacccagaagcugaaggaggacagcgaggccgagagcaccgaguccgugccccuggugugcaagagcgccuccgcgcacaaccucagcuccgagaagaagacgggccacccccgcaccagcaugcugcagaagucccugagcgucaucgccuccgccaaggagaagacccucgggcuggccggcaagacccagacggccggcguggaggagcggaccaagagccagaagccccugcccaaggacaaggagaccaaccgcaaccacuccaacagcgacaacaccgagacgaaggacccggcgccccagaacuccaaccccgccgaggagccccggaagccgcagaaguccgggaucaugaagcagcagcgcgugaaccccaccaccgccaacuccgaccucaaccccggcaccacgcagaugaaggacaacuucgacaucggggaggucugccccugggagguguacgaccugaccccgggccccgugcccagcgaguccaagguccagaagcacgugagcaucguggccuccgagauggagaagaacccgaccuucagccugaaggagaagucccaccacaagcccaaggccgcggaggucugccagcagagcaaccagaagcggaucgacaaggccgaggugugccucugggagagccaggggcaguccauccuggaggacgagaagcugcucaucagcaagacccccgugcugcccgagcgcgccaaggaggagaacggcggccagccgcgggccgcgaacgucugcgccgggcaguccgaggagcugccgcccaaggccguggccagcaagacggagaacgagaaccucaaccagaucggccaccaggagaagaagaccuccagcuccgaggagaacgugcgcgggagcuacaacuccagcaacaacuuccagcagccccugaccucccgggccgaggucugccccugggaguucgagacccccgcgcagcccaacgccggccgcagcguggcccugcccgccuccagcgcccucuccgcgaacaagaucgccgggccgcggaaggaggagaucugggacagcuucaagguguga

SEQ ID NO: 30763 - RNA, 1083 nt, Artificial Sequence
  derived and/or modified sequence opt1 from GPR15__Homo_sapiens__NP_005281
auggaccccgaggagaccagcguguaccuggacuacuacuacgccaccuccccgaacagcgacauccgcgagacgcacucccacguccccuacaccagcguguuccuccccguguucuacaccgccgucuuccugaccggcgugcuggggaaccucgugcugaugggcgcgcugcacuucaagcccgggucccggcgccucaucgacaucuucaucaucaaccuggccgccagcgacuucaucuuccuggucacgcucccgcuguggguggacaaggaggccucccugggccucuggcggaccgggagcuuccugugcaagggcuccagcuacaugaucuccgugaacaugcacugcagcguccugcuccugaccugcauguccguggaccgcuaccuggccaucguguggcccgucgugagccggaaguuccgccggaccgacugcgcguacguggucugcgccuccaucugguucaucagcugccuccugggccugcccacgcuccugucccgcgagcugacccucaucgacgacaagcccuacugcgccgagaagaaggccaccccgaucaagcugaucuggagccugguggcgcucaucuucaccuucuucgugccccugcuguccaucgucacgugcuacugcugcaucgcccggaagcucugcgcccacuaccagcagagcgggaagcacaacaagaagcugaagaaguccaucaagaucaucuucaucgugguggccgccuuccuggucagcuggcuccccuucaacaccuucaaguuccuggcgaucgugagcggccugcgccaggagcacuaccuccccuccgccauccugcagcuggggauggaggugagcggcccgcucgccuucgccaacuccugcgucaaccccuucaucuacuacaucuucgacagcuacauccggcgcgccaucgugcacugccugugccccugccugaagaacuacgacuucggguccagcaccgagaccuccgacagccaccucacgaaggcgcuguccaccuucauccacgccgaggacuucgcccggcgccggaagcgcagcgucucccuguga

SEQ ID NO: 30764 - RNA, 1017 nt, Artificial Sequence
  derived and/or modified sequence opt1 from GPR160__Homo_sapiens__NP_055188
augaccgcccugagcuccgagaacugcagcuuccaguaccagcuccgccagaccaaccagccccuggacgugaacuaccuccuguuccugaucauccugggcaagauccuccugaacauccugacgcucgggaugcggcgcaagaacacgugccagaacuucauggaguacuucugcaucucccuggccuucgucgaccugcuccugcuggugaacaucagcaucauccucuacuuccgggacuucgugcugcuguccauccgcuucaccaaguaccacaucugccucuucacccagaucaucagcuucaccuacggcuuccugcacuacccggucuuccugaccgcgugcaucgacuacugccucaacuucuccaagaccaccaagcugagcuucaagugccagaagcuguucuacuucuucacggugauccucaucuggaucuccgugcuggccuacguccugggggaccccgccaucuaccagagccucaaggcccagaacgccuacucccggcacugccccuucuacgugagcauccaguccuacuggcugagcuucuucauggugaugauccuguucgucgcguucaucacgugcugggaggaggugaccacccucgugcaggccauccgcaucaccuccuacaugaacgagaccauccuguacuuccccuucagcucccacagcuccuacaccguccggagcaagaagaucuuccugagcaagcucaucgugugcuuccuguccaccuggcugccguucgugcuccugcaggucaucaucgugcugcucaaggugcagauccccgccuacaucgagaugaacauccccuggcuguacuucgucaacagcuuccugaucgccacgguguacugguucaacugccacaagcucaaccugaaggacaucggccugccccucgacccguucgugaacuggaagugcugcuucaucccccugaccauccccaaccuggagcagaucgagaagcccaucuccaucaugaucugcuga

SEQ ID NO: 30765 - RNA, 1641 nt, Artificial Sequence
  derived and/or modified sequence opt1 from GPR161__Homo_sapiens__NP_001254540
augaaggugguccagcacgcccugcccaccccgcgccggggcgcccucaccaugagccugaacuccagccuguccugccgcaaggagcucagcaaccugacggaggaggagggcggggagggcggggugaucaucacccaguucaucgcgaucaucgugaucaccaucuucgucugccuggggaaccucgugaucguggucacccuguacaagaaguccuaccugcucacgcugagcaacaaguucguguucucccugacccucagcaacuuccugcuguccgugcucguccugcccuucguggugaccagcuccauccggcgcgaguggaucuucggcgucguguggugcaacuucagcgcccugcucuaccugcugaucuccagcgccuccaugcucacccugggcgugaucgccaucgaccgguacuacgccguccuguaccccaugguguaccccaugaagaucacggggaaccgcgcggugauggcccucgucuacaucuggcugcacagccugaucggcugccucccgccccuguucgggugguccagcguggaguucgacgaguucaaguggaugugcguggccgccuggcaccgggagcccggcuacaccgcguucuggcagaucuggugcgcccuguuccccuuccucgucaugcuggugugcuacggguucaucuuccgcguggcccgggucaaggcccgcaaggugcacugcggcaccgucgugaucguggaggaggacgcccagcggaccggccgcaagaacuccagcacgagcaccuccagcuccgggagccggcgcaacgcguuccagggcgucguguacuccgccaaccagugcaaggcccugaucaccauccucgugguccugggggccuucauggugaccuggggccccuacaugguggucaucgccagcgaggcgcuguggggcaaguccagcgugucccccagccucgagacgugggccaccuggcuguccuucgccagcgccgugugccacccccugaucuacgggcucuggaacaagaccguccggaaggagcugcugggcaugugcuucggggaccgcuacuaccgggagcccuucgugcagcgccagcggaccucccgccucuucagcaucuccaaccggaucacggaccugggccugagcccgcaccucaccgcccugauggccgggggccagccccugggccacuccagcuccaccggggacaccggcuucagcugcagccaggacuccgggacggacaugaugcuccuggaggacuacaccagcgacgacaacccgcccucccacugcacgugcccgcccaagcgccgcagcuccgugaccuucgaggacgaggucgagcagaucaaggaggcggccaagaacagcauccugcacgugaaggccgaggugcacaagucccuggacagcuacgccgcgucccucgccaaggccaucgaggccgaggcgaagaucaaccuguucggcgaggaggcccugcccgggguccucgugaccgcccggaccgugcccggcggcggguucggcgggcgccggggcagccgcacccuggucucccagcggcugcagcuccagagcaucgaggagggggacgugcuggccgccgagcagcgcuga

SEQ ID NO: 30766 - RNA, 915 nt, Artificial Sequence
  derived and/or modified sequence opt1 from GPR162__Homo_sapiens__NP_055264
augcugagcaccggcguggucuccuucuucagccucaaguccgacagcgcgcccccguggauggugcuggccgugcuguggugcuccauggcccagacccuccugcugcccagcuucaucugguccugcgagcgcuaccgggccgacguccgcacggugugggagcagugcguggccaucaugagcgaggaggacggggacgacgacggcgggugcgacgacuacgccgagggccgggucugcaaggugcgcuucgacgccaacggggcgaccggccccggcucccgggaccccgcccaggugaagcuccugccggggcgccacaugcuguucccgccccucgagcggguccacuaccuccaggugccccugagccgccggcugucccacgacgagaccaacaucuucagcacgccccgcgagcccggcuccuuccugcacaaguggagcuccagcgacgacauccgggugcugcccgcccagucccgcgcccucgggggcccgcccgaguaccuggggcagcggcaccgccuggaggacgaggaggacgaggaggaggcggagggcggcgggcucgccagccugcggcaguuccuggaguccggcguccucgggagcggcggcgggccgccccgcggccccggguucuuccgggaggagaucaccaccuucaucgacgagacgccccugcccagccccaccgccucccccggccacagcccgcgccggccccgcccccuggggcucagcccccggcgccugucccugggcuccccggagagccgcgccgugggccucccccuggggcuguccgccggccggcgcugcagccucaccgggggcgaggaguccgcgcgggccuggggcgggagcuggggccccgggaaccccaucuucccgcagcugacccuguga

SEQ ID NO: 30767 - RNA, 960 nt, Artificial Sequence
  derived and/or modified sequence opt1 from GPR171__Homo_sapiens__NP_037440
augaccaacagcuccuucuucugccccguguacaaggaccuggagccguucaccuacuucuucuaccucgucuuccuggugggcaucaucgggagcugcuucgccacgugggccuucauccagaagaacaccaaccaccgcugcguguccaucuaccugaucaaccuccugaccgcggacuuccugcucacccuggcccugcccgucaagaucgugguggaccucggcgucgcccccuggaagcugaagaucuuccacugccaggugacggccugccugaucuacaucaacauguaccucagcaucaucuuccuggccuucguguccaucgaccggugccugcagcucacccacagcugcaagaucuaccgcauccaggagcccggguucgcgaagaugaucuccaccgucguguggcugauggugcugcucaucauggucccgaacaugaugauccccaucaaggacaucaaggagaaguccaacgugggcugcauggaguucaagaaggaguucgggcggaacuggcaccuccugaccaacuucaucugcguggccaucuuccugaacuucagcgccaucauccugaucagcaacugccuggucauccgccagcucuaccggaacaaggacaacgagaacuaccccaacgugaagaaggcccugaucaacauccugcucgugacgaccggcuacaucaucugcuucguccccuaccacaucgugcgcaucccguacacccugucccagaccgaggugaucacggacugcagcacccggaucucccuguucaaggcgaaggaggccacccuccugcuggccgucagcaaccucugcuucgaccccauccuguacuaccaccuguccaaggccuuccgcagcaaggugaccgagacguucgccucccccaaggagaccaaggcgcagaaggagaagcuccggugcgagaacaacgccuga

SEQ ID NO: 30768 - RNA, 1002 nt, Artificial Sequence
  derived and/or modified sequence opt1 from GPR174__Homo_sapiens__NP_115942
augcccgccaacuacacgugcacccgcccggacggcgacaacaccgacuuccgguacuucaucuacgccgugaccuacaccgucauccuggugcccgggcucaucggcaacauccuggcgcuguggguguucuacggguacaugaaggagaccaagcgcgccgucaucuucaugaucaaccucgccaucgccgaccugcuccaggugcugagccugccccugcggaucuucuacuaccucaaccacgacuggcccuucggcccggggcugugcauguucugcuucuaccugaaguacgugaacauguacgccuccaucuacuuccucgucugcaucagcgugcgccgguucugguuccugauguaccccuuccgcuuccacgacugcaagcagaaguacgaccuguacaucuccaucgcgggcuggcucaucaucugccuggccugcgugcuguucccccuccugcggacgagcgacgacaccuccggcaaccgcaccaagugcuucgucgaccugcccacccggaacgugaaccucgcccagagcguggucaugaugacgaucggggagcugaucggcuucgugaccccgcugcucaucgugcuguacugcaccuggaagaccguccugucccuccaggacaaguaccccauggcccaggaccugggggagaagcagaaggcgcugaagaugauccucacgugcgccggcguguuccugaucugcuucgcccccuaccacuucagcuucccccuggacuuccucgugaaguccaacgagaucaagagcugccuggcccgccgggucauccugaucuuccacuccguggcccucugccuggcgagccugaacuccugccucgacccggugaucuacuacuucagcaccaacgaguuccgccggcgccugucccggcaggaccugcacgacagcauccagcuccacgccaaguccuucgucagcaaccacaccgccuccaccaugacgcccgagcugugcuga

SEQ ID NO: 30769 - RNA, 1413 nt, Artificial Sequence
  derived and/or modified sequence opt1 from GPR176__Homo_sapiens__NP_001258784
augcccgccccgcugcuccugaucagccgcacccugggcaacuucauggugcucugguccacgugccggaccaccgucuucaagagcgugaccaaccgcuucaucaagaaccuggccugcuccgggaucugcgcgagccuggugugcguccccuucgacaucauccucuccaccagcccccacugcugcugguggaucuacacgaugcuguucugcaagguggugaaguuccugcacaaggucuucugcuccgugaccauccucagcuuccccgccaucgcccuggaccgguacuacuccgugcuguacccgcucgagcgcaagaucagcgacgccaagucccgggagcuggucauguacaucugggcccacgcggugguggccagcguccccguguucgccgugaccaacgucgccgacaucuacgcgaccuccacgugcaccgagguguggagcaacucccugggccaccucguguacguccugguguacaacaucaccaccgugaucguccccgugguggucguguuccuguuccucauccugauccgccgggcccugagcgccucccagaagaagaaggucaucaucgccgcccuccgcacgccccagaacaccaucagcaucccguacgcgucccagcgggaggccgagcugcacgccacccugcucagcauggugaugguguucauccugugcagcguccccuacgccacccuggugguguaccagacgguccucaacgugcccgacaccuccguguuccugcugcucaccgccgucuggcugcccaaggugagccugcucgcgaacccggugcuguuccugaccgucaacaaguccgugcgcaagugccucaucgggacgcuggugcagcugcaccaccgguacagccgccggaacgucguguccaccggcagcgggauggccgaggccucccucgagcccagcauccgcuccggcagccagcugcuggagauguuccacaucggccagcagcagaucuucaagcccaccgaggacgaggaggaguccgaggccaaguacaucgggagcgccgacuuccaggcgaaggagaucuucuccacgugccucgagggcgagcaggggccccaguucgccccgagcgccccgccccuguccaccguggacagcgucucccagguggcccccgccgcgcccguggagcccgagaccuuccccgacaaguacagccugcaguucggcuucgggcccuucgagcucccgccccaguggcuguccgagacccggaacagcaagaagcgccugcucccgccccugggcaacacccccgaggagcugauccagacgaagguccccaaggugggccggguggagcgcaagaugagccggaacaacaaggucuccaucuuccccaagguggacagcuga

SEQ ID NO: 30770 - RNA, 7104 nt, Artificial Sequence
  derived and/or modified sequence opt1 from GPR179__Homo_sapiens__NP_001004334
augggcacccgcggggccgugaugcccccgcccauguggggccugcuggggugcugcuucgugugcgccugggcccugggcgggccccggcccauccggucccugccgccccucuccagccaggugaagcccggcuccgugcccaugcaggucccccuggagggcgccgaggccgcccuggccuaccucuacagcggggacgcccagcagcugucccaggugaacugcagcgagcgguacgaggcccgcggcgccggggccaugcccggccugccgcccucccuccagggggccgccggcacccuggcccaggccgccaacuuccugaacaugcuccugcaggcgaacgacauccgggagagcuccguggaggaggacgucgagugguaccaggcccuggugcgcagcguggccgagggcgacccccgggucuaccgcgcccuccugacguucaacccgccgcccggggccucccaccuccagcucgcgcugcaggccacccggaccggcgaggagaccauccugcaggaccucagcgggaacugggugcaggaggagaacccgcccggcgaccuggacacgcccgcccugaagaagcgcgugcucaccaacgaccugggcucccuggggagccccaaguggccccaggccgacggcuacgucggggacacccagcagguccggcucagcccgcccuuccuggagugccaggagggccgccugcggcccggguggcucaucacccugagcgccacguucuacggccugaagcccgaccucucccccgaggugcgcggccagguccagauggacguggaccugcagagcguggacaucaaccagugcgcguccgggcccggcugguacagcaacacccaccugugcgaccucaacagcacccagugcgucccccuggagucccagggguucgugcugggccgguaccucugccgcugccggccgggguucuacggcgccagccccuccggcgggcuggaggagagcgacuuccagaccacgggccaguucggguuccccgagggccgcuccgggcggcugcuccagugccugccgugccccgagggcugcaccagcugcauggacgccacccccugccugguggaggaggccgccguccuccgcgcggccgugcuggccugccaggccugcugcaugcuggcgaucuuccucuccaugcuggugagcuaccggugccgccgcaacaagcggaucugggccuccggcgucgugcugcuggagaccguccucuucggguuccugcugcucuacuuccccguguucauccuguacuucaagccgagcguguuccgcugcaucgcccugcgguggguccgccuccugggcuucgccaucguguacgggacgaucauccugaagcucuaccgggugcugcagcuguuccucucccgcaccgcccagcggagcgcgcugcuguccagcggccgccuccugcggcaccugggccuccugcugcuccccguccugggguuccuggccguguggaccgugggcgcccucgagcgcgggauccagcacgcgccccuggucauccggggccacacccccuccgggcgccacuucuaccugugccaccacgaccggugggacuacaucauggugguggccgagcuccugcugcucugcuggggcagcuuccugugcuacgcgacgcgcgccguccuguccgccuuccacgagccgcgguacaugggcaucgcccuccacaacgagcugcugcucagcgccgcguuccacaccgcccgcuucgugcuggugcccucccugcaccccgacuggacccuccugcuguucuucuuccacacccacagcacggucaccaccacccucgcccugaucuucauccccaaguucuggaagcugggggccccgccccgggaggagaugguggacgaggugugcgaggacgagcucgaccugcagcacagcggcuccuaccuggggagcuccaucgcgagcgccugguccgagcacagccucgaccccggcgacauccgcgacgagcugaagaagcuguacgcccagcucgagguccacaagacgaaggagauggccgccaacaacccccaccuccccaagaagcggggguccagcugccagggccugggccgcuccuucaugcgcuaccuggcggaguuccccgaggcccuggcccggcagcacagccgcgacuccgggagccccggccacgggucccugcccggcagcucccggcgccggcuccugagcuccagccugcaggagccggaggggacccccgcccuccacaagagccgcuccaccuacgaccagcggcgcgagcaggacccgccccugcuggacagccuccugcggcgcaagcuggccaagaaggcgucccggaccgagagccgcgaguccguggagggcccgcccgcccucggcuuccggagcgccuccgcccacaaccugacggugggggagcgccugccccgggcccgcccggcgagccuccagaagucccugagcgucgccuccagccgggagaaggcccugcucauggccucccaggcguaccuggaggagaccuaccgccaggccaaggagcgggaggagcgcaagaaggccaaggccgccauggcgagccuggugcggcgccccuccgcccgccggcucgagcgcccccggggcgcgccccugagcgccccgcccucccccgccaagagcuccagcguggacagcucccacaccagcgggcgccugcacgaggaggcgcggcgccggcucccccacccgcccauccgccaccaggucuccacccccauccuggcccugagcggcgggcucggcgagccccggaugcuguccccgacgagcacccuggcccccgcccuccugcccgcccuggcgcccaccccggcccccgcccucgcccccgugcccguguccccgcagagccccaaccugcugaccuacaucugccccugggagaacgccgagcuccccgcgaagcaggagaacgucccgcaggagggccccuccgggcccgagcgcggccaccacagccccgccccggcccgggcccgccuguggcgggcgcuguccguggccguggagaagucccgcgccggggagaacgagauggacgccgaggacgcccaccaccagcgggaggcgaacgacgucgacgaggaccgccccaagaucuuccccaagucccacagccucaaggccccggugcagcagggcuccaugcggagccugggccuggccaucaaggcccugacccgcucccggagcacguaccgcgagaaggaguccguggaggagagccccgaggggcagaacagcggcaccgccggggaguccaugggcgcgcccagccgcagcccccggcucgggcgcccgaaggccgucagcaagcaggccgcccugauccccuccgacgacaaggagagccugcagaaccagcagaacgcccacaccucccggaugcuccaggugugccagcgcgagggcagccgggagcaggaggaccgcggccggcgcaugacccaggggcugggcgagcggaaggcggagcgcgccgggaagacgggccuggccaugcuccgccaggugucccgcgacaagaacaucaagcagagcaaggagacccccgucggguggcaggagcugcccaaggccggccugcagucccucggcagcgcggaccaccggguggccgaggugugcccgugggaggucaccgaguccgagacccgccagcccgacagcgggaacaaggccgagaucugccccugggagacguccgagggcgcccccgagagccgggcccugcgccaggacccgggggacucccagaagaagcggggcgaggcgcgcgggaaguccgagcccaucgacguggugcccaugaugcggaagaagcccgagcgccugguccgggagcaggaggccgugugcccgugggaguccgccgaccgcggcggccucagccccgggagcgcgccccaggaccccggccgcauccgggacaaguccgaggccggggacagcguggaggcgcgcaaggucgagaagccgggcugggaggccgccggccccgaggcccacacccccgacaucaccaaggccgagcccugcccgugggaggcguccgagggcggggaggacgggaagcccgcccaggaggccgugaaggaccugccccaggagaagcagaagacccggaaggccacguucuggaaggagcagaagcccggcggggaccuggagagccucugcccgugggaguccaccgacuuccgcggccccagcgcgguguccauccaggcccccggcagcuccgagugcagcgggucccugggcagcgggaucgccgaggucugccugugggaggccggcgacgccccggcgauccagaaggccgagaucugccccugggagcucgacgacaacgugauggggcaggagaugcugucccugggcaccggccgggagagccuccaggagaaggagaaggccucccgcaaggggagcuucggcgagaugggggagcagaccgugaaggccguccagaagcugucccagcagcaggagagcgugugcccccgggaguccacgguccccggccacagcagcccgugccuggacaacuccagcuccaaggccgggagccaguuccucugcaacggcggcucccgcgcgacccaggugugcccccaggaggaccugcggcccgaggcccaggaggccacccccgccaagaccgagaucugcccgugggaggugaacgagcgcacgcgggaggaguggaccagcgcccaggucccccgcgggggcgagucccagaaggacaaggagaagaugcccgggaaguccgagaucgaggacgugaccgcgugggagaagcccgagggccagauccagaagcaggaggccguggggccgugggaguccgucgaccccggcagcuucagcccccagccccggccgcaggacaccgagcgcccccagacgcugcuccagaugagcggcuccguggggagcaaggccgccgacaucugcccccuggacguggaggagaaccugaccgccggcaaggcggagaucugccccugggaggucggggccggcgccggcgaggagcgggcccucggggcggaggccauccgcaaguccccgaacgacaccggcaaggugagcgccgaccuggggccccgggagcgcgccgugaccgcccccgagaagccccagaagccgacgcccgagugggaggucgcgugccccuggggcuccguggggccgggcgccugcagccagcaccccggcacccuggacgccgacgggcccaaggccggcuuccaggagcucgaccacauggggugccggcccggcgaggugugcccgugggaggcccaggaggcggccaccuccgagaaggccaagaucugccccugggaggucagcgaggggaccacgggcaagggccuggaccagaaggccgggagcgaguccgccgagcagcgcgagaaggcgcuggagaagggccgccucaccagccugggggaggacguguccaagggcauggccaagcugugccagcagcaggagaccaucugcaucugggagaacaaggaccuccgggagagccccgcccaggcccccaagaucuccgaccugccgagcuccaugagcuccgagguggcggaggggcacagccuggaggccaccgagaagggcgaccuccgccaggaccccaagacgggcuccuuccccgagcacaucacccaggagaaggcccccgccgccgacaccgaggaguucaccaccgaggacggggagaagacgagccacgagcugcaguccgucugcccgugggagaccaccgcgcccgccgacagcgugucccaccuggaccggcagcgccccgaccagcccaaggccagcucccagcggcucgugagcaccggcgggcgcgccgccgacgucugcccgugggacgugcccgacgcgggcguguacaagagcgacuccagcgccaaggccgagacgugccccugggaggucaccgagcggauccccgugaagggggugucccgccaggacggcaagggcgacagccaggaggagaaggggcgggccccggagaaguccgagcccaagggcguccccgugcagaagaagcccgagauggccgacuuccgccagcaggaggcggugugcccgugggagagccaggacgggaagggccugagcccccagcccgcccccgacgccagcgaccggucccgcggcagcuccgaggccgcggggagcgucgagacccggguggccgaggugugccugugggaggucguggaggccccguccgccaagaaggccgagaucugccccugggaggcgggcgggggcgccgccgaggagggggagcaggagcgcgagagccagggccagggcgagauguuccuccagaaggccgggcccggcgggaccgaggagcacuucuccaaggccgcggccaagccgcgggagcaggaggccgugugccccggcgaggggacgggcagcggcgggcugcugccccaguccggcgcccucgaccccgagcugaaggucagcccgaaggaggccggguccaugggcagccgcauggcggagcugugccagugggagaucaccgaccccgaggggaacaagaucaagggcaccauggccgacaucugccccggcgaggagaccggggugcccagcgaggaguccggccuccuggcccugacggccacccggcgcgaguucuucccgaccgcccccgagaagccccucugccugcuggugcacgggccccucgaccacuucuucccggagagcaagauccccugccccaaggucucccggcccgcgagcaccuucacgcuggagggcgugcgcgagcugcagggcccguccgggcucgagccccggaccagccuggcccccgagcccucccugcaggaggccgagagccaguccagcucccucaccgaggacagcggccagguggccuucgaggcgcaguacgaggaguucaccccgcccacggucuaccccugggacugggaguga

SEQ ID NO: 30771 - RNA, 1020 nt, Artificial Sequence
  derived and/or modified sequence opt1 from GPR17__Homo_sapiens__NP_001154889
augaacggccuggagguggccccgcccgggcucaucaccaacuucagccuggccaccgcggagcagugcggccaggagacgccccuggagaacaugcuguucgccuccuucuaccuccuggacuucauccucgcccuggucgggaacacccuggcccucuggcuguucauccgcgaccacaagagcggcacccccgccaacguguuccugaugcaccucgcgguggccgaccuguccugcguccuggugcuccccacccggcugguguaccacuucagcgggaaccacuggcccuucggcgagaucgccugccgccugacgggcuuccucuucuaccugaacauguacgccuccaucuacuuccugaccugcaucagcgcggaccgguuccucgccaucguccaccccgugaagucccugaagcugcgccggccccucuacgcccaccuggccugcgccuuccuguggguggucguggcgguggccauggcgccccuccuggucagcccgcagaccgugcagaccaaccacacgguggucugccugcagcucuaccgcgagaaggccucccaccacgcccuggugagccuggccguggccuucaccuuccccuucaucaccaccgucacgugcuaccuccugaucauccggucccugcgccaggggcuccggguggagaagcgccugaagaccaaggccgugcggaugaucgccaucguccuggccaucuuccucgugugcuucgugcccuaccacgucaaccgcagcguguacguccugcacuaccggucccacggcgcgagcugcgccacccagcgcauccuggcccucgccaaccggaucaccuccugccugacgagccugaacggggcccucgaccccaucauguacuucuucguggcggagaaguuccgccacgcccugugcaaccugcucugcggcaagcggcugaaggggccgccgcccuccuucgagggcaagaccaacgagagcucccugagcgccaagagcgagcuguga

SEQ ID NO: 30772 - RNA, 1323 nt, Artificial Sequence
  derived and/or modified sequence opt1 from GPR180__Homo_sapiens__NP_851320
augggcgggcugcgccuccuggccguggcccugaccugcugcugguggccccagggcagccaggggaagacccuccggggcuccuucagcuccacggcggcccaggacgcccaggggcagcgcaucggccacuucgaguuccacggcgaccacgcccugcugugcguccggaucaacaacaucgccguggcgguggggaaggaggccaagcucuaccuguuccaggcccaggaguggcugaagcuccagcagagcucccacggcuacagcugcuccgagaagcugagcaaggcccagcugaccaugaccaugaaccagaccgagcacaaccucacggucucccagaucccgagcccccagaccuggcacguguucuacgcggacaaguacacgugccaggacgacaaggagaacucccagguggaggacauccccuucgagaugguccugcugaaccccgacgccgaggggaacccguucgaccacuucagcgccggcgaguccgggcuccacgaguucuucuuccugcuggugcucguguacuucgucaucgccugcaucuacgcccagagccuguggcaggcgaucaagaagggcggccccaugcacaugauccugaaggugcucaccaccgcccugcugcuccaggccggguccgcccuggccaacuacauccacuucagcuccuacagcaaggacggcaucggggugcccuucaugggcucccuggcggaguucuucgacaucgccagccagauccagaugcucuaccugcugcucagccugugcaugggcuggaccaucguccgcaugaagaagucccagagccggccccugcagugggacuccaccccggccagcaccgggaucgccguguucaucgugaugacgcaguccguccuccugcugugggagcaguucgaggacaucagccaccacuccuaccacagccaccacaaccucgccggcauccugcugaucgugcuccgcaucugccuggcgcugucccucgggugcggccuguaccagaucaucaccguggagcggagcacccugaagcgcgaguucuacaucaccuucgccaaggggugcauccucugguuccugugccaccccguccuggccugcaucuccgugaucuucagcgacuaccagcgggacaaggugaucacgaucggcgucauccucugccaguccgugagcauggugauccuguaccgccuguuccugucccacagccucuacugggaggucuccagccuguccagcgugacccugccccucaccaucagcuccggccacaagagccggccccacuucuga

SEQ ID NO: 30773 - RNA, 1215 nt, Artificial Sequence
  derived and/or modified sequence opt1 from GPR182__Homo_sapiens__XP_011536129
augagcgugaagcccuccuggggcccggggcccagcgagggcgucaccgccgugcccaccuccgaccugggggagauccacaacuggacggagcuccuggaccuguucaaccacacccucagcgagugccacguggagcugucccagagcaccaagcgcgucgugcuguucgcccucuaccuggccauguucguggucggccugguggagaaccuccuggugaucugcgucaacuggcggggguccggccgcgccggccugaugaaccucuacauccugaacauggccaucgccgaccuggggaucgugcucagccugcccguguggaugcuggaggucacccucgacuacacguggcuguggggcuccuucagcugccgguucacccacuacuucuacuucgugaacauguacuccagcaucuucuuccuggugugccucuccgucgaccgcuacgugacccugaccagcgccuccccgagcuggcagcgguaccagcaccgcgugcggcgcgcgaugugcgccgggaucuggguccuguccgccaucaucccccuccccgagguggugcacauccagcuggucgagggccccgagccgaugugccuguucauggcccccuucgagacguacagcaccugggcgcucgccguggcccuguccaccaccauccugggguuccuccugcccuucccccugaucacgguguucaacguccucaccgccugccggcugcgccagccgggccagcccaagagccggcgccacugccugcuccugugcgccuacguggcggucuucgugaugugcuggcugcccuaccacgugacccuccugcugcucacccugcacggcacgcacaucagccugcacugccaccucguccaccuccuguacuucuucuacgacgugaucgacugcuucuccaugcugcacugcgugaucaaccccauccuguacaacuuccugagcccgcacuuccgggggcgccugcucaacgccgucgugcacuaccugcccaaggaccagaccaaggccgggaccugcgccuccagcuccagcugcuccacccagcacagcaucaucaucacgaagggcgacucccagcccgccgcggccgcgccccacccggagcccagccuguccuuccaggcccaccaccuccugcccaacaccagccccaucuccccgacccagccccugacccccagcuga

SEQ ID NO: 30774 - RNA, 1086 nt, Artificial Sequence
  derived and/or modified sequence opt1 from GPR183__Homo_sapiens__NP_004942
auggacauccagauggccaacaacuucacgcccccgagcgccacgccccagggcaacgacugcgaccuguacgcgcaccacuccaccgcccgcaucgugaugccccuccacuacagccuggucuucaucaucgggcuggugggcaaccuccuggcccugguggucaucgugcagaaccggaagaagaucaacuccaccacccucuacagcaccaaccuggugaucuccgacauccuguucacgaccgcccuccccacccgcaucgccuacuacgcgaugggguucgacuggcggaucggcgacgcccugugccgcaucaccgcccuggucuucuacaucaacacguacgccggggugaacuucaugaccugccucagcaucgaccgguucaucgcggugguccacccgcugcgcuacaacaagaucaagcggaucgagcacgccaagggcgugugcaucuucguguggauccuggucuucgcccagacccucccccugcugaucaaccccauguccaagcaggaggccgagcgcaucacgugcauggaguaccccaacuucgaggagaccaagagccucccguggauccugcugggcgccugcuucaucggguacgugcucccccugaucaucauccugaucugcuacucccagaucugcugcaagcuguuccggaccgcgaagcagaacccccucaccgagaaguccggcgugaacaagaaggcccugaacaccaucauccucaucaucgucguguucgugcugugcuucacccccuaccacgucgccaucauccagcacaugaucaagaagcugcgcuucagcaacuuccucgagugcagccagcggcacuccuuccagaucagccugcacuucaccgugugccugaugaacuucaacugcugcauggacccguucaucuacuucuucgccugcaagggguacaagcgcaaggugaugcggaugcucaagcgccaggucuccgugagcaucuccagcgccgugaaguccgcgcccgaggagaacagccgggagaugaccgagacccagaugaugauccacagcaaguccagcaacggcaaguga

SEQ ID NO: 30775 - RNA, 1305 nt, Artificial Sequence
  derived and/or modified sequence opt1 from GPR19__Homo_sapiens__XP_011518926
augaaggaggccagcuucuucuucucccccacccgcaucaagcggaagaaggugaacauggucuucgcccaccgcauggacaacagcaagccccaccugaucauccccacccuccuggugccccugcagaaccgguccugcacggagaccgcgacgccccucccgagccaguaccugauggagcuguccgaggagcacagcuggauguccaaccagaccgaccuccacuacgugcugaagcccggcgaggucgccaccgccagcaucuucuucgggauccuguggcuguucuccaucuucggcaacagccucgugugccuggugauccaccgcucccggcgcacccagagcaccaccaacuacuucgucguguccauggccugcgccgaccuccugaucagcguggcguccacgcccuucguccugcuccaguucaccaccgggcgguggacccugggcagcgccacgugcaagguggugcgcuacuuccaguaccugacccccgggguccagaucuacgugcuccuguccaucugcaucgaccgguucuacaccaucguguacccgcugagcuucaaggucucccgcgagaaggccaagaagaugaucgccgcgagcuggguguucgacgccggcuucgugacccccguccucuucuucuacggcagcaacugggacucccacugcaacuacuuccugcccagcuccugggaggggacggccuacaccgugauccacuuccuggugggcuucgucauccccagcgugcucaucauccuguucuaccagaaggugaucaaguacaucuggcggaucgggaccgacggccgcaccguccggcgcacgaugaacaucgugccgcggaccaaggucaagaccaucaagauguuccugauccucaaccugcuguuccuccuguccuggcugcccuuccacguggcccagcucuggcacccccacgagcaggacuacaagaaguccagccugguguucaccgccaucacguggaucagcuucuccagcuccgcgagcaagcccacccuguacuccaucuacaacgccaacuuccgccgggggaugaaggagaccuucugcaugagcuccaugaagugcuaccgcagcaacgccuacaccaucacgaccuccagccggauggccaagaagaacuacgucggcaucuccgagaucccgagcauggccaagaccaucaccaaggacagcaucuacgacuccuucgaccgcgaggcgaaggagaagaagcucgccuggcccaucaacagcaacccgcccaacacguucguguga

SEQ ID NO: 30776 - RNA, 1068 nt, Artificial Sequence
  derived and/or modified sequence opt1 from GPR1__Homo_sapiens__NP_001091669
auggaggaccuggaggagacccucuucgaggaguucgagaacuacagcuacgaccuggacuacuacucccuggagagcgaccucgaggagaaggugcagcugggcgucgugcacugggugucccugguccucuacugccuggccuucgugcuggggauccccggcaacgccaucgugaucugguucaccggguucaaguggaagaagacggucaccacccucugguuccugaaccuggcgaucgccgacuucaucuuccuccuguuccugccgcucuacaucagcuacguggccaugaacuuccacuggcccuucggcaucuggcugugcaaggccaacuccuucaccgcccagcugaacauguucgcgagcguguucuuccucacggucaucucccuggaccacuacauccaccugauccaccccgugcucagccaccgccaccggacccugaagaacucccugaucgugaucaucuucaucuggcuccuggccagccugaucgggggccccgcccucuacuuccgcgacaccgucgaguucaacaaccacacccugugcuacaacaacuuccagaagcacgacccggaccugacgcucauccggcaccacgugcugaccugggugaaguucaucaucggcuaccuguucccccuccugaccauguccaucugcuaccugugccucaucuucaaggucaagaagcgcagcauccugaucuccagccggcacuucuggaccauccuggugguggucguggccuucguggucugcuggacgcccuaccaccucuucuccaucugggagcugaccauccaccacaacagcuacucccaccacgugaugcaggcggggaucccccugagcaccggccucgccuuccugaacuccugccugaacccgauccucuacgugcugaucagcaagaaguuccaggcccgcuuccggagcuccgucgccgagauccugaaguacacccucugggaggugagcugcuccgggacggucagcgagcagcugcgcaacuccgagaccaagaaccugugccugcucgagaccgcccaguga

SEQ ID NO: 30777 - RNA, 1077 nt, Artificial Sequence
  derived and/or modified sequence opt1 from GPR20__Homo_sapiens__NP_005284
augcccagcguguccccggccggccccagcgccggggcgguccccaacgccaccgccgugaccacggugcgcaccaacgccuccggccuggaggucccccucuuccaccuguucgcccggcuggacgaggagcuccacgggaccuucccgggccuguggcuggcgcucauggccgugcacggggccaucuuccuggccggccuggugcucaacggccuggcgcuguacgucuucugcugccgcacccgggccaagacgcccagcgugaucuacaccaucaaccucguggucaccgaccugcugguggggcucucccugcccacccgcuucgccguguacuacggcgcccgggggugccugcgcugcgccuucccccacguccucggcuacuuccugaacaugcacugcagcauccuguuccucacgugcaucugcguggaccgguaccuggcgaucgugcgcccggaggggucccggcgcugccggcagcccgccugcgcccgcgccgucugcgccuucguguggcuggcggccggcgccgugacccucagcguccugggcgugaccgggucccggcccugcugccgcguguucgcccugaccguccucgaguuccugcugccccuccuggugaucagcguguucacgggccggaucaugugcgcccugucccgcccggggcuccugcaccagggccggcagcgccggguccgcgcgaugcagcugcuccugaccgugcugaucaucuuccucgucugcuucacccccuuccacgcccgccagguggccguggcccuguggcccgacaugccccaccacaccagccuggucguguaccacguggccgucacgcucuccagccugaacuccugcauggacccgaucguguacugcuucgugaccagcggcuuccaggcgaccguccgggggcuguucggccagcacggggagcgcgagcccuccagcggcgacgugguguccaugcaccggagcagcaagggguccggccgccaccacauccucagcgccggcccccacgcccugacccaggcccuggcgaacgggcccgaggccuga

SEQ ID NO: 30778 - RNA, 1302 nt, Artificial Sequence
  derived and/or modified sequence opt1 from GPR22__Homo_sapiens__XP_011514358
augugcuucagcccgauccuggagaucaacaugcaguccgagagcaacaucaccgugcgcgacgacaucgacgacaucaacaccaacauguaccagccgcucuccuacccccugagcuuccaggucucccugacgggcuuccucaugcuggagaucgugcuggggcucggcagcaaccugaccgugcugguccucuacugcaugaaguccaaccugaucaacagcguguccaacaucaucaccaugaaccugcacgugcucgacgucaucaucugcguggggugcaucccccugaccaucgugauccugcuccugagccuggaguccaacacggcccucaucugcugcuuccacgaggccugcgucagcuucgcguccgugagcaccgccaucaacguguucgccaucacccuggaccgguacgacaucuccgucaagcccgccaaccgcauccugaccaugggccgggccgugaugcucaugaucagcaucuggaucuucuccuucuucagcuuccugaucccguucaucgaggugaacuucuucucccugcagagcgggaacacgugggagaacaagacccuccugugcgucagcaccaacgaguacuacaccgagcugggcauguacuaccaccuccuggugcagauccccaucuucuucuucacgguggucgugaugcugaucaccuacaccaagauccuccaggcgcugaacauccgcaucggcacccgguucuccacggggcagaagaagaaggcccgcaagaagaagaccaucagccugaccacccagcacgaggccacggacaugucccagagcuccggcgggcggaacguggucuucggcgugcgcaccagcguguccgucaucaucgcccuccggcgcgcggugaagcggcaccgcgagcggcgcgagcggcagaagcgcgucuuccggaugagccugcugaucaucuccaccuuccuccugugcuggacccccaucagcgugcugaacacgaccauccucugccuggggcccuccgaccugcucgugaagcugcgccugugcuuccucgucauggccuacggcaccaccaucuuccacccgcugcuguacgccuucacgcggcagaaguuccagaaggugcucaagagcaagaugaagaagcgcguggucuccaucguggaggccgacccccugcccaacaacgccgugauccacaacagcuggaucgaccccaagcggaacaagaagaucaccuucgaggacuccgagauccgcgagaagugccuggucccccagguggugaccgacuga

SEQ ID NO: 30779 - RNA, 1014 nt, Artificial Sequence
  derived and/or modified sequence opt1 from GPR26__Homo_sapiens__NP_703143
augaacagcugggacgccggccuggccgggcuccuggugggcaccaugggggucucccugcucagcaacgcgcuggugcugcucugccugcugcacuccgccgacauccgccggcaggcccccgcccucuucacccugaaccugacgugcggcaaccuccugugcaccguggucaacaugccgcugacccucgccggggugguggcgcagcgccagcccgccggcgaccggcugugccgccuggccgccuuccucgacaccuuccuggcggccaacagcaugcuguccauggccgcccucagcaucgaccggugggucgccgugguguucccccuguccuaccgcgcgaagaugcggcugcgcgacgccgcccucauggucgccuacacguggcugcacgcccugaccuuccccgcggccgcccucgcccugagcuggcugggcuuccaccagcucuacgccuccugcacccugugcagccggcgcccggacgagcggcugcgcuucgcgguguucaccggggccuuccacgcccucuccuuccugcugagcuucgugguccucugcugcacguaccugaaggugcugaagguggcccgguuccacugcaagcgcaucgacgucaucaccaugcagacccucgugcugcugguggaccuccaccccuccguccgggagcgcugccuggaggagcagaagcggcgccggcagcgcgccaccaagaagaucagcacguucaucggcaccuuccuggugugcuucgcgcccuacgugaucacccggcucgucgagcuguucuccaccgugcccaucgggagccacuggggcgugcuguccaagugccucgccuacagcaaggccgccuccgacccguucgucuacagccugcugcgccaccaguaccgcaagagcugcaaggagauccugaaccggcuccugcaccgccgguccauccacagcuccgggcugacgggcgacagccacucccagaacauccuccccgugagcgaguga

SEQ ID NO: 30780 - RNA, 1146 nt, Artificial Sequence
  derived and/or modified sequence opt1 from GPR34__Homo_sapiens__NP_001091048
augcgcagccacaccaucaccaugacgaccaccuccgugagcuccuggcccuacagcucccaccggaugcgcuucaucaccaaccacagcgaccagccgccccagaacuucuccgccacgcccaacgucacgaccugccccauggacgagaagcugcucagcaccgugcugaccaccuccuacagcgugaucuucaucgucggccugguggggaacaucaucgcccucuacguguuccugggcauccaccggaagcgcaacuccauccagaucuaccugcucaacgucgcgaucgccgaccugcugcucaucuucugccugccguuccggaucauguaccacaucaaccagaacaaguggacccugggggugauccucugcaagguggucggcacccuguucuacaugaacauguacaucagcaucauccugcucggguucaucucccuggaccgcuacaucaagaucaaccggagcauccagcagcgcaaggccaucacgaccaagcaguccaucuacgugugcugcaucguguggaugcuggcccucggcggcuuccugaccaugaucauccugacccucaagaagggcgggcacaacagcacgaugugcuuccacuaccgggacaagcacaacgccaagggggaggcgaucuucaacuucauccuggucgugauguucuggcugaucuuccuccugaucauccuguccuacaucaagaucggcaagaaccuccugcgcaucagcaagcggcgcuccaaguuccccaacagcgggaaguacgccaccaccgcccggaacagcuucaucgugcugaucaucuucaccaucugcuucguccccuaccacgccuuccgcuucaucuacaucuccagccagcucaacguguccagcugcuacuggaaggagaucgugcacaagacgaacgagaucaugcugguccuguccagcuucaacuccugccucgaccccgugauguacuuccugaugagcuccaacauccggaagaucaugugccagcuccuguuccgccgguuccagggcgagccgagccgcuccgagagcaccuccgaguucaagcccggcuacagccugcacgacaccuccguggcggucaagauccagagcuccagcaaguccaccuga

SEQ ID NO: 30781 - RNA, 1023 nt, Artificial Sequence
  derived and/or modified sequence opt1 from GPR35__Homo_sapiens__NP_001182311
augcugagcggcucccgcgccgugcccaccccgcaccgggggagcgaggagcuccugaaguacaugcugcacucccccugcgucagccucaccaugaacggcacguacaacacgugcggguccagcgaccugaccuggccgcccgccaucaagcugggcuucuacgcguaccucggggugcugcuggugcucggccugcugcucaacucccuggcccugugggucuucugcugccgcaugcagcaguggaccgagacccggaucuacaugaccaaccucgccguggccgaccugugccugcucugcacccugcccuucgugcugcacagccuccgcgacaccuccgacacgccccugugccagcugagccagggcaucuaccucaccaaccgguacauguccaucagccuggucaccgccaucgcgguggaccgcuacguggccguccggcacccccugcgcgcccgggggcuccgcagcccccggcaggccgcggccgugugcgccgugcuguggguccuggugaucggcucccucguggcccgcuggcugcuggggauccaggagggcggguucugcuuccgguccacccgccacaacuucaacagcauggccuucccgcuccugggcuucuaccugccccucgcggucgugguguucugcucccugaaggucgugacggcccuggcccagcggccgcccaccgacgugggccaggccgaggccacccgcaaggcggcccggauggucugggccaaccuccugguguucguggucugcuuccugccccuccacguggggcugaccguccgccuggccgugggcuggaacgccugcgcgcuccuggagacgauccggcgcgcccuguacaucaccagcaagcucuccgacgccaacugcugccuggacgccaucugcuacuacuacauggccaaggaguuccaggaggcgagcgcccuggccguggcccccagcgcgaaggcccacaagucccaggacagccugugcgucacccucgccuga

SEQ ID NO: 30782 - RNA, 1842 nt, Artificial Sequence
  derived and/or modified sequence opt1 from GPR37__Homo_sapiens__NP_005293
augcgcgcccccggcgcccugcucgcgcggaugagccgccugcugcuccugcugcuccugaagguguccgccagcuccgcccugggggucgccccggccagccggaacgagaccugccucggcgaguccugcgcgcccaccgugauccagcgccgggggcgcgacgccuggggccccgggaacagcgcccgggacgugcugcgcgcccgggcgccccgcgaggagcagggcgccgccuuccuggccggcccguccugggaccuccccgccgcgcccgggcgggaccccgccgccggccgcggggccgaggccagcgcggccggcccgcccgggccgcccacgcggccgcccggccccuggcgcuggaagggcgcccgggggcaggagcccuccgagacccugggccgcgggaaccccaccgcccugcagcuguuccugcagaucagcgaggaggaggagaagggcccccggggcgccgggaucuccggccgcagccaggagcaguccgucaagaccgugcccggggcgagcgaccuguucuacuggccccggcgcgccggcaagcuccaggggucccaccacaagccgcugagcaagacggccaacggccuggccggccacgagggguggaccaucgcccuccccggccgggcgcuggcccagaacgggucccugggcgaggggauccacgagcccggcggcccccgccgcgggaacagcaccaaccggcgcgugcggcucaagaacccguucuacccccugacccaggaguccuacggcgccuacgccgucaugugccugagcguggugaucuucgggacgggcaucaucgggaaccucgcggucaugugcaucgugugccacaacuacuacaugcgcagcaucuccaacagccugcuggccaaccucgccuucugggacuuccugaucaucuucuucugccugccccucgugaucuuccacgagcugaccaagaaguggcugcucgaggacuucuccugcaagaucguccccuacaucgagguggccagccugggcgugaccaccuucacgcugugcgcccucugcaucgaccgguuccgcgcggccaccaacguccagauguacuacgagaugaucgagaacugcuccagcaccaccgccaagcuggccgugaucugggugggcgcccugcuccuggcgcugccggaggucgugcuccggcagcuguccaaggaggaccugggguucagcggccgcgcccccgccgagcggugcaucaucaagaucucccccgaccucccggacacgaucuacgugcuggcccugaccuacgacagcgcccgccuguggugguacuucgggugcuacuucugccuccccacccuguucaccaucacgugcucccuggucaccgcgcggaagauccgcaaggccgagaaggccugcacccggggcaacaagcgccagauccagcucgagagccagaugaacugcaccgugguggcccugacgauccuguacggcuucugcaucauccccgagaacaucugcaacaucgucaccgcguacauggccaccggggugucccagcagaccauggaccuccugaacaucaucagccaguuccuccucuucuucaaguccugcgucacgcccgugcugcuguucugccucugcaagccguucagccgggccuucauggagugcugcugcugcugcugcgaggagugcauccagaaguccagcaccgugaccuccgacgacaacgacaacgaguacaccacggagcuggagcugagccccuucagcaccauccgccgggagauguccaccuucgccagcgucggcacccacugcuga

SEQ ID NO: 30783 - RNA, 1446 nt, Artificial Sequence
  derived and/or modified sequence opt1 from GPR37L1__Homo_sapiens__NP_004758
augcgcuggcuguggccccucgccgugagccuggccgucauccuggcggugggccucucccgggugagcgggggcgccccgcugcaccuggggcgccaccgggccgagacccaggagcagcagucccgcagcaagcggggcaccgaggacgaggaggccaaggggguccagcaguacgugcccgaggagugggccgaguacccccgccccauccacccggcgggccuccagcccacgaagccccugguggccaccucccccaacccgggcaaggacgggggcacccccgacagcgggcaggagcugcggggcaaccucaccggggcccccggccagcgccugcagauccagaacccccuguacccggucacggaguccagcuacuccgccuacgcgaucaugcuccuggcccuggugguguucgccgucggcaucguggggaaccucagcgugaugugcaucgucuggcacuccuacuaccucaagagcgccuggaacuccauccuggccagccucgcgcugugggacuuccuggugcuguucuucugccugcccaucgugaucuucaacgagaucaccaagcagcggcugcucggcgacgucuccugccgcgccgugcccuucauggaggugagcucccugggggucaccaccuucagccugugcgcccucggcaucgaccgguuccacguggccacguccacccugcccaaggugcgcccgaucgagcggugccagagcauccuggccaagcucgcggucaucugggugggcagcaugacccuggccgugcccgagcugcuccuguggcagcuggcccaggagcccgcccccaccauggggacgcucgacuccugcaucaugaagccgagcgccucccugcccgagagccuguacucccucgucaugaccuaccagaacgcgcgcauguggugguacuucggcugcuacuucugccugcccauccuguucaccgugaccugccagcucgucacguggcgggugcgcgggcccccgggccgcaagagcgagugccgggccuccaagcacgagcagugcgagagccagcugaacuccaccguggucgggcugaccgugguguacgccuucugcacccuccccgagaacgucugcaacaucgugguggccuaccugagcacggagcugacccggcagacccucgaccugcugggccugaucaaccaguucuccaccuucuucaagggcgccaucacgcccguccuccugcugugcaucugccgcccccucgggcaggcguuccuggacugcugcugcugcugcugcugcgaggagugcggcggggccagcgaggccuccgccgcgaacggcagcgacaacaagcugaagaccgagguguccagcuccaucuacuuccacaagccgcgggagagcccgccccuccugccccuggggacccccugcuga

SEQ ID NO: 30784 - RNA, 1362 nt, Artificial Sequence
  derived and/or modified sequence opt1 from GPR39__Homo_sapiens__NP_001499
auggccagccccucccugccgggcagcgacugcucccagaucaucgaccacagccacgugcccgaguucgaggucgccaccuggaucaagaucacccucauccugguguaccugaucaucuucgugauggggcuccugggcaacuccgcgacgauccgcgucacccaggugcugcagaagaagggguaccuccagaaggaggugaccgaccacauggucagccuggccugcuccgacauccugguguuccucaucggcaugcccauggaguucuacagcaucaucuggaacccccugaccacguccagcuacacccuguccugcaagcuccacaccuuccuguucgaggccugcagcuacgccacccugcuccacgugcugacgcuguccuucgagcgguacaucgccaucugccacccguuccgcuacaaggcggucagcgggcccugccaggugaagcuccugaucggcuucgugugggucaccuccgcccugguggcccucccccugcuguucgccaugggcaccgaguacccccucgugaacgucccgagccaccgggggcugaccugcaaccgcuccagcacgcggcaccacgagcagcccgagaccuccaacaugagcaucugcaccaaccugagcucccgcuggaccguguuccagagcuccaucuucggcgcguucguggucuaccucguggugcugcugagcgucgccuucaugugcuggaacaugaugcagguccucaugaagucccagaaggggagccuggccggcgggacgcggccgccccagcugcgcaaguccgagagcgaggagucccggaccgcccgccggcagaccaucaucuuccuccgccugaucguggugacccuggccgugugcuggaugcccaaccagauccggcgcaucauggcggccgccaagcccaagcacgacuggacgcggagcuacuuccgcgccuacaugauccuccugcccuucuccgagaccuucuucuaccugagcuccgucaucaacccccuccuguacaccgugagcucccagcaguuccggcgcguguucguccaggugcugugcugccggcucagccugcagcacgccaaccacgagaagcgccugcgggugcacgcgcacuccaccacggacagcgcccgcuucguccagcgcccgcuccuguucgccucccggcgccagagcagcgcccggcgcaccgagaagaucuuccuguccaccuuccagagcgaggccgagccccaguccaagagccagucccucagccuggagucccuggagcccaacagcggcgcgaagcccgccaacuccgccgccgagaacggcuuccaggagcacgagguguga

SEQ ID NO: 30785 - RNA, 1089 nt, Artificial Sequence
  derived and/or modified sequence opt1 from GPR4__Homo_sapiens__NP_005273
augggcaaccacaccugggaggggugccacguggacagccgcgucgaccaccuguucccgcccucccucuacaucuucgugaucggcguggggcugcccaccaacugccuggcccucugggccgcguaccggcagguccagcagcgcaacgagcugggcguguaccugaugaaccucagcaucgccgaccugcuguacaucugcacgcucccccuguggguggacuacuuccugcaccacgacaacuggauccacgggcccggcuccugcaagcuguucggcuucaucuucuacaccaacaucuacaucagcaucgccuuccucugcugcaucuccgucgaccgguaccuggccguggcccacccgcuccgcuucgcgcggcugcgccgggugaagaccgccgucgccgugagcuccguggucugggccaccgagcugggggcgaacagcgcgccccucuuccacgacgagcuguuccgcgaccgguacaaccacacguucugcuucgagaaguuccccauggagggcuggguggccuggaugaaccuguaccgcguguucgucggguuccucuuccccugggcccugaugcugcucuccuaccggggcauccugcgcgccgugcgggggagcguguccaccgagcgccaggagaaggccaagaucaagcggcuggcccucagccugaucgccaucguccuggugugcuucgcccccuaccacgugcuccugcugucccgcagcgccaucuaccucggccggcccugggacugcggcuucgaggagcgcgucuucuccgcguaccacagcucccuggccuucaccagccugaacugcguggccgaccccauccucuacugccuggugaacgagggggcccgguccgacgucgccaaggcgcugcacaaccuccugcgcuuccuggccagcgacaagccccaggagauggccaacgccagccucacccuggagacgccgcugaccuccaagcggaacagcaccgccaaggcgaugaccggcuccugggccgccacgccgcccagccagggggaccaggugcagcucaagaugcugccgcccgcccaguga

SEQ ID NO: 30786 - RNA, 1854 nt, Artificial Sequence
  derived and/or modified sequence opt1 from GPR50__Homo_sapiens__NP_004215
augggccccacccuggccgugccgacccccuacgggugcaucggcugcaagcucccccagcccgaguacccgcccgcccugaucaucuucauguucugcgcgauggucaucacgaucgugguggaccugaucgggaacagcauggucauccucgccgugaccaagaacaagaagcugcgcaacuccggcaacaucuucguggucagccuguccguggccgacaugcucguggccaucuaccccuacccccugaugcugcacgccaugagcaucgggggcugggaccucucccagcugcagugccagauggucggcuucaucaccgggcugagcguggugggcuccaucuucaacaucgucgcgaucgccaucaaccgguacugcuacaucugccacagccuccaguacgagcgcaucuucuccgugcggaacacgugcaucuaccuggugaucaccuggaucaugaccguccuggccgugcucccgaacauguacaucgggaccaucgaguacgacccccgcaccuacacgugcaucuucaacuaccugaacaaccccguguucaccgucaccaucgugugcauccacuucgugcugccccuccugaucgucggcuucugcuacgugcggaucuggaccaaggugcuggccgcgcgcgacccggccgggcagaaccccgacaaccagcucgccgagguccggaacuuccugacgauguucgugaucuuccuccuguucgccgucugcuggugccccaucaacgugcugaccgugcuggucgccgugagccccaaggagauggcgggcaagaucccgaacuggcucuaccuggccgccuacuucaucgccuacuucaacuccugccugaacgccgugaucuacggccuccugaacgagaacuuccgccgggaguacuggaccaucuuccacgcgaugcgccaccccaucaucuucuucagcgggcugaucuccgacauccgggagaugcaggaggcccgcacccucgcccgggcccgcgcccacgcgcgggaccaggcccgcgagcaggaccgggcccacgccugccccgccgucgaggagacgcccaugaacgugcgcaacgugccgcugcccggcgacgcggccgccgggcaccccgaccgggccagcggccaccccaagccgcacucccgcagcuccagcgcguaccggaaguccgccagcacccaccacaagagcgucuucucccacagcaaggccgccuccggccaccugaagcccgugagcgggcacuccaagcccgccagcggccaccccaaguccgcgaccguguacccgaagcccgccagcguccacuucaaggccgacuccgugcacuucaagggggacagcgugcacuucaagcccgacuccguccacuucaagccggccagcuccaaccccaagcccaucaccggccaccacgugagcgccgggucccacagcaaguccgcguucagcgccgccacgucccaccccaagccgaccaccggccacaucaagcccgccaccagccacgccgagcccacgaccgcggacuaccccaagccggccaccaccagccaccccaagcccacggccgccgacaaccccgagcucuccgcgagccacugcccggagauccccgccaucgcccaccccguguccgacgacagcgaccugcccgaguccgccagcuccccggccgcgggccccaccaagcccgccgccagccagcuggaguccgacaccaucgccgaccuccccgacccgaccgucgugacgaccagcaccaacgacuaccacgacguggucgugaucgacguggaggacgaccccgacgagauggccgucuga

SEQ ID NO: 30787 - RNA, 1086 nt, Artificial Sequence
  derived and/or modified sequence opt1 from GPR52__Homo_sapiens__NP_005675
augaacgagagccgcuggaccgaguggcggauccugaacauguccagcggcaucgugaacgucuccgagcgccacagcugcccccucggguucggccacuacuccgugguggacgucugcaucuucgagaccguggugaucguccugcugacguuccucaucaucgccgggaaccugaccgugaucuucguguuccacugcgccccgcugcuccaccacuacaccaccagcuacuucauccagacgauggcguacgccgaccuguucgucggcguguccugccuggugcccacccucagccugcugcacuacuccaccgggguccacgagagccugaccugccagguguucggcuacaucaucuccgugcucaagagcgucuccauggccugccuggccugcaucagcguggaccgguaccucgccaucacgaagccccuguccuacaaccagcuggugacccccugccgccuccggaucugcaucauccugaucuggaucuacagcugccugaucuuccucccguccuucuucggcugggggaagcccggcuaccacggggacaucuucgaguggugcgcgaccagcuggcugaccuccgccuacuucacgggcuucaucgucugccugcucuacgcccccgccgcguucguggugugcuucaccuacuuccacaucuucaagaucugccgccagcacaccaaggagaucaacgaccggcgcgcccgguuccccagccacgaggucgacagcucccgcgagaccgggcacagcccggaccggcgcuacgccauggugcuguuccggaucacguccguguucuacaugcuguggcuccccuacaucaucuacuuccugcuggagagcucccgcguccucgacaaccccacccugagcuuccugaccaccuggcucgccaucuccaacagcuucugcaacugcgugaucuacucccugagcaacuccgucuuccggcugggccuccgccggcugagcgagacgaugugcaccuccugcaugugcgugaaggaccaggaggcccaggagcccaagccgcgcaagcgggcgaacagcugcuccaucuga

SEQ ID NO: 30788 - RNA, 960 nt, Artificial Sequence
  derived and/or modified sequence opt1 from GPR55__Homo_sapiens__XP_011510479
augagccagcagaacaccuccggcgacugccuguucgacggggugaacgagcucaugaagacccugcaguucgccguccacauccccacguucgugcugggccuccugcugaaccuccuggccauccacggguucagcaccuuccugaagaaccgcuggccggacuacgcggccaccuccaucuacaugaucaaccucgccguguucgaccugcugcucguccugagccugcccuucaagauggugcucucccaggugcagagccccuuccccucccugugcacccuggucgagugccucuacuucgugagcauguacggcuccguguucacgaucugcuucaucagcauggaccgguuccuggccauccgcuacccgcugcucgucucccaccuccggagcccccgcaagaucuucgggaucugcugcaccaucugggugcugguguggaccggcuccauccccaucuacagcuuccacggcaaggucgagaaguacaugugcuuccacaacauguccgacgacaccuggagcgccaagguguucuucccccuggagguguucggguuccugcugccgaugggcaucaugggguucugcugcucccggagcauccacauccuccugggccgccgggaccacacgcaggacuggguccagcagaaggcgugcaucuacuccaucgccgccagccuggccguguucguggucagcuuccuccccgugcaccugggguucuuccugcaguuccucgugcgcaacuccuucaucgucgagugccgggcgaagcagagcaucuccuucuuccugcagcugagcaugugcuucuccaacgugaacugcugccucgacguguucugcuacuacuucgucaucaaggaguuccgcaugaacauccgggcccaccgccccagccgggugcagcugguccugcaggacaccaccaucucccgcggcuga

SEQ ID NO: 30789 - RNA, 1014 nt, Artificial Sequence
  derived and/or modified sequence opt1 from GPR65__Homo_sapiens__NP_003599
augaacagcacgugcaucgaggagcagcacgaccuggaccacuaccucuuccccaucguguacaucuucgucaucaucguguccaucccggccaacaucggcagccugugcguguccuuccugcaggccaagaaggagagcgagcucgggaucuaccuguucucccugagccucuccgaccugcuguacgcgcucacccugccccuguggaucgacuacaccuggaacaaggacaacuggaccuucagccccgcccucugcaagggcuccgccuuccugauguacaugaacuucuacagcuccaccgccuuccugaccugcaucgccgucgaccgcuaccucgcggugguguacccccugaaguucuucuuccugcggacgcgccgguucgcccucauggucagccuguccaucuggauccuggagaccaucuucaacgccgugaugcucugggaggacgagaccguggucgaguacugcgacgccgagaaguccaacuucacccugugcuacgacaaguacccgcuggagaaguggcagaucaaccucaaccuguuccgcacgugcaccggguacgcgaucccccuggugaccauccucaucugcaaccggaagguguaccaggccguccgccacaacaaggccaccgagaacaaggagaagaagcggaucaucaagcugcuggugagcaucacggugaccuucguccucugcuucacccccuuccacgugaugcugcugauccgcugcauccucgagcacgccgugaacuucgaggaccacagcaacuccggcaagcggaccuacacgauguaccgcaucaccgucgcccugaccagccugaacugcguggcggaccccauccucuacugcuucgugaccgagacggggcgguacgacauguggaacauccugaaguucugcaccggccgcugcaacaccucccagcggcagcgcaagcggauccugagcgucagcaccaaggacacgauggagcucgaggugcuggaguga

SEQ ID NO: 30790 - RNA, 1098 nt, Artificial Sequence
  derived and/or modified sequence opt1 from GPR68__Homo_sapiens__NP_001171147
augggcaacaucaccgccgacaacagcuccaugagcugcaccaucgaccacacgauccaccagacccuggcccccguggucuacgugaccgugcucgucgugggguucccggcgaacugccugucccuguacuucggcuaccuccagaucaaggcccgcaacgagcuggggguguaccugugcaaccucaccgucgccgaccuguucuacaucugcagccugcccuucuggcuccaguacgugcugcagcacgacaacuggucccacggcgaccugagcugccaggugugcgggauccuccuguacgagaacaucuacaucuccgucggcuuccugugcugcaucagcguggaccgguaccucgccguggcccaccccuuccgcuuccaccaguuccggacgcugaaggcggccgucggcguguccguggucaucugggccaaggagcugcucaccagcaucuacuuccugaugcacgaggaggugaucgaggacgagaaccagcaccgcgugugcuucgagcacuaccccauccaggccuggcagcgggcgaucaacuacuaccgcuuccuggucggguuccucuucccgaucugccugcugcucgccuccuaccagggcauccugcgggccgugcgccggagccacgggacccagaagucccgcaaggaccagauccagcggcuggugcucagcaccgucgugaucuuccuggccugcuuccugcccuaccacgugcuccugcugguccgcuccgugugggaggccagcugcgacuucgcgaagggcgucuucaacgccuaccacuucucccuccugcugacgagcuucaacugcguggccgaccccgugcucuacugcuucgucuccgagaccacccaccgggaccuggcccgccugcgcggggccugccucgcguuccugaccugcagccggacgggccgggcccgcgaggccuacccccugggcgccccggaggccagcgggaaguccggcgcgcagggggaggagcccgagcuccugaccaagcugcaccccgccuuccagacccccaacagcccgggcuccggcggguuccccaccggccggcucgccuga

SEQ ID NO: 30791 - RNA, 1134 nt, Artificial Sequence
  derived and/or modified sequence opt1 from GPR6__Homo_sapiens__NP_001273028
augacccugcucgccuggugcacccgcggcgccaaccccgcggccaugaacgccagcgccgccucccugaacgacagccagguggucgugguggcggccgagggggccgccgcggccgccacggccgccggcgggccggacaccggcgagugggggccgcccgcggccgccgcccugggcgccggcgggggcgcgaacgggucccucgagcugagcucccagcugagcgccggcccgcccgggcuccugcugcccgccgucaaccccugggacgugcuccugugcguguccggcaccgucaucgccggcgagaacgcccuggugguggcgcucaucgccagcacccccgcccugcggacgcccauguucguccugguggggucccucgccaccgccgaccugcuggcgggcugcgggcucauccugcacuucguguuccaguaccugguccccagcgagaccgugucccuccugaccgugggcuuccuggucgccagcuucgccgccuccgugagcucccuccuggcgaucacgguggaccgcuaccugagccucuacaacgcccugaccuacuacucccggcgcacccugcucggcguccaccuccugcuggccgccaccuggacggugagccuggggcugggccuccugcccgugcugggguggaacugccucgccgagcgggcggccugcuccgucgugcgcccccuggcccggagccacguggcccugcucagcgccgcguucuucauggucuucggcaucaugcugcaccuguacgugcgcaucugccaggucguguggcggcacgcccaccagaucgcccuccagcagcacugccuggccccgccccaccuggccgcgacccgcaagggggugggcacccucgccgucgugcugggcaccuucggggccuccuggcugcccuucgccaucuacugcguggucggcagccacgaggaccccgcgguguacacguacgccacccugcucccggccaccuacaacuccaugaucaaccccaucaucuacgccuuccggaaccaggagauccagcgcgcccuguggcugcuccugugcgggugcuuccagagcaaggugcccuuccggucccgcagccccuccgaggucuga

SEQ ID NO: 30792 - RNA, 1623 nt, Artificial Sequence
  derived and/or modified sequence opt1 from GPR75__Homo_sapiens__NP_006785
augaacagcaccggccaccuccaggacgcccccaacgccaccucccuccacgugccgcacagccaggaggggaacuccacgagccugcaggagggccugcaggaccucauccacaccgcgacccuggugaccugcacguuccugcucgccgugaucuucugccugggguccuacggcaacuucaucguguuccugagcuucuucgaccccgccuuccgcaaguuccggaccaacuucgacuucaugauccucaaccuguccuucugcgaccuguucaucugcggggucaccgcccccauguucaccuucguccucuucuucagcuccgccagcuccauccccgacgcguucugcuucacguuccaccugaccagcuccggcuucaucaucaugagccugaagaccguggccgucaucgcccuccaccgccugcggauggugcugggcaagcagccgaaccgcaccgccuccuuccccugcacggugcuccugacccugcuccugugggcgaccagcuucacccuggccacgcucgccacccugaagaccuccaagagccaccugugccuccccauguccagccugaucgccgggaagggcaaggccauccugagccucuacgucguggacuucaccuucugcguggcggucguguccgugagcuacaucaugaucgcccagacgcugcggaagaacgcccagguccgcaagugcccgcccgugaucaccguggacgccucccggccccagcccuucauggggguccccgugcagggcgggggcgacccgauccagugcgccaugcccgcgcuguaccgcaaccagaacuacaacaagcuccagcacgugcagacccggggcuacaccaagagccccaaccagcuggucacgcccgccgccucccgccugcagcucgugagcgccaucaaccuguccaccgccaaggacagcaaggcgguggugaccugcgucaucaucguccuguccgugcucgugugcugccugccgcuggggaucagccucguccagguggugcuguccagcaacggcuccuucauccuguaccaguucgagcuguucggguucacccugaucuucuucaagagcggccugaaccccuucaucuacucccggaacagcgccggccuccgccggaagguccuguggugccugcaguacaucgggcugggcuucuucugcugcaagcagaagacgcgccuccgggccauggggaagggcaaccuggaggugaaccgcaacaaguccagccaccacgagaccaacuccgccuacaugcugagccccaagccccagaagaaguucguggaccaggccugcgggccgagccacuccaaggagagcauggucucccccaagaucagcgcgggccaccagcacugcggccaguccagcuccacccccaucaacacccggaucgagcccuacuacagcaucuacaacuccagcccgucccaggaggagagcucccccugcaaccuccagcccgugaacagcuucggguucgccaacuccuacaucgccaugcacuaccacacgaccaacgaccuggugcaggaguacgacagcaccuccgccaagcagauccccgucccgagcguguga

SEQ ID NO: 30793 - RNA, 1092 nt, Artificial Sequence
  derived and/or modified sequence opt1 from GPR78__Homo_sapiens__NP_543009
augggccccggggaggcccugcucgccggccugcuggugaugguccucgcgguggcccugcugagcaacgcccucgugcugcugugcugcgccuacuccgccgagcuccgcacccgggcgagcgggguccugcuggugaaccucucccugggccaccuccugcuggccgcccuggacaugccguucacccuccugggggugaugcgcggccggacccccagcgcccccggcgcgugccaggucaucggguuccuggacaccuuccucgccuccaacgccgcccugagcguggccgcgcuguccgccgaccaguggcucgccgugggcuucccccugcgcuacgccgggcggcugcgcccgcgguacgccggccuccugcuggggugcgcguggggccagagccucgccuucuccggcgccgcccuggggugcagcuggcugggcuacuccagcgccuucgcguccugcagccuccgccugccgcccgagcccgagcggccccgcuucgccgccuucaccgccacccugcacgccgucggguucgugcucccccuggcggugcugugccucacgucccugcagguccaccggguggcccgccggcacugccagcgcauggacaccgugaccaugaaggcccuggcccuccuggcggaccugcaccccagcguccggcagcgcugccucauccagcagaagcggcgccggcaccgcgccacccggaagaucggcaucgccaucgccacguuccugaucugcuucgcccccuacgugaugacccgccuggcggagcucgugccguucgucaccgugaacgcccaguggggcauccuguccaagugccugaccuacagcaaggccguggccgaccccuucacguacucccugcuccgccggcccuuccgccagguccuggccgggauggugcaccggcugcucaagcgcacgccccggccggcgagcacccacgacagcucccuggacguggccggcaugguccaccagcugcucaagcgcacgccccggcccgccagcacccacaacggguccguggacaccgagaacgacagcugccugcagcagacccacuga

SEQ ID NO: 30794 - RNA, 1272 nt, Artificial Sequence
  derived and/or modified sequence opt1 from GPR83__Homo_sapiens__NP_057624
auggugccccaccuccuccugcugugccuccugccgcugguccgcgccaccgagccccacgagggccgggccgacgagcagagcgccgaggccgcccucgccgugcccaacgccucccacuucuucagcuggaacaacuacaccuucuccgacuggcagaacuucguggggcgccggcgcuacggcgcggagagccagaaccccacggucaaggcccugcugaucguggccuacuccuucaucaucguguucagccucuucgggaacguccuggugugccacgugaucuucaagaaccagcggaugcacuccgccaccagccuguucaucgucaaccucgcgguggccgacaucaugaucacccugcugaacaccccguucacgcucgugcgcuucgucaacuccaccuggaucuucggcaaggggaugugccacgugagccgguucgcccaguacugcucccugcacgugagcgcccugacccucaccgccaucgcggucgaccgccaccaggugaucaugcacccccugaagccccggaucuccaucacgaagggcgugaucuacaucgccgucaucuggaccauggccaccuucuucagccugccccacgccaucugccagaagcuguucaccuucaaguacuccgaggacaucgugcgcagccugugccugccggacuuccccgagcccgccgaccucuucuggaaguaccuggaccuggcgacguucauccuccuguacauccugccccuccugaucaucuccguggccuacgcccgggucgccaagaagcuguggcucugcaacaugaucggcgacgugaccaccgagcaguacuucgcccugcgccggaagaagaagaagaccaucaagaugcugaugcucguggucgugcuguucgcgcugugcugguucccgcucaacugcuacguccugcugcucagcuccaaggugauccgcacgaacaacgcccuguacuucgccuuccacugguucgccaugagcagcacgugcuacaaccccuucaucuacugcuggcugaacgagaacuuccggaucgagcucaaggcccugcuguccaugugccagcgcccgcccaagccccaggaggaccggccgcccagccccgugcccuccuuccgcgucgcguggaccgagaagaacgacgggcagcgggcgccccucgccaacaaccugcugcccaccagccagcugcaguccggcaagaccgaccucagcuccguggagcccaucgugaccaugagcuga

SEQ ID NO: 30795 - RNA, 1077 nt, Artificial Sequence
  derived and/or modified sequence opt1 from GPR87__Homo_sapiens__NP_076404
augggcuucaaccugacccucgccaagcugcccaacaacgagcugcacgggcaggagagccacaacuccggcaaccgcagcgacgggccgggcaagaacaccacgcuccacaacgaguucgacaccaucgugcugcccguccuguaccucaucaucuucguggccuccauccugcugaacgggcucgcgguguggaucuucuuccacauccggaacaagaccagcuucaucuucuaccugaagaacaucgucguggccgaccugaucaugacccucacguuccccuuccgcaucgugcacgacgccggcuucggccccugguacuucaaguucauccugugccgguacaccuccguccuguucuacgccaacauguacaccagcaucguguuccucgggcugaucuccaucgaccgcuaccugaagguggucaagccguucggcgacagccggauguacuccaucaccuucacgaaggugcucagcgugugcgucugggugaucauggccgugcugucccugcccaacaucauccucaccaacgggcagcccaccgaggacaacauccacgacugcagcaagcugaaguccccgcugggcgucaaguggcacaccgcggugacguacgugaacagcugccucuucgucgccgugcuggugauccugaucgggugcuacaucgccaucucccgcuacauccacaagagcucccggcaguucaucagccaguccagccgcaagcggaagcacaaccagagcauccgcgucgugguggccgucuucuucacgugcuuccuccccuaccaccugugccggauccccuucaccuucucccaccuggaccgccuccuggacgagagcgcgcagaagauccuguacuacugcaaggagaucacccucuuccuguccgccugcaacgugugccuggaccccaucaucuacuucuucaugugccggagcuucucccgccgccucuucaagaaguccaacauccggacccggagcgagagcauccgcucccugcagagcguccggcgcuccgaggugcggaucuacuacgacuacaccgacguguga

SEQ ID NO: 30796 - RNA, 4188 nt, Artificial Sequence
  derived and/or modified sequence opt1 from GPRASP1__Homo_sapiens__NP_001092881
augaccggcgccgagaucgagagcggggcccaggugaagcccgagaagaagccgggcgaggaggucgucgggggcgcggagaucgagaacgacgugccccugguggugcgccccaaggugcggacccaggcccagaucaugcccggggcccgcccgaagaacaaguccaaggucaugcccggcgccagcacgaagguggagaccuccgccgugggcggggcgcggcccaagagcaaggccaaggccauccccgucucccgcuucaaggaggaggcccagaugugggcgcagccgcgguucggcgccgagcgccucagcaagaccgagcggaacucccagaccaacaucaucgccagcccccugguguccacggacagcgugcuggucgccaagaccaaguaccucuccgaggaccgcgagcuggugaacaccgacaccgagagcuucccccggcgcaaggcccacuaccaggcgggguuccagcccuccuuccggagcaaggaggagacgaacaugggcuccuggugcugcccgcgccccaccagcaagcaggaggccucccccaacagcgacuucaaguggguggacaaguccgucagcagccuguucugguccggggacgaggugaccgccaaguuccaccccggcaaccgggugaaggacagcaaccgcuccaugcacauggccaaccaggaggccaacaccaugagccggucccagacgaaccaggagcucuacaucgcgagcuccagcggcuccgaggacgagagcgucaagaccccgugguucugggcccgcgacaagaccaacaccugguccgggccccgggaggaccccaacagccgcucccgguuccgcagcaagaaggagguguacguggaguccagcuccggcagcgagcacgaggaccaccuggaguccugguucggggccggcaaggaggccaaguuccggagcaagaugcgcgccggcaaggaggcgaacaaccgcgcccggcaccgcgccaagcgggaggccugcaucgacuucaugcccgggagcaucgacgucaucaagaaggaguccugcuucuggccggaggagaacgccaacacguucagccgccccaugaucaagaaggaggcgcgggcccgcgccaugaccaaggaggaggccaagaccaaggcgcgggcccgcgccaagcaggaggcccgguccgaggaggaggcccugaucggcaccugguucugggcgacggacgagagcuccauggccgacgaggccagcaucgaguccagccuccagguggaggacgaguccaucaucgggagcugguucuggaccgaggaggaggccuccaugggcaccggggccagcuccaagagccgcccccggaccgacggcgagcgcaucggcgacucccuguucggggcgcgggagaagacgagcaugaagaccggcgccgaggccaccuccgagagcauccuggccgccgacgacgagcaggucaucaucgggagcugguucugggcgggcgaggaggugaaccaggaggccgaggaggagaccaucuucggguccugguucugggugaucgacgccgccagcgucgaguccggcgugggcgugagcugcgagucccgcacgcggagcgaggaggaggaggucaucgggcccugguucugguccggcgagcaggucgacaucgaggcggggaucggcgaggaggcccgcccgggggccgaggaggagaccaucuucggcagcugguucugggccgagaaccagaccuacauggacugccgggccgagaccuccugcgacacgaugcagggcgcggaggaggaggagcccaucaucgggagcugguucuggacccgcguggaggccugcguggagggcgacgugaacuccaagagcucccucgaggacaaggaggaggccaugauccccugcuucggggccaaggaggaggugagcaugaagcacggcaccggcguccggugccgcuucauggccggggcggaggagaccaacaacaaguccugcuucugggccgagaaggagcccugcauguacccggccggcgggggcagcuggaagucccgccccgaggaggaggaggacaucgugaacagcugguucuggucccggaaguacacgaagcccgaggccaucaucgggagcuggcugugggccaccgaggagagcaacaucgacggcaccggcgagaaggcgaagcugcucaccgaggaggagaccaucaucaacuccugguucuggaaggaggacgaggccaucagcgaggccacggaccgcgaggagucccggccggaggccgaggagggggacaucaucggcagcugguucugggcgggggaggaggaccgccuggagcccgccgccgagacccgggaggaggaccgccuggccgccgagaaggagggcaucgugggguccugguucggcgcgcgggaggagaccauccgccgggaggccggcagcugcuccaagagcucccccaaggccgaggaggaggaggucaucaucgggagcugguucugggaggaggaggccucccccgaggccguggcgggcgugggguucgagagcaagccgggcaccgaggaggaggagaucacggucggguccugguucuggcccgaggaggaggccagcauccaggccggcucccaggccguggaggagauggagagcgagaccgaggaggagaccaucuucggcuccugguucugggacgggaaggaggugagcgaggaggccggccccugcugcgucuccaagcccgaggacgacgaggagaugaucguggagagcugguucuggagccgcgacaaggcgaucaaggagaccgggacgguggcgaccugcgaguccaagccggagaacgaggagggcgccaucgucgggagcugguucgaggccgaggacgagguggacaaccggaccgacaacggcuccaacugcggcagccgcacccucgccgacgaggacgaggccaucgugggguccugguucugggccggcgacgaggcccacuucgagagcaaccccucccccgucuuccgggccaucugccgcagcacgugcuccguggagcaggagcccgacccgagccggcgcccccaguccugggaggaggugaccguccaguucaagcccgggcccuggggccgggugggcuucccgagcaucucccccuuccgcuuccccaaggaggcggccagccuguucugcgagauguucgggggcaagccccggaacauggugcuguccccggagggggaggaccaggagagccuccugcagcccgaccagcccucccccgaguucccguuccaguacgaccccagcuaccgcuccguccaggagauccgggagcaccuccgcgccaaggagagcaccgagcccgagagcuccagcugcaacugcauccagugcgagcucaagaucggcuccgaggaguucgaggagcugcugcuccugauggagaagauccgcgacccguucauccacgagaucagcaagaucgccauggggaugcgguccgccagccaguucacccgcgacuucauccgggacuccggcguggugagccugaucgagacgcuccugaacuaccccuccagccgcguccggaccuccuuccuggagaacaugauccgcauggcgccgcccuaccccaaccucaacaucauccagaccuacaucugcaaggugugcgaggagacccuggccuacagcguggacucccccgagcagcugagcggcauccggaugauccgccaccucacgaccaccaccgacuaccacacgcuggucgccaacuacauguccggguuccugagccuccuggccaccggcaacgccaagacccgguuccacgugcugaagaugcuccugaaccuguccgagaaccucuucaugaccaaggagcugcugagcgcggaggccguguccgaguucaucgggcuguucaaccgcgaggagacgaacgacaacauccagaucguccuggccaucuucgagaacaucggcaacaacaucaagaaggagaccguguucagcgacgacgacuucaacaucgagccccugaucagcgccuuccacaagguggagaaguucgccaaggagcugcaggggaagaccgacaaccagaacgaccccgagggcgaccaggagaacuga

SEQ ID NO: 30797 - RNA, 1074 nt, Artificial Sequence
  derived and/or modified sequence opt1 from GPRC5A__Homo_sapiens__NP_003970
auggccaccaccgugcccgacggcugccgcaacgggcucaagagcaaguacuaccggcugugcgacaaggccgaggcguggggcaucguccuggagacgguggccaccgccgggguggucaccuccguggccuucaugcugacccucccgauccuggugugcaagguccaggacagcaaccgccggaagaugcugcccacgcaguuccucuuccugcugggcgugcucgggaucuucggccugaccuucgccuucaucaucggccuggacggguccaccggccccacccgcuucuuccucuucgggauccuguucagcaucugcuucuccugccugcucgcgcacgccgugagccugacgaagcugguccggggccgcaagccccucucccugcuggugauccucgggcuggccgugggcuucagccugguccaggacgugaucgccaucgaguacaucgugcucaccaugaaccggaccaacgucaacguguucuccgagcugagcgcgccgcgccggaacgaggacuucgugcugcuccugaccuacguccuguuccucauggcccugacguuccugauguccagcuucaccuucugcggcuccuucaccggguggaagcgccacggcgcccacaucuaccucaccaugcugcugagcaucgccaucuggguggccuggaucacgcuccugaugcugcccgacuucgaccggcgcugggacgacaccauccucuccagcgcgcuggccgccaacggguggguguuccugcucgccuacgucucccccgaguucuggcugcugaccaagcagcggaaccccauggacuacccgguggaggacgccuucugcaagccccagcucgugaagaaguccuacggcgucgagaaccgcgcguacagccaggaggagaucacccagggcuucgaggagacgggggacacccuguacgcccccuacagcacccacuuccagcugcagaaccagcccccgcagaaggaguucagcaucccccgggcccacgccuggcccucccccuacaaggacuacgaggugaagaaggagggcagcuga

SEQ ID NO: 30798 - RNA, 1605 nt, Artificial Sequence
  derived and/or modified sequence opt1 from GPRC5B__Homo_sapiens__NP_001291700
augugcgccgugggcgucguggccauccugcgccgggacccccgcgaggggugcaccgacuggaccugcguguuccggggcgcgaaggaggccggggucggcccgagcgugcgcaagcggacgaccaccuccgggagcugggccgugcgccgggagaaguccgucagccgccggaaccuccccggcggcgggcuggccgugugcgugcgccugggcgucuaccgcggggugggcgacuucgagcggcaccgggccggguccauccucagcgcguccuggaccuggugcuggugcgugagcggcaagcugcugcucaugaacccgcccugguccgucgccuggggccaggagggguuccgcgccggcacgcccgggagccgguaccugccccgcauguucguggccuccgagcggaagaugcgcgcgcaccaggugcugaccuuccuccugcuguucgucaucaccagcguggccuccgagaacgccagcaccucccggggcugcggccucgaccugcugccccaguacgugagccucugcgaccuggacgccaucugggggaucgucguggaggccguggcgggcgccggggcccugaucacgcuccugcugaugcucauccugcugguccgccuccccuucaucaaggagaaggagaagaaguccccggugggccugcacuuccuguuccuccuggggacccugggccucuucggccugaccuucgccuucaucauccaggaggacgagaccaucugcagcgugcggcgcuuccuguggggcguccucuucgcccugugcuucuccugccugcucagccaggcguggcgcgugcggcgccugguccggcacgggacggggcccgccggcuggcagcugguggggcucgcccugugccugaugcucgugcaggucaucaucgccguggaguggcuggugcugaccguccuccgcgacacccggcccgccugcgcguacgagcccauggacuucgugauggcccugaucuacgacauggugcugcucgucgugacccugggccuggcccuguucacgcucugcggcaaguucaagcgcuggaagcugaacggggccuuccugcucaucaccgccuuccugagcgugcugaucugggucgcguggaugaccauguaccucuucggcaacgugaagcugcagcagggggacgccuggaacgacccgacccuggccaucacgcucgccgcguccggcuggguguucgucaucuuccacgccauccccgagauccacugcacccugcugcccgcccuccaggagaacacccccaacuacuucgacaccagccagccgcggaugcgcgagacggccuucgaggaggacgugcagcugccccgggccuacauggagaacaaggcguucuccauggacgagcacaacgccgcccugcgcaccgccggguuccccaacggcagccucggcaagcggcccuccgggagccugggcaagcgcccguccgcccccuuccggagcaacguguaccagcccaccgagauggcggucgugcugaacgggggcaccauccccacggccccgcccucccacaccggccgccaccucugguga

SEQ ID NO: 30799 - RNA, 1362 nt, Artificial Sequence
  derived and/or modified sequence opt1 from GPRC5C__Homo_sapiens__NP_061123
augggcacccagcccgagccggggcugggcgcccgcauggccauccacaaggcgcucgugaugugccuggggcugccccucuuccuguuccccggcgccugggcccaggggcacgugcccccgggcugcagccagggccugaacccccucuacuacaaccugugcgaccgguccggggccuggggcaucguccuggaggccguggcgggggccggcaucgucaccaccuucgugcucaccaucauccugguggccagccugcccuucguccaggacaccaagaagcgcucccuccuggggacccagguguucuuccugcucggcacgcugggccuguucugccucguguucgccugcgucgugaagcccgacuucagcacgugcgcgucccggcgcuuccuguucggggugcuguucgccaucugcuucagcugccucgccgcccacgucuucgcccugaacuuccuggcgcggaagaaccacggcccgcgcgggugggugaucuucaccguggcccuccugcugacccucgucgaggugaucaucaacacggaguggcugaucaucacccuggugcggggcuccggcgagggcgggccccaggggaacagcuccgccggcugggccgucgccagccccugcgcgaucgccaacauggacuucgugauggcccucaucuacgugaugcugcugcuccugggggccuuccugggcgccuggcccgcgcucugcggccgcuacaagcgguggcgcaagcacggggucuucgugcugcugaccaccgccacguccguggccaucugggucguguggaucgucauguacaccuacggcaacaagcagcacaacagcccgaccugggacgaccccacccucgccaucgcccuggcggccaacgccugggccuucgugcuguucuacgugauccccgaggucucccaggugaccaagagcucccccgagcagagcuaccagggggacauguacccgacccggggcgugggguacgagaccauccucaaggagcagaagggccaguccauguucgucgagaacaaggcguucagcauggacgagcccguggccgccaagcgccccgugucccccuacagcggcuacaacgggcagcugcugaccagcgucuaccagccgacggagauggcccucaugcacaaggugcccuccgagggcgccuacgacaucauccugccccgggcgaccgccaacagccaggugaugggguccgccaacagcacccugcgcgccgaggacauguacuccgcccagagccaccaggcggccacgcccccgaaggacggcaagaacucccaggucuuccggaaccccuacgugugggacuga

SEQ ID NO: 30800 - RNA, 1038 nt, Artificial Sequence
  derived and/or modified sequence opt1 from GPRC5D__Homo_sapiens__NP_061124
auguacaaggacugcaucgaguccaccggcgacuacuuccugcucugcgacgccgaggggcccuggggcaucauccuggagucccuggccauccucgggaucguggucaccauccugcugcuccuggcguuccuguuccucaugcgcaagauccaggacugcagccaguggaacgugcugccgacgcagcuccucuuccugcuguccgugcucggccuguucgggcuggccuucgccuucaucaucgagcucaaccagcagaccgcccccguccgguacuuccuguucggcgugcuguucgcccucugcuucagcugccugcuggcgcacgccuccaaccucgugaagcugguccgcggcugcgugagcuucuccuggaccaccauccugugcaucgccaucgggugcagccuccugcagaucaucaucgccacggaguacgugacccugaucaugacccggggcaugauguucgucaacaugacccccugccagcucaacguggacuucgugguccugcugguguacgugcuguuccugauggcgcugacguucuucgucuccaaggccaccuucugcgggcccugcgagaacuggaagcagcacggccgccucaucuucaucaccgugcuguucagcaucaucaucuggguggucuggaucuccaugcugcuccgggggaacccgcaguuccagcgccagccccagugggacgaccccguggugugcaucgcccuggucaccaacgccuggguguuccugcuccuguacaucgugcccgagcugugcauccucuaccggagcugccgccaggagugcccgcugcagggcaacgccugccccgucacggcguaccagcacuccuuccagguggagaaccaggagcugagccgggcccgcgacuccgacggcgccgaggaggacgucgcccucaccagcuacgggacccccauccagccccagaccguggacccgacgcaggagugcuucaucccccaggccaagcugagcccccagcaggacgcgggcgggguguga

SEQ ID NO: 30801 - RNA, 2256 nt, Artificial Sequence
  derived and/or modified sequence opt1 from GPRC6A__Homo_sapiens__NP_001273283
auggccuuccugaucauccucaucacgugcuucgugaucauccuggccaccagccagcccugccagacgccggacgacuucgucgcggccaccucccccggccacaucaucaucgggggccuguucgccauccacgagaagaugcucagcuccgaggacagcccccgccggccccagauccaggagugcgugggguucgagaucuccguguuccugcagacccuggccaugauccacagcaucgagaugaucaacaacuccacccuccugccgggcgucaagcugggguacgagaucuacgacacgugcaccgaggugaccguggccauggcggccacccuccgcuuccugagcaaguucaacugcucccgggagacggucgaguucaagugcgacuacagcuccuacaugccccgcgugaaggccgugaucggcagcggcuacuccgagaucaccauggccgucagccggaugcugaaccuccagcugaugccccaggugggguacgaguccaccgcggagauccugagcgacaagauccgcuuccccuccuuccuccggaccgugccgagcgacuuccaccagaucaaggccauggcccaccugauccagaaguccggcuggaacuggaucgggaucaucacgaccgacgacgacuacggccgccuggcccucaacaccuucaucauccaggccgaggcgaacaacgucugcaucgccuucaaggaggugcugcccgccuuccugagcgacaacaccaucgaggugcggaucaaccgcacgcucaagaagaucauccuggaggcccagcugcucgggguccugaagaacgugaccuucaccgacggcuggaacagcuuccacuucgacgcccacggcgaccugaacaccggguacgacgugguccucuggaaggagaucaacggccacaugacggugaccaagauggcggaguacgaccugcagaacgacguguucaucauccccgaccaggagaccaagaacgaguuccggaaccugaagcagauccaguccaagugcagcaaggagugcucccccgggcagaugaagaagaccacgcgcagccagcacaucugcugcuacgagugccagaacugcccggagaaccacuacaccaaccagaccgacaugccccacugccuccugugcaacaacaagacccacugggcccccguccgguccacgaugugcuucgagaaggagguggaguaccugaacuggaacgacagccucgccauccugcugcucauccugucccugcucggcaucaucuucgugcuggucgugggcaucaucuucacccgcaaccugaacacccccgucgucaagagcuccgggggccuccgggugugcuacgugauccugcugugccacuuccucaacuucgccagcaccuccuucuucaucggggagccgcaggacuucacgugcaagacccgccagaccauguucggcgugagcuucacccugugcaucuccugcauccugaccaagagccucaagauccugcuggccuucuccuucgaccccaagcugcagaaguuccucaagugccuguaccggcccauccugaucaucuucacgugcaccgggauccagguggucaucugcacccucuggcugaucuucgcggcccccaccguggaggugaacgucagccugccgcgcgugaucauccucgagugcgaggagggcuccauccuggccuucggcaccaugcugggguacaucgccauccucgccuucaucugcuucaucuucgcguucaagggcaaguacgagaacuacaacgaggccaaguucaucaccuucgggaugcugaucuacuucaucgccuggaucaccuucauccccaucuacgccaccacguucggcaaguacgugcccgcggucgagaucaucgugauccugaucagcaacuacgggauccucuacugcaccuucauccccaagugcuacgugaucaucugcaagcaggagaucaacaccaaguccgccuuccugaagaugaucuacagcuacagcucccacagcgucuccagcaucgcccuguccccggccagccucgacuccaugagcggcaacgugaccaugacgaaccccuccagcuccggcaagagcgccaccuggcagaaguccaaggaccugcaggcgcaggccuucgcccacaucugccgggagaacgccaccagcguguccaagacccugccccgcaagcggaugagcuccaucuga

SEQ ID NO: 30802 - RNA, 3027 nt, Artificial Sequence
  derived and/or modified sequence opt1 from GPRIN1__Homo_sapiens__XP_005265863
auggacaccgccgaggaccccgccuggcugcagcuccugcagaaggacagcuccccgcccggcccccgccccaccgcguucuucugcccccaggacgggagccugggcgccggguccagcgccaugcgggacuacugccccucccagcagaaggccagccccgcgcccccgcgccacacgcccgaccagucccccggcauggagagccggcaccgcucccccagcggggccggcgagggcgccuccugcagcgacgggccgcggggcucccucgccugccccagcccgaccugcuucagcccccaggaguccccguccaaggagacccuggaggcccacggggcgagcaucuccggcacccccgaggccacgaccagcgggaagcccgagcccgugagcuccgucaagaccgagcccaagagcuccgacgaccgcaaccccauguuccuggagaagauggacuucaagagcuccaagcaggccgacagcaccuccaucggcaaggaggaccccggcagcucccggaaggccgaccccauguucacggggaaggccgagccggagauccucggcaagggggaccccguggcgcccggccgcauggaccccaugaccgugcggaaggaggaccugggcagccuggggaaggucgacccgcucugcuccagcaagaccuacaccgugagcccccgcaaggaggaccccggcucccugcggaagguggacccggucuccagcgacaagguggaccccguguucccccgcaaggaggagccccgguacuccgggaaggagcacccggucagcuccgagaagguggcccccacgagcgccgagaagguggaccugguccucagcggcaagcgcgaccccgggcccuccggcaaggccgacccgaugccccuggagagcauggacuccgccagcaccggcaagaccgagcccgggcugcucggcaagcugauccccggguccagcggcaagaacgggccgguguccagcggcaccggcgcgcccgggucccugggccggcucgaccccacgugccuggggauggccgaccccgccagcgugggcaacgucgagaccgugcccgccaccaaggaggacucccgcuuccuggggaagauggaccccgccagcuccggcgagggccggcccgugagcgggcacaccgacacgaccgcguccgccaagaccgaccucaccagccugaagaacgucgaccccauguccagcggcaagguggacccggugagccuggggaagauggaccccaugugcuccggcaagcccgagcuccugagccccggccaggccgagcgcgucuccguggggaaggccggcacggugagcccggggaaggaggaccccgucuccagccggcgcgaggaccccaucuccgccggcagccggaagaccuccagcgagaaggugaacccggaguccagcgggaagaccaaccccgucuccagcggccccggcgacccccgcucccuggggaccgcgggcccgcccagcgccgugaaggccgagcccgccaccgggggcaagggggacccccucuccagcgagaaggcgggccugguggccuccggcaaggccgccccgacggccagcgggaaggcggagccccuggccgucggcaaggaggaccccgugagcaaggggaaggccgacgccggccccuccgggcagggcgacagcguguccaucggcaaggucgugagcaccccggggaagaccgugcccguccccuccggcaagguggaccccgugagccucgggaaggccgaggcgaucccggagggcaaggucgggucccugccccuggagaagggcagccccgugacgaccaccaaggccgacccccgcgccuccggcaaggcccagccgcagagcgggggcaaggccgagaccaagcuccccgggcaggagggcgcggccgcccccggcgaggccggggcggugugccugaagaaggagacgccccaggccuccgagaaggucgacccgggcagcugccggaaggccgagccccuggccuccgggaagggcgagcccgugagccucgggaaggccgacuccgcgcccagccgcaagaccgaguccccgagccugggcaagguggucccccugucccucgagaagaccaagcccagcagcuccagccggcagcuggaccgcaaggcccugggcuccgcccggagcccggagggggcccgcggcuccgaggggcggguggagcccaaggccgagcccgugagcuccaccgaggcgagcucccucggccagaaggaccuggaggccgccggggccgagcgcagccccugcccggaggccgcggccccgccgcccggcccccggacccgcgacaacuucacgaaggcccccuccugggaggccagcgcgccgccgccgccccgggaggacgccggcacccaggccggggcccaggccugcgucuccguggcggugagccccaugagcccccaggacggcgccgggggcuccgccuucuccuuccaggccgcgccccgcgcccccagcccgcccucccggcgcgacgccgggcugcaggucagccucggcgccgccgagacccggagcguggccaccggccccaugacgccccaggcggccgccccgcccgccuuccccgaggugcgcguccggcccggguccgcccuggcggccgccguggccccgcccgagcccgcggagcccgugcgcgacgucagcugggacgagaagggcaugaccugggagguguacggggccgccauggagguggagguccugggcauggccauccagaagcaccucgagcggcagaucgaggagcacggccgccagggggcccccgcgcccccgcccgccgcccgcgccggccccgggcgguccggcagcgugcgcaccgccccgcccgacggggcggccaagcggccgcccggccuguuccgcgcccugcugcaguccgugcggcgcccccggugcugcagccgcgccggccccaccgccgaguga

SEQ ID NO: 30803 - RNA, 1449 nt, Artificial Sequence
  derived and/or modified sequence opt1 from GPRIN2__Homo_sapiens__XP_011538700
augcugaacgagagccucauggagaaggccgacgccuggggccugucccugccccucgagcuggaggcggccaugagcuccagccgcccggagcccgggcccugggcgccccuguccccgcggcuccagccccugagccaguccagcuccagccugcucggcgaggggcgcgagcagcggcccgagcugcgcaagaccgccuccagcaccguguggcaggcccagcugggcgaggcguccacgcggccccaggccccggaggaggaggggaacccgcccgagagcaugaagcccgcccgcgccuccggcccgaaggcgcggcccagcgccggcgggcacuggugguccagcaccgucggcaacguguccaccaugggcgggagcgaccucugccgccugcgggcccccagcgccgccgcgaugcagcgcucccacagcgaccuggugcgguccacccagaugcgcgggcacagcggcgcccggaaggccucccucagcugcuccgcccugggcagcucccccguccaccgcgcccagcugcagcccgggggcacgagcgggcagggcggccaggcgcccgccgggcucgagcgggaccuggcccccgaggacgagaccuccaacagcgccuggaugcugggcgccucccagcucagcgugcccccgcuggaccugggggacaccaccgcgcacuccagcuccgcccaggccgagcccaaggccgccgagcagcucgcgacgacgaccugccacgcccugccgcccgccgcccugcucugcggcaugcgcgaggugcgggccgggggcugcugccacgcccugcccgccaccggcauccuggccuuccccaagcucgucgccagcguguccgagagcgggcugcaggcgcagcacggcgugaagauccacugccgccugagcgggggccuccccgggcacucccacugcugcgcccaccuguggggccccgccggccuggucccggagcccgggagccggaccaaggacguguggaccaugaccuccgccaacgaccucgcccccgcggaggccagcccgcuguccgcccaggacgccggcgugcaggccgcgcccgucgccgccugcaaggccguggcgaccagccccucccuggaggcccccgccgcccuccacguguucccggaggucacgcuggggagcucccuggaggaggugcccagccccgugcgcgacguccggugggacgccgagggcaugaccugggagguguacggggcggccguggaccucgagguccugggcguggccauccagaagcaccuggagaugcaguucgagcagcuccagcgcgcccccgccuccgaggacagccuguccguggagggccgccgggggccgcugcgcgcggucaugcagagccuccggcgccccuccugcugcggcugcagcggggccgcccccgaguga

SEQ ID NO: 30804 - RNA, 2331 nt, Artificial Sequence
  derived and/or modified sequence opt1 from GPRIN3__Homo_sapiens__XP_005262993
augggcaccgugcccgacccgcugcgcagcgccaagaccucccucaucgccgcgagcgggaaggaggacgaccugggcgagccccaggccgccagcccccggcaccgccccgcccugcucugcaagaacgccaacggguucuccggcgcgccggccgagcccgaccugagcccccgggccgccgcggaggcccugaugcaggucugcgagcacgagacgacccagcccgacauguccuccccggggguguucaacgaggugcagaaggcccccgccaccuucaacagccccggcaacccccagcucccgggcuccagccagcccgccgcguccgcccccagcuccgccgccgggcgcgaccugauccacacgccccugaccaugccggccaaccagcacacgugccagagcauccccggcgaccagcccaacgcgaucaccuccagcaugcccgaggacucccucaugcggagccagcgcaccuccaaccgggagcagccggagaagcccagcugccccgucgggggcgugcugagcuccagcaaggaccagguguccugcgaguuccccagcccggagaccauccaggggaccguccagacccccgugaccgccgcccgcguggucucccacagcuccagccccgugggcggccccgagggggagcggcagggcgccaucugcgacuccgagaugcgcagcugcaagccgcugacgcgggaguccgggugcagcgagaacaagcagcccuccgugaccgccagcggcccccagggcaccaccuccgucacgccgcagcccacgccccucaccagcgagcccuccgcgugcccgcccgggcccgagaaggugccccugccggcccagcgccagaugagccgguucaaggaggccuccaccaugaccaaccaggccgagagcgagaucaaggaggugcccagccgcgccuggcaggacgcggagguccaggccguggccuccguggagagccgguccgucagcaccucccccagcauccugaccgccuuccucaaggagucccgcgcgcccgagcacuucgagcaggagcagcugcgggugaucugccacagcuccggcagccacacccuggagcucuccgacagcacgcuggccccgcaggaguccagccagugccccgggaucaugccccaggugcacauccaggccgccgccgcggaguccaccgccuuccagcgcgagaacaagcuggccagccuccccggcgggguccugaagaccuccagcaucaaccuggugagcuccaacgcccagcacacgugcaaggaggacggccggcucgccggcaugaccccggugcgcgaggagagcaccgcgaagaagcuggccgggaccaacuccagcucccugaaggccaccgccaucgaccagaucagcaucuccgccugcagccaggcggagacguccuacggccucgggaaguucgagacccggcccagcgaguucgccgagaagaccaccaacggccacaagacggaccccgacugcaagcuguccgacagcugcggguccaucagcaaggccgaccacuccggcagccuggaccccaccaacaagggcgacgcccgcgagaagaagccggcgagcccccaggucgugaaggagaaggaguccaccgggaccgacaccuccgacgccaagacgcuccugcugaaccccaagagccaggagagcggcgggaccgaguccgccgccaaccccaccccgagccccauccgcaagaaccaggaguccacccucgaggagaaccggcagacgaagaccgccaccagccugucccugcccagcgacccgaugggcgacuccagccccggguccggcaagaagacccccagccgcuccgucaaggcgagcccccggcgcccgucccgggugagcgaguuccucaaggagcagaagcugaacgugacggccgccgccgcccaggucggccugacccccggggacaagaagaagcagcucggcgcggacuccaagcugcagcugaagcagagcaagcgcgugcgggacguggucugggacgagcaggggaugaccugggagguguacggcgccucccucgacgccgagagccugggcaucgccauccagaaccaccuccagcgccagauccgggagcacgagaagcugaucaagacccagaacucccagacgcgccggagcaucagcuccgacaccagcuccaacaagaagcugcgcgggcggcagcacagcguguuccaguccaugcugcagaacuuccgccggcccaacugcugcguccgccccgccccgagcuccgugcucgacuga

SEQ ID NO: 30805 - RNA, 984 nt, Artificial Sequence
  derived and/or modified sequence opt1 from GPS2__Homo_sapiens__NP_004480
augcccgcccugcucgagcgcccgaagcugagcaacgccauggcgcgggcccugcaccgccacaucaugauggagcgggagcgcaagcggcaggaggaggaggagguggacaagaugauggagcagaagaugaaggaggagcaggagcgccggaagaagaaggagauggaggagcgcaugucccucgaggagaccaaggagcagauccugaagcuggaggagaagcuccuggcccugcaggaggagaagcaccagcuguuccugcagcugaagaagguccuccacgaggaggagaagcggcgccggaaggagcagagcgaccugaccacgcugaccuccgccgccuaccagcagagccucaccgugcacaccggcacgcaccuccuguccaugcaggggagccccggcgggcacaaccgccccggcacccucauggcggccgaccgggccaagcagauguucgggccccaggugcugaccacccgccacuacgucggcuccgccgcggccuucgccggcacgccggagcacgggcaguuccagggcagccccgggggcgccuacgggaccgcccagcccccgccccacuacggccccacccagcccgcguacucccccagccagcagcugcgggccccguccgccuuccccgccgugcaguaccucagccagccccagccccagccguacgccgugcacggccacuuccagcccacccagacgggguuccugcagcccggcggggcgcugucccuccagaagcagauggagcacgccaaccagcagaccggcuucagcgacuccagcucccugcgccccaugcacccgcaggcccugcaccccgcccccggccuccuggccagcccccagcugccgguccagaugcagcccgcggggaaguccggcuucgccgccaccagccagcccgggccccggcucccguucauccagcacagccagaacccccgcuucuaccacaaguga

SEQ ID NO: 30806 - RNA, 2028 nt, Artificial Sequence
  derived and/or modified sequence opt1 from GPSM1__Homo_sapiens__NP_001139110
auggccggccccgccccgcccgcggccgacgagcugcccgggcccgccgcccgccggcucuacagccgcauggaggccuccugccuggagcuggcgcucgagggcgagcggcugugcaaggccggggacuucaagaccggcguggccuucuucgaggccgcgguccagguggggaccgaggaccugaagacgcucagcgccaucuacucccagcugggcaacgccuacuucuaccugaaggagcacggccgcgcccucgaguaccacaagcacgaccugcugcucgcccggaccaucggggaccgcaugggcgaggcgaaggccagcgggaaccugggcaacacccugaaggugcucgggcgguucgacgaggccgccgucugcugccagcgccaccuguccaucgcccaggagcagggcgacaaggugggcgaggcgcgggcccuguacaacaucgggaacguguaccacgccaagggcaagcagcucagcuggaacgccgccaacgcgacccaggacccggggcaccucccgcccgacguccgcgagacgcugugcaaggccuccgaguucuacgagcggaaccugagccuggugaaggagcugggcgaccgcgccgcccagggccgggccuacgggaaccucggcaacacccacuaccugcuggggaacuucaccgaggcgaccacguuccacaaggagcgccucgccaucgccaaggaguucggcgacaaggccgcggagcggcgcgccuacuccaaccuggggaacgcccacguguuccugggccgguucgacgucgccgccgaguacuacaagaagacccuccagcugagccgccagcugcgggaccaggcgguggaggcccaggccugcuacucccucggcaacaccuacacccugcugcaggacuacgagcgcgccgccgaguaccaccuccggcaccuccugaucgcgcaggagcuggccgaccgcgugggggagggccgcgccugcuggagccuggggaacgccuacgucuccaugggccggcccgcccaggcgcugacguucgccaagaagcaccuccagaucagccaggagaucggggaccgccacggcgagcugaccgcccggaugaacguggcccagcugcagcucgugcugggccgccugaccucccccgcggccagcgagaagcccgaccucgccggguacgaggcccagggcgcccggcccaagcgcacccagcggcuguccgcggagacgugggaccugcugcgccucccccuggagcgggagcagaacggggacagccaccacuccggcgacuggcgcgggccgagccgggacagccugccccuccccguccgcucccggaaguaccaggagggccccgacgccgagcgccggccgcgcgagggcagccacagcccccuggacuccgccgacgugcgggugcacgucccccgcaccuccaucccccgggccccgagcuccgacgaggagugcuucuucgaccugcucaccaaguuccagagcucccgcauggacgaccagcgcugcccccuggacgacgggcaggccggcgcggccgaggccaccgccgcccccacgcuggaggaccggaucgcgcagcccagcaugaccgccuccccgcagaccgaggaguucuucgaccucaucgccagcucccagagccgccggcuggacgaccagcgcgccuccguggggagccugcccggccuccggaucacccacuccaacgcgggccaccuccgcgggcacggcgagccccaggagcccggggacgacuucuucaacaugcugaucaaguaccagagcucccggaucgacgaccagcgcugcccgccgcccgacgugcugccccggggccccacgaugcccgacgaggacuucuucagccugauccagcgcguccaggccaagcggauggacgagcagcgcguggaccuggccgggggccccgagcagggcgccgggggcccgcccgagccccagcagcagugccagcccggggccagcuga

SEQ ID NO: 30807 - RNA, 1377 nt, Artificial Sequence
  derived and/or modified sequence opt1 from GPSM2__Homo_sapiens__XP_011539605
auggaggagaaccugaucagcaugcgcgaggaccacuccuuccacgugcgguaccgcauggaggccagcugccucgagcuggcccuggagggcgagcggcucugcaaguccggggacugccgcgcgggcgucagcuucuucgaggccgccguccagguggggaccgaggaccugaagacccuguccgccaucuacagccagcucggcaacgccuacuucuaccugcacgacuacgcgaaggcccuggaguaccaccaccacgaccucacgcuggcccggaccaucggggaccagcugggcgaggccaaggcguccggcaaccucgggaacacccugaaggugcugggcaacuucgacgaggccaucgugugcugccagcgccaccucgacaucagccgggagcugaacgacaaggugggggaggcccgcgcccuguacaaccucggcaacgucuaccacgccaaggggaaguccuucggcugccccggcccgcaggacgugggggaguuccccgaggaggugcgggacgcgcugcaggccgccgucgacuucuacgaggagaaccugagccucgugaccgcccugggcgaccgcgccgcgcaggggcgggccuucggcaaccugggcaacacgcacuaccuccuggggaacuuccgcgacgccgugaucgcccacgagcagcggcugcucaucgccaaggaguucggcgacaaggcggccgagcgccgggccuacuccaaccuggggaacgccuacaucuuccugggcgaguucgagaccgccagcgaguacuacaagaagacccuccugcuggcgcgccagcucaaggaccgggccgucgaggcccaguccugcuacagccuggggaacaccuacacgcugcuccaggacuacgagaaggccaucgacuaccaccugaagcaccuggcgaucgcccaggagcucaacgaccgcaucggcgagggccgggccugcuggucccuggggaacgccuacaccgcccugggcaaccacgaccaggcgaugcacuucgccgagaagcaccucgagaucagccgcgaggugggggacaaguccggcgagcugaccgcccggcugaaccucagcgaccugcagauggugcuggggcucuccuacagcaccaacaacagcaucauguccgagaacacggagaucgacagcucccugaacggcguccgccccaagcugggccgccggcacagcauggagaacauggagcugaugaagcucacccccgagaaggugcugaagaaccagcacuucaacgugcugaucaugcgcauccacuccaugcaccucguccaggugcugaagaucgugcaguacaccaagaaggacaucuucaaggagaucuga

SEQ ID NO: 30808 - RNA, 483 nt, Artificial Sequence
  derived and/or modified sequence opt1 from GPSM3__Homo_sapiens__NP_071390
auggaggccgagcgcccccaggaggaggaggacggcgagcaggggccgccccaggacgaggagggcuggccccccccgaacagcaccacccggcccuggcgcuccgccccccccagcccgcccccccccgggacgcggcacaccgcgcugggcccgcgcuccgccagccuccugucccugcagaccgagcuccugcuggaccucguggccgaggcccagagccggcgccuggaggagcagcgggccaccuucuacacgccccagaaccccuccagccuggcgcccgccccgcuccgcccccuggaggaccgggagcagcuguacuccaccauccucagccaccagugccagcgcauggaggcccagcgguccgagcccccccugccgcccgggggccaggagcugcucgagcugcugcuccgcguccagggcgggggccggauggaggagcagcgcagccggccccccacccacaccugcuga

SEQ ID NO: 30809 - RNA, 1272 nt, Artificial Sequence
  derived and/or modified sequence opt1 from GPT2__Homo_sapiens__NP_001135938
augggccagcagcccaucaccuuccugcgccaggugauggcccucugcaccuacccgaaccugcuggacagccccuccuuccccgaggacgccaagaagcgggcgcgccggauccuccaggccugcgggggcaacagccugggguccuacagcgccucccagggcgucaacugcauccgcgaggacguggccgccuacaucacgcggcgcgacgggggcgugcccgcggacccggacaacaucuaccugaccaccggcgccagcgacgggaucuccaccauccucaagauccuggucagcggcgggggcaagucccggacgggggugaugauccccaucccccaguacccccuguacagcgccgugaucuccgagcucgacgccauccaggucaacuacuaccuggacgaggagaacugcugggcgcugaacgugaacgagcuccgccgggccgugcaggaggccaaggaccacugcgacccgaagguccugugcaucaucaaccccggcaaccccaccggccaggugcagagccgcaagugcaucgaggacgugauccacuucgccugggaggagaagcuguuccuccuggccgacgaggucuaccaggacaacguguacucccccgacugccgguuccacagcuucaagaaggugcuguacgagauggggccggaguacuccagcaacgucgagcucgcguccuuccacagcaccuccaagggcuacaugggggagugcggcuaccgcggcggguacauggaggugaucaaccugcaccccgagaucaagggccagcuggugaagcuccugagcguccggcugugcccgcccgugagcgggcaggccgccauggacaucguggucaacccgcccguggccggcgaggaguccuucgagcaguucagccgcgagaaggaguccgugcucgggaaccuggccaagaaggcgaagcugaccgaggaccucuucaaccagguccccggcauccacugcaacccccugcagggcgccauguacgccuucccccggaucuucauccccgccaaggccguggaggcggcccaggcccaccagauggcccccgacauguucuacugcaugaagcugcucgaggagacggggaucugcgucgugcccggcagcggguucggccagcgcgaggggaccuaccacuuccggaugaccauccugccgcccguggagaagcugaagaccguccuccagaaggugaaggacuuccacaucaacuuccuggagaaguacgccuga

SEQ ID NO: 30810 - RNA, 1491 nt, Artificial Sequence
  derived and/or modified sequence opt1 from GPT__Homo_sapiens__XP_011515295
auggccagcuccaccggcgaccgcagccaggccgugcggcacgggcugcgcgcgaagguccucacccuggacggcaugaacccccgggugcgccggguggaguacgccguccgcgggccgaucgugcagcgggcccuggagcucgagcaggagcugcgccagggcgugaagaagcccuucacggaggucauccgggccaacaucggggacgcccaggcgaugggccagcgccccaucaccuuccugcgccaggugcucgcccugugcgugaaccccgaccugcucuccagcccgaacuuccccgacgacgccaagaagcgggccgagcggauccugcaggcgugcggcgggcacucccugggcgccuacagcgucuccagcgggauccagcucauccgcgaggacguggcccgguacaucgagcgccgggacggcgggauccccgccgaccccaacaacguguuccuguccaccggcgccagcgacgcgaucgucaccgugcugaagcuccugguggccggcgaggggcacacgcgcaccggcguccugaucccgaucccccaguacccccucuacuccgccacccuggccgagcugggggccguccagguggacuacuaccucgacgaggagcgggcgugggcccuggacguggccgagcugcaccgcgcccucggccaggcccgggaccacugccgcccccgcgcgcugugcgugaucaacccgggcaaccccaccggccaggugcagacgcgggagugcaucgaggccgucauccgcuucgccuucgaggagcggcuguuccuccuggccgacgagguguaccaggacaacguguacgccgcggggagccaguuccacuccuucaagaagguccugauggagauggggccgcccuacgccggccagcaggagcucgccagcuuccacuccaccagcaagggguacaugggcgagugcggcuuccgcgggggcuacguggaggucgugaacauggacgccgcggugcagcagcagaugcugaagcugauguccguccggcucugcccgcccgugcccgggcaggcccugcuggaccucguggucagcccgcccgcccccaccgaccccuccuucgcccaguuccaggccgagaagcaggcggugcuggccgagcuggccgccaaggccaagcucaccgagcaggucuucaacgaggcgcccggcaucagcugcaaccccgugcagggggccauguacagcuucccccgcgugcagcugccgccccgggccguggagcgcgcccaggagcugggccucgcccccgacauguucuucugccugcggcugcucgaggagacgggcaucugcgucgugcccggguccggcuucgggcagcgcgagggcaccuaccacuuccggaugaccauccugcccccgcuggagaagcuccgccugcugcuggagaagcucagccgguuccacgcgaaguucacccuggaguacuccuga

SEQ ID NO: 30811 - RNA, 666 nt, Artificial Sequence
  derived and/or modified sequence opt1 from GPX5__Homo_sapiens__NP_001500
augaccacccagcugcgcgugguccaccuccugccccugcuccuggccugcuucgugcagacgagcccgaagcaggagaagaugaagauggacugccacaaggacgagaagggcaccaucuacgacuacgaggccaucgcgcugaacaagaacgaguacguguccuucaagcaguacgucgggaagcacauccucuucgugaacguggccaccuacugcggccugaccgcccaguaccccgagcugaacgcccuccaggaggagcugaagcccuacgggcuggucgugcucggcuuccccugcaaccaguucgggaagcaggagccgggcgacaacaaggagauccugcccggccugaaguacgugcggcccgggggcggguucguccccagcuuccagcuguucgagaagggcgacgugaacggggagaaggagcagaagguguucuccuuccucaagcacagcugcccgcaccccuccgagauccugggcacguucaagagcaucuccugggaccccgucaaggugcacgacauccgcuggaacuucgagaaguuccucgugggccccgacgggaucccggucaugcgguggagccaccgcgccaccguguccagcgugaagaccgacauccuggcguaccugaagcaguucaagaccaaguga

SEQ ID NO: 30812 - RNA, 2238 nt, Artificial Sequence
  derived and/or modified sequence opt1 from GRAMD1B__Homo_sapiens__NP_001273492
augaagggcuucaagcugagcugcaccgccuccaacagcaaccgcuccacccccgccugcagcccgauccuccggaagcgcucccggagccccacgccccagaaccaggacggggacaccaugguggagaagggcuccgaccacagcuccgacaagagccccuccaccccggagcaggggguccagcgcagcugcuccagccaguccggccggagcgggggcaagaacuccaagagccacaagcgccuguccaagaagucccagagcugguacaacgugcugagccccaccuacaagcagcggaacgaggacuuccgcaagcuguucaagcagcugcccgacacggagcggcugaucguggacuacagcugcgcgcuccagcgcgacauccugcugcagggccggcucuaccuguccgagaacuggaucugcuucuacagcaacaucuuccgcugggagacccugcucaccguccggcugaaggacaucugcuccaugaccaaggagaagacggcccgccugauccccaacgccauccaggugugcaccgacagcgagaagcacuucuucaccuccuucggggcccgggaccgcaccuacaugaugauguuccggcucuggcagaacgcccugcuggagaagccgcucugccccaaggagcuguggcacuucgugcaccagugcuacggcaacgagcuggggcucacgagcgacgacgaggacuacgucccgcccgacgacgacuucaacaccaugggcuacugcgaggagauccccguggaggagaacgaggugaacgacuccagcuccaagagcuccaucgagaccaagcccgacgcgagcccccagcugcccaagaaguccaucaccaacagcacgcugaccuccaccgggagcuccgaggccccggucagcuucgacggccucccccuggaggaggaggcccuggagggcgacgggagccucgagaaggagcuggccaucgacaacaucaugggcgagaagaucgagaugaucgcgcccgugaacucccccagccuggacuucaacgacaacgaggacaucccgaccgagcucuccgacagcuccgacacgcacgacgagggggaggugcaggccuucuacgaggaccugagcggccgccaguacgucaacgagguguucaacuucuccguggacaagcuguacgaccuccuguucaccaacagccccuuccagcgggacuucauggagcagcgccgguucuccgacaucaucuuccaccccuggaagaaggaggagaacggcaaccagagccgcgucauccuguacaccaucacccucacgaacccccuggccccgaagaccgccaccgugcgcgagacccagacgauguacaaggccucccaggagagcgagugcuacgugaucgacgcggagguccugacccacgacgugcccuaccacgacuacuucuacaccaucaaccgguacacccucacgcgcguggcccggaacaagucccgccugcgggucagcaccgagcugcgcuaccggaagcagcccugggggcucgugaagaccuucaucgagaagaacuucugguccggccuggaggacuacuuccgccaccuggagagcgagcucgccaagaccgaguccacguaccuggccgagaugcaccggcagagccccaaggagaaggccagcaagaccaccaccgugcgccggcgcaagcggccgcacgcgcaccuccgcgucccccaccucgaggaggugaugucccccgucaccacgccgaccgacgaggacguggggcaccggaucaagcacguggccggcagcacccagacccgccacauccccgaggacacgcccaacggguuccaccuccaguccgucagcaagcugcugcuggugaucuccugcgugaucugcuucagccugguccugcucgugauccugaacaugaugcuguucuacaagcucuggaugcuggaguacaccacccagacccugacggccuggcagggccuccggcugcaggagcgccugccccagucccagaccgagugggcccagcuccuggagagccagcagaaguaccacgacaccgagcugcagaaguggcgggagaucaucaaguccagcgugaugcuccuggaccagaugaaggacucccugaucaaccuccagaacggcauccgcagccgcgacuacaccuccgagagcgaggagaagcggaaccgcuaccacuga

SEQ ID NO: 30813 - RNA, 1344 nt, Artificial Sequence
  derived and/or modified sequence opt1 from GRAMD3__Homo_sapiens__NP_001139791
augacccgccggcagcagguccugcaggccaagcgcagcauccagcagaccuuccaggcccagcucaugcccuggaaguccauguuccacggccgggaggugaagccgguggggcccgaccuggagcugagcgaggcggagaacggcguggaggagaagaagaaggccugccgcucccccacggcccagagccccaccccguccgucgaggccgacagccccgaccagaagaagaucaucucccucuggagcaaguccagcuucgacggggccucccuggcgagcgacaagaacgacugcaagaccgaguccaagaacgaccccaagaccgagcggaagaaguccagcagcuccagccaguacaaggccaacaugcacuuccacaagcuguuccucuccgugcccacggaggagccgcugaagcagagcuucacgugcgcccugcagaaggagauccucuaccagggcaagcuguucgugagcgagaacuggaucugcuuccacuccaaggucuucgggaaggacaccaagaucagcauccccgccuucuccgugacccugaucaagaagaccaagaccgcgcuccuggugcccaacgcccugaucaucgccaccgucaccgaccgcuacaucuucgugagccuccugucccgggacagcacguacaagcugcucaaguccgugugcggccaccuggagaacaccagcgucggcaacucccccaacccgagcuccgccgagaacagcuuccgcgccgaccggcccuccagccugccccucgacuucaacgacgaguucuccgaccuggacgggguggugcagcagcgccggcaggacauggagggcuacagcuccagcgggucccagacccccgagagcgagaacagccgcgacuuccacgcgaccgagucccagacgguccugaacgugagcaagggcgaggccaagccgacccgggccgacgcccacgugaaccgcguccccgaggggaaggccaagucccuccccgugcagggccugagcgagaccgugggcauccugcacaaggucaagucccagaagugccccaugcuccaccacauccugaucuucuacgcgaucguggugugcgcccugaucaucagcaccuucuacaugcgguaccgcaucaacacgcucgaggagcagcuggggcugcucaccuccaucgucgacacccacaacaccgagcaggccgccccgagcggccugcggucccaggugcaguucaacgucgaggugcugugccaggagcucacggccaacaucgugaagcuggagaagauccagaacaaccugcagaagcuccuggagaacggggacuga

SEQ ID NO: 30814 - RNA, 1737 nt, Artificial Sequence
  derived and/or modified sequence opt1 from GRAMD4__Homo_sapiens__NP_055939
augcugcgccggcucgacaagauccgcuuccggggccacaagcgcgacgacuuccuggaccuggccgagagccccaacgccuccgacaccgagugcagcgacgagaucccgcucaaggugccccggaccagcccccgcgacuccgaggagcugcgggaccccgcggggccgggcacgcugaucauggccaccgggguccaggacuucaaccgcaccgaguucgaccggcucaacgagaucaagggccaccuggagaucgcccugcucgagaagcacuuccugcaggaggagcugcgcaagcuccgggaggagaccaacgccgagaugcugcgccaggagcuggaccgggagcgccagcggcgcauggagcucgagcagaaggugcaggaggugcugaaggcccggacggaggagcagauggcgcagcagccgcccaaggggcaggcccaggccuccaacggcgccgagcgccggagccagggccuguccagccgccuccagaagugguucuacgagcgguucggggaguacgucgaggacuuccgcuuccagcccgaggagaacaccguggagaccgaggagccccuguccgcgcgccggcugaccgagaacaugcgccggcucaagcgcggcgccaagcccgugacgaacuucgucaagaaccugagcgcccuguccgacugguacagcguguacaccuccgccaucgccuucaccguguacaugaacgcggucuggcacgggugggccaucccccucuuccuguuccuggccauccuccggcugagccugaacuaccucaucgcccgcggcuggcggauccagugguccaucgugcccgaggugagcgagccggucgagccgcccaaggaggaccugaccguguccgagaaguuccagcuggugcucgacgucgcccagaaggcgcagaaccuguucgggaagauggccgacauccuggagaagaucaagaaccucuucaugugggugcagcccgagaucacgcagaagcuguacguggcccugugggccgccuuccucgcgagcugcuucuuccccuaccgccuggucggccuggccgugggccucuacgccgggaucaaguucuuccugaucgacuucaucuucaagcggugcccccgccugcgggccaaguacgacacccccuacaucaucuggcgcucccuccccaccgacccgcagcugaaggagcggagcagcgccgcggugucccgccggcugcagaccacgagcucccgcagcuacguccccuccgcccccgccggccucgggaaggaggaggacgccggccgguuccacagcaccaagaagggcaacuuccacgagaucuucaaccugaccgagaacgagcgcccccuggcggugugcgagaacggguggcggugcugccugaucaaccgcgaccgcaagaugccgaccgacuacauccggaacggcgugcucuacgucacggagaacuaccugugcuucgaguccagcaaguccgggagcuccaagcgcaacaaggugaucaagcuggucgacaucaccgacauccagaaguacaaggugcucagcgugcugcccggcuccgggaugggcaucgccgucagcacccccuccacccagaagccccugguguucggcgccauggugcaccgggacgaggccuucgagacgauccucagccaguacaucaagaucaccuccgccgcggccagcgggggcgacuccuga

SEQ ID NO: 30815 - RNA, 993 nt, Artificial Sequence
  derived and/or modified sequence opt1 from GRAP2__Homo_sapiens__NP_001278754
auggaggccguggccaaguucgacuucaccgcgagcggcgaggacgagcuguccuuccacaccggggacguccucaagauccugagcaaccaggaggagugguucaaggccgagcugggcucccaggagggguacgugcccaagaacuucaucgacauccaguucccgaagugguuccacgagggccucagccgccaccaggccgagaaccugcugauggggaaggaggugggcuucuucaucauccgggccucccagagcucccccggcgacuucagcaucuccguccgccacgaggacgacgugcagcacuucaaggugaugcgggacaacaaggggaacuacuuccucuggacggagaaguuccccagccugaacaagcuggucgacuacuaccgcaccaacuccaucagccggcagaagcagaucuuccuccgcgaccggacccgcgaggaccagggccaccgggggaacucccuggaccgccggagccagggcgggccccaccuguccggcgccgugggcgaggagauccgcccgagcaugaaccggaagcucuccgaccacccgcccacccugccccugcagcagcaccagcaccagccccagccgccccaguacgcgcccgcgccccagcagcuccagcagccgccccagcagcgcuaccugcagcaccaccacuuccaccaggagcggcgcgggggcagccuggacaucaacgacgggcacugcggcacgggccucggguccgagaugaacgccgcccugaugcaccggcgccacaccgaccccgugcagcugcaggccgccggccggguccgcugggcccgggcccucuacgacuucgaggcccuggaggacgacgagcugggguuccacagcggcgaggugguggagguccucgacagcuccaaccccagcugguggaccgggcgccugcacaacaagcugggccucuuccccgcgaacuacguggcccccaugacccgcuga

SEQ ID NO: 30816 - RNA, 654 nt, Artificial Sequence
  derived and/or modified sequence opt1 from GRAP__Homo_sapiens__NP_006604
auggagagcguggcccuguacuccuuccaggccaccgagagcgacgagcucgcguucaacaagggcgacacccugaagauccugaacauggaggacgaccagaacugguacaaggccgagcuccgcggggucgagggcuucauccccaagaacuacauccgggugaagccgcaccccugguacuccgggcgcaucagccggcagcuggccgaggagauccugaugaagcgcaaccaccucggcgccuuccugauccgggaguccgagagcucccccggggaguucagcguguccgucaacuacggcgaccaggugcagcacuucaaggugcugcgcgaggccagcggcaaguacuuccucugggaggagaaguucaacucccugaacgagcuggucgacuucuaccggacgaccaccaucgcgaagaagcgccagaucuuccuccgggacgaggagccccugcucaagagcccgggggccugcuucgcccaggcccaguucgacuucuccgcgcaggaccccagccagcuguccuuccgccggggcgacaucaucgaggugcuggagcgccccgacccccacugguggcgggggcgcagcugcggccgggugggguucuucccgcgcuccuacguccagcccgugcaccuguga

SEQ ID NO: 30817 - RNA, 759 nt, Artificial Sequence
  derived and/or modified sequence opt1 from GRASP__Homo_sapiens__NP_001258785
augacccugcuccccagcaagggcggggacaccaucgccuccgugaacggccugaacgucgaggggauccgccaccgggagaucguggacaucaucaaggccagcggcaacgugcugcgccucgagacgcuguacgggaccuccauccggaaggcggagcuggaggcccgccuccaguaccugaagcagacccuguacgagaaguggggcgaguaccggagccucaugguccaggagcagcgccuggugcacggccugguggucaaggaccccuccaucuacgacacccucgagagcgugcgguccugccuguacggggccggccugcuccccgggagccugcccuucggcccccugcucgccgugccggggcgcccccggggcggcgcccgccgggcgcgcggggacgccgacgacgccgucuaccacacgugcuucuucggcgacuccgagccgcccgcccugcccccgccgccgccgcccgcgcgggccuucgggcccggccccgccgagacccccgccgugggccccgggcccggcccccgcgccgcgcugagccgguccgccagcgugcgcugcgccgggcccggcgggggcggcgggggcggggcccccggcgcccucuggaccgaggcgcgggagcaggcccugugcgggcccggccugcgcaagaccaaguaccgguccuuccgccggcgccuccugaaguucauccccggccugaaccgcagccucgaggaggaggagucccagcuguga

SEQ ID NO: 30818 - RNA, 1647 nt, Artificial Sequence
  derived and/or modified sequence opt1 from GRB10__Homo_sapiens__NP_001001549
auggcccuggccggcugccccgacagcuuccuccaccacccguacuaccaggacaagguggagcagacgccccgcucccagcaggaccccgcggggcccggccugccggcccagagcgaccggcuggccaaccaccaggaggacgacgucgaccucgaggcccuggugaacgacaugaacgccucccuggagagccucuacuccgcgugcagcaugcaguccgacaccgugccccugcugcagaacgggcagcacgcccgcagccagccccgggccuccgggcccccgcgcagcauccagccccaggucagcccccggcagcgcgugcagcggucccagcccgugcacauccucgccguccgccggcugcaggaggaggaccagcaguuccgcaccuccagccugccggcgauccccaaccccuuccccgagcucugcgggccgggcuccccgcccgugcugacccccggcagccugccgcccucccaggccgccgccaagcaggacgugaaggucuucagcgaggacgggaccuccaaggugguggagauccucgccgacaugaccgcgcgggaccugugccagcugcucgucuacaagagccacugcguggacgacaacagcuggacgcugguggagcaccacccccaccugggccucgagcgcugccuggaggaccacgagcuggucguccagguggaguccaccauggccagcgaguccaaguuccucuuccggaagaacuacgccaaguacgaguucuucaagaaccccaugaacuucuuccccgagcagauggugaccuggugccagcagagcaacgggucccagacccagcugcugcaggagccccgccaccuccagcugcuggccgaccucgaggacagcaacaucuucucccugaucgccggccggaagcaguacaacgcgcccacggaccacgggcugugcaucaagcccaacaaggugcgcaacgagaccaaggagcuccggcugcugugcgccgaggacgagcagacccggaccugcuggaugacggccuuccgccuccugaaguacggcaugcugcucuaccagaacuaccgcaucccgcagcagcggaaggcccugcugagccccuucuccacccccgugcgcagcgucuccgagaacagccucguggccauggacuucuccggccagaccgggcgcgugaucgagaacccggcggaggcccagagcgccgcccuggaggagggccacgccuggcggaagcgcuccacccggaugaacauccuggggagccagagcccccuccaccccuccacgcuguccaccgucauccaccgcacccagcacugguuccacggccggaucagccgcgaggagagccaccggaucaucaagcagcagggccugguggacggccucuuccugcugcgcgacucccagagcaaccccaaggcguucguccugacccucugccaccaccagaagaucaagaacuuccagauccugccgugcgaggacgacggccagacguucuucucccuggacgacgggaacaccaaguucagcgaccucauccagcugguggacuucuaccagcugaacaagggcgugcuccccugcaagcugaagcaccacugcauccgggucgcccuguga

SEQ ID NO: 30819 - RNA, 1362 nt, Artificial Sequence
  derived and/or modified sequence opt1 from GRB14__Homo_sapiens__NP_001290351
augagccuguccgcccgccgggugacccuccccgccaucaccccgaucauccugcagaagcgcgucaucaagguguacagcgaggacgagacgucccgggcgcuggacgugcccagcgacaucaccgcccgcgacgucugccagcuccugauccugaagaaccacuacaucgacgaccacuccuggacccucuucgagcaccucccccacaucggcguggagcggaccaucgaggaccacgagcuggugaucgagguccugagcaacugggggaucgaggaggagaacaagcuguacuuccgcaagaacuacgccaaguacgaguucuucaagaaccccauguacuucuucccggagcacaugguguccuucgccacggagaccaacggcgagaucagccccacccagauccugcagauguuccucuccagcuccaccuaccccgagauccacggguuccugcacgccaaggagcagggcaagaaguccuggaagaagaucuacuucuuccugcggcgcagcgggcucuacuucagcacgaagggcaccuccaaggagccccggcaccuccaguucuucagcgaguucggcaacuccgacaucuacgugagccuggcggggaagaagaagcacggcgccccgaccaacuacggguucugcuucaagcccaacaaggccggcgggccccgcgaccugaagaugcugugcgccgaggaggagcagucccggaccugcugggucacggcgauccgccugcucaaguacggcaugcagcuguaccagaacuacaugcaccccuaccagggccggagcgggugcagcucccagagcaucuccccgaugcgcagcaucuccgagaacagccugguggccauggacuucuccggccagaagucccgggugaucgagaaccccaccgaggcccucagcgucgccguggaggaggggcuggccuggcgcaagaagggcugccugcggcucggcacccacgggagccccaccgcguccagccaguccagcgccacgaacauggccauccaccgcucccagcccugguuccaccacaagaucagccgggacgaggcccagcgccugaucauccagcagggccugguggacggggucuuccucgugcgggacucccagagcaacccgaagaccuucgugcuguccaugagccacggccagaagaucaagcacuuccagaucauccccgucgaggacgacggggagauguuccacacccuggacgacggccacacccgcuucacggaccucauccagcugguggaguucuaccagcugaacaagggcgugcuccccugcaagcugaagcacuacugcgcccgcaucgcgcuguga

SEQ ID NO: 30820 - RNA, 654 nt, Artificial Sequence
  derived and/or modified sequence opt1 from GRB2__Homo_sapiens__NP_002077
auggaggccaucgccaaguacgacuucaaggcgaccgccgacgacgagcugagcuucaagcgcggcgacauccucaaggugcugaacgaggagugcgaccagaacugguacaaggccgagcugaacgggaaggacggcuucauccccaagaacuacaucgagaugaagccgcaccccugguucuucgggaagaucccccgggccaaggccgaggagaugcucuccaagcagcgccacgacggcgcguuccugauccgggagagcgaguccgcccccggggacuucagccuguccgucaaguucggcaacgacgugcagcacuucaaggugcuccgcgacggcgccgggaaguacuuccugugggucgugaaguucaacagccugaacgagcucguggacuaccaccgguccaccagcgucucccgcaaccagcagaucuuccugcgggacaucgagcaggucccgcagcagcccacguacgugcaggcccuguucgacuucgacccccaggaggacggcgagcucggguuccgccggggcgacuucauccacgugauggacaacagcgaccccaacugguggaagggggcgugccacggccagaccggcauguucccgcgcaacuacgugacccccgugaaccggaacgucuga

SEQ ID NO: 30821 - RNA, 1668 nt, Artificial Sequence
  derived and/or modified sequence opt1 from GRB7__Homo_sapiens__NP_001229371
augggcaaguggcgccccgggcagggccacaccaccgggagcgugaagccgcugucccggagcgacgccauggagcucgaccuguccccgccccaccugagcuccagccccgaggaccucugccccgcccccggcacgccgcccgggacgccccgcccgcccgacacgccccugcccgaggaggucaagcggucccagccccugcucauccccaccaccggccgcaagcugcgggaggaggagcgccgggcgaccagccugcccuccaucccgaaccccuuccccgagcucugcagcccgcccucccagagccccauccugggcgggcccuccagcgcccgcggccugcucccccgggacgccucccgcccgcacguggugaaggucuacagcgaggacggggccugccgguccguggagguggccgcgggcgccaccgcccgccacgucugcgagaugcuggugcagcgggcccacgcgcugagcgacgagaccugggggcucguggagugccacccccaccuggcccuggagcgcggccucgaggaccacgaguccgucguggaggugcaggccgccuggcccgucggcggggacagccgguucguguuccgcaagaacuucgccaaguacgagcuguucaagagcagcccccacucccuguucccggagaagaugguguccagcugccucgacgcgcacaccggcaucucccacgaggaccugauccagaacuuccugaacgccgggagcuuccccgagauccagggcuuccuccagcugcggggcuccgggcgcaagcuguggaagcgguucuucugcuuccuccgccggagcggccuguacuacuccaccaaggggaccagcaaggacccccgccaccuccaguacgucgccgacgugaacgaguccaacguguacgucgugacccagggccgcaagcuguacgggaugccgacggacuucggcuucugcgugaagcccaacaagcugcggaacggccacaaggggcugcgcaucuucugcagcgaggacgagcagucccggaccugcuggcucgccgccuuccgccuguucaaguacggcguccagcuguacaagaacuaccagcaggcgcagagccggcaccuccaccccuccugccuggggagcccgccccugcgcuccgccagcgacaacacccucguggccauggacuucuccggccacgccgggcgggugaucgagaacccccgcgaggcccugagcgucgcgcuggaggaggcccaggccuggcggaagaagaccaaccaccgccucagccugcccaugcccgccuccggcacgagccuguccgccgcgauccaccggacccagcucugguuccacggccgcaucagccgggaggagucccagcgccugaucgggcagcagggccugguggacggccucuuccugguccgggagagccagcgcaacccgcagggguucgugcugucccugugccaccuccagaaggugaagcacuaccugauccugcccagcgaggaggaggggcggcucuacuucuccauggacgacggccagacccgcuucaccgaccugcugcagcucgucgaguuccaccagcugaaccggggcauccugcccugccuccugcgccacugcugcacgcgcguggcccuguga

SEQ ID NO: 30822 - RNA, 1230 nt, Artificial Sequence
  derived and/or modified sequence opt1 from GREB1__Homo_sapiens__NP_683701
augggcaacagcuacgccgggcagcugaagaccacccgcuucgaggaggugcuccacaacuccaucgaggccagccugcgguccaacaaccuggucccccgcccgaucuucagccagcucuaccuggaggcggagcagcagcuggccgcccucgagggcgggucccggguggacaacgaggaggaggaggaggagggcgagggcgggcuggagacgaacggcccgcccaaccccuuccagcugcacccgcuccccgaggggugcugcaccaccgacggcuucugccaggccgggaaggaccugcgccuggugagcaucuccaacgagcccauggacguccccgccggcuuccuccuggugggggucaagagcccgucccugcccgaccaccuccuggugugcgcgguggacaagcgguuccugcccgacgacaacggccacaacgcccuccugggcuucagcgggaacugcgugggcugcgggaagaagggcuucugcuacuucaccgaguucuccaaccacaucaaccugaagcucacgacccagcccaagaagcagaagcaccugaaguacuaccugguccgcaacgcccagggcacccucaccaaggggccgcugaucugcuggaagggcagcgaguuccggucccgccagauccccgccagcacgugcuccagcucccuguuccccgcgcucgagagcaccgccgccuuccccuccgagccggugcccgggaccaaccccagcauccugaugggcgcccagcaggccgggcccgcgagcgaccacccgucccugaacgccgccaugggccccgccguguucaacggcaaggacagccccaagugccagcagcucgccaagaacaaccugcuggcgcucccccggccguccgcccuggggauccugagcaacuccggcccgcccaagaagcgccacaagggguggagccccgagucccccagcgcccccgacggcgggugcccccagggcggcgggaaccgggccaaguacgaguccgccggcaugagcugcgucccccagguggggcucgugggccccgcguccgucaccuuccccgugguggccagcggggagcccgucuccgugccggacaaccugcugaagaucugcaaggccaagcccgugaucuucaaggucuucgugaacggcgccacgcagaugguggcccucggccccgcggagcccgccagcccgcgcucccuguga

SEQ ID NO: 30823 - RNA, 432 nt, Artificial Sequence
  derived and/or modified sequence opt1 from GREM1__Homo_sapiens__NP_001178252
augagccgcaccgccuacaccgugggcgcccugcuccugcugcucgggacgcugcugcccgcggccgagggcaagaagaaggggucccagggcgccaucccgccgcccgacaaggcccuccacgucaccgagcggaaguaccugaagcgcgacuggugcaagacccagccccugaagcagaccauccacgaggaggggugcaacagccggacgaucaucaaccgcuucugcuacggccagugcaacuccuucuacaucccccggcacauccgcaaggaggagggcagcuuccaguccugcagcuucugcaagcccaagaaguucaccaccaugauggugacccucaacugccccgagcugcagcccccgacgaagaagaagcgggugacccgcgucaagcagugccggugcaucuccaucgaccuggacuga

SEQ ID NO: 30824 - RNA, 561 nt, Artificial Sequence
  derived and/or modified sequence opt1 from GREM2__Homo_sapiens__XP_005273283
augcgcgcccugcgggccgagagcaccuccggcagccgccagacccccugccggauguucuggaagcucucccugagccuguuccucguggcgguccuggugaagguggccgaggcccgcaagaaccggccggccggggccauccccucccccuacaaggacggcagcuccaacaacagcgagcgcuggcagcaccagaucaaggagguccuggcguccagccaggaggcccucguggugacggagcggaaguaccugaaguccgacuggugcaagacccagccccugcgccagaccgucagcgaggaggggugccggucccgcaccauccucaaccgguucugcuacggccagugcaacagcuucuacaucccgcgccacgugaagaaggaggaggaguccuuccagagcugcgccuucugcaagccccagcgggugacguccguccugguggagcuggagugccccgggcucgacccgcccuuccgccugaagaagauccagaaggugaagcagugccggugcaugagcgucaaccuguccgacagcgacaagcaguga

SEQ ID NO: 30825 - RNA, 1857 nt, Artificial Sequence
  derived and/or modified sequence opt1 from GRHL1__Homo_sapiens__NP_937825
augacccaggaguacgacaacaagcgccccgugcugguccuccagaacgaggcccuguacccgcagcggcgcagcuacaccuccgaggacgaggccuggaaguccuuccuggagaacccccucacggcggccaccaaggccaugaugagcaucaacggcgacgaggacagcgccgccgcgcuggggcugcucuacgacuacuacaaggugccccgggagcgccgguccagcaccgccaagcccgagguggagcacccggagcccgaccacuccaagcgcaacagcauccccaucgucaccgagcagccccugaucuccgccggcgagaaccggguccaggugcugaagaacgugccguucaacaucgugcucccccacgggaaccagcugggcaucgacaagcgcgggcaccugacggcccccgacaccaccgugaccgucagcaucgcgacgaugcccacccacuccaucaagaccgagacccagccgcacggcuucgccgugggcaucccgcccgccguguaccaccccgagcccacggagcgggucgugguguucgaccgcaaccucaacaccgaccaguucagcuccggggcccaggcccccaacgcgcagcggcgcacccccgacagcaccuucuccgagacguucaaggagggcguccaggagguguucuuccccagcgaccugucccugcggaugccggggaugaacagcgaggacuacguguucgacuccgucagcggcaacaacuucgaguacacccucgaggccagcaagucccugcgccagaagcccggggacagcaccaugaccuaccugaacaagggccaguucuaccccaucacgcucaaggagguguccagcuccgagggcauccaccaccccaucagcaaggugcgguccgucaucauggugguguucgccgaggacaagagccgcgaggaccagcugcggcacuggaaguacuggcacucccgccagcacaccgccaagcagcggugcaucgacaucgccgacuacaaggagagcuucaacaccaucuccaacaucgaggagaucgcguacaacgccaucagcuucaccugggacaucaacgacgaggccaaggucuucaucuccgugaacugccugagcacggacuucuccagccagaagggggucaagggccucccgcugaacauccagguggacaccuacuccuacaacaaccgcagcaacaagcccgugcaccgggccuacugccagaucaaggucuucugcgacaagggggccgagcgcaagauccgcgacgaggagcggaagcaguccaagcgcaaggugagcgacgugaaggucccccugcuccccagccacaagcggauggacaucaccguguucaagccguucaucgaccuggacacccagcccgugcuguucauccccgacguccacuucgcgaaccuccagcgcggcacgcacgugcugccgaucgccuccgaggagcuggagggcgaggggagcgugcucaagcggggccccuacgggaccgaggacgacuucgccgucccgcccuccaccaagcuggcccgcaucgaggagcccaagcgggugcugcucuacgugcgcaaggagagcgaggaggucuucgacgcccugaugcugaagacccccucccucaagggccugauggaggcgaucagcgacaaguacgacgugccccacgacaagaucgggaagaucuucaagaagugcaagaagggcauccuggugaacauggacgacaacaucgucaagcacuacuccaacgaggacacguuccagcuccagaucgaggaggccggcgggagcuacaagcugacccugaccgagaucuga

SEQ ID NO: 30826 - RNA, 1878 nt, Artificial Sequence
  derived and/or modified sequence opt1 from GRHL2__Homo_sapiens__NP_079191
augagccaggaguccgacaacaacaagcgccugguggcccucguccccaugccgagcgacccgcccuucaacacccggcgcgccuacaccuccgaggacgaggcguggaaguccuaccuggagaacccccugacggccgccaccaaggccaugaugagcaucaacggcgacgaggacagcgccgcggcccucgggcugcuguacgacuacuacaaggugccccgggacaagcgccuccuguccgugagcaaggccuccgacagccaggaggaccaggagaagcggaacugccugggcaccuccgaggcccagagcaaccucuccgggggcgagaaccgcguccaggugcugaagaccgugcccgucaaccugagccucaaccaggaccaccuggagaacuccaagcgggagcaguacagcaucuccuuccccgagagcuccgcgaucauccccgugagcgggaucacgguggucaaggccgaggacuucaccccgguguucauggccccgcccgugcacuacccccgcggcgacggcgaggagcagcgggucgugaucuucgagcagacccaguacgacgugcccagccuggccacccacuccgccuaccucaaggacgaccagcgcagcacgcccgacuccaccuacagcgaguccuucaaggacgcggccaccgagaaguuccggagcgccuccgucggggccgaggaguacauguacgaccagaccagcuccggcacguuccaguacacccuggaggccaccaagagccugcgccagaagcagggggagggccccaugaccuaccucaacaaggggcaguucuacgcgaucacgcuguccgagaccggcgacaacaagugcuuccggcaccccaucagcaaggugcgcuccguggucauggugguguucagcgaggacaagaaccgggacgagcagcugaaguacuggaaguacuggcacucccgccagcacaccgccaagcagcggguccucgacaucgccgacuacaaggagagcuucaacaccaucggcaacaucgaggagaucgccuacaacgccguguccuucacgugggacgugaacgaggaggcgaagaucuucaucaccgucaacugccugagcaccgacuucuccagccagaagggggugaagggccugccgcucaugauccagaucgacaccuacagcuacaacaaccgcuccaacaagcccauccaccgggccuacugccagaucaaggucuucugcgacaagggggccgagcgcaagauccgggacgaggagcgcaagcagaaccgcaagaagggcaagggccaggccagccagacgcagugcaacuccagcuccgacgggaagcuggccgcgaucccccugcagaagaaguccgacaucaccuacuucaagaccaugcccgaccuccacagccagccggugcuguucauccccgacgugcacuucgccaaccugcagcggaccggccaggucuacuacaacacggacgacgagcgcgagggcgggagcgugcucgugaagcggauguuccgccccauggaggaggaguucgggcccgucccguccaagcagaugaaggaggagggcaccaagcgggugcugcuguacgugcgcaaggagaccgacgacgucuucgacgcccucaugcucaagagccccaccgugaagggccugauggaggccaucuccgagaaguacgggcugcccguggagaagaucgcgaagcuguacaagaaguccaagaagggcauccuggucaacauggacgacaacaucaucgagcacuacagcaacgaggacacguucauccucaacauggagagcaugguggagggguucaaggugacccugauggagaucuga

SEQ ID NO: 30827 - RNA, 987 nt, Artificial Sequence
  derived and/or modified sequence opt1 from GRHPR__Homo_sapiens__NP_036335
augcggcccgugcggcugaugaaggucuucgugacccgccggaucccggccgagggccgcguggcccucgcgcgggccgccgacugcgaggucgagcagugggacagcgacgagcccauccccgccaaggagcuggagcgcgggguggccggcgcgcacgggcugcucugccugcuguccgaccacguggacaagcggauccucgacgccgccggcgccaaccugaaggucaucagcaccauguccguggggaucgaccaccuggcgcucgacgagaucaagaagcgcggcauccgggugggcuacacgcccgacguccugaccgacaccaccgccgagcuggccgugagccuccugcugacgaccugccgccggcucccggaggccaucgaggaggugaagaacgggggcuggaccuccuggaagccccuguggcugugcggguacggccucacccagagcacggucgggaucaucggccugggccgcaucgggcaggccaucgcgcggcgccugaagcccuucggcgugcagcgguuccucuacaccgggcgccagccccggccggaggaggccgccgaguuccaggccgaguucguguccacccccgagcuggccgcgcagagcgacuucaucgucguggccugcucccugacccccgccacggagggccucugcaacaaggacuucuuccagaagaugaaggagaccgccguguucaucaacaucagccgcggcgacgucgugaaccaggacgaccuguaccaggcccuggcguccgggaagaucgccgccgccggccucgacgugaccagccccgagccgcugcccaccaaccacccccugcucacgcugaagaacugcgucauccugccccacaucggguccgccacccaccggacccgcaacaccaugagccuccuggcggccaacaaccugcucgccggccugcgcggggagccgaugcccuccgagcugaagcucuga

SEQ ID NO: 30828 - RNA, 2721 nt, Artificial Sequence
  derived and/or modified sequence opt1 from GRIA1__Homo_sapiens__NP_000818
augcagcacaucuucgccuucuucugcaccggcuuccugggggccguggucggcgcgaacuuccccaacaacauccagaucgggggccucuucccgaaccagcagagccaggagcacgccgccuuccgcuucgcccugucccagcugaccgagccgcccaagcuccugccccagaucgacaucgugaacaucagcgacuccuucgagaugacguaccgguucugcagccaguucuccaaggggguguacgccaucuucggcuucuacgagcgccggaccgucaacaugcugaccagcuucugcggcgcgcuccacgugugcuucaucacccccuccuuccccguggacacgagcaaccaguucguccugcagcugcgccccgagcuccaggacgcccugaucuccaucaucgaccacuacaaguggcagaaguucguguacaucuacgacgccgaccgggggcugagcgugcuccagaagguccuggacaccgccgcggagaagaacuggcaggucaccgccgugaacauccugaccacgaccgaggagggcuaccgcaugcuguuccaggaccucgagaagaagaaggagcggcugguggugguggacugcgaguccgagcgccucaacgccauccuggggcagaucaucaagcuggagaagaacggcaucggguaccacuacauccucgccaaccugggcuucauggacaucgaccugaacaaguucaaggagagcggcgccaacgucaccggguuccagcucgugaacuacaccgacacgauccccgcgaagaucaugcagcaguggaagaacuccgacgcccgggaccacacccgcguggacuggaagcggccgaaguacaccagcgcccugaccuacgacggcgucaaggugauggccgaggccuuccagucccugcgccggcagcgcaucgacaucagccggcgcgggaacgcgggcgacugccucgccaaccccgccgugcccuggggccaggggaucgacauccagcgggcccugcagcagguccgcuucgagggccugacggggaacgugcaguucaacgagaagggccggcgcaccaacuacacccuccacgugaucgagaugaagcacgacgggauccggaagaucggcuacuggaacgaggacgacaaguucguccccgccgcgaccgacgcccaggccggcggggacaacuccagcgugcagaaccgcacguacaucgucaccaccauccuggaggacccguacgugaugcugaagaagaacgccaaccaguucgagggcaacgaccgcuacgagggguacugcguggagcucgccgcggagaucgccaagcacgucggcuacuccuaccggcuggagaucgugagcgacgggaaguacggcgcccgcgaccccgacaccaaggccuggaacggcauggugggggagcuggucuacggccgggcggacguggccguggcgccccucacgaucacccugguccgcgaggaggugaucgacuucagcaagcccuucaugucccuggggaucagcaucaugaucaagaagccgcagaaguccaagcccggcguguucagcuuccucgacccccuggccuacgagaucuggaugugcaucgucuucgccuacaucgggguguccgugguccuguuccucgugagccgguucucccccuacgaguggcacagcgaggaguucgaggagggccgcgaccagaccaccuccgaccagagcaacgaguucggcaucuucaacucccugugguucagccugggggccuucaugcagcagggcugcgacaucuccccgcggagccucuccgggcgcaucgugggcggcgucuggugguucuucacgcugaucaucaucagcuccuacaccgccaaccuggccgccuuccucaccguggagcggauggugagccccaucgaguccgccgaggaccuggcgaagcagaccgagaucgccuacgggacgcuggaggccggcagcaccaaggaguucuuccgccggagcaagaucgccgucuucgagaagauguggaccuacaugaaguccgccgagcccagcguguucgugcgcaccacggaggaggggaugauccggguccgcaaguccaagggcaaguacgcguaccugcucgagagcaccaugaacgaguacaucgagcagcggaagcccugcgacaccaugaaggucgggggcaaccuggacuccaagggcuacgggaucgccaccccgaagggcagcgcccugcgcaaccccgugaaccucgccgugcugaagcugaacgagcaggggcuccuggacaagcugaagaacaaguggugguacgacaagggcgagugcggguccggcggcggggacagcaaggacaagaccuccgcgcucagccuguccaacguggccggcguguucuacauccugaucgggggccucgggcuggccaugcuggucgcccucaucgaguucugcuacaagagccgguccgagagcaagcgcaugaagggcuucugccugaucccccagcaguccaucaacgaggccauccggacgagcacccugccccgcaacuccggcgcgggggccagcagcggcggguccggcgagaacgggcgcguggugagccacgacuucccgaaguccaugcagagcauccccugcaugucccacagcuccggcaugccccucggcgccaccgggcuguga

SEQ ID NO: 30829 - RNA, 2652 nt, Artificial Sequence
  derived and/or modified sequence opt1 from GRIA2__Homo_sapiens__NP_000817
augcagaagaucaugcacaucagcgugcugcucucccccguccuguggggccugaucuucggggugagcuccaacagcauccagaucggcggccucuucccgcgcggggccgaccaggaguacuccgccuuccggguggggaugguccaguucagcaccuccgaguuccgccugacgccccacaucgacaaccuggagguggcgaacagcuucgccgugaccaacgccuucugcucccaguucagccggggcgucuacgccaucuucggcuucuacgacaagaaguccgugaacaccaucaccagcuucugcgggacccuccacguguccuucaucacgcccagcuuccccaccgacggcacccacccguucgucauccagaugcgccccgaccugaagggggcccugcucucccugaucgaguacuaccagugggacaaguucgcguaccuguacgacagcgaccggggccucuccacccugcaggccgugcuggacagcgccgccgagaagaaguggcaggucacggcgaucaacguggggaacaucaacaacgacaagaaggacgagauguaccgcucccucuuccaggaccuggagcugaagaaggagcggcgcgugauccucgacugcgagcgggacaaggugaacgacaucgucgaccaggugaucaccaucggcaagcacgugaagggcuaccacuacaucaucgccaaccugggguucaccgacggcgaccugcucaagauccaguucgggggcgccaacgucagcggcuuccagaucguggacuacgacgacagccugguguccaaguucaucgagcgcuggagcacccuggaggagaaggaguaccccggggcccacacgaccaccaucaaguacaccuccgcccucacguacgacgcgguccaggugaugaccgaggccuuccggaaccugcgcaagcagcggaucgagaucagccgccggggcaacgccggggacugccuggccaaccccgccgugccguggggccagggggucgagaucgagcgcgcgcucaagcagguccagguggagggccuguccggcaacaucaaguucgaccagaacgggaagcggaucaacuacaccaucaacaucauggagcugaagaccaacggcccccgcaagaucggguacuggagcgagguggacaagaugguggucacgcucaccgagcugcccuccggcaacgacaccagcgggcuggagaacaagaccgugguggucacgaccauccucgagucccccuacgugaugaugaagaagaaccacgagaugcuggagggcaacgagcgguacgagggcuacugcguggaccuggccgccgagaucgccaagcacugcggguucaaguacaagcucaccaucgucggcgacgggaaguacggcgcccgcgacgcggacaccaagaucuggaacgggauggugggcgagcugguguacggcaaggccgacaucgccaucgccccgcugacgaucacccucguccgggaggaggugaucgacuucagcaagcccuucaugucccuggggaucagcaucaugaucaagaagccccagaaguccaagcccggcguguucagcuuccuggacccgcucgccuacgagaucuggaugugcaucgucuucgcguacaucgggguguccgugguccuguuccuggugagccgcuucucccccuacgaguggcacaccgaggaguucgaggacggccgcgagacccagagcuccgagagcacgaacgaguucggcaucuucaacagccucugguucucccugggggccuucaugcggcagggcugcgacaucagcccccgcucccugagcgggcggaucgugggcggggucuggugguucuucacccucaucaucaucuccagcuacaccgccaaccuggccgcguuccugaccguggagcgcauggugucccccaucgagagcgccgaggaccuguccaagcagacggagaucgccuacggcacccucgacagcggcuccaccaaggaguucuuccggcgcagcaagaucgccgucuucgacaagauguggaccuacaugcgguccgccgagccgagcguguucgugcgcaccacggcggagggggucgcccgggugcgcaaguccaagggcaaguacgccuaccugcuggagagcaccaugaacgaguacaucgagcagcggaagcccugcgacaccaugaaggucgggggcaaccucgacuccaagggguacggcaucgccacccccaagggcagcagccugcgcacgcccgugaaccuggccgugcucaagcuguccgagcagggggugcuggacaagcucaagaacaaguggugguacgacaagggcgagugcggggcgaaggacagcggcuccaaggagaagaccagcgcccugucccugagcaacgucgccgggguguucuacauccucgugggcggccuggggcuggccaugcucgucgcccugaucgaguucugcuacaagucccgggcggaggccaagcgcaugaagguggccaagaacgcccagaacaucaacccgagcuccagccagaacucccagaacuucgcgaccuacaaggagggcuacaacguguacgggaucgagagcgucaagaucuga

SEQ ID NO: 30830 - RNA, 2685 nt, Artificial Sequence
  derived and/or modified sequence opt1 from GRIA3__Homo_sapiens__NP_000819
auggcccgccagaagaagaugggccagagcgugcugcgggccgucuucuuccucgugcuggggcugcucggccacucccacgggggcuuccccaacaccaucagcaucgggggccuguucaugcgcaacaccgugcaggagcacuccgcguuccgguucgccguccagcuguacaacacgaaccagaacaccaccgagaagccguuccaccucaacuaccacguggaccaccuggacagcuccaacagcuucuccgugaccaacgccuucugcagccaguucucccgcggcgucuacgccaucuucggguucuacgaccagaugagcaugaacacgcugaccuccuucugcggcgcccuccacaccagcuucgugacccccuccuuccccacggacgcggacgugcaguucgucauccagaugcggcccgcccugaagggggccauccugagccuccugggccacuacaagugggagaaguucguguaccuguacgacaccgagcgcggguucuccauccuccaggccaucauggaggcggccgugcagaacaacuggcaggucaccgcccggagcgugggcaacaucaaggacgugcaggaguuccgccggaucaucgaggagauggaccgccggcaggagaagcgcuaccugaucgacugcgaggucgagcggaucaacaccauccuggagcaggucgugauccucggcaagcacucccgcggguaccacuacaugcuggccaaccugggcuucacggacauccuccuggagcgggugaugcacgggggcgccaacaucaccggcuuccagaucgugaacaacgagaacccgauggugcagcaguucauccagcgcuggguccggcuggacgagcgcgaguuccccgaggcgaagaacgcgccccucaaguacaccagcgcccugacccacgacgccauccuggugaucgccgaggccuuccgguaccuccgccggcagcgcguggacgucucccgccgggggagcgccggcgacugccuggccaaccccgccgugccguggagccaggggaucgacaucgagcgcgcccugaagaugguccaggugcagggcaugacggggaacauccaguucgacaccuacggccggcgcaccaacuacaccaucgacguguacgagaugaaggucuccggcagccggaaggcgggguacuggaacgaguacgagcgcuucgugcccuucuccgaccagcagaucagcaacgacuccgccagcuccgagaaccggacgaucguggucaccaccauccucgagagccccuacgugauguacaagaagaaccacgagcagcuggagggcaacgagcgcuacgagggguacugcguggaccuggccuacgagaucgccaagcacguccggaucaaguacaagcucuccaucgugggcgacgggaaguacggcgcccgcgaccccgagaccaagaucuggaacggcauggugggggagcuggucuacggccgggcggacaucgccguggccccgcugacgaucacccucgugcgcgaggaggucaucgacuucagcaagcccuucaugucccuggggaucagcaucaugaucaagaagccccagaaguccaagcccggcguguucagcuuccuggacccgcucgccuacgagaucuggaugugcaucguguucgcguacaucggggucuccguggugcuguuccuggucagccgguucucccccuacgaguggcaccucgaggacaacaacgaggagccccgcgacccccagagcccgcccgacccgcccaacgaguucggcaucuucaacucccugugguucagccugggcgccuucaugcagcaggggugcgacaucagcccccggucccucagcggccgcaucgucgggggcguguggugguucuucacccugaucaucaucuccagcuacaccgccaaccuggccgccuuccucacgguggagcggauggugucccccaucgagagcgcggaggaccuggccaagcagaccgagaucgccuacggcacccuggacuccgggagcaccaaggaguucuuccgccgguccaagaucgccguguacgagaagauguggagcuacaugaaguccgccgagcccagcgucuucacgaagaccaccgcggacggcguggcccgcgugcgcaaguccaaggggaaguucgccuuccugcucgagagcaccaugaacgaguacaucgagcagcggaagcccugcgacacgaugaaggucggcgggaaccuggacuccaagggcuacggcguggccaccccgaaggggagcgcccugggcaacgcggugaaccucgccguccugaagcugaacgagcaggggcuccuggacaagcugaagaacaaguggugguacgacaagggcgagugcggguccggcggcggggacagcaaggacaagaccagcgcccucucccugagcaacguggccggcguguucuacauccuggucgggggccucgggcuggcgaugaugguggcccugaucgaguucugcuacaagucccgcgccgagagcaagcggaugaagcucaccaagaacacccagaacuucaagcccgcccccgccacgaacacccagaacuacgcgaccuaccgcgagggcuacaacguguacggcaccgaguccgucaagaucuga

SEQ ID NO: 30831 - RNA, 2655 nt, Artificial Sequence
  derived and/or modified sequence opt1 from GRIA4__Homo_sapiens__NP_001070711
augcgcaucaucagccggcagaucgugcuccuguucuccggcuucugggggcuggccaugggcgccuuccccagcuccguccagaucgggggccuguucauccgcaacaccgaccaggaguacaccgcguuccggcucgccaucuuccugcacaacacgagcccgaacgccuccgaggcccccuucaaccuggugccccacguggacaacaucgagaccgccaacagcuucgcggucaccaacgccuucugcucccaguacagccgcgggguguucgccaucuucggccucuacgacaagcgguccgugcacacccugacgagcuucugcuccgcccugcacaucagccucaucacccccuccuucccgaccgagggcgagagccaguucguccugcagcugcgccccucccuccgcggggcgcugcugagccuccuggaccacuacgaguggaacugcuucguguuccuguacgacaccgaccggggcuacuccauccuccaggccaucauggagaaggccgggcagaacggcuggcacgugagcgccaucugcgucgagaacuucaacgacguguccuaccggcagcugcuggaggagcucgaccgccggcaggagaagaaguucgugaucgacugcgagaucgagcgccugcagaacauccuggagcagaucgucagcguggggaagcacgugaagggcuaccacuacaucaucgccaaccucggcuucaaggacaucagccuggagcgguucauccacgggggcgcgaacgucacgggguuccagcugguggacuucaacacccccauggugaucaagcucauggaccgcuggaagaagcuggaccagcgggaguaccccggcuccgagaccccgcccaaguacaccagcgcccugacguacgacggcguccucgugauggccgagaccuuccgcucccugcggcgccagaagaucgacaucagccggcgcgggaacgccggcgacugccuggccaaccccgcggcccccugggggcagggcaucgacauggagcggacccucaagcagguccgcauccaggggcugaccggcaacgugcaguucgaccacuacggccgccgggugaacuacacgauggacguguucgagcugaaguccaccgggccgcgcaaggucggcuacuggaacgacauggacaagcucgugcugauccaggacguccccacccuggggaacgacaccgccgccaucgagaaccggacggugguggucaccaccaucauggagagccccuacgugauguacaagaagaaccacgagauguucgagggcaacgacaaguacgagggguacugcguggaccucgccuccgagaucgcgaagcacaucggcaucaaguacaagaucgccaucguccccgacggcaaguacggggcccgcgacgccgacaccaagaucuggaacggcauggugggggagcugguguacggcaaggccgagaucgcgaucgccccgcugacgaucacccucguccgggaggaggugaucgacuucagcaagcccuucaugucccuggggaucagcaucaugaucaagaagccccagaaguccaagcccggcguguucagcuuccuggacccgcucgccuacgagaucuggaugugcaucgucuucgccuacaucggcguguccgugguccuguuccuggugagccgcuucucccccuacgaguggcacaccgaggagcccgaggacgggaaggagggccccagcgaccagccgcccaacgaguucgggaucuucaacucccucugguucagccugggcgcguucaugcagcagggcugcgacaucagcccccggagccugagcgggcgcaucgugggcggggucuggugguucuucacccugaucaucaucuccagcuacacggccaaccucgccgccuuccugaccguggagcggauggugucccccaucgagagcgccgaggaccuggcgaagcagaccgagaucgccuacggcacccucgacuccgggagcacgaaggaguucuuccgccgguccaagaucgccgucuacgagaagauguggaccuacaugcgcagcgccgagccguccguguucacccggaccacggccgagggcguggcgcgcguccggaaguccaagggcaaguucgccuuccugcuggaguccaccaugaacgaguacaucgagcagcgcaagcccugcgacaccaugaaggucgggggcaaccucgacagcaagggguacggcguggccacccccaagggguccagccugggcaacgccgugaaccuggccgugcucaagcugaacgagcagggccugcucgacaagcugaagaacaaguggugguacgacaagggggagugcggcuccgggggcggggacagcaaggacaagaccuccgcgcugagccucagcaacguggccggcgucuucuacauccuggugggcgggcugggccucgccaugcugguggcccugaucgaguucugcuacaagucccgggcggaggccaagcgcaugaaggucgccaagagcgcccagacguucaacccgaccuccagccagaacacccagaaccucgccaccuaccgggagggguacaacguguacggcacggaguccaucaagaucuga

SEQ ID NO: 30832 - RNA, 3030 nt, Artificial Sequence
  derived and/or modified sequence opt1 from GRID1__Homo_sapiens__NP_060021
auggaggcccugacccucuggcugcugcccuggaucugccagugcgugagcguccgcgccgacuccaucauccacaucggcgcgaucuucgaggagaacgccgccaaggacgaccggguguuccagcucgccgugagcgaccugucccugaacgacgacauccuccagagcgagaagaucaccuacuccaucaaggucaucgaggccaacaacccguuccaggcggugcaggaggccugcgaccugaugacgcaggggauccuggcccucgugaccagcaccggcugcgccuccgcgaacgcccugcagagccugaccgacgccaugcacaucccccaccucuucguccagcgcaaccccgggggcagcccccggacggccugccaccugaacccgucccccgacggggaggccuacacccuggcgucccgcccgcccgugcggcucaacgacgugaugcugcgccuggucaccgagcuccgguggcagaaguucgugauguucuacgacagcgaguacgacauccgcggccugcaguccuuccuggaccaggccagccggcucggccuggacgugucccugcagaaggucgacaagaacaucagccacguguucaccucccucuucacgaccaugaagaccgaggagcugaaccgcuaccgggacacccugcgccgggccauccuccugcugagcccccagggggcccacuccuucaucaacgaggccguggagacgaaccucgcgagcaaggacagccacugggucuucgugaacgaggagaucuccgaccccgagauccuggaccuggugcacagcgcccucggccgcaugaccgucgugcggcagaucuuccccuccgccaaggacaaccagaagugcacccgcaacaaccaccggaucagcucccugcugugcgacccccaggagggguaccuccagaugcugcagaucagcaaccuguaccucuacgacuccgugcugaugcuggccaacgccuuccaccgcaagcucgaggaccggaaguggcacagcauggcgucccugaacugcauccgcaagagcaccaagccguggaacggcgggcgguccaugcuggacacgaucaagaagggccacaucaccggccucaccggggucauggaguuccgcgaggacagcuccaaccccuacgugcaguucgagauccugggcaccacguacagcgagaccuucgggaaggacaugcgcaagcuggccaccugggacuccgagaagggccucaacggcagccugcaggagcggcccauggggucccgccugcagggccugacccucaagguggucacggugcuggaggagcccuucgucaugguggccgagaacauccuggggcagccgaagcgguacaagggcuucagcaucgacgugcucgacgcccuggccaaggcgcugggguucaaguacgagaucuaccaggcccccgacggccgcuacggccaccagcuccacaacaccuccuggaacgggaugaucggcgagcugaucagcaagcgggccgaccuggccaucagcgcgaucaccaucacccccgagcgcgaguccgucguggacuucagcaagcgguacauggacuacuccguggggauccucaucaagaagcccgaggagaagaucagcaucuucucccuguucgccccguucgacuucgccgucugggccugcaucgccgcggccauccccguggugggcguccugaucuucgugcucaaccgcauccaggccgugcgggcccagagcgccgcgcagccccgccccuccgccagcgccacgcugcacuccgccaucuggaucgucuacggggccuucgugcagcagggcggcgagagcuccgugaacagcauggcgaugcggaucgucaugggguccugguggcuguucacccucaucgugugcagcuccuacaccgccaaccuggccgccuuccugaccgugagccgcauggacaacccgauccggacguuccaggaccucuccaagcaggucgagaugagcuacggcaccgugcgcgacagcgcgguguacgaguacuuccgggccaaggggaccaacccccuggagcaggacuccaccuucgccgagcuguggcgcacgaucagcaagaacggcggggccgacaacugcgucuccagccccuccgagggcauccggaaggccaagaagggcaacuacgcguuccucugggacguggccguggucgaguacgccgcccugaccgacgacgacugcagcgugaccgugaucgggaacuccaucagcuccaagggcuacgggaucgcccugcagcacggcagccccuaccgcgaccucuucucccagcggauccuggagcugcaggacaccggcgaccucgacguccugaagcagaagugguggccgcacauggggcgcugcgaccugaccagccacgcguccgcccaggccgacggcaagagccucaagcugcacuccuucgccgggguguucugcauccuggccaucggccuccugcuggcgugccucguggccgcccuggagcugugguggaacagcaaccgcugccaccaggagacgcccaaggaggacaaggaggucaaccucgagcagguccaccggcgcaugaacucccugauggacgaggacaucgcccacaagcagaucagccccgcguccaucgagcugagcgcccucgagaugggcgggcuggccccgacccagacccuggagcccacccgggaguaccagaacacgcagcucagcguguccaccuuccugcccgagcagagcucccacggcaccagccgcacccuguccagcgggcccuccagcaaccucccgcugccccuguccagcuccgccacgaugcccagcaugcagugcaagcaccggucccccaacggcgggcuguuccgccagagcccggugaagacccccauccccauguccuuccagcccgugccgggcggggugcuccccgaggcccuggacaccagccacggcaccuccaucuga

SEQ ID NO: 30833 - RNA, 2739 nt, Artificial Sequence
  derived and/or modified sequence opt1 from GRID2__Homo_sapiens__NP_001273767
auggagguguuccccuuccugcucguccugagcgugugguggucccgcaccugggacagcgccaacgccgacuccaucauccacaucggcgcgaucuucgacgagagcgccaagaaggacgacgagguguuccggaccgccgucggggaccugaaccagaacgaggagauccuccagacggagaagaucaccuucuccgugaccuucguggacggcaacaacccguuccaggccguccaggaggacauccgcgggauccaggaguuccuggacaaggugagccagcagggcauggacguggcccugcagaaggucgagaacaacaucaacaagaugaucaccacccucuucgacaccaugcggaucgaggagcugaaccgcuaccgggacacccugcgccgggcgauccucgugaugaaccccgccaccgccaaguccuucaucacggagguggucgagaccaaccugguggccuucgacugccacuggaucaucaucaacgaggagaucaacgacguggacguccaggagcuggugcgccggagcaucgggcgccucaccaucauccggcagaccuuccccgugccccagaacaucucccagcgcugcuuccggggcaaccaccgcaucagcuccacgcugugcgacccgaaggaccccuucgcgcagaacauggagaucagcaaccuguacaucuacgacaccguccuccugcuggccaacgccuuccacaagaagcucgaggaccggaaguggcacuccauggccagccuguccugcauccgcaagaacagcaagcccuggcagggcgggcgguccaugcuggagaccaucaagaagggcggggugagcggccucaccggggagcuggaguucggcgagaacggcgggaaccccaacgugcacuucgagauccugggcacgaacuacggggaggagcucggccgcggcguccggaagcuggggugcuggaacccggugaccggccugaacgggucccucaccgacaagaagcuggagaacaacaugcgcggcgugguccugcggguggucaccgugcucgaggagcccuucgugauggucagcgagaacgugcuggggaagcccaagaaguaccagggcuucagcaucgacgugcuggacgcccucuccaacuaccugggcuucaacuacgagaucuacgucgcgcccgaccacaaguacgggagcccgcaggaggacggcacguggaacgggcuggugggcgagcucguguucaagcgcgccgacaucgggaucuccgcccugaccaucacccccgaccgcgagaacgucguggacuucaccacgcgguacauggacuacagcgugggcguccugcuccgccgggccgagaagaccguggacauguucgccugccuggcgcccuucgaccugucccucugggccugcaucgccggcaccgugcugcuggucgggcuccugguguaccugcucaacuggcugaacccgccccgccugcagaugggcagcaugaccuccacgacccuguacaacagcaugugguucguguacggguccuucguccagcagggcggggaggugcccuacaccacccucgccacgcggaugaugaugggcgccugguggcuguucgcgcugaucgugaucagcuccuacaccgccaaccucgccgccuuccugaccaucacccgcaucgagagcuccauccagagccugcaggaccucuccaagcagacggagauccccuacggcaccguccuggacagcgccguguacgagcacgugcggaugaaggggcugaaccccuucgagcgcgacuccauguacagccagauguggcggaugaucaaccgcuccaacggcagcgagaacaacguccucgagagccaggcggggauccagaaggugaaguacggcaacuacgccuucgugugggacgccgccguccuggaguacguggcgaucaacgacccggacugcuccuucuacaccaucggcaacaccguggccgaccggggguacggcaucgcccugcagcacgggagccccuaccgcgacgucuucucccagcggauccucgagcugcagcagaacggcgacauggacauccugaagcacaagugguggcccaagaacgggcagugcgaccucuacagcuccguggacaccaagcagaagggcggcgcccuggacaucaagagcuucgccgggguguucugcauccuggcggccggcaucguccucuccugcuucaucgccaugcuggagacgugguggaacaagcgcaaggggagccgggugcccuccaaggaggacgacaaggagaucgaccuggagcaccuccaccgccgggugaacagccugugcaccgacgacgacuccccgcacaagcaguucagcaccuccagcaucgaccugacgccccucgacaucgacacgcugcccacccgccaggcccuggagcagaucuccgacuuccggaacacccacaucaccacgaccaccuucauccccgagcagauccagacccucagccgcacgcuguccgccaaggcggccagcggcuucaccuucgggaacgucccggagcaccgcaccggccccuuccggcaccgcgcccccaacggcggguucuuccggagcccgaucaagaccauguccagcauccccuaccagcccacgcccacccugggccucaaccuggggaacgacccggaccgcggcaccuccaucuga

SEQ ID NO: 30834 - RNA, 2757 nt, Artificial Sequence
  derived and/or modified sequence opt1 from GRIK1__Homo_sapiens__NP_000821
auggagcacggcacccugcucgcccagcccgggcuguggacccgcgacacgagcugggcccugcucuacuuccugugcuacauccugccgcagaccgcgccccaggugcuccggaucggcgggaucuucgagaccgucgagaacgagcccgugaacguggaggagcuggccuucaaguucgccgucaccuccaucaaccgcaaccggacgcugaugcccaacaccacccucaccuacgacauccagcgcaucaaccuguucgacagcuucgaggccucccggcgcgccugcgaccagcuggcgcucggcguggccgcccuguucgggccgagccacuccagcuccgugagcgccguccaguccaucugcaacgcgcuggaggugccccacauccagacgcgguggaagcaccccagcguggacaacaaggaccucuucuacaucaaccuguaccccgacuacgccgccaucucccgcgccauccuggaccucguccuguacuacaacuggaagaccgugaccguggucuacgaggacagcaccggccugauccggcuccaggagcugaucaaggccccgucccgcuacaacaucaagaucaagauccggcagcugcccagcggcaacaaggacgcgaagccccuccugaaggagaugaagaaggggaaggaguucuacgugaucuucgacugcucccacgagacggccgccgagauccugaagcagauccucuucaugggcaugaugaccgaguacuaccacuacuucuucaccacccuggaccuguucgcccucgaccuggagcuguaccgcuacagcggggugaacaugacgggcuuccggcuccugaacaucgacaacccccacgucuccagcaucaucgagaagugguccauggagcgccugcaggccccgccccggcccgagaccgggcuccuggacggcaugaugaccaccgaggcggcccugauguacgacgccguguacaugguggccaucgccagccaccgcgcgagccagcucacggucuccagccugcagugccaccggcacaagcccuggcgccugggcccgcgguucaugaaccucaucaaggaggcccgcugggacgggcugaccggccacaucaccuucaacaagaccaacgggcugcggaaggacuucgaccucgacaucaucucccugaaggaggagggcacggagaaggccgccggcgaggugagcaagcaccuguacaagguguggaagaagaucgggaucuggaacuccaacagcggccucaacaugaccgacuccaacaaggacaagagcuccaacaucaccgacagccuggccaaccgcacccugaucgucacgaccauccuggaggagcccuacgugauguaccgcaaguccgacaagccccucuacgggaacgaccgguucgagggcuacugccuggaccugcucaaggagcugagcaacauccugggguucaucuacgacgugaagcucguccccgacggcaaguacggcgcgcagaacgacaagggggaguggaacggcauggugaaggagcugaucgaccaccgcgccgaccuggccgucgccccgcucaccaucaccuacgugcgggagaaggugaucgacuucuccaagcccuucaugacgcuggggaucagcauccuguaccgcaagcccaacggcaccaaccccggggucuucuccuuccucaacccgcugagccccgacaucuggauguacgugcugcucgcgugccugggcguguccugcguccuguucgugaucgcccgguucacccccuacgagugguacaacccccacccgugcaaccccgacagcgacguggucgagaacaacuucacccuccugaacuccuucugguucggcgugggggcccugaugcagcagggcagcgagcucaugcccaaggcccugagcacgcgcaucgucgggggcaucuggugguucuucacccugaucaucaucuccagcuacaccgccaaccucgcggccuuccugaccguggagcggauggaguccccgaucgacagcgccgacgaccuggccaagcagaccaagaucgaguacggggccgugcgcgacggcuccacgaugaccuucuucaagaaguccaagaucagcaccuacgagaagaugugggcguucaugagcucccggcagcagaccgcccucgugcgcaacagcgacgagggcauccagcggguccugacgaccgacuacgcccugcucauggaguccaccagcaucgaguacgugacccagcgcaacugcaaccugacgcagaucgggggccugaucgacuccaagggguacggcgugggcacccccaucgggagccccuaccgggacaagaucaccaucgccauccuccagcugcaggaggagggcaagcugcacaugaugaaggagaagugguggcgcgggaacggcugccccgaggaggacaacaaggaggccuccgcgcucggggucgagaacaucggcggcaucuucaucgugcuggccgccgggcuggugcucagcgucuucguggccaucggcgaguucaucuacaagucccggaagaacaacgacaucgagcaggcguucugcuucuucuacgggcugcagugcaagcagacccacccgacgaacagcaccagcggcaccacccuguccacggaccucgagugcgggaagcugauccgcgaggagcggggcauccgcaagcagagcuccgugcacaccgucuga

SEQ ID NO: 30835 - RNA, 2727 nt, Artificial Sequence
  derived and/or modified sequence opt1 from GRIK2__Homo_sapiens__XP_005267002
augaagaucaucuuccccauccugagcaacccgguguuccgccggaccgucaagcuccugcugugccuccuguggaucggcuacucccaggggaccacgcacgugcugcgcuucggcgggaucuucgaguacguggagagcggccccaugggggccgaggagcucgccuuccgguucgcggucaacaccaucaaccgcaaccggacccugcugcccaacaccacgcucaccuacgacacccagaagaucaaccuguacgacuccuucgaggccagcaagaaggccugcgaccagcugucccucggcguggccgccaucuucggccccagccacuccagcuccgcgaacgccgugcagagcaucugcaacgcccugggggucccgcacauccagacccgcuggaagcaccagguguccgacaacaaggacagcuucuacgugucccuguaccccgacuucagcucccucagccgggccauccuggaccugguccaguucuucaaguggaagacggugaccguggucuacgacgacuccaccggccucauccgccugcaggagcugaucaaggcgcccagccgguacaaccuccgccugaagauccggcagcugcccgccgacaccaaggacgccaagccgcuccugaaggagaugaagcgcgggaaggaguuccacgugaucuucgacugcucccacgagauggccgccggcauccugaagcaggcgcucgccauggggaugaugacggaguacuaccacuacaucuucaccacccuggaccuguucgcccucgacguggagcccuaccgguacagcggcgucaacaugaccggcuuccgcauccugaacacggagaacacccaggugagcuccaucaucgagaaguggagcauggagcggcugcaggccccgcccaagcccgacuccgggcuccuggacggcuucaugaccaccgacgccgcgcugauguacgacgccgugcacgucgugagcguggccguccagcaguucccccagaugacgguguccagccuccagugcaaccgccacaagcccuggcgguucgggacccgcuucaugucccugaucaaggaggcccacugggagggccugaccggccggaucaccuucaacaagacgaacgggcuccgcaccgacuucgaccuggacgugaucagccugaaggaggagggccucgagaagaucgggaccugggaccccgccuccggccugaacaugaccgagagccagaaggggaagccggcgaacaucacggacucccugagcaaccggucccucaucgucaccaccauccuggaggagcccuacgugcuguucaagaaguccgacaagccccucuacggcaacgaccgcuucgagggcuacugcaucgaccugcugcgcgagcugagcaccauccucggguucacguacgagauccggcuggucgaggacggcaaguacggggcccaggacgacgccaacggccaguggaacgggauggugcgcgagcugaucgaccacaaggccgaccucgccguggcgccccuggccaucaccuacguccgggagaaggugaucgacuucagcaagccguucaugacccugggcaucuccauccucuaccgcaagcccaacggcaccaaccccgggguguucagcuuccugaacccccuguccccggacaucuggauguacauccuccuggccuaccugggcgucagcugcguccucuucgugaucgcccgguucagccccuacgagugguacaacccccaccccugcaacccggacuccgacgugguggagaacaacuucacgcugcugaacagcuucugguucggggugggcgcgcucaugcagcagggguccgagcugaugcccaaggcccugagcacccgcaucgucggcggcaucuggugguucuucacccucaucaucaucuccagcuacaccgccaaccuggccgccuuccugaccguggagcggauggagucccccaucgacagcgcggacgaccucgccaagcagacgaagaucgaguacggggccguggaggacggcgccaccaugaccuucuucaagaaguccaagaucagcaccuacgacaagaugugggccuucauguccagccgccggcaguccguccuggucaagagcaacgaggaggggauccagcgcgugcugacguccgacuacgcguuccucauggagagcaccaccaucgaguucgugacccagcggaacugcaaccugacgcagaucggcggccugaucgacuccaagggguacggcguggggaccccgaugggcagccccuaccgcgacaagaucaccaucgccauccuccagcugcaggaggaggggaagcugcacaugaugaaggagaagugguggcggggcaacggcugccccgaggaggagagcaaggaggccuccgcccucggggugcagaacaucggcgggaucuucaucguccuggccgcgggccuggugcucagcguguucgucgccgugggggaguuccuguacaaguccaagaagaacgcccagcuggagaagcgcagcuucugcuccgccaugguggaggagcuccggaugagccugaagugccagcgccggcugaagcacaagccccaggcgccggucaucgugaagaccgaggaggugaucaacaugcacacguucaacgaccgccggcuccccggcaaggagaccauggccuga

SEQ ID NO: 30836 - RNA, 2871 nt, Artificial Sequence
  derived and/or modified sequence opt1 from GRIK4__Homo_sapiens__NP_001269399
augccccgcgugagcgccccgcugguccuccugcccgccuggcuggugaugguggcgugcagcccccacucccuccggaucgccgccauccuggacgaccccauggagugcucccgcggcgagcggcugagcaucacccucgccaagaaccgcaucaaccgggccccggagcgccuggggaaggcgaaggucgagguggacaucuucgagcugcuccgggacuccgaguacgagaccgccgagacgaugugccagauccugcccaagggcguggucgccgugcuggggcccagcuccagccccgccuccagcuccaucaucagcaacaucugcggcgagaaggaggugccgcacuucaaggucgcgcccgaggaguucgugaaguuccaguuccagcgcuucaccacccucaaccugcaccccuccaacaccgacaucagcguggccgucgccgggauccugaacuucuucaacugcacgaccgccugccucaucugcgccaaggcggagugccugcugaaccucgagaagcugcugcggcaguuccucaucuccaaggacacccugagcgugcgcaugcuggacgacacccgggaccccacgccgcuccugaaggagauccgcgacgacaagaccgccaccaucaucauccacgccaacgccuccaugagccacaccauccugcucaaggccgcggagcugggcaugguguccgccuacuacacguacaucuucaccaaccuggaguucagccuccagcggauggacagccuggucgacgaccgcgugaacauccugggcuucuccaucuucaaccagagccacgccuucuuccaggaguucgcccagucccucaaccagagcuggcaggagaacugcgaccacgugcccuucaccgggcccgcccuguccagcgcgcuccuguucgacgccgucuacgccguggugaccgccguccaggagcugaaccggucccaggagaucggcgugaagccccugagcugcggguccgcccagaucuggcagcacggcacgagccucaugaacuaccugcgcaugguggagcuggaggggcucaccggccacaucgaguucaacuccaagggccagcggagcaacuacgcgcugaagauccugcaguucacccgcaacggguuccggcagaucggccaguggcacgucgccgaggggcucuccauggacagccaccuguacgccuccaacaucagcgacacccuguucaacacgacccucguggucaccaccauccuggagaacccguaccugaugcugaagggcaaccaccaggagauggagggcaacgaccgcuacgagggguucugcguggacaugcucaaggagcuggccgagauccugcgguucaacuacaagauccgccucgugggcgacggggucuacggcgugcccgaggcgaacgggacguggaccggcauggugggcgagcugaucgcccgcaaggccgaccuggccgucgccgggcucaccaucaccgcggagcgggagaaggugaucgacuucuccaagcccuucaugacgcugggcaucagcauccuguaccgcgugcacauggggcggaagcccggcuacuucuccuuccucgacccguucagccccggggucuggcuguucaugcugcucgccuaccuggccgugagcugcgugcuguuccucgucgcccgccugacccccuacgagugguacagcccccacccgugcgcccagggccggugcaaccugcucgugaaccaguacucccugggcaacucccugugguuccccgucgggggcuucaugcagcaggggagcaccaucgcgccccgcgcccucuccacccggugcgugagcggcguguggugggccuucacgcugaucaucaucuccagcuacaccgccaaccuggccgcguuccucaccgugcagcgcauggacguccccaucgaguccguggacgaccuggccgaccagaccgccaucgaguacgggacgauccacggcggcagcuccaugaccuucuuccagaacagccgguaccagaccuaccagcgcauguggaacuacauguacuccaagcagccgagcguguucgucaaguccaccgaggaggggaucgcccgggugcugaacagcaacuacgcguuccuccuggaguccaccaugaacgaguacuaccgccagcggaacugcaaccugacgcagaucggcgggcuccuggacaccaagggcuacggcaucgggaugcccgugggcagcgucuuccgcgacgaguucgaccuggccauccuccagcugcaggagaacaaccggcuggagauccucaagcgcaaguggugggagggcgggaagugccccaaggaggaggaccaccgggccaaggggcugggcauggagaacaucggcgggaucuucguggugcugaucugcggccucaucgucgccaucuucauggccaugcuggaguuccuguggacccuccgccacagcgaggcgaccgagguguccgugugccaggagauggucacggagcugcggagcaucauccugugccaggacuccauccacccgcgccgccggcgcgccgccgugcccccgccccggccgcccauccccgaggagcgccggccccgcgggaccgccacccucagcaacggcaagcugugcggggccggcgagcccgaccagcuggcgcagcggcucgcccaggaggccgcccugguggcccgcggcugcacccacauccgggucugccccgagugccgccgguuccaggggcugcgcgcgcggcccucccccgcccgcagcgaggagucccucgagugggagaagacgaccaacagcuccgagccggaguga

SEQ ID NO: 30837 - RNA, 2946 nt, Artificial Sequence
  derived and/or modified sequence opt1 from GRIK5__Homo_sapiens__NP_001287959
augcccgccgagcugcuccugcugcucaucguggccuucgcgagccccuccugccagguccugagcucccugcgcauggccgccauccucgacgaccagaccgugugcggccgcggggagcggcuggcccuggcccucgcgcgggagcagaucaacggcaucaucgaggugcccgccaaggcccgcgucgagguggacaucuucgagcugcagcgggacagccaguacgagaccacggacaccaugugccagauccugcccaaggggguggucuccgugcucggccccagcuccagcccggccuccgcgagcaccgugucccacaucugcggggagaaggagaucccccacaucaaggucggccccgaggagacgccccgccugcaguaccugcgguucgccagcgugucccucuacccgagcaacgaggacgugucccuggccgucagccgcauccugaaguccuucaacuaccccagcgccucccucaucugcgccaaggcggagugccugcugcggcucgaggagcuggugcgcggcuuccugaucagcaaggagacccucagcgugcggaugcuggacgacucccgcgaccccacgccccugcucaaggagauccgggacgacaaggucagcaccaucaucaucgacgccaacgccuccaucagccaccugauccugcgcaaggccuccgagcucgggaugaccagcgccuucuacaaguacauccugaccaccauggacuucccgauccugcaccucgacggcaucguggaggacuccagcaacauccugggguucuccauguucaacaccagccaccccuucuaccccgaguucgugcggucccugaacaugagcuggcgcgagaacugcgaggcguccaccuaccucggccccgcccugagcgccgcccugauguucgacgccguccacgugguggucuccgcggugcgggagcucaaccgcagccaggagaucggggugaagccgcuggccugcacguccgccaacaucuggccccacggcaccagccugaugaacuaccuccggauggucgaguacgacggccugaccgggcgcguggaguucaacuccaagggccagcggaccaacuacacgcugcgcauccucgagaagucccgccaggggcaccgggagaucggcgucugguacagcaaccgcacccuggccaugaacgccaccacccuggacaucaaccucagccagacgcuggcgaacaagacccugguggugaccaccauccuggagaaccccuacgucaugcggcgccccaacuuccaggcccucagcggcaacgagcgguucgagggguucugcguggacaugcugcgcgagcuggccgagcuccugcgguuccgcuaccggcugcgccucguggaggacggccuguacggggccccggagcccaacggcuccuggacggggauggucggcgagcugaucaaccggaaggcggaccucgccguggccgccuucaccaucaccgccgagcgcgagaaggugaucgacuucagcaagcccuucaugacccugggcaucuccauccuguaccggguccacauggggcgcaagcccggcuacuucagcuuccucgacccguucucccccgcgguguggcuguucaugcugcucgccuaccuggccgugagcugcguccuguuccucgccgcccggcugucccccuacgagugguacaacccccacccgugccugcgcgcgcggccccacauccucgagaaccaguacacgcuggggaacagccugugguuccccgugggcggguucaugcagcagggcuccgagaucaugccgcgcgcccucagcacccggugcguguccggcgucuggugggccuucacccugaucaucaucagcuccuacaccgccaaccuggccgcguuccucacggugcagcgcauggaggugcccgucgagagcgccgacgaccuggccgaccagaccaacaucgaguacgggaccauccacgccggcuccaccaugacguucuuccagaacagccgcuaccagaccuaccagcggauguggaacuacaugcagagcaagcagcccuccguguucgucaagagcaccgaggaggggaucgcgcgcgugcugaacucccgguacgccuuccuccuggagagcaccaugaacgaguaccaccgccggcugaacugcaaccucacccagaucggcgggcugcuggacacgaagggcuacggcaucgggaugccccucggcuccccguuccgcgacgagaucacccuggccauccugcagcuccaggagaacaaccggcuggagauccugaagcgcaaguggugggagggcgggcggugccccaaggaggaggaccaccgcgccaagggccucgggauggagaacaucggcgggaucuucaucgugcugaucugcggccugaucaucgccguguucgucgcggugauggaguucaucuggagcacccggcgcuccgccgagagcgaggagacccccgcccuccaccccgccgccugccagugcuccgcgcuggggccgcggacgccccugaaggagcccagcaugcuccuggugaagguccccuccacccgcguccagguggccuucagccggaccucccugcgccaggugugcccguuccuccugcagcaccagcugagcucccucuacuggauccaggccaccaacgugcagaucugcugccacuucagcucccugaagcccagccccgaccugacguucccgcccucccaccggccccucagcagccugcuguucaccgcccucgccgcggugggcggccugcccgacgccuccagcuucuucuucccgcccaucuccagcugcccgccccugcaguccgggaucggccccugccacagcaccgaggccacccucgucacguccaacuuccacguguga

SEQ ID NO: 30838 - RNA, 2658 nt, Artificial Sequence
  derived and/or modified sequence opt1 from GRIN1__Homo_sapiens__NP_000823
augagcaccaugcgccugcucacccuggcccuccucuucuccugcagcguggcccgggcggccugcgaccccaagaucgucaacaucggcgccgugcuguccacgcgcaagcacgagcagauguuccgggaggccgugaaccaggccaacaagcgccacgggagcuggaagauccagcugaacgcgaccuccgucacccacaagccgaacgccauccagauggcccucagcgugugcgaggaccugaucuccagccagguguacgccauccuggucucccacccgcccacccccaacgaccacuucacgcccacccccgugagcuacaccgcgggcuucuaccggauccccgugcucgggcugaccacgcgcauguccaucuacagcgacaaguccauccaccugagcuuccuccggaccgugcccccguacucccaccagagcuccgugugguucgagaugaugcgcguguacagcuggaaccacaucauccugcuggucuccgacgaccacgagggccgggccgcccagaagcgccucgagacccugcuggaggagcgggagagcaaggccgagaaggugcuccaguucgaccccgggaccaagaacgugacggcccugcugauggaggcgaaggagcucgaggcccgcgucaucauccugagcgccuccgaggacgacgccgccaccguguaccgggcggccgccaugcugaacaugaccggcagcggcuacguguggcucgucggggagcgcgagaucuccggcaacgcccugcgguacgcccccgacgggauccugggccuccagcugaucaacgggaagaacgagagcgcgcacaucuccgacgccgugggcguggucgcccaggccgugcacgagcugcucgagaaggagaacaucaccgacccgccccgcggcugcguggggaacacgaacaucuggaagaccggcccccuguucaagcggguccugaugagcuccaaguacgccgacggggugaccggccgcgucgaguucaacgaggacggcgaccggaaguucgcgaacuacagcaucaugaaccuccagaaccgcaagcugguccagguggggaucuacaacggcacccacgucauccccaacgaccggaagaucaucuggcccgggggcgagacggagaagccgcgcggguaccagauguccacccgccugaagaucgugaccauccaccaggagcccuucguguacgucaagcccacccucagcgacggcacgugcaaggaggaguucaccgugaacggcgaccccgugaagaaggucaucugcaccgggccgaacgacaccucccccggcagcccccggcacacggugccccagugcugcuacggguucugcaucgaccugcugaucaagcucgcccgcaccaugaacuucaccuacgaggugcaccuggucgccgacggcaaguucgggacccaggagcgggugaacaacuccaacaagaaggaguggaacggcaugaugggcgagcugcucagcgggcaggccgacaugaucguggcgccgcugacgaucaacaacgagcgcgcccaguacaucgaguucuccaagcccuucaaguaccagggccugaccauccucgucaagaaggagaucccccggagcacccuggacuccuucaugcagcccuuccagagcacccuguggcuccugguggggcuguccgugcacgucguggccgugaugcuguaccuccuggaccgcuucagcccguucggccgguucaaggucaacagcgaggaggaggaggaggacgcccugacgcucuccagcgccaugugguucuccuggggcgugcugcugaacagcgggaucggcgagggggcgccccgcuccuucagcgcccggauccucggcauggugugggccggguucgccaugaucaucgucgccuccuacaccgcgaaccuggccgccuuccuggugcucgaccgccccgaggagcggaucaccggcaucaacgacccgcgccugcggaaccccagcgacaaguucaucuacgccaccgugaagcaguccagcgucgacaucuacuuccgccgccagguggagcuguccaccauguaccggcacauggagaagcacaacuacgagagcgccgcggaggccauccaggccgugcgggacaacaagcuccacgccuucaucugggacuccgcgguccuggaguucgaggccagccagaagugcgaccuggugacgaccggcgagcuguucuuccgcuccggguucggcaucgggaugcggaaggacagccccuggaagcagaacgugucccugagcauccucaagagccacgagaacggcuucauggaggaccuggacaagaccuggguccgcuaccaggagugcgacucccgcagcaacgcccccgccacccugacguucgagaacauggccgggguguucaugcugguggcgggcggcaucgucgccgggaucuuccucaucuucaucgagaucgccuacaagcggcacaaggacgcccgccggaagcagaugcagcuggccuucgcggccgugaacguguggcgcaagaaccugcagcaguaccacccgaccgacaucaccggcccccucaaccuguccgaccccagcgucuccaccgugguguga

SEQ ID NO: 30839 - RNA, 4395 nt, Artificial Sequence
  derived and/or modified sequence opt1 from GRIN2A__Homo_sapiens__NP_000824
augggccgcgugggguacuggacccugcucguccugcccgcccugcucguguggcggggcccggcccccagcgcggccgccgagaaggggccgcccgcccugaacaucgccgugaugcugggccacucccacgacgucaccgagcgcgagcuccggacgcugugggggcccgagcaggcggccggccugccccucgacgugaacguggucgcccugcugaugaaccgcaccgaccccaagagccucaucacccacgugugcgaccugauguccggcgcccggauccacgggcugguguucggcgacgacaccgaccaggaggcggucgcccagaugcucgacuucaucagcucccacacguucgugcccauccuggggauccacggcggggccagcaugaucauggccgacaaggacccgaccuccaccuucuuccaguucggcgccagcauccagcagcaggcgaccgugaugcugaagaucaugcaggacuacgacuggcacgucuucucccucgugacgaccaucuuccccggcuaccgcgaguucaucagcuucgugaagaccaccgucgacaacuccuucguggggugggacaugcagaacgugaucacgcuggacaccagcuucgaggacgccaagacccagguccagcugaagaagauccacuccagcgugauccuccuguacugcuccaaggacgaggccgugcugauccucagcgaggcccggucccugggccugaccggguacgacuucuucuggaucguccccagccucguguccggcaacacggagcugauccccaaggaguucccgagcggccugaucagcguguccuacgacgacugggacuacagccucgaggcccgcguccgggacgggaucggcauccugaccaccgcggccuccagcaugcuggagaaguucuccuacauccccgaggccaaggccagcugcuacgggcagauggagcgccccgaggugcccaugcacacccuccacccguucauggucaacgugacgugggacggcaaggaccuguccuucaccgaggagggguaccaggugcacccccggcuggucgugaucgugcucaacaaggaccgcgagugggagaaggucggcaagugggagaaccacacccugagccugcggcacgccguguggccccgcuacaaguccuucagcgacugcgagcccgacgacaaccaccucuccaucgugacccuggaggaggcgccguucgucaucguggaggacaucgacccccugacggagaccugcgugcggaacaccguccccugccgcaaguucgugaagaucaacaacagcaccaacgagggcaugaacgugaagaagugcugcaagggguucugcaucgacauccucaagaagcugucccggacggucaaguucaccuacgaccuguaccucgugaccaacggcaagcacgggaagaaggugaacaacgucuggaacggcaugaucggggaggugguguaccagcgcgccgucauggccgugggcagccugaccaucaacgaggagcgguccgagguggucgacuucagcgugcccuucguggagacgggcaucuccgucauggugagccgcuccaacgggaccgugagcccgagcgccuuccuggagcccuucuccgccagcgucugggugaugauguucgugaugcuccugaucgucuccgcgaucgccguguucguguucgaguacuucagccccgucggcuacaaccggaaccuggccaaggggaaggcgccccacggcccguccuucaccaucgggaaggccaucuggcugcucuggggccugguguucaacaacagcgugcccguccagaaccccaagggcaccacguccaagaucauggugagcgugugggccuucuucgccgucaucuuccuggccuccuacaccgccaaccucgcggccuucaugauccaggaggaguucguggaccaggugaccgggcugagcgacaagaaguuccagcgcccgcacgacuacuccccgcccuuccgcuucggcaccguccccaacgggagcaccgagcggaacauccgcaacaacuaccccuacaugcaccaguacaugacgaaguucaaccagaagggcguggaggacgcccuggugucccucaagaccggcaagcuggacgccuucaucuacgacgccgcgguccugaacuacaaggccgggcgggacgagggcugcaagcucgugaccaucgggagcggcuacaucuucgccaccacgggguacggcaucgcccugcagaagggcucccccuggaagcgccagaucgaccuggcccuccugcaguucgugggggacggcgagauggaggagcuggagacccucuggcugaccgggaucugccacaacgagaagaacgaggucaugagcucccagcuggacaucgacaacauggcgggcguguucuacaugcucgccgccgccauggcgcugagccugaucaccuucaucugggagcaccucuucuacuggaagcugcgguucugcuucacgggggucugcagcgaccgccccggccugcuguucuccaucagccggggcaucuacuccugcauccacggggugcacaucgaggagaagaagaagucccccgacuucaaccugaccggcagccagagcaacaugcugaagcuccugcgcuccgccaagaacaucagcuccaugagcaacaugaacuccagccggauggacuccccgaagcgcgccgccgacuucauccagcgggggagccugaucauggacaugguguccgacaagggcaaccucauguacagcgacaaccgcuccuuccaggggaaggagagcaucuucggcgacaacaugaacgagcugcagaccuucgucgccaaccggcagaaggacaaccugaacaacuacguguuccagggccagcacccccucacccugaacgaguccaaccccaacacgguggaggucgcggugagcaccgagagcaaggccaacucccgcccccggcagcuguggaagaaguccguggacagcauccgccaggacagccucucccagaacccggucagccagcgggacgaggccaccgccgagaaccgcacccacucccucaagagcccccgguaccugcccgaggagauggcccacuccgacaucagcgagacguccaaccgcgcgaccugccaccgcgagcccgacaacagcaagaaccacaagaccaaggacaacuucaagcgguccguggccagcaaguacccgaaggacugcuccgagguggagcgcaccuaccucaagaccaagagcuccagcccccgggacaagaucuacaccaucgacggggagaaggagcccggcuuccaccuggacccgccccaguucgucgagaacgugacccugcccgagaacguggacuuccccgaccccuaccaggacccguccgagaacuuccgcaagggggacagcacccuccccaugaaccggaacccccugcacaacgaggagggccugagcaacaacgaccaguacaagcucuacuccaagcacuucacgcugaaggacaaggggagcccgcacuccgagaccagcgagcgcuaccggcagaacuccacccacugccgcagcugccuguccaacaugcccaccuacagcggccacuucacgaugcggucccccuucaagugcgacgccugccuccgcaugggcaaccuguacgacaucgacgaggaccagaugcugcaggagaccgggaaccccgccaccggcgagcaggucuaccagcaggacugggcccagaacaacgcgcuccagcugcagaagaacaagcugcggaucagccgccagcacuccuacgacaacaucguggacaagccgcgggagcucgaccugagccgccccucccggagcaucucccugaaggaccgcgagcggcuccuggaggggaacuucuacggcagccuguucuccgugcccagcuccaagcucagcggcaagaaguccagccuguucccccaggggcuggaggacagcaagcgcuccaagagccuccugccggaccacaccuccgacaaccccuuccugcacagccaccgggacgaccagcgccucgucaucggccggugccccuccgaccccuacaagcacagccugccgucccaggccgugaacgacagcuaccugcgcuccagccuccgcuccacggccagcuacugcucccgggacagccgcgggcacaacgacguguacaucuccgagcacgucaugcccuacgccgcgaacaagaacaacauguacagcacgccccgggugcugaacuccugcagcaaccgccggguguacaagaagaugcccagcaucgaguccgacgucuga

SEQ ID NO: 30840 - RNA, 4455 nt, Artificial Sequence
  derived and/or modified sequence opt1 from GRIN2B__Homo_sapiens__XP_011518932
augaagccccgcgccgagugcugcagcccgaaguucuggcuggugcucgccguccuggcgguguccggcagccgggcccgcucccagaaguccccgcccuccaucgggaucgccgugauccuggucggcaccagcgacgagguggccaucaaggacgcccacgagaaggacgacuuccaccaccucuccguggucccccggguggagcugguggcgaugaacgagaccgaccccaagagcaucaucacgcgcaucugcgaccugauguccgaccggaagauccagggggucguguucgccgacgacaccgaccaggaggccaucgcccagauccucgacuucaucagcgcgcagacccugacccccauccugggcauccacgggggcuccagcaugaucauggccgacaaggacgaguccagcauguucuuccaguucggccccuccaucgagcagcaggccagcgugaugcucaacaucauggaggaguacgacugguacaucuucuccaucgucacgaccuacuuccccggguaccaggacuucgugaacaagauccgcagcaccaucgagaacuccuucgugggcugggagcuggaggagguccugcuccuggacaugagccuggacgacggggacagcaagauccagaaccagcucaagaagcugcaguccccgaucauccugcucuacugcaccaaggaggaggccacguacaucuucgagguggccaacagcgugggccugaccggguacggcuacaccuggaucguccccucccugguggcgggcgacaccgacacggugcccgccgaguuccccaccgggcucaucagcgucuccuacgacgagugggacuacggccugccggcccgggugcgcgacgggaucgccaucaucaccaccgccgcgagcgacaugcuguccgagcacagcuucauccccgagcccaaguccagcugcuacaacacgcacgagaagcggaucuaccaguccaacaugcucaaccgcuaccugaucaacgugaccuucgagggccggaaccugagcuucuccgaggacggcuaccagaugcaccccaagcucgucaucauccugcugaacaaggagcgcaagugggagcggguggggaaguggaaggacaagagccuccagaugaaguacuacgucuggccgcgcaugugccccgagaccgaggagcaggaggacgaccaccuguccaucgugacccuggaggaggcccccuucgugaucgucgagagcguggacccccucuccggcacgugcaugcggaacaccgugccgugccagaagcgcaucgucaccgagaacaagaccgacgaggagcccggguacaucaagaagugcugcaagggcuucugcaucgacauccugaagaagaucagcaaguccgugaaguucacguacgaccuguaccucgugaccaacgggaagcacggcaagaagaucaacggcaccuggaacgggaugaucggcgaggucgugaugaagcgggccuacauggccguggggagccugaccaucaacgaggagcgcagcgaggucguggacuucuccgugcccuucaucgagacgggcaucagcgucauggugucccggagcaacgggaccgugucccccagcgccuuccuggagccguucuccgcggacgucugggugaugauguucgugaugcuccugaucgucagcgccguggccguguucgucuucgaguacuucucccccgugggcuacaaccgcugccuggccgacggccgggagcccgggggccccagcuucaccaucgggaaggccaucuggcuccuguggggccugguguucaacaacuccgucccggugcagaaccccaaggggaccacgagcaagaucaugguguccgucugggcguucuucgccgugaucuuccucgccagcuacaccgccaaccuggcggccuucaugauccaggaggaguacguggaccaggucuccggccugagcgacaagaaguuccagcgccccaacgacuucuccccgcccuuccgcuucggcaccgugcccaacgggagcaccgagcggaacauccgcaacaacuacgccgagaugcacgccuacaugggcaaguucaaccagcgcgggguggacgacgcccuccugagccugaagacgggcaagcuggacgcguucaucuacgacgccgccguccucaacuacauggccggccgggacgaggggugcaagcuggugaccaucggcuccgggaagguguucgccagcaccggcuacgggaucgcgauccagaaggacuccggcuggaagcggcaggucgaccuggccauccuccagcuguucggcgacggggagauggaggagcuggaggcccucuggcugaccggcaucugccacaacgagaagaacgaggugaugagcucccagcuggacaucgacaacauggccgggguguucuacaugcucggcgccgcgauggcccugagccugaucaccuucaucugcgagcaccucuucuacuggcaguuccgccacugcuucaugggggucugcuccggcaagcccggcaugguguucagcaucucccgggggaucuacagcugcauccacggcguggccaucgaggagcgccaguccgucaugaacagcccgacggccaccaugaacaacacccacuccaacauccugcggcugcuccgcaccgcgaagaacauggccaaccugagcggggugaacggcagcccccagagcgcccuggacuucauccggcgcgaguccagcguguacgacaucuccgagcaccggcgcagcuucacgcacagcgacugcaaguccuacaacaacccgcccugcgaggagaaccucuucagcgacuacaucuccgaggucgagcggaccuucgggaaccugcagcugaaggacagcaacguguaccaggaccacuaccaccaccaccaccgcccccacuccaucggcagcgccuccagcaucgacggccucuacgacugcgacaacccgcccuucaccacccagucccggagcaucuccaagaagccccuggacaucgggcugcccagcuccaagcacagccagcucuccgaccuguacggcaaguucagcuucaaguccgaccgcuacagcgggcacgacgaccugauccgguccgacgugagcgacaucagcacgcacaccgucaccuacggcaacaucgaggggaacgccgcgaagcgccgcaagcagcaguacaaggacucccucaagaagcggcccgccagcgccaagucccgccgggaguucgacgagaucgagcuggccuaccgccggcgcccgccccggagccccgaccacaagcgcuacuuccgggacaaggagggccugcgcgacuucuaccucgaccaguuccggaccaaggagaacagcccccacugggagcacguggaccugacggacaucuacaaggagcgcuccgacgacuucaagcgggacuccgucagcggcgggggccccugcaccaaccgcucccacaucaagcacgggaccggcgacaagcacggcguggugagcgggguccccgccccgugggagaagaaccugaccaacguggagugggaggaccgguccggcgggaacuucugccgcagcugccccuccaagcuccacaacuacagcacgaccgugaccggccagaacuccgggcggcaggcgugcauccgcugcgaggccugcaagaaggccggcaaccuguacgacaucagcgaggacaacucccugcaggagcucgaccagcccgccgcccccgucgcggugaccagcaacgccuccacgaccaaguacccgcagagccccaccaacagcaaggcccagaagaagaaccggaacaagcugcgccggcagcacuccuacgacaccuucguggaccugcagaaggaggaggccgcgcucgcgccccgcagcgucucccugaaggacaagggccgcuucauggacgggagcccguacgcccacauguucgagauguccgccggcgagagcacguucgccaacaacaaguccagcgugcccaccgccgggcaccaccaccacaacaaccccggcgggggcuacaugcuguccaagagccucuaccccgaccgggugacccagaacccguucauccccaccuucggcgacgaccagugccugcugcacggguccaagagcuacuucuuccgccagcccacggucgccggcgccuccaaggcccggcccgacuuccgcgcccucgugaccaacaagccgguggucagcgcgcugcacggggccgugcccgcccgguuccagaaggacaucugcaucggcaaccaguccaaccccugcgugcccaacaacaagaacccgcgcgccuucaacgggagcuccaacggccacgucuacgagaagcugagcuccaucgagagcgacguguga

SEQ ID NO: 30841 - RNA, 3702 nt, Artificial Sequence
  derived and/or modified sequence opt1 from GRIN2C__Homo_sapiens__NP_000826
augggcggggcccugggccccgcccuccugcugaccagccucuucggggcgugggccggccuggggccgggccagggcgagcaggggaugaccguggccgucguguucuccagcuccggccccccccaggcccaguuccgcgcccggcugacgccccagagcuuccucgaccugccgcuggagauccagccccucaccgugggggucaacaccaccaaccccuccagccugcugacgcagaucugcggccuccugggggcggcccacgugcacggcaucguguucgaggacaacgucgacaccgaggccguggcccagauccuggacuucaucuccagccagacccacgugcccauccucuccaucagcggcggguccgcggucgugcugaccccgaaggagcccggcagcgccuuccugcagcucggggugucccuggagcagcagcugcagguccucuucaaggugcuggaggaguacgacuggagcgccuucgccgugaucacgucccugcaccccggccacgcccucuuccuggagggcguccgcgcgguggccgacgccagccacguguccuggcggcugcucgacgucgugacccuggagcuggggcccggcgggccgcgcgcccggacccagcgccuccugcggcagcuggacgcccccguguucgucgcguacugcagccgcgaggaggccgaggugcucuucgccgaggccgcccaggcgggccugguggggcccggccacgucuggcuggugcccaaccucgcccugggcuccaccgacgccccgcccgccacguuccccgucgggcugaucagcguggugaccgagagcuggcggcucucccugcgccagaagguccgggacggcguggccauccuggcgcucggggcccacagcuacuggcgccagcacggcacccugcccgccccggccggggacugccgggugcaccccggccccgucucccccgcgcgcgaggccuucuaccggcaccugcucaacgugaccugggagggccgcgacuucagcuucuccccggggggcuaccuggugcagcccacgauggucgugaucgcccugaaccggcaccgccucugggagaugguggggcggugggagcacggcguccuguacaugaaguaccccguguggccccgcuacagcgccucccugcagccgguggucgacagccggcaccugaccguggccacccucgaggagcgccccuucgugaucgucgagucccccgacccggggaccggcggcugcgugcccaacacggugcccugccgccggcagagcaaccacaccuucuccagcggggacgucgcgcccuacaccaagcugugcugcaagggcuucugcaucgacauccugaagaagcucgcccgcguggugaaguucuccuacgaccuguaccuggucaccaacgggaagcacggcaagcgggugcgcggcguguggaacgggaugaucggcgaggucuacuacaagcgggccgacauggccaucgggagccucacgaucaacgaggagcgcuccgagaucguggacuucagcgugccguucgucgagaccggcaucuccgugaugguggcccggagcaacgggaccgucucccccagcgcguuccuggagcccuacagccccgccgugugggugaugauguucgucaugugccugaccgugguggccaucacggucuucauguucgaguacuucuccccggugagcuacaaccagaaccucacccgcggcaagaaguccggcgggcccgccuucaccaucggcaagagcguguggcugcugugggcccucgucuucaacaacuccgugcccaucgagaacccccgggggaccacgagcaagaucauggugcuggucugggcguucuucgccgugaucuuccuggccuccuacaccgccaaccucgcggccuucaugauccaggagcaguacaucgacaccgugagcggccuguccgacaagaaguuccagcgcccgcaggaccaguacccccccuuccgguucgggaccguccccaacggcagcacggagcgcaacauccgguccaacuaccgcgacaugcacacccacauggugaaguucaaccagcggagcguggaggacgcccugaccucccucaagaugggcaagcuggacgccuucaucuacgacgccgcgguccugaacuacauggccgggaaggacgagggcugcaagcucgugaccaucgggagcggcaaggucuucgccaccacgggguacggcaucgccaugcagaaggacucccacuggaagcgcgccaucgaccuggcgcugcuccaguuccugggcgacggggagacccagaagcuggagaccguguggcucagcggcaucugccagaacgagaagaacgaggugauguccagcaagcuggacaucgacaacauggccggggucuucuacaugcugcucguggccaugggccuggcccugcucguguucgccugggagcaccuggucuacuggaagcugcggcacagcgugccgaacuccagccagcucgacuuccugcuggcguucucccgcgggaucuacagcugcuucuccggcgugcagagccucgccucccccccccggcaggccagccccgaccugaccgccuccagcgcgcaggccuccguccugaagaugcuccaggccgcccgcgacauggugacgaccgccggcgugagcuccagccuggaccgcgcgacccggaccaucgagaacugggggggcgggcgccgggccccgccccccucccccugcccgacgccccgcagcggccccuccccgugccugcccacccccgaccccccgcccgagcccagccccaccggcugggggccgcccgacggcgggcgggccgcccucguccgccgggccccccagcccccgggccgcccccccacccccgggccgccccuguccgacgugagccgggugagccgccggcccgcgugggaggcccgcuggcccguccggacgggccacugcggccgccaccuguccgccagcgagcggccgcucucccccgcccgcugccacuacagcuccuucccccgggccgaccgcagcgggcggcccuuccugccgcuguuccccgagcucgaggaccugccccugcucggccccgagcagcuggcgcgccgggaggcccugcuccacgccgccugggcccgcgggucccgcccgcggcacgcgagccugcccuccagcguggccgaggccuucgcccgccccuccagccugccggcgggcugcaccgggcccgccugcgcccggcccgacggccacuccgccugccgccggcucgcccaggcgcagagcaugugccugcccaucuaccgcgaggccugccaggagggcgagcaggccggggccccggccuggcagcaccggcagcacgugugccugcacgcgcacgcccaccuccccuucugcuggggcgccgucugcccccaccugcccccgugcgccucccacgggagcuggcuguccggcgccugggggccccucggccaccgcggccggacccuggggcugggcaccggguaccgcgacagcggcggccucgacgagaucucccggguggcgcgcgggacgcagggcuuccccgggcccugcaccuggcggcgcaucagcagccuggaguccgagguguga

SEQ ID NO: 30842 - RNA, 4011 nt, Artificial Sequence
  derived and/or modified sequence opt1 from GRIN2D__Homo_sapiens__NP_000827
augcgcggcgccgggggcccccgggggccccgcggccccgccaagaugcugcuccugcuggcccucgccugcgccagccccuuccccgaggaggcccccgggcccggcggcgccgggggccccgggggcgggcugggcggcgcccggccccugaacguggcccucgucuucuccgggcccgccuacgccgccgaggccgcccgccugggccccgccguggccgcggccgugcggagccccgggcuggacguccgccccguggcccucgugcugaacggcuccgacccccggagccugguccuccagcugugcgaccugcucuccggccugcgcgugcacgggguggucuucgaggacgacagccgggcccccgccguggcgcccauccuggacuuccucuccgcccagacgagccugcccaucguggccguccacggcggggccgcccuggugcucacccccaaggagaagggcuccacguuccugcagcuggggagcuccaccgagcagcagcuccaggugaucuucgagguccuggaggaguacgacuggaccagcuucguggcggugaccacgcgcgcccccggccaccgggccuuccuguccuacaucgagguccucaccgacggcagccugguggggugggagcaccgcggcgcccugacccucgaccccggggccggcgaggcggugcuguccgcccagcugcggagcgucuccgcccagauccgccuccuguucugcgcccgggaggaggcggagcccguguuccgcgccgccgaggaggccgggcugaccggcagcggcuacgugugguucauggucgggccccagcucgccggcgggggcggguccggcgcgcccggcgagccgccccuccugcccggcggcgcgccccugcccgccgggcuguucgccgugcggagcgccggcuggcgcgacgaccuggcgcggcgcgucgccgccggcguggccguggucgcccgcggggcccaggcccuccugcgggacuacggcuuccugcccgagcucgggcacgacugccgcgcccagaaccggacgcaccgcggcgagagccugcaccgguacuucaugaacaucaccugggacaaccgcgacuacuccuucaacgaggacggguuccuggugaaccccagccucguggucaucucccugacccgggaccgcaccugggagguggugggcagcugggagcagcagacgcugcggcugaaguacccccucuggucccgcuacggccgguuccugcagcccgucgacgacacccagcaccugaccguggccacccucgaggagcgccccuucgugaucgucgagcccgcggaccccaucagcgggacgugcauccgggacuccgugcccugccgcagccagcugaaccggacccacagcccgccgcccgacgcgccccgccccgagaagcggugcugcaagggcuucugcaucgacauccugaagcgccucgcccacaccaucggguucuccuacgaccuguaccuggugaccaacggcaagcacgggaagaagaucgacggcgucuggaacggcaugaucggggagguguucuaccagcgggccgacauggccaucggcucccucacgaucaacgaggagcgcagcgagaucguggacuucuccguccccuucguggagaccgggaucagcgugauggucgcgcgguccaacggcaccgugagccccuccgccuuccuggagcccuacagccccgccgugugggucaugauguucgugaugugccugaccguggucgccgugacgguguucaucuucgaguaccucucccccgucggguacaaccgcagccuggccaccggcaagcgccccggcgggagcaccuucaccaucggcaaguccaucuggcugcucugggcgcugguguucaacaacagcgugcccgucgagaacccccgggggacgaccuccaagaucauggugcuggugugggccuucuucgccgucaucuuccucgccagcuacaccgccaaccuggcggccuucaugauccaggaggaguacguggacaccguguccggccugagcgaccgcaaguuccagcggccccaggagcaguacccgccccugaaguucgggacgguccccaacggcuccaccgagaagaacauccgcagcaacuaccccgacaugcacuccuacauggugcgguacaaccagccccgcguggaggaggcccugacccagcugaaggccggcaagcucgacgcguucaucuacgacgccgccguccugaacuacauggcccggaaggacgaggggugcaagcuggugaccaucggcagcgggaagguguucgccacgaccggcuacggcaucgcgcuccacaaggggucccgcuggaagcggcccaucgaccuggcccugcuccaguuccugggcgacgacgagaucgagaugcuggagcgccucuggcugagcgggaucugccacaacgacaagaucgaggucauguccagcaagcuggacaucgacaacauggccggcguguucuacaugcuccugguggccauggggcugucccuccuggucuucgccugggagcaccugguguacuggcggcuccgccacugccugggcccgacccaccggauggacuuccugcucgcguucagccgcggcauguacuccugcugcagcgccgaggccgcgccgccgcccgccaagcccccgcccccgccccagccccugcccagccccgcguaccccgcgccccggcccgccccggggcccgcccccuucgugccccgcgagcgggccuccgucgaccgcuggcggcgcaccaagggcgcggggccgcccggcggggccggccuggccgacggcuuccaccgguacuacgggcccaucgagccccagggccucgggcugggccugggggaggcccgcgcggccccgcgcggcgccgccggccggccccucuccccgcccgccgcgcagccgccccagaagccgccgcccuccuacuucgccaucgugcgcgacaaggagcccgccgagccgcccgccggggccuuccccggcuuccccuccccgcccgcgccgcccgccgccgccgccaccgcggucgggccgccccugugccggcuggccuucgaggacgagagcccgcccgcccccgcccgcuggccccggagcgaccccgagucccagccccuccugggccccggcgccgggggcgccgggggcaccgggggcgccggcgggggcgcccccgccgcgccgccgcccugccgcgccgccccgccgcccugccccuaccuggaccucgagccgagccccuccgacagcgaggacuccgagagccucgggggcgccucccucgggggccucgagcccuggugguucgccgacuuccccuacccguacgcggagcggcuggggccgccgcccgggcgcuacuggagcguggacaagcugggcggguggcgggccggcuccugggacuaccugccgccccgcagcgggcccgccgccuggcacugccggcacugcgccucccuggagcugcugcccccgccccgccaccucagcugcucccacgacggccuggacggcggguggugggcgcccccgccgccgcccugggccgccggcccgcucccccggcgccgggcccgcugcgggugcccccggagccacccccaccgcccgcgggcgagccaccgcacccccgccgccgccgcgccccaccaccaccgccaccggcgcgcggccggcgggugggaccugcccccgcccgcccccaccucccggagccuggaggaccucuccagcugcccccgcgccgccccggcgcggcgccugaccggccccucccggcacgcccgccggugcccccacgccgcccacuggggcccgccccugcccacggccagccaccgccggcaccgcgggggcgaccucgggacccggcgcggcuccgcgcacuucagcucccuggagagcgagguguga

SEQ ID NO: 30843 - RNA, 3348 nt, Artificial Sequence
  derived and/or modified sequence opt1 from GRIN3A__Homo_sapiens__NP_597702
augcgccggcugagccucugguggcugcugucccgcgugugccuccugcugcccccgcccugcgcccucguccuggccggcgugcccagcuccagcucccacccccagcccugccagauccugaagcggaucgggcacgcggugcgcgucggcgccgugcaccuccagcccuggaccaccgcgccccgggccgccagccgcgcccccgacgacucccgggccggggcccagcgcgacgagccggagcccggcacgcggcgcagccccgcccccuccccgggggcgcgguggcugggcagcacccugcacggccgcgggccgcccggcucccggaagcccggggagggcgcccgcgccgaggcccucuggccccgggacgcccugcuguucgcgguggacaaccucaaccgcgucgaggggcugcugcccuacaaccucagccuggagguggugauggccaucgaggccggccugggcgaccucccccugcugcccuucuccagcccguccagccccugguccagcgaccccuucuccuuccuccagagcgucugccacaccguggugguccagggggugagcgcccugcuggccuucccccagucccagggcgagaugauggagcucgaccuggugagccugguccuccacaucccggugaucuccaucgugcggcacgaguucccccgcgagagccagaacccccugcaccuccagcugucccuggagaacagccuguccagcgacgcggacgucaccguguccauccucacgaugaacaacugguacaacuucagccugcugcucugccaggaggacuggaacaucaccgacuuccugcugcucacccagaacaacuccaaguuccaccuggggagcaucaucaacaucaccgccaaccugcccuccacgcaggaccuccugagcuuccugcagauccagcucgaguccaucaagaacagcaccccgaccguggucauguucggcugcgacauggaguccauccggcgcaucuucgagaucaccacgcaguucggcgugaugccgcccgagcugcggugggugcugggggacagccagaacgucgaggagcugcgcaccgagggccucccccuggggcugaucgcccacggcaagaccacccaguccguguucgagcacuacguccaggacgccauggagcucguggcccgcgcgguggccacggccaccaugauccagcccgagcuggcccugauccccagcaccaugaacugcauggaggucgagaccacgaaccucaccagcgggcaguaccugucccgguuccuggccaacaccaccuuccgcggccucagcggcuccauccgggugaaggggagcacgaucguguccagcgagaacaacuucuucaucuggaaccugcagcacgaccccaugggcaagccgauguggacccgccugggguccuggcagggcgggaagaucgucauggacuacggcaucuggcccgagcaggcgcagcggcacaagacccacuuccagcaccccagcaagcuccaccuccgcguggugacccugaucgagcaccccuucgucuucacgcgggagguggacgacgagggccugugcccggccgggcagcugugccuggaccccaugaccaacgacuccagcacccucgacucccuguucagcucccugcacagcuccaacgacaccgugcccaucaaguucaagaagugcugcuacggcuacugcaucgaccuccuggagaagaucgccgaggacaugaacuucgacuucgaccuguacaucgucggggacggcaaguacggggccuggaagaacggccacuggacgggccucgugggggaccugcugcgcggcaccgcgcacauggccgugaccagcuucuccaucaacaccgcccggagccaggucaucgacuucacgagccccuucuucuccaccagccucgggauccuggugcgcacccgggacaccgccgccccgaucggcgcguucauguggccccugcacuggaccauguggcucggcaucuucguggcccugcacaucacggccgucuuccugacccucuacgaguggaagucccccuucgggcugacccccaagggccgcaaccggagcaagguguucuccuucagcuccgcccugaacaucugcuacgcccuccuguucgggcgcaccguggcgaucaagccgcccaagugcuggacgggccgguuccugaugaaccucugggccaucuucugcauguucugccugagcaccuacaccgccaaccuggccgccgucauggugggggagaagaucuacgaggagcucuccggcauccacgaccccaagcugcaccaccccagccagggcuuccgcuucgggaccgugcgggaguccagcgcggaggacuacguccgccaguccuucccggagaugcacgaguacaugcggcgcuacaacgugcccgccacgcccgacggcguggaguaccugaagaacgaccccgagaagcucgacgccuucaucauggacaaggcccugcuggacuacgaggucagcaucgacgcggacugcaagcuccugaccguggggaagccguucgccaucgagggcuacgggaucggccugccgcccaacagcccccucaccgccaacaucuccgagcugaucucccaguacaagagccacggcuucauggacaugcugcacgacaagugguaccgcgugguccccugcgggaagcgguccuucgccgugaccgagacgcuccagaugggcaucaagcacuucagcgggcuguucgugcugcucugcaucggcuucgggcugagcauccugaccaccaucggcgagcacaucgucuaccgccuccugcugccccggaucaagaacaaguccaagcuccaguacuggcugcacaccagccagcgccugcaccgggccaucaacacguccuucaucgaggagaagcagcagcacuucaagaccaagcgcguggagaagcggagcaacgugggcccccgccagcucaccgucuggaacaccuccaaccugagccacgacaaccggcgcaaguacaucuucuccgacgaggaggggcagaaccagcugggcauccggauccaccaggacaucccgcucccgccccgccggcgcgagcugcccgcgcugcggacgaccaacgggaaggccgacagccucaacgugucccgcaacagcgugaugcaggagcuguccgagcuggagaagcagauccaggucauccggcaggagcuccagcuggccgugagccgcaagaccgagcuggaggaguaccagcggaccucccgcacgugcgagagcuga

SEQ ID NO: 30844 - RNA, 3132 nt, Artificial Sequence
  derived and/or modified sequence opt1 from GRIN3B__Homo_sapiens__NP_619635
auggaguucgugcgcgcccuguggcucggccuggcccuggcgcucgggcccggcagcgccgggggccacccgcagcccugcgggguccuggcccggcugggcggcuccgugcgccucggggcccugcugccccgggcgccccucgcccgcgcccgggcccgcgccgcgcuggcccgggccgcccuggccccgcgccucccccacaaccugagccuggagcucguggucgcggccccgcccgcccgggaccccgccucccugacccgcggccugugccaggcccucgugccgcccgggguggcggcccugcuggccuuccccgaggcccggcccgagcuccugcagcugcacuuccucgccgcggccaccgagacgcccguccugagccugcuccgccgggaggcccgcgcgccccugggcgcccccaacccguuccaccuccagcuccacugggccagcccccuggagacccugcucgacgugcugguggccguccugcaggcccacgccugggaggacguggggcucgcgcugugccggacccaggaccccggcggccugguggcccucuggaccucccgcgccgggcggcccccgcagcugguccuggaccucucccgccgggacacgggcgacgccgggcugcgcgcccggcuggcgcccauggccgcccccgugggcggcgaggcccccgugccggccgcgguccuccuggggugcgacaucgcccgcgcccgccgggugcuggaggccgugccgcccggcccccacuggcuccuggggacgccccugccgcccaaggcccugcccaccgcgggccucccgcccgggcugcuggcccucggcgaggucgcccgcccgccccuggaggccgcgauccacgacaucgugcagcugguggcccgggcccucggcagcgccgcccagguccagcccaagcgcgcgcugcugcccgcccccgugaacugcggggaccuccagcccgccggccccgagucccccgggcgguuccuggcccgcuuccuggccaacaccagcuuccagggccggaccgggcccgugugggucaccggcuccagccaggugcacaugucccgccacuucaaggucuggagccugcggcgcgacccgcggggcgcgcccgccugggccaccgugggguccuggcgcgacggccagcuggaccuggagcccgggggcgccagcgcccggcccccgccgccccagggggcccagguguggcccaagcuccgcgucgugacccugcuggagcaccccuucguguucgcgcgggaccccgacgaggacggccagugccccgccggccagcucugccuggaccccgggacgaacgacuccgccacccuggacgcccucuucgcggcccuggccaacggcagcgccccgcgcgcgcugcggaagugcugcuacggguacugcaucgaccuccuggagcgccuggccgaggacacccccuucgacuucgagcucuaccuggucggcgacggcaaguacggggcccugcgggacggccgcuggaccgggcucgugggcgaccugcuggccgggcgcgcccacauggcggugacguccuucagcaucaacagcgcccggucccaggucguggacuucaccagccccuucuucuccaccagccucggcaucauggugcgcgcccgggacaccgccuccccgaucggcgccuucauguggccccugcacuggagcacguggcugggggucuucgcggcccuccaccugaccgcccuguuccucaccguguacgaguggcgcucccccuacggccugacgccccgggggcgcaaccggagcaccguguucuccuacagcuccgcccugaaccucugcuacgccauccuguuccgccggaccgucagcuccaagaccccgaagugccccaccggccgccugcucaugaaccugugggcgaucuucugccugcucgugcugagcuccuacacggccaaccuggccgccgugauggucggggacaagaccuucgaggagcucagcggcauccacgaccccaagcugcaccaccccgcgcagggcuuccgguucgggaccgugugggaguccagcgccgaggccuacaucaagaaguccuucccggacaugcacgcccacaugcgccggcacagcgcccccaccacgccccgcggcguggcgaugcugaccagcgacccgcccaagcucaacgccuucaucauggacaagucccugcuggacuacgaggucagcaucgacgccgacugcaagcuccugaccguggggaagcccuucgccaucgagggcuacgggaucggccugccccagaacagcccccucaccuccaaccuguccgaguucaucagccgguacaaguccagcggcuucaucgaccugcuccacgacaagugguacaagauggugccgugcgggaagcgcgucuucgccgugacggagacccugcagauguccaucuaccacuucgcgggccuguucgugcuccugugccuggggcucggcagcgcccugcuguccagccucggggagcacgccuucuuccggcuggcccugccccgcauccggaagggcucccgccuccaguacuggcugcacaccagccagaagauccaccgggcccugaacaccgagccgcccgagggcuccaaggaggagaccgcggaggccgagcccagcgggcccgaggucgagcagcagcagcagcagcaggaccagcccacggcccccgagggcuggaagcgcgcccgccgggcgguggacaaggagcgccgggugcgcuuccuccuggagccggccgucgugguggcccccgaggccgacgccgaggcggaggccgcgccccgggaggggcccgucuggcugugcuccuacggccgcccgcccgccgcccggcccaccggcgccccgcagcccggggagcuccaggagcuggagcgccggaucgagguggcccgcgagcggcugcgccaggcccucgugcggcgcggccagcugcuggcccagcucggggacagcgcccggcaccgcccccggcgccugcugcaggcgcgggccgcccccgccgaggcgccgccccacagcggccgccccgggucccaggaguga

SEQ ID NO: 30845 - RNA, 1116 nt, Artificial Sequence
  derived and/or modified sequence opt1 from GRINA__Homo_sapiens__NP_001009184
augagccacgagaaguccuuccuggugagcggcgacaacuacccgccgcccaaccccggguaccccggcgggccccagccgcccaugccgcccuacgcccagccgcccuaccccggcgcccccuacccccagccgcccuuccagcccucccccuacgggcagcccggcuacccccacggccccagccccuacccccagggcggguacccccaggggccguacccccagggcggguacccccagggccccuacccgcaggagggcuacccccaggggcccuacccgcagggcggguacccccagggccccuacccccaguccccguucccgcccaaccccuacggccagccccaggucuuccccgggcaggaccccgacagcccccagcacggcaacuaccaggaggaggggccgcccuccuacuacgacaaccaggacuuccccgcgaccaacugggacgacaagagcauccgccaggccuucauccggaagguguuccucgugcugacccugcagcucuccgucacgcugagcaccguguccguguucaccuucgucgccgaggugaagggcuucgugcgcgagaacgucuggaccuacuacgugagcuacgccguguucuucaucucccugaucguccucagcugcugcggggacuuccggcgcaagcaccccuggaaccugguggcccuguccgugcucacggcgagccuguccuacauggucggcaugaucgccagcuucuacaacaccgaggccgugaucauggccgugggcaucaccaccgcggucugcuucacgguggugaucuucuccaugcagacccgguacgacuucaccagcugcauggggguccugcucgugagcauggugguccuguucaucuucgccauccugugcaucuucauccgcaaccggauccucgagaucguguacgccucccugggcgcccuccuguucacgugcuuccuggccgucgacacccagcugcuccuggggaacaagcagcugagccucuccccggaggaguacguguucgcggcccugaaccuguacaccgacaucaucaacaucuuccucuacauccugaccaucaucggccgcgccaaggaguga

SEQ ID NO: 30846 - RNA, 3231 nt, Artificial Sequence
  derived and/or modified sequence opt1 from GRIP1__Homo_sapiens__NP_066973
augaucgccgugagcuucaagugccgcugccagauccugcggcgccucaccaaggacgagucccccuacaccaagagcgccucccagacgaagccgcccgacggcgcgcuggccguccggcgccagagcauccccgaggaguucaagggguccaccgugguggagcugaugaagaaggagggcaccacccucgggcugacggucagcggcgggaucgacaaggacggcaagccccggguguccaaccugcgccagggcgggaucgccgcccggagcgaccagcucgacgugggcgacuacaucaaggccgucaacgggaucaaccuggcgaaguuccgccacgacgagaucaucucccugcucaagaacgugggcgagcgggugguccuggagguggaguacgagcugccgcccgugagcguccagggguccagcgugaucuuccgcaccguggaggucacccuccacaaggagggcaacaccuucggcuucgugauccgcgggggcgcccacgacgaccggaacaagucccggcccguggucaucacgugcgugcgccccgggggcccggccgaccgggagggcaccaucaagcccggggaccgccugcugagcguggacggcauccggcuccuggggaccacccacgccgaggcgauguccauccugaagcagugcggccaggaggccgcccuccugaucgaguacgacgucagcgugauggacuccguggccacggccagcgggccccugcucgucgagguggcgaagacccccggcgccucccugggcgucgcccugaccaccagcaugugcugcaacaagcaggucaucgugaucgacaagaucaagagcgccuccaucgccgaccgcugcggggcgcuccacgugggcgaccacauccugagcaucgacgggacguccauggaguacugcacccuggccgaggccacccaguuccucgccaacaccacggaccaggugaagcuggagauccugccgcaccaccagacccggcucgcccugaagggccccgaccacgcggcccuggugagcuccagcuucucccccaccagcauguccgccuacagccucuccagccugaacauggggacccugccccgcucccucuacagcacguccccgcggggcaccaugaugcgccgccggcugaagaagaaggacuucaagagcucccugagccucgccuccagcaccgucggccuggccggccagguggugcacaccgagacgaccgaggucgugcugaccgcggaccccgugaccggguucgggauccagcuccagggcagcgucuucgccacggagacccuguccagcccgccccugaucuccuacaucgaggccgacagccccgccgagcgcugcggggugcuccagaucggcgaccgggugauggcgaucaacggcauccccaccgaggacuccaccuucgaggaggccagccagcugcugcgcgacuccagcaucacguccaaggucacccucgagaucgaguucgacguggccgagagcgugauccccuccagcgggaccuuccacgucaagcugcccaagaagcacaacguggagcugggcaucaccaucuccagcccguccagccggaagcccggggacccccuggugaucuccgacaucaagaagggcagcgucgcccaccgcaccggcacgcucgagcugggggacaagcugcucgccaucgacaacauccggcuggacaacugcagcauggaggacgcggugcagauccugcagcagugcgaggaccucgugaagcugaagauccgcaaggacgaggacaacuccgacgagcaggagagcuccggcgccaucaucuacaccgucgagcugaagcgguacgggggcccccucgggaucaccaucagcggcaccgaggagccguucgaccccaucaucaucuccagccugacgaagggcgggcuggccgagcgcaccggcgccauccacaucggggaccggauccucgccaucaacuccagcucccugaagggcaagccccugagcgaggcgauccaccuccugcagauggccggggagaccgugacccugaagaucaagaagcagacggacgcccaguccgccagcuccccgaagaaguuccccaucagcucccaccucagcgaccugggcgacguggaggaggacuccagccccgcccagaagcccggcaagcuguccgacauguacccgagcaccguccccagcguggacuccgcgguggacagcugggacggguccgccaucgacaccagcuacggcacccaggggacguccuuccaggccagcggcuacaacuucaacaccuacgacuggcgcucccccaagcagcgggggagccucucccccgucaccaagccgcgcagccagaccuaccccgacgugggccuguccuacgaggacugggaccggagcacggccuccggcuucgcgggggccgccgacagcgccgagaccgagcaggaggagaacuucuggucccaggcccuggaggaccucgagaccugcggccagagcgggauccugcgcgagcuggaggagaaggcggaccggcgcgugucccuccggaacaugacccugcuggccacgaucaugagcggcuccaccaugagccucaaccacgaggcccccacgccccgcagccagcuggggcgccaggccuccuuccaggagcggagcuccagccgcccgcacuacucccagaccacccggagcaacacccugcccuccgacgucggccgcaagagcgugacccuccggaagaugaagcaggagaucaaggagaucaugucccccacccccguggagcugcacaaggucacgcuguacaaggacagcgacauggaggacuucggcuucuccguggccgacgggcuccuggagaagggcguguacgucaagaacauccgcccggcggggcccggcgaccugggcgggcucaagcccuacgaccggcugcuccaggugaaccacgugcgcacccgggacuucgacugcugccuggucgugccccugaucgccgagagcggcaacaagcuggaccucgugaucucccgcaacccgcuggccagccagaaguccaucgaccagcagagccugcccggggacugguccgagcagaacagcgccuucuuccagcagcccucccacggcgggaaccucgagacccgggagcccaccaacacgcuguga

SEQ ID NO: 30847 - RNA, 1692 nt, Artificial Sequence
  derived and/or modified sequence opt1 from GRK1__Homo_sapiens__NP_002920
auggacuucggcagccuggagaccguggucgccaacuccgccuucaucgcggcccgcgggagcuucgacggcuccagcucccagcccagccgggacaagaaguaccucgccaagcugaagcugccgccccucuccaagugcgagagccugcgcgacucccugagccucgaguucgaguccgugugccuggagcagcccaucgggaagaagcuguuccagcaguuccuccagagcgccgagaagcaccuccccgcccuggagcuguggaaggacaucgaggacuacgacaccgcggacaacgaccugcagccgcagaaggcccagacgauccuggcccaguaccucgacccccaggccaagcuguucugcuccuuccuggacgagggcaucguggcgaaguucaaggaggggcccgucgagauccaggacggccucuuccagccccugcugcaggccacccucgcccaccugggccaggccccguuccaggaguaccuggggagccucuacuuccugcgguuccugcaguggaaguggcucgaggcccagcccaugggcgaggacugguuccuggacuuccgcgugcuggggaagggcggguucggcgagguguccgcgugccagaugaaggccaccggcaagcucuacgccugcaagaagcugaacaagaagcggcugaagaagcgcaagggguaccagggcgccauggucgagaagaagauccucaugaaggugcacagccgguucaucgugucccuggccuacgcguucgagaccaaggccgaccugugccucgucaugacgaucaugaacgggggcgacauccgcuaccacaucuacaacgugaacgaggagaaccccggcuuccccgagccgcgggcccuguucuacaccgcccagaucaucugcgggcuggagcaccuccaccagcgccggaucguguaccgcgaccugaagcccgagaacguccugcucgacaacgacggcaacgugcggaucagcgaccuggggcuggccguggagcuccuggacggccaguccaagaccaagggguacgcgggcacccccggcuucauggcccccgagcugcuccagggggaggaguacgacuucagcgucgacuacuucgcccugggcgugacgcuguacgagaugaucgccgcccgcgggccguuccgggcgcgcggcgagaagguggagaacaaggagcugaagcaccggaucaucagcgagcccgucaaguaccccgacaaguucucccaggccagcaaggacuucugcgaggcccuccuggagaaggaccccgagaagcgccugggguuccgggacgagaccugcgacaagcuccgcgcccacccgcuguucaaggaccugaacuggcggcagcucgaggcgggcaugcugaugccgcccuucauccccgacuccaagaccguguacgccaaggacauccaggacgugggcgccuucagcaccgucaaggggguggccuucgacaagacggacaccgaguucuuccaggaguucgccaccggcaacugccccauccccuggcaggaggagaugaucgagaccgggaucuucggcgagcugaacguguggcgcuccgacgggcagaugcccgacgacaugaagggcaucagcggcggguccagcuccagcuccaagagcggcaugugccucgucuccuga

SEQ ID NO: 30848 - RNA, 1641 nt, Artificial Sequence
  derived and/or modified sequence opt1 from GRK4__Homo_sapiens__NP_001004056
auggagcuggagaacaucguggccaacagccuccugcugaaggcccgccaggagaaggacuacuccagccucugcgacaagcagcccaucggccggcgccuguuccggcaguucugcgacaccaagccgacccugaagcgccacaucgaguuccucgacgcggucgccgaguacgagguggccgacgacgaggaccgguccgacugcgggcugagcauccuggaccgcuucuucaacgacaagcucgccgcgccccugcccgagaucccgcccgacguggucacggagugccggcugggccucaaggaggagaaccccuccaagaaggccuucgaggagugcacccgcguggcccacaacuaccugcgcggggagcccuucgaggaguaccaggagagcuccuacuucagccaguuccugcaguggaaguggcucgagcggcagcccgugaccaagaacaccuuccggcacuaccgcguccugggcaagggcggguucggcgaggugugcgccugccaggugcgggccacggggaagauguacgcgugcaagaagcugcagaagaagcgcaucaagaagcggaagggcgaggccauggcccucaacgagaagcgcauccuggagaagguccagucccgguucguggugagccuggccuacgccuacgagaccaaggacgcgcucugccugguccugaccaucaugaacgggggcgaccucaaguuccacaucuacaaccuggggaacccgggcuucgacgagcagcgcgccguguucuacgccgccgagcugugcugcggccucgaggaccugcagcgggagcgcaucguguaccgggaccugaagcccgagaacauccuccuggacgaccgcgggcacauccgcaucuccgaccugggccucgccaccgagauccccgaggggcagcggguccgcggccgggugggcacggugggguacauggcgcccgaggucgugaacaacgagaaguacaccuucagcccggacugguggggccuggggugccugaucuacgagaugauccagggccacucccccuucaagaaguacaaggagaaggugaagugggaggaggucgaccagcgcaucaagaacgacaccgaggaguacagcgagaaguucuccgaggacgccaagagcaucugccggaugcuccugaccaagaaccccuccaagcgccuggggugccggggcgagggcgccgccggggugaagcagcaccccguguucaaggacaucaacuuccgccggcucgaggccaacaugcuggagccgcccuucugccccgacccccacgcggucuacugcaaggacgugcuggacaucgagcaguucagcgucgugaagggcaucuaccucgacacggccgacgaggacuucuacgcccgcuucgccaccgggugcguguccaucccguggcagaacgagaugaucgagagcggcugcuucaaggacaucaacaagagcgaguccgaggaggcccugccccuggaccucgacaagaacauccacacccccgucagccggcccaaccgcggguucuucuaccggcuguuccgccggggcggcugccugaccauggugccguccgagaaggagguggagcccaagcagugcuga

SEQ ID NO: 30849 - RNA, 1773 nt, Artificial Sequence
  derived and/or modified sequence opt1 from GRK5__Homo_sapiens__NP_005299
auggagcuggagaacaucguggccaacaccguccuccugaaggcccgcgagggcgggggcgggaagcggaagggcaagagcaagaaguggaaggagauccugaaguucccccacaucucccagugcgaggaccuccgccggaccaucgaccgcgacuacugcagccugugcgacaagcagcccaucgggcggcuccuguuccgccaguucugcgagacgcggcccggccuggagugcuacauccaguuccuggacuccguggcggaguacgaggugacccccgacgagaagcucggcgagaaggggaaggagaucaugaccaaguaccugacccccaagagccccgucuucaucgcccaggugggccaggaccuggugucccagacggaggagaagcuccugcagaagcccugcaaggagcuguucagcgccugcgcccaguccguccacgaguaccuccgcggggagcccuuccacgaguaccuggacagcauguucuucgaccgguuccugcaguggaaguggcucgagcgccagcccgugaccaagaacaccuuccggcaguaccgcgugcugggcaagggcggguucggcgaggucugcgccugccaggugcgggcgaccgggaagauguacgccugcaagcgccuggagaagaagcggaucaagaagcgcaagggcgaguccauggcccucaacgagaagcagauccuggagaaggugaacagccaguucgucgugaaccuggccuacgcguacgagacgaaggacgcccucugccuggugcugaccaucaugaacgggggcgaccucaaguuccacaucuacaacaugggcaacccgggguucgaggaggagcgggcccuguucuacgccgccgagauccugugcggccucgaggaccugcaccgcgagaacaccgucuaccgggaccugaagcccgagaacauccuccuggacgacuacgggcacauccgcaucuccgaccugggccucgcggugaagauccccgagggggaccugauccggggccgcgugggcaccgucggguacauggcccccgaggugcugaacaaccagcgcuacggccucagcccggacuacugggggcugggcugccugaucuacgagaugaucgaggggcagucccccuuccggggccgcaaggagaaggugaagcgggaggaggucgaccgccgggugcucgagacggaggagguguacagccacaaguucuccgaggaggccaagagcaucugcaagaugcugcugaccaaggacgccaagcagcgccucggcugccaggaggagggggccgcggaggucaagcggcaccccuucuuccgcaacaugaacuucaagcggcuggaggccggcaugcuggacccgcccuucgugcccgacccccgcgccgucuacugcaaggacgugcucgacaucgagcaguucuccaccgugaagggggucaaccuggaccacaccgacgacgacuucuacagcaaguucuccacgggcagcgugagcauccccuggcagaacgagaugaucgagaccgagugcuucaaggagcugaacguguucgggccgaacggcacccugccgcccgaccucaaccggaaccacccgcccgagccgcccaagaagggccugcugcagcgccucuucaagcggcagcaccagaacaacuccaagagcucccccagcuccaagaccagcuucaaccaccacaucaacuccaaccacgucagcuccaacagcacgggguccagcuga

SEQ ID NO: 30850 - RNA, 1683 nt, Artificial Sequence
  derived and/or modified sequence opt1 from GRK6__Homo_sapiens__NP_001004105
auggagcuggagaacaucguggccaacaccguccuccugaaggcccgcgagggcgggggcgggaaccggaagggcaagagcaagaaguggcgccagaugcugcaguucccccacaucucccagugcgaggagcuccggcugagccuggagcgcgacuaccacucccucugcgagcggcagcccaucgggcgccugcuguuccgggaguucugcgcgacccgccccgagcucagccggugcguggccuuccuggacggcguggccgaguacgaggucacgcccgacgacaagcgcaaggccugcggccggcagcugacccagaacuuccucucccacaccgggcccgaccugaucccggaggugccccgccagcuggugaccaacugcacgcagcggcucgagcagggccccugcaaggaccuguuccaggagcugacccgccucacccacgaguaccugagcgucgcccccuucgcggacuaccuggacuccaucuacuucaaccgguuccuccaguggaaguggcuggagcgccagccggugaccaagaacacguuccggcaguaccgcgugcuggggaagggcggguucggcgaggucugcgccugccaggugcgggccaccggcaagauguacgccugcaagaagcucgagaagaagcgcaucaagaagcggaagggggaggcgauggcccugaacgagaagcagauccuggagaaggugaacagccgcuucgucgugucccucgccuacgccuacgagaccaaggacgcccugugccuggugcucacccugaugaacggcggggaccugaaguuccacaucuaccacaugggccaggcgggcuuccccgaggcccgcgccgucuucuacgccgccgagaucugcugcgggcucgaggaccugcaccgggagcgcaucguguaccgggaccugaagcccgagaacauccuccuggacgaccacggccacauccgcaucagcgaccuggggcucgcggugcacguccccgagggccagacgaucaaggggcgggugggcaccgugggcuacauggccccggaggucgugaagaacgagcgcuacaccuucucccccgacuggugggcccuggggugccugcucuacgagaugaucgccggccagagccccuuccagcagcggaagaagaagaucaagcgcgaggagguggagcggcuggucaaggaggugcccgaggaguacuccgagcgcuucagcccgcaggcccggucccugugcagccagcuccugugcaaggaccccgcggagcgccuggggugccggggcggguccgcccgcgaggucaaggagcacccccucuucaagaagcugaacuucaagcggcugggcgccggcaugcuggagcccccguucaagcccgacccccaggccaucuacugcaaggacgugcucgacaucgagcaguucagcaccgugaagggggucgagcuggagcccacggaccaggacuucuaccagaaguucgccaccggcuccgugccgauccccuggcagaacgagaugguggagaccgagugcuuccaggagcugaacgucuucgggcucgacggcagcgugccgcccgaccuggacuggaaggggcagccgcccgcgccgcccaagaagggccugcuccagcgccuguucagccggcagcgcuga

SEQ ID NO: 30851 - RNA, 1662 nt, Artificial Sequence
  derived and/or modified sequence opt1 from GRK7__Homo_sapiens__NP_631948
augguggacaugggcgcccuggacaaccucaucgccaacaccgcguaccugcaggcccgcaagcccagcgacugcgacuccaaggagcugcagcggcgccggcgcagccucgcccugccggggcugcagggcugcgccgagcuccggcagaagcugucccugaacuuccacagccucugcgagcagcagcccaucgggcgccggcuguuccgcgacuuccuggccaccguccccacguuccggaaggcggccaccuuccucgaggacgugcagaacugggagcuggccgaggagggccccaccaaggacuccgcccugcaggggcucguggcgaccugcgccagcgccccggcccccggcaacccccagcccuuccugucccaggccgucgcgacgaagugccaggccgccaccaccgaggaggagcgcguggccgccgugacccuggcgaaggccgaggccauggccuuccuccaggagcagccguucaaggacuucgucacgagcgccuucuacgacaaguuccugcaguggaagcuguucgagaugcagcccguguccgacaaguacuucaccgaguuccgggugcucggcaagggcggguucggggaggucugcgcgguccaggugaagaacaccggcaagauguacgccugcaagaagcuggacaagaagcgccugaagaagaagggcggggagaagauggcccuccuggagaaggagauccuggagaaggugagcucccccuucaucgugagccucgccuacgccuucgaguccaagacccaccugugccuggugaugagccucaugaacggcggggaccugaaguuccacaucuacaacgucggcacgcgggggcuggacaugucccgcgugaucuucuacagcgcgcagaucgccugcggcaugcuccaccuccacgagcugggcaucguguaccgggacaugaagcccgagaacguccugcuggacgaccuggggaacugccgccucuccgaccugggccuggccguggagaugaagggcgggaagccgaucacccagcgggccgggaccaacggcuacauggcgcccgagauccucauggagaaggugagcuacuccuaccccgucgacugguucgccaugggcugcagcaucuacgagaugguggccgggcgcacccccuucaaggacuacaaggagaaggugagcaaggaggaccugaagcagcggacgcugcaggacgaggucaaguuccagcacgacaacuucaccgaggaggccaaggacaucugccgccucuuccuggccaagaagccggagcagcggcugggcucccgcgagaaguccgacgacccccgcaagcaccacuucuucaagaccaucaacuucccccggcucgaggcggggcugaucgagcccccguucgugcccgaccccagcgucguguacgccaaggacaucgccgagaucgacgacuucagcgaggugcgcggcgucgaguucgacgacaaggacaagcaguucuucaagaacuucgccaccggggccgugcccaucgcguggcaggaggagaucaucgagacgggccuguucgaggagcugaacgacccgaaccggcccaccggcugcgaggaggggaacuccagcaaguccggcgugugccuccugcuguga

SEQ ID NO: 30852 - RNA, 2721 nt, Artificial Sequence
  derived and/or modified sequence opt1 from GRM1__Homo_sapiens__NP_001264995
auggugggccugcuccuguucuucuuccccgccaucuuccuggaggucagccuccugccgcgcucccccgggcggaaggugcugcucgccggcgcgagcucccagcgcagcguggcccggauggacggggacgucaucaucggcgcccuguucuccgugcaccaccagccgcccgccgagaaggugcccgagcgcaagugcggggagauccgggagcaguacggcauccagcgcgucgaggccauguuccacacccuggacaagaucaacgcggaccccgugcuccugcccaacaucacccugggcagcgagauccgggacuccugcuggcacagcuccguggcccucgagcagagcaucgaguucauccgcgacucccugaucagcauccgggacgagaaggacgggaucaaccgcugccugcccgacggccagucccucccgcccgggcggacgaagaagcccaucgccggcgucaucgggcccggcagcuccagcguggccauccaggugcagaaccugcugcagcuguucgacaucccgcagaucgcguacuccgccaccagcaucgaccucuccgacaagacccuguacaaguacuuccuccgcgucgugcccagcgacacccugcaggcccgggccaugcuggacaucgugaagcgcuacaacuggacguacgucagcgccgugcacaccgagggcaacuacggggaguccggcauggacgcguucaaggagcucgccgcccaggaggggcugugcaucgcccacagcgacaagaucuacuccaacgccggcgagaaguccuucgaccggcugcuccgcaagcugcgggagcgccugcccaaggcgcggguggucgugugcuucugcgagggcaugaccgugcgcgggcuccugagcgccaugcggcgccugggcgucgugggggaguucagccucaucggcuccgacgggugggccgaccgcgacgaggugaucgagggcuacgaggucgaggccaacggcgggaucaccaucaagcugcagagccccgaggugcgguccuucgacgacuacuuccugaagcuccgccuggacacgaacacccggaacccgugguuccccgaguucuggcagcaccgcuuccagugccggcugcccggccaccuccuggagaaccccaacuucaagcgcaucugcaccgggaacgagagccuggaggagaacuacguccaggacuccaagaugggcuucgugaucaacgccaucuacgcgauggcccacgggcuccagaacaugcaccacgcccugugcccgggccacgugggccugugcgacgccaugaagcccaucgacgggagcaagcuccuggacuuccugaucaaguccagcuucaucggcgucuccggggaggaggugugguucgacgagaagggcgacgcccccgggcgguacgacaucaugaaccuccaguacaccgaggcgaaccgcuacgacuacgugcacgucggcacguggcacgagggcgugcugaacaucgacgacuacaagauccagaugaacaagagcggggugguccgguccgugugcagcgagcccugccugaagggccagaucaaggugauccgcaagggggaggucuccugcugcuggaucugcaccgccugcaaggagaacgaguacgugcaggacgaguucacgugcaaggccugcgaccugggcugguggccgaacgccgaccucaccggcugcgagcccauccccgugcgguaccuggaguggagcaacaucgagagcaucaucgcgaucgccuucuccugccuggggauccucgucacccuguucgugacccugaucuucgugcucuaccgcgacacccccgucgucaagagcuccagccgggagcugugcuacaucauccuggccggcaucuuccucggguacgugugcccguucacccugaucgccaagcccacgaccaccuccugcuaccugcagcgccuccuggugggccugagcuccgccaugugcuacagcgcgcucgugaccaagacgaaccggaucgcccgcauccuggccggguccaagaagaagaucugcacccggaagccccgcuucaugagcgccugggcccaggugaucaucgcguccauccugaucagcguccagcucacccugguggugacccugaucaucauggagccgcccaugcccauccucuccuaccccagcaucaaggaggucuaccugaucugcaacacguccaaccugggcgugguggccccgcucggcuacaacgggcugcugaucaugagcugcaccuacuacgccuucaagacccggaacguccccgccaacuucaacgaggccaaguacaucgcguucaccauguacacgaccugcaucaucuggcucgccuucgugcccaucuacuucggcuccaacuacaagaucaucacgaccugcuucgccgugagccugagcgucaccguggcccuggggugcauguucacccccaagauguacaucaucaucgcgaagccggagcgcaacgugcgcuccgccuucaccaccagcgacgucgugcggaugcacgugggcgacgggaagcuccccugccgcuccaacaccuuccugaacaucuuccggcgcaagaaggccggcgccggcaacgccaagaagcggcagcccgaguucagccccacgucccagugcccgagcgcgcacguccagcuguga

SEQ ID NO: 30853 - RNA, 2619 nt, Artificial Sequence
  derived and/or modified sequence opt1 from GRM2__Homo_sapiens__NP_000830
augggcagccugcucgcccugcuggcccuccugcugcucuggggcgcgguggccgaggggcccgccaagaagguccugacccuggagggggaccucgugcugggcgggcuguucccggugcaccagaagggcggccccgccgaggacugcgggcccgucaacgagcaccgcggcauccagcggcucgaggccaugcuguucgcgcuggaccgcaucaaccgggacccccaccuccugccgggggugcgccugggcgcccacauccucgacuccugcagcaaggacacccacgcccuggagcaggcccuggacuucgugcgggcgucccucagccgcggggccgacggcucccggcacaucugccccgacggcagcuacgccacgcacggggacgcccccaccgccaucaccggcgucaucgggggcuccuacagcgacguguccauccagguggcgaaccugcugcgccucuuccagaucccccagaucagcuacgccuccaccagcgccaagcuguccgacaagagccgguacgacuacuucgcccgcacggucccgcccgacuucuuccaggccaaggcgauggccgagauccugcgguucuucaacuggaccuacguguccaccguggccagcgagggcgacuacggggagaccggcaucgaggccuucgagcucgaggcccgcgcgcggaacaucugcgucgccacguccgagaagguggggcgcgccaugagccgggccgccuucgagggcgugguccgcgcgcugcugcagaagcccuccgcccggguggccguccucuucacccgcagcgaggacgcccgggagcugcuggcggccagccagcgccucaacgccuccuucaccuggguggccagcgacggguggggcgcccuggaguccgugguggcgggcagcgagggggccgccgagggcgccaucaccaucgagcuggccuccuaccccaucagcgacuucgcguccuacuuccagagccucgacccguggaacaacucccggaaccccugguuccgcgaguucugggagcagcgcuuccggugcagcuuccgccagcgggacugcgccgcccacucccugcgcgccguccccuucgagcaggagagcaagaucauguucguggugaacgccgucuacgcgauggcccacgcccugcacaacaugcaccgggcccucugccccaacacgacccgccugugcgacgcgaugcggccggugaacgggcgccggcuguacaaggacuucguccucaacgugaaguucgacgcccccuuccgccccgccgacacccacaacgaggugcgguucgaccgcuucggcgacgggaucggccgguacaacaucuucaccuaccugcgcgccggcuccgggcgguaccgcuaccagaaggucggcuacugggccgaggggcugacgcucgacaccagccugauccccugggcguccccgagcgccggcccccugcccgccucccggugcagcgagcccugccuccagaacgaggugaaguccgugcagccgggggaggucugcugcuggcugugcauccccugccagcccuacgaguaccgccuggacgaguucacgugcgccgacugcggccugggcuacuggcccaacgccagccucaccgggugcuucgagcugccgcaggaguacauccgguggggcgacgcgugggccguggggcccgugaccaucgccugccugggcgcccucgccacccuguucguccugggcguguucgugcgccacaacgcgacccccgucgugaaggccagcgggcgcgagcucugcuacauccugcugggcgggguguuccucugcuacugcaugaccuucaucuucaucgccaagccguccacggccgucugcacccugcggcgccugggccucgggaccgcguucagcgugugcuacuccgcccugcugaccaagacgaaccggaucgcccgcaucuucggcggcgcccgggagggggcccagcgcccccgguucaucagccccgcgucccagguggccaucugccucgcccugaucagcggccagcugcucaucgucguggccuggcugguggucgaggcccccgggaccggcaaggagaccgcgccggagcgccgggagguggugacccugcgcugcaaccaccgggacgccuccaugcucgggagccuggccuacaacguccugcucaucgcccugugcacgcuguacgccuucaagacccgcaagugccccgagaacuucaacgaggcgaaguucaucggcuucaccauguacaccacgugcaucaucuggcucgccuuccugcccaucuucuacgugaccuccagcgacuaccgggugcagaccaccaccaugugcgucuccgugagccuguccggcagcgugguccucgggugccuguucgcccccaagcugcacaucauccucuuccagccgcagaagaacguggugucccaccgcgcccccacgagccgguucggcuccgccgcggcccgcgccagcagcucccuggggcagggcagcgggucccaguucguccccaccgugugcaacggccgggagguggucgacagcaccaccuccagccuguga

SEQ ID NO: 30854 - RNA, 2640 nt, Artificial Sequence
  derived and/or modified sequence opt1 from GRM3__Homo_sapiens__NP_000831
augaagaugcugacccgccuccaggugcugacccuggcccucuucagcaagggcuuccugcugucccucggggaccacaacuuccugcggcgcgagaucaagaucgagggcgaccugguccucgggggccuguuccccaucaacgagaaggggacgggcaccgaggagugcggccggaucaacgaggaccgcgggauccagcggcuggaggccaugcuguucgcgaucgacgagaucaacaaggacgacuaccuccugccgggcgugaagcucggggugcacauccuggacacgugcagccgcgacaccuacgcccuggagcagucccucgaguucguccgggccagccugaccaagguggacgaggccgaguacaugugccccgacggcuccuacgccauccaggagaacaucccccugcucaucgcgggggugaucggcggcagcuacuccagcgucuccauccagguggccaaccugcugcgccucuuccagaucccccagaucagcuacgccuccaccagcgccaagcuguccgacaagagccgguacgacuacuucgcgcgcaccgugccgcccgacuucuaccaggccaaggccauggccgagauccugcgguucuucaacuggaccuacgucuccacgguggccagcgagggggacuacggcgagaccgggaucgaggcguucgagcaggaggcccgccuccggaacaucugcaucgccaccgccgagaaggugggccgcuccaacauccgcaagagcuacgacuccgucauccgggagcugcugcagaagcccaacgcccggguggugguccucuucaugcgcagcgacgacagccgggagcugaucgcggccgccucccgcgccaacgccagcuucaccuggguggcguccgacggcuggggcgcccaggagagcaucaucaagggguccgagcacguggccuacggggccaucacgcuggagcucgccagccagcccguccggcaguucgaccgcuacuuccagucccugaacccguacaacaaccaccgcaaccccugguuccgggacuucugggagcagaaguuccagugcagccugcagaacaagcgcaaccaccggcgcgugugcgacaagcaccucgcgaucgacuccagcaacuacgagcaggaguccaagaucauguucguggucaacgccguguacgccauggcccacgcgcugcacaagaugcagcggacccugugccccaacaccaccaagcucugcgacgccaugaagauccuggacggcaagaagcuguacaaggacuaccuccugaagaucaacuucacggcccccuucaacccgaacaaggacgccgacagcaucgugaaguucgacaccuucggggacggcaugggccgcuacaacgucuucaacuuccagaacgucgggggcaaguacuccuaccugaagguggggcacugggccgagacccucagccuggacgugaacuccauccacuggagccggaacuccgugcccaccagccagugcuccgaccccugcgcgcccaacgagaugaagaacaugcagccgggcgacgucugcugcuggaucugcauccccugcgagcccuacgaguaccuggccgacgaguucacgugcauggacugcgggagcggccaguggcccaccgccgaccucaccggcugcuacgaccugccggaggacuacauccgcugggaggacgccugggccaucgggcccgugaccaucgcgugccugggcuucaugugcacgugcaugguggucaccguguucaucaagcacaacaacacgccccuggugaaggccagcgggcgggagcucugcuacauccugcuguucggcgucgggcucuccuacugcaugaccuucuucuucaucgccaagcccagcccggugaucugcgcccugcgccggcugggccucggcuccagcuucgccaucugcuacuccgcgcugcugaccaagaccaacugcaucgcccgcaucuucgacggggugaagaacggcgcccagcggcccaaguucaucagccccuccagccaggucuucaucugccucgggcugauccuggugcagaucgugauggucuccguguggcucauccuggaggcccccggcacccgccgguacacccuggcggagaagcgcgagacggugauccucaagugcaacgucaaggacagcuccaugcugaucagccugaccuacgacgugauccucgugauccugugcaccgucuacgccuucaagacccggaagugcccggagaacuucaacgaggccaaguucaucggcuucacgauguacacgaccugcaucaucuggcuggccuuccuccccaucuucuacgugaccuccagcgacuaccgcgugcagaccaccaccaugugcaucuccgucagccuguccggguucguggugcugggcugccucuucgcccccaagguccacaucauccuguuccagccgcagaagaacguggugacccaccggcugcaccucaaccgcuucagcgucagcgggaccggcacgaccuacucccagagcuccgcgagcaccuacgugcccaccgugugcaacgggcgcgagguccuggacuccacgaccagcucccuguga

SEQ ID NO: 30855 - RNA, 2739 nt, Artificial Sequence
  derived and/or modified sequence opt1 from GRM4__Homo_sapiens__NP_000832
augcccggcaagcgcgggcugggcugguggugggcccggcucccgcugugccugcuccugagccuguacgggcccuggaugcccuccagccucggcaagcccaaggggcacccgcacaugaacuccauccgcaucgacggcgacaucacccugggcgggcuguuccccgugcacggccgggggagcgagggcaagcccugcggggagcucaagaaggagaagggcauccaccgccuggaggccaugcuguucgcgcucgaccggaucaacaacgaccccgaccugcugccgaacaucacccucggcgcccgcauccuggacacgugcucccgggacacccacgcccuggagcagagccucaccuucguccaggcccugaucgagaaggacgggaccgaggugcgcugcggcuccgggggcccgcccaucaucacgaagcccgagcggguggucggcgugaucggggccagcggcuccagcguguccaucauggucgcgaacauccugcgccucuucaagaucccgcagaucagcuacgccuccaccgcccccgaccugagcgacaacucccgguacgacuucuucagccgcguggugcccuccgacaccuaccaggcccaggcgauggucgacaucgugcgggcccugaaguggaacuacgugagcaccgucgccuccgaggggagcuacggcgagagcgggguggaggccuucauccagaagucccgcgaggacggcggcgugugcaucgcccagagcgucaagaucccccgggagccgaaggcgggggaguucgacaagaucauccgccggcuccuggagacguccaacgcccgcgccgugaucaucuucgccaacgaggacgacauccggcgcgugcuggaggccgcgcggcgcgccaaccagaccggccacuucuucuggauggggagcgacuccuggggcagcaagaucgcccccguccuccaccuggaggagguggccgagggggccgugaccauccugcccaagcgcauguccguccggggcuucgaccgcuacuucagcucccggacccucgacaacaaccgccggaacaucugguucgcggaguucugggaggacaacuuccacugcaagcugagccgccacgcccugaagaagggcucccacgugaagaagugcacgaaccgggagcgcaucgggcaggacagcgccuacgagcaggagggcaaggugcaguucgucaucgacgccguguacgccauggggcacgcgcuccacgccaugcaccgggaccugugccccggccgcgucgggcugugcccgcggauggaccccguggacggcacccagcuccugaaguacauccgcaacgugaacuucuccggcaucgccgggaaccccgucaccuucaacgagaacggcgacgcccccgggcgguacgacaucuaccaguaccagcugcgcaacgacagcgcggaguacaaggugaucggcuccuggaccgaccaccuccaccuccggaucgagcgcaugcacuggccgggcagcgggcagcagcugccccgguccaucugcagccugcccugccagcccggcgagcgcaagaagacggugaaggggaugccgugcugcuggcacugcgagcccugcaccggcuaccaguaccaggucgaccgguacacgugcaagaccugccccuacgacaugcgcccgaccgagaaccgcaccgggugccggcccauccccaucaucaagcuggaguggggcucccccugggccgugcugccccucuuccuggccguggucggcaucgccgccacccuguucguggugaucaccuucguccgcuacaacgacacgcccaucgugaaggcgagcgggcgggagcucagcuacgugcugcuggccggcaucuuccugugcuacgccaccaccuuccucaugaucgccgagcccgaccuggggaccugcucccugcgccggaucuuccucggccuggggaugagcaucuccuacgccgcgcugcucacgaagaccaaccgcaucuaccggaucuucgagcagggcaagcgcagcgucuccgcgccccgguucaucagcccggccucccagcuggccaucaccuucagccugaucucccuccagcugcugggcaucugcgugugguucguggucgaccccagccacuccgugguggacuuccaggaccagcgcacccucgacccccgguucgcccgcgggguccugaagugcgacaucagcgaccugucccucaucugccugcugggcuacagcaugcuccugauggugacgugcaccguguacgccaucaagacccgcgggguccccgagaccuucaacgaggccaagccgaucggcuucacgauguacacgaccugcaucguguggcuggccuucauccccaucuucuucgggaccucccagagcgccgacaagcucuacauccagaccaccacccugaccguguccgucagccugagcgcguccgugagccucggcaugcuguacaugcccaagguguacaucauccuguuccaccccgagcagaacgucccgaagcggaagcggucccucaaggccguggugaccgccgccacgaugagcaacaaguucacccagaagggcaacuuccgccccaacggggaggccaaguccgagcugugcgagaaccuggaggcgcccgcccucgccaccaagcagaccuacgucacguacaccaaccacgccaucuga

SEQ ID NO: 30856 - RNA, 3543 nt, Artificial Sequence
  derived and/or modified sequence opt1 from GRM5__Homo_sapiens__NP_000833
auggugcugcuccugauccugagcguccuccugcugaaggaggacgugcgcggcuccgcccagagcuccgagcggcgcguggucgcccacaugcccggggacaucaucaucggcgcccucuucagcgugcaccaccagccgaccguggacaagguccacgagcggaagugcggggccgugcgcgagcaguacggcauccagcggguggaggccaugcugcacacccuggagcgcaucaacuccgaccccacgcuccugcccaacaucacccuggggugcgagauccgggacagcugcuggcacuccgccgucgcccucgagcagagcaucgaguucauccgcgacucccugaucagcuccgaggaggaggagggccuggugcggugcguggacggcagcuccagcuccuuccgcagcaagaagcccaucgucggggugaucggcccgggguccagcuccguggcgauccagguccagaaccuccugcagcuguucaacaucccccagaucgccuacagcgccaccagcauggaccucuccgacaagacccuguucaaguacuucaugcggguggugcccagcgacgcccagcaggcgcgcgccauggucgacaucgugaagcgguacaacuggacguacguguccgccguccacaccgagggcaacuacggggagagcggcauggaggccuucaaggacauguccgccaaggagggcaucugcaucgcgcacagcuacaagaucuacuccaacgccggggagcagagcuucgacaagcugcucaagaagcugaccucccaccuccccaaggcccgcgugguggccugcuucugcgagggcaugaccguccgggggcugcugauggccaugcgccggcugggccucgcgggcgaguuccugcugcucgggagcgacggcugggccgaccgcuacgacgugacggacggguaccagcgggaggccgucggcgggaucaccaucaagcugcaguccccggacgugaagugguucgacgacuacuaccugaagcuccgccccgagaccaaccaccggaaccccugguuccaggaguucuggcagcaccgcuuccagugccgccuggagggcuucccccaggagaacagcaaguacaacaagaccugcaacuccagccugacgcucaagacccaccacgugcaggacuccaagaugggcuucgucaucaacgccaucuacagcauggccuacgggcugcacaacaugcagaugucccugugcccgggcuacgcggggcucugcgacgccaugaagcccaucgacggccggaagcugcuggagagccucaugaagaccaacuucaccgggguguccggcgacacgauccuguucgacgagaacggcgacagccccgggcgcuacgagaucaugaacuucaaggagaugggcaaggacuacuucgacuacaucaacguggggagcugggacaacggcgagcugaagauggacgacgacgaggucugguccaagaaguccaacaucauccggagcgugugcagcgagcccugcgagaaggggcagaucaaggugauccgcaagggcgaggucuccugcugcuggaccugcaccccgugcaaggagaacgaguacguguucgacgaguacacgugcaaggccugccagcucggcagcuggcccaccgacgaccugaccgggugcgaccugauccccgugcaguaccuccgguggggcgaccccgagccgaucgccgccgucguguucgcgugccuggggcugcuggccacccucuucgugaccgucguguucaucaucuaccgcgacacgcccguggucaaguccagcucccgggagcugugcuacaucauccuggccggcaucugccucggcuaccugugcaccuucugccugaucgccaagcccaagcagaucuacugcuaccuccagcgcaucgggaucggccugagccccgcgauguccuacagcgcccuggugaccaagaccaaccggaucgcccgcauccucgccggguccaagaagaagaucugcacgaagaagccgcgguucaugagcgccugcgcgcagcuggugaucgccuucauccugaucugcauccagcucggcaucaucgucgcccuguucaucauggagccgcccgacaucaugcacgacuaccccuccauccgcgagguguaccugaucugcaacaccaccaaccucgggguggucacgccccugggcuacaacggccugcucauccugagcugcaccuucuacgccuucaagacccggaacgugcccgccaacuucaacgaggcgaaguacaucgccuucaccauguacaccacgugcaucaucuggcuggccuucgugcccaucuacuucggguccaacuacaagaucaucaccaugugcuucagcgucagccucuccgccaccguggcccugggcugcauguucgugccgaaggucuacaucauccuggcgaagcccgagcgcaacgugcggagcgccuucaccaccuccacggugguccgcaugcacgugggggacggcaagagcuccagcgccgccucccggagcuccagccucgugaaccuguggaagcgccggggguccagcggcgagacccuguccagcaacggcaaguccgucaccugggcgcagaacgagaaguccagccgcgggcagcaccucuggcagcgccugagcauccacaucaacaagaaggagaaccccaaccagaccgccgugaucaagcccuucccgaaguccacggagagccggggccugggggccggcgccggggccggcggcagcgccgggggcgugggggcgaccggcggggccggcugcgccggcgccgggcccggcgggcccgagucccccgacgcgggcccgaaggcccucuacgacgucgccgaggccgaggagcacuuccccgcccccgcgcgcccccggagcccgucccccaucagcacccugucccaccgcgccggcagcgccucccggaccgacgacgacgugcccagccugcacuccgagcccguggcccgcagcuccagcucccaggggagccucauggagcagaucuccagcgucgugacgcgguucaccgcgaacaucuccgagcugaacagcaugaugcuguccaccgccgccccgagccccggcgugggggcgccccucugcagcuccuaccugauccccaaggagauccagcugccgaccacgaugaccaccuucgccgagauccagccccuccccgcgaucgaggucaccggcggggcccagcccgccgccggcgcccaggcggccggcgacgccgcccgcgagagcccggccgcggggcccgaggccgccgccgccaagcccgaccuggaggagcugguggcgcucacgccgcccucccccuuccgggacagcguggacuccggcagcaccacccccaacuccccggucagcgaguccgcccugugcauccccagcucccccaaguacgacacccugaucauccgcgacuacacgcagagcuccagcucccucuga

SEQ ID NO: 30857 - RNA, 2634 nt, Artificial Sequence
  derived and/or modified sequence opt1 from GRM6__Homo_sapiens__NP_000834
auggcccgcccccggcgcgcccgggagccgcugcucguggcgcugcugccccucgccuggcuggcccaggccggccuggcccgcgcggccgggagcguccggcucgccggcgggcugacccugggcgggcucuuccccgugcacgcccgcggcgcggccggccgggccugcgggcagcugaagaaggagcagggcgugcaccgccuggaggccaugcucuacgcccuggaccgggucaacgcggaccccgagcugcucccgggggugcgccugggcgcccggcugcucgacaccugcucccgcgacacguacgcccuggagcaggcccugagcuucgugcaggcccucauccgggggcgcggcgacggcgacgaggucggggugcggugccccggcggggugcccccccugcgcccggcgccccccgagcgggucguggccguggucggcgccuccgccagcuccgugagcaucaugguggccaacguccugcgccucuucgcgaucccccagaucuccuacgccagcaccgccccggagcuguccgacagcacccgguacgacuucuucucccgcguggugccccccgacagcuaccaggcccaggccauggucgacaucgugcgggcgcugggcuggaacuacguguccacccucgccagcgaggggaacuacggcgaguccggggucgaggccuucgugcagaucagccgcgaggccggcggggugugcaucgcgcaguccaucaagaucccccgcgagccgaagcccggcgaguucagcaaggucauccggcgccugauggagacgcccaacgcccggggcaucaucaucuucgccaacgaggacgacauccgccgggugcuggaggccgcccgccaggcgaaccucaccgggcacuuccugugggucggcuccgacagcuggggggccaagaccagccccauccugucccucgaggacguggccgugggcgccaucaccauccugccgaagcgggccagcaucgacggguucgaccaguacuucaugacgcgcucccuggagaacaaccggcgcaacaucugguucgcggaguucugggaggagaacuucaacugcaagcucaccagcuccggcacccagagcgacgacuccacccggaagugcacgggcgaggagcgcaucgggcgggacagcaccuacgagcaggagggcaagguccaguucgugaucgacgccguguacgccaucgcccacgcccugcacuccaugcaccaggcgcugugccccgggcacaccggccucugccccgccauggagcccaccgacgggcgcaugcugcugcaguacauccgggccguccgcuucaacggcagcgccggcacgccggugauguucaacgagaacggggacgcgcccggccgguacgacaucuuccaguaccaggccaccaacggguccgccagcuccggcggcuaccaggccguggggcagugggccgagacccuccgccuggacgucgaggcgcugcaguggagcggcgacccccacgaggugcccuccagccucugcucccugccgugcgggcccggcgagcggaagaagauggugaaggggguccccugcugcuggcacugcgaggccugcgacggcuaccgcuuccagguggacgaguucaccugcgaggccugcccgggcgacaugcgccccacgcccaaccacaccgggugccggcccaccccggugguccgccugagcugguccagccccugggccgcccccccccuccugcuggcggugcugggcaucguggccaccacgaccgucguggccaccuucgugcgguacaacaacaccccgaucguccgcgccagcgggcgggagcucuccuacgugcugcugacgggcaucuuccucaucuacgccaucaccuuccugaugguggcggagcccggggccgccgucugcgccgcgcgccggcuguuccucggccugggcaccacccugagcuacuccgcccuccugacgaagaccaaccgcaucuaccggaucuucgagcaggggaagcgcagcgugaccccccccccguucaucucccccaccagccagcuggugaucacguucucccucaccagccugcaggucgugggcaugaucgccuggcugggggcccggcccccccacuccgugaucgacuacgaggagcagcgcaccgucgacccggagcaggcccggggcgugcucaagugcgacaugagcgaccugucccugaucgggugccucggcuacagccugcugcucauggugaccugcaccgucuacgcgaucaaggcccgcggcgugcccgagacguucaacgaggccaagcccaucggguucaccauguacaccaccugcaucaucuggcuggccuucgugcccaucuucuucggcacggcccaguccgcggagaagaucuacauccagaccaccacccugacggucagccucucccugagcgccuccgugagccuggggaugcucuacgugccgaagaccuacgucauccuguuccaccccgagcagaacgugcagaagcggaagcgcagccugaaggccaccuccaccguggccgccccccccaagggcgaggacgcggaggcccacaaguga

SEQ ID NO: 30858 - RNA, 2748 nt, Artificial Sequence
  derived and/or modified sequence opt1 from GRM7__Homo_sapiens__NP_000835
auggugcagcugcgcaagcuccugcggguccugacccucaugaaguuccccugcugcgugcuggaggugcugcucugcgcccuggccgcggccgcccgcggccaggagauguacgccccgcacagcauccggaucgagggggacgucacccugggcggccucuuccccgugcacgccaaggggcccuccggggugcccugcggcgacaucaagcgcgagaacggcauccaccggcuggaggcgaugcuguacgcccucgaccagaucaacagcgacccgaaccugcugcccaacgucacgcucggggcccgcauccuggacacgugcucccgggacaccuacgcccuggagcagagccucaccuucgugcaggcgcugauccagaaggacaccuccgacgugcgcugcaccaacggcgagccgcccgucuucgugaagcccgagaagguggucggggugaucggcgccagcggguccagcguguccaucauggucgccaacauccugcgccucuuccagaucccccagaucagcuacgccuccaccgcccccgagcugagcgacgaccggcgguacgacuucuucucccgcguggugcccccggacagcuuccaggcgcaggccauggucgacaucgugaaggcccugggcuggaacuacguguccacccucgccagcgagggcuccuacggggagaagggcgucgagagcuucacgcagaucuccaaggaggccgggggccugugcaucgcgcagagcgugcggaucccccaggagcgcaaggaccggaccaucgacuucgaccgcaucaucaagcagcugcucgacacccccaacagccgggccguggucaucuucgccaacgacgaggacaucaagcagauccuggccgccgcgaagcgcgccgaccaggugggccacuuccugugggucggguccgacagcuggggcuccaagaucaacccccuccaccagcacgaggacaucgccgagggggccaucaccauccagccgaagcgggccacgguggagggcuucgacgcguacuucaccagccgcacccuggagaacaaccggcgcaacgugugguucgccgaguacugggaggagaacuucaacugcaagcugaccaucuccgggagcaagaaggaggacacggaccgcaagugcaccggccaggagcggaucggcaaggacuccaacuacgagcaggaggggaagguccaguucgugaucgacgccguguacgccauggcgcacgcccuccaccacaugaacaaggaccugugcgccgacuaccgcggcgucugccccgagauggagcaggccgggggcaagaagcugcucaaguacauccggaacgugaacuucaacgggagcgccggcacccccgugauguucaacaagaacggcgacgcgcccgggcgcuacgacaucuuccaguaccagaccacgaacaccuccaacccgggcuaccggcugaucgggcaguggaccgacgagcugcagcucaacaucgaggacaugcaguggggcaaggggguccgcgagauccccgccagcgugugcacccugcccugcaagcccggccagcggaagaagacgcagaagggcaccccgugcugcuggaccugcgagcccugcgacggguaccaguaccaguucgacgagaugaccugccagcacugccccuacgaccagcgccccaacgagaaccggacgggcugccaggacaucccgaucaucaagcuggaguggcacucccccugggccgugauccccgucuuccucgccaugcuggggaucaucgccaccaucuucgugauggcgaccuucauccgcuacaacgacaccccgaucgugcgggccagcggccgcgagcuguccuacguccuccugacgggcaucuuccugugcuacaucaucaccuuccucaugaucgccaagcccgacguggccgugugcagcuuccggcgcgucuuccuggggcugggcaugugcaucuccuacgccgcgcugcucaccaagaccaaccggaucuaccgcaucuucgagcaggggaagaaguccgugacggcgccccggcugaucagccccaccagccagcuggccaucaccuccagccucaucagcgugcagcugcugggcgucuucaucugguucgggguggacccgcccaacaucaucaucgacuacgacgagcacaagaccaugaaccccgagcaggcccgcggcgugcucaagugcgacaucaccgaccugcagaucaucugcucccugggcuacagcauccuccugauggucacgugcaccguguacgccaucaagacccgcggggugcccgagaacuucaacgaggccaagccgaucggcuucaccauguacacgaccugcaucgucuggcuggccuucauccccaucuucuucgggaccgcccaguccgccgagaagcucuacauccagaccacgacccugaccaucagcaugaaccuguccgcgagcguggcccucggcaugcuguacaugcccaagguguacaucaucaucuuccaccccgagcugaacguccagaagcggaagcgcuccuucaaggccguggugaccgccgccacgaugagcucccggcucagccacaagccguccgaccgccccaacggggaggcgaagaccgagcugugcgagaacgucgaccccaacagccccgccgccaagaagaaguacguguccuacaacaaccuggugaucuga

SEQ ID NO: 30859 - RNA, 2727 nt, Artificial Sequence
  derived and/or modified sequence opt1 from GRM8__Homo_sapiens__XP_006716001
auggugugcgagggcaagcgcagcgccuccugccccugcuucuuccugcucaccgccaaguucuacuggauccugaccaugaugcagcggacgcacagccaggaguacgcgcacuccauccgcgucgacggggacaucauccugggcggccucuucccggugcacgccaagggggagcgcggggugcccugcggcgagcugaagaaggagaagggcauccaccggcuggaggccaugcucuacgccaucgaccagaucaacaaggaccccgaccugcugagcaacaucacccucgggguccggauccuggacacgugcucccgcgacaccuacgcccuggagcagagccucaccuucgugcaggcgcugaucgagaaggacgccuccgacgugaagugcgccaacggcgacccgcccaucuucaccaagcccgacaagaucagcggggucaucggcgccgcggccuccagcguguccaucaugguggccaacauccugcgccucuucaagaucccccagaucagcuacgccuccaccgcccccgagcugagcgacaacacccgguacgacuucuucucccgggucgugccgcccgacagcuaccaggcgcaggccaugguggacaucgucacggcccugggguggaacuacguguccacccucgccagcgagggcaacuacggcgaguccgggguggaggccuucacccagaucagccgcgagaucggcggggucugcaucgcgcagagccagaagaucccccgggagccccgcccgggcgaguucgagaagaucaucaagcggcugcuggagacccccaacgcccgcgccgugaucauguucgccaacgaggacgacauccggcgcauccucgaggccgcgaagaagcugaaccaguccggccacuuccuguggaucgggagcgacuccuggggcagcaagaucgcccccguguaccagcaggaggagaucgccgagggggccgucacgauccuccccaagcgggccuccaucgacggcuucgaccgcuacuuccggagccgcacccuggcgaacaaccggcgcaacgugugguucgccgaguucugggaggagaacuucgggugcaagcugggcucccacggcaagcgcaacagccacaucaagaagugcaccgggcucgagcggaucgcccgcgacuccagcuacgagcaggagggcaaggugcaguucgucaucgacgccguguacuccauggcguacgcccugcacaacaugcacaaggaccugugcccgggguacaucggccucugcccccggaugagcaccaucgacgggaaggagcugcugggcuacauccgcgccgugaacuucaacggcuccgccgggacgcccgucaccuucaacgagaacggcgacgcccccgggcgguacgacaucuuccaguaccagaucaccaacaagagcaccgaguacaaggugaucggccacuggacgaaccagcuccaccugaaggucgaggacaugcagugggcgcaccgcgagcacacccacccggccuccgugugcagccugcccugcaagcccggggagcggaagaagaccgugaagggcguccccugcugcuggcacugcgagcgcugcgagggcuacaacuaccagguggacgagcucuccugcgagcugugcccgcuggaccagcggcccaacaugaaccgcaccgggugccagcucauccccaucaucaagcuggaguggcacagccccugggccguggucccgguguucguggccauccugggcaucaucgccacgaccuucgucaucgugaccuucgugcgguacaacgacacccccaucguccgcgcguccgggcgggagcucagcuacgugcugcugacgggcaucuuccucugcuacagcaucaccuuccugaugaucgccgcccccgacaccaucaucugcuccuuccgccggguguuccugggccucgggaugugcuucagcuacgccgcccugcugaccaagacgaaccgcauccaccggaucuucgagcagggcaagaaguccgucaccgcgccgaaguucaucagccccgccucccagcuggugaucaccuucagccucaucuccgugcagcugcugggggucuucgugugguucguggucgacccgccccacaucaucaucgacuacggcgagcagcgcacccucgaccccgagaaggcccgcggggugcugaagugcgacaucagcgaccugucccucaucugcagccugggcuacuccauccugcucauggugacgugcaccgucuacgccaucaagacccggggcgugcccgagaccuucaacgaggcgaagcccaucggguucaccauguacacgaccugcaucaucuggcuggccuucauccccaucuucuucggcaccgcccagagcgccgagaagauguacauccagaccacgacccugaccguguccaugagccucuccgccagcgucucccuggggaugcuguacaugccgaagguguacaucaucaucuuccaccccgagcagaacgugcagaagcgcaagcggagcuucaaggcggucgugaccgccgccacgaugcagagcaagcucauccagaagggcaacgaccgccccaacggggaggugaaguccgagcugugcgagagccuggagaccaacaccuccagcaccaagacgaccuacaucuccuacagcaaccacuccaucuga

SEQ ID NO: 30860 - RNA, 1782 nt, Artificial Sequence
  derived and/or modified sequence opt1 from GRN__Homo_sapiens__XP_005257310
auguggacccuggugagcugggucgcccucaccgccggccugguggcggggacgcgcugccccgacggccaguucugcccgguggccugcugccuggaccccgggggcgccuccuacagcugcugccggccccuccuggacaaguggcccaccacccugucccgccaccucgggggcccgugccaggucgacgcccacugcagcgccggccacuccugcaucuucaccgugagcgggacguccagcugcugccccuuccccgaggcgguggccugcggcgacgggcaccacugcugcccccggggcuuccacugcuccgccgacgggcgcagcugcuuccagcgguccggcaacaacagcgucggcgccauccagugcccggacucccaguucgagugccccgacuucagcaccugcugcgugaugguggacggguccuggggcugcugccccaugccccaggcgagcugcugcgaggaccgcguccacugcugcccgcacggggccuucugcgaccuggugcacacccggugcaucacccccacgggcacccacccccuggccaagaagcuccccgcccagcgcaccaaccgggccguggcgcuguccagcuccgucaugugcccggacgcccgcagccggugccccgacggcagcaccugcugcgagcugcccuccgggaaguacggcugcugccccaugccgaacgccacgugcugcagcgaccaccuccacugcugcccccaggacaccgugugcgaccugauccaguccaagugccugagcaaggagaacgccaccaccgaccuccugacgaagcugcccgcccacaccgugggggacgucaagugcgacauggagguguccugccccgacggcuacaccugcugccgccuccagagcggggcguggggcugcugcccguucacccaggccgugugcugcgaggaccacauccacugcugccccgccggcuucacgugcgacacccagaaggggaccugcgagcagggcccccaccagguccccuggauggagaaggccccggcccaccugucccugcccgacccccaggcgcucaagcgggacgugccgugcgacaacgugagcuccugccccagcuccgacaccugcugccagcugacgagcggggaguggggcugcugccccauccccgaggccgucugcugcuccgaccaccagcacugcugcccgcagggguacaccugcguggccgagggccagugccagcgcggcagcgagaucguggccgggcuggagaagaugcccgcccggcgcgcgucccucagccacccccgggacaucggcugcgaccagcacaccuccugccccgucgggcagaccugcugcccgagccugggcggguccugggccugcugccagcugccccacgccgugugcugcgaggaccgccagcacugcugccccgccggcuacacgugcaacgucaaggcgcggagcugcgagaaggagguggugagcgcccagcccgccaccuuccucgcccgcuccccgcacgucggcgugaaggacguggagugcggggagggccacuucugccacgacaaccagaccugcugccgggacaaccgccaggggugggccugcugccccuaccgccagggcgucugcugcgcggaccggcgccacugcugccccgccggcuuccggugcgccgcccgcgggaccaagugccugcggcgcgaggccccccggugggacgcgccgcugcgcgaccccgcccuccggcagcugcuguga

SEQ ID NO: 30861 - RNA, 654 nt, Artificial Sequence
  derived and/or modified sequence opt1 from GRPEL1__Homo_sapiens__NP_079472
auggccgcccagugcgugcgccuggcgcggcgcagccuccccgcccuggcccugucccuccggccgagcccccgccugcugugcaccgccaccaagcagaagaacuccggccagaaccucgaggaggacauggggcagagcgagcagaaggccgacccgcccgcgacggagaagacccugcuggaggagaaggucaagcucgaggagcagcugaaggagaccguggagaaguacaagcgggcccuggccgacaccgagaaccuccgccagcggucccagaagcugguggaggaggccaagcuguacggcauccaggcguucugcaaggaccuccuggaggucgccgacgugcuggagaaggccacgcagugcgugcccaaggaggagaucaaggacgacaacccccaccucaagaaccuguacgaggggcuggucaugaccgaggugcagauccagaagguguucaccaagcacggccuccugaagcugaaccccgucggggccaaguucgaccccuacgagcacgaggcccucuuccacaccccgguggagggcaaggagcccggcacgguggcgcuggucagcaaggugggguacaagcugcacggccgcacccuccggcccgcccuggugggggucgugaaggaggccuga

SEQ ID NO: 30862 - RNA, 426 nt, Artificial Sequence
  derived and/or modified sequence opt1 from GRP__Homo_sapiens__NP_001012530
augcgcggccgggagcugccccucgugcugcuggcccucguccugugccuggccccgcgcgggcgggcggugccccuccccgccggcgggggcaccgugcugaccaagauguacccccgcgggaaccacugggccgucggccaccugaugggcaagaaguccacgggggagagcagcuccgugagcgagcggggcucccucaagcagcagcugcgcgaguacauccggugggaggaggccgcccgcaaccugcucgggcugaucgaggcgaaggagaaccggaaccaccagccgccccagcccaaggcccugggcaaccagcagcccagcugggacuccgaggacagcuccaacuucaaggacguggggagcaagggcaagggcucccagcgcgaggggcggaacccgcagcucaaccagcaguga

SEQ ID NO: 30863 - RNA, 1155 nt, Artificial Sequence
  derived and/or modified sequence opt1 from GRPR__Homo_sapiens__NP_005305
auggcccugaacgacugcuuccuccugaaccuggagguggaccacuucaugcacugcaacaucagcucccacagcgccgaccuccccgucaacgacgacuggucccacccgggcauccuguacgugauccccgcgguguacggggucaucauccugaucggccucaucgggaacaucacccugaucaagaucuucugcaccgucaagagcaugcgcaacgugcccaaccuguucaucuccagccucgcccugggcgaccugcuccugcugaucacgugcgcccccguggacgccucccgguaccucgccgaccgcuggcuguucgggcggaucggcugcaagcugaucccguucauccagcucaccagcgugggcguguccgucuucacccugaccgcgcugagcgccgaccgcuacaaggccaucgugcggcccauggacauccaggccucccacgcgcucaugaagaucugccugaaggccgccuucaucuggaucaucagcaugcugcucgccauccccgaggccguguucuccgaccugcaccccuuccacgaggagagcacgaaccagaccuucaucuccugcgcgccguacccccacagcaacgagcugcaccccaagauccacuccauggccagcuuccucgucuucuacgugaucccccuguccaucaucagcguguacuacuacuucaucgccaagaaccugauccagagcgccuacaaccucccggucgaggggaacauccacgugaagaagcagaucgagucccgcaagcggcuggccaagaccgugcuggucuucgugggccucuucgcguucugcuggcugcccaaccacgugaucuaccuguaccgcagcuaccacuacuccgaggucgacaccagcaugcuccacuucgugacguccaucugcgcccggcugcuggccuucaccaacagcugcgugaaccccuucgcccucuaccugcuguccaagagcuuccgcaagcaguucaacacccagcuccugugcugccagcccgggcugaucauccggucccacagcaccggccgcuccacgaccugcaugaccagccucaaguccaccaacccgagcgucgccacguucucccugaucaacgggaacaucugccacgagcgguacguguga

SEQ ID NO: 30864 - RNA, 957 nt, Artificial Sequence
  derived and/or modified sequence opt1 from GRSF1__Homo_sapiens__NP_001091947
auggaggacgugcugaacuucuucagcgacugccgcauccggaacggcgagaacgggauccacuuccuccugaaccgcgacggcaagcggcgcggggacgcccugaucgagauggaguccgagcaggacguccagaaggcccucgagaagcaccggauguacaugggccagcgcuacguggagguguacgagaucaacaacgaggacgucgacgcgcugaugaagucccugcaggucaagagcagccccguggugaacgacgggguggugcggcuccgcggccugccguacuccugcaacgagaaggacaucgucgacuucuucgccggccugaacaucguggacaucaccuucgugauggacuaccgggggcgccggaagaccggcgaggccuacguccaguucgaggagcccgagauggccaaccaggcccuccugaagcaccgcgaggagaucgggaaccgguacaucgagaucuuccccagccgccggaacgaggugcgcacgcacgugggcuccuacaaggggaagaagaucgcgagcuuccccaccgccaaguacaucaccgagccggagauggucuucgaggagcacgaggugaacgaggacauccagcccaugaccgccuucgaguccgagaaggagaucgagcugcccaaggaggugcccgagaagcucccggaggccgcggacuucggcacgaccagcucccugcacuucguccacaugcggggccugcccuuccaggccaacgcccaggacaucaucaacuucuucgcgccccucaagcccgugcgcaucaccauggaguacagcuccagcgggaaggccaccggcgaggccgacgugcacuucgagacgcacgaggacgccgucgccgccaugcugaaggaccggucccacgugcaccaccgcuacaucgagcuguuccucaacagcugcccgaaggggaaguga

SEQ ID NO: 30865 - RNA, 873 nt, Artificial Sequence
  derived and/or modified sequence opt1 from GRXCR1__Homo_sapiens__NP_001073945
augcugaagcgcgagaugaagcccgagagcgaccggccgcgcaaggugcgguuccgcaucgccuccagccacuccggccggguccucaaggagguguacgaggacgggcagcccagcggcucccuggacagcgagugcgccuccaucugcgggaucgacggccugggggacagcgacggccagcagaacggccacaucgaguccgagggggacgagaacgagaacgaccaggacagccuccuggugcuggcgcgcgccgccuccgagaagggcuucgggacccggcgcgucaacauccucagcaagaacggcaccgugcgcggggugaaguacaaggucuccgccggccaggcccuguucaacaaccugacgaaggugcuccagcagcccagcaccgaccuggaguucgaccggguggucaucuacacgaccugccugcggguggugcgcaccaccuucgagcggugcgagcucguccgcaagaucuuccagaaccaccgggugaaguucgaggagaagaacaucgcgcugaacggcgaguacgggaaggagcuggacgagcgcugccggcgcguguccgaggcccccagccucccggucguguucaucgacggccacuaccucgggggcgccgagaagauccuguccaugaacgagagcggcgagcugcaggacauccugaccaagaucgagcgggugcagcacccccacgagugccccuccugcgggggcuucggguuccugcccugcagcgucugccacggcagcaagauguccauguuccgcaacugcuucaccgacagcuucaaggcccucaagugcacggcgugcaacgagaacgggcugcagcggugcaagaacugcgccggcuga

SEQ ID NO: 30866 - RNA, 747 nt, Artificial Sequence
  derived and/or modified sequence opt1 from GRXCR2__Homo_sapiens__XP_011535976
auggaggaccccgagaagaagcugaaccagaaguccgacggcaagccgcgcaaggugcgguucaagaucagcagcuccuacagcgggcgcguccucaagcaggucuucgaggacggccaggagcuggagucccccaaggaggaguacccccacagcuuccugcaggagucccucgagaccauggacgggguguacggcagcggggaggugccccggccgcagaugugcucccccaagcugaccgcccagcgcaucagcguguuccgggagggcaacgccuacacgcuggcgggcgggcagccccgcuucaacgacuacaaggccaacgaccacaagccccucccgaucaucgacuucggcaagaucaucaucuacaccaacaaccugaagaucauccggacccccauggacaagcgcgacuucgugcggaagauccugcagaaggaggaggaggccgaggaggagucccucaugaacaaggaggagagcuacgggggccgcgaccagcacgaccggccccuggucgaggccgaguccacccugccccagaaccgcuacacgcaggagggggacaucccggaggacagcugcuuccacugccggggcuccggcagcgcgaccugcucccucugccacgggagcaaguucuccaugcuggccaaccgcuucaaggagagcuaccgggcccugcgcugccccgccugcaacgagaacggccuccagcccugccagaucugcaaccaguga

SEQ ID NO: 30867 - RNA, 618 nt, Artificial Sequence
  derived and/or modified sequence opt1 from GSC2__Homo_sapiens__NP_005306
auggccgccgcggccggcggggccgccagccgccggggcgccgggcgccccugcccguucuccaucgagcacauccugagcucccuccccgagcggagccugcccgcgcgcgccgccugcccgccccagcccgccggccggcagucccccgcgaagcccgaggagccgggggcccccgaggccgcccccugcgccugcugcugcugcugcggcccccgcgcggccccgugcggcccgcccgaggccgccgccgggcugggcgcgcggcucgccuggccccugcgccuggggcccgccgugccccucagccugggcgcccccgccgggggcuccggcgcgcugcccggggccgucggcccggggagccagcggcgcacccggcgccaccggaccaucuucuccgaggagcagcuccaggcccuggaggcccuguucgugcagaaccaguaccccgacgugagcacgcgcgagcggcucgccggccgcauccggcugcgcgaggagcgggucgaggugugguucaagaaccgccgggcgaaguggcgccaccagaagcgcgccuccgccagcgcccggcugcuccccggcgugaagaagucccccaaggggagcugcuga

SEQ ID NO: 30868 - RNA, 774 nt, Artificial Sequence
  derived and/or modified sequence opt1 from GSC__Homo_sapiens__NP_776248
augcccgccagcauguucuccaucgacaacauccuggccgcgcgcccgcggugcaaggacagcgugcuccccgucgcccacuccgccgccgcccccgugguguuccccgcgcugcacggcgacagccuguacggggccuccggcggggccagcuccgacuacggcgccuucuacccgcgccccgucgcgcccgggggcgccggccuccccgccgccgugagcgggucccggcugggcuacaacaacuacuucuacgggcagcugcacgugcaggccgcgccggucggccccgccugcugcggggccgugccgccccucggcgcccagcagugcagcugcgugcccaccccgcccggcuacgaggggcccggcuccguccuggugagccccgugccccaccagaugcugcccuacaugaacgucgggacccucucccgcacggagcugcagcugcucaaccagcugcacugccggcgcaagcggcgccaccggaccaucuucaccgacgagcagcuggaggcccucgagaaccuguuccaggagaccaaguaccccgacgugggcacgcgcgagcagcuggcgcggaaggugcaccuccgcgaggagaaggucgaggugugguucaagaaccggcgcgccaaguggcggcgccagaagcggagcuccagcgaggaguccgagaacgccgagaaguggaacaagaccagcuccagcaaggccagcccggagaagcgcgaggaggagggcaaguccgaccuggacagcgacuccuga

SEQ ID NO: 30869 - RNA, 1338 nt, Artificial Sequence
  derived and/or modified sequence opt1 from GSDMA__Homo_sapiens__XP_006721895
augaccauguucgagaacgugacccgcgcccuggcccggcagcucaacccccgcggcgaccugacgccgcuggacagccucaucgacuucaagcgguuccaccccuucugccugguccugcgcaagcggaaguccacccucuucuggggcgcgcgcuacgugcggaccgacuacacccugcuggacgugcucgagcccgggagcucccccagcgacccgacggacaccgggaacuucggcuucaagaacaugcuggacacccgcgucgagggggacguggacgugcccaagaccgucaaggugaagggcacggccggccugucccagaacagcacccucgaggugcagacccuguccgucgcccccaaggcccuggagaccgugcaggagcggaagcucgccgcggaccaccccuuccugaaggagaugcaggaccagggggagaaccuguacguggucauggaggugguggagacgguccaggaggugacccucgagcgcgccggcaaggccgaggccugcuucagccugccguucuucgcgccccuggggcuccagggcuccaucaaccacaaggaggccgugaccauccccaaggggugcguccuggccuuccgggugcgccagcugauggugaagggcaaggacgagugggacaucccccacaucugcaacgacaacaugcagaccuucccgcccggcgagaaguccggggaggagaaggucauccucauccaggccagcgacgugggcgacgugcacgagggguuccggacgcugaaggaggagguccagcgcgagacccagcaggucgagaagcugagccgggugggccaguccagccuccuguccagccuguccaagcuccugggcaagaagaaggagcugcaggaccucgagcuggcccuggagggggcgcucgacaagggccacgaggugacccuggaggcccugcccaaggacgugcuccugagcaaggaggccgucggggccauccuguacuucgugggcgcccucaccgagcuguccgaggcgcagcagaagcugcucgucaagagcauggagaagaagauccugcccgugcagcugaagcucguggagagcacgauggagcagaacuuccugcuggacaaggaggggguguucccgcugcagcccgagcuccuguccagccugggcgacgaggagcucacccugaccgaggcccuggucggccucuccgggcuggaggugcagcgcagcggcccccaguacaugugggaccccgacacccugccgcggcucugcgcccuguacgccgggcugucccuccugcagcagcugacgaaggccagcuga

SEQ ID NO: 30870 - RNA, 1251 nt, Artificial Sequence
  derived and/or modified sequence opt1 from GSDMB__Homo_sapiens__XP_011523318
auguucagcguguucgaggagaucacccgcaucgucgugaaggagauggacgccggcggggacaugaucgccgugcggucccuggucgacgcggaccgcuuccggugcuuccaccucgugggcgagaagcgcaccuucuucgggugccggcacuacacgaccggccugacccugauggacauccucgacaccgacggggacaaguggcuggacgagcuggacagcggccuccagggccagaaggccgaguuccagauccuggacaacguggacuccacgggggagcugaucguccgccuccccaaggagaucaccaucagcggcuccuuccagggguuccaccaccagaagaucaagaucagcgagaaccggaucucccagcaguaccuggccacccuggagaaccgcaagcucaagcgggagcugccguucagcuuccgcuccaucaacacccgggagaaccuguaccucgugacggagacccuggagaccgugaaggaggagacccucaagagcgaccgccaguacaaguucuggucccagaucagccagggccaccuguccuacaagcacaaggggcagcgggaggucacgaucccgcccaaccgcgugcugagcuaccgggugaagcagcuggucuuccccaacaaggagaccaugaacauccacuuccgcggcaagaccaaguccuuccccgaggagaaggacggcgccagcuccugccucggcaagagccugggguccgaggacagccggaacaugaaggagaagcuggaggacauggagagcgugcucaaggaccugaccgaggagaagcgcaaggacgugcugaacucccucgccaagugccuggggaaggaggacauccggcaggaccuggagcagcgcgucagcgaggugcucaucuccggcgagcugcacauggaggaccccgacaagccccugcucagcucccuguucaacgcggccggcgugcuggucgaggcccgggccaaggcgauccucgacuuccuggacgcccugcucgagcugagcgaggagcagcaguucguggccgaggcccuggagaaggggacgcucccccugcugaaggaccaggugaaguccgucauggagcagaacugggacgagcucgccagcuccccgcccgacauggacuacgaccccgaggcgcgcauccugugcgcccuguacgugguggucagcauccuccuggagcuggccgagggccccaccuccgugagcuccuga

SEQ ID NO: 30871 - RNA, 1527 nt, Artificial Sequence
  derived and/or modified sequence opt1 from GSDMC__Homo_sapiens__NP_113603
augcccagcaugcuggagcgcaucuccaagaaccucgugaaggagaucggcagcaaggaccugaccccggucaaguaccugcucuccgccaccaagcugcggcaguucgugauccugcgcaagaagaaggacagccgguccagcuucugggagcaguccgacuacgugcccgucgaguucagccucaacgacauccuggagcccuccagcuccgugcuggagacgguggucaccgggcccuuccacuucagcgacaucaugauccagaagcacaaggccgacaugggcgugaacguggggaucgaggucuccgugagcggcgaggcguccguggaccacgggugcagccucgaguuccagaucgucaccaucccgucccccaaccuggaggacuuccagaagcgcaagcugcucgaccccgagcccagcuuccugaaggagugccggcgccggggcgacaaccuguacguggugaccgaggccgucgagcucaucaacaacacggugcuguacgacuccagcagcgugaacauccugggcaagaucgcccucuggaucaccuacgggaagggccaggggcagggcgagucccugcgcgucaagaagaaggcccugacccuccagaaggggauggugauggccuacaagcggaagcagcuggugaucaaggagaaggcgauccugaucagcgacgacgacgagcagcgcaccuuccaggacgaguacgagaucuccgagauggucggcuacugcgccgcccggagcgagggccuccugccguccuuccacacgaucagccccacccuguucaacgccuccagcaacgacaugaagcucaagcccgagcuguuccugacccagcaguuccucuccgggcaccuccccaaguacgagcagguccacauccugccggugggccgcaucgaggagcccuucuggcagaacuucaagcaccuccaggaggagguguuccagaagaucaagacccuggcgcagcugagcaaggacgugcaggacgucauguucuacuccauccuggccaugcugcgggaccgcggggcccugcaggaccucaugaacaugcuggagcuggacagcuccggccaccucgacggccccgggggcgccauccugaagaagcugcagcaggacagcaaccacgccugguucaaccccaaggacccgauccucuaccugcuggaggcgaucauggugcucuccgacuuccagcacgaccugcuggccugcagcauggagaagcggauccugcuccagcagcaggagcuggugcgcuccauccuggagcccaacuuccgguaccccuggagcauccccuucacgcucaagccggagcugcuggcgccccuccaguccgaggggcuggccaucaccuacggccugcucgaggagugcgggcugcgcauggagcuggacaacccccggagcaccugggacgucgaggccaagaugccccucagcgcccuguacggcacccugucccuccugcagcagcuggccgaggccuga

SEQ ID NO: 30872 - RNA, 1455 nt, Artificial Sequence
  derived and/or modified sequence opt1 from GSDMD__Homo_sapiens__NP_079012
augggcagcgccuucgagcgcgugguccggcgcguggugcaggagcuggaccacgggggcgaguucauccccgucaccucccuccagagcuccaccggguuccagccguacugccugguggugcggaagcccagcuccagcugguucuggaagccccgcuacaagugcgucaaccuguccaucaaggacauccucgagcccgacgccgcggagccggacgugcagcggggccgcagcuuccacuucuacgacgccauggacgggcagauccagggcuccguggagcuggccgcccccggccaggccaagaucgccgggggcgccgccgucagcgacuccagcuccaccagcaugaacguguacucccugagcguggaccccaacaccuggcagacccuccugcacgagcggcaccuccgccagcccgagcacaagguccuccagcagcugcggucccgcggggacaacguguacguggucaccgaggugcugcagacgcagaaggagguggaggucacccggacccacaagcgcgagggcagcgggcgguucucccucccgggcgcgaccugccugcagggcgaggggcagggccaccugagccagaagaagacggugaccauccccagcggguccacccucgcguuccgcguggcccagcuggucaucgacagcgaccuggacgugcuccuguuccccgacaagaagcagcggaccuuccagcccccggccacgggccacaagcgcuccaccagcgagggcgccuggccccagcugcccuccgggcucagcaugaugcggugccugcacaacuuccugaccgacggcgugcccgccgagggggcguucaccgaggacuuccagggccuccgcgccgaggucgagacgaucuccaaggagcuggagcugcucgaccgggagcugugccagcugcuccuggaggggcuggagggcgugcuccgcgaccagcuggcccugcgggcccucgaggaggcccuggagcagggccagagccuggggccggucgagccccucgacggccccgcgggggccgugcuggagugccuggugcucuccagcggcaugcugguccccgagcuggccaucccggugguguaccuccugggggcccugaccaugcucuccgagacccagcacaagcugcuggccgaggcgcuggagagccagacccuccugggcccccuggagcucgucggcucccugcuggagcagagcgcccccuggcaggagcgcuccacgaugagccugcccccggggcugcugggcaacuccuggggcgagggggcccccgccugggugcuccuggacgagugcgggcuggagcucggcgaggacacgccccacgugugcugggagccccaggcccagggccgcaugugcgcgcuguacgccagccuggcccuccuguccgggcugagccaggagccgcacuga

SEQ ID NO: 30873 - RNA, 3342 nt, Artificial Sequence
  derived and/or modified sequence opt1 from GSE1__Homo_sapiens__NP_001127945
augggccccaucaucgugccgcccgggggccacuccgugcccuccacgccgcccguggugaccaucgcccccacgaagaccgucaacgggguguggcgcuccgagucccggcaggacgccggcagccgcuccagcuccgggggccgggagcgccugaucguggagccgccccugccccaggagaaggcgggcgggcccgccauccccagccaccuccuguccacccccuaccccuucggccugagccccuccagcgucgugcaggacucccgguucccgccccugaaccugcagcgccccgugcaccacgucgugccgcccagcaccgugaccgaggacuaccuccgguccuuccgccccuaccacaccaccgacgaccugcggaugagcucccugccgccccucgggcuggaccccgccaccgccgccgccuacuaccaccccagcuaccuggcgccccaccccuucccccaccccgccuuccgcauggacgacuccuacugccucagcgcccugcggagccccuucuaccccauccccacgcccggcucccugccgccccugcaccccagcgccaugcaccuccaccuguccgggguccgcuacccgcccgagcucagccacuccagccuggccgcccugcacuccgagcggaugagcggccucuccgccgagcgccugcagauggacgaggagcugcggcgcgagcgggagcgcgagcgggagcgcgagcgggagcgcgaggccgaccgcgagcgggagaaggagcgcgagcgggagcgcgagaaggagcgggagcaggagaaggagcgcgagcgggagaaggagcgcgagcgggagcucgagcgccagcgggagcagcgcgcgcgggagaaggagcugcuggccgccaaggcccucgagcccagcuuccugcccguggccgagcugcacggccuccgcgggcacgcgaccgaggagcggggcaagcccuccgagcagcugacccccacccgcgccgagaagcugaaggacgccgggcuccaggcccccaagcccgugcagcacccccugcaccccguccccacgccccaccacaccgugcccagccugaucuccaaccacggcaucuucagccuccccuccagcuccgccgcgaccgcccugcugauccagcggaccaacgaggaggagaaguggcucgcccgccagcggcgccugcgccaggagaaggaggaccggcagagccagguguccgaguuccgccagcagguccuggagcagcaccucgacaugggccggccgcccgugcccgccgaggccgagcaccgccccgagagcacgacccggcccgggcccaaccgccacgagcccggcgggcgggacccgccccagcacuucggcgggccgccgccccugaucagccccaagccgcagcugcacgcggcccccaccgcccucuggaaccccgugucccugauggacaacacccuggagacgcgccgggccgagagccacucccuccacagccaccccgcggccuucgagccgucccgccaggccgccgucccccuggugaagguggagcgggucuucugccccgagaaggccgaggagggcccccgcaagcgggagccggcgccccuggacaaguaccagccgcccccgcccccgccccgcgagggcgggagccuggagcaccagcccuuccuccccggccccgggcccuuccuggccgagcuggagaaguccacccagaccauccucggccagcagcgggccagccugccgcaggccgccaccuucggggagcuguccggcccccucaagcccggcagccccuaccgcccgcccgugccccgggcgccggaccccgccuacaucuacgacgaguuccugcagcagcgccggcgccuggucuccaagcucgaccuggaggagcggcgccgccgggaggcccaggagaagggguacuacuacgaccuggacgacagcuacgacgaguccgacgaggaggaggugcgcgcccaccuccggugcguggccgagcagccgccccugaagcuggacacgagcuccgagaagcucgaguuccugcagcuguucggccucaccacccagcagcagaaggaggagcuggucgcgcagaagcgccggaagcgccggcgcaugcugcgggagcgcagcccgagcccgcccaccauccagagcaagcggcagacgcccagcccgcgccucgcccuguccacccgguacagccccgacgagaugaacaacucccccaacuucgaggagaagaagaaguuccugaccaucuucaaccucacccacaucagcgccgagaagcgcaaggacaaggagcggcugguggagaugcugcgcgccaugaagcagaaggcgcucuccgccgccguggccgacagccugacgaacagcccccgggacagcccggccgucucccugagcgagcccgcgacccagcaggccucccucgacguggagaagcccgugggggucgccgccagccuguccgacauccccaaggccgcggagccgggcaagcuggagcagguccgcccccaggagcucagccgggugcaggagcuggcccccgccuccggggagaaggcccgccugagcgaggcccccggcggcaagaagucccucagcaugcugcacuacauccgcggggcggccccgaaggacauccccgucccccugucccacagcaccaacggcaagagcaagcccugggagccguucguggccgaggaguucgcccaccaguuccacgaguccgugcuccagagcacccagaaggcgcugcagaagcacaagggguccgucgccgugcugagcgccgagcagaaccacaagguggacacguccguccacuacaacauccccgagcuccagagcuccagccgggcgccgccgccccagcacaacggccagcaggagccgcccaccgcccgcaagggcccgcccacccaggagcuggaccgggacuccgaggaggaggaggaggaggacgacgaggacggggaggacgaggaggaggugcccaagcgcaaguggcagggcaucgaggcgguguucgaggccuaccaggagcacaucgaggagcagaaccuggagcggcagguccuccagacccagugccgccggcuggaggcccgccacuacagccugucccucaccgccgagcagcugagccacuccguggccgagcugcggagccagaagcagaagaugguguccgagcgcgagcggcuccaggcggagcuggaccaccuccgcaagugccucgcccugcccgccaugcacuggccccggggguaccugaagggcuacccccgcuga

SEQ ID NO: 30874 - RNA, 996 nt, Artificial Sequence
  derived and/or modified sequence opt1 from GSG1L__Homo_sapiens__NP_001103233
augaagaccagccgccggggccgcgcccugcucgccguggcgcugaaccugcucgcccugcuguucgccaccacggccuuccucaccacccacuggugccaggggacccagcggguccccaagccgggcugcgggcagggcgggcgcgccaacugccccaacuccggcgcgaacgccacggccaacggcaccgccgcgcccgccgccgccgccgcggccgccaccgccagcgggaacggcccgcccgggggcgcccuguacuccugggagaccggggacgaccgguuccuguuccgcaacuuccacacgggcaucugguacagcugcgaggaggagcucuccggccugggggagaagugccggagcuucaucgaccuggcgcccgccuccgagaagggcgugcucuggcugagcguggucuccgaggugcuguacauccuccugcugguggucggguucagccucaugugccuggagcuguuccacuccagcaacgugaucgacggccucaagcugaacgccuucgccgccguguucaccguccuguccggccuccuggggaugguggcgcacaugauguacacccagguguuccaggucaccgugagccugggccccgaggacuggcgcccccacuccugggacuacggguggagcuucugccucgccuggggcuccuucacgugcugcauggccgccagcgugaccacccugaacuccuacaccaagacggucaucgaguuccggcacaagcgcaagguguucgagcagggguaccgggaggagccgaccuucaucgaccccgaggccaucaaguacuuccgcgagcggauggagaagcgcgacggcagcgaggaggacuuccaccuggacugccggcacgagcgcuaccccgcgcggcaccagccccacauggccgacagcuggccgcgcuccagcgcccaggaggcccccgagcucaaccggcagugcugggugcugggccacugggucuga

SEQ ID NO: 30875 - RNA, 1452 nt, Artificial Sequence
  derived and/or modified sequence opt1 from GSK3A__Homo_sapiens__NP_063937
augagcggcgggggccccuccgggggcgggccgggcggcagcgggcgcgcccggaccuccagcuucgccgagcccggcgggggcgggggcggcgggggcgggggccccggcggguccgcgagcggccccgggggcaccgggggcggcaaggccuccgugggggccaugggcgggggcgucggggccagcuccagcggcggcgggccgggcggguccggcgggggcggcagcgggggccccggggccggcacguccuucccgccgcccggcgugaagcuggggcgcgacagcggcaaggugaccaccgucguggcgacccucgggcagggccccgagcggucccaggagguggccuacacggacaucaaggucaucgggaacggcagcuucggcgugguguaccaggcccgccuggccgagacccgggagcuggucgcgaucaagaaggugcuccaggacaagcgcuucaagaaccgggagcugcagaucaugcgcaagcuggaccacugcaacaucgugcggcuccgcuacuucuucuacuccagcggggagaagaaggacgagcuguaccugaaccucguccuggaguacgugcccgagaccguguaccgggucgcccgccacuucaccaaggccaagcugacgauccccauccucuacgugaagguguacauguaccagcuguuccggucccuggccuacauccacagccagggcgucugccaccgcgacaucaagccccagaaccuccugguggaccccgacaccgccgugcugaagcucugcgacuucgggagcgcgaagcagcugguccggggcgagcccaacguguccuacaucugcagccgcuacuaccgggcccccgagcugaucuucggggccaccgacuacaccuccagcaucgacgugugguccgccggcugcguccucgccgagcugcugcucggccagccgaucuuccccggggacagcggcguggaccagcuggucgagaucaucaaggugcuggggacgcccacccgcgagcagauccgggagaugaaccccaacuacaccgaguucaaguucccgcagaucaaggcgcaccccuggaccaagguguucaagucccgcacgccgcccgaggccaucgcccucugcagcucccugcuggaguacacccccagcucccggcucagcccccuggaggccugcgcccacuccuucuucgacgagcugcgcugccucggcacccagcugcccaacaaccgcccccugccgccccucuucaacuucagcgcgggggagcuguccauccagcccagccugaacgccauccucaucccgccccaccuccggucccccgccggcaccacgacccugacccccagcucccaggcccugaccgagacgccgaccagcagcgacuggcaguccaccgacgccacccccacgcugaccaacagcuccuga

SEQ ID NO: 30876 - RNA, 1263 nt, Artificial Sequence
  derived and/or modified sequence opt1 from GSK3B__Homo_sapiens__NP_001139628
augagcggccgcccccggaccaccuccuucgccgagagcugcaagcccgugcagcagcccuccgccuucgggagcaugaaggucucccgcgacaaggacggcagcaaggugacgaccguggucgcgacccccgggcagggccccgaccggccgcaggagguguccuacaccgacacgaaggugaucgggaacggcagcuucggcgucguguaccaggccaagcugugcgacuccggggagcucguggccaucaagaagguccugcaggacaagcgcuucaagaaccgggagcugcagaucaugcgcaagcucgaccacugcaacaucgugcggcugcgcuacuucuucuacagcuccggcgagaagaaggacgagguguaccugaaccucguccuggacuacgugcccgagaccguguaccgggucgcccgccacuacagccgggccaagcagacccugcccgugaucuacgugaagcucuacauguaccagcuguuccgcucccuggcguacauccacagcuucgggaucugccaccgggacaucaagccccagaaccuccugcuggacccggacaccgccguccucaagcugugcgacuucggcuccgccaagcagcuggugcgcggggagcccaacgugagcuacaucugcucccgguacuaccgcgcccccgagcucaucuucggcgcgacggacuacaccagcuccaucgacgucuggagcgccggcugcgugcuggccgagcugcuccuggggcagcccaucuucccgggcgacagcgggguggaccagcuggucgagaucaucaaggugcucggcacccccacccgggagcagauccgcgagaugaaccccaacuacacggaguucaaguucccccagaucaaggcccacccguggaccaaggucuuccggccccgcaccccgcccgaggccaucgcgcugugcucccggcugcucgaguacacccccacggcccgccugacgccccuggaggccugcgcccacagcuucuucgacgagcuccgcgaccccaacgugaagcugcccaacggccgggacaccccggcccuguucaacuucaccacccaggagcucuccagcaacccgccccuggcgaccauccugaucccgccccacgcccgcauccaggccgccgccuccacccccaccaacgcgacggccgccagcgacgccaacaccggggaccggggccagaccaacaacgccgcguccgccagcgccuccaacagcaccuga

SEQ ID NO: 30877 - RNA, 2349 nt, Artificial Sequence
  derived and/or modified sequence opt1 from GSN__Homo_sapiens__NP_000168
auggcgccccaccgcccggcccccgcccugcucugcgcccugagccuggcccucugcgcccugucccugcccgugcgggccgcgaccgccagccgcggcgccucccaggccggggcgccccagggccgggucccggaggcccgccccaacagcauggugguggagcaccccgaguuccucaaggccgggaaggagcccggccugcagaucuggcgggucgagaaguucgaccuggugccggugcccaccaaccucuacggggacuucuucacgggcgacgccuacgucauccugaagaccgugcagcugcgcaacggcaaccuccaguacgaccugcacuacuggcuggggaacgagugcucccaggacgagagcggcgccgcggccaucuucaccgugcagcucgacgacuaccugaacgggcgggccguccagcaccgcgaggugcagggcuucgaguccgccaccuuccugggguacuucaagagcggccucaaguacaagaagggcgggguggccuccggcuucaagcacgucgugcccaacgagguggucgugcagcggcuguuccaggugaaggggcgccgggucgugcgcgcgacggaggugcccgucagcugggaguccuucaacaacggcgacugcuucauccuggaccucggcaacaacauccaccaguggugcgggagcaacuccaaccgguacgagcgccugaaggccacccaggugagcaagggcauccgggacaacgagcgcuccgggcgggcccgcgugcacgucagcgaggagggcaccgagccggaggccaugcuccaggugcuggggcccaagcccgcccugcccgcgggcaccgaggacacggccaaggaggacgccgccaaccggaagcuggccaagcucuacaaggucuccaacggcgcggggaccaugagcgugucccugguggccgacgagaacccguucgcccagggcgcccugaaguccgaggacugcuucauccucgaccacgggaaggacggcaagaucuucgucuggaaggggaagcaggcgaacaccgaggagcgcaaggccgcccugaagaccgccagcgacuucaucacgaagauggacuaccccaagcagacccagguguccgugcugcccgagggcggcgagacgccccucuucaagcaguucuucaagaacuggcgggacccggaccagaccgacgggcugggccugagcuaccucuccagccacaucgccaacgucgagcgcgugcccuucgacgcggccacccugcacaccuccaccgccauggccgcccagcacgggauggacgacgacggcaccgggcagaagcagaucuggcgcaucgagggcagcaacaaggugcccgucgaccccgcgacguacggccaguucuacgggggcgacuccuacaucauccuguacaacuaccggcacgggggccgccagggccagaucaucuacaacuggcagggggcccagagcacccaggacgagguggccgccuccgccauccucaccgcgcagcuggacgaggagcugggcgggaccccggugcagagccgggucgugcagggcaaggagcccgcccaccucaugucccuguucgggggcaagcccaugaucaucuacaagggcgggacgagccgcgagggcgggcagaccgcccccgccuccacccggcuguuccaggugcgcgcgaacagcgccggcgccacccgggccgucgaggugcucccgaaggccggggcgcugaacuccaacgacgccuucgugcugaagacgcccagcgccgccuaccucugggucggcaccggcgccuccgaggcggagaagaccggggcccaggagcugcugcgcgugcugcgggcccagcccgugcaggucgccgagggcagcgagccggacggguucugggaggcccucggcgggaaggcggccuaccgcaccagcccccggcugaaggacaagaagauggacgcccacccgccccgccuguucgccugcagcaacaagaucggccgguucgugaucgaggaggugcccggcgagcucaugcaggaggaccuggcgacggacgacgucaugcugcucgacaccugggaccagguguucgugugggucgggaaggacagccaggaggaggagaagaccgaggcccugaccuccgccaagcgcuacaucgagacggaccccgccaaccgggaccgccggacccccaucaccguggugaagcagggcuucgagcccccgagcuucgucgggugguuccugggcugggacgacgacuacugguccguggacccccucgaccgcgccauggcggagcuggccgccuga

SEQ ID NO: 30878 - RNA, 1911 nt, Artificial Sequence
  derived and/or modified sequence opt1 from GSPT1__Homo_sapiens__NP_001123478
auggaccccggcagcgggggcgggggcgggggcggcgggggcgggggcagcagcagcgggagcuccagcuccgacagcgccccggacugcugggaccaggccgacauggaggcgcccggccccggccccugcgggggcgggggcucccuggccgccgccgccgaggcgcagcgcgagaaccucagcgccgccuucucccggcagcugaacgugaacgccaagccguucguccccaacgugcacgcggccgaguucgugcccagcuuccugcgcggccccgccgccccgcccccgcccgccgggggcgcggccaacaaccacggggccggcuccggggccggcggccgggccgcgcccgucgagagcucccaggaggagcagagccucugcgagggguccaacagcgccguguccauggagcugagcgagcccaucgagaacggcgagaccgagaugagccccgaggaguccugggagcacaaggaggagaucagcgaggccgagcccgggggcgggucccugggcgacggccgcccgcccgaggagagcgcccacgagaugauggaggaggaggaggagauccccaagcccaaguccguggucgccccgcccggggcgcccaagaaggagcacgugaacguggucuucaucggccacguggacgccgggaaguccaccaucggcgggcagaucauguaccucacgggcaugguggacaagcggacccuggagaaguacgagcgcgaggccaaggagaagaaccgggagaccugguaccugagcugggcccucgacaccaaccaggaggagcgcgacaagggcaagacggucgagguggggcgggccuacuucgagaccgagaagaagcacuucaccauccuggacgcgcccggccacaagagcuucgugccgaacaugaucgggggcgccucccaggccgaccuggccguccucgugaucagcgcgcgcaagggcgaguucgagaccggguucgagaagggcgggcagacgcgggagcacgccaugcuggccaagaccgccggcgugaagcaccugaucguccucaucaacaagauggacgaccccaccgugaacugguccaacgagcgcuacgaggagugcaaggagaagcuggugcccuuccugaagaaggucggguucaaccccaagaaggacauccacuucaugccgugcagcggccucaccggcgccaaccugaaggagcaguccgacuucugccccugguacaucgggcugcccuucaucccguaccucgacaaccugcccaacuucaaccggagcguggacggccccauccgccugcccaucguggacaaguacaaggacauggggacggucgugcucggcaagcuggaguccgggagcaucugcaagggccagcagcuggucaugaugccgaacaagcacaacguggaggugcucggcauccuguccgacgacgucgagaccgacaccguggcgcccggggagaaccugaagauccggcucaagggcaucgaggaggaggagauccugcccggguucauccugugcgaccccaacaaccucugccacagcggccgcaccuucgacgcccagaucgugaucaucgagcacaaguccaucaucugcccgggguacaacgccguccugcacauccacacgugcaucgaggagguggagaucaccgcccugaucugccucguggacaagaaguccggcgagaaguccaagacccggccccgcuucgucaagcaggaccaggugugcaucgcccggcugcgcaccgcgggcacgaucugccuggagaccuucaaggacuucccccagauggggcgguucacccuccgcgacgagggcaagaccaucgccaucgggaaggugcugaagcugguccccgagaaggacuga

SEQ ID NO: 30879 - RNA, 1887 nt, Artificial Sequence
  derived and/or modified sequence opt1 from GSPT2__Homo_sapiens__NP_060564
auggacagcggcagcagcuccagcgacuccgcccccgacugcugggaccagguggacauggagagcccgggguccgcccccagcggcgacggggucuccagcgcgguggccgaggcccagcgcgagccccuguccagcgccuucucccggaagcucaacgugaacgccaagcccuucgucccgaacgugcacgcggccgaguucgugcccagcuuccugcgcggccccacccagcccccgacccugcccgccggguccggcagcaacgacgagacgugcaccggcgccggguacccccagggcaagcggauggggcgcggcgcgcccgucgagccgucccgggaggagccccucgugagccuggagggguccaacagcgccgugaccauggagcugagcgagcccgucguggagaacggcgagguggagauggcccucgaggaguccugggagcacagcaaggaggucuccgaggccgagcccggcgggggcagcuccggggacagcggcccgcccgaggaguccggccaggagaugauggaggagaaggaggagauccgcaagagcaaguccgugaucgugcccagcggggcccccaagaaggagcacgucaacgugguguucaucggccacgucgacgcggggaaguccaccaucggcgggcagaucauguuccugacgggcaugguggacaagcggacccuggagaaguacgagcgcgaggccaaggagaagaaccgggagaccugguaccucagcugggcccuggacaccaaccaggaggagcgcgacaagggcaagacgguggaggucgggcgggccuacuucgagaccgagcgcaagcacuucaccauccuggacgccccgggccacaaguccuucgugcccaacaugaucgggggcgcgagccaggccgaccucgccgugcuggucaucuccgcccggaagggggaguucgagaccggcuucgagaagggcgggcagacgcgcgagcacgccaugcuggcgaagaccgccggcgugaagcaccucaucguccugaucaacaagauggacgaccccaccgugaacuggagcaucgagcgguacgaggagugcaaggagaagcuggugcccuuccucaagaaggucggguucuccccgaagaaggacauccacuucaugcccugcagcggccugaccggggccaacaucaaggagcaguccgacuucugccccugguacacgggccugcccuucaucccguaccucgacaaccugcccaacuucaaccgcagcaucgacggccccauccggcugccgaucguggacaaguacaaggacauggggaccgugguccucggcaagcuggagagcggguccaucuucaagggccagcagcuggugaugaugcccaacaagcacaacguggagguccucggcauccugagcgacgacaccgagaccgacuucguggcccccggggagaaccugaagauccgccucaagggcaucgaggaggaggagauccugcccggguucauccugugcgacccguccaaccucugccacagcggccggacguucgacgugcagaucgucaucaucgagcacaaguccaucaucugccccggguacaacgccgugcugcacauccacacgugcaucgaggagguggagaucaccgcgcugaucagccucgucgacaagaaguccggcgagaaguccaagacccgcccccgguucgugaagcaggaccaggugugcaucgcccgccugcgcaccgccggcaccaucugccuggagaccuucaaggacuucccccagauggggcgguucacccuccgcgacgagggcaagacgaucgccaucgggaagguccugaagcuggugccggagaaggacuga

SEQ ID NO: 30880 - RNA, 1569 nt, Artificial Sequence
  derived and/or modified sequence opt1 from GSR__Homo_sapiens__NP_000628
auggcccugcucccccgcgcccugagcgcgggcgccgggccguccuggcggcgcgccgcccgggccuuccgcggcuuccugcuccugcugcccgagcccgcggcccucacccgggcccugagccgcgccauggcgugccggcaggagccccagccgcaggggcccccgcccgccgccggcgccguggccuccuacgacuaccuggucaucgggggcggcagcgggggccucgcguccgcccgccgggccgccgagcugggggcccgcgcggccgugguggagagccacaagcugggcgggaccugcgucaacgugggcugcgugcccaagaaggucauguggaacacggccgugcacuccgaguucaugcacgaccacgccgacuacggcuuccccagcugcgaggggaaguucaacuggcgggugaucaaggagaagcgcgacgccuacgucucccggcucaacgcgaucuaccagaacaaccugaccaagagccacaucgagaucauccgcggccacgccgccuucaccuccgaccccaagcccaccaucgaggugagcgggaagaaguacacggccccgcacauccugaucgccaccggcggcaugcccuccacgccccacgagagccagauccccggggcgucccucggcaucaccagcgacggguucuuccagcuggaggagcugccgggccgguccgugaucgucggggccggcuacaucgccguggagauggccggcauccucagcgcgcugggguccaagaccagccugaugauccgccacgacaaggugcuccggagcuucgacuccaugaucagcaccaacugcaccgaggagcuggagaacgccggcgucgaggugcugaaguucucccaggugaaggaggucaagaagacccucagcgggcuggagguguccauggugacggccguccccggccgccugcccgugaugaccaugauccccgacguggacugccuccugugggccaucgggcgggucccgaacaccaaggaccugagccucaacaagcugggcauccagaccgacgacaagggccacaucaucguggacgaguuccagaacacgaacgucaaggggaucuacgccgugggcgacgugugcgggaaggcgcugcucacccccgucgccaucgccgccggccgcaagcuggcccaccggcuguucgaguacaaggaggacuccaagcucgacuacaacaacauccccaccgugguguucagccacccgcccaucgggaccgucggccugacggaggacgaggcgauccacaaguacggcaucgagaacgugaagaccuacuccaccagcuucacccccauguaccacgccgugacgaagcgcaagaccaagugcgucaugaagauggugugcgccaacaaggaggagaagguggucgggauccacaugcagggccuggggugcgacgagaugcuccagggcuucgccguggccgugaagaugggcgcgaccaaggccgacuucgacaacaccgucgccauccaccccacguccagcgaggagcuggugacccugcgcuga

SEQ ID NO: 30881 - RNA, 1425 nt, Artificial Sequence
  derived and/or modified sequence opt1 from GSS__Homo_sapiens__XP_011527098
auggccaccaacuggggcagccugcuccaggacaagcagcagcuggaggagcuggcccgccaggcgguggaccgggcccucgccgaggggguccugcugcgcaccucccaggagcccacgagcuccgagguggugagcuacgccccguucacccucuuccccucccugguccccagcgcccugcucgagcaggcguacgccgugcagauggacuucaaccugcugguggacgccgucucccagaacgccgcguuccucgagcagacccugagcuccaccaucaagcaggacgacuucacggcccggcuguucgacauccacaagcagguccucaaggagggcaucgcccagaccguguuccuggggcugaaccgcagcgacuacauguuccagcgguccgccgacggcagccccgcccucaagcagaucgagaucaacaccaucuccgcgagcuucgggggccuggccucccgcaccccggccgugcaccggcacgugcugagcgugcucuccaagacgaaggaggccggcaagauccugagcaacaaccccuccaaggggcuggcccucggcaucgcgaaggccugggagcuguacgggagccccaacgcccugguccuccugaucgcccaggagaaggagcgcaacaucuucgaccagcgggccaucgagaacgagcugcucgcgcgcaacauccacgugauccggcgcaccuucgaggacaucagcgagaagggcucccuggaccaggaccggcgccuguucguggacgggcaggagaucgccgucguguacuuccgggacggcuacaugccccgccaguacagccuccagaacugggaggcccggcugcugcucgagcgcucccacgccgccaagugcccggacaucgcgacccagcuggccggcaccaagaaggugcagcaggagcugagccggcccgggaugcucgagaugcugcugcccggccagcccgaggccgucgcccgccuccgggcgacguucgccgggcuguacucccuggacgugggcgaggagggcgaccaggccaucgccgaggcccucgcggccccgagccgcuucgugcugaagccccagcgcgagggcggcgggaacaaccuguacggggaggagaugguccaggcccucaagcagcugaaggacuccgaggagcgggccagcuacauccugauggagaagaucgagcccgagcccuucgagaacugccugcuccgcccggggucccccgcccggguggugcagugcaucagcgagcugggcaucuucggcgucuacgugcgccaggagaagacccuggucaugaacaagcacguggggcaccuccugcggaccaaggcgaucgagcacgccgacggcgggguggccgccggcgucgccgugcuggacaaccccuaccccguguga

SEQ ID NO: 30882 - RNA, 669 nt, Artificial Sequence
  derived and/or modified sequence opt1 from GSTA1__Homo_sapiens__NP_665683
auggccgagaagcccaagcugcacuacuucaacgcccgcggccggauggagagcacccgcuggcuccuggcggccgccgggguggaguucgaggagaaguucaucaaguccgccgaggaccuggacaagcuccggaacgacggcuaccugauguuccagcagguccccaugguggagaucgacgggaugaagcuggugcagacccgcgccauccucaacuacaucgcgagcaaguacaaccuguacggcaaggacaucaaggagcgggcccugaucgacauguacaucgaggggaucgccgaccucggcgagaugauccugcugcuccccgucugcccgcccgaggagaaggacgccaagcuggcgcugaucaaggagaagaucaagaaccgcuacuuccccgccuucgagaaggugcucaagucccacggccaggacuaccugguggggaacaagcugagccgggccgacauccaccucgucgagcugcuguacuacguggaggagcucgacuccagccugaucuccagcuucccccugcucaaggcccugaagacgcgcaucuccaaccugcccaccgugaagaaguuccuccagcccggcagcccgcggaagccgcccauggacgagaagucccuggaggaggcccgcaagaucuuccgguucuga

SEQ ID NO: 30883 - RNA, 669 nt, Artificial Sequence
  derived and/or modified sequence opt1 from GSTA2__Homo_sapiens__XP_011512834
auggccgagaagcccaagcugcacuacagcaacauccgcggccggauggaguccauccgcuggcuccuggccgcggccgggguggaguucgaggagaaguucaucaagagcgccgaggaccuggacaagcuccggaacgacggcuaccugauguuccagcaggucccgaugguggagaucgacgggaugaagcuggugcagacccgcgccauccucaacuacaucgccuccaaguacaaccuguacggcaaggacaucaaggagaaggcgcugaucgacauguacaucgaggggaucgccgaccucggcgagaugauccugcugcuccccuucagccagcccgaggagcaggacgccaagcuggcccugauccaggagaagaccaagaaccgguacuuccccgcguucgagaagguccucaagucccacggccaggacuaccugguggggaacaagcugagccgcgccgacauccaccucguggagcugcuguacuacgucgaggagcucgacuccagccugaucuccagcuucccgcugcucaaggcccugaagacgcggaucuccaaccugcccaccgugaagaaguuccuccagcccggcagcccccgcaagccgcccauggacgagaagucccuggaggagagccggaagaucuuccgcuucuga

SEQ ID NO: 30884 - RNA, 669 nt, Artificial Sequence
  derived and/or modified sequence opt1 from GSTA4__Homo_sapiens__XP_005249092
auggccgcccgccccaagcugcacuacccgaacggccgggggcgcauggagagcgugcgguggguccucgcggccgccggcguggaguucgacgaggaguuccuggagaccaaggagcagcuguacaagcuccaggacgggaaccaccuccuguuccagcagguccccaugguggagaucgacggcaugaagcuggugcagacccgcuccauccugcacuacaucgccgacaagcacaaccuguucgggaagaaccucaaggagcggacgcugaucgacauguacguggagggcacccuggaccuccuggagcugcucaucaugcaccccuuccugaagcccgacgaccagcagaaggaggucgugaacauggcccagaaggcgaucauccgcuacuucccgguguucgagaagauccugcggggccacgggcagagcuuccucgucggcaaccagcugucccuggccgacgugauccuccugcagaccauccuggcccucgaggagaagauccccaacauccugagcgccuuccccuuccugcaggaguacaccgugaagcucuccaacauccccacgaucaagcgcuuccuggagccggggagcaagaagaagcccccgcccgacgagaucuacguccggaccguguacaacaucuuccgccccuga

SEQ ID NO: 30885 - RNA, 669 nt, Artificial Sequence
  derived and/or modified sequence opt1 from GSTA5__Homo_sapiens__NP_714543
auggccgagaagcccaagcugcacuacagcaacgcccgcggcagcauggagagcauccgguggcuccuggcggccgccgggguggagcuggaggagaaguuccucgaguccgccgaggaccuggacaagcugcgcaacgacggcagccuccuguuccagcagguccccaugguggagaucgacgggaugaagcuggugcagacccgggccauccucaacuacaucgcguccaaguacaaccuguacggcaaggacaugaaggagcgcgcccugaucgacauguacaccgaggggaucgucgaccucacggagaugauccugcugcuccugaucugccagcccgaggagcgggacgccaagaccgcccuggugaaggagaagaucaagaaccgcuacuuccccgcguucgagaaggugcucaagagccaccggcaggacuaccuggucggcaacaagcuguccugggccgacauccaccucguggagcuguucuacuacguggaggagcuggacagcucccucaucagcuccuucccccugcugaaggcccucaagacccgcaucagcaaccugccgaccgucaagaaguuccugcagcccggcucccagcggaagccgcccauggacgagaagucccucgaggaggcccgcaagaucuuccgguucuga

SEQ ID NO: 30886 - RNA, 1902 nt, Artificial Sequence
  derived and/or modified sequence opt1 from GSTCD__Homo_sapiens__NP_001026890
augaaggccaucaagaagucccugaccgaggaggaguaccucuaccuggacuucagccaccagaccgagggcugcaucuucccccugcacacgagcgugacccucuuccugcuguccuacugcgacugcaagaucuucaagaucugccucgucgugaccaaggaggugagccgcgacuccagccugcugcgggacgaccucauccaggacgucgagauccagaucaucucccgccaggagcugccgcccaucgugcagaacugcugccugcccgccguggucgagcggagcgacaacuucugccgcgcggggcucgccguggugcugcggcacaucauccagaaguccuacgaggccgacccccugaagaaggagcuccuggagcugcucggcuucaagaagaccugccugaaggccugcgccgaggucagccaguggacgcgccugugcgagcucaccaucccgcuggcgaucgagaacuuccugcgggaguccagcgaccagccgcccaccauccccguggagauccuccagcuggagaagaagcuguccgagcccgugcgcguccacaacgacgacaagcuccggcgccagaagcugaagcagcagaaggccgacggggugggcccgccccugaccaaggggaaggccaagagcaaggugcacacgcaggagaccuccgagggccucgacagcuccagcaagucccuggagcugaaggucgccuucagcaagcucaccgugcaggaggagcccgcgaccacgaaccgggagcccagccacauccgcaaggccaaggccuccgaccugccgccccuggagcacguguucgccgagggccucuacuucacccuggccgacaucguccugcuccccugcauccaccacuuccuggugaucaucagccggaaguucuccgagaagcugguggaguucccccuccuggcgagcugguaccagcgcauccaggagguccccggggugaagaccgccgccuccaagugcggcauccaguuccugcaccuccccaagcugcugaccacgagcaccgagcagcaccccaaccucugcgaggugccgggggucgaggagcaguccgacccccuguucaucggcgggccccggcccaccauggccaagcugauggagaagggcaucgaggugauguucagcccgcaccccugccccaccuggacgcuggacuggaacguccuccccgccgcgguguccccgaaggagggcaagaugagcuccgaccgcgcccugcggaagcagcagcagcugaacaaccucguguacgucgugaccaaccaggccaagcccggggaccgcaucguggacuucugcagcggcgggggccacgucggcaucgugcuggcccacaugcugcccuccugccaggugacccucaucgagaacaaggagcugagccugauccgggccaagaagcgcuccgacgagcucgggcugagcaacaucugguucauccaggcgaacauggaguacuucaccggcauguucaacaucggggucgcccugcacgccugcggcguggccacggacauggugaucgagcacugcaucaagacccgggccuccuucgugaccugcccgugcugcuacggguucauccagaacaccagcaaguucaacuuccccaaguccgagcaguucaagaagacgcucagcuacaaggagcacaugauccugugccgcuucgcggaccagaccgccguccagcugccgccccagcgccggcucaucggcaagcagugcaugugccugguggaccuggaccgcgcccgggccgcggaggagugcggcuacagcguccaggugaucuccauggagcccgagagcugcucccccaagaacaacaugaucguggggguccccaucuga

SEQ ID NO: 30887 - RNA, 849 nt, Artificial Sequence
  derived and/or modified sequence opt1 from GSTK1__Homo_sapiens__NP_001137151
augggcccccugccccgcaccguggagcuguucuacgacguccugagccccuacuccuggcugggguucgagauccucugccgguaccagaacaucuggaacaucaaccugcagcugcgccccagccucaucaccggcaucaugaaggacuccgggaacaagcccccgggccugcugccccggaaggggcucuacauggccaacgaccugaagcugcuccgccaccaccuccagauccccauccacuuccccaaggacuuccugagcgugaugcucgagaagggcucccugagcgccaugcgguuccugacggcggugaaccucgagcacccggagaugcuggagaaggccucccgcgagcuguggaugcgggucuggagccgcguguccgugggccucugggagagcuccgggcggacccuggacgacuuccugaccuucccccgccacgucuuccgggugaugauccucccgccgcccggcgggagcaccgugcugcccgucacgccccugagcccccaccgccuccccgccguguucuccuccagccagaacgaggacaucaccgagccccaguccauccuggccgccgcggagaaggccggcaugagcgccgagcaggcccaggggcugcucgagaagaucgcgacccccaaggugaagaaccagcugaaggagaccacggaggccgccugccgguacggcgccuucggccugcccaucaccgucgcccacguggacgggcagacccacaugcuguucggcuccgaccgcauggagcuccuggcgcaccuccugggggagaaguggaugggcccgaucccgcccgccgugaacgcccggcuguga

SEQ ID NO: 30888 - RNA, 897 nt, Artificial Sequence
  derived and/or modified sequence opt1 from GSTM3__Homo_sapiens__XP_011539598
augaacgagguguggcugcccccggccggcaagggcggggccagcaccuccgggccccuccugagcugcuccacccccgcgcgcgugcccccgcggggccgccaggcccugaaccccaacgccgggaucagccgggccugcgcccgccccugcggcgcggccgaggcccgggacggcgagcgcgggggcgggggcguccgggcccccgcgcgcgggccgcggccccucauguccggcaucaagccccugccccugacggugagccucguccuggagggcuccgaggcccgccaccacguggugcgggucguguacgggagccgcgugcugggcuacuccugggccccggacuacgaccggagccaguggcucgacgucaaguucaagcuggaccuggacuuccccaaccuccccuaccugcuggacgggaagaacaagaucacccaguccaacgccauccuccgcuacaucgcccggaagcacaacaugugcggcgagaccgaggaggagaagauccgcguggacaucaucgagaaccaggugauggacuuccggacccagcugauccgccugugcuacagcuccgaccacgagaagcucaagccccaguaccuggaggagcugccgggccagcucaagcaguucagcauguuccuggggaaguucuccugguucgcgggcgagaagcugacguucgucgacuuccucaccuacgacauccuggaccagaaccggaucuucgaccccaagugccuggacgaguuccccaaccucaaggccuucaugugccgcuucgaggcccuggagaagaucgccgccuaccugcagagcgaccaguucugcaagaugcccaucaacaacaagauggcgcagugggggaacaagccggugugcuga

SEQ ID NO: 30889 - RNA, 627 nt, Artificial Sequence
  derived and/or modified sequence opt1 from GSTO1__Homo_sapiens__NP_001177931
augagcggcgaguccgcccgcagccuggggaagggcuccgcgcccccggggcccgugcccgagggcagcauccggaucuacuccaugcgcuucugccccuucgccgagcggacccgccucguccugaaggccaaggggauccggcacgaggugaucaacaucaaccugaagaacaagccggagugguucuucaagaagaaccccuucggccucgugcccguccuggagaacagccagggccagcugaucuacgaguccgccaucacgugcgaguaccucgacgaggccuaccccgggaagaagcugcugccggacgaccccuacgagaaggccugccagaagaugauccucgagcuguucagcaaggugcugaccaacaagaagaccaccuucuucggcgggaacuccaucagcaugaucgacuaccucaucuggcccugguucgagcgccuggaggcgaugaagcugaacgagugcguggaccacacccccaagcucaagcuguggauggccgccaugaaggaggacccgacggucuccgcccugcucaccagcgagaaggacuggcagggcuuccuggagcuguaccuccagaacucccccgaggcgugcgacuacgggcuguga

SEQ ID NO: 30890 - RNA, 630 nt, Artificial Sequence
  derived and/or modified sequence opt1 from GSTO2__Homo_sapiens__NP_001177942
augagcggcgacgccacccgcacccuggggaagggcucccagcccccggggcccgugcccgagggccucauccggaucuacagcaugcgcuucugccccuacucccaccggacgcgccugguccugaaggccaaggacauccggcacgagguggugaacaucaaccuccgcaacaagccggagugguacuacaccaagcaccccuucgggcacauccccguccuggagaccagccagugccagcugaucuacgaguccgugaucgcgugcgaguaccucgacgacgccuaccccggccggaagcuguucccguacgaccccuacgagcgcgcccggcagaagaugcugcucgagcuguucugcaagauccuggaguaccagaacaccacguucuucggcgggaccugcaucagcaugaucgacuaccuccuguggcccugguucgagcgccuggacguguacggcauccucgacugcgucucccacacccccgcccugcggcuguggaucagcgccaugaagugggacccgaccgugugcgcgcuccugauggacaaguccaucuuccagggguuccugaaccucuacuuccagaacaaccccaacgccuucgacuucggccugugcuga

SEQ ID NO: 30891 - RNA, 633 nt, Artificial Sequence
  derived and/or modified sequence opt1 from GSTP1__Homo_sapiens__NP_000843
augcccccguacaccguggucuacuuccccgugcgcggccggugcgccgcccugcgcaugcuccuggcggaccaggggcagagcuggaaggaggagguggucaccguggagacguggcaggagggcucccugaaggccagcugccucuacgggcagcugcccaaguuccaggacggcgaccugacccucuaccaguccaacaccauccugcggcaccuggggcgcacccucggccuguacggcaaggaccagcaggaggccgcccugguggacauggucaacgacgggguggaggaccuccggugcaaguacaucagccugaucuacacgaacuacgaggccggcaaggacgacuacgugaaggcgcugcccgggcagcucaagccguucgagacccugcugucccagaaccagggcgggaagaccuucaucgucggcgaccagaucagcuucgccgacuacaaccuccuggaccugcuccugauccacgaggugcuggcccccggcugccucgacgccuucccccugcuguccgcguacguggggcgccucagcgcccggcccaagcugaaggccuuccuggccuccccggaguacgucaaccuccccaucaacggcaacgggaagcaguga

SEQ ID NO: 30892 - RNA, 723 nt, Artificial Sequence
  derived and/or modified sequence opt1 from GSTT1__Homo_sapiens__NP_000844
augggccuggagcucuaccuggaccugcucagccagcccugccgcgccguguacaucuucgccaagaagaacgacaucccguucgagcugcggaucgucgaccugaucaaggggcagcaccucuccgacgcguucgcccaggugaacccccugaagaaggugcccgcccugaaggacggcgacuucacccucaccgagagcgucgccauccugcuguaccucacgcgcaaguacaaggugcccgacuacugguacccgcaggaccugcaggcccgggcgcgcguggacgaguaccuggccuggcagcacaccacccuccggcgcuccugccugcgggcccuguggcacaaggucauguuccccguguuccucggggagcccgugagcccccagacccuggccgcgacgcuggccgagcucgacgucacccugcagcugcucgaggacaaguuccugcagaacaaggccuuccugaccggcccgcacaucucccucgccgaccugguggccaucaccgagcugaugcaccccgugggggcgggcugccaggucuucgagggccgccccaagcucgccacguggcggcagcgcguggaggccgccgugggggaggaccuguuccaggaggcccacgaggucauccugaaggcgaaggacuucccgcccgccgaccccaccaucaagcagaagcucaugcccugggugcuggccaugauccgguga

SEQ ID NO: 30893 - RNA, 735 nt, Artificial Sequence
  derived and/or modified sequence opt1 from GSTT2B__Homo_sapiens__NP_001074312
augggccuggagcuguuccucgaccuggugagccagcccucccgcgccguguacaucuucgccaagaagaacgggaucccgcucgagcugcggaccguggaccuggugaagggccagcacaagagcaaggaguuccuccagaucaacucccuggggaagcugcccacccucaaggacggcgacuucauccugacggagagcuccgcgauccugaucuaccucagcugcaaguaccagacccccgaccacugguaccccuccgaccugcaggcccgcgcccggguccacgaguaccugggguggcacgccgacugcauccgcggcaccuucggcaucccgcucuggguccaggugcuggggccccugaucggcguccaggugcccgaggagaagguggagcggaaccgcaccgccauggaccaggcgcuccaguggcuggaggacaaguuccugggggaccggcccuuccucgccggccagcaggucacgcuggccgaccugauggcccucgaggagcugaugcagccgguggcgcugggguacgagcuguucgagggccgcccccggcucgccgccuggcgcggccggguggaggccuuccugggggccgagcucugccaggaggcgcacagcaucauccuguccauccuggagcaggccgccaagaagacccuccccacccccagcccggaggccuaccaggccaugcugcugcgcaucgcgcggauccccuga

SEQ ID NO: 30894 - RNA, 735 nt, Artificial Sequence
  derived and/or modified sequence opt1 from GSTT2__Homo_sapiens__NP_000845
augggccuggagcuguuccucgaccuggugagccagcccucccgcgccguguacaucuucgccaagaagaacgggaucccgcucgagcugcggaccguggaccuggugaagggccagcacaagagcaaggaguuccuccagaucaacucccuggggaagcugcccacccucaaggacggcgacuucauccugacggagagcuccgcgauccugaucuaccucagcugcaaguaccagacccccgaccacugguaccccuccgaccugcaggcccgcgcccggguccacgaguaccugggguggcacgccgacugcauccgcggcaccuucggcaucccgcucuggguccaggugcuggggccccugaucggcguccaggugcccaaggagaagguggagcggaaccgcaccgccauggaccaggcgcuccaguggcuggaggacaaguuccugggggaccggcccuuccucgccggccagcaggucacgcuggccgaccugauggcccucgaggagcugaugcagccgguggcgcugggguacgagcuguucgagggccgcccccggcucgccgccuggcgcggccggguggaggccuuccugggggccgagcucugccaggaggcgcacagcaucauccuguccauccuggagcaggccgccaagaagacccuccccacccccagcccggaggccuaccaggccaugcugcugcgcaucgcgcggauccccuga

SEQ ID NO: 30895 - RNA, 651 nt, Artificial Sequence
  derived and/or modified sequence opt1 from GSTZ1__Homo_sapiens__NP_665877
augcaggccggcaagcccauccuguacagcuacuuccgcuccagcugcuccuggcgggugcgcaucgcccucgcgcugaaggggaucgacuacgagaccgucccgaucaaccugaucaaggacggcgggcagcaguucagcaaggacuuccaggcccucaaccccaugaagcagguccccacccugaagaucgacggcaucacgauccaccagucccuggccaucaucgaguaccucgaggagaugcggcccaccccgcgccugcugccccaggaccccaagaagcgggccagcgugcgcaugaucuccgaccucaucgccgggggcauccagccccugcagaaccugagcgugcucaagcaggucggcgaggagaugcagcugaccugggcgcagaacgccaucacgugcggguucaacgcccuggagcagauccuccaguccaccgccggcaucuacugcgugggggacgaggugaccauggcggaccugugccuggugccccagguggccaacgccgagcgguucaaggucgaccucaccccguaccccaccaucagcuccaucaacaagcgccugcuggugcucgaggccuuccaggugagccaccccugccggcagccggacacgcccaccgagcugcgcgccuga

SEQ ID NO: 30896 - RNA, 795 nt, Artificial Sequence
  derived and/or modified sequence opt1 from GSX1__Homo_sapiens__NP_663632
augccccgcagcuuccugguggacucccucguccugcgggaggccggcgagaagaaggccccggaggggagcccgccgccccuguuccccuacgcggugcccccgccccacgcccuccacggccugucccccggggccugccacgcccgcaaggccggccugcucugcgugugcccccugugcgucaccgcgagccagcugcacgggccgcccggcccgcccgcccucccccugcugaaggccuccuucccgcccuucggcagccaguacugccacgcgccccucgggcggcagcacuccgccgugagccccggcguggcccacgggcccgccgccgccgcggccgccgccgcccuguaccagaccuccuacccccugcccgacccccgccaguuccacugcaucagcgucgacuccagcuccaaccagcuccccagcuccaagcggaugcgcacggcguucaccagcacccagcugcuggagcucgagcgggaguucgccuccaacauguaccugagccgccugcggcgcaucgagaucgccaccuaccucaaccuguccgagaagcaggucaagaucugguuccagaaccggcgcgugaagcacaagaaggagggcaaggggagcaaccaccggggcggcgggggcgggggcgccggcgggggcgggagcgcgccccagggcugcaagugcgccucccugagcuccgccaagugcagcgaggacgacgacgagcuccccaugucccccagcuccagcgggaaggacgaccgcgaccugacggugacccccuga

SEQ ID NO: 30897 - RNA, 915 nt, Artificial Sequence
  derived and/or modified sequence opt1 from GSX2__Homo_sapiens__NP_573574
augagccgcuccuucuacguggacagccugaucaucaaggacaccucccggcccgccccgagccuccccgagccccaccccggcccggacuucuucaucccccuggggaugcccccgccccuggucauguccgugagcggccccgggugccccucccgcaagagcggcgccuucugcgugugcccccucugcgucaccucccaccuccacagcucccgggggagcgugggcgcgggcuccgggggcgccggggccggcgugacgggggccggcggcagcggggucgccggcgcggccggggcccugccgcugcugaagucccaguucagcuccgcccccggcgacgcgcaguucugcccccgcgugaaccacgcccaccaccaccaccacccgccccagcaccaccaccaccaccaccagccccagcagcccggcagcgccgccgccgcggccgccgccgccgcggccgccgccgccgcggccgcccuggggcacccccagcaccacgccccggugugcaccgccaccaccuacaacgucgcggacccccggcgcuuccacugccucacgaugggcggguccgacgccagccaggugcccaacggcaagcggaugcgcaccgccuucaccagcacccagcugcuggagcucgagcgggaguucuccagcaacauguaccugucccgccugcggcgcaucgagaucgccacguaccucaaccugagcgagaagcaggucaagaucugguuccagaaccggcgcgugaagcacaagaaggaggggaagggcacccagcggaacucccacgcgggcugcaagugcguggggagccaggugcacuacgcccgcuccgaggacgaggacagccugucccccgccagcgccaacgacgacaaggagaucuccccgcucuga

SEQ ID NO: 30898 - RNA, 1377 nt, Artificial Sequence
  derived and/or modified sequence opt1 from GTDC1__Homo_sapiens__NP_001006637
augagcauccugaucaucgaggccuucuacggcgggucccacaagcagcucguggaccugcugcaggaggagcucggcgacugcgucguguacacccugcccgccaagaaguggcacuggcgcgcgcggaccagcgcccuguacuucucccagacgaucccgaucagcgagcacuaccgcacccucuucgccuccagcgugcugaaccugaccgagcucgccgcccugcggcccgaccuggggaagcucaagaagauccuguacuuccacgagaaccagcugaucuaccccgucaagaagugccaggagcgcgacuuccaguacggcuacaaccagauccucuccugccugguggcggacguggucguguucaacagcguguucaacauggaguccuuccugaccagcauggggaaguucaugaagcucauccccgaccaccggccgaaggaccuggaguccaucauccgccccaagugccaggucaucuacuuccccauccgguuccccgacgugagccgcuucaugccgaagcacaagacgacccaccugaagaagaugcucggccugaagggcaacgggggcgccgugcuguccauggcccuccccuuccagcccgagcagcgggacagcgaggaccugcugaagaacuucaacuccgagugcgacacccacugcgggcucgacaccgcccgccaggaguaccugggcaacagccugcggcaggaguccgaccucaagaaguccacgagcagcgacaacagcuccagccaccacggggagaacaagcagaaccugaccgucgaccccugcgacauccugggcggcguggacaaccagcagcgccuccugcacaucguguggccgcaccggugggagcacgacaaggaccccgaguccuucuucaagguccugaugcaccucaaggaccuggggcugaacuuccacgugagcgugcucggcgagaccuucaccgacguccccgacaucuucuccgaggcgaagaaggcccuggggagcuccgugcugcacuggggcuaccuccccagcaaggacgacuacuuccaggugcugugcauggccgacgucgugaucuccacggccaagcacgaguucuucggcguggccaugcuggaggcggucuacugcgggugcuacccgcucugccccaaggaccugguguaccccgagaucuuccccgccgaguaccuguacagcaccccggagcagcucuccaagcgccugcagaacuucugcaagcggcccgacaucauccgcaagcaccuguacaagggcgagaucgcccccuucagcugggccgcccugcacgggaaguuccggucccuccugaccaccgagccccgcgaggaccuguga

SEQ ID NO: 30899 - RNA, 1131 nt, Artificial Sequence
  derived and/or modified sequence opt1 from GTF2A1__Homo_sapiens__NP_056943
auggccaacagcgccaacaccaacaccgugcccaagcuguaccgcuccgucaucgaggacgugaucaacgacgugcgggacaucuuccucgacgacggcgucgacgagcagguccugauggagcugaagacgcucugggagaacaagcugaugcagagccgcgcgguggacggguuccacuccgaggagcagcagcugcuccuccaggugcagcagcagcaccagccgcagcagcagcagcaccaccaccaccaccaccaccagcaggcccagccccagcagaccgugccccagcaggcccagacccagcagguccugauccccgccagccagcaggccaccgcgccccaggugaucgugccggacuccaagcugauccagcacaugaacgccagcaacauguccgccgccgcgacggccgccacccuggcccugcccgccggcgugacccccguccagcagauccucaccaacagcgggcagcugcuccagguggugcgggcggccaacggcgcccaguacaucuuccagccgcagcaguccgucgugcugcagcagcaggucaucccccagaugcagcccgggggcgugcaggcccccgugauccagcagguccuggccccgcugcccggcgggaucagcccccagacgggcgugaucauccagccccagcagauccucuucaccgggaacaagacccaggugaucccgaccacgguggcggcccccacccccgcccaggcccagaucaccgccaccggccagcagcagccccaggcgcagccggcccagacgcaggcgccccugguccuccagguggacgggaccggcgacaccuccagcgaggaggacgaggacgaggaggaggacuacgacgacgacgaggaggaggacaaggagaaggacggcgccgaggacgggcaggucgaggaggagccccugaacuccgaggacgacgugagcgacgaggagggccaggagcuguucgacaccgagaacguggucgugugccaguacgacaagauccaccgcuccaagaacaaguggaaguuccaccugaaggacgggaucaugaaccucaacggccgggacuacaucuucagcaaggccaucggcgacgccgagugguga

SEQ ID NO: 30900 - RNA, 1335 nt, Artificial Sequence
  derived and/or modified sequence opt1 from GTF2A1L__Homo_sapiens__NP_001180416
auggccugccugaaccccgugcucugggagaccaagguccugcagagcaaggccaccgaggacuucuuccgcaacuccauccagagcccgcuguucacgcuccagcugccccacucccugcaccagacccuccagagcuccaccgcgagccuggugauccccgccggccggacccugcccuccuucacgaccgccgagcucgggaccagcaacuccagcgccaacuucaccuucccgggcuaccccauccacgugcccgccggggucacgcugcagaccguguccggccaccuguacaaggugaacguccccaucauggugaccgagaccagcgggcgcgcgggcauccuccagcacccgauccagcaggucuuccagcagcugggccagcccuccgugauccagacgagcgugccccagcugaaccccuggucccuccaggccaccaccgagaagucccagcggaucgagaccgugcugcagcagccggccauccugcccuccgggcccgucgaccgcaagcaccucgagaacgccacgagcgacauccuggugucccccggcaacgagcacaagaucgugccggaggcgcugcucugccaccaggagagcagccacuacaucucccugcccggggucguguucagcccccaggugucccagaccaacagcaacgucgaguccgugcugagcggcuccgccagcauggcccagaaccuccacgacgagucccugagcaccagcccccacggggcccugcaccagcacgugaccgacauccagcuccacauccugaagaaccggauguacggcugcgacagcgucaagcagccgcgcaacaucgaggagcccuccaacauccccgugagcgagaaggacuccaacagccagguggaccuguccauccgggucacggacgacgacaucggcgagaucauccagguggacgggagcggcgacaccuccagcaacgaggagaucgggagcacccgcgacgccgacgagaacgaguuccucggcaacaucgacggcggggaccugaagguccccgaggaggaggcggacuccaucagcaacgaggacuccgccaccaacagcuccgacaacgaggacccccaggugaacaucguggaggaggacccgcugaacagcggcgacgacgucuccgagcaggacgugcccgaccucuucgacacggacaacgugaucgucugccaguacgacaagauccaccggagcaagaacaaguggaaguucuaccugaaggacggggugaugugcuucggcgggcgcgacuacguguucgccaaggccaucggcgacgccgagugguga

SEQ ID NO: 30901 - RNA, 330 nt, Artificial Sequence
  derived and/or modified sequence opt1 from GTF2A2__Homo_sapiens__NP_004483
auggccuaccagcuguaccgcaacaccacccucggcaacagccugcaggagucccuggacgagcucauccagagccagcagaucacgccccagcuggcccuccaggugcugcugcaguucgacaaggcgaucaacgccgcccuggcccagcggguccgcaaccgggugaacuuccgcgggucccucaacaccuaccgguucugcgacaacguguggaccuucguccugaacgacguggaguuccgcgaggugaccgagcugaucaaggucgacaaggugaagaucguggccugcgacggcaagaacacggggagcaacaccaccgaguga

SEQ ID NO: 30902 - RNA, 1320 nt, Artificial Sequence
  derived and/or modified sequence opt1 from GTF2E1__Homo_sapiens__NP_005504
auggccgaccccgacgugcugaccgaggucccggccgcgcucaagcgccuggccaaguacgugauccggggcuucuacgggaucgagcacgcccuggcccucgacauccugauccgcaacagcugcgugaaggaggaggacaugcuggagcuccugaaguucgaccggaagcagcugcgcuccguccucaacaaccugaagggcgacaaguucaucaagugccggaugcgcguggagaccgccgcggacgggaagacgacccggcacaacuacuacuucaucaacuaccgcacccuggugaacgucgugaaguacaagcucgaccacaugcggcgccggaucgagaccgacgagcgcgacagcacgaaccgggccuccuucaagugccccgugugcagcuccaccuucaccgaccuggaggccaaccagcuguucgaccccaugaccggcacguuccgcugcaccuucugccacaccgaggucgaggaggacgagagcgccaugcccaagaaggacgcgcggacccuccuggcccgcuucaacgagcagaucgagccgaucuacgcccugcuccgggagacggaggacgugaaccuggccuacgagauccuggagcccgagcccaccgagauccccgcccucaagcaguccaaggaccacgcggccaccaccgccggggccgccagccuggcgggcggccaccaccgcgaggccugggccacgaaggggccguccuacgaggaccuguacacccagaacguggucaucaacauggacgaccaggaggaccuccaccgggccagccuggagggcaaguccgccaaggagcgccccaucuggcugcgggagagcaccgugcagggggcguacggcuccgaggacaugaaggagggcgggaucgacauggacgccuuccaggagcgcgaggagggccacgccgggcccgacgacaacgaggaggugaugcgcgcccuccugauccacgagaagaagaccagcuccgccauggcgggcagcgucggggccgccgcccccgugacggcggccaacggcuccgacagcgaguccgagaccagcgagagcgacgacgacuccccgccccggcccgccgccguggccguccacaagcgcgaggaggacgaggaggaggacgacgaguucgaggagguggcggacgaccccaucgugauggucgccggccggccguucagcuacuccgaggugagccagcgccccgagcugguggcccagaugacccccgaggagaaggaggccuacaucgccauggggcagcggauguucgaggaccucuucgaguga

SEQ ID NO: 30903 - RNA, 876 nt, Artificial Sequence
  derived and/or modified sequence opt1 from GTF2E2__Homo_sapiens__NP_002086
auggaccccagccugcuccgcgagcgggagcuguucaagaagcgcgcccuguccaccccgguggucgagaagcggagcgccuccagcgaguccagcuccagcuccagcaagaagaagaagaccaagguggagcacggcggguccagcggcuccaagcagaacagcgaccacuccaacgggagcuucaaccucaaggcgcuguccggcagcuccggguacaaguucggcgugcuggccaagaucgucaacuacaugaagacgcgccaccagcggggcgacacccacccccucacccuggacgagauccuggacgagacccagcaccucgacaucgggcugaagcagaagcaguggcugaugacggaggcccucgugaacaaccccaagaucgaggugaucgacggcaaguacgccuucaagcccaaguacaacguccgcgacaagaaggcccugcugcggcuccuggaccagcacgaccagcgcgggcugggcgggauccuccuggaggacaucgaggaggcgcugccgaacagccagaaggccgugaaggcccucggcgaccagauccuguucgugaaccggcccgacaagaagaagauccuguucuucaacgacaagagcugccaguucuccgucgacgaggaguuccagaagcucuggcgcagcgugaccguggacuccauggacgaggagaagaucgaggaguaccugaagcggcagggcaucagcuccaugcaggagagcgggcccaagaaggucgcccccauccagcgccggaagaagccggcgucccagaagaagcgccgguucaagacccacaacgagcaccuggccggcgugcucaaggacuacagcgacaucaccuccagcaaguga

SEQ ID NO: 30904 - RNA, 1554 nt, Artificial Sequence
  derived and/or modified sequence opt1 from GTF2F1__Homo_sapiens__NP_002087
auggccgcccugggccccagcucccagaacgugaccgaguacgucgugcgcgugccgaagaacaccacgaagaaguacaacaucauggcguucaacgccgccgacaaggucaacuucgccaccuggaaccaggcccggcucgagcgcgaccugagcaacaagaagaucuaccaggaggaggagaugcccgaguccggggcgggcagcgaguucaaccggaagcugcgcgaggaggcccggcgcaagaaguacgggaucgugcucaaggaguuccggcccgaggaccagcccuggcugcugcgcgugaacggcaaguccgggcggaaguucaagggcaucaagaagggcggggucaccgagaacaccagcuacuacaucuucacgcagugcccggacggcgccuucgaggccuuccccgugcacaacugguacaacuucacgccccucgcgcgccaccggacccugaccgccgaggaggccgaggaggagugggagcgccggaacaaggugcugaaccacuucuccaucaugcagcagcgccggcucaaggaccaggaccaggacgaggacgaggaggagaaggagaagcgcgggcggcgcaaggccagcgagcugcggauccacgaccuggaggacgaccucgagauguccagcgacgccuccgacgcgagcggcgaggagggcgggcgcguccccaaggccaagaagaaggccccgcuggccaagggcgggcggaagaagaagaagaagaagggcuccgacgacgaggccuucgaggacagcgacgacggggacuucgagggccaggagguggacuacauguccgacggcagcuccagcucccaggaggagcccgagagcaaggcgaaggcgccccagcaggaggaggggcccaagggcguggacgagcagagcgacuccagcgaggaguccgaggaggagaagccgcccgaggaggacaaggaggaggaggaggagaagaaggcccccacgccccaggagaagaagcgccgcaaggacagcuccgaggagagcgacuccagcgaggaguccgacaucgacagcgaggccuccagcgcccuguucauggccaagaagaagaccccgcccaagcgggagcgcaagcccuccgggggcagcucccgggggaacagccgccccggcaccccguccgccgagggcgggagcaccuccagcacccuccgggccgccgccagcaagcuggagcagggcaagcgcgucuccgagaugcccgcggccaagcggcugcgccucgacaccgggccccagagccuguccggcaagagcacgccccagccgcccuccgggaagaccacccccaacagcggcgacguccaggugaccgaggacgccgugcggcgcuaccugacccggaagcccaugaccacgaaggaccuccugaagaaguuccagaccaagaagaccggccuguccagcgagcagaccgugaacgugcucgcccagauccugaagcgccugaacccggagcggaagaugaucaacgacaagaugcacuucucccucaaggaguga

SEQ ID NO: 30905 - RNA, 750 nt, Artificial Sequence
  derived and/or modified sequence opt1 from GTF2F2__Homo_sapiens__NP_004119
auggccgagcgcggcgagcuggaccucaccggggccaagcagaacaccggcguguggcuggucaaggugcccaaguaccugagccagcagugggcgaaggccuccgggcggggcgagguggggaagcuccgcaucgccaagacgcagggccggaccgaggucagcuucacccugaacgaggaccuggccaacauccacgacaucggcgggaagccggccuccgugagcgcgccccgcgagcaccccuucgugcuccaguccgucggcgggcagacccugacgguguucaccgagagcuccagcgacaagcugucccucgagggcaucgugguccagcgggccgagugccgccccgccgccagcgagaacuacaugcggcugaagcgccugcagaucgaggaguccagcaagccggugcggcucucccagcagcuggacaagguggucaccaccaacuacaagcccguggcgaaccaccaguacaacaucgaguacgagcgcaagaagaaggaggacgggaagcgggcccgcgccgacaagcagcacgugcuggacaugcuguucagcgccuucgagaagcaccaguacuacaaccucaaggaccuggucgacaucacgaagcagcccgugguguaccucaaggagauccugaaggagaucggcguccagaacgugaagggcauccacaagaacaccugggagcugaagcccgaguaccggcacuaccagggggaggagaaguccgacuga

SEQ ID NO: 30906 - RNA, 1647 nt, Artificial Sequence
  derived and/or modified sequence opt1 from GTF2H1__Homo_sapiens__NP_001135779
auggccaccagcuccgaggaggugcugcucaucgucaagaaggugcgccagaagaagcaggacggcgcccuguaccugauggcggagcggaucgccugggcccccgaggggaaggaccgcuucaccaucagccacauguacgccgacaucaagugccagaagaucuccccggagggcaaggccaagauccagcuccagcuggugcugcacgcgggggacacgaccaacuuccacuucagcaacgaguccaccgccgucaaggagcgggacgccgugaaggaccuccugcagcagcugcuccccaaguucaagcgcaaggccaacaaggagcuggaggagaagaaccggaugcugcaggaggaccccguccucuuccagcuguacaaggaccugguggugagccaggugaucuccgcggaggaguucugggccaaccgccucaacgucaacgccaccgacagcuccagcacguccaaccacaagcaggacgugggcaucagcgccgccuuccuggcggacgugcggccccagaccgacgggugcaacggccugcgcuacaaccucaccuccgacaucaucgagagcaucuuccggaccuacccggccgucaagaugaaguacgccgagaacgugccccacaacaugacggagaaggaguucuggacccgcuucuuccagucccacuacuuccaccgggaccgccugaacaccggcagcaaggaccuguucgccgagugcgccaagaucgacgagaaggggcucaagaccauggugucccugggcgucaagaacccccugcucgaccugacggcgcuggaggacaagccccucgacgagggguacggcaucagcuccgugccgagcgccagcaacuccaagagcaucaaggagaacuccaacgccgccaucaucaagcgguucaaccaccacagcgccauggugcuggcggccgggcugcgcaagcaggaggcccagaacgagcagaccuccgagcccagcaacauggacggcaacuccggcgacgccgacugcuuccagcccgccgucaagcgggcgaagcuccaggagagcaucgaguacgaggaccuggggaagaacaacuccgugaagaccaucgcccugaaccucaagaaguccgaccgcuacuaccacggccccaccccgauccagagccugcaguacgccacgagccaggacaucaucaacuccuuccagagcauccggcaggagauggaggccuacacccccaagcugacccaggugcucuccagcuccgcggccagcuccaccaucacggcccugagccccgggggcgcccugaugcagggcgggacccagcaggccaucaaccagaugguccccaacgacauccagagcgagcucaagcaccuguacguggcggugggcgagcugcuccgccacuucugguccugcuucccggucaacacccccuuccuggaggagaagguggucaagaugaaguccaaccuggagcgguuccaggugaccaagcucugccccuuccaggagaagauccgccggcaguaccugagcacgaaccuggugagccacaucgaggagaugcuccagaccgccuacaacaagcugcacaccuggcagucccgccgccugaugaagaagaccuga

SEQ ID NO: 30907 - RNA, 1188 nt, Artificial Sequence
  derived and/or modified sequence opt1 from GTF2H2C_2__Homo_sapiens__NP_001035955
auggacgaggagcccgagcgcaccaagcggugggagggcggguacgagcgcaccugggagauccugaaggaggacgagagcggcucccucaaggccacgaucgaggacauccuguucaaggccaagcggaagcgcguguucgagcaccacgggcagguccggcugggcaugaugcgccaccucuacgugguggucgacgggagccggaccauggaggaccaggaccugaagccgaaccgccugaccugcacccucaagcugcuggaguacuucguggaggaguacuucgaccagaaccccaucucccagaucggcaucaucgugaccaagagcaagcgggcggagaagcucaccgagcuguccggcaacccccgcaagcacaucaccagccugaaggaggccgucgacaugaccugccacggggagcccucccucuacaacagccuguccauggccaugcagacgcugaagcacaugccgggccacaccagccgggaggugcucaucaucuucuccagccugacgaccugcgaccccuccaacaucuacgaccugaucaagacgcucaaggccgccaagauccgcgugagcgucaucgggcuguccgcggaggugcgggugugcaccguccuggcccgcgagaccggcgggaccuaccacgugauccucgacgagagccacuacaaggagcugcugacgcaccaccucuccccgccgcccgccagcuccagcagcgagugcucccugauccggaugggcuucccccagcacaccaucgccagccuguccgaccaggacgcgaagcccagcuucuccauggcccaccucgacggcaacaccgagcccgggcugacccugggcggguacuucugcccccagugccgcgccaaguacugcgagcuccccguggagugcaagaucugcggccugacgcuggucagcgcgccccaccucgcccgguccuaccaccaccuguucccccuggacgccuuccaggagaucccgcucgaggaguacaacggcgagcgcuucugcuacgggugccagggcgagcugaaggaccagcacguguacgugugcgccgucugccagaacguguucugcguggacugcgacgucuucgugcacgacagccugcacugcugccccgggugcauccacaagauccccgcccccuccggcguguga

SEQ ID NO: 30908 - RNA, 1017 nt, Artificial Sequence
  derived and/or modified sequence opt1 from GTF2H2C__Homo_sapiens__XP_005248650
augcgccaccuguacguggucguggacggcagccggaccauggaggaccaggaccucaagcccaaccgccugaccugcacgcugaagcuccuggaguacuucguggaggaguacuucgaccagaacccgaucucccagaucgggaucaucgucaccaagagcaagcgggccgagaagcugaccgagcucuccggcaacccccgcaagcacaucaccagccugaaggaggccguggacaugacgugccacggggagcccucccuguacaacagccucuccauggcgaugcagacccugaagcacaugcccggccacaccagccgggaggugcugaucaucuucuccagccucaccacgugcgacccguccaacaucuacgaccugaucaagacccugaaggccgccaagauccgcgucagcgugaucgggcucuccgccgaggugcgggucugcaccgugcuggcccgcgagaccggcggcacguaccacgugauccuggacgagagccacuacaaggagcuccugacccaccaccuguccccgccgcccgcgagcuccagcuccgagugcagccucauccggaugggguucccccagcacaccaucgccagccuguccgaccaggacgccaagcccagcuucuccauggcccaccuggacggcaacaccgagcccgggcucacgcugggcggguacuucugcccccagugccgcgcgaaguacugcgagcugcccgucgagugcaagaucugcggccucacccuggugagcgcgccccaccuggcccgguccuaccaccaccucuucccccuggacgccuuccaggagaucccccuggaggaguacaacggcgagcgcuucugcuacgggugccagggcgagcucaaggaccagcacguguacgucugcgccgugugccagaacguguucugcgucgacugcgacguguucgugcacgacagccugcacugcugcccggggugcauccacaagauccccgcccccuccggcgucuga

SEQ ID NO: 30909 - RNA, 1188 nt, Artificial Sequence
  derived and/or modified sequence opt1 from GTF2H2__Homo_sapiens__NP_001506
auggacgaggagcccgagcgcaccaagcggugggagggcggguacgagcgcaccugggagauccugaaggaggacgagagcggcucccucaaggccacgaucgaggacauccuguucaaggccaagcggaagcgcguguucgagcaccacgggcagguccggcugggcaugaugcgccaccucuacgugguggucgacgggagccggaccauggaggaccaggaccugaagccgaaccgccugaccugcacccucaagcugcuggaguacuucguggaggaguacuucgaccagaaccccaucucccagaucggcaucaucgugaccaagagcaagcgggcggagaagcucaccgagcuguccggcaacccccgcaagcacaucaccagccugaagaaggccgucgacaugaccugccacggggagcccucccucuacaacagccuguccaucgccaugcagacgcugaagcacaugccgggccacaccagccgggaggugcucaucaucuucuccagccugacgaccugcgaccccuccaacaucuacgaccugaucaagacgcucaaggccgccaagauccgcgugagcgucaucgggcuguccgcggaggugcgggugugcaccguccuggcccgcgagaccggcgggaccuaccacgugauccucgacgagagccacuacaaggagcugcugacgcaccacguguccccgccgcccgccagcuccagcagcgagugcucccucauccggaugggcuucccccagcacaccaucgccagccuguccgaccaggacgcgaagcccagcuucuccauggcccaccuggacggcaacaccgagcccgggcucacccugggcggguacuucugcccccagugccgcgccaaguacugcgagcugcccgucgagugcaagaucugcggccucacgcuggugagcgcgccccaccuggcccgguccuaccaccaccucuucccccuggacgccuuccaggagaucccgcuggaggaguacaacggcgagcgcuucugcuacgggugccagggcgagcucaaggaccagcacguguacgucugcgccgugugccagaacguguucugcgucgacugcgacguguucgugcacgacagccugcacugcugccccgggugcauccacaagauccccgcccccuccggcgucuga

SEQ ID NO: 30910 - RNA, 804 nt, Artificial Sequence
  derived and/or modified sequence opt1 from GTF2H3__Homo_sapiens__NP_001258796
auggugcugggcaacagccaccucuucaugaaccgcuccaacaagcuggccgucaucgccagccacauccaggagucccgguuccuguaccccgggaagaacggccgccucggggacuucuucggcgacccggggaacccgcccgaguucaaccccagcggcuccaaggacggcaaguacgagcugcugaccagcgcgaacgaggugaucguggaggagaucaaggaccucaugaccaaguccgacaucaaggggcagcacacggagacccugcuggccggcagccucgccaaggcccugugcuacauccaccggaugaacaaggaggucaaggacaaccaggagaugaagucccgcauccuggugaucaaggccgcggaggacagcgcccuccaguacaugaacuucaugaacgugaucuucgccgcccagaagcagaacauccugaucgacgcgugcguccuggacuccgacagcgggcuccugcagcaggccugcgacaucaccggcgggcuguaccucaaggugccccagaugcccucccugcugcaguaccuccuguggguguuccugcccgaccaggaccagcggagccagcucauccugcccccgcccguccacguggacuaccgcgccgccugcuucugccaccggaaccugaucgagaucggcuacgugugcuccgucugccucagcaucuucugcaacuucucccccaucugcaccacgugcgagaccgccuucaagaucagccugcccccggugcugaaggcgaagaagaagaagcucaagguguccgccuga

SEQ ID NO: 30911 - RNA, 1389 nt, Artificial Sequence
  derived and/or modified sequence opt1 from GTF2H4__Homo_sapiens__NP_001508
auggagagcacccccucccgcggccugaaccgggugcaccuccagugccgcaaccugcaggaguuccucgggggccucagcccggggguccuggaccggcuguacggccaccccgcgaccugccucgccguguuccgcgagcugcccucccuggccaagaacugggugaugcggaugcuguuccuggagcagccccugccgcaggccgccgucgcccucugggugaagaaggaguucagcaaggcccaggaggaguccacggggcugcugagcggccuccgcaucuggcacacccagcugcugcccggcgggcuccagggccugauccugaaccccaucuuccggcagaaccuccgcaucgcgcugcucgggggcgggaaggccugguccgacgacaccagccagcugggccccgacaagcacgcccgggacgugccgucccuggacaaguacgccgaggagcgcugggaggucgugcugcacuucauggugggcagccccuccgcggccgucagccaggaccucgcccagcugcugucccaggccgggcucaugaaguccaccgagcccggcgagcccccgugcaucacgagcgccggguuccaguuccugcugcucgacacccccgcgcagcugugguacuucaugcugcaguaccuccagaccgcccagagccggggcauggaccugguggagauccuguccuuccucuuccagcugagcuucuccacccugggcaaggacuacagcguggaggggaugagcgacucccuccugaacuuccugcagcaccuccgcgaguucggccuggucuuccagcggaagcgcaagagccggcgcuacuaccccacgcggcuggccaucaaccucuccagcgggguguccggcgccgggggcaccgugcaccagcccggcuucaucgucguggagaccaacuaccgccuguacgccuacaccgagagcgagcugcagaucgcgcugaucgcccucuucuccgagaugcuguaccgguucccgaacaugguggucgcccaggugacgcgcgagagcgugcagcaggccaucgccuccgggaucaccgcgcagcagaucauccacuuccugcggacccgcgcccaccccgucaugcucaagcagacccccgugcugcccccgacgaucaccgaccagauccgccugugggagcucgagcgggaccgccugcgguucaccgagggcgugcuguacaaccaguuccucagccaggucgacuucgagcugcugcucgcccacgcccgcgagcugggggugcuggucuucgagaacuccgccaagcggcucaugguggugacccccgcgggccacagcgacgucaagcgcuucuggaagcggcagaagcacuccagcuga

SEQ ID NO: 30912 - RNA, 216 nt, Artificial Sequence
  derived and/or modified sequence opt1 from GTF2H5__Homo_sapiens__NP_997001
auggugaacguccugaagggcgugcucaucgagugcgaccccgccaugaagcaguuccugcuguaccucgacgagagcaacgcccuggggaagaaguucaucauccaggacaucgacgacacccacguguucgucaucgcggagcuggugaacgugcuccaggagcgcgucggcgagcugauggaccagaacgccuucucccugacccagaaguga

SEQ ID NO: 30913 - RNA, 825 nt, Artificial Sequence
  derived and/or modified sequence opt1 from GTF2I__Homo_sapiens__NP_001267729
auggcccagguggccaugagcacccugcccgucgaggacgaggaguccagcgagucccgcaugguggugaccuuccucaugagcgcgcuggaguccaugugcaaggagcuggccaagagcaaggccgaggucgccugcaucgccguguacgagacggacguguucgucgugggcaccgagcgggggcgcgcguucgugaacacccggaaggacuuccagaaggacuucgucaaguacugcguggaggaggaggagaaggccgccgagaugcacaagaugaaguccaccacgcaggccaaccgcaugagcguggacgcggucgagaucgagacccuccggaagaccguggaggacuacuucugcuucugcuacggcaaggcccuggggaaguccaccguggucccggugcccuacgagaagaugcugcgcgaccagagcgccguggucgugcagggccuccccgaggggguggccuucaagcaccccgagaacuacgaccuggccacgcugaaguggauccucgagaacaaggcgggcaucuccuucaucaucaagcggccguuccuggagcccaagaagcacgucggcgggcgcgugauggugaccgacgccgaccggagcauccugucccccggcgggagcugcggccccaucaaggucaagaccgagccgaccgaggacuccgggaucagccucgagauggccgccgugacggucaaggaggaguccgaggaccccgacuacuaccaguacaacauccagggcagccaccacuccagcgagggcaacgaggggaccgagauggaggugcccgccgagggcuga

SEQ ID NO: 30914 - RNA, 2931 nt, Artificial Sequence
  derived and/or modified sequence opt1 from GTF2IRD1__Homo_sapiens__NP_001186136
auggcccugcucggcaagcgcugcgacgugcccaccaacgggugcggcccggaccgguggaacagcgccuucacccgcaaggacgagaucaucacgucccuggucagcgcgcuggacuccaugugcagcgcccucuccaagcugaacgccgagguggccugcguggccguccacgacgagagcgcguucgugguggggaccgagaagggccggauguuccugaacgcccgcaaggagcuccaguccgacuuccugcgguucugccugagcgccgcccagcaccgcgcggccaccucccagcucgaggggcgggucgugcgccgggugcugaccgucgccagccgcgcccugugccccacgggcggcccgcccuggaaggacccggaggccgagcaccccaagaaggugcagcgcggggagggcgggggccggucccucccccggagcucccuggagcacgggagcgacguguaccugcuccgcaagauggucgaggagguguucgacgugcuguacuccgaggcgcugggccgggccagcgucgugccccucccguacgagcgccugcugcgggagcccggccuccuggccgugcaggggcugcccgagggccucgccuuccgccggcccgccgaguacgacccgaaggcgcugauggccauccuggagcacucccaccgcauccgguucaagcucaagcgcccccuggaggacgggggccgcgacagcaaggcccuggucgagcucaacggcgugucccugauccccaaggggagccgggacugcggccugcacgggcaggcccccaaggugccgccccaggaccucccgcccaccgccaccagcuccagcauggcguccuuccuguacagcaccgcccugcccaaccacgccauccgcgagcucaagcaggaggcccccuccugcccccuggcccccagcgaccugggccucucccggccgaugcccgagcccaaggcgacgggggcccaggacuucagcgacugcugcggccagaagcccaccggccccgggggcccccugauccagaacguccacgccuccaagcgcauccuguucagcaucgugcacgacaaguccgagaagugggacgccuucaucaaggagaccgaggacaucaacacccuccgggagugcgugcagauccuguucaacagccgcuacgcggaggcccuggggcucgaccacaugguccccgugccguaccggaagaucgccugcgaccccgaggccgucgagaucgugggcauccccgacaagauccccuucaagcgcccgugcacguacggggugcccaagcugaagcggauccuggaggagcgccacuccauccacuucaucaucaagcggauguucgacgagcgcaucuucaccggcaacaaguucaccaaggacaccacgaagcucgagcccgccagcccgcccgaggacaccuccgcggaggucagccgggccaccgugcuggaccuggccggcaacgcccgcuccgacaaggggagcauguccgaggacugcggccccgggaccagcggcgagcucgggggccuccggcccaucaagaucgagcccgaggaccuggacaucauccaggugacggucccggaccccagccccaccuccgaggagaugaccgacagcaugcccggccaccucccguccgaggacagcggguacggcauggagaugcugaccgacaaggggcuguccgaggacgcccgccccgaggagcggcccguggaggacagccacggcgacgugauccgcccccugcggaagcaggucgagcuccuguucaacacgcgcuacgcgaaggccaucggcaucuccgagccggugaaggugcccuacagcaaguuccugaugcaccccgaggagcuguucgucguggggcugcccgagggcaucucccugcgccggccgaacugcuucgggaucgccaagcuccgcaagauccuggaggccagcaacuccauccaguucgugaucaagcggcccgagcugcucaccgagggcgucaaggagcccaucauggacagccaggagcgcgacuccggggacccgcugguggacgagagccugaagcggcagggcuuccaggagaacuacgacgcccgccucucccggaucgacaucgcgaacacccugcgcgagcagguccaggaccuguucaacaagaaguacggcgaggcccucgggaucaaguaccccguccaggugcccuacaagcggaucaagagcaaccccggcuccgugaucaucgaggggcugccgcccggcauccccuuccgcaagcccugcaccuucgggagccagaaccuggagcggauccucgccguggccgacaagaucaaguucacggugacccgcccguuccagggccugauccccaagcccgacgaggacgacgcgaaccggcugggcgagaaggugauccuccgcgagcaggucaaggagcuguucaacgagaaguacggggaggcccugggccucaaccggcccgugcuggugccguacaagcugauccgcgacagccccgacgccgucgaggugaccgggcuccccgacgacauccccuuccggaacccgaacaccuacgacauccaccgccuggagaagauccugaaggcccgggagcacgugcgcauggucaucaucaaccagcuccagcccuucgccgagaucugcaacgacgcgaaggugcccgccaaggacuccagcauccccaagcggaagcgcaagcgcguguccgagggcaacagcgucuccagcuccagcuccagcuccagcuccagcuccagcaacccggacuccguggccagcgccaaccagaucucccuggugcaguggcccauguacauggucgacuacgccgggcugaacgugcagcuccccggcccccugaacuacuga

SEQ ID NO: 30915 - RNA, 2850 nt, Artificial Sequence
  derived and/or modified sequence opt1 from GTF2IRD2__Homo_sapiens__NP_775808
auggcccagguggccgucagcacccugcccguggaggaggaguccagcuccgagacccgcaugguggucacguuccucgugagcgcgcuggaguccaugugcaaggagcuggccaagagcaaggccgagguggccugcaucgccgucuacgagaccgacguguucguggucggcaccgagcgggggugcgcguucgugaacgcccgcaccgacuuccagaaggacuucgccaaguacugcguggccgagggccucugcgaggucaagccgcccugccccgugaacgggaugcagguccacuccggcgagacggagauccugcggaaggcgguggaggacuacuucugcuucugcuacgggaaggcccugggcaccaccgugauggugcccgucccguacgagaagaugcuccgcgaccagagcgccguggugguccagggccugcccgaggggguggccuuccagcaccccgagaacuacgaccuggccacccucaaguggauccuggagaacaaggcgggcaucuccuucaucaucaaccggcccuuccuggggccggagagccagcucggcgggcccggcauggugacggacgccgagcgcuccaucgucagccccuccgagagcugcggccccaucaacgugaagaccgagccgauggaggacuccgggaucagccugaaggccgaggccgucuccgugaagaaggagagcgaggaccccaacuacuaccaguacaacaugcagggcucccaccccagcagcaccuccaacgaggugaucgagauggagcugcccauggaggacagcaccccgcucguccccuccgaggagcccaacgaggaccccgaggccgaggugaagaucgaggggaacacgaacagcuccagcgugaccaacuccgcggccggcgucgaggaccugaacaucguccaggugaccgugccggacaacgagaaggagcggcugagcuccaucgagaagaucaagcagcuccgcgagcaggucaacgaccuguucagccggaaguucggcgaggccaucgggguggacuuccccgugaaggugcccuaccgcaagaucaccuucaaccccggcugcguggucaucgacgggaugccgcccggcgugguguucaaggcccccggguaccuggagaucuccagcaugcggcgcauccucgaggccgcggaguucaucaaguucacggucauccggccccugccgggccuggagcucuccaacgugggcaagcgcaagaucgaccaggaggggcggguguuccaggagaagugggagcgcgccuacuucuucgucgaggugcagaacaucccgaccugccugaucugcaagcagagcauguccgugagcaaggaguacaaccugcggcgccacuaccagaccaaccacuccaagcacuacgaccaguacauggagcggaugcgcgacgagaagcuccacgagcugaagaagggccugcggaaguaccuccuggggagcuccgacaccgagugccccgagcagaagcaggucuucgccaaccccagccccacgcagaagucccccgugcagcccguggaggaccuggccggcaaccucugggagaagcugcgcgagaagauccgcagcuucgucgccuacagcaucgcgaucgacgagaucaccgacaucaacaacaccacccagcuggccaucuucauccgcgggguggacgagaacuucgacguguccgaggagcuccuggacacggucccgaugaccggcaccaagagcggcaacgagaucuucucccggguggagaagucccugaagaaguucugcaucgacuggagcaagcucgugagcgucgccuccaccgggacgcccgccaugguggacgcgaacaacggccuggugaccaagcucaagagccgggucgccaccuucugcaagggggccgagcugaaguccaucugcugcaucauccaccccgagagccugugcgcccagaagcugaagauggaccacgugauggacguggucgugaaguccgugaacuggaucugcagccgcggccucaaccacuccgaguucaccacgcugcuguacgagcucgacagccaguacgggucccugcuguacuacaccgagaucaaguggcugagccggggccucguccugaagcgcuucuucgagagccuggaggagaucgacuccuucaugagcucccggggcaagccccucccgcagcugagcuccaucgacuggauccgcgaccuggccuuccucguggacaugaccaugcaccugaacgcgcugaacaucagccuccaggggcacucccagaucgugacccagauguacgaccugauccgggccuuccuggccaagcucugccugugggagacgcaccugacccgcaacaaccucgcccacuuccccacccugaagcuggccagccggaacgaguccgacggccucaacuacauccccaagaucgcggagcugaagaccgaguuccagaagcgccugagcgacuucaagcucuacgaguccgagcugacccuguucagcucccccuucagcacgaagaucgacuccguccacgaggagcuccagauggaggugaucgaccugcagugcaacaccgugcugaagaccaaguacgacaaggucgggaucccggaguucuacaaguaccucuggggcagcuaccccaaguacaagcaccacugcgccaagauccuguccauguucggcagcaccuacaucugcgagcagcuguucuccaucaugaagcucagcaagacgaaguacugcagccagcugaaggacucccagugggacagcgugcugcacaucgccaccuga

SEQ ID NO: 30916 - RNA, 1098 nt, Artificial Sequence
  derived and/or modified sequence opt1 from GTF3A__Homo_sapiens__NP_002088
auggacccgcccgccguggucgccgagagcguguccagccugaccaucgcggacgccuucaucgccgccggcgaguccagcgcccccaccccgccccgccccgcgcucccccggcgcuucaucugcuccuuccccgacugcagcgccaacuacuccaaggccuggaagcuggacgcccaccugugcaagcacacgggggagcggcccuucgugugcgacuacgagggcugcgggaaggcguucauccgcgacuaccaccucagccggcacauccugacccacaccggcgagaagccguucgucugcgccgccaacgggugcgaccagaaguucaacaccaaguccaaccugaagaagcacuucgagcgcaagcacgagaaccagcagaagcaguacaucugcagcuucgaggacugcaagaagacguucaagaagcaccagcagcucaagauccaccagugccagcacaccaacgagccccuguucaagugcacccaggagggcugcggcaagcacuucgccucccccagcaagcugaagcggcacgccaaggcgcacgagggguacgugugccagaagggcugcuccuucguggccaagaccuggacggagcuccugaagcacguccgcgagacccacaaggaggagauccugugcgaggugugccggaagaccuucaagcgcaaggacuaccucaagcagcacaugaagacccacgcccccgagcgggacgugugccgcugcccgcgggaggggugcggccgcacguacaccaccgucuucaaccugcagagccacauccuguccuuccacgaggagagccggcccuucgugugcgagcacgccgggugcggcaagaccuucgccaugaagcagucccucacgcgccacgcggugguccacgaccccgacaagaagaagaugaagcugaaggugaagaagucccgggagaagcgcagccuggccagccaccucagcggcuacaucccgcccaagcggaagcaggggcagggccugucccugugccagaacggggagagccccaacugcguggaggacaagaugcucuccaccgucgccgugcugacccugggcuga

SEQ ID NO: 30917 - RNA, 6330 nt, Artificial Sequence
  derived and/or modified sequence opt1 from GTF3C1__Homo_sapiens__NP_001511
auggacgcccuggagagccuccuggacgagguggcccuggagggccucgacgggcugugccugcccgcccucuggagccgccuggagacccgggugccgcccuucccccugccccucgagcccugcacccaggaguuccuguggcgcgcccuggccacccaccccggcaucagcuucuacgaggagccccgggagcgccccgaccuccagcugcaggaccgguacgaggagaucgaccuggagaccgggauccucgagagccgccgggaccccguggcccuggaggacguguaccccauccacaugauccuggagaacaaggacggcauccaggggagcugccgcuacuucaaggagcggaagaacaucaccaacgacauccgcaccaagucccuccagccccggugcaccaugguggaggccuucgaccgcuggggcaagaagcugaucaucguggcgagccaggccaugcgguaccgcgcccugaucggccaggagggggaccccgaccucaagcugcccgacuucuccuacugcauccuggagcggcucggccgcagccgguggcagggggagcugcagcgcgaccugcacaccaccgccuucaagguggacgcgggcaagcuccacuaccaccggaagauccugaacaagaacgggcugaucaccaugcagucccacgugauccgccuccccacgggcgcccagcagcacagcauccugcugcuccugaaccgguuccacguggaccgccgcuccaaguacgacauccugauggagaagcucagcgugaugcuguccacccggaccaaccacaucgagacccugggcaagcuccgcgaggagcuggggcugugcgagcggacguucaagcgccucuaccaguacaugcugaacgccggccuggccaaggucgugagccuccggcugcaggagauccaccccgagugcgggcccugcaagaccaagaagggcaccgacgugaugguccgcugccugaagcuccugaaggaguucaagcggaacgaccacgacgacgacgaggacgaggaggugaucuccaagaccgugccgcccgucgacaucguguucgagcgcgacaugcugacgcagaccuacgaccugaucgagcggcgcggcaccaaggggaucagccaggccgagauccggguggcgaugaacgucggcaagcucgaggcccgcaugcugugccggcugcuccagcgcuucaagguggugaagggguucauggaggacgagggccggcagcgcaccacgaaguacaucuccugcgucuucgccgaggagagcgaccugucccggcaguaccagcgcgagaaggcccggagcgagcugcucaccaccgugagccuggccuccaugcaggaggagagccugcuccccgagggggaggacaccuuccuguccgagagcgacuccgaggaggagcgcagcuccagcaagcgccggggccgcggcucccagaaggacacgcgggcgagcgccaaccugcgccccaagacccagccgcaccacuccacccccaccaagggcggguggaagguggucaaccuccacccccugaagaagcagcccccgagcuuccccggggccgccgaggagcgggccugccagucccuggcgagccgcgacucccuccuggacacgagcuccgugagcgagcccaacgucuccuucgugagccacugcgccgacagcaacuccggcgacaucgccgugaucgaggagguccggauggagaaccccaaggagagcuccagcucccugaagaccgggcgccacagcuccggccaggacaagccgcacgagaccuaccggcuccugaagcgccggaaccugaucaucgaggccgugaccaaccuccgccugaucgagagccuguucacgauccagaagaugaucauggaccaggagaagcaggagggcguguccaccaagugcugcaagaaguccaucguccggcucgugcgcaaccuguccgaggaggggcugcuccggcuguaccgcaccaccgugauccaggacggcaucaagaagaaggucgaccugguggugcaccccagcauggaccagaacgacccccucguccgguccgccaucgagcagguccgcuuccggaucagcaacuccagcacggcgaaccgcgugaagaccucccagccgcccgucccccagggggaggccgaggaggacagccagggcaaggaggggcccagcggcuccggcgacagccagcuguccgccagcucccggagcgaguccgggcgcaugaagaaguccgacaacaagaugggcaucaccccgcugcgcaacuaccaccccaucguggugcccgggcucggccggucccugggcuuccugcccaagaugccgcgccuccgggucgugcacauguuccugugguaccugaucuacgggcaccccgccagcaacaccguggagaagcccuccuucaucagcgagcgccggaccaucaagcaggaguccggccgcgcggggguccggcccagcuccagcggcuccgccugggaggccugcagcgaggccccguccaaggggagccaggacggcgugacgugggaggccgagguggagcucgcgaccgagaccgucuacguggacgacgccagcuggaugcgcuacaucccgcccauccccgugcaccgggacuucggcuucgggugggcccuggucuccgacauccugcucugccugccgcugagcaucuucauccagaucguccagguguccuacaaggucgacaaccucgaggaguuccugaacgacccccugaagaagcacacccucauccgcuuccugccccggcccauccgccagcagcugcucuacaagcggcgcuacaucuucagcgugguggagaaccugcagcggcugugcuacaugggccuccugcaguucgggccgacggagaaguuccaggacaaggaccaggucuucaucuuccugaagaagaacgccgugaucguggacaccaccaucugcgacccccacuacaaccucgcccgcuccagccggcccuucgagcgccggcuguacguccugaacuccaugcaggacguggagaacuacugguucgaccuccagugcgugugccugaacacgccccugggcgucgugcgcugcccgcgcgugcggaagaacagcuccacggaccaggggagcgacgaggagggcucccuccagaaggagcaggagagcgcgauggacaagcacaaccuggagcgcaagugcgccaugcuggaguacaccaccggcucccgggaggucguggacgaggggcucauccccggcgacgggcugggcgccgccgggcuggacagcuccuucuacggccaccucaagcgcaacuggaucuggaccagcuacaucaucaaccaggccaagaaggagaacacggcggccgagaacggccugaccgugcggcugcagaccuuccucuccaagcgccccaugccgcugagcgcccgggggaacucccgccugaacaucuggggcgaggcccgggucgggagcgagcucugcgcgggcugggaggagcaguucgagguggaccgcgagcccagccuggaccggaaccgccgggugcgcgggggcaagucccagaagcggaagcgccugaagaaggaccccggcaagaagaucaagcggaagaagaagggggaguuccccggcgagaaguccaagcgccuccgguaccacgacgaggccgaccaguccgcccugcagcgcaugacccggcugcgcgucacguggagcaugcaggaggacgggcuccuggugcugugccgcaucgccuccaacgugcucaacaccaaggucaagggcccguucgugaccuggcaggucgugcgggacauccugcacgccaccuucgaggagagccuggacaagacgucccacagcgugggccgccgggcgcgcuacaucgucaagaacccccaggccuaccucaacuacaaggugugccuggccgagguguaccaggacaaggcccuggucggggacuucaugaaccggcgcggcgacuacgacgaccccaaggugugcgccaacgaguucaaggaguucguggagaagcucaaggagaaguucuccagcgcgcugcggaacuccaaccuggagauccccgacacccuccaggagcuguucgcccgcuaccggguccuggccaucggggacgagaaggaccagacccgcaaggaggacgagcugaacagcguggacgacauccacuuccucgugcugcagaaccugauccaguccacccucgcccugagcgacucccagaugaaguccuaccaguccuuccagacguuccggcuguaccgcgaguacaaggaccacguccucgugaaggccuucauggagugccagaagcggagccuggugaaccgccggcgcgucaaccacacccugggcccgaagaagaaccgggcgcuccccuucgugcccauguccuaccagcugagccagaccuacuaccgcaucuucaccuggcgguuccccagcacgaucugcaccgaguccuuccaguuccuggaccgcaugcgcgccgccgggaagcucgaccagccggaccgguucagcuucaaggaccaggacaacaacgagcccaccaacgacaugguggccuucucccuggacggccccggcgggaacugcgucgcggugcugacccucuucagccugggccugaucuccguggacguccgcauccccgagcagaucaucgugguggacagcuccauggucgagaacgaggugaucaagagccucgggaaggacggcucccuggaggacgacgaggacgaggaggacgaccuggacgagggggugggcggcaagcggcgcagcauggaggucaagccggcccaggccucccacacgaacuaccuccugaugcggggguacuacagccccggcaucguguccacccgcaaccugaaccccaacgacagcaucguggucaacuccugccagaugaaguuccagcuccggugcacccccgugccggcccgccugcggcccgccgcggcgccccuggaggagcucaccauggggacgagcugccugcccgacaccuucaccaagcugaucaacccgcaggagaacacgugcucccucgaggaguucgugcugcagcuggagcucagcggcuacucccccgaggaccugaccgccgcccuggagauccucgaggccaucaucgcgacggggugcuucggcaucgacaaggaggagcugcgccggcgcuucagcgcccuggagaaggccggcgggggccggacccgcaccuucgccgacugcauccaggcccuccuggagcagcaccagguccuggaggucgggggcaacaccgcgcggcucguggccaugggcagcgccuggcccuggcugcugcacuccguccgccucaaggaccgggaggacgccgacauccagcgcgaggacccccaggcccggccgcuggaggggagcuccagcgaggacagcccgcccgagggccaggcgccgcccagccacagcccccgcgggacgaagcggcgcgccagcugggccuccgagaacggcgagaccgacgccgaggggacccagaugacccccgcgaagcgcccggcccugcaggacagcaaccucgcccccucccugggccccggcgccgaggacggggccgaggcgcaggcccccagcccgccgcccgcccuggaggacacggccgccgcgggcgccgcccaggaggaccaggagggggugggcgaguucuccagccccgggcaggagcagcucuccggccaggcccagccgcccgagggcagcgaggacccccggggguucaccgaguccuucggcgccgcgaacaucagccaggccgcccgcgagcgggacugcgaguccgugugcuucaucgggcgccccuggcgggucguggacggccaccugaaccugccggugugcaaggggaugauggaggccaugcucuaccacaucaugacccgccccggcauccccgagagcagccugcugcggcacuaccagggcguccuccagcccguggcggugcuggagcugcuccaggggcuggagucccugggcugcauccgcaagcgguggcuccgcaagccgcggcccgucagccuguucuccacccccgugguggaggaggucgaggugcccagcucccuggacgagagcccgauggccuucuacgagcccacgcucgacugcacccugcgccuggggcggguguucccccacgaggucaacuggaacaaguggauccaccucuga

SEQ ID NO: 30918 - RNA, 2010 nt, Artificial Sequence
  derived and/or modified sequence opt1 from GTPBP1__Homo_sapiens__NP_004277
auggccaccgagcgcagccgguccgccauggacagccccgugccggcguccauguucgcccccgagcccagcucccccggcgccgcccgcgccgcggccgccgccgcgcggcugcacgggggcuucgacagcgacugcuccgaggacggggaggcccucaacggcgagccggagcuggaccugaccagcaagcucguccuggugucccccacgagcgagcaguacgacucccugcuccgccagaugugggagcggauggacgaggggugcggcgagaccaucuacgugaucggccaggggagcgacggcaccgaguacgggcuguccgaggccgacauggaggccagcuacgccaccgucaaguccauggcggagcagaucgaggccgacgugauccugcuccgcgagcggcaggaggccggcgggcgcgugcgggacuaccugguccgcaagcgggugggcgacaacgacuuccuggaggugcgcgucgccguggugggcaacgucgacgccggcaagagcacgcuccugggggugcugacccacggggagcucgacaacggccggggcuucgcgcgccagaagcuguuccggcacaagcacgagaucgaguccgggcgcaccagcuccgugggcaacgacauccugggguucgacagcgagggcaacgucgugaacaagcccgacagccacgggggcucccucgaguggaccaagaucugcgagaaguccacgaaggugaucaccuucaucgaccuggccggccacgagaaguaccugaagaccaccgucuucgggaugacgggccaccuccccgacuucugcaugcugauggugggguccaacgccggcaucguggggaugaccaaggagcaccugggccucgcccuggcccugaacgucccgguguucguggucgugaccaagaucgacaugugccccgcgaacauccuccaggagacccugaagcugcuccagcggcugcucaagagccccggcugccgcaagauccccguccuggugcaguccaaggacgacgugaucgucacggccagcaacuucuccagcgagcggaugugcccgaucuuccagaucuccaacgugaccggggagaaccuggaccugcucaagauguuccugaaccugcucagcccccgcaccuccuaccgggaggaggagcccgccgaguuccagaucgacgacaccuacagcgugcccggcgucgggacggugguguccggcaccacccugcgcgggcugaucaagcucaacgacacccugcugcucggcccggacccccugggcaacuuccugagcaucgccgucaaguccauccaccgcaagcggaugcccgugaaggaggugcgcgggggccagacggccagcuucgcgcucaagaagaucaagcgguccagcauccgcaaggggauggucauggugagcccccggcugaacccgcaggccagcugggaguucgaggccgagauccuggugcugcaccaccccaccaccaucagcccccgcuaccaggccaugguccacugcggcuccauccggcagaccgcgacgauccucagcauggacaaggacugccugcgcaccggcgacaaggccaccgugcacuuccgguucaucaagacccccgaguaccugcacaucgaccagcgccucguguuccgggaggggcgcacgaaggccgucggcaccaucaccaagcugcugcagaccacgaacaacuccccgaugaacagcaagccccagcagaucaagaugcaguccaccaagaaggggccccucaccaagcgggacgagggcgggcccagcggcggcccggccgugggggccccgccgcccggcgacgaggcguccagcgugggggccggccagcccgccgccuccagcaaccugcagccccagcccaagcccuccagcgggggccgccggcgcggcgggcagcggcacaaggucaagucccagggcgccugcgugacccccgcgagcgggugcuga

SEQ ID NO: 30919 - RNA, 1416 nt, Artificial Sequence
  derived and/or modified sequence opt1 from GTPBP3__Homo_sapiens__NP_001122327
auguggcgcggccuguggacccucgccgcccaggcggcccgggggccccgccggcugugcacccgccggagcuccggcgcccccgcccccgggagcggcgccacgaucuucgcgcuguccagcgggcagggccgcugcggcaucgccgugauccggaccuccgggcccgccagcggccacgcccuccgcauccugaccgcgccccgggaccugccgcucgcccgccacgccucccugcggcugcucagcgacccccgcuccggggagccccuggaccgggcccugguccucugguuccccggcccgcagagcuucaccggggaggacugcguggaguuccacgugcacggcggccccgccgucguguccggggugcugcaggcgcugggcagcguccccgggcuccgccccgccgaggccggcgaguucacgcggcgcgccuucgccaacggcaagcugaaccugaccgagguggaggggcucgcggaccugauccacgccgagaccgaggcccagcggcgccaggcccugcggcagcucgacggcgagcuggggcaccugugccgcggcugggccgagacccucacgaaggcgcuggcccacguggaggccuacaucgacuucggggaggacgacaaccuggaggagggcguccucgagcaggccgacaucgaggugcgggcccugcaggucgcgcugggcgcccaccuccgcgacgcccgccgggggcagcgccugcgguccggcgugcacgugguggucaccgggccgcccaacgccggcaagagcucccuggugaaccuccugagccgcaagcccguguccaucgucagccccgagccggggaccacccgggacgugcuggagacgcccguggaccucgcgggcuuccccguccugcuguccgacaccgccggccuccgcgagggggugggccccguggagcaggaggggguccggcgcgcccgggagagcugcaacuuccuggccaccguggucgccagcgugggcgcgcaguccccgagcgacuccagccagcgccugcuccuggugcugaacaaguccgaccuccugagccccgaggggcccggccccggcccggaccugccgccccaccuccugcuguccugccugaccggggagggccucgacgggcugcuggaggcccuccggaaggagcuggccgccgucugcggcgaccccagcacggacccgccccugcucacccgcgcccggcaccagcaccaccuccagggcugccuggacgcgcuggggcacuacaagcaguccaaggaccuggcccuggccgccgaggcccuccgcguggcgcggggccaccugacccgccugaccgggggcgggggcacggaggagauccucgacaucaucuuccaggacuucugcgugggcaaguga

SEQ ID NO: 30920 - RNA, 1905 nt, Artificial Sequence
  derived and/or modified sequence opt1 from GTPBP4__Homo_sapiens__NP_036473
auggcccacuacaacuucaagaagaucaccgugguccccagcgccaaggacuucaucgaccugacccucuccaagacgcagcgcaagaccccgaccgugauccacaagcacuaccagauccaccggauccgccacuucuacaugcggaaggugaaguucacccagcagaacuaccacgaccgccugagccagauccugacggacuuccccaagcucgacgacauccaccccuucuacgcggaccugaugaacauccuguacgacaaggaccacuacaagcucgcccugggccagaucaacaucgccaagaaccuggucgacaacguggccaaggacuacgugcggcucaugaaguacggggacucccuguaccgcugcaagcagcugaagcgggccgcgcucggccgcaugugcaccgucaucaagcggcagaagcagagccuggaguaccuggagcagguccgccagcaccucucccggcugcccaccaucgacccgaacacccgcacgcugcuccugugcggguaccccaacgugggcaagagcuccuucaucaacaaggugacccgggccgacguggacgugcagcccuacgccuucaccaccaagagccuguucgucgggcacauggacuacaaguaccuccgcuggcaggucguggacacgcccggcauccuggaccacccgcuggaggaccggaacaccaucgagaugcaggccaucaccgcgcucgcccaccuccgcgccgccgugcuguacgugauggaccucuccgagcagugcggccacgggcugcgggagcagcuggagcuguuccagaacauccgcccccuguucaucaacaagccccugaucguggucgccaacaagugcgacgugaagcggaucgcggagcucagcgaggacgaccagaagaucuucaccgaccugcaguccgagggcuuccccgugaucgagacgagcacccugaccgaggagggggucaucaaggugaagaccgaggccugcgaccgccuccuggcccaccggguggagacgaagaugaagggcaacaaggucaacgaggugcugaaccgccuccaccuggccaucccgacccgccgggacgacaaggagcgcccgcccuucauccccgagggggucguggcccggcgcaagcggauggagaccgaggagucccgcaagaagcgggagcgcgaccuggagcucgagaugggcgacgacuacauccuggaccugcagaaguacugggaccucaugaaccugagcgagaagcacgacaagauccccgagaucugggagggccacaacaucgcggacuacaucgaccccgccaucaugaagaagcuggaggagcucgagaaggaggaggagcugcggaccgccgccggggaguacgacuccgugagcgaguccgaggacgaggagaugcuggagauccgccagcuggccaagcagauccgggagaagaagaagcucaagauccuggagagcaaggagaagaacacgcagggcccccgcaugccccggaccgcgaagaagguccagcgcaccgugcuggagaaggagaugcggucccucgggguggacauggacgacaaggacgacgcccacuacgccguccaggcccgccggagccgcagcaucacccggaagcgcaagcgcgaggacuccgccccgcccagcuccguggcgcggagcggcuccugcagccgcacgccccgggacguguccggccugcgcgacgucaagauggugaagaaggccaagaccaugaugaagaacgcccagaagaagaugaaccggcuggggaagaagggcgaggccgaccgccacguguucgacaugaagcccaagcaccuccugagcgggaagcggaaggcgggcaagaaggaccgccgguga

SEQ ID NO: 30921 - RNA, 504 nt, Artificial Sequence
  derived and/or modified sequence opt1 from GTSF1__Homo_sapiens__NP_653195
auggaggagaccuacaccgacagccuggaccccgagaagcuccugcagugcccguacgacaagaaccaccagauccgcgccugccgguuccccuaccaccugaucaagugccgcaagaaccaccccgacguggccuccaagcucgcgacgugccccuucaacgcccggcaccaggucccgcgcgccgagaucagccaccacaucuccagcugcgacgaccgguccugcaucgagcaggacguggugaaccagacccgcagccugcggcaggagacccuggccgaguccaccuggcagugcccgcccugcgacgaggacugggacaaggaccucugggagcagacgagcacccccuucgucuggggcaccacccacuacuccgacaacaacagccccgccuccaacaucgugacggagcacaagaacaaccuggcgagcgggaugcgcgugcccaagucccugcccuacguccuccccuggaagaacaacggcaacgcccaguga

SEQ ID NO: 30922 - RNA, 606 nt, Artificial Sequence
  derived and/or modified sequence opt1 from GUCA1A__Homo_sapiens__NP_000400
augggcaacgugauggagggcaagagcgucgaggagcuguccagcaccgagugccaccagugguacaagaaguucaugaccgagugccccuccgggcagcucacgcuguacgaguuccgccaguucuucgggcugaagaaccucagcccguccgccagccaguacguggagcagauguucgagaccuucgacuucaacaaggacggcuacaucgacuucauggaguacguggccgcgcugucccugguccucaaggggaagguggagcagaagcugcggugguacuucaagcuguacgacguggacggcaacggcugcaucgaccgcgacgagcuccugaccaucauccaggccauccgggccaucaaccccugcagcgacaccacgaugaccgccgaggaguucaccgacaccgucuucuccaagaucgacgugaacggggacggcgagcugagccucgaggaguucaucgagggggugcagaaggaccagaugcugcuggacacgcucacccgcucccuggaccugacccggaucguccgccggcuccagaacggcgagcaggacgaggagggggccgacgaggcggccgaggccgccggcuga

SEQ ID NO: 30923 - RNA, 603 nt, Artificial Sequence
  derived and/or modified sequence opt1 from GUCA1B__Homo_sapiens__NP_002089
augggccaggaguucagcugggaggaggccgaggccgcgggggagaucgacguggccgagcugcaggagugguacaagaaguucgucauggagugccccuccggcacccucuucaugcacgaguucaagcgcuucuucaaggugaccgacgacgaggaggccagccaguacguggaggggauguuccgggccuucgacaagaacggcgacaacacgaucgacuuccuggaguacgucgccgcgcugaaccucgugcugcgcgggacccuggagcacaagcucaaguggaccuucaagaucuacgacaaggacggcaacggcugcaucgaccggcuggagcugcucaacaucguggaggggaucuaccagcugaagaaggccugccgccgggagcugcagaccgagcagggccagcuccugacgccggaggaggucguggaccgcaucuuccugcucguggacgagaacggggacggccagcugucccugaacgaguucgucgagggggcccggcgcgacaagugggugaugaagaugcuccagauggacaugaaccccagcuccuggcuggcccagcagcggcgcaagagcgcgauguucuga

SEQ ID NO: 30924 - RNA, 720 nt, Artificial Sequence
  derived and/or modified sequence opt1 from GUCD1__Homo_sapiens__NP_001271183
augcgcaccgaggccgaggccgcggggcccccgcuggagcccggcgacuucgugcagcuccccguccccgugauccagcagcuguaccacugggacugcggccuggccugcagccggauggugcuccgcuaccuggggcagcuggacgacuccgaguucgagcgggcccuccagaagcugcagcugacccgcagcaucuggacgaucgaccucgccuaccugaugcaccacuucggcguccggcaccgcuucugcacccagacccuggggguggacaagggcuacaagaaccaguccuucuaccggaagcacuucgacaccgaggagacgcgcgugaaccagcuguucgcccaggcgaaggccugcaagguccucguggagaagugcaccgugagcgucaaggacauccaggcccaccuggcccagggccacguggcgaucgugcucgucaacuccggggugcugcacugcgaccugugcagcuccccggugaaguacugcugcuucacccccagcggccaccacugcuucugccggacccccgacuaccaggggcacuucaucguccuccgcggcuacaaccgggccacggggugcaucuucuacaacaaccccgccuacgccgaccgcaugugcuccaccagcaucuccaacuucgaggaggcccggaccagcuacggcaccgacgaggacauccuguucguguaccuggacuccuga

SEQ ID NO: 30925 - RNA, 2199 nt, Artificial Sequence
  derived and/or modified sequence opt1 from GUCY1A2__Homo_sapiens__NP_000846
augagccgccggaagaucuccagcgaguccuucagcucccugggcagcgacuaccucgagaccucccccgaggaggagggggagugcccgcugagccgccugugcuggaacggcucccggagcccgcccgggccccucgagcccucccccgccgccgcggccgccgccgccgcgcccgcccccaccccggccgccagcgcggccgccgccgccgcgacggccggcgcccgccgggugcagcgccggcgccgggucaaccuggacucccugggggagagcaucucccgccucaccgcccccagcccccagaccauccagcagacccugaagcggacgcugcaguacuacgagcaccaggugaucggcuaccgcgacgccgagaagaacuuccacaacaucuccaaccggugcagcuacgcggaccacuccaacaaggaggagaucgaggacgugagcggcauccuccagugcaccgccaacauccuggggcugaaguucgaggagauccagaagcgcuucggcgaggaguucuucaacaucugcuuccacgagaacgagcggguccuccgcgccgucgggggcacccugcaggacuucuucaacggguucgacgcccugcucgagcacauccggaccagcuucggcaagcaggccacgcuggagucccccagcuuccugugcaaggagcucccggagggcacccugaugcugcacuacuuccacccccaccacaucgugggguucgcgaugcucggcaugaucaaggccgccgggaagaagaucuaccgccuggacguggagguggagcaggucgccaacgagaagcugugcuccgacgugagcaaccccggcaacugcuccugccucaccuuccugaucaaggagugcgagaacaccaacaucaugaagaaccugccccagggcacgagccaggugccggccgaccuccggaucuccaucaacaccuucugccgcgcguuccccuuccaccugauguucgaccccagcauguccgugcugcagcucggggagggccugcggaagcagcugcgcugcgacacccacaagguccucaaguucgaggacugcuucgagaucgugagccccaaggugaacgccaccuucgagcgcguccugcugcggcucuccacgccguucgugauccgcaccaagcccgaggccagcggguccgagaacaaggacaaggugauggaggucaagggccagaugauccacgugcccgagagcaacuccauccuguuccuggggagccccugcguggacaagcucgacgagcugaugggccggggccugcaccucuccgacaucccgauccacgacgccacccgcgacgucauccuggugggggagcaggcgaaggcccaggacggccugaagaagcggauggacaagcucaaggccacccuggagcgcacgcaccaggcccuggaggaggagaagaagaagaccguggaccuccuguacagcaucuuccccggggacgucgcccagcagcuguggcagggccagcagguccaggcgcggaaguucgacgacgugaccaugcuguucuccgacaucgugggguucaccgccaucugcgcccagugcacgcccaugcaggucaucagcaugcucaacgagcuguacacccgcuucgaccaccagugcggcuuccuggacaucuacaagguggagaccaucggcgacgccuacugcguggccgcggggcuccaccgcaagagccugugccacgccaagcccaucgcccugauggcccucaagaugauggagcuguccgaggaggugcugaccccggacggccggcccauccagaugcggaucgggauccacagcggcuccguccucgccgggguggugggcguccgcaugccccgguacugccuguucggcaacaacgugacgcuggcgagcaaguucgaguccgggagccacccgcgccggaucaacgugucccccaccaccuaccagcuccugaagcgcgaggagagcuucaccuucaucccccggucccgcgaggagcugcccgacaacuucccgaaggagauccccggcaucugcuacuuccucgagguccggacggggcccaagcccccgaagcccagccuguccagcucccgcaucaagaaggugagcuacaacaucggcaccauguuccugcgcgagaccucccucuga

SEQ ID NO: 30926 - RNA, 1368 nt, Artificial Sequence
  derived and/or modified sequence opt1 from GUCY1A3__Homo_sapiens__NP_001124157
augcccccgugcuuccacaacgacugcagcgaguucgugaaccagcccuaccugcucuacuccguccacaugaaguccaccaagcccucccugagccccuccaagccgcagagcucccuggugauccccaccagccucuucugcaagaccuuccccuuccacuucauguucgacaaggacaugaccauccugcaguucggcaacgggauccgccggcugaugaaccgccgggacuuccagggcaagcccaacuucgaggaguacuucgagauccucaccccgaagaucaaccagaccuucuccgggaucaugacgaugcugaacaugcaguucgugguccgcgugcggcgcugggacaacagcgugaagaaguccagccgggucauggaccugaagggccagaugaucuacaucguggaguccagcgccauccucuuccuggggucccccugcguggaccgccuggaggacuucaccggccggggccucuaccugagcgacauccccauccacaacgcccugcgcgacgucgugcucaucggggagcaggcgcgggcccaggacggccugaagaagcgccuggggaagcucaaggccacccuggagcaggcccaccaggcccuggaggaggagaagaagaagaccguggaccuccugugcuccaucuuccccugcgaggucgcgcagcagcuguggcagggccagguggugcaggccaagaaguucagcaacgucacgaugcuguucuccgacaucgugggguucaccgccaucugcagccagugcagcccgcuccaggugaucaccaugcugaacgcccucuacacccgguucgaccagcagugcggcgagcuggacgucuacaagguggagacgaucggcgacgcguacugcguggccgggggccugcacaaggaguccgacacccacgccguccagaucgcccucauggcccugaagaugauggagcugagcgacgaggugaugagcccccacggggagcccaucaagaugcgcaucggccuccacagcggcuccguguucgcgggggucgugggcgucaagaugccccgguacugccuguucgggaacaacgugacccuggccaacaaguucgagagcugcuccgugccgcgcaagaucaacgucagccccaccacguaccggcuccugaaggacugccccggcuucguguucacgccccgcucccgggaggagcugccgcccaacuuccccagcgagauccccgggaucugccacuuccucgacgccuaccagcagggcaccaacuccaagccgugcuuccagaagaaggacguggaggacggcaacgccaacuuccuggggaaggccagcggcaucgacuga

SEQ ID NO: 30927 - RNA, 1860 nt, Artificial Sequence
  derived and/or modified sequence opt1 from GUCY1B3__Homo_sapiens__NP_000848
auguacggcuucgugaaccacgcccuggagcuccuggugauccgcaacuacgggcccgaggugugggaggacaucaagaaggaggcccagcuggacgaggagggccaguuccucgugcggaucaucuacgacgacagcaagaccuacgaccuggucgcggccgccuccaaggugcugaaccucaacgccggggagauccugcagauguucggcaagauguucuucguguucugccaggagagcggguacgacaccauccugcgcguccucggcuccaacgugcgggaguuccugcagaaccuggacgcccuccacgaccaccuggcgacgaucuacccgggcaugcgcgcccccagcuuccggugcaccgacgccgagaaggggaagggccugauccuccacuacuacuccgagcgcgaggggcugcaggacaucgugaucggcaucaucaagaccgucgcccagcagauccacgggaccgagaucgacaugaaggugauccagcagcggaacgaggagugcgaccacacgcaguuccugaucgaggagaaggagagcaaggaggaggacuucuacgaggaccucgaccgcuucgaggagaacggcacccaggagucccggaucagccccuacaccuucugcaaggcguuccccuuccacaucaucuucgaccgcgaccugguggucacccagugcggcaacgccaucuaccgggugcugccgcagcuccagcccgggaacugcucccugcugagcguguucucccucguccgcccccacaucgacaucagcuuccacggcauccugucccacaucaacacgguguucgugcugcggagcaaggaggggcuccuggacgucgagaagcuggagugcgaggacgagcucaccggcaccgagaucuccugccugcgccugaagggccagaugaucuaccuccccgaggccgacagcauccuguuccugugcuccccgagcgugaugaaccucgacgaccugacccggcgcgggcuguaccucuccgacaucccccugcacgacgccacgcgggaccuggugcuccugggcgagcaguuccgcgaggaguacaagcugacccaggagcucgagauccugaccgaccggcugcagcucacccugcgcgcccuggaggacgagaagaagaagacggacacccugcucuacagcguccugccgcccagcguggcgaacgagcugcggcacaagcgccccgugcccgccaagcgcuacgacaacgucaccauccucuucuccgggaucgugggcuucaacgccuucugcagcaagcacgccuccggggagggcgccaugaagaucgucaaccugcugaacgaccucuacacccgguucgacacgcugaccgacagccgcaagaaccccuucguguacaagguggagaccgucggcgacaaguacaugaccguguccgggcugcccgagccgugcauccaccacgcgcggagcaucugccaccucgcccuggacaugauggagaucgccggccaggugcaggucgacggggaguccgugcagaucacgaucggcauccacaccggggagguggucaccggcgugaucggccagcgcaugccccgguacugccuguucgggaacaccgugaaccucacgagccgcaccgagaccaccggcgagaaggggaagaucaacgucuccgaguacacguaccggugccugaugagccccgagaacuccgacccccaguuccaccuggagcaccgcggcccggugagcaugaaggggaagaaggagcccaugcaggucugguuccucucccggaagaacaccggcaccgaggagaccaagcaggacgacgacuga

SEQ ID NO: 30928 - RNA, 3222 nt, Artificial Sequence
  derived and/or modified sequence opt1 from GUCY2C__Homo_sapiens__NP_004954
augaagacccugcuccuggaccuggcccucuggagccugcuguuccagcccggcuggcucuccuucagcucccaggugagccagaacugccacaacggguccuacgagaucagcguccugaugaugggcaacuccgccuucgcggagccccugaagaaccucgaggacgccgugaacgaggggcuggagaucgugcgcggccggcugcagaacgccgggcucaacgucaccgugaacgccacguucauguacagcgacggccugauccacaacuccggcgacugccgcagcuccacgugcgaggggcuggaccuccugcggaagaucagcaacgcccagcgcaugggcugcgugcugaucgggcccuccugcaccuacagcaccuuccagauguaccucgacaccgagcuguccuaccccaugaucagcgcgggcuccuucgggcugagcugcgacuacaaggagacccucacccggcugaugucccccgcccgcaagcugauguacuuccucgucaacuucuggaagaccaacgaccugccguucaagacguacagcuggagcaccuccuacguguacaagaacggcaccgagaccgaggacugcuucugguaccugaacgcccucgaggccagcguguccuacuucagccacgagcugggcuucaaggucgugcugcggcaggacaaggaguuccaggacauccucauggaccacaaccgcaaguccaacgugaucaucaugugcgggggccccgaguuccuguacaagcugaagggggaccgggcggucgccgaggacaucgugaucauccucguggaccuguucaacgaccaguacuucgaggacaacgucacggcccccgacuacaugaagaacgugcuggugcucacccugagccccggcaacucccugcucaacagcuccuucagccgcaaccuguccccgaccaagcgggacuucgcccuggccuaccucaacggcauccugcuguucgggcacaugcucaagaucuuccuggagaacggcgagaacaucaccacgcccaaguucgcgcacgccuuccgcaaccugaccuucgagggguacgacggccccgucacccucgacgacuggggcgacguggacagcaccauggugcugcuguacacguccgucgacaccaagaaguacaaggugcugcucaccuacgacacccacgugaacaagacguaccccgucgacaugagcccgaccuucaccuggaagaacuccaagcugcccaacgacaucaccgggcggggcccccagauccugaugaucgccguguucacgcucaccggggccgucgugcugcugcuccugguggcccugcucaugcugcgcaaguaccggaaggacuacgagcugcgccagaagaaguggagccacaucccgcccgagaacaucuucccccucgagaccaacgagaccaaccacgucucccugaagaucgacgacgacaagcggcgcgacacgauccagcggcugcgccagugcaaguacgacaagaagcgggugauccucaaggaccugaagcacaacgacggcaacuucaccgagaagcagaagaucgagcugaacaagcuccugcagaucgacuacuacaaccugaccaaguucuacgggaccgugaagcucgacacgaugaucuucggcgucaucgaguacugcgagcgcgggagccugcgcgaggugcugaacgacaccaucuccuaccccgacggcaccuucauggacugggaguucaagaucagcgugcucuacgacaucgcgaagggcaugagcuaccugcacuccagcaagaccgagguccacgggcggcugaaguccaccaacugcgugguggacagccgcauggucgugaagaucacggacuucggcugcaacuccauccugcccccgaagaaggaccuguggaccgcccccgagcaccuccggcaggccaacaucagccagaagggggacguguacuccuacggcaucaucgcccaggagaucauccuccgcaaggagaccuucuacacccugagcugccgggaccgcaacgagaagaucuuccgggucgagaacuccaacgggaugaagcccuuccgccccgaccuguuccucgagacggccgaggagaaggagcuggagguguaccugcucgugaagaacugcugggaggaggacccggagaagcggcccgacuucaagaagaucgagaccacccuggcgaagaucuucggccuguuccacgaccagaagaacgagagcuacauggacacccucauccgccggcugcagcuguacucccgcaaccucgagcaccuggucgaggagcggacgcagcuguacaaggccgagcgcgaccgggccgaccgccucaacuucaugcugcugccccggcucguggucaagagccugaaggagaagggcuucguggagcccgagcuguacgaggaggugaccaucuacuucuccgacaucgugggguucaccaccaucugcaaguacagcacgccgauggaggucguggacaugcucaacgacaucuacaaguccuucgaccacaucguggaccaccacgacgucuacaagguggagaccaucggcgacgccuacaugguggccagcgggcugcccaagcgcaacggcaaccggcacgcgaucgacaucgccaagauggcccuggagauccucuccuucaugggcaccuucgagcuggagcaccuccccgggcugccgaucuggauccgcaucggcguccacagcgggcccugcgccgcgggcgugguggggaucaagaugccccgcuacugccuguucggcgacaccgucaacacggccagccggauggaguccaccggccugccccuccgcauccacgugagcggguccaccaucgccauccugaagcggaccgagugccaguuccuguacgaggugcgcggcgagacguaccucaaggggcggggcaacgagaccaccuacuggcugaccgggaugaaggaccagaaguucaaccugccgacgccgcccaccgucgagaaccagcagcgccuccaggccgaguucagcgacaugaucgccaacucccugcagaagcggcaggcggccggcauccgcagccagaagccccggcgcguggccuccuacaagaagggcacccuggaguaccuccagcugaacaccacggacaaggagagcaccuacuucuga

SEQ ID NO: 30929 - RNA, 3312 nt, Artificial Sequence
  derived and/or modified sequence opt1 from GUCY2D__Homo_sapiens__NP_000171
augaccgccugcgcccgccgggcgggcgggcugcccgacccgggccucugcgggcccgccuggugggcccccagccugccccgccugccgcgggcccucccccgccugccccugcuccugcugcuccugcugcuccagcccccggcccuguccgcgguguucaccgucggcgugcuggggcccugggccugcgaccccaucuucagccgggcccgccccgaccucgccgcgcggcuggccgccgcccgccugaaccgggacccgggccucgccggcgggccccgcuucgagguggcgcugcugcccgagcccugccggacgccgggcucccucggggccgucagcuccgcccuggcccgcgugagcggccugguggggcccgucaaccccgccgcgugccggcccgccgagcuccuggccgaggaggccggcaucgcccuggugccguggggcugccccuggacccaggcggaggggaccaccgcccccgccgugacgcccgccgccgacgcgcucuacgcccugcugcgcgccuucggcugggcccgggucgcgcucgugaccgccccgcaggaccuguggguggaggccgggcgcucccugagcaccgcccuccgggcccgcggccugcccgucgcguccgugaccagcauggagccccuggaccucuccggcgcccgggaggcccugcgcaaggugcgggacgggccccgcgucacggccgugaucauggugaugcacagcguccugcucggcggggaggagcagcgcuaccugcuggaggccgcggaggagcucggccugaccgacgggucccugguguuccucccguucgacaccauccacuacgcccugagccccggccccgaggcccuggccgcccucgcgaacuccagccagcugcggcgcgcccacgacgccgugcugacccugacgcggcacugcccguccgagggcagcguccucgacucccugcgccgggcccaggagcgccgggagcugcccagcgaccucaaccugcagcaggucagcccccuguucgggaccaucuacgacgcgguguuccuccuggcccgcggcguggccgaggcccgggccgcggccgggggccgcuggguguccggggccgccgucgcccggcacauccgcgacgcccaggugcccggcuucugcggcgaccucgggggcgacgaggagccgcccuucgugcuccuggacaccgacgcggccggggaccggcuguucgccaccuacaugcucgaccccgcccgcggcagcuuccuguccgcggggacgcggaugcacuucccccgcggcggcagcgccccggggcccgaccccuccugcugguucgaccccaacaacaucugcggcgggggccuggagccgggccucgucuuccugggguuccugcucguggugggcauggggcuggccggcgccuuccuggcgcacuacguccggcaccgccuccugcacaugcagauggugagcgggcccaacaagaucauccugaccguggacgacaucaccuuccuccacccccacggcggcaccucccggaaggucgcccaggggagccgcuccagccugggcgcccgcuccaugagcgacauccgguccgggcccagccagcaccuggacuccccgaacaucggcguguacgagggggaccgcguguggcucaagaaguuccccggcgaccagcacaucgccauccggcccgccacgaagaccgcguucagcaagcugcaggagcugcgccacgagaacgucgcccucuaccugggccuguuccucgcccgcggggccgagggccccgccgcgcugugggaggggaaccuggccgugguguccgagcacugcacccggggcagccuccaggaccugcuggcccagcgggagaucaagcucgacuggauguucaaguccagccugcugcucgaccugaucaaggggauccgcuaccugcaccaccggggcgucgcccacggccgccucaagagccggaacugcaucguggacgggcgcuucgugcugaagaucaccgaccacggccacgggcggcugcucgaggcccagaagguccugccggagccgccccgcgcggaggaccagcuguggacggcccccgagcuccugcgggaccccgcccuggagcgccggggcacccucgccggggacguguucucccuggccaucaucaugcaggagguggucugccgcagcgcgcccuacgccaugcuggagcucacccccgaggagguggugcagcggguccgcuccccgccgccccugugccggccccuggugagcauggaccaggcccccguggagugcauccuccugaugaagcagugcugggccgagcagcccgagcugcgccccuccauggaccacaccuucgaccucuucaagaacaucaacaagggccgcaagacgaacaucaucgacagcaugcugcggaugcuggagcaguacuccagcaaccucgaggaccugauccgcgagcggaccgaggagcuggagcucgagaagcagaagaccgaccgccugcugacccagaugcugcccccguccgucgcggaggcccugaagacgggcacccccguggagcccgaguacuucgagcaggucacccuguacuucagcgacaucgugggguucaccacgaucuccgccaugagcgagcccaucgaggugguggaccuccugaacgaccuguacacccucuucgacgccaucaucggcucccacgacgucuacaagguggagaccaucggggacgccuacaugguggcgagcggccugccgcagcggaacggccagcgccacgccgccgagaucgccaacaugucccuggacauccucagcgccgucgggaccuuccggaugcgccacaugcccgaggugcccgugcggauccgcaucggccugcacuccgggcccugcgucgcgggcgugguggggcugaccaugccgcgguacugccucuucggcgacacggucaacaccgccagccgcauggagagcaccggccugcccuaccggauccacgugaaccuguccaccguggggauccuccgcgcccuggacagcggcuaccaggucgagcugcgggggcgcacggagcucaagggcaagggggccgaggacaccuucuggcuggugggccggcgcggcuucaacaagcccauccccaagccgcccgaccugcagcccggguccagcaaccacggcaucucccuccaggagaucccgcccgagcggcgccgcaagcuggagaaggcccggcccgggcaguucagcuga

SEQ ID NO: 30930 - RNA, 3327 nt, Artificial Sequence
  derived and/or modified sequence opt1 from GUCY2F__Homo_sapiens__NP_001513
auguuccugggccucgggcgcuucagccggcuggugcugugguucgccgccuuccgcaagcuccugggccaccacgggcuggcguccgccaaguuccucuggugccugugccugcucagcgucaugucccugccccagcaggucuggacccugccguacaagaucggcgugguggggcccugggccugcgacagccucuucuccaaggcccugcccgagguggccgcgcggcuggccaucgagcgcaucaaccgggaccccagcuucgaccucuccuacagcuucgaguacgugauccugaacgaggacugccagaccucccgcgcccugagcuccuucaucagccaccaccagauggccuccggcuucaucggcccgacgaaccccggguacugcgaggcggccagccuccugggcaacuccugggacaaggggaucuucagcugggccugcgucaacuacgagcuggacaacaagaucuccuaccccaccuucagccggacccuccccuccccgauccgcgugcuggugaccgucaugaaguacuuccagugggcccacgccggcgugaucagcagcgacgaggacaucugggugcacacggcgaaccgggucgccuccgcccugcgcagccacgggcuccccgugggcgugguccugaccaccggccaggacucccagagcaugcggaaggcccugcagcgcauccaccaggccgaccggauccgcaucaucaucaugugcaugcacuccgcgcucaucgggggcgagacccagaugcaccuccuggagugcgcccacgaccugaagaugacggacgggaccuacguguucgugcccuacgacgcccugcuguacagccuccccuacaagcacaccccguaccggguccugcgcaacaaccccaagcugcgggaggccuacgacgccgugcucaccaucacgguggagucccaggagaagaccuucuaccaggcguucaccgaggccgccgcccgcggcgagauccccgagaagcuggaguucgaccaggucagcccccuguucggcaccaucuacaacuccaucuacuucaucgcccaggcgaugaacaacgccaugaaggagaacgggcaggccggcgccgcgagccucgugcagcacucccggaacaugcaguuccacggguucaaccagcugaugcgcacggacagcaacggcaacgggaucuccgaguacgugauccuggacaccaaccucaaggagugggagcugcacagcaccuacaccgucgacauggagauggagcugcuccgguucggcggcacgccgauccacuuccccgggggccgcccgccccgcgccgacgccaagugcugguucgccgaggggaagaucugccacggcgggaucgaccccgccuucgcgaugauggugugccugacccugcucaucgcccugcuguccaucaacggcuucgccuacuucauccggcgccggaucaacaagauccagcugaucaagggccccaaccgcauccuccugacccuggaggacgucaccuucaucaacccccacuucgggagcaagcggggcucccgcgccagcguguccuuccagaucacgagcgaggugcagagcgggcggagcccccgccucuccuucuccagcggcucccugaccccggccaccuacgagaacagcaacaucgcgaucuacgagggggacugggucuggcugaagaaguucucccucggcgacuucggcgaccucaagagcaucaagucccgggccagcgacguguucgagaugaugaaggaccugcgccacgagaacaucaacccccugcugggguucuucuacgacuccggcauguucgccaucgugaccgaguucugcagccgggggucccuggaggacauccucacgaaccaggacgucaagcuggacuggauguucaagagcucccugcuccuggaccugaucaagggcaugaaguaccuccaccaccgcgaguucgugcacggccggcucaagagccgcaacugcguggucgacgggcgguucgugcugaaggugaccgacuacggcuucaacgacauccuggagaugcugcgccuguccgaggaggagagcagcauggaggagcuccuguggaccgcccccgagcugcuccgggcgccccgcgggucccggcugggcagcuucgccggggacgucuacuccuucgccaucaucaugcaggaggugauggugcgcggcaccccguucugcaugauggaccugcccgcccaggagaucaucaaccgccucaagaagcccccgcccgucuaccggcccguggugcccccggagcacgccccgcccgagugccugcagcugaugaagcagugcugggcggaggccgccgagcagcgccccacguucgacgagaucuucaaccaguucaagaccuucaacaagggcaagaagaccaacaucaucgacagcaugcuccggaugcuggagcaguacuccagcaaccuggaggaccucauccgcgagcggaccgaggagcuggagaucgagaagcagaagacggagaagcugcucacccagaugcugccgcccuccgucgccgagagccugaagaaggggugcaccguggagcccgagggcuucgaccucgugacccuguacuucuccgacaucgucggguucaccacgaucagcgccauguccgagcccaucgaggugguggaccugcucaacgaccuguacacccuguucgacgcgaucaucggcagccacgacgucuacaagguggagaccaucggggacgccuacaugguggccuccggccuccccaagcgcaacggcagccggcacgccgccgagaucgcgaacaugucccuggacauccugagcuccgucgggaccuucaagaugcgccacaugcccgaggugcccgugcggauccgcaucggccuccacagcgggcccgucguggccggcguggucgggcugacgaugccgcgguacugccuguucggcgacaccgugaacaccgccucccgcauggagagcaccggccuccccuaccggauccacgugagccuguccacggucaccauccugcagaaccucagcgagggguacgagguggagcugcgcggccggaccgagcugaaggggaagggcaccgaggagacguucuggcucaucgggaagaagggcuucaugaagccccugcccgugccgccgcccgucgacaaggacggccagguggggcacggccugcagcccguggagaucgccgccuuccagcgccggaaggcggagcgccagcucguccggaacaagcccuga

SEQ ID NO: 30931 - RNA, 657 nt, Artificial Sequence
  derived and/or modified sequence opt1 from GUK1__Homo_sapiens__NP_001152862
augcugcgccggccccucgccggccuggccgcggccgcccuggggcgcgccccgcccgacggcaugagcgggccccggcccgugguccucuccggcccgagcggggccggcaaguccacccugcugaagcgccuccugcaggagcacagcggcaucuucggguucuccgugagccacaccacgcggaacccccgccccggcgaggagaacgggaaggacuacuacuucgugacccgggaggucaugcagcgcgacaucgcggccggcgacuucaucgagcacgccgaguucuccgggaaccuguacggcaccagcaagguggccgugcaggcgguccaggccaugaaccggaucugcgugcucgacguggaccugcagggcguccgcaacaucaaggccaccgaccugcggcccaucuacaucuccgugcagccgcccagccuccacgugcuggagcagcgccugcggcagcgcaacacggagaccgaggagucccucgucaagcggcuggccgccgcgcaggccgacauggagagcuccaaggagcccgggcuguucgacguggugaucaucaacgacagccucgaccaggccuacgccgagcugaaggaggcccuguccgaggagaucaagaaggcgcagcgcaccggcgccuga

SEQ ID NO: 30932 - RNA, 876 nt, Artificial Sequence
  derived and/or modified sequence opt1 from GULP1__Homo_sapiens__NP_001239597
augaaccgcgccuucagccggaagaaggacaagaccuggaugcacacccccgaggcccuguccaagcacuucauccccuacaacgcgaaguuccucggcagcacggagguggagcagcccaaggggaccgaggucgugcgcgacgccgugcggaagcugaaguucgcccgccacaucaagaaguccgagggccagaagauccccaaggucgagcugcagaucagcaucuacggggugaagauccucgagcccaagaccaaggaggugcagcacaacugccagcugcaccggaucuccuucugcgccgacgacaagaccgacaagcgcaucuucacguucaucugcaaggacagcgaguccaacaagcaccugugcuacgucuucgacagcgagaagugcgccgaggagaucacccucaccaucggccaggcguucgaccuggccuaccggaaguuccuggaguccgggggcaaggacguggagacccgcaagcagaucgccggccuccagaagcggauccaggaccuggagacggagaacauggagcugaagaacaaggugcaggaccucgagaaccagcugcgcaucacccaggucagcgccccgcccgcgggguccaugacccccaagagccccuccaccgacaucuucgacaugaucccguucagccccaucucccaccagagcuccaugcccacgcggaacggcacccagcccccgcccgugcccagccgcuccaccgagaucaagcgggaccuguucggggccgagcccuucgacccguucaacugcggcgccgccgacuucccgcccgacauccagagcaagcucgacgagaugcagcgccagcgguggcgcgggagcaagugggacuga

SEQ ID NO: 30933 - RNA, 1956 nt, Artificial Sequence
  derived and/or modified sequence opt1 from GUSB__Homo_sapiens__NP_000172
auggcccgcggcagcgccguggcgugggccgcccuggggccccuccuguggggcugcgcccuggggcuccagggcgggaugcuguacccgcaggagucccccagccgggagugcaaggagcuggacggccucugguccuuccgcgccgacuucagcgacaaccggcgccggggcuucgaggagcagugguaccgccggccccugugggaguccgggcccaccgucgacaugccggugcccagcuccuucaacgacaucagccaggacuggcgccugcggcacuucgugggcugggucugguacgagcgcgaggugauccuccccgagcgguggacccaggaccugcgcacgcgggugguccugcgcaucggguccgcgcacagcuacgccaucgugugggugaacggcgucgacacccucgagcacgagggcggguaccugcccuucgaggccgacaucuccaaccugguccaggugggcccgcuccccagccggcugcgcaucaccaucgccaucaacaacacccugacgcccaccacccugcccccggggaccauccaguaccucacggacaccuccaaguaccccaagggcuacuucgugcagaacaccuacuucgacuucuucaacuacgcggggcugcagcggagcgugcuccuguacaccacgcccaccaccuacaucgacgacaucaccgugacgaccuccgucgagcaggacagcggccuggugaacuaccagaucuccgugaagggcagcaaccucuucaagcuggagguccgccugcucgacgccgagaacaaggugguggccaacgggaccggcacccaggggcagcugaagguccccggcgugucccugugguggccguaccucaugcacgagcggcccgccuaccuguacagccuggaggugcagcucacggcccagaccagccuggggcccgucuccgacuucuacacccugcccgugggcauccgcaccgucgcggugaccaagagccaguuccucaucaacggcaagccguucuacuuccacggggugaacaagcacgaggacgccgacauccggggcaagggguucgacuggccccugcuggucaaggacuucaaccuccugcgcuggcugggcgccaacgccuuccgcacgucccacuaccccuacgccgaggaggugaugcagaugugcgaccgguacgggaucguggucaucgacgagugccccggcgugggccucgcgcugccgcaguucuucaacaacgugagccugcaccaccacaugcaggucauggaggagguggugcgccgggacaagaaccaccccgccgucgugaugugguccguggccaacgagcccgccagccaccucgaguccgccggguacuaccugaagauggucaucgcgcacaccaagagccuggaccccucccgcccggugaccuucgugagcaacuccaacuacgccgccgacaagggcgcccccuacgucgacgugaucugccucaacagcuacuacuccugguaccacgacuacgggcaccuggagcugauccagcugcagcucgccacgcaguucgagaacugguacaagaaguaccagaagcccaucauccagagcgaguacggcgcggagaccaucgccggguuccaccaggacccgccccugauguucaccgaggaguaccagaagucccugcucgagcaguaccaccugggccuggaccagaagcggcgcaaguacguggucggcgagcucaucuggaacuucgccgacuucaugaccgagcagagccccacgcgggugcuggggaacaagaagggcaucuucacccgccagcggcagcccaaguccgccgcguuccugcuccgcgagcgguacuggaagaucgccaacgagacccgcuacccgcacagcguggccaagucccagugccuggagaacagccuguucaccuga

SEQ ID NO: 30934 - RNA, 1002 nt, Artificial Sequence
  derived and/or modified sequence opt1 from GYG1__Homo_sapiens__NP_001171649
augaccgaccaggccuucgugacccugacgaccaacgacgccuacgcgaagggcgcccucguccuggggagcucccugaagcagcaccgcaccacccggcgccucguggugcuggccacgccccaggucagcgacuccaugcggaaggugcuggagaccguguucgacgaggucaucaugguggacgugcucgacagcggcgacuccgcccaccugacccugaugaagcgcccggagcucggggucacccugacgaagcugcacugcuggagccucacccaguacuccaagugcguguucauggacgccgacacccuggugcuggcgaacaucgacgaccucuucgaccgggaggagcugagcgccgcccccgaccccggcuggcccgacugcuucaacuccggggucuucguguaccagccgagcguggagaccuacaaccagcugcuccaccuggccuccgagcagggcagcuucgacggcggggaccagggcauccugaacacguucuucuccagcugggcgaccaccgacauccgcaagcaccuccccuucaucuacaaccuguccagcaucuccaucuacagcuaccugcccgccuucaaggucuucggggccuccgccaagguggugcacuuccucggccgggucaagcccuggaacuacaccuacgacccgaagaccaagagcgucaagagcgaggcccacgaccccaacaugacgcaccccgaguuccugauccugugguggaacaucuucaccaccaacgugcucccccugcugcagcaguucgggcucgugaaggacacgugcuccuacgugaacguggaggacgucagcggcgcgaucucccaccugagccugggcgagaucccggccauggcccagcccuucguguccagcgaggagcgcaaggagcggugggagcaggggcaggccgacuacaugggcgccgacuccuucgacaacaucaagcgcaagcucgacaccuaccugcaguga

SEQ ID NO: 30935 - RNA, 1413 nt, Artificial Sequence
  derived and/or modified sequence opt1 from GYG2__Homo_sapiens__NP_001073324
augagcgugaccgaccaggccuucgucacccuggccacgaacgacaucuacugccagggcgcgcucgugcuggggcagucccugcgccggcaccgccucacccggaagcuggugguccugaucacgccccaggugagcucccuccugcgcgugauccugagcaaggucuucgacgaggugaucgaggugaaccucaucgacuccgccgacuacauccaccuggccuuccugaagcggccggagcucggccugacccugaccaagcuccacugcuggacccugacccacuacagcaagugcgucuuccuggacgccgacacccucgugcuguccaacguggacgagcuguucgaccgcggggaguucagcgccgcgcccgaccccggcuggcccgacugcuucaacuccggggucuucguguuccagccgagccuccacacgcacaagcugcugcuccagcacgccauggagcacggcuccuucgacggcgccgaccaggggcugcugaacagcuucuuccggaacugguccaccaccgacauccacaagcaccuccccuucaucuacaaccugagcuccaacaccauguacacguacagccccgccuucaagcaguucggcuccagcgcgaaggugguccacuuccugggguccaugaagcccuggaacuacaaguacaacccgcagagcggcagcgugcucgagcagggguccgccagcuccagccagcaccaggccgccuuccugcaccugugguggaccguguaccagaacaacguccucccccuguacaaguccgugcaggccggcgaggcgcgcgccagccccggccacacccugugccacuccgacgucgggggccccugcgccgacagcgccuccggggugggcgagccgugcgagaacagcacccccuccgccggcgugcccugcgcgaacagcccccucggguccaaccagccggcccagggccugcccgagcccacgcagaucguggacgagacccugagccuccccgaggggcggcgcuccgaggacaugaucgccugcccggagaccgagacccccgccgucaucacgugcgacccccugagccagcccuccccgcagcccgccgacuucaccgagaccgagaccauccugcagcccgcgaacaagguggagagcgucuccagcgaggagacguucgagcccagccaggagcucccggccgaggcccugcgggaccccucccugcaggacgcccucgagguggaccuggccgugagcgucucccagaucagcaucgaggagaaggugaaggagcugucccccgaggaggagcgccggaagugggaggagggccgcaucgacuacauggggaaggacgcguucgcccggauccaggagaagcucgaccgcuuccugcaguga

SEQ ID NO: 30936 - RNA, 2166 nt, Artificial Sequence
  derived and/or modified sequence opt1 from GYLTL1B__Homo_sapiens__NP_001287650
augcugccccgcggccggccgcgcgcccucggggccgcggcccugcugcuccugcugcuccugcugggcuuccuccuguucgggggcgaccuggggugcgagcggcgcgagcccggcggccgggccggggcccccggcugcuuccccgggccgcucaugccccgcgugccgcccgacggccggcugcgccgggccgcggcccuggacggggaccccggcgccggccccggggaccacaaccgcagcgacugcggcccccagcccccgcccccgcccaagugcgagcuccugcacgucgccaucgugugcgcggggcacaacuccagccgggacgugaucacccuggucaaguccaugcuguucuaccgcaagaacccccugcaccuccaccucgugaccgacgccguggcccggaacauccuggagacgcuguuccacaccuggaugguccccgccgugcgcgugagcuucuaccacgccgaccagcucaagccccaggucuccuggauccccaacaagcacuacagcggccuguacggccugaugaagcucgugcugccguccgcgcugcccgccgagcucgcccgggugaucguccuggacaccgacgugaccuucgccagcgacaucuccgagcugugggcccucuucgcgcacuucagcgacacgcaggccaucgggcugguggagaaccaguccgacugguaccugggcaaccucuggaagaaccaccgccccuggcccgcccuggggcggggcuucaacaccggggucauccugcuccgccuggaccggcugcgccaggccggcugggagcagauguggcggcucaccgcccgccgcgagcugcugagccucccggcgaccucccuggccgaccaggacaucuucaacgccgugaucaaggagcaccccggccuggugcagcggcuccccugcgucuggaacgugcagcugagcgaccacacgcuggccgagcgcugcuacuccgaggccagcgaccugaaggugauccacuggaacucccccaagaagcuccgggucaagaacaagcacguggaguucuuccgcaacuucuaccugaccuuccuggaguacgacgggaaccuccugcggcgcgagcuguucgugugcccgagccagcccccgcccggcgcggagcagcuccagcaggcccuggcccagcuggacgaggaggaccccugcuucgaguuccggcagcagcagcucaccguccaccgcgugcacgucaccuuccugccccacgagcccccgccgccccggccccacgacgugacgcugguggcccagcucuccauggaccgccugcagaugcuggaggcgcucugccggcacuggcccgggcccaugagccuggcccuguaccucaccgacgccgaggcccagcaguuccugcacuucgucgaggccagccccgugcuggcggcccgccaggacguggccuaccacgucguguaccgggagggcccccucuacccggugaaccagcugcgcaacgucgcccuggcccaggcgcucacccccuacguguuccuguccgacaucgacuuccugcccgccuacagccucuacgacuaccugcgggccuccaucgagcagcuggggcucggcagccgccggaaggccgcccuggugguccccgcguucgagacccugcgcuaccgguucuccuucccgcacagcaagguggagcuccuggcccugcucgacgccggcacgcuguacaccuuccgcuaccacgaguggccccgcgggcacgcccccaccgacuacgcgcgguggcgcgaggcccaggcccccuaccgggugcagugggccgccaacuacgagccguacgucguggugccccgcgacugcccccgguacgacccccgcuucgucggcuucggguggaacaagguggcgcacaucguggagcuggacgcccaggaguacgagcuccugguccugccggaggccuucaccauccaccucccccacgcccccucccuggacaucagccgguuccgcuccagcccgacguaccgggacugccugcaggcccucaaggacgaguuccaccaggaccugucccgccaccacggcgcggccgcccugaaguaccuccccgcccugcagcagccccagagccccgcccggggguga

SEQ ID NO: 30937 - RNA, 453 nt, Artificial Sequence
  derived and/or modified sequence opt1 from GYPA__Homo_sapiens__NP_002090
auguacggcaagaucaucuucgugcugcuccugagcgagaucgucuccaucagcgcccuguccaccaccgagguggccaugcacacgagcaccuccagcuccgugaccaagagcuacaucuccagccagaccaacgacacgcacaagcgcgacaccuacgcggccacgccccgggcccacgaggucuccgagaucagcgugcgcaccguguacccgcccgaggaggagaccggggagcggguccagcucgcccaccacuucuccgagcccgagaucacccugaucaucuucggcgugauggccggggugaucggcaccauccugcucaucagcuacgggauccgccggcugaucaagaagucccccagcgacgucaagccgcugcccucccccgacaccgacgugccccucagcuccguggagaucgagaacccggagacgagcgaccaguga

SEQ ID NO: 30938 - RNA, 276 nt, Artificial Sequence
  derived and/or modified sequence opt1 from GYPB__Homo_sapiens__NP_002091
auguacggcaagaucaucuucgugcugcuccugagcgagaucgucuccaucagcgcccuguccaccaccgagguggccaugcacacgagcaccuccagcuccgugaccaagagcuacaucuccagccagaccaacggggagacgggccagcucguccaccgcuucaccgugcccgcgccgguggucaucauccugaucauccugugcgugauggccgggaucaucggcaccauccuccugaucuccuacaccauccggcgccugaucaaggccuga

SEQ ID NO: 30939 - RNA, 324 nt, Artificial Sequence
  derived and/or modified sequence opt1 from GYPC__Homo_sapiens__NP_001243513
auggccagcgccuccaccaccaugcacacgaccaccaucgcggagcccgacccgggcaugagcggguggcccgacggccgcauggagaccuccacgcccaccaucauggacaucguggucaucgccggggugaucgccgccguggccaucguccuggugagccuccuguucgugaugcugcgguacauguaccgccacaagggcaccuaccacaccaacgaggcgaaggggacggaguucgccgaguccgccgacgccgcgcuccagggcgaccccgcccugcaggacgccggcgacagcucccggaaggaguacuucaucuga

SEQ ID NO: 30940 - RNA, 237 nt, Artificial Sequence
  derived and/or modified sequence opt1 from GYPE__Homo_sapiens__NP_002093
auguacggcaagaucaucuucgugcugcuccugagcgggaucgucuccaucagcgccuccagcaccaccggcguggccaugcacacguccaccagcuccagcgugaccaaguccuacaucagcucccagaccaacgggaucacgcugaucaacuggugggcgauggcccgcgucaucuucgaggugaugcucguggucgugggcaugaucauccugaucagcuacugcauccgguga

SEQ ID NO: 30941 - RNA, 2022 nt, Artificial Sequence
  derived and/or modified sequence opt1 from GYS1__Homo_sapiens__NP_001155059
augccccugaaccgcacccucagcauguccagccugccgggccuggaggacugggaggacgaguucgaccucgagaacgccgugcuguucgaggucgccugggagguggcgaacaaggucgggggcaucuacaccgugcugcagacgaaggccaaggugaccggggacgaguggggcgacaacuacuuccucguggggcccuacaccgagcagggcguccggacccagguggagcugcuggaggcccccacgcccgcccucaagcgcacccuggacuccaugaacagcaagggcugcaaguuccuggcccaguccgaggagaagccgcacguggucgcgcacuuccacgaguggcucgccggggugggccugugccugugccgggcccgccggcuccccguggccaccaucuucaccacgcacgcgacccugcuggggcgcuaccucugcgccggcgccgucgacuucuacaacaaccuggagaacuucaacguggacaaggaggccggggagcggcagaucuaccaccgcuacugcauggagcgggccgcggcccacugcgcccacguguucaccaccgucagccagaucacggccaucgaggcccagcaccuccugaagcgcaagcccgacaucgugacccccaacggccugaacgugaagaaguucuccgcgaugcacgaguuccagaaccugcacgcccagagcaaggcccggauccaggaguucguccgcggccacuucuacgggcaccucgacuucaaccuggacaagacccuguacuucuucaucgccggccgguacgaguucuccaacaagggggccgacguguuccucgaggcgcuggcccgccugaacuaccuccugcgggugaacggcagcgagcagaccgucguggccuucuucaucaugccggcccgcacgaacaacuucaacguggagacccugaagggccaggccguccggaagcagcucugggacaccgcgaacaccgugaaggagaaguucgggcgcaagcuguacgagucccugcucgucggcagccugcccgacaugaacaagaugcuggacaaggaggacuucacgaugaugaagcgggccaucuucgccacccagcgccaguccuucccgcccgugugcacccacaacaugcucgacgacagcuccgaccccauccugaccacgauccggcgcaucgggcuguucaacagcuccgccgaccgcgugaaggucaucuuccaccccgaguuccucagcuccaccagcccccugcugcccguggacuacgaggaguucgugcggggcugccaccucggggucuucccgagcuacuacgagcccuggggcuacacccccgcggagugcaccgugaugggcauccccuccaucagcacgaaccuguccggguucggcugcuucauggaggagcacaucgccgacccgagcgccuacgggaucuacauccuggaccgccgguuccgcucccucgacgacagcugcucccagcugaccagcuuccuguacuccuucugccagcagagccggcgccagcggaucauccagcgcaaccggaccgagcgccuguccgaccuccuggacuggaaguaccugggccgguacuacaugagcgcccgccacauggcccucuccaaggcguuccccgagcacuucaccuacgagcccaacgaggccgacgccgcccagggguaccgguacccccgcccggccagcgugccgcccucccccagccugucccggcacagcagcccccaccaguccgaggacgaggaggacccccgcaacggcccccuggaggaggacggcgagcgguacgacgaggacgaggaggcggccaaggaccgccggaacauccgcgccccggaguggccccgccgggccagcugcacguccagcaccuccgggagcaagcgcaacuccgucgacaccgccaccagcuccagccucuccacgcccagcgagccccuguccccgaccagcucccugggcgaggagcggaacuga

SEQ ID NO: 30942 - RNA, 2112 nt, Artificial Sequence
  derived and/or modified sequence opt1 from GYS2__Homo_sapiens__NP_068776
augcugcgcggccggagccucuccgugaccagccucgggggccugccccagugggaggucgaggagcucccgguggaggagcugcugcuguucgagguggccugggaggucaccaacaaggucgggggcaucuacacggugauccagaccaaggccaagaccaccgcggacgaguggggcgagaacuacuuccugaucgggcccuacuucgagcacaacaugaagacgcaggucgagcagugcgagcccgugaacgacgccgugcgccgggccgucgacgccaugaacaagcacggcugccaggugcacuucgggcgcuggcugaucgagggcucccccuacgugguccucuucgacaucggguacagcgccuggaaccuggaccgguggaagggcgaccugugggaggcgugcuccguggggaucccguaccacgaccgcgaggccaacgacaugcucaucuucggcagccugaccgccugguuccugaaggaggugaccgaccacgccgacggcaaguacgucguggcgcaguuccacgaguggcaggccgggaucggccucauccugucccgggcccgcaagcugcccaucgccaccaucuucacgacccacgccacccuccuggggcgguaccugugcgcggccaacaucgacuucuacaaccaccucgacaaguucaacaucgacaaggaggccggcgagcgccagaucuaccaccgguacugcauggagcgcgccagcgugcacugcgcccacgucuucaccacgguguccgagaucaccgcgaucgaggccgagcacaugcugaagcggaagcccgacguggucacccccaacggccugaacgugaagaaguucagcgccgugcacgaguuccagaaccuccacgccauguacaaggcccgcauccaggacuucguccgggggcacuucuacggccaccuggacuucgaccuggagaagacccucuuccuguucaucgcggggcgcuacgaguucuccaacaagggcgccgacaucuuccuggagagccucucccggcugaacuuccugcuccgcaugcacaagagcgacaucacggugauggucuucuucaucaugccggccaagaccaacaacuucaacguggagacccugaaggggcaggccgugcggaagcagcugugggacgucgcccacuccgugaaggagaaguucggcaagaagcucuacgacgcgcugcugcgcggcgagauccccgaccucaacgacauccuggaccgggacgaccugaccaucaugaagcgcgccaucuucagcacgcagcgccagucccucccgcccgugaccacccacaacaugaucgacgacagcaccgaccccauccuguccacgauccggcgcaucgggcuguucaacaaccggaccgaccgcgucaaggugauccuccaccccgaguuccugagcagcaccagcccccugcuccccauggacuacgaggaguucgugcggggcugccaccugggggucuucccguccuacuacgagcccuggggcuacacccccgccgagugcacggugauggggauccccuccgugaccaccaaccugagcggcuucggcugcuucaugcaggagcacgucgccgacccgaccgcguacgggaucuacaucguggaccgccgguuccgcucccccgacgacagcugcaaccagcugacgaaguuccucuacggcuucugcaagcagucccggcgccagcggaucauccagcgcaaccggaccgagcgccugagcgaccugcucgacuggcgguaccuggggcgcuacuaccagcacgcccggcaccugacccucucccgcgccuuccccgacaaguuccacguggagcugaccagcccgcccacgaccgagggcuucaaguacccccggcccuccagcgugcccccgucccccagcgggucccaggccagcagcccccaguccuccgacguggaggacgagguggaggacgagcgcuacgacgaggaggaggaggccgagcgcgaccggcugaacaucaagagcccguucagccucucccacgucccccacggcaagaagaagcugcacggcgaguacaagaacuga

SEQ ID NO: 30943 - RNA, 1368 nt, Artificial Sequence
  derived and/or modified sequence opt1 from GZF1__Homo_sapiens__XP_005260860
auggagagcggcgccgugcugcucgaguccaagagcucccccuucaaccugcugcacgagaugcacgagcuccgccugcuggggcaccucugcgacgucaccgugagcguggaguaccagggcguccggaaggacuucauggcccacaaggcggugcuggccgccaccuccaaguucuucaaggagguguuccugaacgagaaguccgucgacgggacgcgcaccaacguguaccucaacgaggugcaggucgccgacuucgccagcuuccuggaguucguguacaccgcgaaggugcaggucgaggaggaccgggugcagcgcaugcuggagguggccgagaagcucaagugccuggaccugagcgagaccugcuuccagcucaagaagcagaugcuggaguccguccugcucgagcugcagaacuucagcgagucccaggagguggaggugagcuccggcagccaggucuccgccgccccggcgccccgggccagcguggccacggacgggccccaccccuccggccugaccgacagccucgacuacccgggcgagcgcgccuccaacgggaugagcagcgaccugccgcccaagaaguccaaggacaagcuggacaagaagaaggagguggucaagccgcccuaccccaagauccggcgcgccagcggccggcucgcggggcgcaagguguucguggagauccccaagaagaaguacacccggcgccugcgggagcagcagaagaccgccgagggcgacgucggggacuaccgcugcccccaggaccagucccccgaccgggugggcacggagauggagcaggucagcaagaacgagggcugccaggccggggccgagcuggaggagcucuccaagaaggccggccccgaggaggaggaggaggaggaggaggaggacgaggagggggagaagaagaaguccaacuucaagugcagcaucugcgagaaggcguuccuguacgagaaguccuuccugaagcacagcaagcaccgccacggcguggccaccgagguggucuaccggugcgacacgugcggccagaccuucgccaaccgcugcaaccucaagagccaccagcggcacgugcacuccagcgagcgccacuuccccugcgagcugugcgggaagaaguucaagcggaagaaggacgugaagcgccacguccuccaggugcacgagggcgggggcgagcgccaccggugcgggcagugcggcaagggccuguccagcaagaccgcccugcgccugcacgagcggacccacaccggggaccgccccuacggcugcaccgagugcggggcccgguucucccagccgagcgcgcucaagacgcacaugcgcuga

SEQ ID NO: 30944 - RNA, 789 nt, Artificial Sequence
  derived and/or modified sequence opt1 from GZMA__Homo_sapiens__NP_006135
augcgcaacagcuaccgguuccuggccuccagccucuccguggucgugagccugcugcucauccccgaggacgugugcgagaagaucaucggcgggaacgaggucaccccgcacucccgccccuacauggugcugcugagccucgaccggaagaccaucugcgccggcgcgcugaucgccaaggacugggugcugacggccgcccacugcaaccucaacaagcgcucccaggucauccugggggcccacagcaucacccgggaggagcccaccaagcagaucaugcuggugaagaaggaguuccccuacccgugcuacgaccccgcgacccgcgagggcgaccucaagcugcugcagcucacggagaaggccaagaucaacaaguacgugaccauccugcaccuccccaagaagggggacgacgucaagcccggcaccaugugccagguggccggcugggggcggacccacaacuccgccagcugguccgacacgcugcgcgaggugaacaucaccaucaucgaccggaaggucugcaacgaccgcaaccacuacaacuucaacccggugaucggcaugaacauggugugcgcggggagccugcggggcgggcgcgacuccugcaacggcgacagcggcagcccccugcucugcgagggggucuuccggggcgugaccuccuucgggcuggagaacaagugcggcgacccccgcggccccgggguguacauccugcucuccaagaagcaccugaacuggaucaucaugaccaucaagggcgccgucuga

SEQ ID NO: 30945 - RNA, 744 nt, Artificial Sequence
  derived and/or modified sequence opt1 from GZMB__Homo_sapiens__NP_004122
augcagcccauccugcuccugcuggccuuccuccugcugccgcgcgccgacgcgggcgagaucaucgggggccacgaggccaagccccacagccggcccuacauggccuaccucaugaucugggaccagaagucccugaagcgcugcgggggcuuccugauccgggacgacuucgugcucaccgccgcccacugcugggggagcuccaucaacgucacccugggcgcgcacaacaucaaggagcaggagcccacgcagcaguucaucccggugaagcgccccaucccccaccccgccuacaacccgaagaacuucagcaacgacaucaugcugcuccagcuggagcggaaggccaagcgcacccgggccgugcagccccugcgccuccccuccaacaaggcgcaggucaagcccggccagaccugcagcguggccggguggggccagaccgccccgcuggggaagcacucccacacgcugcaggaggugaagaugaccguccaggaggaccggaagugcgagagcgaccuccgccacuacuacgacuccaccaucgagcugugcgugggcgaccccgagaucaagaagaccagcuucaagggggacuccggcggcccccuggugugcaacaaggucgcccaggggaucgugagcuacggccggaacaacgggaugcccccgcgcgccugcacgaagguguccagcuucguccacuggaucaagaagaccaugaagcgguacuga

SEQ ID NO: 30946 - RNA, 483 nt, Artificial Sequence
  derived and/or modified sequence opt1 from GZMH__Homo_sapiens__NP_001257710
augcagcccuuccugcuccugcuggccuuccuccugacccccggcgccgggaccgaggagaucaucggcgggcacgaggcgaagccccacagccgccccuacauggccuucgugcaguuccugcaggagaagucccggaagcgcugcggcgggauccucguccggaaggacuucgugcugacggccgcccacugccagggcagcuccaucaacgugacccugggcgcccacaacaucaaggagcaggagcgcacccagcaguucauccccgucaagcggccgaucccccaccccgcguacaaccccaagaacuucagcaacgacaucaugcuccugcagggggacuccggcgggccgcuggugugcaaggacguggcccagggcauccucagcuacgggaacaagaagggcaccccgcccggcgucuacaucaaggugucccacuuccugcccuggaucaagcgcacgaugaagcggcuguga

SEQ ID NO: 30947 - RNA, 795 nt, Artificial Sequence
  derived and/or modified sequence opt1 from GZMK__Homo_sapiens__NP_002095
augaccaaguucagcuccuucagccuguucuuccucaucgugggcgccuacaugacccacgucugcuucaacauggagaucaucgggggcaaggaggugagcccccacucccgccccuucauggccuccauccaguacgggggccaccacgugugcgggggcguccugaucgacccccagugggugcugacggcggcccacugccaguaccgguucaccaagggccagagccccaccgugguccucggggcccacucccugagcaagaacgaggccuccaagcagacccuggagaucaagaaguucauccccuucagccgcgugacguccgacccgcagagcaacgacaucaugcucgugaagcugcagaccgccgcgaagcugaacaagcacgucaagaugcuccacauccgguccaagaccagccugcgcuccggcaccaagugcaaggugacgggguggggcgccaccgaccccgacagccugcggcccuccgacacccuccgcgaggugaccgucacggugcugagccggaagcugugcaacucccagagcuacuacaacggggaccccuucaucaccaaggacauggugugcgccggcgacgccaagggccagaaggacagcugcaagggggacuccggcgggccgcucaucugcaagggcgucuuccacgcgaucgugagcggcgggcacgagugcggcguggccaccaagcccgggaucuacacccugcugacgaagaaguaccagaccuggaucaaguccaaccucgucccgccccacaccaacuga

SEQ ID NO: 30948 - RNA, 774 nt, Artificial Sequence
  derived and/or modified sequence opt1 from GZMM__Homo_sapiens__NP_005308
auggaggccugcgugagcucccugcucguccuggcccugggcgcgcucagcgugggguccagcuucggcacccagaucaucgggggccgcgaggugaucccccacucccggccguacauggccagccugcagcgcaacgggucccaccugugcggcggcguccucgugcaccccaagugggugcugaccgccgcccacugccuggcccagcggauggcgcagcuccgccugguccuggggcuccacacgcuggacagccccggccugaccuuccacaucaaggccgccauccagcacccccgguacaagccggugcccgcccucgagaacgaccuggcgcugcuccagcuggacgggaaggugaagcccucccgcaccauccggccccuggcccucccgagcaagcgccaggucguggccgccggcacccggugcuccauggccggguggggccugacgcaccagggcgggcgccugagccgggugcuccgcgagcuggaccugcagguccucgacacccggaugugcaacaacucccgcuucuggaacggcagccugucccccagcauggugugccuggcggccgacuccaaggaccaggcccccugcaagggggacagcggcggcccccucgugugcgggaagggccggguccuggccggggugcuguccuucagcagccgcgugugcaccgacaucuucaagccgcccgucgccaccgcgguggcccccuacguguccuggauccggaaggucacgggccgcagcgccuga

SEQ ID NO: 30949 - RNA, 585 nt, Artificial Sequence
  derived and/or modified sequence opt1 from H1F0__Homo_sapiens__NP_005309
augaccgagaacagcaccuccgcccccgccgcgaagccgaagcgcgccaaggccagcaagaaguccacggaccaccccaaguacagcgacaugaucguggccgccauccaggcggagaagaaccgggccggcuccagccgccaguccauccagaaguacaucaagagccacuacaaggucggggagaacgccgacucccagaucaagcugagcaucaagcggcucgugaccaccggcgugcugaagcagaccaagggggucggcgccuccgggagcuuccgccuggcgaaguccgacgagcccaagaaguccguggccuucaagaagacgaagaaggagaucaagaagguggccacccccaagaaggccagcaagccgaagaaggccgcgagcaaggcccccaccaagaagcccaaggccacccccgucaagaaggccaagaagaagcucgccgcgacgccgaagaaggccaagaagcccaagaccgugaaggccaagcccgugaaggccuccaagcccaagaaggccaagccggucaagcccaaggccaagagcuccgcgaagcgggccggcaagaagaaguga

SEQ ID NO: 30950 - RNA, 642 nt, Artificial Sequence
  derived and/or modified sequence opt1 from H1FX__Homo_sapiens__NP_006017
augagcguggagcuggaggaggcccuccccgucaccaccgccgagggcauggcgaagaaggugacgaaggccgggggcuccgccgcccugagcccguccaagaagcgcaagaacagcaagaagaagaaccagcccgggaaguacucccagcugguggucgagaccauccggcgccucggcgagcggaacgggagcucccuggccaagaucuacaccgaggcgaagaaggugcccugguucgaccagcagaacggccgcaccuaccugaaguacagcaucaaggcccucgugcagaacgacacgcugcugcaggucaagggcaccggggccaacggcuccuucaagcucaaccggaagaagcuggagggcggcggggagcgccgcggggcccccgcggccgccaccgccccggcccccaccgcgcacaaggccaagaaggccgcccccggcgccgcggggagccggcgggccgacaagaagcccgcccgcggccagaagccggagcagcggucccacaagaagggggccggcgccaagaaggacaagggcgggaaggcgaagaagacggccgccgccggcgggaagaaggugaagaaggccgcgaagcccagcgugcccaagguccccaagggccgcaaguga

SEQ ID NO: 30951 - RNA, 390 nt, Artificial Sequence
  derived and/or modified sequence opt1 from H2AFJ__Homo_sapiens__NP_808760
augagcggccgcgggaagcagggcgggaaggugcgggccaaggccaagucccgcagcucccgggcgggccugcaguuccccgucgggcgcgugcaccggcuccugcgcaagggcaacuacgccgagcgggugggcgccggggccccggucuaccuggccgcggugcucgaguaccugaccgccgagauccuggagcucgccggcaacgccgcgcgcgacaacaagaagacccggaucaucccccgccaccuccagcuggccauccggaacgacgaggagcugaacaagcugcuggggaaggugacgaucgcccagggcgggguccuccccaacauccaggccgugcugcugcccaagaagaccgagagccagaagaccaaguccaaguga

SEQ ID NO: 30952 - RNA, 432 nt, Artificial Sequence
  derived and/or modified sequence opt1 from H2AFX__Homo_sapiens__NP_002096
augagcggccgcgggaagaccggcgggaaggcccgggccaaggcgaagucccgcagcucccgggccggccugcaguuccccguggggcgcguccaccggcuccugcgcaagggccacuacgccgagcgggugggcgccggggccccgguguaccuggcggccguccucgaguaccugaccgccgagauccuggagcucgccggcaacgcggcccgcgacaacaagaagacgcggaucaucccccgccaccuccagcuggccauccggaacgacgaggagcugaacaagcugcucgggggcgugaccaucgcccagggcggggugcugcccaacauccaggccguccugcugcccaagaagaccagcgcgaccgugggcccgaaggcccccuccgggggcaagaaggccacgcaggccagccaggaguacuga

SEQ ID NO: 30953 - RNA, 1119 nt, Artificial Sequence
  derived and/or modified sequence opt1 from H2AFY2__Homo_sapiens__NP_061119
augagcggccgcuccgggaagaagaagaugagcaagcugucccggagcgcccgcgccggcgugaucuuccccgucgggcggcucaugcgcuaccugaagaagggcaccuucaaguaccggaucuccgugggggcgccgguguacauggccgccgucaucgaguaccuggccgccgagauccucgagcuggcgggcaacgccgcccgcgacaacaagaaggcccggaucgcgccccgccacauccugcucgccguggccaacgacgaggagcugaaccagcugcucaagggcgugaccaucgccagcgggggcguccugccccggauccaccccgagcugcucgccaagaagcgcgggacgaagggcaaguccgagaccauccugagcccgccgcccgagaagcgggggcgcaaggcgaccuccggcaagaagggcgggaagaaguccaaggccgccaagccccggaccagcaagaaguccaagcccaaggacagcgacaaggagggcacgagcaacuccaccagcgaggacgggcccggcgacggcuucaccauccuguccagcaagucccucgugcuggggcagaagcugagccucacccagagcgacaucucccacaucggcagcaugcgcguggaggggaucguccaccccacgaccgccgagaucgaccugaaggaggacaucggcaaggcccuggagaaggccgggggcaaggaguuccucgagaccgugaaggagcugcggaagucccagggcccccuggagguggcggaggccgccgucagccaguccagcgggcucgccgcgaaguucgugauccacugccacaucccgcaguggggcuccgacaagugcgaggagcagcuggaggagaccaucaagaacugccugagcgccgccgaggacaagaagcucaaguccguggccuucccgcccuuccccagcgggcgcaacugcuuccccaagcagacggccgcgcaggucacccugaaggccaucuccgcccacuucgacgacagcuccgccagcucccugaagaacguguacuuccuccuguucgacagcgaguccaucggcaucuacgugcaggagauggcgaagcuggacgccaaguga

SEQ ID NO: 30954 - RNA, 1116 nt, Artificial Sequence
  derived and/or modified sequence opt1 from H2AFY__Homo_sapiens__NP_004884
augagcucccgcggcgggaagaagaaguccaccaagaccagccggagcgccaaggccggcgugaucuuccccgucgggcgcaugcugcgguacaucaagaagggccacccgaaguaccgcaucggggugggcgcgcccguguacauggccgccguccucgaguaccugacggccgagauccuggagcucgccggcaacgcggcccgggacaacaagaaggggcgcgugacgccccggcacauccugcuggccguggccaacgacgaggagcucaaccagcugcugaagggcgucaccaucgcguccgggggcgugcuccccaacauccacccggagcugcuggccaagaagcgcgggagcaagggcaagcucgaggccaucaucaccccgccgcccgccaagaaggccaagucccccagccagaagaagcccguguccaagaaggcgggcgggaagaagggcgcccgcaagagcaagaagcagggggaggucuccaaggccgccagcgccgacuccaccaccgagggcacccccgcggacggcuucaccgugcugagcacgaagucccuguuccucgggcagaagcugaaccugauccacagcgagaucuccaaccucgccggcuucgagguggaggccaucaucaaccccaccaacgccgacaucgaccugaaggacgaccuggggaacacccucgagaagaagggcgggaaggaguucgucgaggccgugcuggagcugcggaagaagaacggcccccucgagguggcgggcgccgccgucagcgccgggcacggccugcccgccaaguucgugauccacugcaacucccccguguggggcgcggacaagugcgaggagcugcucgagaagaccgucaagaacugccuggcccuggccgacgacaagaagcucaagagcaucgccuuccccagcaucggguccgggcggaacggcuucccgaagcagacggcggcccagcugauccugaaggccaucagcuccuacuucgugagcaccauguccagcuccaucaagaccguguacuucguccucuucgacagcgaguccaucggcaucuacgugcaggagauggccaagcuggacgccaacuga

SEQ ID NO: 30955 - RNA, 387 nt, Artificial Sequence
  derived and/or modified sequence opt1 from H2AFZ__Homo_sapiens__NP_002097
auggccggcgggaaggccggcaaggacagcgggaaggcgaagaccaaggccgugucccgcagccagcgggccggccugcaguuccccgucgggcgcauccaccggcaccucaagucccgcaccacgagccacggccgggugggcgccaccgccgcgguguacuccgccgccauccuggaguaccugaccgccgagguccucgagcuggcggggaacgccagcaaggaccugaaggugaagcgcaucaccccgcggcaccuccagcuggccauccgcggcgacgaggagcuggacucccucaucaaggccacgaucgccgggggcggggugaucccccacauccacaagagccugaucggcaagaagggccagcagaagaccgucuga

SEQ ID NO: 30956 - RNA, 528 nt, Artificial Sequence
  derived and/or modified sequence opt1 from H2BFWT__Homo_sapiens__NP_001002916
augcugcgcaccgaggugccccggcucccgcgcagcaccacggccaucgucugguccugccaccugauggccaccgcgagcgccauggccggccccuccagcgagaccaccuccgaggagcagcugaucacgcaggagcccaaggaggccaacagcaccaccucccagaagcagagcaagcagcggaagcgcgggcggcacggcccccgccggugccacuccaacugccgcggggacagcuucgccaccuacuuccggcgcgugcucaagcagguccaccagggccugucccugagccgggaggcgguguccgugauggacagccucgugcacgacauccuggaccgcaucgccacggaggccgggcaccuggcccgguccaccaagcgccagaccaucaccgcgugggagacgcggauggccguccgccuccugcugccgggccagaugggcaagcucgccgagagcgaggggaccaaggccgugcugcggaccucccuguacgccauccagcagcagcgcaaguga

SEQ ID NO: 30957 - RNA, 411 nt, Artificial Sequence
  derived and/or modified sequence opt1 from H3F3B__Homo_sapiens__NP_005315
auggcccgcaccaagcagaccgcccgcaagagcacgggcgggaaggcgccccggaagcagcuggccaccaaggccgcccggaaguccgccccgagcaccggcggggugaagaagccccaccgcuaccggcccggcaccgucgcgcuccgcgagauccggcgcuaccagaaguccacggagcugcugauccggaagcuccccuuccagcgccuggugcgggagaucgcccaggacuucaagaccgaccugcgcuuccagagcgccgccaucggggcgcuccaggaggccuccgaggccuaccuggugggccuguucgaggacaccaaccucugcgccauccacgccaagcgggucaccaucaugccgaaggacauccagcuggcgcgccggauccgcggcgagcgggccuga

SEQ ID NO: 30958 - RNA, 861 nt, Artificial Sequence
  derived and/or modified sequence opt1 from HAAO__Homo_sapiens__NP_036337
auggagcgccggcugggcgugcgcgccugggucaaggagaaccgggggagcuuccagcccccggugugcaacaagcucaugcaccaggagcagcugaaggugauguucaucggcgggcccaacacccgcaaggacuaccacaucgaggagggcgaggaggucuucuaccagcuggagggggacauggugcuccgggugcuggagcagggcaagcaccgcgacgucgugauccggcagggcgagaucuuccugcuccccgcccgcgugccccacuccccgcagcgguucgcgaacaccgucgggcuggugguggagcgccggcgccuggagacggagcucgacggccugcgguacuacgucggggacaccauggacgugcuguucgagaagugguucuacugcaaggaccucggcacccagcuggcccccaucauccaggaguucuucagcuccgagcaguaccgcaccgggaagcccauccccgaccagcugcucaaggagccgcccuucccccugagcacgcgguccaucauggagcccaugagccuggacgccuggcucgacucccaccaccgcgagcugcaggccggcaccccgcugagccucuucggcgacaccuacgagacccaggugaucgccuacgggcagggcuccagcgaggggcugcggcagaacgucgacguguggcuguggcagcucgagggcuccagcguggucacgaugggcgggcgccggcugucccuggcgcccgacgacagccuccuggugcuggccggcaccuccuacgccugggagcgcacccaggggagcguggcccucuccgucacccaggaccccgcgugcaagaagccccugggcuga

SEQ ID NO: 30959 - RNA, 1605 nt, Artificial Sequence
  derived and/or modified sequence opt1 from HABP2__Homo_sapiens__NP_001171131
augagccugcucgagucccuggaccccgacuggaccccggaccaguacgacuacagcuacgaggacuacaaccaggaggagaacaccuccagcacccugacccacgccgagaaccccgacugguacuacaccgaggaccaggccgaccccugccagcccaacccgugcgagcacggcggggacugccucgugcacggcuccaccuucacgugcagcugccuggcgcccuucuccgggaacaagugccagaagguccagaacacgugcaaggacaaccccugcggccgcgggcagugccugaucacccagagcccgcccuacuaccggugcgugugcaagcaccccuacaccggccccuccugcagccaggugguccccgugugccgcccgaaccccugccagaacggcgccacgugcucccggcacaagcgccggagcaaguucacgugcgccugccccgaccaguucaaggggaaguucugcgagaucggcuccgacgacugcuacgugggggacggcuacagcuaccgcgggaagaugaaccggaccgucaaccagcacgccugccucuacuggaacucccaccuccugcuccaggagaacuacaacauguucauggaggacgccgagacccacggcaucggcgagcacaacuucugccgcaaccccgacgcggacgagaagccguggugcuucaucaaggugaccaacgacaaggugaagugggaguacugcgacgucagcgccugcuccgcccaggacguggccuaccccgaggagagccccaccgagcccuccaccaagcugccgggguucgacagcugcggcaagaccgagaucgcggagcggaagaucaagcgcaucuacgggggcuucaagagcacggccggcaagcaccccuggcaggccucccugcagagcucccucccccugaccaucagcaugccccaggggcacuucugcggcggggcccugauccacccgugcugggugcucaccgccgcgcacugcaccgacaucaagacgcggcaccugaaggucgugcugggcgaccaggaccucaagaaggaggaguuccacgagcaguccuuccgcguggagaagaucuucaaguacagccacuacaacgagcgggacgagaucccccacaacgacaucgcccugcugaagcucaagcccgucgacgggcacugcgcccuggaguccaaguacgugaagaccgugugccugcccgacggcagcuucccguccggcagcgagugccacaucuccggguggggcgucaccgagaccgggaagggcagccgccagcuccuggacgccaaggugaagcugaucgccaacacgcucugcaacucccggcagcuguacgaccacaugaucgacgacagcaugaucugcgcggggaaccugcagaagcccggccaggacacgugccagggcgacuccgggggcccccugaccugcgagaaggacgggaccuacuacguguacggcaucgucagcugggggcuggagugcggcaagcgcccgggcguguacacccaggugaccaaguuccugaacuggaucaaggccaccaucaaguccgagagcggguucuga

SEQ ID NO: 30960 - RNA, 1242 nt, Artificial Sequence
  derived and/or modified sequence opt1 from HABP4__Homo_sapiens__NP_055097
augaagggcgcccuggggagccccguggccgcggccggcgccgccaugcaggaguccuucgggugcgucguggccaaccgcuuccaccagcuccuggacgacgagagcgacccguucgacauccugcgggaggcggagcgccggcgccagcagcagcuccagcggaagcgccgggacgaggccgccgccgcggccggcgccgggccccgcggcggccggucccccgccggggccagcggccaccgcgcgggggccggcgggcggcgcgagucccagaaggagcgcaagagccugcccgccccgguggcccagcggcccgacucccccggcggcgggcugcaggcccccggccagaagcggaccccgcgccgcggggagcagcagggcuggaacgacagccggggccccgaggggaugcucgagcgggcggagcgccgguccuaccgcgaguaccgccccuacgagaccgagcggcaggccgacuucacggccgagaaguuccccgacgagaagccgggcgaccgcuucgaccgggaccgcccccugcgggggcgcggcgggccccggggcggcaugcgcgggcggggccgcgggggccccgggaaccgggucuucgacgccuucgaccagcgcggcaagcgggaguucgagcgcuacggcgggaacgacaagaucgccgugcggaccgaggacaacaugggcgggugcggcgugcgcaccugggggagcggcaaggacaccuccgacgucgagccgacggcgcccauggaggagcccaccgugguggaggagagccagggcacccccgaggaggaguccccggccaagguccccgagcuggagguggaggaggagacccaggugcaggagaugacgcucgacgaguggaagaaccugcaggagcagacccggcccaagcccgaguucaacauccgcaagccggagagcaccguccccuccaaggccguggugauccacaagagcaaguaccgggacgacauggucaaggacgacuacgaggacgacucccacguguuccgcaagcccgccaacgacaucaccagccagcuggagaucaacuucgggaaccucccccgcccgggccgcggggcccggggcggcacgcgcgggggccgggggcggauccgccgggcggagaacuacggcccccgcgccgagguggucaugcaggacguggcccccaacccggacgaccccgaggacuuccccgcccuguccuga

SEQ ID NO: 30961 - RNA, 867 nt, Artificial Sequence
  derived and/or modified sequence opt1 from HACD1__Homo_sapiens__NP_055056
augggccgccugaccgaggccgccgcggccgggagcggcucccgggccgccgggugggccggcagcccgcccacccuccugccccugucccccacgagcccccgcugcgcggccaccauggccuccagcgacgaggacgggaccaacggcggcgccuccgaggcgggggaggaccgggaggccccgggcgagcgccggcgccucggggugcuggccaccgccuggcugacguucuacgacaucgccaugaccgcgggcuggcucguccuggccaucgccauggugcgguucuacauggagaaggggacccaccgcggccuguacaagagcauccagaagacccucaaguucuuccagacguucgcccugcuggagaucgugcacugccucaucggcaucguccccaccuccgugaucgugaccgggguccaggugagcucccggaucuucaugguguggcugaucacccacagcaucaagcccauccagaacgaggaguccgucgugcuguuccucguggccuggacggucaccgagaucacccgcuacagcuucuacaccuucucccugcuggaccaccuccccuacuucaucaagugggcgcgguacaacuucuucaucauccuguacccggugggcguggccggggagcugcucacgaucuacgccgcccugccccacgucaagaagaccggcauguucagcauccgccugcccaacaaguacaacguguccuucgacuacuacuacuuccuccugaucaccauggccagcuacaucccccuguucccgcagcucuacuuccacaugcugcggcagcgccggaaggugcugcacggcgaggucaucguggagaaggacgacuga

SEQ ID NO: 30962 - RNA, 765 nt, Artificial Sequence
  derived and/or modified sequence opt1 from HACD2__Homo_sapiens__NP_940684
auggccgccguggcggccaccgccgccgccaagggcaacgggggcgggggcgggcgcgcgggcgccggcgacgccagcgggacccggaagaagaagggccccgggccgcuggccacggcguaccucgucaucuacaacguggugaugaccgccggcuggcuggucaucgccguggggcuggugcgcgccuaccucgccaagggcuccuaccacagccuguacuacuccaucgagaagccccugaaguucuuccagaccggcgcgcuccuggagauccugcacugcgccaucgggaucguccccagcuccguggugcucaccagcuuccaggucaugucccggguguuccugaucugggccgugacgcacagcgucaaggaggugcaguccgaggacagcgugcuccuguucgucaucgccuggaccaucaccgagaucauccgcuacuccuucuacaccuucagccugcugaaccaccuccccuaccugaucaagugggcccgguacacgcuguucaucgugcucuacccgaugggcguguccggggagcugcugaccaucuacgcggcccuccccuucguccgccaggccggccuguacagcaucucccugcccaacaaguacaacuucagcuucgacuacuacgccuuccucauccugaucaugaucuccuacauccccaucuucccgcagcuguacuuccacaugauccaccagcggcgcaagauccucagccacaccgaggagcacaagaaguucgaguga

SEQ ID NO: 30963 - RNA, 699 nt, Artificial Sequence
  derived and/or modified sequence opt1 from HACD4__Homo_sapiens__NP_001010915
augggcccccuggcccucccggccuggcugcagccccgcuaccggaagaacgcguaccuguucaucuacuaccucauccaguucugcgggcacagcuggaucuucaccaacaugaccgugcgcuucuucuccuucggcaaggacagcauggucgacacguucuacgccaucgggcuggugaugcggcugugccaguccgugagccuccuggagcugcuccacaucuacgucggcaucgaguccaaccaccuccugccccgcuuccugcagcugaccgagcggaucaucauccuguucguggugaucaccagccaggaggagguccaggagaaguacguggugugcguccucuucguguucuggaaccugcuggacauggugcgcuacaccuacuccaugcucagcgucaucgggaucuccuacgccgugcugacguggcugagccagacccucuggaugcccaucuacccgcugugcgugcuggccgaggccuucgcgaucuaccagucccuccccuacuucgagagcuucggcaccuacuccaccaagcugcccuucgaccugagcaucuacuuccccuacguccucaagaucuaccugaugaugcuguucaucggcauguacuucacguacucccaccucuacagcgagcggcgcgacauccuggggaucuucccgaucaagaagaagaagauguga

SEQ ID NO: 30964 - RNA, 2730 nt, Artificial Sequence
  derived and/or modified sequence opt1 from HACE1__Homo_sapiens__NP_065822
auggagcgcgccauggagcagcugaaccggcucacccgcagccugcggcgcgcccggaccguggagcugcccgaggacaacgagacggcggucuacacccucaugccgauggugauggccgaccagcaccgcuccgugagcgagcugcuguccaacagcaaguucgacgucaacuacgccuucggccgggugaagcgcucccuccugcacaucgccgccaacugcgggagcguggagugccugguccuccugcugaagaagggcgcgaaccccaacuaccaggacaucuccgggugcacgccccuccaccuggccgcccggaacggccagaagaagugcaugagcaagcugcucgaguacuccgccgacgugaacaucugcaacaacgaggggcugaccgcgauccacuggcuggccgugaacggccgcaccgagcuccugcacgaccugguccagcacgugagcgacguggacgucgaggacgccaugggccagaccgcccuccacguggccugccagaacgggcacaagaccaccgugcagugccugcuggacuccggcgcggacaucaaccggcccaacgucagcggggccacgccgcucuacuucgccugcucccacggccagcgcgacaccgcccagauccugcugcuccgcggggccaaguaccugcccgacaagaacggcgugacgccccuggaccucugcgugcagggcggguacggcgagaccugcgagguccugauccaguaccacccccggcuguuccagaccaucauccagaugacccagaacgaggaccuccgggagaacaugcugcgccaggugcuggagcaccucagccagcaguccgagagccaguaccugaagauccugaccucccucgcggagguggccaccacgaacgggcacaagcugcugagccucuccagcaacuacgacgcccagaugaagucccugcugcggaucguccgcauguucugccacguguuccggaucggcccgagcagccccuccaacggcaucgacaugggguacaacggcaacaagacgccccgcagccagguguucaagccccucgagcugcuguggcacucccucgacgaguggcugguccugaucgccaccgagcugaugaagaacaagcgggacagcaccgagaucaccuccauccuccugaagcagaaggggcaggaccaggacgccgcgagcaucccgcccuucgagccgcccggccccggguccuacgagaaccugagcaccggcacccgcgaguccaagcccgacgcccucgccggccgccaggaggccagcgccgacugccaggacgugaucuccaugaccgcgaaccggcugagcgccgucauccaggccuucuacaugugcugcuccugccagaugccgcccgggaugacgagcccccgcuucaucgaguucgugugcaagcacgacgaggugcugaagugcuucgucaaccggaaccccaagaucaucuucgaccacuuccacuuccuccuggagugccccgagcugaugucccgcuucaugcacaucaucaaggcccagcccuucaaggaccggugcgagugguucuacgagcaccuccacagcggccagccggacuccgacauggugcaccgccccgugaacgagaacgacauccugcugguccaccgggacagcaucuuccgcagcuccugcgagguggugagcaaggcgaacugcgccaagcucaagcaggggaucgccguccgguuccacggcgaggaggggaugggccagggcguggugcgcgagugguucgacauccuguccaacgagaucgucaaccccgacuacgcccuguucacccagagcgccgacgggaccaccuuccagcccaacuccaacagcuacgugaacccggaccaccucaacuacuuccgguucgcgggccagauccuggggcuggcccucaaccaccgccagcuggugaacaucuacuucacgcgguccuucuacaagcacauccugggcauccccgucaacuaccaggacguggccagcaucgaccccgaguacgccaagaaccuccaguggauccuggacaacgacaucuccgaccuggggcucgagcugaccuucagcguggagaccgacgucuucggcgccauggaggaggugccgcugaagcccggcgggggcuccauccucgugacccagaacaacaaggcggaguacguccagcuggugacggagcugcgcaugacccgggccauccagccccagaucaacgccuuccuccagggguuccacauguucaucccgcccagccugauccagcuguucgacgaguacgagcucgagcugcugcucuccggcaugcccgagaucgacgugagcgacuggaucaagaacaccgaguacaccuccggcuacgagcgcgaggaccccgucauccagugguucugggaggugguggaggacaucacgcaggaggagcggguccugcugcuccaguucgugaccgggagcucccgcgugccccacggcggguucgccaacaucaugggcgggagcggccugcagaacuucaccaucgccgcggucccguacacccccaaccugcuccccaccagcuccacgugcaucaacaugcugaagcugcccgaguacccgagcaaggagauccucaaggaccggcugcugguggcccuccacugcggcuccuacggguacaccauggccuga

SEQ ID NO: 30965 - RNA, 1737 nt, Artificial Sequence
  derived and/or modified sequence opt1 from HACL1__Homo_sapiens__NP_036392
augcccgacagcaacuucgccgagcgcuccgaggagcaggucagcggcgccaaggugaucgcgcaggcccugaagacccaggacguggaguacaucuucgggaucgugggcaucccggugaccgagaucgccaucgccgcccagcagcucgggaucaaguacaucggcaugcggaacgagcaggcggccugcuacgccgccuccgcgaucggguaccugacgagccgccccggcgugugccugguggucuccggccccgggcucauccacgcccugggcgggauggccaacgccaacaugaacugcuggccccugcucgugaucggcgggagcuccgagcggaaccaggagaccaugggcgccuuccaggaguucccccagguggaggcgugccgccuguacaccaaguucagcgcccggcccuccagcaucgaggccauccccuucgucaucgagaaggccgugcgcuccagcaucuacggccggcccggggccugcuacguggacaucccggcggacuucgucaaccuccaggugaacgugaacuccaucaaguacauggagcgcugcaugagcccgcccaucuccauggccgagaccagcgccgucugcacggccgccuccgugauccggaacgcgaagcagccccugcugaucaucggcaagggggccgccuacgcccacgccgaggagagcaucaagaagcugguggagcaguacaagcucccguuccugcccacccccaugggcaagggcgucgugcccgacaaccacccguacugcgugggggcggcccgcucccgggcccugcaguucgccgacgucaucguccucuucggcgcgcgccugaacuggauccugcacuucgggcucccgccccgguaccagcccgacgugaaguucauccagguggacaucugcgccgaggagcugggcaacaacgugaagcccgccgucacccugcucgggaacauccacgccgugaccaagcagcugcuggaggagcucgacaagacgcccuggcaguacccgcccgagagcaagugguggaagacccugcgcgagaagaugaaguccaacgaggccgcgagcaaggagcuggccagcaagaagucccuccccaugaacuacuacaccguguucuaccacguccaggagcagcugccccgggacugcuucguggugagcgagggcgccaacaccauggacaucggccgcacgguccugcagaacuaccucccccggcaccgccuggacgccgggaccuucggcaccaugggggugggccugggguucgccaucgcggccgccguggucgccaaggaccggucccccggccaguggaucaucugcguggagggcgacagcgccuucggguucuccggcauggagguggagaccaucugccgcuacaaccucccgaucauccugcuggucgugaacaacaacgggaucuaccagggcuucgacacggacaccuggaaggagaugcucaaguuccaggacgcgaccgccguggucccgcccaugugccugcugcccaacagccacuacgagcaggucaugaccgccuucgggggcaagggcuacuucgugcagacgcccgaggagcuccagaagucccugcggcagagccuggccgacaccaccaagcccucccucaucaacaucaugaucgagccccaggcgacccgcaaggcccaggacuuccacuggcugacgcgcagcaacauguga

SEQ ID NO: 30966 - RNA, 2292 nt, Artificial Sequence
  derived and/or modified sequence opt1 from HADHA__Homo_sapiens__NP_000173
augguggccugccgcgccaucggcauccugagccgguucuccgcguuccgcauccuccggagccgcggguacaucugccggaacuucaccggcuccagcgcccugcugacccgcacgcacaucaacuacggggucaagggcgacguggccgugguccggaucaacucccccaacagcaaggugaacacccucuccaaggagcugcacagcgaguucuccgaggugaugaacgagaucugggccagcgaccagauccgcuccgccguccugaucagcuccaagccggggugcuucaucgcgggcgccgacaucaacaugcucgccgccugcaagacccugcaggaggugacccagcugagccaggaggcgcagcggaucguggagaagcucgagaaguccacgaagcccaucgucgccgccaucaacggcagcugccucgggggcgggcuggagguggccaucuccugccaguaccgcaucgccaccaaggaccggaagaccgugcugggcacccccgagguccugcugggggcgcuccccggcgccggcgggacgcagcgccugccgaagauggugggcgugcccgccgcccuggacaugaugcucaccgggcggagcauccgcgccgaccgggcgaagaagaugggccuggucgaccagcugguggagccccucggccccgggcugaagccgcccgaggagcgcaccaucgaguaccuggaggagguggccaucaccuucgccaagggccucgccgacaagaagaucucccccaagcgggacaaggggcuggucgagaagcugacggccuacgcgaugaccauccccuucgugcgccagcaggucuacaagaagguggaggagaaggugcggaagcagaccaagggccucuacccggcgccccugaagaucaucgacguggucaagaccgggaucgagcagggcagcgacgccggcuaccugugcgagagccagaaguucggggagcucgugaugacgaaggaguccaaggcccugaugggccuguaccacgggcagguccucugcaagaagaacaaguucggcgcgccccagaaggacgugaagcaccuggccauccugggggccggccucaugggcgccgggaucgcccaggugagcgucgacaagggccugaagaccauccugaaggacgccacccucaccgcccuggaccgcgggcagcagcaggucuucaagggccugaacgacaaggugaagaagaaggcccucacguccuucgagcgggacagcaucuucuccaaccugaccgggcagcuggacuaccagggcuucgagaaggccgacauggugaucgaggccguguucgaggaccucagccugaagcaccgcgugcugaaggaggucgaggcggugauccccgaccacugcaucuucgccuccaacaccagcgcccucccgaucuccgagaucgccgccgugagcaagcgccccgagaaggucaucggcaugcacuacuucucccccguggacaagaugcagcugcuggagaucaucaccacggagaagaccagcaaggacaccuccgcgagcgccguggccgucgggcugaagcagggcaaggugaucaucguggucaaggacgggcccggcuucuacaccacgcggugccucgccccgaugauguccgaggugauccgcauccugcaggagggcguggaccccaagaagcuggacagccucaccaccuccuucggguuccccgucggcgccgcgacccugguggacgaggugggggucgacguggccaagcacguggccgaggaccugggcaaggucuucggggagcgguucggcggcgggaaccccgagcuccugacgcagauggugagcaagggcuuccuggggcgcaaguccggcaagggguucuacaucuaccaggagggcgugaagcggaaggaccucaacagcgacauggacagcauccuggccucccugaagcucccgcccaagagcgaggucuccagcgacgaggacauccaguuccgccuggugacccgguucgugaacgaggcggucaugugccugcaggagggcauccucgccacccccgccgagggggacaucggcgccguguucgggcugggcuucccgcccugccucgggggccccuuccgcuucguggaccuguacggcgcccagaagaucgucgaccggcugaagaaguacgaggcggccuacgggaagcaguucacccccugccagcugcucgccgaccacgccaacuccccgaacaagaaguucuaccaguga

SEQ ID NO: 30967 - RNA, 1380 nt, Artificial Sequence
  derived and/or modified sequence opt1 from HADHB__Homo_sapiens__NP_001268441
augaccauccugaccuaccccuucaagaaccucccgacggccagcaagugggcccugcgcuucuccauccggccccugagcugcuccagccagcuccgcgcggcccccgccgugcagaccaagaccaagaagacccuggccaagcccaacauccggaacgucgugguggucgacggcgugcgcacgccguuccugcucuccgggaccagcggccugcugcaccggaccuccgugcccaaggaggucguggacuacaucaucuucgggaccgugauccaggaggucaagacgagcaacguggcccgcgaggcggcccucggcgccggguucuccgacaagacccccgcccacaccgugaccauggcgugcaucagcgccaaccaggccaugacgaccggcgucggccugaucgccuccgggcagugcgacgugaucguggccggcggggucgagcugaugagcgacgugcccauccggcacucccgcaagaugcggaagcucaugcuggaccugaacaaggccaagagcaugggccagcgccucucccugaucagcaaguuccgguucaacuuccuggcgccggagcuccccgccguguccgaguucagcaccuccgagaccauggggcacagcgccgaccgccuggccgcggccuucgccgucagccggcuggagcaggacgaguacgcccuccgcucccacagccuggccaagaaggcgcaggacgagggccugcucuccgacguggugcccuucaagguccccggcaaggacacggugaccaaggacaacgggauccggccgagcucccuggagcagauggccaagcugaagcccgccuucaucaagcccuacggcaccgugaccgccgccaacagcuccuuccucacggacggggcgagcgccaugcugaucauggccgaggagaaggcccuggcgaugggcuacaagcccaaggccuaccuccgcgacuucauguacgucucccaggacccgaaggaccagcugcugcucggccccaccuacgccacccccaaggugcuggagaaggccgggcugaccaugaacgacaucgacgccuucgaguuccacgaggcguucagcggccagauccucgccaacuucaaggccauggacuccgacugguucgccgagaacuacauggggcggaagacgaaggucggccugcccccgcuggagaaguucaacaacuggggcgggagccucucccugggccaccccuucggggccaccggcugccgccuggugauggcggccgccaaccggcuccgcaaggagggcgggcaguacgggcugguggccgccugcgcggccggcggccaggggcacgccaugaucgucgaggccuaccccaaguga

SEQ ID NO: 30968 - RNA, 996 nt, Artificial Sequence
  derived and/or modified sequence opt1 from HADH__Homo_sapiens__NP_001171634
auggccuucgugacccgccaguucaugcggagcgucuccagcuccagcaccgccuccgcgagcgccaagaagaucaucgugaagcacgugacggucaucggcgggggccugaugggggccggcaucgcccagguggccgcggccaccgggcacaccgugguccucguggaccagaccgaggacauccuggccaaguccaagaagggcaucgaggagagccugcgcaagguggccaagaagaaguucgcggagaaccccaaggccggcgacgaguucgucgagaagacgcucuccaccaucgccaccagcaccgacgccgccuccguggugcacagcacggaccuggucguggaggcgaucguggagaaccugaaggucaagaacgagcuguucaagcggcucgacaaguucgccgccgagcacaccaucuucgccuccaacaccagcucccugcagaucaccagcaucgccaacgcgacgacccgccaggaccgguucgccgggcuccacuucuucaacccggugcccgugaugaagcuggucgaggugaucaagacccccaugaccucccagaagacguucgagagccugguggacuucuccaaggcccucggcaagcaccccgucagcugcaaggacaccccgggguucaucgugaaccgccugcuggugcccuaccucauggaggccauccggcuguacgagcgcgacuuccagaccugcggcgacagcaacuccgggcugggcuucagccucaagggcgacgccuccaaggaggacaucgacaccgcgaugaagcugggggccggcuaccccauggggcccuucgagcugcucgacuacgucggccuggacacgaccaaguucaucguggacggcuggcacgagauggacgccgagaacccgcugcaccagcccagccccucccucaacaagcuggucgccgagaacaaguucgggaagaagaccggcgagggguucuacaaguacaaguga

SEQ ID NO: 30969 - RNA, 783 nt, Artificial Sequence
  derived and/or modified sequence opt1 from HAGH__Homo_sapiens__NP_001035517
augaagguggagguccugcccgcccucaccgacaacuacauguaccuggugaucgacgacgagaccaaggaggccgcgaucguggacccgguccagccccagaaggugguggacgccgcccgcaagcacggcgucaagcugacgaccgugcucaccacccaccaccacugggaccacgccgggggcaacgagaagcuggugaagcuggagagcgggcucaaggucuacggcggggacgaccggaucggcgcccugacgcacaagaucacccaccuguccacccuccaggugggcagccugaacgugaagugccuggcgacccccugccacacguccgggcacaucugcuacuucgucagcaagcccggcggguccgagccgcccgccguguucaccggcgacacccucuucguggccgggugcggcaaguucuacgagggcaccgccgacgagaugugcaaggcgcugcuggagguccucgggcgccugccgcccgacacgcggguguacugcggccacgaguacaccaucaacaaccugaaguucgcccgccacguggagcccgggaacgccgccauccgggagaagcucgccugggcgaaggagaaguacagcaucggcgagcccaccguccccuccacccuggccgaggaguucacguacaaccccuucaugcgcgugcgggagaagaccgugcagcagcacgccggcgagaccgacccggucaccacgaugcgcgccgugcggcgcgagaaggaccaguucaagaugccccgggacuga

SEQ ID NO: 30970 - RNA, 1350 nt, Artificial Sequence
  derived and/or modified sequence opt1 from HAL__Homo_sapiens__NP_001245262
augcugcucgcccugcgcaucaacgugcuggccaagggcuacagcgggaucucccucgagacccugaagcaggucaucgagauguucaacgcgagcugccugcccuacgugccggagaagggcaccgugggggccuccggcgaccucgcgccccugagccaccuggcccucgggcuggucggcgagggcaagauguggucccccaagagcgggugggccgacgccaaguacgugcuggaggcccacggccucaagcccgugauccugaagccgaaggaggggcuggcccucaucaacggcacccagaugaucaccucccuggggugcgaggccgucgagcgggcgagcgccaucgcccgccaggccgacaucguggccgcgcugacccucgaggugcugaagggcaccacgaaggccuucgacaccgacauccacgcccugcggccccaccgcggccagaucgaggucgccuuccgguuccgcucccuccuggacagcgaccaccaccccuccgagaucgccgagagccaccgguucugcgaccgcgugcaggacgcguacacccugcggugcugcccccaggugcacggggucgugaacgacaccaucgccuucgugaagaacaucaucacgaccgagcucaacuccgccaccgacaacccgauggucuucgccaaccgcggcgagaccgugagcgggggcaacuuccacggcgaguaccccgccaaggcgcuggacuaccuggccaucgggauccacgagcucgccgccaucuccgagcggcgcaucgagcggcugugcaaccccagccuguccgagcuccccgccuuccugguggcggagggcgggcugaacagcggcuucaugaucgcccacugcacggccgccgcgcucgucuccgagaacaaggcccugugccacccgagcagcguggacucccugagcaccuccgccgccaccgaggaccacgugagcaugggcgggugggccgcgcgcaaggcccuccgggucaucgagcacguggagcagguccuggccaucgagcugcucgccgccugccagggcaucgaguuccugcgcccccugaagaccacgacgccccucgagaagguguacgaccuggugcgguccgucgugcgccccuggaucaaggaccgguucauggcgccggacaucgaggccgcccaccgccugcuccuggagcagaaggugugggaggucgccgcccccuacaucgagaaguaccggauggagcacauccccgagagccgcccccuguccccgaccgcguucagccuccaguuccugcacaagaaguccaccaagauccccgagagcgaggaccuguga

SEQ ID NO: 30971 - RNA, 255 nt, Artificial Sequence
  derived and/or modified sequence opt1 from HAMP__Homo_sapiens__NP_066998
auggcccugagcucccagaucugggccgcgugccuccugcugcuccugcugcucgccagccugaccuccggcagcguguucccccagcagaccgggcagcuggccgagcuccagccgcaggaccgcgccggcgcccgggcguccuggaugcccauguuccagcgccggcgccggcgcgacacgcacuuccccaucugcaucuucugcugcgggugcugccaccggagcaagugcggcaugugcugcaagaccuga

SEQ ID NO: 30972 - RNA, 648 nt, Artificial Sequence
  derived and/or modified sequence opt1 from HAND1__Homo_sapiens__NP_004812
augaaccuggugggcagcuacgcccaccaccaccaccaccaccacccccacccggcccaccccaugcuccacgagcccuuccuguucgggcccgcgucccgcugccaccaggagcggccguacuuccagagcuggcugcucucccccgccgacgccgcccccgacuuccccgccggcgggccgccgcccgcggccgccgccgcggccaccgccuacggccccgacgcccgccccgggcagagccccggccggcuggaggcccugggcgggcgccucggccggcgcaagggguccggccccaagaaggagcggcgccggaccgagagcaucaacuccgcguucgccgagcugcgcgagugcauccccaacgucccggccgacacgaagcugagcaagaucaagacccuccggcuggccaccuccuacaucgccuaccugauggacgugcucgcgaaggacgcccagagcggggaccccgaggccuucaaggccgagcugaagaaggccgacggcggccgcgaguccaagcggaagcgcgagcugcagcagcacgagggguucccgcccgcgcucggccccguggagaagcggaucaaggggcgcaccggcuggccccagcaggucugggcccuggagcugaaccaguga

SEQ ID NO: 30973 - RNA, 654 nt, Artificial Sequence
  derived and/or modified sequence opt1 from HAND2__Homo_sapiens__NP_068808
augagccuggugggcggguucccccaccacccggucgugcaccacgagggcuaccccuucgccgccgcggccgccgccgccgcggccgccgccgcgucccgcugcagccacgaggagaaccccuacuuccacggguggcucaucggccaccccgagauguccccgcccgacuacagcauggcccuguccuacagccccgaguacgccuccggggccgccggccuggaccacagccacuacggcggggugcccccgggcgcggggccgcccggccucgggggcccccggcccgucaagcgccggggcaccgccaaccgcaaggagcggcgccggacccaguccaucaacagcgccuucgccgagcugcgcgagugcauccccaacgugcccgccgacacgaagcuguccaagaucaagacccuccggcuggcgaccagcuacaucgccuaccugauggaccuccuggccaaggacgaccagaacggggaggccgaggccuucaaggcggagaucaagaagaccgacgugaaggaggagaagcgcaagaaggagcugaacgagauccucaaguccacggucagcuccaacgacaagaagaccaagggccggaccggguggccccagcacgugugggcccuggagcugaagcaguga

SEQ ID NO: 30974 - RNA, 1113 nt, Artificial Sequence
  derived and/or modified sequence opt1 from HAO1__Homo_sapiens__NP_060015
augcugccccgccucaucugcaucaacgacuacgagcagcacgccaagagcgugcugccgaaguccaucuacgacuacuaccggagcggcgccaacgacgaggagacccuggcggacaacaucgccgccuucucccgcuggaagcucuacccccggaugcugcgcaacgucgccgagaccgaccugagcacguccgugcucgggcagcgggugagcaugcccaucugcgucggcgccaccgcgaugcagcgcauggcccacguggacggggagcuggccaccgugcgggccugccagucccugggcaccgggaugaugcucagcuccugggcgacgagcuccaucgaggaggucgccgaggccggccccgaggcccugcgcuggcugcagcucuacaucuacaaggaccgggaggugaccaagaagcuggugcgccaggccgagaagaugggcuacaaggcgaucuucgucaccguggacaccccguaccuggggaaccggcucgacgacgugcgcaaccgguucaagcugccgccccagcugcgcaugaagaacuucgagacgagcacccucuccuucagccccgaggagaacuucggcgacgacuccgggcuggccgccuacgucgccaaggccaucgaccccagcaucuccugggaggacaucaaguggcugcggcgccucaccagccugcccaucguggcgaagggcauccugcgcggggacgacgcccgggaggccgugaagcacggccucaacggcauccuggucuccaaccacggggcccggcagcuggacggcgugcccgccaccaucgacgugcuccccgagaucgucgaggcgguggaggggaagguggaggucuuccuggacggcggcgugcgcaaggggacggacgugcugaaggcccucgcccugggcgccaaggccgucuucguggggcggccgaucgucuggggccuggcguuccagggggagaagggcgugcaggacgugcucgagauccugaaggaggaguuccgccuggccauggcccucagcggcugccagaacgucaaggugaucgacaagacccuggugcgcaagaacccccuggccgucagcaagaucuga

SEQ ID NO: 30975 - RNA, 1149 nt, Artificial Sequence
  derived and/or modified sequence opt1 from HAO2__Homo_sapiens__XP_011539860
augagccuggugugccucaccgacuuccaggcccacgcccgcgagcagcuguccaagagcacccgggacuucaucgagggcggggcggacgacuccaucacgcgcgacgacaacaucgccgccuucaagcggauccgccugcggccccgcuaccuccgggacgucagcgagguggacacccgcaccaccauccagggcgaggagaucuccgccccgaucugcaucgcccccacgggguuccacugccugguguggcccgacggcgagaugagcaccgcgcgggcccccgaggggcugcgcugguuccagcucuacguccacccggaccugcagcugaacaagcagcucauccagcggguggagucccugggcuucaaggcccuggugaucacccucgacacccccgucugcggcaaccgccggcacgacauccgcaaccagcugcggcgcaaccugacgcucaccgaccugcagagccccaagaaggggaacgccauccccuacuuccagaugaccccgaucuccaccagccugugcuggaacgaccucuccugguuccagagcaucacgcggcugcccaucauccugaagggcauccucaccaaggaggacgcggagcuggccgugaagcacaacgugcaggggaucaucgucuccaaccacggcgggcgccagcuggacgaggugcucgccagcaucgacgcccugaccgagguggucgccgcggugaagggcaagaucgagguguaccuggacggcgggguccggaccggcaacgacgugcucaaggcccuggcccugggggccaagugcaucuuccucggccgccccauccuguggggccuggccugcaaggcggccgggcggucccuccgcagcaucgagacgugguccagcuuccccggcugcaagaagaaggggccgaucacccgccugcugcggcuccccaccggcgggucccagacccacagcacggugugcgacgccguccugcccggcccccacagcgugcgccggcugauggcccacaucucccacaucagcaacaccaccaccccggugcuccaggcccugcagacgcccgucuuccccaagugcuccaugcccuucuucgugagccugaccaucaucugcugcucccucgcguga

SEQ ID NO: 30976 - RNA, 1809 nt, Artificial Sequence
  derived and/or modified sequence opt1 from HAP1__Homo_sapiens__NP_001073339
augcgccccaagcggcugggccgcugcugcgccgggagccggcucggcccgggggaccccgccgcgcugaccugcgcccccucccccagcgccuccccggcccccgagcccagcgcccagccccaggcgcgcggcaccgggcagcgggugggcucccgcgccacgagcggcucccaguuccugagcgaggcccggaccggggcccgcccggcguccgaggccggcgccaaggccggggcccggcgccccagcgcguucuccgccauccagggcgacguccggagcaugcccgacaacuccgacgcccccuggacccgcuucguguuccaggggccguucggcagccgggccaccggccgcgggacgggcaaggccgcggggaucuggaagacccccgccgccuacgugggccggcgccccggcgucuccgggcccgagcgggccgccuucauccgcgagcucgaggaggcgcugugcccgaaccugcccccgcccgugaagaagaucacccaggaggacgugaaggucaugcucuaccugcuggaggaggugugcaccgccuuccucauccagcugcugccgcccgugugggagagcgucacguacggcauggugcuccagcgggagcgcgaccugaacaccgccgcccggaucgggcagucccuggugaagcagaacagcguccucauggaggagaacuccaagcuggaggcccugcucggcagcgcgaaggaggagauccuguaccugcgccaccaggugaaccuccgcgacgagcugcugcagcucuacagcgacuccgacgaggaggacgaggacgaggaggaggaggaggaggagaaggaggccgaggaggagcaggaggaggaggaggccgaggaggaccugcagugcgcccaccccugcgacgcgcccaagcugaucagccaggaggcccuccugcaccagcaccacugcccccagcuggaggcccuccaggagaagcugcggcugcucgaggaggagaaccaccagcugcgcgaggaggccucccagcuggacacccucgaggacgaggagcagaugcugauccuggagugcguggagcaguucagcgaggccucccagcagauggcggagcucagcgagguccuggugcugcggcucgagaacuacgagcgccagcagcaggagguggcccggcugcaggcccagguccugaagcuccagcagcgcugccggauggagacccugcccggguuccaggagacgcuggccgaggagcuccgcaccucccugcggcgcaugaucagcgaccccguguacuucauggagcggaacuacgagaugccccgcggcgacaccuccagccugcgguacgacuuccgcuacuccgaggaccgggagcagguccgcggcuucgaggccgaggaggggcugaugcucgcggccgacaucaugcggggcgaggacuucaccccggccgaggaguucgugccccaggaggagcugggggccgccaagaaggugcccgcggaggagggcgugauggaggaggccgagcuggucagcgaggagacggaggggugggaggagguggagcucgagcuggacgaggccacccgcaugaacgucgugaccuccgcccuggaggcgagcggccucggcccgucccaccuggacaugaacuacgugcugcagcagcucgccaacuggcaggacgcccacuaccggcgccagcugcgcuggaagaugcugcagaagggggagugcccccacggcgcccuccccgccgcgagccggaccuccugccgcagcuccugccgguga

SEQ ID NO: 30977 - RNA, 1065 nt, Artificial Sequence
  derived and/or modified sequence opt1 from HAPLN1__Homo_sapiens__NP_001875
augaagucccugcuccugcuggugcucaucagcaucugcugggccgaccaccugagcgacaacuacacccuggaccacgaccgcgccauccacauccaggcggagaacggcccccaccuccuggucgaggccgagcaggccaagguguucucccaccgcgggggcaacgugacccugccgugcaaguucuaccgggaccccacggccuucgggagcggcauccacaagauccggaucaaguggaccaagcucaccuccgacuaccugaaggaggucgacguguucgugagcaugggguaccacaagaagaccuacggcggcuaccaggggcgcgucuuccugaagggcggguccgacagcgacgccucccucgugaucacggaccugacccuggaggacuacggccgguacaagugcgaggugaucgaggggcucgaggacgacaccgucgugguggcgcuggaccugcagggcgucguguuccccuacuucccccgccucggccgguacaaccugaacuuccacgaggcccagcaggccugccuggaccaggacgccgugaucgcgagcuucgaccagcucuacgacgccuggcgcgggggccuggacuggugcaacgccggguggcuguccgacggcagcguccaguacccgaucaccaagccccgggagcccugcggcgggcagaacacggugcccggcgugcgcaacuacggguucugggacaaggacaagucccgguacgacgucuucugcuucaccagcaacuucaacggccgcuucuacuaccucauccacccgaccaagcugaccuacgacgaggccgugcaggccugccugaacgacggggcgcagaucgccaaggugggccagaucuucgccgccuggaagauccucggcuacgaccggugcgacgccggguggcuggcggacggcuccguccgcuaccccaucagccggccccgccggcgcugcucccccacggaggccgccgugcgguucgugggguucccggacaagaagcacaagcuguacggcgucuacugcuuccgcgccuacaacuga

SEQ ID NO: 30978 - RNA, 1209 nt, Artificial Sequence
  derived and/or modified sequence opt1 from HAPLN4__Homo_sapiens__NP_075378
auggugugcgcccgcgccgcgcugggccccggggcccucugggccgccgccuggggcguccugcugcucaccgcgccggccggggcccagcggggccgcaagaagguggugcacguccuggagggggagagcggcuccguggugguccagaccgcccccggccagguggugagccaccgcgggggcacgaucguccugcccugccgguaccacuacgaggcggccgcccacgggcacgacggcgugcggcucaaguggaccaagguggucgacccccuggccuucaccgacguguucguggcccuggggccgcagcaccgcgcguucggcuccuaccggggccgcgccgagcuccagggggacggccccggggacgccagccugguccugcggaacgugacccuccaggacuacggccgcuacgagugcgaggugacgaacgagcuggaggacgacgccggcauggucaagcuggaccucgagggggugguguuccccuaccacccccggggcgggcgcuacaagcugaccuucgccgaggcgcagcgggccugcgccgagcaggacggcauccuggccuccgccgagcagcuccacgcggccuggcgcgacgggcuggacuggugcaacgccggcuggcugcgggacggcagcguccaguacccggugaaccgcccccgggagcccugcgggggccucgggggcaccggguccgccggcggcgggggcgacgccaacgggggccugcgcaacuacggguaccggcacaacgcggaggagcgcuacgacgccuucugcuucaccagcaaccugcccggccggguguucuuccucaagccgcugcgccccguccccuucuccggcgccgcccgcgcgugcgccgcccgcggggccgccguggcgaaggucggccagcuguucgccgccuggaagcuccagcugcuggaccggugcacggccggguggcucgccgacggcagcgcgcgguaccccaucgugaacccgcgcgcccggugcggcgggcgccggcccggcgugcgcucccugggguuccccgacgccacccggcgccuguucggcgucuacugcuaccgggcccccggggccccggaccccgcgcccggcggcuggggguggggcugggccgggggcgggggcugggccggcggggcccgcgaccccgcggccuggaccccgcuccacguguga

SEQ ID NO: 30979 - RNA, 1446 nt, Artificial Sequence
  derived and/or modified sequence opt1 from HARS2__Homo_sapiens__NP_001265660
augccccugcucggccugcugccgcgccgggccugggccagccuccugucccagcugcuccgcccgcccugcgcgagcugcaccggggccgugcggugccagucccagggcacccgcgaccugagcccccagcacauggucgugcgggagaagauccuggaccucgugaucuccugcuucaagcgccacggggccaagggcauggacacgcccgccuucgagcugaaggagacccugaccgagaaguacggggaggacagcggccucauguacgaccugaaggaccagggcggggagcugcucucccugcgguacgaccugaccguccccuucgcccgcuaccucgcgaugaacaaggugaagaagaugaagcgguaccacgugggcaaggucuggcgccgggagagccccacgaucgugcaggggcgcuaccgggaguucugccagugcgacuucgacaucgccggccaguucgaccccaugaucccggacgccgagugccugaagaucaugugcgagauccuguccgggcuccagcugggcgacuuccugaucaaggugaacgaccgccggaucgucgacggcauguucgccgugugcggggugcccgagagcaaguuccgcgcgaucugcuccagcaucgacaagcucgacaagauggccuggaaggacguccggcacgagaugguggugaagaagggccuggcccccgaggucgccgaccgcaucggggacuacgugcagugccacggcggcgugucccuggucgagcagauguuccaggacccccggcucagccagaacaagcaggcccuggaggggcugggcgaccucaagcugcuguucgaguaccucacccuguucgggaucgcggacaagaucuccuucgaccugagccucgcccgcggccuggacuacuacaccggggugaucuacgaggccgugcugcuccagaccccgacgcaggccggcgaggagccccugaacgucggcuccguggccgccgggggccgguacgacgggcuggugggcauguucgaccccaaggggcacaagguccccugcgugggccucagcaucggcgucgagcgcaucuucuacaucguggagcagcgcaugaagaccaagggggagaaggugcggaccaccgagacgcaggucuucguggcgaccccgcagaagaacuuccugcaggagcgccugaagcucaucgccgagcugugggacuccggcaucaaggccgagaugcuguacaagaacaaccccaagcuccugacccagcugcacuacugcgagagcaccgggaucccccugguggucaucaucggcgagcaggagcucaaggagggggugaucaagauccggagcguggccucccgcgaggaggucgcgaucaagcgggagaacuucguggccgagauccagaagcgccugagcgaguccuga

SEQ ID NO: 30980 - RNA, 1410 nt, Artificial Sequence
  derived and/or modified sequence opt1 from HARS__Homo_sapiens__NP_001244969
auggccgagcgcgccgcgcuggaggagcucgugaagcugcagggcgagcggguccgcgggcugaagcagcagaaggccagcgccgagcucaucgaggaggagguggccaagcugcugaagcucaaggcccagcugggccccgacgaguccaagcagaaguucgugcugaagaccccgaaggagacccucauggggaaguacggcgaggacagcaagcugaucuacgaccugaaggaccagggcggggagcuccugucccugcgguacgaccucacgguccccuucgcgcgcuaccuggccaugaacaagcugaccaacaucaagcgguaccacaucgccaagguguaccgccgggacaaccccgccaugacccgcggccgguaccgcgaguucuaccagugcgacuucgacaucgcggggaacuucgaccccaugaucccggacgccgagugccucaagaucaugugcgagauccugagcucccugcagaucggcgacuuccucgugaaggucaacgaccggcgcauccuggacgggauguucgccaucugcggcgugagcgacuccaaguuccggaccaucugcagcuccguggacaagcuggacaaggucagcugggaggaggugaagaacgagauggugggggagaagggccucgcccccgaggucgccgaccgcaucggcgacuacgugcagcagcacgggggcgugucccuggucgagcagcugcuccaggaccccaagcugagccagaacaagcaggcgcuggaggggcucggcgaccugaagcuccuguucgaguaccugacgcuguucggcaucgacgacaagaucuccuucgaccucagccuggcccgggggcuggacuacuacaccggcgugaucuacgaggccgugcuccugcagacccccgcccaggccggggaggagccgcugggcgucggguccguggcggccggcggccgcuacgacgggcucgugggcauguucgaccccaaggggcggaagguccccugcgugggccugagcaucgggguggagcgcaucuucuccaucgucgagcagcggcuggaggcccucgaggagaagauccgcaccacggagacccaggugcuggucgccagcgcccagaagaagcugcucgaggagcggcugaagcugguguccgagcugugggacgcgggcaucaaggccgagcuccuguacaagaagaaccccaagcugcucaaccagcugcaguacugcgaggaggccggcaucccgcugguggccaucaucggggagcaggagcucaaggacggcgucaucaagcugcgcagcgugaccagccgcgaggagguggacguccggcgcgaggaccugguggaggagaucaagcggcgcaccgggcagccccucugcaucugcuga

SEQ ID NO: 30981 - RNA, 1734 nt, Artificial Sequence
  derived and/or modified sequence opt1 from HAS1__Homo_sapiens__NP_001284365
augcgccaggacgcccccaagccgacccccgccgcgugccggugcagcggccuggcccgccgggugcucaccaucgccuucgcccugcugauccucgggcugaugacgugggccuacgcggccggcgugccccuggccuccgaccgcuacgggcuccuggccuucggccuguacggggcguuccucagcgcccaccugguggcccagucccuguucgccuaccucgagcaccggcgcguggccgcggccgcccggggcccccuggacgccgccaccgcgcgcagcgucgcccugaccaucuccgccuaccaggaggacccggccuaccuccggcagugccuggccagcgcgcgcgcccugcucuacccccgggcccgccugcgggugcugaugguggucgacggcaaccgcgccgaggaccucuacaugguggacauguuccgggagguguucgccgacgaggaccccgcgaccuacgucugggacgggaacuaccaccagcccugggagccggccgccgccggcgcggugggggccggcgccuaccgcgagguggaggccgaggaccccgggcggcuggccgucgaggcgcuggugcgcacgcggcgcugcgugugcgucgcccagcgguggggcggcaagcgcgaggugauguacaccgccuucaaggcccucggggacuccguggacuacguccaggugugcgacagcgacacccgccuggaccccauggcccugcucgagcuggugcggguccuggacgaggacccccgcgugggcgcggucgggggcgacgugcggauccucaacccgcuggacuccugggugagcuuccuguccagccuccgcuacugggucgccuucaacguggagcgggccugccaguccuacuuccacugcgugagcugcaucuccggcccccuggggcuguaccgcaacaaccuccugcagcaguuccuggaggccugguacaaccagaaguuccucggcacccacugcacguucggggacgaccggcaccugaccaaccgcaugcugagcaugggcuacgccaccaaguacaccucccggagccgcugcuacuccgagacgcccagcagcuuccuccgguggcugucccagcagacccgcuggagcaaguccuacuuccgggaguggcuguacaacgcgcucugguggcaccgccaccacgccuggaugaccuacgaggccgucgugagcgggcuguuccccuucuucguggccgcgaccguccugcgccucuucuacgccggccggccgugggcccugcugugggugcugcucugcgugcagggcgucgcccuggccaaggcggccuucgccgccuggcugcgggggugccuccgcauggugcugcugucccucuacgcgccccuguacaugugcggccugcuccccgccaaguuccuggcccuggugacgaugaaccagagcggguggggcaccuccgggcggcgcaagcucgccgccaacuacgucccccugcugccgcucgcccugugggcgcugcuccugcugggcggccucgugcgcagcguggcccacgaggcccgggccgacugguccgggcccagccgcgcggccgaggccuaccaccuggccgccggcgcgggggccuacgucggcuacuggguggccaugcugacccucuacuggguggggguccggcgccugugccggcgccggaccggcggcuaccgcguccagguguga

SEQ ID NO: 30982 - RNA, 1659 nt, Artificial Sequence
  derived and/or modified sequence opt1 from HAS2__Homo_sapiens__XP_011515304
augcacugcgagcgcuuccugugcauccuccggaucaucggcaccacccuguucggggugagccugcuccugggcaucacggccgccuacaucgucggguaccaguucauccagaccgacaacuacuacuucuccuucggccuguacggggcguuccucgccagccaccugaucauccagucccuguucgccuuccucgagcaccgcaagaugaagaagucccuggagacccccaucaagcugaacaagaccguggcccucugcaucgccgcguaccaggaggacccggacuaccugcggaagugccugcagagcgugaagcgccucacguaccccggcaucaaggucgugauggugaucgacggcaacagcgaggacgaccuguacaugauggacaucuucuccgaggucauggggcgggacaagagcgccaccuacaucuggaagaacaacuuccacgagaagggccccggggagaccgacgagucccacaaggagagcucccagcacgugacccagcuggugcucagcaacaaguccaucugcaucaugcagaaguggggcgggaagcgcgaggucauguacacggccuuccgggcccugggccgcagcguggacuacgugcaggucugcgacuccgacaccaugcuggaccccgcgagcuccguggagauggugaagguccucgaggaggacccgauggugggcggggugggcggggacguccagauccugaacaaguacgacagcuggaucuccuuccugagcagcgugcgguacuggauggccuucaacaucgagcgcgccugccaguccuacuucggcugcgugcagugcaucagcggcccccucgggauguaccggaacucccugcugcacgaguucgucgaggacugguacaaccaggaguucaugggcaaccagugcagcuucggggacgaccgccaccucaccaaccgggugcugucccugggcuacgccaccaaguacacggcccgcagcaagugccucaccgagacccccaucgaguaccugcgguggcugaaccagcagacccgcugguccaagagcuacuuccgggaguggcucuacaacgcgaugugguuccacaagcaccaccuguggaugacguacgaggccaucaucaccggguucuuccccuucuuccugaucgccaccgugauccagcuguucuaccgcggcaagaucuggaacauccuccuguuccuccugaccguccagcuggugggccucaucaaguccagcuucgccuccugccugcgggggaacaucgucaugguguucaugagccuguacuccgugcucuacaugagcucccugcugccggccaagauguucgcgaucgccacgaucaacaaggccggcugggggaccagcggccgcaagaccaucgucgugaacuucaucgggcucauccccguguccgucugguucaccauccugcugggcggcgugaucuucacgaucuacaaggagagcaagcggcccuucuccgagagcaagcagaccgugcugaucgucgggacccuccuguacgccugcuacugggugaugcugcucacccuguacgugguccugaucaacaagugcggccgccgcaagaaggggcagcaguacgacauggugcucgacguguga

SEQ ID NO: 30983 - RNA, 1662 nt, Artificial Sequence
  derived and/or modified sequence opt1 from HAS3__Homo_sapiens__NP_005320
augcccgugcagcugaccaccgcccuccgcgucgugggcacgagccuguucgcccuggcggugcucgggggcauccuggccgccuacgucaccggguaccaguucauccacaccgagaagcacuaccuguccuucggccucuacggggccauccugggccugcaccuccugauccagagccuguucgccuuccucgagcaccggcgcaugcggcgcgcgggccaggcccugaagcugccgagcccccggcgcggguccguggcccucugcaucgccgcguaccaggaggaccccgacuaccugcggaagugccugcgcuccgcccagcggaucagcuuccccgaccucaagguggucauggugguggacggcaaccgccaggaggacgccuacaugcuggacaucuuccacgagguccucgggggcaccgagcaggccggguucuucguguggcgguccaacuuccacgaggccggcgagggcgagacggaggcgagccuccaggaggggauggaccgcgugcgggacgucgugcgcgccuccaccuucagcugcaucaugcagaaguggggcgggaagcgggaggugauguacaccgccuucaaggcccugggcgacuccgucgacuacauccaggugugcgacagcgacaccgugcuggacccggccugcacgaucgagaugcuccgcguccuggaggaggacccccaggugggcggggugggcggggacguccagauccugaacaaguacgacuccuggaucagcuuccucuccagcgugcgguacuggauggcguucaacguggagcgcgccugccaguccuacuucggcugcguccagugcaucagcgggccccugggcauguaccggaacucccugcuccagcaguuccuggaggacugguaccaccagaaguuccugggcagcaagugcagcuucggggacgaccgccaccucaccaaccgggugcugucccugggcuaccgcaccaaguacaccgcccgcagcaagugccucacggagacccccaccaaguaccugcgguggcugaaccagcagacccgcugguccaagagcuacuuccgggaguggcucuacaacucccugugguuccacaagcaccaccuguggaugacguacgagagcgucgugaccggguucuucccguucuuccucaucgccaccgugauccagcuguucuaccgcggccggaucuggaacauccugcuguuccugcugaccguccagcucguggggaucaucaaggccacguacgcgugcuuccugcgcggcaacgccgagaugaucuucaugucccuguacagccugcucuacauguccagccugcugcccgccaagaucuucgccaucgccaccaucaacaaguccggcugggggaccagcggccggaagaccaucguggucaacuucaucgggcucauccccguguccaucuggguggcgguccugcugggcgggcucgccuacacggccuacugccaggaccuguucagcgagaccgagcuggccuuccucguguccggcgcgauccuguacggcugcuacuggguggcccugcucaugcuguaccuggccaucaucgcccgccggugcgggaagaagcccgagcaguacagccucgccuucgcggaggucuga

SEQ ID NO: 30984 - RNA, 1260 nt, Artificial Sequence
  derived and/or modified sequence opt1 from HAT1__Homo_sapiens__NP_003633
auggccggcuucggggccauggagaaguuccugguggaguacaagagcgcggucgagaagaagcucgccgaguacaagugcaacaccaacaccgccaucgagcugaagcuggugcgcuuccccgaggaccucgagaacgacauccggacguucuucccggaguacacccaccagcuguucggcgacgacgagaccgccuucggguacaagggccugaagauccuccuguacuacaucgccgggucccugagcaccauguuccgcguggaguacgcguccaaggucgacgagaacuucgacugcguggaggccgacgacguggagggcaagauccggcagaucaucccgcccggcuucugcacgaacaccaacgacuuccucagccugcuggagaaggaggucgacuucaagcccuucgggacccuccugcacaccuacuccgugcugagccccacgggcggggagaacuucaccuuccagaucuacaaggccgacaugaccugccgcggcuuccgggaguaccacgagcgccuccagaccuuccugaugugguucaucgagacggccuccuucaucgacguggacgacgagcgguggcacuacuuccuggucuucgagaaguacaacaaggacggggcgacccucuucgccaccgugggcuacaugaccguguacaacuacuacgucuaccccgacaagacgcgcccccgggugagccagaugcugauccugacccccuuccagggccaggggcacggcgcccagcuccuggagaccgugcaccgcuacuacaccgaguucccgacgguccuggacaucaccgccgaggaccccuccaagagcuacgugaagcuccgggacuucgugcuggucaagcugugccaggaccuccccugcuucucccgcgagaagcugaugcagggguucaacgaggacauggccaucgaggcgcagcagaaguucaagaucaacaagcagcacgcccggcgcguguacgagauccugcggcuccuggugaccgacaugagcgacgccgagcaguaccgcuccuaccggcuggacaucaagcgccggcucaucagccccuacaagaagaagcagcgcgaccuggccaagaugcggaagugccugcgcccggaggagcucaccaaccagaugaaccagaucgagaucuccaugcagcacgagcagcuggaggagagcuuccaggagcuggucgaggacuaccgccgggugaucgagcgccucgcccaggaguga

SEQ ID NO: 30985 - RNA, 1095 nt, Artificial Sequence
  derived and/or modified sequence opt1 from HAVCR1__Homo_sapiens__NP_001166864
augcacccccagguggucauccugagccucauccugcaccuggccgacuccguggccggcagcgugaaggucgggggcgaggcggggccguccgugacccuccccugccacuacagcggcgccgugaccuccaugugcuggaaccgcgggagcugcucccuguucacgugccagaacggcaucgucuggaccaacggcacccacgugaccuaccggaaggacacgcgcuacaagcugcucggggaccugagccggcgcgacgugucccugaccaucgagaacaccgccgucagcgacuccggcguguacugcugccggguggagcaccgcgggugguucaacgacaugaagaucaccgucagccucgagaucgugccgcccaaggugacgaccacccccaucgucaccacggugcccaccgugaccaccguccggacguccaccaccgugcccaccacgaccaccgugcccaugaccacggucccgaccaccaccgugcccacgaccaugagcauccccaccaccacgaccgugcugaccaccaugacggucuccaccaccaccagcgugcccaccacgaccuccaucccgaccaccacgagcguccccgugaccaccaccguguccacguucgucccgcccaugccccugccccgccagaaccacgagcccguggccaccagccccagcuccccgcagcccgccgagacccaccccaccacgcuccagggcgcgauccggcgcgagcccaccagcuccccgcuguacagcuacaccaccgacgggaacgacacggugaccgaguccagcgacggccuguggaacaacaaccagacccagcuguuccucgagcacucccugcucaccgccaacacgaccaagggcaucuacgccggggucugcaucagcgugcuggugcugcucgcccugcugggcgucaucaucgcgaagaaguacuucuucaagaaggaggugcagcagcucuccgugagcuucuccagccugcagaucaaggcccugcagaacgccgucgagaaggaggugcaggccgaggacaacaucuacaucgagaacucccucuacgccaccgacuga

SEQ ID NO: 30986 - RNA, 906 nt, Artificial Sequence
  derived and/or modified sequence opt1 from HAVCR2__Homo_sapiens__NP_116171
auguucagccaccuccccuucgacugcgugcugcugcugcuccugcugcuccugacccgcuccagcgaggucgaguaccgggccgaggugggccagaacgccuaccugccgugcuucuacacccccgcggcccccgggaaccucgugcccgucugcuggggcaagggggccugcccgguguucgagugcggcaacgugguccugcgcacggacgagcgggacgugaacuacuggaccucccgcuacuggcugaacggggacuuccggaagggcgacgugagccucaccaucgagaacgucacccuggccgacuccggcaucuacugcugccgcauccagauccccgggaucaugaacgacgagaaguucaaccugaagcucgugaucaagcccgccaaggugacgcccgcgccgacccggcagcgcgacuucaccgccgccuucccccggaugcugaccacgcgcggccacgggcccgccgagacccagacccugggcagccuccccgacaucaaccugacccagaucuccacgcuggcgaacgagcuccgggacagccgccuggccaacgaccugcgggacuccggggccaccauccgcaucggcaucuacaucggcgccgggaucugcgccggccucgcgcuggcccugaucuucggggcccucaucuucaagugguacagccacuccaaggagaagauccagaaccugagccugaucucccucgccaaccugccgcccagcggccuggccaacgcggucgccgagggcauccgguccgaggagaacaucuacaccaucgaggagaacguguacgagguggaggagcccaacgaguacuacugcuacgucagcucccgccagcagcccagccagccgcucgggugccgguucgccaugcccuga

SEQ ID NO: 30987 - RNA, 696 nt, Artificial Sequence
  derived and/or modified sequence opt1 from HAX1__Homo_sapiens__NP_001018238
augagccuguucgaccucuuccgcggcuucuucggguuccccggcccgcgguccuucagccccgggggcgggauccgcuuccacgacaacuucggcuucgacgaccuggugcgggacuucaacuccaucuucagcgacaugggcgccuggacccugcccucccacccgcccgagcuccccgggcccgagagcgagacccccggcgagcgccugcgggaggggcagacgcugcgcgacuccaugcucaaguacccggacagccaccagccccggaucuucggcgggguccuggaguccgacgcccgcagcgagagcccccagcccgcgccggacuggggcucccagcggcccuuccaccgcuucgacgacguguggcccauggacccccacccgcggacccgcgaggacaacgaccuggacucccaggugagccaggagggccucgggcccguccugcagccccagcccaaguccuacuucaagagcaucuccgugaccaagaucaccaagccggacggcaucguggaggagcggcgcacggucguggacagcgaggggcggaccgagaccaccgugacgcgccacgaggccgacuccagcccccggggcgaccccgagagcccccgcccgcccgcccuggacgacgccuucuccauccucgaccuguuccugggccggugguuccgcagccgguga

SEQ ID NO: 30988 - RNA, 429 nt, Artificial Sequence
  derived and/or modified sequence opt1 from HBA2__Homo_sapiens__NP_000508
auggugcugagccccgccgacaagaccaacgucaaggccgcguggggcaaggugggggcccacgccggcgaguacggggccgaggcccucgagcgcauguuccuguccuucccgaccacgaagaccuacuucccccacuucgaccugagccacggcuccgcccaggugaaggggcacggcaagaaggucgcggacgcccucaccaacgccguggcgcacguggacgacaugcccaacgcccugagcgcccuguccgaccuccacgcccacaagcugcgggucgaccccgugaacuucaagcugcucagccacugccugcuggugacccucgccgcgcaccucccggccgaguucacgcccgccguccacgccucccuggacaaguuccuggccagcguguccaccgugcugaccagcaaguaccgcuga

SEQ ID NO: 30989 - RNA, 444 nt, Artificial Sequence
  derived and/or modified sequence opt1 from HBB__Homo_sapiens__NP_000509
auggugcaccugacccccgaggagaaguccgccgucaccgcccucuggggcaaggugaacguggacgaggucgggggcgaggcgcuggggcgccugcucgugguguacccguggacgcagcgguucuucgagagcuucggcgaccugagcacccccgacgccgucauggggaaccccaaggugaaggcccacggcaagaaggugcugggcgccuucuccgacgggcucgcccaccuggacaaccugaagggcaccuucgcgacccucagcgagcugcacugcgacaagcugcacgucgaccccgagaacuuccgccuccuggggaacgugcuggugugcguccucgcccaccacuucggcaaggaguucacgccgcccgugcaggccgccuaccagaagguggucgcggggguggccaacgcccuggcccacaaguaccacuga

SEQ ID NO: 30990 - RNA, 444 nt, Artificial Sequence
  derived and/or modified sequence opt1 from HBD__Homo_sapiens__NP_000510
auggugcaccugacccccgaggagaagaccgccgucaacgcccucuggggcaaggugaacguggacgcggucgggggcgaggcccuggggcgccugcucgugguguacccguggacgcagcgguucuucgagagcuucggcgaccuguccagccccgacgccgucauggggaaccccaaggugaaggcccacggcaagaaggugcugggcgccuucuccgacgggcucgcgcaccuggacaaccugaagggcaccuucagccagcucuccgagcugcacugcgacaagcugcacgucgaccccgagaacuuccgccuccuggggaacgugcuggugugcguccucgcccggaacuucggcaaggaguucaccccgcagaugcaggccgccuaccagaaggugguggcgggggucgccaacgcccuggcccacaaguaccacuga

SEQ ID NO: 30991 - RNA, 444 nt, Artificial Sequence
  derived and/or modified sequence opt1 from HBE1__Homo_sapiens__NP_005321
auggugcacuucaccgccgaggagaaggccgcggucaccagccugugguccaagaugaacguggaggaggccggcggggaggcccucggccgccugcugguggucuaccccuggacgcagcgguucuucgacagcuucgggaaccucuccagcccguccgccauccugggcaaccccaaggugaaggcccacgggaagaaggugcugaccagcuucggcgacgcgaucaagaacauggacaaccucaagcccgccuucgccaagcuguccgagcugcacugcgacaagcuccacgucgaccccgagaacuucaagcugcugggcaacgugauggugaucauccucgccacccacuucgggaaggaguucaccccggagguccaggcggccuggcagaagcuggugagcgccguggccaucgcccuggcgcacaaguaccacuga

SEQ ID NO: 30992 - RNA, 627 nt, Artificial Sequence
  derived and/or modified sequence opt1 from HBEGF__Homo_sapiens__NP_001936
augaagcugcuccccagcgugguccugaagcuguuccucgccgccgugcuguccgcgcuggugaccggcgagagccucgagcggcugcggcgcgggcuggccgccggcaccuccaacccggacccgcccacggucagcaccgaccagcuccugccccucgggggcgggcgggaccgcaaggugcgggaccugcaggaggccgaccuggaccugcuccgcgugacccuguccagcaagccccaggcccuggcgacccccaacaaggaggagcacggcaagcggaagaagaagggcaaggggcucggcaagaagcgcgaccccugccugcggaaguacaaggacuucugcauccacggggagugcaaguacgucaaggagcugcgcgcccccuccugcaucugccacccgggcuaccacggggagcggugccacggccucagccugcccguggagaaccgccuguacacguacgaccacaccaccauccucgccguggucgccguggugcuguccagcgucugccugcucgugaucgugggccugcugauguuccgguaccaccgccgcgggggcuacgacgucgagaacgaggagaaggugaagcucgggaugaccaacucccacuga

SEQ ID NO: 30993 - RNA, 444 nt, Artificial Sequence
  derived and/or modified sequence opt1 from HBG1__Homo_sapiens__NP_000550
augggccacuucaccgaggaggacaaggccaccaucacgagccugugggggaaggugaacgucgaggacgccggcggggagacccucggccgccugcuggugguguaccccuggacccagcgguucuucgacuccuucgggaaccucagcuccgcgagcgccaucaugggcaacccgaaggucaaggcccacggcaagaaggugcugaccucccugggggacgccacgaagcaccucgacgaccugaagggcaccuucgcccagcugagcgagcuccacugcgacaagcugcacguggaccccgagaacuucaagcugcucgggaacguccuggugaccgugcuggcgauccacuucggcaaggaguucacccccgagguccaggccuccuggcagaagauggugacggccguggccagcgcgcucuccagccgcuaccacuga

SEQ ID NO: 30994 - RNA, 444 nt, Artificial Sequence
  derived and/or modified sequence opt1 from HBG2__Homo_sapiens__NP_000175
augggccacuucaccgaggaggacaaggccaccaucacgagccugugggggaaggugaacgucgaggacgccggcggggagacccucggccgccugcuggugguguaccccuggacccagcgguucuucgacuccuucgggaaccucagcuccgcgagcgccaucaugggcaacccgaaggucaaggcccacggcaagaaggugcugaccucccugggggacgccaucaagcaccucgacgaccugaagggcacguucgcccagcugagcgagcuccacugcgacaagcugcacguggaccccgagaacuucaagcugcucgggaacguccuggugaccgugcuggcgauccacuucggcaaggaguucacccccgagguccaggccuccuggcagaagauggugaccgggguggccagcgcccucuccagccgcuaccacuga

SEQ ID NO: 30995 - RNA, 426 nt, Artificial Sequence
  derived and/or modified sequence opt1 from HBM__Homo_sapiens__NP_001003938
augcugagcgcccaggagcgcgcccagaucgcccaggugugggaccucaucgcgggccacgaggcccaguucggggccgagcugcugcuccggcuguucaccgucuaccccuccaccaagguguacuucccgcaccugagcgccugccaggacgcgacgcagcuccugucccacggccagcgcaugcuggccgccgugggggccgcgguccagcacguggacaaccuccgggccgcccugagcccccuggccgaccuccacgcccuggugcugcgcgucgaccccgcgaacuucccccuccugauccagugcuuccacguggugcuggccucccaccuccaggacgaguucaccguccagaugcaggccgccugggacaaguuccugaccggcguggccgugguccugaccgagaaguaccgguga

SEQ ID NO: 30996 - RNA, 1575 nt, Artificial Sequence
  derived and/or modified sequence opt1 from HBP1__Homo_sapiens__NP_001231191
auggccaccggccugagcgagcaccacaacauggugugggaggucaagaccaaccagaugcccaacgccgugcagaagcuccugcuggugauggacaagcgcgcguccgggaugaacgacagccucgagcugcugcagugcaacgagaaccucccguccagccccggcuacaacuccugcgacgagcacauggagcuggacgaccugcccgagcuccaggccguccagagcgaccccacgcaguccgggauguaccagcugagcuccgacgugagccaccaggaguacccgcgguccagcuggaaccagaacaccuccgacauccccgagaccaccuaccgcgagaacgagguggacuggcugacggagcucgccaacaucgccaccagcccccagagcccccugaugcagugcuccuucuacaaccgguccagcccgguccacaucaucgccaccuccaagagccugcacagcuacgcgcgcccgccgcccguguccagcuccagcaaguccgagcccgccuucccccaccaccacuggaaggaggagacccccgugcggcacgagcgcgccaacagcgaguccgagagcggcaucuucugcauguccagccucuccgacgacgacgaccugggguggugcaacagcuggcccuccacggucuggcacugcuuccugaagggcacccggcucugcuuccacaagggcagcaacaaggaguggcaggacguggaggacuucgcccgcgcggaggggugcgacaacgaggaggaccugcagaugggcauccacaagggguacggcuccgacgggcugaagcuccugagccacgaggaguccgugagcuucggcgaguccguccugaagcucaccuucgaccccggcaccguggaggacgggcugcugacgguggagugcaagcucgaccaccccuucuacgucaagaacaagggcuggagcagcuucuaccccucccugaccguggugcagcacgggauccccugcugcgagguccacaucggcgacgugugccugccgcccggccaccccgacgccaucaacuucgacgacagcgggguguucgacaccuucaaguccuacgacuucacccccauggacagcuccgccgucuacgugcucagcuccauggcccggcagcgccgggccagccuguccugcggcgggccgggcgggcaggacuucgcgcgcagcggcuucuccaagaacugcggcagccccggguccagccagcuguccagcaacucccucuacgccaaggccgugaagaaccacagcagcggcacggucuccgccaccagccccaacaagugcaagcggcccaugaacgccuucaugcuguucgcgaagaaguaccgcguggaguacacccagauguacccggggaaggacaaccgggccaucuccgucauccugggcgaccgcuggaagaagaugaagaacgaggagcggcgcauguacacccucgaggccaaggcccuggccgaggagcagaagcggcugaaccccgacugcuggaagcgcaagcggacgaacagcgggucccagcagcacuga

SEQ ID NO: 30997 - RNA, 429 nt, Artificial Sequence
  derived and/or modified sequence opt1 from HBQ1__Homo_sapiens__NP_005322
auggcccugagcgccgaggaccgcgcgcucgugcgggcccuguggaagaagcugggcuccaacgucgggguguacaccaccgaggcccucgagcgcacguuccuggccuuccccgccaccaagaccuacuucagccaccuggaccucuccccgggcagcucccaggugcgggcgcacgggcagaaggucgccgacgcccugagccuggccguggagcgccucgacgaccugccccacgcgcuguccgcccucagccaccuccacgccugccagcugcggguggaccccgccuccuuccagcugcugggccacugccugcucgucacccuggcccgccacuaccccggggacuucagcccggcgcugcaggccucccucgacaaguuccugagccacgugaucuccgcccuggugagcgaguaccgguga

SEQ ID NO: 30998 - RNA, 1929 nt, Artificial Sequence
  derived and/or modified sequence opt1 from HBS1L__Homo_sapiens__NP_001138630
auggcccgccaccggaacgugcgcggcuacaacuacgacgaggacuucgaggacgacgaccuguacgggcagagcgucgaggacgacuacugcaucucccccagcaccgcccggcucuacuccugccuggaccacaugcgcgaggugcugggcgacgcggugccggacgagauccucaucgaggccguccugaagaacaaguucgacgugcagaaggcccugagcggggugcucgagcaggaccggguccagucccugaaggacaagaacgaggccaccgugagcacgggcaagaucgccaaggggaagcccguggacucccagaccagccgcuccgagagcgagaucguccccaagguggcgaagaugaccguguccggcaagaagcagaccaugggcuucgagguccccggggugagcuccgaggagaacggccacagcuuccacacgccgcagaaggggccgcccaucgaggacgccaucgccuccagcgacgugcuggagaccgccuccaagagcgcgaacccgccccacaccauccaggccuccgaggagcagagcagcacccccgcccccgucaagaaguccggcaagcuccggcagcagaucgacgugaaggccgagcuggagaagcgccagggcgggaagcagcugcucaaccugguggucaucggccacguggacgccggcaagagcacgcugauggggcacaugcucuaccugcuggggaacaucaacaagcggaccaugcacaaguacgagcaggaguccaagaaggcgggcaaggccagcuucgccuacgccugggugcucgacgagaccggcgaggagcgcgagcggggcgucaccauggacguggggaugacgaaguucgagaccaccaccaaggugaucacgcugauggacgcccccgggcacaaggacuucauccccaacaugaucaccggcgcggcccaggccgacgucgccgugcuggucguggacgccucccgcggggaguucgaggcgggcuucgagaccggcgggcagacccgggagcacggccuccuggugcgcagccugggggucacgcagcucgccguggccgugaacaagauggaccaggucaacuggcagcaggagcgguuccaggagaucaccggcaagcuggggcacuuccugaagcaggccggcuucaaggaguccgacgugggcuucauccccaccagcgggcucuccggcgagaaccugaucacccgcagccaguccagcgagcugacgaagugguacaaggggcucugccugcuggagcagaucgacuccuucaagccgccccagcggagcaucgacaagcccuuccgccucugcguguccgacgucuucaaggaccagggcagcggguucugcaucaccggcaagaucgaggccggcuacauccagaccggggaccggcugcuggcgaugccgcccaacgagaccugcacggugaagggcaucacccuccacgacgagcccguggacugggccgccgccggggaccacgucucccugacccuggugggcauggacaucaucaagaucaacgugggcugcaucuucugcgggcccaagguccccaucaaggcgugcacccgcuuccgggcccgcauccucaucuucaacaucgagauccccaucacgaagggcuuccccgugcugcugcacuaccagaccgugagcgagccggccgucaucaagcgccucaucuccgugcugaacaagagcaccggggaggugaccaagaagaagcccaaguuccugacgaagggccagaacgcccucgucgagcugcagacccagcggcccaucgcccuggagcucuacaaggacuucaaggagcuggggcgcuucaugcugcgguacggcggcagcaccaucgcggccgggguggugaccgagaucaaggaguga

SEQ ID NO: 30999 - RNA, 429 nt, Artificial Sequence
  derived and/or modified sequence opt1 from HBZ__Homo_sapiens__NP_005323
augagccugaccaagaccgagcgcacgaucaucguguccaugugggccaagaucagcacccaggccgacaccaucggcaccgagacgcucgagcggcuguuccugucccacccccagaccaagaccuacuucccgcacuucgaccuccaccccgggagcgcgcagcugcgcgcccacggcuccaaggucguggccgccgugggggacgccgucaagagcaucgacgacaucggcggggcgcuguccaagcucagcgagcugcacgccuacauccugcggguggaccccgugaacuucaagcuccugucccacugccugcucgucacccuggccgcccgcuuccccgcggacuucacggccgaggcccacgccgccugggacaaguuccugagcgugguguccagcguccucaccgagaaguaccgguga

SEQ ID NO: 31000 - RNA, 1041 nt, Artificial Sequence
  derived and/or modified sequence opt1 from HCAR1__Homo_sapiens__NP_115943
auguacaacggcagcugcugccgcaucgagggggacaccaucucccaggugaugcccccgcugcucaucgucgccuucgugcugggcgcccuggggaacggcguggcgcucugcggguucugcuuccacaugaagaccuggaagcccagcacggucuaccuguucaaccuggccguggccgacuuccuccugaugaucugccugcccuuccggaccgacuacuaccuccgccggcgccacugggccuucggcgacauccccugccgggugggccuguucacccuggccaugaaccgcgcgggguccaucgucuuccucaccgugguggccgccgaccgguacuucaaggucgugcacccgcaccacgccgugaacacgaucagcacccgcgucgcggccggcaucgugugcacccugugggcccuggugauccucgggaccgucuaccugcugcucgagaaccaccugugcgugcaggagacggccguguccugcgagagcuucaucauggaguccgccaacggcuggcacgacaucauguuccagcuggaguucuucaugccccucgggaucauccuguucugcagcuucaagaucgucuggucccugcggcgccggcagcagcucgcgcgccaggcccggaugaagaaggccacccgcuucaucauggugguggccaucgucuucaucacgugcuaccugcccagcguguccgcccggcuguacuuccucuggaccgugcccagcuccgcgugcgacccgagcguccacggcgcccugcacaucacccuguccuucaccuacaugaacagcaugcucgacccccugguguacuacuucuccagccccuccuuccccaaguucuacaacaagcugaagaucugcagccucaagccgaagcagcccggccacagcaagacccagcgccccgaggagaugcccaucuccaaccuggggcggcgcagcugcaucuccgucgccaacagcuuccagucccagagcgacggccagugggacccgcacaucguggaguggcacuga

SEQ ID NO: 31001 - RNA, 1092 nt, Artificial Sequence
  derived and/or modified sequence opt1 from HCAR2__Homo_sapiens__NP_808219
augaaccgccaccaccuccaggaccacuuccuggagaucgacaagaagaacugcugcguguuccgggacgacuucaucgucaaggugcugcccccggugcugggccucgaguucaucuucgggcugcugggcaacgggcucgcccuguggaucuucugcuuccaccucaagagcuggaaguccagccgcaucuuccuguucaaccuggccgucgcggacuuccugcucaucaucugccugcccuuccugauggacaacuacgugcggcgcugggacuggaaguucggcgacauccccugccggcucaugcuguucaugcuggccaugaaccgccagggguccaucaucuuccucaccguggucgccguggaccgguacuuccgcgugguccacccccaccacgcccugaacaagaucagcaaccggaccgccgcgaucaucuccugccugcucuggggcaucacgaucggccugaccgugcaccuccugaagaagaagaugccgauccagaacgggggcgccaaccugugcagcuccuucagcaucugccacaccuuccaguggcacgaggccauguuccugcucgaguucuuccugccccuggggaucauccucuucugcuccgcccgcaucaucuggagccugcggcagcgccagauggaccggcacgcgaagaucaagcgcgccaucaccuucaucaugguggucgccaucguguucgugaucugcuuccugcccuccgucguggugcggauccgcaucuucuggcuccugcacacgagcggcacccagaacugcgaggucuaccgguccguggaccuggccuucuucaucacccucagcuucaccuacaugaacuccaugcuggaccccguggucuacuacuucagcuccccgagcuuccccaacuucuucuccacgcugaucaaccgcugccuccagcggaagaugaccggggagcccgacaacaaccgcagcaccagcguggagcugaccggcgaccccaacaagacgcggggcgccccggaggcgcugauggccaacuccggggagcccuggagccccuccuaccucggccccaccagcccguga

SEQ ID NO: 31002 - RNA, 1164 nt, Artificial Sequence
  derived and/or modified sequence opt1 from HCAR3__Homo_sapiens__NP_006009
augaaccgccaccaccuccaggaccacuuccucgagaucgacaagaagaacugcugcguguuccgggacgacuucaucgccaagguccugcccccggugcugggccucgaguucaucuucgggcugcugggcaacgggcucgcccuguggaucuucugcuuccaccucaagagcuggaaguccagccgcaucuuccuguucaaccuggcgguggccgacuuccugcucaucaucugccugcccuucgucauggacuacuacgugcggcgcuccgacuggaaguucggcgacauccccugccggcuggugcuguucauguucgccaugaaccgccaggggagcaucaucuuccugaccgucguggccguggaccgguacuuccgcgucgugcacccccaccacgcccugaacaagaucuccaacuggaccgcggccaucaucagcugccuccuguggggcaucacggugggccugaccguccaccuccugaagaagaagcugcucauccagaacgggaccgccaacgugugcaucuccuucagcaucugccacaccuuccgguggcacgaggccauguuccugcuggaguucuuccucccgcugggcaucauccuguucugcuccgcgcgcaucaucuggagccuccggcagcgccagauggaccggcacgccaagaucaagcgcgccaucacguucaucaugguggucgccaucguguucgugaucugcuuccugcccuccgucguggugcggauccacaucuucuggcugcuccacaccagcgggacccagaacugcgaggucuaccgcuccguggaccuggccuucuucaucacccugagcuucacguacaugaacuccaugcucgaccccguggucuacuacuucagcucccccagcuucccgaacuucuucuccacccugaucaaccggugccugcagcgcaagaucaccggcgagcccgacaacaaccggagcaccagcguggagcucacgggggaccccaacaagacccgcggcgcgcccgaggcccugaucgccaacuccggcgagccguggagccccuccuaccuggggcccaccagcaacaaccacuccaagaagggccacugccaccaggagcccgccagccucgagaagcagcuggggugcugcaucgaguga

SEQ ID NO: 31003 - RNA, 807 nt, Artificial Sequence
  derived and/or modified sequence opt1 from HCCS__Homo_sapiens__NP_001116080
augggccugagccccuccgccccggccguggcgguccaggccagcaacgccuccgccagcccgcccuccgggugccccaugcacgagggcaagaugaaggggugccccgugaacaccgagcccagcggcccgaccugcgagaagaagacguacuccgugcccgcccaccaggagcgcgcguacgaguacgucgagugccccauccgggggaccgccgccgagaacaaggagaaccucgaccccagcaaccugaugcccccgcccaaccagacccccgcccccgaccagcccuucgcgcuguccaccgugcgcgaggagagcuccaucccgcgggccgacagcgagaagaaguggguguaccccuccgagcagauguucuggaacgccaugcucaagaagggcuggaaguggaaggacgaggacaucagccagaaggacauguacaacaucauccgcauccacaaccagaacaacgagcaggccuggaaggagauccugaagugggaggcccugcacgcggccgagugccccugcggccccucccucauccgguucgggggcaaggccaaggaguacagcccgcgcgcccggauccgcuccuggaugggguacgagcugcccuucgaccggcacgacuggaucaucaaccgcugcggcacggagguccgguacgugaucgacuacuacgacgggggcgaggugaacaaggacuaccaguucaccauccuggacguccgccccgcccucgacagccuguccgcggugugggaccggaugaagguggccugguggcgcuggaccagcuga

SEQ ID NO: 31004 - RNA, 6108 nt, Artificial Sequence
  derived and/or modified sequence opt1 from HCFC1__Homo_sapiens__NP_005325
auggccagcgccgugagccccgcgaaccugcccgccguccugcugcagccccgcuggaagcggguggugggcuggagcgggcccgucccccgcccccggcacggccaccgcgccguggccaucaaggagcugaucguggucuucgggggcgggaacgagggcaucguggacgagcuccacguguacaacacggccaccaaccagugguucauccccgcgguccggggcgacaucccgcccgggugcgccgccuacggcuucgugugcgacgggacgcgccugcugguguucggcgggauggucgaguacggcaaguacagcaacgaccucuacgagcugcaggccagccggugggaguggaagcgccugaaggcgaagacccccaagaacgggccgccgcccugcccccggcucgggcacuccuucagccuggugggcaacaagugcuaccuguucgggggccucgccaacgacuccgaggaccccaagaacaacaucccccgcuaccugaacgaccuguacauccucgagcugcggcccggcagcgggguggucgccugggacauccccaucaccuacggcgugcugccgccgccccgcgagucccacaccgccguggucuacacggagaaggacaacaagaaguccaagcucgugaucuacgggggcauguccgggugccggcugggcgaccuguggacccucgacaucgacacccugaccuggaacaagcccagccuguccggcguggcgccccugccccgcagccugcacuccgcgacgaccaucgggaacaagauguacgucuucggcgggugggugccccuggugauggacgacgucaagguggccacccacgagaaggaguggaagugcaccaacacgcucgccugccugaaccuggacaccauggccugggagaccauccucauggacacccuggaggacaacaucccccgggcccgcgcgggccacugcgccgucgccaucaacacgcggcuguacaucuggagcgggcgcgacggcuaccggaaggccuggaacaaccaggugugcugcaaggaccucugguaccuggagaccgagaagccgccgccgcccgcccgcgugcagcugguccgggcgaacaccaacucccucgaggugagcuggggcgccguggccaccgccgacuccuaccugcugcagcuccagaaguacgacauccccgccacggcggccaccgccaccagccccacccccaaccccguccccagcgugcccgccaacccgcccaagucccccgcgcccgccgccgccgcccccgcggugcagccccugacgcaggucgggaucacccugcucccccaggccgcccccgccccgcccaccaccacgaccauccaggugcugcccaccgugcccggcagcuccaucagcguccccaccgccgcgcgcacgcagggggugcccgccgugcugaaggucaccggcccccaggccaccaccgggacgccccucgugaccaugcgcccggccucccaggccggcaaggcgcccgugaccgucaccagccugcccgccggcgugcggauggugguccccacccaguccgcccaggggacggugaucggcagcuccccgcagaugagcgggauggccgcgcuggccgccgccgccgcggccacccagaagaucccgcccuccagcgccccgaccgugcucuccguccccgccggcaccacgaucgugaagaccauggccgugacccccggcaccacgacccugcccgcgaccgucaagguggccagcuccccggugauggucagcaaccccgccacccgcaugcugaagacggccgccgcccagguggggaccuccgugagcuccgccaccaacaccagcacgcggcccaucaucaccguccacaagagcggcaccgugaccguggcccagcaggcccaggucgugacgaccguggucgggggcgugaccaagaccaucacgcuggugaagucccccaucagcguccccggcggcuccgcgcucaucagcaaccugggcaaggugauguccgugguccagaccaagcccgugcagaccagcgccgugaccgggcaggccuccacgggccccgucacccagaucauccagaccaaggggccccugccggccggcaccauccucaagcuggugacgagcgccgacgggaagcccaccaccaucaucaccacgacccaggcguccggcgccggcaccaagcccaccauccuggggaucagcuccgugagccccuccaccacgaagccgggcaccaccaccaucaucaagacgauccccaugagcgccaucaucacccaggccggggccaccggcgucaccuccagccccgggaucaagucccccaucacgaucaucaccaccaaggugaugaccagcggcacgggcgcgccggccaagaucaucaccgccguccccaagaucgccaccgggcacggccagcagggggugacccaggugguccucaagggcgcccccgggcagcccggcacgauccugcgcaccgugccgaugggcggggugcggcuggucacccccgugaccgugagcgcggucaagcccgccgugacgacccucguggucaagggcaccaccggggugacgacccugggcaccgugaccggcacggucuccaccagccuggccggggccggcgggcacuccaccagcgccucccucgcgacccccaucacgacccugggcaccaucgccacccugagcucccaggugaucaacccgacggccaucaccgugagcgccgcgcagaccacccucaccgccgccgggggccugacgacccccaccaucaccaugcagcccgucucccagccgacccaggugacccugaucaccgcccccagcggcguggaggcccagcccguccacgaccuccccguguccauccuggcgagcccgaccacggagcagcccaccgccaccgugaccaucgccgacuccgggcagggcgacguccagcccgggacggugacccuggugugcagcaacccgcccugcgagacccacgagaccggcacgaccaacaccgccaccacgaccgucguggccaaccucgggggccacccccagcccacccaggugcaguucgucugcgaccgccaggaggcggccgccucccuggugaccagcacggugggccagcagaacggguccgucgugcgggugugcagcaacccgcccugcgagacccacgagaccggcaccacgaacaccgccaccaccgccacguccaacauggcggggcagcacggcugcagcaacccgcccugcgagacccacgagaccgggaccacgaacaccgccaccaccgccaugagcuccgucggcgccaaccaccagcgcgacgcgcggcgcgccugcgccgccggcacgcccgccgugauccggaucagcguggcgaccggggcccuggaggccgcccagggcuccaagagccagugccagacccgccagaccuccgccaccagcacgaccaugaccgucauggcgaccggggcccccugcuccgccggcccccuccugggccccagcauggcccgggagcccgggggccgcucccccgccuucgugcagcuggcgccccucagcuccaaggugcggcugagcucccccagcaucaaggaccugcccgccgggcgccacucccacgccgucagcacggccgcgaugacccgguccagcgugggcgccggggagccgcgcauggcccccgugugcgagucccuccagggcggcagccccagcaccaccgucacggugaccgcccuggaggcccugcucugccccuccgcgaccgugacccaggucugcagcaacccgcccugcgagacgcacgagaccgggaccaccaacacggccaccaccuccaacgccggcagcgcccagcgggugugcuccaacccgcccugcgagacccacgagacggggaccacccacaccgccacgaccgcgaccagcaacggcgggaccggccagcccgagggcgggcagcagccgcccgccggccgccccugcgagacgcaccagaccaccuccaccgggacgaccaugagcguguccgucggcgcccugcugcccgacgccaccagcucccaccgcaccguggagagcgggcucgaggucgccgcggcccccuccgugacgccccaggccggcaccgcccugcuggccccguuccccacccagcgggugugcagcaacccgcccugcgagacccacgagaccggcacgacccacaccgcgaccacggucaccuccaacaugagcuccaaccaggacccgccgcccgccgccagcgaccagggggagguggaguccacccagggcgacagcgugaacaucaccagcuccagcgccaucacgaccaccgucuccagcacccucacgcgcgcggugaccaccgugacccaguccacgcccgucccggggcccagcgugccgccgcccgaggagcuccaggugucccccggcccccggcagcagcugccgccccgccagcuccugcagagcgccuccaccgcccugaugggggagagcgccgagguccucuccgccagccagacccccgagcugcccgcggccguggaccuguccagcaccggcgagcccuccagcggccaggaguccgccgggagcgccguggucgccacgguggugguccagccgccgccgcccacccaguccgagguggaccagcucagccugccccaggagcugauggcggaggcccaggccggcaccaccacgcucauggugaccgggcugacccccgaggagcuggccgucaccgccgcggccgaggccgccgcgcaggccgccgccacggaggaggcccaggcgcucgccauccaggccgugcugcaggccgcccagcaggcggugaugggcaccggcgagcccauggacaccagcgaggccgccgccaccgucacgcaggccgagcuggggcaccucuccgcggagggccaggaggggcaggccaccaccauccccaucgugcugacccagcaggagcuggccgcccucgugcagcagcagcagcugcaggaggcgcaggcccagcagcagcaccaccaccuccccacggaggcccucgcccccgccgacagccugaacgaccccgcgaucgaguccaacugccugaacgagcucgccggcaccgucccgagcaccguggcccugcugcccuccaccgccaccgagagccucgcccccuccaacacguucguggcgccccagccggucgugguggccagccccgccaagcugcaggccgccgcgacccugaccgaggucgccaacgggaucgagucccucggcgugaagcccgaccugcccccgccgcccagcaaggcccccaugaagaaggagaaccagugguucgacgugggcgucaucaaggggaccaacgugauggugacgcacuacuuccugccgcccgacgacgccguccccuccgacgacgaccucggcaccgugcccgacuacaaccagcugaagaagcaggagcugcagccggggaccgccuacaaguuccggguggcgggcaucaacgccugcgggcgcggccccuucagcgagaucuccgccuucaagaccugccuccccggcuucccgggggcccccugcgcgaucaagaucagcaagucccccgacggcgcccaccugacgugggagcccccgagcgucaccuccgggaagaucaucgaguacagcguguaccuggccauccaguccagccaggccggcggggagcucaagagcuccacccccgcccagcuggcguucaugcggguguacugcggccccagccccuccugccugguccagagcuccagccucuccaacgcccacaucgacuacaccacgaagccggccaucaucuuccgcaucgccgcccggaacgagaagggcuacgggcccgcgacccaggugcgcuggcugcaggagaccagcaaggacuccagcggcaccaagcccgccaacaagcggcccauguccagcccggagaugaaguccgcccccaagaaguccaaggccgacgggcaguga

SEQ ID NO: 31005 - RNA, 2379 nt, Artificial Sequence
  derived and/or modified sequence opt1 from HCFC2__Homo_sapiens__NP_037452
auggccgcccccagccugcucaacuggcgccggguguccagcuucaccggcccggucccccgcgcccggcacgggcaccgcgccguggccauccgggagcugaugaucaucuucggcgggggcaacgaggggaucgccgacgagcugcacguguacaacaccgccacgaaccagugguuccuccccgcgguccgcggcgacaucccgcccggcugcgccgcccacggguucgugugcgacggcacccggauccugguguucgggggcauggucgaguacgggcgcuacuccaacgagcuguacgagcuccaggccagccgguggcuguggaagaaggugaagccccacccgccgcccuccggccugccgcccugcccccgccucggccacagcuucucccuguacgggaacaagugcuaccuguucggcgggcucgcgaacgagagcgaggacuccaacaacaacgugccccgguaccugaacgacuucuacgagcuggagcuccagcacggcagcggcgucguggggugguccauccccgugaccaagggcgucgugcccagcccccgcgagucccacaccgccgugaucuacugcaagaaggacagcgggucccccaagauguacgucuucggcgggaugugcggcgcccggcuggacgaccuguggcagcucgaccuggagacgaugagcugguccaagcccgagaccaagggcaccgugccccugccccgcagccuccacaccgccuccgugaucgggaacaagauguacaucuucggcgggugggucccgcacaagggcgagaacacggagaccagcccccacgacugcgaguggcggugcaccagcuccuucagcuaccugaaccuggacaccacggaguggaccacccucguguccgacagccaggaggacaagaagaacucccgcccccggccccgcgccgggcacugcgcgguggccaucggcacccggcuguacuucuggagcggccgcgacggguacaagaaggcccugaacucccaggucugcugcaaggaccucugguaccuggacacggagaagccgcccgcccccagccaggugcagcugaucaaggccaccaccaacuccuuccacgugaagugggacgaggucagcaccguggagggcuaccuccugcagcuguccacggaccuccccuaccaggcggccagcuccgacagcuccgccgccccgaacaugcaggggguccggauggacccccaccgccagggcagcaacaacaucgugcccaacuccaucaacgacaccaucaacagcaccaagaccgagcagccggccacgaaggagaccuccaugaagaacaagcccgacuucaaggcgcugaccgacagcaacgccauccuguaccccagccucgccuccaacgccagcaaccacaacucccacguggucgacaugcugcgcaagaacgaggggccccacaccagcgccaacgugggcgugcuguccagcugccucgacguccggacggugaucccggagaccuccgugagcuccaccgucagcuccacccagacgauggugacccagcagaccaucaagaccgagagcuccagcacgaacggcgcgguggucaaggacgagaccucccugaccaccuucagcaccaaguccgagguggacgagacguacgcccugcccgccaccaagaucagccgcguggagacccacgccaccgcgacgcccuucagcaaggagacccccuccaacccggucgccaccgugaaggccggggagcggcaguggugcgacgugggcaucuucaagaacaacaccgcccucgucagccaguucuaccugcugcccaaggggaagcaguccaucagcaaggugggcaacgccgacgugcccgacuacucccuccugaagaagcaggaccugguccccggcacgggguaccgcuuccggguggcggccaucaacggcugcgggaucggcccguucagcaagaucuccgaguucaagaccugcauccccggguuccccggcgcccccagcgccgugcgcaucuccaagaacgucgagggcauccaccucagcugggagccgcccaccucccccagcgggaacauccuggaguacuccgccuaccuggcgauccggaccgcccagauccaggacaaccccagccagcugguguucaugcgcaucuacugcggccucaagacguccugcaucgugaccgccgggcagcuggccaacgcccacaucgacuacaccagccggccggcgaucgucuuccgcaucuccgccaagaacgagaagggcuacgggcccgccacccaggugcgguggcugcagggcaacaacaagaaggcgccccucaacuga

SEQ ID NO: 31006 - RNA, 1578 nt, Artificial Sequence
  derived and/or modified sequence opt1 from HCK__Homo_sapiens__NP_001165601
augggcgggcgcagcuccugcgaggaccccggcugcccgcgggacgaggagcgcgcgccccggauggggugcaugaaguccaaguuccuccaggugggcgggaacaccuucuccaagaccgagacgagcgccagcccccacugccccgucuacgugccggaccccaccagcaccaucaagcccggccccaacucccacaacagcaacaccccgggcauccgcgagggguccgaggacaucaucguggucgcccuguacgacuacgaggccauccaccacgaggaccugagcuuccagaagggcgaccagaugguggugcuggaggaguccggggagugguggaaggcccggagccucgccacgcgcaaggagggcuacauccccuccaacuacgucgcccggguggacagccuggagaccgaggagugguucuucaaggggaucucccgcaaggacgcggagcggcagcugcucgcccccggcaacaugcugggcagcuucaugauccgcgacuccgagaccaccaaggggagcuacucccugagcgugcgggacuacgacccccgccagggcgacacggucaagcacuacaagauccggacccucgacaacgggggcuucuacaucagcccgcgcuccaccuucagcacccugcaggagcugguggaccacuacaagaagggcaacgacgggcucugccagaagcuguccgugcccugcaugagcuccaagccccagaagcccugggagaaggacgccugggagaucccgcgggagagccugaagcucgagaagaagcugggcgccgggcaguucggcgaggucuggauggcgacguacaacaagcacaccaagguggccgugaagaccaugaagcccggguccaugagcgucgaggccuuccuggccgaggccaacgugaugaagacccuccagcacgacaagcuggugaagcugcacgcggucgugacgaaggagcccaucuacaucaucaccgaguucauggccaagggcucccuccuggacuuccucaagagcgacgagggcuccaagcagccccugccgaagcugaucgacuucagcgcccagaucgccgaggggauggccuucaucgagcagcgcaacuacauccaccgggaccugcgcgcggccaacauccucguguccgccagccuggucugcaagaucgccgacuucggccuggcccgggugaucgaggacaacgaguacaccgcgcgcgagggggccaaguuccccaucaaguggaccgcccccgaggccaucaacuucggcuccuucacgaucaagagcgacgugugguccuucgggauccuccugauggagaucgucaccuacggccggauccccuacccgggcaugagcaaccccgaggugauccgcgcccuggagcgcggguaccggaugccccgccccgagaacugcccggaggagcucuacaacaucaugaugcggugcuggaagaaccgccccgaggagcggcccaccuucgaguacauccaguccguccuggacgacuucuacaccgcgacggagagccaguaccagcagcagccguga

SEQ ID NO: 31007 - RNA, 1461 nt, Artificial Sequence
  derived and/or modified sequence opt1 from HCLS1__Homo_sapiens__NP_005326
auguggaaguccguggucggccacgacgugagcgugagcgucgagacccagggggacgacugggacaccgaccccgacuucgugaacgacaucuccgagaaggagcagcgcuggggcgccaagacgaucgaggggagcggccggaccgagcacaucaacauccaccagcugcgcaacaagguguccgaggagcacgacguccuccggaagaaggagauggagagcgggccgaaggccucccacggcuacggcgggcgcuucggcguggagcgggaccgcauggacaagagcgcgguggggcacgaguacgucgccgagguggagaagcacuccagccagaccgacgccgccaagggcuucgggggcaaguacggcguggagcgggaccgcgccgacaaguccgcggucggguucgacuacaagggcgagguggagaagcacaccagccagaaggacuacucccggggguucggcggccgcuacgggguggagaaggacaagugggacaaggccgcccugggcuacgacuacaagggggagacggagaagcacgagagccagcgggacuacgccaagggcuucgggggccaguacggcauccagaaggaccgcgucgacaaguccgcggugggguucaacgagauggaggcccccaccaccgccuacaagaagaccacgcccaucgaggccgccagcuccggcacccgggggcugaaggcgaaguucgagagcauggccgaggagaagcgcaagcgggaggaggaggagaaggcccagcaggucgcccgccggcagcaggagcgcaaggccgugaccaagcggucccccgaggcgccgcagcccgugaucgccauggaggagcccgccgugcccgccccgcuccccaagaagaucagcagcgaggccuggccgcccgucggcaccccgcccuccagcgaguccgagcccgugcgcacgagccgggagcaccccgugccccugcugcccauccgccagacccuccccgaggacaacgaggagcccccggcgcugccgccccgcacccuggaggggcuccaggucgaggaggagcccguguacgaggccgagcccgagcccgagcccgagcccgagccggagcccgagaacgacuacgaggacgucgaggagauggaccggcacgagcaggaggacgagcccgagggcgacuacgaggaggugcuggagccggaggacuccagcuucuccagcgcccuggccggcuccagcgggugccccgccggcgcgggggccggcgccguggcccucgggaucuccgcggucgcccuguacgacuaccagggcgagggcagcgacgagcuguccuucgaccccgacgacgugaucaccgacaucgagaugguggacgaggggugguggcgcggccggugccacgggcacuucggccucuuccccgccaacuacgucaagcugcuggaguga

SEQ ID NO: 31008 - RNA, 2673 nt, Artificial Sequence
  derived and/or modified sequence opt1 from HCN1__Homo_sapiens__NP_066550
auggagggcgggggcaagcccaacagcuccagcaacucccgcgacgacgggaacagcguguuccccgccaaggccuccgcgaccggcgccgggcccgccgccgccgagaagcggcugggcaccccgcccggcgggggcggggcgggcgccaaggagcacgggaacagcgucugcuucaagguggacggcggcgggggcgggggcggcgggggcgggggcggggaggagcccgccggcggcuucgaggacgccgaggggccccgccggcaguacggcuucaugcagcgccaguucacguccaugcuccagcccggggugaacaaguucagccugcggauguucggcucccagaaggcggucgagaaggagcaggagcgcgugaagaccgccggguucuggaucauccaccccuacagcgacuuccgguucuacugggaccugaucaugcucaucaugauggugggcaaccuggucaucaucccggugggcaucaccuucuucaccgagcagacgaccacccccuggaucaucuucaacguggccuccgacaccgucuuccugcucgaccugaucaugaacuuccgcacggggaccgugaacgaggacagcuccgagaucauccuggaccccaaggugaucaagaugaacuaccucaagagcugguucgucguggacuucaucuccagcauccccguggacuacaucuuccugaucgucgagaagggcauggacuccgagguguacaagaccgcccgggcccugcgcaucgugcgguucaccaagauccucagccugcugcgccuccugcggcugucccgccucauccgguacauccaccagugggaggagaucuuccacaugacguacgaccuggcgagcgccgucgugcgcaucuucaaccugaucgggaugaugcuccugcugugccacugggacggcugccuccaguuccuggugccgcugcuccaggacuucccgcccgacugcugggucagccugaacgagauggugaacgacuccugggggaagcaguacagcuacgcccuguucaaggccaugucccacaugcucugcaucggcuacggcgcccaggcgcccgugagcauguccgaccuguggaucaccaugcugagcaugaucgucggggcgaccugcuacgccauguucgugggccacgccaccgcccucauccagucccuggacagcucccggcgccaguaccaggagaaguacaagcaggucgagcaguacaugagcuuccacaagcugcccgccgacaugcggcagaagauccacgacuacuacgagcaccgcuaccaggggaagaucuucgacgaggagaacauccucaacgagcugaacgacccccugcgggaggagaucgugaacuucaacugccgcaagcucguggccacgaugccccuguucgccaacgccgaccccaacuucgucaccgccaugcuguccaagcuccgcuucgagguguuccagccgggcgacuacaucauccgggagggcgcgguggggaagaagauguacuucauccagcacggcgucgccggggugaucaccaagagcuccaaggagaugaagcugaccgacggcagcuacuucggggagaucugccugcucacgaagggccgccggaccgccuccgugcgcgccgacaccuacugccggcuguacagccuguccgucgacaacuucaacgaggugcucgaggaguaccccaugaugcgccgggcguucgagaccguggccaucgaccgccuggaccggaucggcaagaagaacagcauccugcugcagaaguuccagaaggaccucaacacgggggucuucaacaaccaggagaacgagauccugaagcagaucgugaagcacgaccgcgagauggugcaggccaucgcccccaucaacuacccccagaugaccacccugaacuccaccagcagcacgaccaccccgaccucccggaugcgcacgcagagcccgcccgucuacaccgccaccucccucagccacuccaaccugcacagccccucccccagcacccagacgccccagcccuccgcgauccugagcccgugcuccuacaccaccgccgugugcagcccgcccgugcagagcccccucgccgcccggaccuuccacuacgccucccccaccgcgucccagcugagccugaugcagcagcagccccagcagcagguccagcagucccagccgccccagacgcagccccagcagcccagcccccagccccagaccccgggcagcuccacccccaagaacgaggugcacaagagcacccaggcccuccacaacacgaaccugacccgcgaggugcggccccuguccgccagccagcccucccucccgcacgaggucagcacccugaucucccgcccccaccccaccgugggggagagccuggccuccaucccccagccggugacggccguccccggcaccgggcuccaggcgggcggccggagcaccgugccccagcgcgugacccuguuccggcagauguccagcggggccaucccgcccaaccgcggcgucccgcccgcgcccccgccgcccgccgccgcccugccccgcgaguccagcuccgugcucaacacggaccccgacgccgagaagccccgguucgccagcaaccuguga

SEQ ID NO: 31009 - RNA, 2670 nt, Artificial Sequence
  derived and/or modified sequence opt1 from HCN2__Homo_sapiens__NP_001185
auggacgcccgcggcgggggcgggcggcccggcgagagccccggggccacccccgcccccgggcccccgcccccgcccccgcccgcgccgccccagcagcagcccccgccgccgccgccgcccgcgcccccgcccggccccgggcccgccccgccccagcacccgccccgcgccgaggcgcugccgcccgaggccgccgacgagggcgggccccggggccgccuccggucccgcgacagcuccugcgggcggcccggcacccccggcgccgcgagcacggccaaggggucccccaacggcgagugcgggcgcggcgagccccagugcagccccgccggccccgaggggcccgcccggggccccaagguguccuucagcugccgcggggccgcguccggccccgcccccgggcccggccccgccgaggaggccggcagcgaggaggccgggcccgccggcgagccccgggggucccaggccagcuucaugcagcgccaguucggcgcccugcugcagcccggggugaacaaguucucccuccggauguucggcagccagaaggccguggagcgcgagcaggagcgggugaaguccgccggcgcguggaucauccaccccuacagcgacuuccgcuucuacugggacuucaccaugcugcuguucauggucgggaaccucaucaucauccccgugggcaucaccuucuucaaggacgagaccacggcccccuggaucguguucaacgucguguccgacaccuucuuccugauggaccuggugcucaacuuccggaccgggaucgucaucgaggacaacaccgagaucauccuggaccccgagaagaucaagaagaaguaccugcgcacgugguucgugguggacuucgucagcuccauccccguggacuacaucuuccucaucguggagaagggcaucgacagcgaggucuacaagaccgcccgggcccugcgcaucgugcgguucaccaagauccugagccuccugcgccugcuccgccugucccggcugauccgcuacauccaccagugggaggagaucuuccacaugaccuacgaccucgccagcgcggugaugcggaucugcaaccugaucuccaugaugcugcuccugugccacugggacgggugccugcaguuccucguccccaugcugcaggacuucccccgcaacugcugggugagcaucaacggcauggugaaccacuccuggagcgagcuguacuccuucgcccucuucaaggccaugagccacaugcugugcaucggcuacgggcggcaggcccccgaguccaugacggacaucuggcugaccaugcucagcaugaucgucggcgcgaccugcuacgccauguucaucgggcacgccaccgcccugauccagucccuggacagcucccgccggcaguaccaggagaaguacaagcaggucgagcaguacaugagcuuccacaagcuccccgccgacuuccgccagaagauccacgacuacuacgagcaccgguaccagggcaagauguucgacgaggacuccauccugggcgagcugaacgggccccuccgcgaggagaucgugaacuucaacugccggaagcuggucgcgagcaugccccuguucgccaacgccgaccccaacuucgugacggccaugcucaccaagcugaaguucgaggucuuccagcccggcgacuacaucauccgcgaggggaccaucggcaagaagauguacuucauccagcacggggugguguccguccugaccaagggcaacaaggagaugaagcucagcgacggcuccuacuucggggagaucugccugcugacgcggggccgccggaccgccagcgugcgcgcggacaccuacugccggcucuacagccuguccguggacaacuucaacgagguccuggaggaguaccccaugaugcgccgggccuucgagaccguggccaucgaccgccuggaccgcaucgggaagaagaacagcauccuccugcacaaggugcagcacgaccugaacuccggcgucuucaacaaccaggagaacgccaucauccaggagaucgugaaguacgaccgggagauggugcagcaggccgagcucgggcagcgcgucggccuguucccgccgcccccgcccccgccccaggugacgagcgcgaucgccacccugcagcaggccgccgcgauguccuucugcccccagguggcccggccccucgucggcccccuggcccuggggagcccccgccucgugcggcggccgccgcccggcccggcccccgccgcggccucccccgggcccccgccgcccgccagcccgcccggcgcccccgccagcccccgcgcgccccgcaccucccccuacgggggccugcccgccgcgccccuggccggcccggcccuccccgcgcggcgccugucccgggccagccgcccccuguccgccagccagcccucccucccgcacggggcccccggccccgcggccagcacccggcccgccuccagcagcacgccgcgccuggggcccacccccgccgcccgggcggccgcccccuccccggaccgccgggacagcgccucccccggcgccgccggcggccuggacccccaggacagcgcccgcucccggcucagcuccaaccuguga

SEQ ID NO: 31010 - RNA, 2325 nt, Artificial Sequence
  derived and/or modified sequence opt1 from HCN3__Homo_sapiens__NP_065948
auggaggccgagcagcgccccgccgcgggcgccagcgagggggccacccccggccuggaggccgugccgcccgucgcgccgccgcccgccaccgccgccuccgggcccauccccaagagcggccccgagcccaagcggcgccaccucgggacccugcugcagcccaccgugaacaaguucucccuccggguguucggcagccacaaggccgucgagaucgagcaggagcgcgugaaguccgcgggcgccuggaucauccaccccuacagcgacuuccgguucuacugggaccugaucaugcugcuccugaugguggggaaccugaucguccuccccgugggcaucaccuucuucaaggaggagaacuccccgcccuggaucguguucaacguccugagcgacaccuucuuccugcucgaccuggugcugaacuuccgcacggggaucguggucgaggagggcgccgagauccuccuggcgccccgggccauccgcacccgguaccugcgcaccugguuccucguggaccugaucuccagcauccccguggacuacaucuuccuggucguggagcucgagccccggcuggacgccgagguguacaagaccgcccgcgcccugcggaucguccgcuucacgaagauccucucccugcugcggcuccugcgccugagccggcucauccgcuacauccaccagugggaggagaucuuccacaugaccuacgaccuggccuccgccguggugcggaucuucaaccugaucgggaugaugcuccugcugugccacugggacggcugccuccaguuccugguccccaugcugcaggacuucccgcccgacugcugggugagcaucaaccacauggugaaccacuccuggggccgccaguacagccacgcccucuucaaggccaugucccacaugcugugcaucggguacggccagcaggcccccgucgggaugcccgacguguggcugaccaugcucagcaugaucgucggcgcgaccugcuacgccauguucaucggccacgcgacggcccugauccagucccuggacagcagccggcgccaguaccaggagaaguacaagcaggucgagcaguacauguccuuccacaagcuccccgccgacacccgccagcggauccacgaguacuacgagcaccgcuaccaggggaagauguucgacgaggagagcauccugggcgagcuguccgagccgcuccgggaggagaucaucaacuucacgugccgcgggcugguggcccacaugccccuguucgcccacgcggaccccagcuucgugaccgccgugcugaccaagcuccgguucgagguguuccagcccggcgaccuggucgugcgcgagggguccgugggccggaagauguacuucauccagcacggccugcucagcguccuggcccgcggggcccgggacacccgccugaccgacggcuccuacuucggggagaucugccuccugacccggggccgccggacggcgagcgugcgcgccgacaccuacugccggcuguacucccucagcguggaccacuucaacgccguccuggaggaguucccgaugaugcgccgggccuucgagaccguggccauggaccgccugcuccggaucgggaagaagaacuccauccugcagcgcaagcgcagcgagcccucccccggcagcuccggcgggaucauggagcagcaccuggugcagcacgaccgggacauggcgcgcggcguccgggggcgcgccccgagcaccggcgcccagcucuccgggaagcccgugcugugggagccccuggugcacgcgccccuccaggccgccgccgucacgagcaacguggccaucgcccugacccaccagcggggcccgcugccccucucccccgacagccccgccacccugcuggcgcgcagcgccuggcgguccgccggcagcccggccagcccccucgugcccguccgcgcggggcccugggccuccaccucccggcugccggccccgcccgcccgcacgcugcacgccagccucucccgggcgggccgcagccaggugucccugcuggggcccccgcccggcggcgggggccggcgccucgggccccggggccgcccccugagcgccucccagcccagccugccccagcgggccaccggggacggcucccccggccgcaaggggagcggcuccgagcggcugcccccgagcgggcuccuggccaagccgccccgcaccgcccagccgccccggccgcccgugcccgagcccgcgacgccccgcggccuccagcuguccgccaacauguga

SEQ ID NO: 31011 - RNA, 3612 nt, Artificial Sequence
  derived and/or modified sequence opt1 from HCN4__Homo_sapiens__NP_005468
auggacaagcugccgcccagcaugcgcaagcggcucuacagccugccccagcaggucggcgccaaggccuggaucauggacgaggaggaggacgcggaggaggagggcgccggcgggcgccaggaccccagccggcgcuccauccggcugcgcccccuccccagccccucccccagcgccgccgccggcgggaccgagucccggagcuccgcccugggcgccgccgacagcgagggccccgcccgcggggccggcaaguccagcaccaacggggacugccggcgcuuccggggcucccuggccagccucgggucccgcggcggcgggagcggcgggaccggcuccggcagcucccacgggcaccuccacgacagcgccgaggagcggcgccugaucgccgagggcgacgccagcccgggggaggaccggacgccgcccggccucgcggccgagcccgagcgcccgggggccuccgcccagcccgccgcguccccgcccccgccccagcagccgccccagcccgccuccgccagcugcgagcagcccuccguggacaccgccaucaagguggagggcggcgccgcggccggggaccagauccugcccgaggccgaggugcggcugggccaggccggguucaugcagcgccaguucggcgccaugcuccagcccggggugaacaaguucagccugcggauguucggcucccagaaggcgguggagcgcgagcaggagcgggugaaguccgccggcuucuggaucauccacccguacuccgacuuccgcuucuacugggaccugaccaugcuccugcugauggucgggaaccucaucaucauccccgugggcaucaccuucuucaaggacgagaacaccacccccuggaucguguucaacgucgugagcgacaccuucuuccugaucgaccuggugcucaacuuccgcaccgggaucgucguggaggacaacaccgagaucauccuggacccccagcggaucaagaugaaguaccugaaguccugguucaugguggacuucaucagcuccaucccggucgacuacaucuuccucaucguggagacccgcaucgacagcgagguguacaagaccgcccgggcccugcgcaucguccgguucaccaagauccugucccuccugcgccugcuccggcugagccgccugauccgguacauccaccagugggaggagaucuuccacaugaccuacgaccucgcguccgccguggugcgcaucgucaaccugaucggcaugaugcugcuccugugccacugggacgggugccugcaguuccucgugcccaugcugcaggacuuccccgacgacugcugggugagcaucaacaacauggucaacaacuccuggggcaagcaguacagcuacgcccuguucaaggccaugagccacaugcucugcaucggcuacgggcggcaggccccggugggcauguccgacgucuggcugaccaugcugagcaugaucgugggggcgaccugcuacgccauguucaucggccacgccacggcccucauccagucccuggacagcucccgccggcaguaccaggagaaguacaagcaggucgagcaguacaugagcuuccacaagcugccgcccgacacccgccagcggauccacgacuacuacgagcaccgcuaccagggcaagauguucgacgaggaguccauccucggggagcugagcgagccccugcgggaggagaucaucaacuucaacugccgcaagcuggucgccuccaugccccucuucgcgaacgccgaccccaacuucgugaccagcaugcugaccaagcugcgguucgagguguuccagcccggcgacuacaucauccgcgaggggaccaucggcaagaagauguacuucauccagcacggggucguguccgugcucaccaagggcaacaaggagaccaagcuggccgacggcagcuacuucggggagaucugccugcucacccgcggccggcgcacggccuccguccgggccgacaccuacugccgccuguacagccuguccguggacaacuucaacgaggugcucgaggaguaccccaugaugcggcgcgcguucgagaccgucgcccuggaccggcuggaccgcaucgggaagaagaacagcauccuccugcacaaggugcagcacgaccugaacuccggcguguucaacuaccaggagaacgagaucauccagcagaucguccagcacgaccgggagauggcccacugcgcccaccgcgugcaggcggccgccagcgccaccccgacgcccacccccgugaucuggacgccccucauccaggccccgcugcaggcggccgccgccaccacgagcgucgccaucgcgcugacccaccacccccggcuccccgccgccaucuuccggcccccgcccggguccggccugggcaaccugggggccggccagacgccccggcaccucaagcgccugcagagccugauccccuccgcccucgggagcgcgucccccgccagcucccccagccagguggacacccccuccagcuccagcuuccacauccagcagcuggccggcuucuccgcccccgcggggcugagcccgcuccugcccuccagcuccagcagcccgccgcccggcgccugcggcagccccagcgcccccacgcccuccgccgggguggccgcgaccaccaucgccggcuucgggcacuuccacaaggcccugggcgggagccucuccagcuccgacagcccccugcugacgccccuccagcccggcgcccggagcccccaggccgcgcagcccucccccgcgccgcccggcgcccgcgggggccuggggcugcccgagcacuuccugcccccgccgcccuccagccggucccccagcuccagccccggccagcugggccagccgcccggggagcugucccucggccuggccaccgggccccugagcacgcccgagaccccgccccgccagcccgagccgcccucccucgucgccggcgcgagcgggggcgccucccccgugggcuucacgccccgcggcggccugagcccgcccgggcacagccccgggccgccccgcaccuuccccuccgcgccgccccgggccagcgggucccacggcagccugcuccugccgcccgccuccuccccgcccccgccccaggugccccagcgccgcggcacgccgccccugacccccgggcggcucacccaggaccugaagcugaucuccgcgagccagcccgcccucccccaggacggcgcccagacccugcgccgggccagcccccacuccuccggggagagcauggcggccuucccccuguucccccgcgccggcgggggcuccggcgggagcggcuccagcgggggccucgggccgcccgggcggcccuacggcgccauccccgggcagcacgucacgcugccccgcaagaccuccagcggcucccugcccccgccccucagccuguucggggcccgggcgaccagcuccggcggcccgccccugaccgccgggccccagcgcgagcccggcgcccggcccgagcccgugcgcagcaagcuccccuccaaccuguga

SEQ ID NO: 31012 - RNA, 396 nt, Artificial Sequence
  derived and/or modified sequence opt1 from HCRT__Homo_sapiens__NP_001515
augaaccugcccagcaccaagguguccugggccgccgucacccuccugcugcuccugcugcuccugccgcccgcgcugcucagcuccggcgccgccgcccagccccugcccgacugcugccgccagaagacgugcagcugccggcuguacgagcuccugcacggggccggcaaccacgcggccgggauccugacccucggcaagcgccgguccgggccgcccggccugcagggccgccugcagcggcuccugcaggccagcgggaaccacgccgcgggcauccugaccauggggcgccgggccggcgccgagcccgcgccccgcccgugccucgggcggcgcugcuccgcccccgccgccgccagcguggcccccggcggccaguccgggaucuga

SEQ ID NO: 31013 - RNA, 1335 nt, Artificial Sequence
  derived and/or modified sequence opt1 from HCRTR2__Homo_sapiens__NP_001517
augagcggcaccaagcuggaggacuccccgcccugccggaacuggagcuccgccagcgagcucaacgagacccaggagcccuuccugaaccccacggacuacgacgacgaggaguuccugcgguaccucuggcgcgaguaccugcaccccaaggaguacgagugggugcugaucgccggguacaucaucguguucgugguggcgcucaucggcaacguccuggugugcguggccgucuggaagaaccaccacaugcggaccgugaccaacuacuucaucgugaaccugucccucgccgacguccuggugaccaucacgugccugccggccacccucguggucgacaucaccgagaccugguucuucgggcagagccugugcaaggugauccccuaccugcagacgguguccgucagcguguccgugcucacccugagcugcaucgcccuggaccgcugguacgcgaucugccacccccucauguucaaguccaccgccaagcgggcccgcaacagcaucgucaucaucuggaucguguccugcaucaucaugaucccccaggccaucgugauggagugcagcaccgucuucccgggccuggcgaacaagacgacccuguucaccgugugcgacgagcgguggggcggggagaucuaccccaagauguaccacaucugcuucuuccucgugaccuacauggcgccccugugccugaugguccucgccuaccugcagaucuuccgcaagcuguggugccggcagauccccggcacguccagcgugguccagcgcaaguggaagccgcuccagcccgugucccagccccgggggcccggccagccgaccaagagccgcauguccgccguggccgccgagaucaagcagauccgggcccgccggaagaccgcccgcaugcugaugaucguccugcucguguucgccaucugcuaccugcccaucagcauccugaacgugcucaagcgggucuucgggauguucgcccacaccgaggaccgcgagacgguguacgcgugguucaccuucagccacuggcugguguacgccaacuccgccgccaaccccaucaucuacaacuuccugagcggcaaguuccgggaggaguucaaggccgcguucuccugcugcugccucgggguccaccaccgccaggaggaccggcugacccgcggccgcaccagcacggagucccgcaagagccugaccacccagaucuccaacuucgacaacaucagcaagcucuccgagcaggucgugcugaccagcaucuccacgcugcccgccgccaacggcgccgggccgcuccagaacugguga

SEQ ID NO: 31014 - RNA, 279 nt, Artificial Sequence
  derived and/or modified sequence opt1 from HCST__Homo_sapiens__NP_001007470
augauccaccugggccacauccucuuccugcugcuccugcccguggccgccgcgcagaccaccccgggggagcgcagcucccugcccgccuucuaccccggcacgagcggguccugcagcggcugcgggucccucagccugccccugcucgccggccuggucgccgccgacgcgguggccucccugcucaucgugggcgccgucuuccugugcgcccggccgcgccggagccccgcgcaggacgggaagguguacaucaacaugcccggccgcggguga

SEQ ID NO: 31015 - RNA, 1950 nt, Artificial Sequence
  derived and/or modified sequence opt1 from HDAC10__Homo_sapiens__NP_001152758
augggcaccgcccugguguaccacgaggacaugaccgccacgcgccuccugugggacgaccccgagugcgagaucgagcggccggagcgccugaccgcggcccucgaccggcugcgccagcgggggcuggagcagcgcugccuccggcugagcgcccgcgaggccuccgaggaggagcugggccucguccacagccccgaguacgugucccuggugcgggagacccagguccuggggaaggaggagcuccaggcccugagcggccaguucgacgcgaucuacuuccaccccuccaccuuccacugcgcccgccuggccgccggggcgggccuccagcugguggacgccgugcugacgggcgccguccagaacgggcucgcccuggugcggcccccgggccaccacgggcagcgcgccgcggccaacggcuucugcguguucaacaacgucgccaucgccgccgcgcacgccaagcagaagcacgggcugcaccggauccucgugguggacugggacguccaccacggccagggcauccaguaccuguucgaggacgaccccagcgugcuguacuucuccuggcaccgcuacgagcacgggcgguucuggcccuuccuccgcgagagcgacgccgacgccgugggccgggggcagggccugggcuucaccgucaaccugcccuggaaccagguggggaugggcaacgccgacuacguggcggccuuccuccaccuccugcugccgcuggccuucgaggggcagaugcaggccacccccgagugcuucgcccaccugacccagcuccugcagguccuggcgggcgggcgcgugugcgccgugcucgagggcggcuaccaccuggagucccuggccgagagcgucugcaugacggugcagacccuccugggggaccccgcgcccccgcuguccggccccauggcccccugccagagcgcccucgaguccauccagagcgcccgggccgcccaggcgccccacuggaagucccugcagcagcaggacgugaccgccgucccgaugagccccuccagccacucccccgaggggcggcccccgccccugcuccccggcgggcccgugugcaaggccgccgccagcgcgccgagcucccugcuggaccagcccugccucugccccgcccccagcguccgcaccgccguggcccugacgaccccggacaucacccuggugcugccgcccgacgucauccagcaggaggccuccgcgcuccgcgaggagaccgaggccugggcccgcccccacgagagccuggcccgggaggaggcgcugacggcccucggcaagcugcuguaccuccuggacggcaugcuggacggccaggugaacuccgggaucgccgccacccccgccagcgcggccgccgccacccucgacguggccguccgccgggggcugucccacggcgcgcagcgccugcucugcguggcccuggggcagcuggaccggccgcccgaccucgcccacgacggccgcagccuguggcugaacauccggggcaaggaggccgccgcgcucuccauguuccacgugagcaccccgcugcccgucaugaccgggggcuuccuguccugcauccucgggcuggugcugccccucgccuacggcuuccagcccgaccuggugcuggucgcccucggccccgggcacggccugcaggggccccacgccgcgcugcucgccgccaugcugcgcggccuggccgggggccgggugcucgcccugcuggaggagaacagcacgccccagcucgcgggcauccuggcccgcgugcugaacggggaggcgcccccgucccucggccccagcuccgucgccagccccgaggacgugcaggcccugauguaccugcgggggcagcucgagccccaguggaagaugcugcagugccacccgcaccugguggccuga

SEQ ID NO: 31016 - RNA, 891 nt, Artificial Sequence
  derived and/or modified sequence opt1 from HDAC11__Homo_sapiens__NP_001129513
augggccuggagaagcuccaccccuucgacgccgggaaguggggcaaggugaucaacuuccugaaggaggagaagcugcucagcgacuccaugcuggucgaggcccgcgaggcgagcgaggaggaccugcucguggugcacacccggcgcuaccugaacgagcugaagcggaagguccuccgcccgcugcggacccagaccgggggcacgaucauggccgggaagcuggccguggagcgcggcugggccaucaacgugggcgggggcuuccaccacugcuccagcgaccgcgggggcggguucugcgccuacgcggacaucacccucgccaucaaguuccuguucgagcgggucgagggcaucucccgggccaccaucaucgaccuggacgcccaccagggcaacgggcacgagcgcgacuucauggacgacaagcggguguacaucauggacguguacaaccgccacaucuaccccggcgaccgguucgcgaagcaggccauccgccggaaggucgagcucgagugggggacggaggacgacgaguaccuggacaagguggagcgcaacaucaagaagucccugcaggagcaccuccccgacguggucguguacaacgccggcaccgacauccuggagggcgaccggcucgggggccugagcaucagccccgccgggaucgugaagcgcgacgagcuggucuuccggauggugcgcggccggcgcgugccgauccugauggucaccuccgggggcuaccagaagcgcaccgcccggaucaucgcggacagcauccucaaccuguucggccuggggcucaucggccccgagucccccagcguguccgcccagaacagcgacacgccccugcugccgcccgccgugcccuga

SEQ ID NO: 31017 - RNA, 870 nt, Artificial Sequence
  derived and/or modified sequence opt1 from HDAC1__Homo_sapiens__XP_011539611
augaccgugagcuuccacaaguacggcgaguacuuccccgggaccggcgaccugcgcgacaucggggccggcaaggggaaguacuacgccgucaacuacccgcuccgggacggcaucgacgacgaguccuacgaggcgaucuucaagcccgugaugagcaaggugauggagauguuccagcccuccgccgucgugcugcagugcggcagcgacucccugagcggggaccgccucggcugcuucaaccugacgaucaaggggcacgccaagugcguggaguucgucaaguccuucaaccugcccaugcucaugcugggcgggggcggcuacaccauccggaacguggcccgcugcuggaccuacgagaccgccguggcgcuggacacggagaucccgaacgagcuccccuacaacgacuacuucgaguacuucgggcccgacuucaagcugcacaucagccccuccaacaugaccaaccagaacaccaacgaguaccuggagaagaucaagcagcgccucuucgagaaccugcggaugcugccgcacgcccccggcguccagaugcaggccauccccgaggacgccauccccgaggagagcggggacgaggacgaggacgacccggacaagcggaucuccaucugcagcuccgacaagcgcaucgcgugcgaggaggaguucagcgacuccgaggaggagggcgagggcgggcggaagaacagcuccaacuucaagaaggccaagcgcgugaagaccgaggacgagaaggagaaggaccccgaggagaagaaggaggugacggaggaggagaagaccaaggaggagaagcccgaggccaagggcgucaaggaggaggugaagcucgccuga

SEQ ID NO: 31018 - RNA, 1467 nt, Artificial Sequence
  derived and/or modified sequence opt1 from HDAC2__Homo_sapiens__NP_001518
auggccuacagccagggcgggggcaagaagaaggugugcuacuacuacgacggggacaucggcaacuacuacuacgggcagggccaccccaugaagccgcaccgcauccggaugacccacaaccugcuccugaacuacggccuguaccgcaagauggagaucuaccggccccacaaggccaccgcggaggagaugacgaaguaccacuccgacgaguacaucaaguuccuccgcagcauccggcccgacaacauguccgaguacagcaagcagaugcagcgcuucaacgucggggaggacugccccguguucgacggccuguucgaguucugccagcuguccaccgggggcagcguggccggggccgucaagcucaaccggcagcagaccgacauggccgugaacugggccggcggccugcaccacgcgaagaaguccgaggccagcggguucugcuacgugaacgacaucguccuggccauccucgagcugcugaaguaccaccagcgcgugcucuacaucgacaucgacauccaccacggcgacgggguggaggaggccuucuacaccacggaccgggucaugaccguguccuuccacaaguacggcgaguacuucccgggcaccggggaccugcgcgacaucggcgcggggaagggcaaguacuacgccgugaacuuccccaugcgggacgggaucgacgacgagagcuacggccagaucuucaagcccaucaucuccaaggucauggagauguaccagcccagcgccguggugcugcagugcggcgccgacucccucagcggggaccgccugggcugcuucaaccugaccgucaaggggcacgccaagugcguggagguggucaagacguucaaccucccgcugcugaugcucggcgggggcggcuacaccauccggaacguggcgcgcugcuggaccuacgagaccgccguggcccuggacugcgagauccccaacgagcugcccuacaacgacuacuucgaguacuucgggcccgacuucaagcuccacaucuccccgagcaacaugacgaaccagaacacccccgaguacauggagaagaucaagcagcggcuguucgagaaccugcgcaugcucccccacgcccccggcguccagaugcaggccaucccggaggacgcggugcacgaggacuccggggacgaggacggcgaggaccccgacaagcggaucagcauccgcgccuccgacaagcggaucgccugcgacgaggaguucagcgacagcgaggacgagggggagggcggccgccggaacguggccgaccacaagaagggggccaagaaggcgcgcaucgaggaggacaagaaggagaccgaggacaagaagaccgacgucaaggaggaggacaaguccaaggacaacagcggcgagaagacggacaccaaggggaccaaguccgagcagcugagcaaccccuga

SEQ ID NO: 31019 - RNA, 1287 nt, Artificial Sequence
  derived and/or modified sequence opt1 from HDAC3__Homo_sapiens__NP_003874
auggccaagaccguggccuacuucuacgaccccgacgucggcaacuuccacuacggggcgggccacccgaugaagccccaccgccuggcccucacccacagccuggugcugcacuacgggcucuacaagaagaugaucguguucaagcccuaccaggccucccagcacgacaugugccgguuccacagcgaggacuacaucgacuuccugcagcgcgucucccccacgaacaugcagggcuucaccaagagccugaacgccuucaacgugggggacgacugcccgguguuccccggccucuucgaguucugcucccgguacaccggcgccagccugcagggggcgacccagcugaacaacaagaucugcgacaucgccaucaacugggccggcgggcuccaccacgccaagaaguucgaggcguccggcuucugcuacgucaacgacaucgugaucgggauccuggagcugcucaaguaccacccccgcgugcuguacaucgacaucgacauccaccacggcgacggcguccaggaggccuucuaccugacggaccgggugaugaccgugagcuuccacaaguacgggaacuacuucuuccccggcaccggggacauguacgaggucggcgccgaguccggccgcuacuacugccucaacgugccgcugcgggacgggaucgacgaccagagcuacaagcaccuguuccagcccgugaucaaccaggucguggacuucuaccagccgaccugcaucgugcuccagugcggcgccgacucccuggggugcgaccgccugggcugcuucaaccucagcauccgggggcacggcgagugcgucgaguacgugaaguccuucaacaucccccugcuggugcucggcgggggcggguacacgguccgcaacguggcccggugcuggaccuacgagaccagccugcugguggaggaggcgaucuccgaggagcuccccuacagcgaguacuucgaguacuucgcccccgacuucacccugcaccccgacgucuccacgcgcaucgagaaccagaacagccggcaguaccuggaccagauccgccagaccaucuucgagaaccucaagaugcugaaccacgcccccuccgugcagauccacgacgucccggccgaccugcucaccuacgaccggaccgacgaggccgacgcggaggagcgcggccccgaggagaacuacagccggcccgaggcccccaacgaguucuacgacggggaccacgacaacgacaaggagagcgacguggagaucuga

SEQ ID NO: 31020 - RNA, 3255 nt, Artificial Sequence
  derived and/or modified sequence opt1 from HDAC4__Homo_sapiens__NP_006028
augagcucccagagccaccccgacggccuguccgggcgcgaccagcccguggagcuccugaaccccgcccgggucaaccacaugcccagcaccguggacguggccaccgcgcugccccuccaggucgccccguccgccgugcccauggaccugcgccuggaccaccaguucagccuccccguggccgagcccgcccugcgggagcagcagcugcagcaggagcuccuggcgcugaagcagaagcagcagauccagcgccagauccucaucgccgaguuccagcggcagcacgagcagcugucccgccagcacgaggcccagcugcacgagcacaucaagcagcagcaggagaugcucgccaugaagcaccagcaggagcugcuggagcaccagcggaagcucgagcgccaccggcaggagcaggagcuggagaagcagcaccgcgagcagaagcugcagcagcucaagaacaaggagaagggcaaggagagcgcggucgccuccacggaggugaagaugaagcugcaggaguucgugcugaacaagaagaaggcccucgcccaccggaaccugaaccacugcaucagcuccgacccgcgcuacugguacgggaagacccagcacagcucccuggaccagagcuccccgccccagagcggcgucuccaccagcuacaaccaccccgugcucgggauguacgacgccaaggacgacuucccccugcggaagaccgcguccgagcccaaccugaagcuccgcagccggcugaagcagaagguggccgagcgccggagcagcccccugcuccgccggaaggacggccccgucgugacggcccugaagaagcgcccgcuggacgugaccgacuccgccugcuccagcgcccccggcuccgggcccagcucccccaacaacagcuccggcagcgucuccgcggagaacgggaucgccccggccgugcccagcauccccgccgagaccucccucgcccaccggcugguggcgcgcgagggcagcgccgcgccccugccgcucuacaccucccccagccugcccaacaucacgcuggggcuccccgccaccggcccguccgccggcaccgccgggcagcaggacgccgagcgccugacccugcccgcccuccagcagcggcugagccuguuccccggcacgcaccucaccccguaccuguccaccagcccccuggagcgcgacgggggcgccgcgcacagcccccugcuccagcacaugguccugcuggagcagcccccggcccaggcgccccucgugaccggccugggggcccugccccuccacgcccagucccuggugggcgccgaccgggucagccccuccauccacaagcugcgccagcaccggccgcucgggcgcacgcagagcgcgccccugccccagaacgcccaggcccugcagcaccucgugauccagcagcagcaccagcaguuccuggagaagcacaagcagcaguuccagcagcagcagcugcagaugaacaagaucauccccaagccguccgagcccgcccggcagcccgagagccaccccgaggagaccgaggaggagcuccgcgagcaccaggcccugcuggacgagccguaccucgaccggcugcccggccagaaggaggcccacgcccaggccggggugcaggucaagcaggagcccaucgaguccgacgaggaggaggccgagcccccgcgcgagguggagcccggccagcggcagcccagcgagcaggagcuccuguuccgccagcaggcgcugcugcucgagcagcagcggauccaccagcugcgcaacuaccaggccuccauggaggccgccggcauccccgucagcuucgggggccaccggccgcugucccgcgcgcagagcucccccgccagcgccaccuuccccguguccgugcaggagccgcccaccaagccccgguucacgaccgggcucgucuacgacacccugaugcugaagcaccagugcacgugcggcagcuccagcagccaccccgagcacgccgggcgcauccaguccaucuggagccggcuccaggagaccggccugcgcggcaagugcgagugcauccgcgggcggaaggccacccuggaggagcuccagaccgugcacuccgaggcgcacacccugcuguacggcacgaacccgcucaaccgccagaagcuggacagcaagaagcugcucgggucccuggccagcguguucguccggcugcccugcggcggggugggcguggacuccgacaccaucuggaacgagguccacagcgccggcgccgcccgccucgcgguggggugcguggucgagcugguguucaagguggccaccggcgagcugaagaacggguucgccgucgugcggccgcccggccaccacgccgaggaguccacccccaugggcuucugcuacuucaacagcguggccgucgcggccaagcuccugcagcagcgccuguccgugagcaagauccucaucguggacugggacguccaccacgggaacggcacgcagcaggccuucuacuccgaccccagcgugcuguacaugucccugcaccgguacgacgacgggaacuucuuccccggcagcggggcccccgacgaggugggcaccggcccgggggucggcuucaacgugaacauggcguucaccgggggccucgacccgcccaugggggacgccgaguaccuggccgccuuccgcaccguggucaugcccaucgccuccgaguucgcgcccgacguggugcuggucagcuccggcuucgacgccguggagggccaccccacgccccucgggggcuacaaccugagcgcccggugcuucggguaccugaccaagcagcucaugggccuggccgggggccgcaucgugcuggcccucgagggcgggcacgaccugaccgcgaucugcgacgccagcgaggccugcgucuccgcccugcucggcaacgagcuggacccccugccggagaaggugcuccagcagcggcccaacgccaacgcggugcgcagcauggagaaggucauggagauccacuccaaguacuggcggugccugcagcgcaccaccagcacggccgggcggucccugaucgaggcccagaccugcgagaacgaggaggccgagaccgugaccgccauggcgagccucuccgugggcgucaagcccgccgagaagcgccccgacgaggagccgauggaggaggagccgccccuguga

SEQ ID NO: 31021 - RNA, 3372 nt, Artificial Sequence
  derived and/or modified sequence opt1 from HDAC5__Homo_sapiens__XP_005256961
augaacagccccaacgaguccgccgacggcaugagcgggcgcgagccgucccuggagauccucccccggaccagccugcacuccauccccgugaccgucgaggugaagcccgugcugccgcgcgccaugcccagcuccaugggcgggggcgggggcggcagccccucccccgucgagcuccggggggcgcuggugggcagcguggacccgacgcugcgcgagcagcagcuccagcaggagcugcuggcccucaagcagcagcagcagcugcagaagcagcugcucuucgccgaguuccagaagcagcacgaccaccugacccggcagcacgagguccagcugcagaagcaccucaagcagcagcaggagaugcuggccgccaagcagcagcaggagaugcuggcggccaagcgccagcaggagcucgagcagcagcggcagcgcgagcagcagcggcaggaggagcuggagaagcagcgccuggagcagcagcuccugauccugcggaacaaggagaaguccaaggagagcgccaucgccuccaccgaggugaagcuccgccugcaggaguuccugcucagcaaguccaaggagcccacccccgggggccugaaccacagccugccccagcacccgaagugcuggggggcgcaccacgccucccucgaccagagcucccccccccagagcggccccccgggcacgccccccagcuacaagcugccccugccggggcccuacgacucccgggacgacuucccccuccgcaagaccgccagcgagcccaaccugaaggugcggucccgccugaagcagaaggucgccgagcggcgcagcuccccgcuccugcggcgcaaggacggcaccgugaucagcaccuucaagaagcgggccguggagaucacgggggcgggccccggcgccuccagcgucugcaacuccgcccccgggagcggccccuccagcccgaacuccagccacuccaccaucgccgagaacggguucaccggcagcgugcccaacauccccaccgagaugcugccgcagcaccgcgcccucccccuggacuccagccccaaccaguucucccuguacacgagccccagccucccgaacaucucccuggggcugcaggcgaccgugaccgucaccaacagccaccucacggccucccccaagcugagcacccagcaggaggccgagcgccaggcccugcagucccuccggcagggcggcacccugaccgggaaguucaugagcacguccagcauccccggcugccugcuggggguggcccucgagggcgacggguccccccacggccacgcgagccugcugcagcacgugcuccugcuggagcaggcccgccagcaguccacccucaucgccgucccgcugcacggccagagcccccuggugaccggggagcggguggccaccuccaugcgcacggucggcaagcucccccggcaccgcccccugagccggacccaguccagcccgcugccccaguccccccaggcccuccagcagcuggugaugcagcagcagcaccagcaguuccuggagaagcagaagcagcagcagcuccagcuggggaagauccugaccaagaccggcgagcucccccgccagccgacgacccaccccgaggagaccgaggaggagcugaccgagcagcaggaggugcugcucggggagggcgcgcugacgaugccccgggagggcagcaccgagagcgaguccacccaggaggaccuggaggaggaggacgaggaggacgacggggaggaggaggaggacugcauccaggucaaggacgaggagggcgagagcggggccgaggagggccccgaccucgaggagccgggcgccggguacaagaagcuguucuccgacgcccagccccugcagccccuccagguguaccaggcgccccugagccuggccaccgucccgcaccaggcccucggccgcacgcaguccagccccgccgcccccgggggcaugaaguccccgcccgaccagcccgugaagcaccuguucaccaccgggguggucuacgacaccuucaugcugaagcaccagugcaugugcggcaacacccacgugcaccccgagcacgcgggccggauccagagcaucuggucccgccuccaggagacggggcugcugagcaagugcgagcggauccgcggccggaaggccacccucgacgagauccagaccgugcacuccgaguaccacacccugcuguacgggacgagcccgcucaaccgccagaagcuggacuccaagaagcugcucggccccaucagccagaagauguacgccguccugcccugcgggggcaucggcguggacuccgacaccguguggaacgagaugcacagcuccagcgccguccggauggccguggggugccugcucgagcuggcguucaagguggccgccggcgagcugaagaacggguucgccaucauccgccccccgggccaccacgccgaggaguccaccgcgaugggguucugcuucuucaacagcgucgccaucaccgccaagcuccugcagcagaagcugaacgugggcaaggugcucaucgucgacugggacauccaccacggcaacgggacgcagcaggccuucuacaacgaccccagcgugcuguacaucucccugcaccgguacgacaacggcaacuucuuccccgggagcggcgcgcccgaggagguggggggcggcccgggggucggcuacaacgugaacguggccuggaccgggggcgucgacccccccaucggcgacguggaguaccucaccgccuuccgcaccguggucaugcccaucgcccacgaguucuccccggacguggugcuggucagcgccggguucgacgcgguggagggccaccuguccccccucgggggcuacagcgugacggcccgcugcuucgggcaccugacccggcagcugaugacccucgccggcggccgcgucgugcuggcccuggaggggggccacgaccucaccgccaucugcgacgcguccgaggccugcgugagcgcccugcuguccgucgagcuccagccccuggacgaggccgugcugcagcagaagcccaacaucaacgccguggcgacgcucgagaaggucaucgagauccagagcaagcacugguccugcgugcagaaguucgccgccgggcugggccggagccugcgcgaggcccaggcgggggagaccgaggaggccgagaccguguccgccauggcccuccugagcgucggcgccgagcaggcgcaggccgccgccgcccgggagcacuccccgcgccccgcggaggagcccauggagcaggagcccgcccuguga

SEQ ID NO: 31022 - RNA, 3648 nt, Artificial Sequence
  derived and/or modified sequence opt1 from HDAC6__Homo_sapiens__NP_006035
augaccagcaccggccaggacuccacgaccacccgccagcggcgcagccggcagaacccccaguccccgccccaggacagcuccgugaccagcaagcgcaacaucaagaagggggccgucccccgguccauccccaaccuggccgaggugaagaagaagggcaagaugaagaagcucgggcaggcgauggaggaggaccugaucgugggccugcaggggauggaccucaaccuggaggccgaggcccuggccggcacgggccucguccuggacgagcagcugaacgaguuccacugccucugggacgacagcuucccggaggggcccgagcgccugcacgccaucaaggagcagcugauccaggagggccuccuggaccggugcguguccuuccaggcgcgcuucgccgagaaggaggagcugaugcucgugcacagccuggaguacaucgaccugauggagaccacccaguacaugaacgagggggagcuccggguccuggccgacaccuacgacuccguguaccugcaccccaacagcuacuccugcgccugccucgcgagcggcuccgugcugcgccuggucgacgccgugcucggggccgagauccggaacggcauggccaucauccggcccccgggccaccacgcccagcacagccugauggacggguacugcauguucaaccacguggcggucgccgcccgcuacgcccagcagaagcaccgcauccggcgcgugcugaucguggacugggacguccaccacggccaggggacgcaguucaccuucgaccaggaccccuccgugcucuacuucagcauccaccgguacgagcagggccgcuucuggccccaccugaaggccuccaacuggagcaccaccggcuucgggcagggccagggguacacgaucaacgugcccuggaaccaggucggcaugcgggacgcggacuacaucgccgccuuccugcacgugcuccugccgguggcccuggaguuccagccccagcucguccugguggccgcgggguucgacgcccugcagggcgaccccaagggcgagauggccgccacccccgccggguucgcgcagcucacccaccuccugaugggccucgccgggggcaagcugauccugagccucgagggcggguacaaccugcgcgcccuggccgagggcguguccgcgagccuccacacccugcugggggacccgugccccaugcuggagucccccggcgcccccugccggagcgcccaggccuccgucagcugcgcccuggaggcgcuggagccguucugggaggugcugguccgcuccacggagaccguggagcgcgacaacauggaggaggacaacguggaggagagcgaggaggaggggcccugggagccgcccguccuccccauccugaccuggcccgugcugcagucccggaccggccucguguacgaccagaacaugaugaaccacugcaaccugugggacagccaccaccccgaggucccccagcgcauccugcggaucaugugccgccucgaggagcuggggcuggccggccggugccucacgcugaccccgcgccccgccaccgaggccgagcugcucacgugccacuccgccgaguacgugggccaccuccgggcgaccgagaagaugaagacccgcgagcugcaccgggagagcuccaacuucgacagcaucuacaucugccccuccaccuucgccugcgcccagcuggccaccggggccgcgugccgccugguggaggccguccugagcggcgaggugcucaacggggccgccgugguccggccgcccggccaccacgcggagcaggacgccgccugcggcuucugcuucuucaacuccguggccguggccgcgcgccacgcccagacgaucagcgggcacgcccugcggauccugaucgucgacugggacgugcaccacggcaacgggacccagcacauguucgaggacgaccccuccgugcucuacgucagccugcaccgcuacgaccacggcaccuucuuccccaugggggacgagggcgccagcucccagaucggccgggccgcggggaccggcuucacggugaacguggccuggaacgggccgcgcaugggcgacgccgacuaccuggccgccuggcaccggcucguccugcccaucgcguacgaguucaaccccgagcuggugcucgugagcgccggguucgacgccgcccgcggcgacccccugggcgggugccaggucuccccggagggcuacgcgcaccugacccaccuccugauggggcuggccagcggccggaucauccucauccuggagggcggguacaaccugaccuccaucagcgaguccauggccgccugcacccgcagccuccugggcgacccgccgccccugcucacgcugccccgcccgccccuguccggggcccucgcgagcaucaccgagaccauccaggugcaccggcgcuacuggcggucccugcgcgugaugaaggucgaggaccgggagggccccagcuccagcaagcuggugaccaagaaggcgccccagcccgccaagccccgccucgccgagcggaugaccacgcgcgagaagaaggugcuggaggccgggaugggcaaggucaccuccgccagcuucggggaggaguccacccccggccagaccaacagcgagacggccgugguggcccugacccaggaccagcccagcgaggccgccaccggcggggcgacccucgcccagacgaucuccgaggccgccaucggcggggccaugcugggccagaccaccagcgaggaggcggucggcggggccacccccgaccagacgaccuccgaggagaccgugggcggggccauccuggaccagaccacgagcgaggacgccgugggcggggcgacccucggccagaccaccuccgaggaggccgucggcggggccacgcuggcccagaccaccagcgaggccgcgauggagggcgccacccuggaccagacgaccuccgaggaggcccccgggggcaccgagcucauccagacgccccuggccagcuccaccgaccaccagaccccgcccaccagccccgugcaggggaccacgccgcagaucucccccagcacccugaucggcucccuccggacccuggagcugggcagcgagucccagggggccagcgagucccaggcgcccggcgaggagaaccuccugggggaggccgccggcgggcaggacauggccgacagcaugcugaugcagggcucccgcggccucaccgaccaggccaucuucuacgcggugacgccccugccguggugcccccaccuggucgccgugugccccauccccgccgccgggcucgacgugacccagccgugcggcgacugcgggaccauccaggagaacugggucugccugagcugcuaccagguguacugcggccgguacaucaacggccacaugcugcagcaccacgggaacagcggccacccccucgugcuguccuacaucgaccugagcgcguggugcuacuacugccaggccuacguccaccaccaggcccuccuggacgugaagaacaucgcccaccagaacaaguucggggaggacaugccccacccccacuga

SEQ ID NO: 31023 - RNA, 2865 nt, Artificial Sequence
  derived and/or modified sequence opt1 from HDAC7__Homo_sapiens__NP_001091886
augcacagccccggcgccgacgggacccagguguccccgggcgcccacuacugcagccccaccggggcgggcugcccccgccccugcgccgacacgccggggccccagccccagcccauggaccugcgggucggccagcgcccgcccguggagccccccccggagcccacccuccuggcccugcagcggccccagcgccuccaccaccaccuguuccuggccggccuccagcagcagcgguccguggagcccaugcgccugagcauggacaccccgaugcccgagcugcaggucgggccccaggagcaggagcuccggcagcugcugcacaaggacaaguccaagcgcagcgccguggcguccagcguggucaagcagaagcucgccgaggugauccugaagaagcagcaggccgcccuggagcggaccgugcaccccaacuccccgggcauccccuaccgcacgcucgagccccuggagaccgagggggcgacccggagcaugcuguccagcuuccuccccccgguccccucccugcccagcgaccccccggagcacuucccccugcgcaagaccguguccgagcccaaccucaagcugcgguacaagccgaagaagagccuggagcgccggaagaacccccuccugcgcaaggaguccgccccccccagccugcggcgccggccggccgagacgcucggcgacuccagccccagcuccagcuccacccccgccagcgggugcuccagccccaacgacuccgagcacggcccgaaccccauccugggcagcgaggccgacuccgaccgccggacccaccccacccuggggccccgcggcccgauccucgggagcccccacacgccccuguuccugccccacggccucgagccggaggcgggcgggacccugcccucccgccugcagcccauccuccugcuggaccccagcggcucccacgccccgcuccugaccgugcccgggcugggcccccuccccuuccacuucgcccagagccugaugaccacggagcggcuguccgggagcggccuccacuggccgcugucccgcacccggagcgagccccugcccccguccgccaccgcccccccccccccgggccccaugcagccccgccucgagcagcugaagacccacguccaggugaucaagcggagcgcgaagcccagcgagaagccgcgccugcggcagauccccuccgccgaggaccuggagacggacgggggcgggcccggccagguggucgacgacgggcucgagcaccgcgagcugggccacggccagcccgaggcccgggggccggccccccugcagcagcacccccaggugcuccugugggagcagcagcgccuggccggccggcucccccgcgggagcaccggcgacaccgugcugcugccgcucgcgcaggggggccaccggccccugucccgcgcccagagcucccccgccgcccccgccagccuguccgcgccggagcccgccagccaggcccggguccucuccagcuccgagacccccgcccgcacgcugcccuucaccaccggccugaucuacgacagcgugaugcucaagcaccagugcuccugcggggacaacagccggcacccggagcacgcgggccgcauccaguccaucuggagccggcugcaggagcgcgggcugcgcucccagugcgagugccuccggggccgcaaggccagccuggaggagcugcagagcgugcacuccgagcggcacguccuccuguacggcaccaacccccugagccgccucaagcuggacaacgggaagcuggccggccuccuggcccagcggauguucgugaugcugcccugcgggggcgugggggucgacacggacaccaucuggaacgagcuccacuccagcaacgccgcgcgcugggccgccggcuccgugaccgaccuggccuucaaggucgccagccgggagcugaagaacggcuucgcgguggugcgccccccggggcaccacgccgaccacuccaccgccaugggcuucugcuucuucaacagcgucgccaucgccugccggcagcuccagcagcaguccaaggcgagcaagauccugaucguggacugggacgugcaccacgggaacggcacgcagcagaccuucuaccaggaccccuccguccuguacaucagccuccaccgccacgacgacgggaacuucuuccccggcuccggcgccguggacgaggugggggccggcagcggggagggcuucaacgucaacguggccugggcggggggccuggacccgcccaugggcgaccccgaguaccuggccgccuuccggaucguggucaugcccaucgcccgcgaguucuccccggaccucgugcuggugagcgccggguucgacgcggccgagggccaccccgccccccuggggggcuaccacgucuccgccaagugcuucggguacaugacccagcagcucaugaaccuggccggcggcgcgguggugcuggcccucgaggggggccacgaccugaccgccaucugcgacgccagcgaggccugcgucgcggcccugcucgggaaccggguggacccccuguccgaggagggcuggaagcagaagccgaaccugaacgccauccgcagccucgaggccgugauccggguccacagcaaguacuggggcugcaugcagcgccuggcguccugccccgacagcugggugccccgggugcccggggccgacaaggaggaggucgaggccgugacggcccuggccucccucagcgugggcauccuggcggaggaccgcccguccgagcagcuggucgaggaggaggagcccaugaaccucuga

SEQ ID NO: 31024 - RNA, 861 nt, Artificial Sequence
  derived and/or modified sequence opt1 from HDAC8__Homo_sapiens__NP_001159890
auggaggagcccgaggagccggccgacagcggccagucccuggugcccgucuacaucuacagccccgaguacguguccaugugcgacagccucgccaagauccccaagcgcgcguccauggugcacagccugaucgaggccuacgcccugcacaagcagaugcgggacgaggccuccggguucugcuaccucaacgacgccguccugggcauccugcgccuccggcgcaaguucgagcggauccuguacguggaccuggaccuccaccacggggacggcguggaggacgcguucagcuucaccuccaaggucaugaccgugagccugcacaaguucuccccgggguucuuccccggcacgggcgacgugagcgacgucgggcugggcaaggggcgcuacuacuccgugaacgugcccauccaggacggcauccaggacgagaaguacuaccagaucugcgagagcguccucaaggagguguaccaggccuucaaccccaaggccgugguccugcagcugggggccgacaccaucgcgggcgacccgaugugcuccuucaacaugacccccgugggcaucgggaagugccucaaguacauccugcaguggcagcuggccacccucauccugggcgggggcggcuacaaccuggccaacacggcccggugcuggaccuaccucaccggggugauccugggcaagacccugagcuccgagauccccgaccacgaguucuucacggccuacgggcccgacuacguccucgagaucaccccgagcugccgccccgaccggaacgagccccaccgcauccagcagauccugaacuacaucaagggcaaccugaagcacgugguguga

SEQ ID NO: 31025 - RNA, 1767 nt, Artificial Sequence
  derived and/or modified sequence opt1 from HDAC9__Homo_sapiens__NP_001191073
augaugagcucccccgcccagccggaccugauguggaaccucgugcccuggguccuguucugcggcugcugccgcaucuuccccgacgggguggccggccgggagcagcugcucgcgcagcagcgcaugcacagcaugaucuccagcguggacgucaaguccgaggugcccguggggcuggagccgaucagcccccuggaccuccggaccgaccugcgcaugaugaugcccgucguggaccccgugguccgggagaagcagcugcagcaggagcuccugcugauccagcagcagcagcagauccagaagcagcuccugaucgccgaguuccagaagcagcacgagaaccugacccgccagcaccaggcccagcuccaggagcacaucaaggagcugcuggccaucaagcagcagcaggagcuccuggagaaggagcagaagcuggagcagcagcggcaggagcaggagguggagcgccaccggcgcgagcagcagcucccgccccugcggggcaaggaccgcgggcgggagcgcgccguggcguccacggaggucaagcagaagcugcaggaguuccuccugagcaaguccgccaccaaggacacccccaccaacggcaagaaccacagcgugucccggcaccccaagcugugguacacggccgcccaccacaccagccucgaccaguccagcccgccccuguccggcaccagccccuccuacaaguacacccugcccggggcgcaggacgccaaggacgacuucccgcuccgcaagacggagagcuccgugagcagcuccagccccggcuccgggcccagcucccccaacaacggcccgaccgggagcgucaccgagaacgagaccuccgugcugccgcccacgccccacgccgagcagauggugagccagcagcggauccugauccacgaggacuccaugaaccuccugagccuguacaccucccccagccuccccaacaucacccugggccugcccgccguccccucccagcucaacgccagcaacucccugaaggagaagcagaagugcgagacccagacgcugcgccagggcgugccgcuccccgggcaguacggcgggagcauccccgcguccagcucccacccgcacgugacccuggagggcaagccgcccaacagcagccaccaggcccugcuccagcaccuccugcugaaggagcagaugcggcagcagaagcugcuggucgccggcggggugccccugcacccccagagcccccucgccaccaaggagcgcaucucccccggcauccgggggacccacaagcugccccgccaccgcccgcugaaccggacgcaguccgcgccccucccccagagcacccuggcccagcuggugauccagcagcagcaccagcaguuccucgagaagcagaagcaguaccagcagcagauccacaugaacaagcugcuguccaagagcaucgagcagcucaagcagcccggcucccaccuggaggaggccgaggaggagcugcagggggaccaggccaugcaggaggaccgcgccccgagcuccggcaacagcacccgguccgacagcuccgccugcgucgacgacacccucggccaggugggggcggucaaggugaaggaggagcccguggacagcgacgaggacgcccagauccaggagauggaguccggcgagcaggccgccuucaugcagcaggucaucgggaaggaccuggcccccggcuucgugaucaaggugaucaucuga
